United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 65

SEQ ID NO: 2325975 - RNA, 16 nt, Yersinia pestis KIM
aagaaagaaaaauaga

SEQ ID NO: 2325976 - RNA, 14 nt, Yersinia pestis KIM
aagaaagaaaaaua

SEQ ID NO: 2325977 - RNA, 22 nt, Yersinia pestis KIM
aagaacagcccuccagccgguu

SEQ ID NO: 2325978 - RNA, 16 nt, Yersinia pestis KIM
aagaacagcuuugcuu

SEQ ID NO: 2325979 - RNA, 16 nt, Yersinia pestis KIM
aagaaccgcagacaua

SEQ ID NO: 2325980 - RNA, 18 nt, Yersinia pestis KIM
aagaacggccugccagaa

SEQ ID NO: 2325981 - RNA, 14 nt, Yersinia pestis KIM
aagaacucaacaau

SEQ ID NO: 2325982 - RNA, 14 nt, Yersinia pestis KIM
aagaagccaagaug

SEQ ID NO: 2325983 - RNA, 19 nt, Yersinia pestis KIM
aacuuuucuucauugcugc

SEQ ID NO: 2325984 - RNA, 13 nt, Yersinia pestis KIM
aacuuuucaguuu

SEQ ID NO: 2325985 - RNA, 19 nt, Yersinia pestis KIM
aacuuuggguauaugacug

SEQ ID NO: 2325986 - RNA, 20 nt, Yersinia pestis KIM
aacuuuggguauaugacugu

SEQ ID NO: 2325987 - RNA, 20 nt, Yersinia pestis KIM
aacuuuuaugcaucuuuuag

SEQ ID NO: 2325988 - RNA, 15 nt, Yersinia pestis KIM
aacuuugguuuuuga

SEQ ID NO: 2325989 - RNA, 14 nt, Yersinia pestis KIM
aacuuuaucagucu

SEQ ID NO: 2325990 - RNA, 18 nt, Yersinia pestis KIM
aacuuucaucccuuuagc

SEQ ID NO: 2325991 - RNA, 14 nt, Yersinia pestis KIM
aacuuguucauaua

SEQ ID NO: 2325992 - RNA, 19 nt, Yersinia pestis KIM
aacuuuaauaugcaaaaaa

SEQ ID NO: 2325993 - RNA, 18 nt, Yersinia pestis KIM
aacuugguaccagucuaa

SEQ ID NO: 2325994 - RNA, 13 nt, Yersinia pestis KIM
aacuuccuuugcc

SEQ ID NO: 2325995 - RNA, 17 nt, Yersinia pestis KIM
aacuuccuugauuuuca

SEQ ID NO: 2325996 - RNA, 16 nt, Yersinia pestis KIM
aacuuccccuucucac

SEQ ID NO: 2325997 - RNA, 20 nt, Yersinia pestis KIM
aacuuccagcguauguuccu

SEQ ID NO: 2325998 - RNA, 16 nt, Yersinia pestis KIM
aacuucagccaccaga

SEQ ID NO: 2325999 - RNA, 19 nt, Yersinia pestis KIM
aacuuauuacaccuuaaaa

SEQ ID NO: 2326000 - RNA, 23 nt, Yersinia pestis KIM
aacuucaagccgauaaucccugc

SEQ ID NO: 2326001 - RNA, 14 nt, Yersinia pestis KIM
aacuucaaaaucaa

SEQ ID NO: 2326002 - RNA, 18 nt, Yersinia pestis KIM
aacuuauagcucaucggu

SEQ ID NO: 2326003 - RNA, 10 nt, Yersinia pestis KIM
aacuuacugc

SEQ ID NO: 2326004 - RNA, 21 nt, Yersinia pestis KIM
aacuuaaguucuuuuugucag

SEQ ID NO: 2326005 - RNA, 15 nt, Yersinia pestis KIM
aacuuaagcaauauu

SEQ ID NO: 2326006 - RNA, 20 nt, Yersinia pestis KIM
aacugacucacgucaguaau

SEQ ID NO: 2326007 - RNA, 14 nt, Yersinia pestis KIM
aacugacugaaguu

SEQ ID NO: 2326008 - RNA, 16 nt, Yersinia pestis KIM
aacugacaacaucaaa

SEQ ID NO: 2326009 - RNA, 17 nt, Yersinia pestis KIM
aacugaccgcagccuuc

SEQ ID NO: 2326010 - RNA, 15 nt, Yersinia pestis KIM
aacugaacugaacug

SEQ ID NO: 2326011 - RNA, 11 nt, Yersinia pestis KIM
aacugaaucac

SEQ ID NO: 2326012 - RNA, 13 nt, Yersinia pestis KIM
aacugaaugcguu

SEQ ID NO: 2326013 - RNA, 15 nt, Yersinia pestis KIM
aacugaggugaacug

SEQ ID NO: 2326014 - RNA, 21 nt, Yersinia pestis KIM
aacugaggugaacugaacuga

SEQ ID NO: 2326015 - RNA, 23 nt, Yersinia pestis KIM
aacugagccagguuuuuuuuacu

SEQ ID NO: 2326016 - RNA, 21 nt, Yersinia pestis KIM
aacugauauaaagcauuuauc

SEQ ID NO: 2326017 - RNA, 18 nt, Yersinia pestis KIM
aacugaucguuugauuaa

SEQ ID NO: 2326018 - RNA, 16 nt, Yersinia pestis KIM
aacugcucuaccaacu

SEQ ID NO: 2326019 - RNA, 20 nt, Yersinia pestis KIM
aacugcuccccccgugauau

SEQ ID NO: 2326020 - RNA, 17 nt, Yersinia pestis KIM
aacugcucaacugcuca

SEQ ID NO: 2326021 - RNA, 18 nt, Yersinia pestis KIM
aacugcucaacugcucaa

SEQ ID NO: 2326022 - RNA, 23 nt, Yersinia pestis KIM
aacugccagcuaaaaggggauaa

SEQ ID NO: 2326023 - RNA, 19 nt, Yersinia pestis KIM
aacugcauagcgccguggu

SEQ ID NO: 2326024 - RNA, 16 nt, Yersinia pestis KIM
aacuggcuccgcacgg

SEQ ID NO: 2326025 - RNA, 13 nt, Yersinia pestis KIM
aacuguaaaaucu

SEQ ID NO: 2326026 - RNA, 16 nt, Yersinia pestis KIM
aacuguaaaaucuuuc

SEQ ID NO: 2326027 - RNA, 14 nt, Yersinia pestis KIM
aacuguaaauauca

SEQ ID NO: 2326028 - RNA, 17 nt, Yersinia pestis KIM
aacuguggcaugacuga

SEQ ID NO: 2326029 - RNA, 21 nt, Yersinia pestis KIM
aacuguccgcaauagccaaga

SEQ ID NO: 2326030 - RNA, 13 nt, Yersinia pestis KIM
aacugucagucaa

SEQ ID NO: 2326031 - RNA, 14 nt, Yersinia pestis KIM
aacuguaaggccaa

SEQ ID NO: 2326032 - RNA, 19 nt, Yersinia pestis KIM
aacuguaaggccaaacccg

SEQ ID NO: 2326033 - RNA, 20 nt, Yersinia pestis KIM
aacuguucuuauugcuaucu

SEQ ID NO: 2326034 - RNA, 23 nt, Yersinia pestis KIM
aacuguucuuauugcuaucuguu

SEQ ID NO: 2326035 - RNA, 13 nt, Yersinia pestis KIM
aacuguucuuauu

SEQ ID NO: 2326036 - RNA, 17 nt, Yersinia pestis KIM
aacuguguuuauaccaa

SEQ ID NO: 2326037 - RNA, 16 nt, Yersinia pestis KIM
aacuguguuuauacca

SEQ ID NO: 2326038 - RNA, 23 nt, Yersinia pestis KIM
aacuguuuugcugauucagauuu

SEQ ID NO: 2326039 - RNA, 14 nt, Yersinia pestis KIM
aacuuaaauaauuu

SEQ ID NO: 2326040 - RNA, 14 nt, Yersinia pestis KIM
aacucuucuguugc

SEQ ID NO: 2326041 - RNA, 23 nt, Yersinia pestis KIM
aacucccgauucagcucugccag

SEQ ID NO: 2326042 - RNA, 21 nt, Yersinia pestis KIM
aacucccgauucagcucugcc

SEQ ID NO: 2326043 - RNA, 20 nt, Yersinia pestis KIM
aacuccaggguaauaaguga

SEQ ID NO: 2326044 - RNA, 23 nt, Yersinia pestis KIM
aacuccaggguaauaagugauca

SEQ ID NO: 2326045 - RNA, 12 nt, Yersinia pestis KIM
aacuccaucgcc

SEQ ID NO: 2326046 - RNA, 18 nt, Yersinia pestis KIM
aacucgagcauuugaccg

SEQ ID NO: 2326047 - RNA, 13 nt, Yersinia pestis KIM
aacucgacaaccu

SEQ ID NO: 2326048 - RNA, 22 nt, Yersinia pestis KIM
aacucaccgagcauauuuuuua

SEQ ID NO: 2326049 - RNA, 16 nt, Yersinia pestis KIM
aacucaccuaaaucau

SEQ ID NO: 2326050 - RNA, 16 nt, Yersinia pestis KIM
aacucacuguucagac

SEQ ID NO: 2326051 - RNA, 11 nt, Yersinia pestis KIM
aacucagggcu

SEQ ID NO: 2326052 - RNA, 13 nt, Yersinia pestis KIM
aacucagugaaac

SEQ ID NO: 2326053 - RNA, 13 nt, Yersinia pestis KIM
aacucauuuuuug

SEQ ID NO: 2326054 - RNA, 19 nt, Yersinia pestis KIM
aacucauuuaucuaaaacu

SEQ ID NO: 2326055 - RNA, 21 nt, Yersinia pestis KIM
aacucauuuaucuaaaacugc

SEQ ID NO: 2326056 - RNA, 19 nt, Yersinia pestis KIM
aacucaucggcguuacagu

SEQ ID NO: 2326057 - RNA, 20 nt, Yersinia pestis KIM
aacucaucggcguuacagua

SEQ ID NO: 2326058 - RNA, 19 nt, Yersinia pestis KIM
aacucauccuaccgccagc

SEQ ID NO: 2326059 - RNA, 13 nt, Yersinia pestis KIM
aacucaaaacaau

SEQ ID NO: 2326060 - RNA, 21 nt, Yersinia pestis KIM
aacucaaacugauaaagcaaa

SEQ ID NO: 2326061 - RNA, 12 nt, Yersinia pestis KIM
aacucaaauuau

SEQ ID NO: 2326062 - RNA, 13 nt, Yersinia pestis KIM
aacucaaauuauu

SEQ ID NO: 2326063 - RNA, 15 nt, Yersinia pestis KIM
aacuauuuggugguu

SEQ ID NO: 2326064 - RNA, 21 nt, Yersinia pestis KIM
aacuauuggucaaucuagagg

SEQ ID NO: 2326065 - RNA, 16 nt, Yersinia pestis KIM
aacuacuccaucccca

SEQ ID NO: 2326066 - RNA, 22 nt, Yersinia pestis KIM
aacuacuccauccccaacucuu

SEQ ID NO: 2326067 - RNA, 23 nt, Yersinia pestis KIM
aacuacuccauccccaacucuuu

SEQ ID NO: 2326068 - RNA, 19 nt, Yersinia pestis KIM
aacuacaccgcuaaccuua

SEQ ID NO: 2326069 - RNA, 21 nt, Yersinia pestis KIM
aacuagcggauuuauaaggaa

SEQ ID NO: 2326070 - RNA, 16 nt, Yersinia pestis KIM
aacuaauaucaacaga

SEQ ID NO: 2326071 - RNA, 21 nt, Yersinia pestis KIM
aacuaauaucaacagaacuaa

SEQ ID NO: 2326072 - RNA, 13 nt, Yersinia pestis KIM
aacuaacaugcca

SEQ ID NO: 2326073 - RNA, 16 nt, Yersinia pestis KIM
aacuaacguuuuguaa

SEQ ID NO: 2326074 - RNA, 19 nt, Yersinia pestis KIM
aacuaagagucacagcauu

SEQ ID NO: 2326075 - RNA, 12 nt, Yersinia pestis KIM
aacuaagcugcc

SEQ ID NO: 2326076 - RNA, 18 nt, Yersinia pestis KIM
aacuaaacagaucacccg

SEQ ID NO: 2326077 - RNA, 16 nt, Yersinia pestis KIM
aacuaaacagaucacc

SEQ ID NO: 2326078 - RNA, 19 nt, Yersinia pestis KIM
aacguuguuauuucuguuc

SEQ ID NO: 2326079 - RNA, 13 nt, Yersinia pestis KIM
aacguucugccaa

SEQ ID NO: 2326080 - RNA, 22 nt, Yersinia pestis KIM
aacguguuagguaauaccaaug

SEQ ID NO: 2326081 - RNA, 22 nt, Yersinia pestis KIM
aacgugguugcggcaccugccc

SEQ ID NO: 2326082 - RNA, 16 nt, Yersinia pestis KIM
aacguuaacugcagua

SEQ ID NO: 2326083 - RNA, 16 nt, Yersinia pestis KIM
aacguucaacaccaca

SEQ ID NO: 2326084 - RNA, 12 nt, Yersinia pestis KIM
aacgucgccagu

SEQ ID NO: 2326085 - RNA, 12 nt, Yersinia pestis KIM
aacgucccauuc

SEQ ID NO: 2326086 - RNA, 12 nt, Yersinia pestis KIM
aacgucaacaga

SEQ ID NO: 2326087 - RNA, 14 nt, Yersinia pestis KIM
aacgucaacagaac

SEQ ID NO: 2326088 - RNA, 16 nt, Yersinia pestis KIM
aacgucaacagaacua

SEQ ID NO: 2326089 - RNA, 16 nt, Yersinia pestis KIM
aacgucauaauugcca

SEQ ID NO: 2326090 - RNA, 18 nt, Yersinia pestis KIM
aacgucauaauugccaaa

SEQ ID NO: 2326091 - RNA, 23 nt, Yersinia pestis KIM
aacgucauaauugccaaacgaua

SEQ ID NO: 2326092 - RNA, 21 nt, Yersinia pestis KIM
aacgucauugguguuacagca

SEQ ID NO: 2326093 - RNA, 17 nt, Yersinia pestis KIM
aacgucagauaaacaaa

SEQ ID NO: 2326094 - RNA, 12 nt, Yersinia pestis KIM
aacgucagauua

SEQ ID NO: 2326095 - RNA, 19 nt, Yersinia pestis KIM
aacgguuucaacuucaacg

SEQ ID NO: 2326096 - RNA, 14 nt, Yersinia pestis KIM
aacguaaacaucuu

SEQ ID NO: 2326097 - RNA, 18 nt, Yersinia pestis KIM
aacguaauaucugccacc

SEQ ID NO: 2326098 - RNA, 14 nt, Yersinia pestis KIM
aacguacccuccca

SEQ ID NO: 2326099 - RNA, 16 nt, Yersinia pestis KIM
aacggucuguuaaucc

SEQ ID NO: 2326100 - RNA, 13 nt, Yersinia pestis KIM
aacggugaacaga

SEQ ID NO: 2326101 - RNA, 17 nt, Yersinia pestis KIM
aacgggugauguuuaac

SEQ ID NO: 2326102 - RNA, 23 nt, Yersinia pestis KIM
aacgggucgucucuugcaaugaa

SEQ ID NO: 2326103 - RNA, 20 nt, Yersinia pestis KIM
aacggucauaaucagggaug

SEQ ID NO: 2326104 - RNA, 19 nt, Yersinia pestis KIM
aacggcgcgauaaauaguc

SEQ ID NO: 2326105 - RNA, 14 nt, Yersinia pestis KIM
aacggcucaucgcu

SEQ ID NO: 2326106 - RNA, 14 nt, Yersinia pestis KIM
aacgggcuuccauc

SEQ ID NO: 2326107 - RNA, 11 nt, Yersinia pestis KIM
aacgggcuucc

SEQ ID NO: 2326108 - RNA, 16 nt, Yersinia pestis KIM
aacgggcaaccuguac

SEQ ID NO: 2326109 - RNA, 15 nt, Yersinia pestis KIM
aacgcuggccagcau

SEQ ID NO: 2326110 - RNA, 16 nt, Yersinia pestis KIM
aacggcacaucccaau

SEQ ID NO: 2326111 - RNA, 17 nt, Yersinia pestis KIM
aacggcacguuuccccu

SEQ ID NO: 2326112 - RNA, 17 nt, Yersinia pestis KIM
aacggacgaccuguagc

SEQ ID NO: 2326113 - RNA, 18 nt, Yersinia pestis KIM
aacgcggaauagccggcg

SEQ ID NO: 2326114 - RNA, 22 nt, Yersinia pestis KIM
aacgcgccggaauuagcgaaau

SEQ ID NO: 2326115 - RNA, 21 nt, Yersinia pestis KIM
aacgcugauguaggcaauaca

SEQ ID NO: 2326116 - RNA, 23 nt, Yersinia pestis KIM
aacgcuccgguuuucacccccac

SEQ ID NO: 2326117 - RNA, 19 nt, Yersinia pestis KIM
aacgcuauucuuagccucg

SEQ ID NO: 2326118 - RNA, 17 nt, Yersinia pestis KIM
aacgcguuaauuaagac

SEQ ID NO: 2326119 - RNA, 19 nt, Yersinia pestis KIM
aacgccagugcaaaaugcu

SEQ ID NO: 2326120 - RNA, 16 nt, Yersinia pestis KIM
aacgcccaaaucugcc

SEQ ID NO: 2326121 - RNA, 17 nt, Yersinia pestis KIM
aacgccagcagacgcgu

SEQ ID NO: 2326122 - RNA, 14 nt, Yersinia pestis KIM
aacgcccugcaucu

SEQ ID NO: 2326123 - RNA, 17 nt, Yersinia pestis KIM
aacgccagauaugauca

SEQ ID NO: 2326124 - RNA, 17 nt, Yersinia pestis KIM
aacgccaaacaguaaau

SEQ ID NO: 2326125 - RNA, 16 nt, Yersinia pestis KIM
aacgccaacugcggca

SEQ ID NO: 2326126 - RNA, 19 nt, Yersinia pestis KIM
aacgcauucaucagggcag

SEQ ID NO: 2326127 - RNA, 20 nt, Yersinia pestis KIM
aacgccgcgucaauaacauu

SEQ ID NO: 2326128 - RNA, 13 nt, Yersinia pestis KIM
aacgccgaguaag

SEQ ID NO: 2326129 - RNA, 15 nt, Yersinia pestis KIM
aacgaguuuccaguu

SEQ ID NO: 2326130 - RNA, 18 nt, Yersinia pestis KIM
aacgaguuuccaguucaa

SEQ ID NO: 2326131 - RNA, 13 nt, Yersinia pestis KIM
aacgcacaugccg

SEQ ID NO: 2326132 - RNA, 23 nt, Yersinia pestis KIM
aacgcaccccacaaccugcgcca

SEQ ID NO: 2326133 - RNA, 13 nt, Yersinia pestis KIM
aacgcagagcgau

SEQ ID NO: 2326134 - RNA, 14 nt, Yersinia pestis KIM
aacgcacugagagc

SEQ ID NO: 2326135 - RNA, 16 nt, Yersinia pestis KIM
aacgcauacucaaaaa

SEQ ID NO: 2326136 - RNA, 21 nt, Yersinia pestis KIM
aaccucgguggcucaauccaa

SEQ ID NO: 2326137 - RNA, 21 nt, Yersinia pestis KIM
aaccucgcgugcgggcauuga

SEQ ID NO: 2326138 - RNA, 17 nt, Yersinia pestis KIM
aaccucuaauaaaccug

SEQ ID NO: 2326139 - RNA, 20 nt, Yersinia pestis KIM
aaccucuggcgcaagaguua

SEQ ID NO: 2326140 - RNA, 13 nt, Yersinia pestis KIM
aaccucagccuca

SEQ ID NO: 2326141 - RNA, 14 nt, Yersinia pestis KIM
aaccucagccucau

SEQ ID NO: 2326142 - RNA, 22 nt, Yersinia pestis KIM
aaccugagcggcguuguucucu

SEQ ID NO: 2326143 - RNA, 14 nt, Yersinia pestis KIM
aaccugcaaugccu

SEQ ID NO: 2326144 - RNA, 13 nt, Yersinia pestis KIM
aaccugagcacca

SEQ ID NO: 2326145 - RNA, 19 nt, Yersinia pestis KIM
aaccugacugguucacacc

SEQ ID NO: 2326146 - RNA, 18 nt, Yersinia pestis KIM
aaccucuucuuccgccac

SEQ ID NO: 2326147 - RNA, 13 nt, Yersinia pestis KIM
aaccuggcucagu

SEQ ID NO: 2326148 - RNA, 18 nt, Yersinia pestis KIM
aaccuaaugccagacaca

SEQ ID NO: 2326149 - RNA, 17 nt, Yersinia pestis KIM
aaccuauuaucccaguu

SEQ ID NO: 2326150 - RNA, 17 nt, Yersinia pestis KIM
aacgaauuucauuuuaa

SEQ ID NO: 2326151 - RNA, 12 nt, Yersinia pestis KIM
aacgaauuucau

SEQ ID NO: 2326152 - RNA, 13 nt, Yersinia pestis KIM
aacgacagcagca

SEQ ID NO: 2326153 - RNA, 11 nt, Yersinia pestis KIM
aacgacauuuc

SEQ ID NO: 2326154 - RNA, 21 nt, Yersinia pestis KIM
aacgaacgcucuuuaacaauu

SEQ ID NO: 2326155 - RNA, 15 nt, Yersinia pestis KIM
aacgaacgcucuuua

SEQ ID NO: 2326156 - RNA, 19 nt, Yersinia pestis KIM
aacgaagccacgggcaccu

SEQ ID NO: 2326157 - RNA, 15 nt, Yersinia pestis KIM
aacgaaguuagaccc

SEQ ID NO: 2326158 - RNA, 24 nt, Yersinia pestis KIM
aacgaaacgcauaagaaugugauu

SEQ ID NO: 2326159 - RNA, 18 nt, Yersinia pestis KIM
aacgaacacaguccuguu

SEQ ID NO: 2326160 - RNA, 16 nt, Yersinia pestis KIM
aaccuuaucaccaacg

SEQ ID NO: 2326161 - RNA, 15 nt, Yersinia pestis KIM
aaccugugugaccuc

SEQ ID NO: 2326162 - RNA, 20 nt, Yersinia pestis KIM
aaccuuuauguaguucaguc

SEQ ID NO: 2326163 - RNA, 19 nt, Yersinia pestis KIM
aaccuuucgaguugaacuc

SEQ ID NO: 2326164 - RNA, 20 nt, Yersinia pestis KIM
aaugaaguuauccuccauuc

SEQ ID NO: 2326165 - RNA, 20 nt, Yersinia pestis KIM
aaugaacauuauuuuucacg

SEQ ID NO: 2326166 - RNA, 14 nt, Yersinia pestis KIM
aaucuuugagcacc

SEQ ID NO: 2326167 - RNA, 14 nt, Yersinia pestis KIM
aaucuauucuuuuu

SEQ ID NO: 2326168 - RNA, 17 nt, Yersinia pestis KIM
aaucugguaggaacguu

SEQ ID NO: 2326169 - RNA, 14 nt, Yersinia pestis KIM
aaucuauuaauauc

SEQ ID NO: 2326170 - RNA, 16 nt, Yersinia pestis KIM
aaucuuaaauugaaga

SEQ ID NO: 2326171 - RNA, 19 nt, Yersinia pestis KIM
aaucuuaaauugaagaguu

SEQ ID NO: 2326172 - RNA, 13 nt, Yersinia pestis KIM
aaucugucgcugu

SEQ ID NO: 2326173 - RNA, 18 nt, Yersinia pestis KIM
aaugaccggaugauaaaa

SEQ ID NO: 2326174 - RNA, 17 nt, Yersinia pestis KIM
aaugacgaucacugcuu

SEQ ID NO: 2326175 - RNA, 22 nt, Yersinia pestis KIM
aaugacuaauugugcagcauca

SEQ ID NO: 2326176 - RNA, 19 nt, Yersinia pestis KIM
aaugagauuaauucaaaaa

SEQ ID NO: 2326177 - RNA, 12 nt, Yersinia pestis KIM
aaugagccuguc

SEQ ID NO: 2326178 - RNA, 12 nt, Yersinia pestis KIM
aaugaucaucag

SEQ ID NO: 2326179 - RNA, 18 nt, Yersinia pestis KIM
aaugaugacuugauuaac

SEQ ID NO: 2326180 - RNA, 21 nt, Yersinia pestis KIM
aaugauuuaauuucuggauuu

SEQ ID NO: 2326181 - RNA, 13 nt, Yersinia pestis KIM
aaugauggcggcu

SEQ ID NO: 2326182 - RNA, 18 nt, Yersinia pestis KIM
aaugcaaccaguuaaaga

SEQ ID NO: 2326183 - RNA, 14 nt, Yersinia pestis KIM
aaugcagcauccca

SEQ ID NO: 2326184 - RNA, 23 nt, Yersinia pestis KIM
aaugcagguucauuacacagcau

SEQ ID NO: 2326185 - RNA, 15 nt, Yersinia pestis KIM
aaugcagucagcacu

SEQ ID NO: 2326186 - RNA, 19 nt, Yersinia pestis KIM
aaugcagguuuugccagau

SEQ ID NO: 2326187 - RNA, 18 nt, Yersinia pestis KIM
aaugcauccaagccauca

SEQ ID NO: 2326188 - RNA, 14 nt, Yersinia pestis KIM
aaugccacccccag

SEQ ID NO: 2326189 - RNA, 14 nt, Yersinia pestis KIM
aaugccgagaacag

SEQ ID NO: 2326190 - RNA, 16 nt, Yersinia pestis KIM
aaugccgaaugauuca

SEQ ID NO: 2326191 - RNA, 16 nt, Yersinia pestis KIM
aaugccguacaacaau

SEQ ID NO: 2326192 - RNA, 18 nt, Yersinia pestis KIM
aaugccgcugaucaggaa

SEQ ID NO: 2326193 - RNA, 18 nt, Yersinia pestis KIM
aaugccuuagguaaguca

SEQ ID NO: 2326194 - RNA, 15 nt, Yersinia pestis KIM
aaugcgccagccaau

SEQ ID NO: 2326195 - RNA, 22 nt, Yersinia pestis KIM
aaugcgcgcagcaagcugagua

SEQ ID NO: 2326196 - RNA, 22 nt, Yersinia pestis KIM
aaugcgcggguaacaacucacc

SEQ ID NO: 2326197 - RNA, 19 nt, Yersinia pestis KIM
aaugcuguuuugucauaaa

SEQ ID NO: 2326198 - RNA, 18 nt, Yersinia pestis KIM
aauggaaguuaaaaaaau

SEQ ID NO: 2326199 - RNA, 16 nt, Yersinia pestis KIM
aauggaucacaucaca

SEQ ID NO: 2326200 - RNA, 19 nt, Yersinia pestis KIM
aauggauaaugcugaugca

SEQ ID NO: 2326201 - RNA, 13 nt, Yersinia pestis KIM
aauggcauuaaaa

SEQ ID NO: 2326202 - RNA, 12 nt, Yersinia pestis KIM
aauggccuugcc

SEQ ID NO: 2326203 - RNA, 17 nt, Yersinia pestis KIM
aauggccgauggaacca

SEQ ID NO: 2326204 - RNA, 18 nt, Yersinia pestis KIM
aaugguucacuauaauuu

SEQ ID NO: 2326205 - RNA, 17 nt, Yersinia pestis KIM
aaugguugaaugaccaa

SEQ ID NO: 2326206 - RNA, 17 nt, Yersinia pestis KIM
aaugguuguuaauuaag

SEQ ID NO: 2326207 - RNA, 22 nt, Yersinia pestis KIM
aaugguuguuaauuaagauuaa

SEQ ID NO: 2326208 - RNA, 15 nt, Yersinia pestis KIM
aauccuuguaagacc

SEQ ID NO: 2326209 - RNA, 22 nt, Yersinia pestis KIM
aaucgcucugcguuuuucccug

SEQ ID NO: 2326210 - RNA, 14 nt, Yersinia pestis KIM
aaucgcgcauuucu

SEQ ID NO: 2326211 - RNA, 15 nt, Yersinia pestis KIM
aaucgcccaauguca

SEQ ID NO: 2326212 - RNA, 23 nt, Yersinia pestis KIM
aaucgccguuacccccuucacca

SEQ ID NO: 2326213 - RNA, 17 nt, Yersinia pestis KIM
aaucgcugccauaugca

SEQ ID NO: 2326214 - RNA, 16 nt, Yersinia pestis KIM
aaucgggugauaaagg

SEQ ID NO: 2326215 - RNA, 22 nt, Yersinia pestis KIM
aaucuagaggacggcggccuua

SEQ ID NO: 2326216 - RNA, 15 nt, Yersinia pestis KIM
aaucuacuuuauuca

SEQ ID NO: 2326217 - RNA, 14 nt, Yersinia pestis KIM
aaucuagaacuauu

SEQ ID NO: 2326218 - RNA, 19 nt, Yersinia pestis KIM
aaucccgauauaaauaaaa

SEQ ID NO: 2326219 - RNA, 17 nt, Yersinia pestis KIM
aauccccagaagcgcac

SEQ ID NO: 2326220 - RNA, 17 nt, Yersinia pestis KIM
aaucccguuccgcuucc

SEQ ID NO: 2326221 - RNA, 23 nt, Yersinia pestis KIM
aaucccugccagaaucagcccca

SEQ ID NO: 2326222 - RNA, 16 nt, Yersinia pestis KIM
aauccgaccacugaca

SEQ ID NO: 2326223 - RNA, 17 nt, Yersinia pestis KIM
aauccgguuagcaaaaa

SEQ ID NO: 2326224 - RNA, 15 nt, Yersinia pestis KIM
aauccggugcaacca

SEQ ID NO: 2326225 - RNA, 20 nt, Yersinia pestis KIM
aauccuauauacaaggcaca

SEQ ID NO: 2326226 - RNA, 19 nt, Yersinia pestis KIM
aauccuacaauaucuuccc

SEQ ID NO: 2326227 - RNA, 17 nt, Yersinia pestis KIM
aauccugaauaauacug

SEQ ID NO: 2326228 - RNA, 23 nt, Yersinia pestis KIM
aauccaugccagcccaucaccau

SEQ ID NO: 2326229 - RNA, 11 nt, Yersinia pestis KIM
aauccauucac

SEQ ID NO: 2326230 - RNA, 12 nt, Yersinia pestis KIM
aauccauucacg

SEQ ID NO: 2326231 - RNA, 23 nt, Yersinia pestis KIM
aauccauaagauugagggcgucu

SEQ ID NO: 2326232 - RNA, 14 nt, Yersinia pestis KIM
aauccaguguauua

SEQ ID NO: 2326233 - RNA, 21 nt, Yersinia pestis KIM
aaucauuuaggcguuucuucc

SEQ ID NO: 2326234 - RNA, 17 nt, Yersinia pestis KIM
aauccaaaauaauauaa

SEQ ID NO: 2326235 - RNA, 22 nt, Yersinia pestis KIM
aauccaaccuauauagcccagc

SEQ ID NO: 2326236 - RNA, 14 nt, Yersinia pestis KIM
aauccaacucaccu

SEQ ID NO: 2326237 - RNA, 21 nt, Yersinia pestis KIM
aauccaccugacgaaaugccg

SEQ ID NO: 2326238 - RNA, 17 nt, Yersinia pestis KIM
aaucaguacaucaauag

SEQ ID NO: 2326239 - RNA, 19 nt, Yersinia pestis KIM
aaucaggugaacguuggcu

SEQ ID NO: 2326240 - RNA, 15 nt, Yersinia pestis KIM
aaucagguugauucu

SEQ ID NO: 2326241 - RNA, 18 nt, Yersinia pestis KIM
aaucagcuucauuaagga

SEQ ID NO: 2326242 - RNA, 13 nt, Yersinia pestis KIM
aaucagcuucauu

SEQ ID NO: 2326243 - RNA, 20 nt, Yersinia pestis KIM
aaucagcugauaugaaaaau

SEQ ID NO: 2326244 - RNA, 20 nt, Yersinia pestis KIM
aauaugguagaauuuaccuc

SEQ ID NO: 2326245 - RNA, 20 nt, Yersinia pestis KIM
aaucauguaacacacagcag

SEQ ID NO: 2326246 - RNA, 17 nt, Yersinia pestis KIM
aaucaugcucugcuaau

SEQ ID NO: 2326247 - RNA, 18 nt, Yersinia pestis KIM
aaucauaucaaaauaaaa

SEQ ID NO: 2326248 - RNA, 19 nt, Yersinia pestis KIM
aaucauugacguuacagau

SEQ ID NO: 2326249 - RNA, 15 nt, Yersinia pestis KIM
aaucauugcaaugcu

SEQ ID NO: 2326250 - RNA, 22 nt, Yersinia pestis KIM
aaucauguugcaucgcacugau

SEQ ID NO: 2326251 - RNA, 15 nt, Yersinia pestis KIM
aauucgggcugagua

SEQ ID NO: 2326252 - RNA, 19 nt, Yersinia pestis KIM
aauucgauaaaaggcuauu

SEQ ID NO: 2326253 - RNA, 22 nt, Yersinia pestis KIM
aauuccuauaaauuuuaaguua

SEQ ID NO: 2326254 - RNA, 19 nt, Yersinia pestis KIM
aauuccuauaaauuuuaag

SEQ ID NO: 2326255 - RNA, 13 nt, Yersinia pestis KIM
aauuccuauaaau

SEQ ID NO: 2326256 - RNA, 18 nt, Yersinia pestis KIM
aauucugccgacuaauau

SEQ ID NO: 2326257 - RNA, 15 nt, Yersinia pestis KIM
aauucuaucugguuu

SEQ ID NO: 2326258 - RNA, 19 nt, Yersinia pestis KIM
aauucuaccuggcucaaau

SEQ ID NO: 2326259 - RNA, 17 nt, Yersinia pestis KIM
aauucguuucucuaaaa

SEQ ID NO: 2326260 - RNA, 23 nt, Yersinia pestis KIM
aauucguuuuucauuuuucuugc

SEQ ID NO: 2326261 - RNA, 23 nt, Yersinia pestis KIM
aauucccgucagguucaauuccc

SEQ ID NO: 2326262 - RNA, 16 nt, Yersinia pestis KIM
aauuccgcccugaaua

SEQ ID NO: 2326263 - RNA, 17 nt, Yersinia pestis KIM
aauucccccaaaaccuc

SEQ ID NO: 2326264 - RNA, 23 nt, Yersinia pestis KIM
aauucccgcgccgugagaaaaaa

SEQ ID NO: 2326265 - RNA, 22 nt, Yersinia pestis KIM
aauuccaugcaaaauaugguag

SEQ ID NO: 2326266 - RNA, 13 nt, Yersinia pestis KIM
aauucauuauuac

SEQ ID NO: 2326267 - RNA, 14 nt, Yersinia pestis KIM
aauucauuauuacu

SEQ ID NO: 2326268 - RNA, 22 nt, Yersinia pestis KIM
aauucauguugccaaugggcca

SEQ ID NO: 2326269 - RNA, 16 nt, Yersinia pestis KIM
aauucaugugagauaa

SEQ ID NO: 2326270 - RNA, 18 nt, Yersinia pestis KIM
aauucaugugagauaaca

SEQ ID NO: 2326271 - RNA, 19 nt, Yersinia pestis KIM
aauucaugugagauaacac

SEQ ID NO: 2326272 - RNA, 15 nt, Yersinia pestis KIM
aauucaucuuuaaca

SEQ ID NO: 2326273 - RNA, 16 nt, Yersinia pestis KIM
aauucaucuuuaacaa

SEQ ID NO: 2326274 - RNA, 15 nt, Yersinia pestis KIM
aauucauguugccaa

SEQ ID NO: 2326275 - RNA, 16 nt, Yersinia pestis KIM
aauucauguugccaau

SEQ ID NO: 2326276 - RNA, 23 nt, Yersinia pestis KIM
aauuccacauaaaauagcccagu

SEQ ID NO: 2326277 - RNA, 12 nt, Yersinia pestis KIM
aauuccauaucg

SEQ ID NO: 2326278 - RNA, 18 nt, Yersinia pestis KIM
aauuccauaauaagugaa

SEQ ID NO: 2326279 - RNA, 14 nt, Yersinia pestis KIM
aauucacguuuacu

SEQ ID NO: 2326280 - RNA, 18 nt, Yersinia pestis KIM
aauucagauaagaucuca

SEQ ID NO: 2326281 - RNA, 15 nt, Yersinia pestis KIM
aauucagauguuaac

SEQ ID NO: 2326282 - RNA, 22 nt, Yersinia pestis KIM
aauucagaugagaaucucucca

SEQ ID NO: 2326283 - RNA, 22 nt, Yersinia pestis KIM
aauucacgucgccgguggcuga

SEQ ID NO: 2326284 - RNA, 15 nt, Yersinia pestis KIM
aauucacugcuuaau

SEQ ID NO: 2326285 - RNA, 22 nt, Yersinia pestis KIM
aauucagacggcagauccugaa

SEQ ID NO: 2326286 - RNA, 19 nt, Yersinia pestis KIM
aauucauaugacaaauaag

SEQ ID NO: 2326287 - RNA, 18 nt, Yersinia pestis KIM
aauucauaccgcagauaa

SEQ ID NO: 2326288 - RNA, 20 nt, Yersinia pestis KIM
aauucauacggcgauauuua

SEQ ID NO: 2326289 - RNA, 13 nt, Yersinia pestis KIM
aauucaaauauca

SEQ ID NO: 2326290 - RNA, 14 nt, Yersinia pestis KIM
aauucaaauaucau

SEQ ID NO: 2326291 - RNA, 18 nt, Yersinia pestis KIM
aauucaauccauugaucu

SEQ ID NO: 2326292 - RNA, 13 nt, Yersinia pestis KIM
aauuauuguggcu

SEQ ID NO: 2326293 - RNA, 17 nt, Yersinia pestis KIM
aauuauugccgcagaua

SEQ ID NO: 2326294 - RNA, 12 nt, Yersinia pestis KIM
aauuauuucucu

SEQ ID NO: 2326295 - RNA, 13 nt, Yersinia pestis KIM
aauuaucaucaau

SEQ ID NO: 2326296 - RNA, 13 nt, Yersinia pestis KIM
aauuauagugaaa

SEQ ID NO: 2326297 - RNA, 20 nt, Yersinia pestis KIM
aauuaucgaucacaugcuca

SEQ ID NO: 2326298 - RNA, 22 nt, Yersinia pestis KIM
aauuaucuaauaaugagccaua

SEQ ID NO: 2326299 - RNA, 18 nt, Yersinia pestis KIM
aauuaucgccuaccauca

SEQ ID NO: 2326300 - RNA, 18 nt, Yersinia pestis KIM
aauuauccauuuucugcc

SEQ ID NO: 2326301 - RNA, 15 nt, Yersinia pestis KIM
aauuaucaucaauag

SEQ ID NO: 2326302 - RNA, 18 nt, Yersinia pestis KIM
aauuaucuuauccacagc

SEQ ID NO: 2326303 - RNA, 19 nt, Yersinia pestis KIM
aauuaucuuauccacagca

SEQ ID NO: 2326304 - RNA, 20 nt, Yersinia pestis KIM
aauuaucuuauccacagcau

SEQ ID NO: 2326305 - RNA, 12 nt, Yersinia pestis KIM
aauuauuaaaua

SEQ ID NO: 2326306 - RNA, 13 nt, Yersinia pestis KIM
aauuauuaaauaa

SEQ ID NO: 2326307 - RNA, 20 nt, Yersinia pestis KIM
aauuaugacggguauauuua

SEQ ID NO: 2326308 - RNA, 19 nt, Yersinia pestis KIM
aauuaugacguucaguagu

SEQ ID NO: 2326309 - RNA, 15 nt, Yersinia pestis KIM
aauuaugauaaaugg

SEQ ID NO: 2326310 - RNA, 21 nt, Yersinia pestis KIM
aauuaacacccaauaauaaaa

SEQ ID NO: 2326311 - RNA, 20 nt, Yersinia pestis KIM
aauuaacacccaauaauaaa

SEQ ID NO: 2326312 - RNA, 22 nt, Yersinia pestis KIM
aauuaacacccaauaauaaaaa

SEQ ID NO: 2326313 - RNA, 16 nt, Yersinia pestis KIM
aauuaacagcaucacu

SEQ ID NO: 2326314 - RNA, 20 nt, Yersinia pestis KIM
aauuaauuacuuuauuuaaa

SEQ ID NO: 2326315 - RNA, 15 nt, Yersinia pestis KIM
aauuacaaaaucuca

SEQ ID NO: 2326316 - RNA, 16 nt, Yersinia pestis KIM
aauuacaaaaucucaa

SEQ ID NO: 2326317 - RNA, 13 nt, Yersinia pestis KIM
aauuaauuauaag

SEQ ID NO: 2326318 - RNA, 18 nt, Yersinia pestis KIM
aauguacagucauuuacu

SEQ ID NO: 2326319 - RNA, 14 nt, Yersinia pestis KIM
aauuaaauuuuaua

SEQ ID NO: 2326320 - RNA, 22 nt, Yersinia pestis KIM
aauuacggcucaguugaugcaa

SEQ ID NO: 2326321 - RNA, 15 nt, Yersinia pestis KIM
aauuacgugcccaaa

SEQ ID NO: 2326322 - RNA, 23 nt, Yersinia pestis KIM
aauuacgugcccaaaaacgcugg

SEQ ID NO: 2326323 - RNA, 18 nt, Yersinia pestis KIM
aauuacggcucaguugau

SEQ ID NO: 2326324 - RNA, 15 nt, Yersinia pestis KIM
aauuacgcacugccu

SEQ ID NO: 2326325 - RNA, 17 nt, Yersinia pestis KIM
aauuacucguauaaaaa

SEQ ID NO: 2326326 - RNA, 20 nt, Yersinia pestis KIM
aauuacucguauaaaaaaua

SEQ ID NO: 2326327 - RNA, 19 nt, Yersinia pestis KIM
aauuauagccaaaucugga

SEQ ID NO: 2326328 - RNA, 21 nt, Yersinia pestis KIM
aauuagcgccuccggcgacua

SEQ ID NO: 2326329 - RNA, 22 nt, Yersinia pestis KIM
aauuagccaagcaaccuuguuu

SEQ ID NO: 2326330 - RNA, 22 nt, Yersinia pestis KIM
aauugguuuauaacaaggaaau

SEQ ID NO: 2326331 - RNA, 21 nt, Yersinia pestis KIM
aauugguuuuaauaaccauug

SEQ ID NO: 2326332 - RNA, 14 nt, Yersinia pestis KIM
aauuguucaucgcu

SEQ ID NO: 2326333 - RNA, 20 nt, Yersinia pestis KIM
aauuguuauuauuaaauuuu

SEQ ID NO: 2326334 - RNA, 22 nt, Yersinia pestis KIM
aauugugccccaagaagagaua

SEQ ID NO: 2326335 - RNA, 19 nt, Yersinia pestis KIM
aauuuaaacaaccaaaaau

SEQ ID NO: 2326336 - RNA, 14 nt, Yersinia pestis KIM
aauuuacugacggu

SEQ ID NO: 2326337 - RNA, 18 nt, Yersinia pestis KIM
aauuuaacuuucaucccu

SEQ ID NO: 2326338 - RNA, 13 nt, Yersinia pestis KIM
aauuuagccgcaa

SEQ ID NO: 2326339 - RNA, 23 nt, Yersinia pestis KIM
aauuuagccgcccucucuagauu

SEQ ID NO: 2326340 - RNA, 22 nt, Yersinia pestis KIM
aauuuaggcugauggacuuacc

SEQ ID NO: 2326341 - RNA, 18 nt, Yersinia pestis KIM
aauuuaucuuuucuucuu

SEQ ID NO: 2326342 - RNA, 19 nt, Yersinia pestis KIM
aauuuaucaggcuaauaca

SEQ ID NO: 2326343 - RNA, 14 nt, Yersinia pestis KIM
aauuuaucaguagu

SEQ ID NO: 2326344 - RNA, 22 nt, Yersinia pestis KIM
aauuuaucaguagucaauacaa

SEQ ID NO: 2326345 - RNA, 13 nt, Yersinia pestis KIM
aauuuauccaacu

SEQ ID NO: 2326346 - RNA, 16 nt, Yersinia pestis KIM
aauuuauuucagauuu

SEQ ID NO: 2326347 - RNA, 17 nt, Yersinia pestis KIM
aauugggggucagggcg

SEQ ID NO: 2326348 - RNA, 18 nt, Yersinia pestis KIM
aauugggggucagggcgg

SEQ ID NO: 2326349 - RNA, 20 nt, Yersinia pestis KIM
aauuggcuuaacucgccacu

SEQ ID NO: 2326350 - RNA, 15 nt, Yersinia pestis KIM
aauuggcagcggcaa

SEQ ID NO: 2326351 - RNA, 20 nt, Yersinia pestis KIM
aauuggcagcggcaaauaga

SEQ ID NO: 2326352 - RNA, 17 nt, Yersinia pestis KIM
aauuggaagagccugaa

SEQ ID NO: 2326353 - RNA, 15 nt, Yersinia pestis KIM
aauuggaaugaaaua

SEQ ID NO: 2326354 - RNA, 21 nt, Yersinia pestis KIM
aauuggaaugaaauagucaca

SEQ ID NO: 2326355 - RNA, 17 nt, Yersinia pestis KIM
aauugcuucaauaccgc

SEQ ID NO: 2326356 - RNA, 13 nt, Yersinia pestis KIM
aauugcugaaaaa

SEQ ID NO: 2326357 - RNA, 19 nt, Yersinia pestis KIM
aauugcuacguaaugauga

SEQ ID NO: 2326358 - RNA, 23 nt, Yersinia pestis KIM
aauugcgauuaggacaaauagau

SEQ ID NO: 2326359 - RNA, 20 nt, Yersinia pestis KIM
aauugauauuauuuauauga

SEQ ID NO: 2326360 - RNA, 17 nt, Yersinia pestis KIM
aauugauauuauuuaua

SEQ ID NO: 2326361 - RNA, 15 nt, Yersinia pestis KIM
aauugauauuauuua

SEQ ID NO: 2326362 - RNA, 22 nt, Yersinia pestis KIM
aauugauauuauuuauaugaua

SEQ ID NO: 2326363 - RNA, 14 nt, Yersinia pestis KIM
aauugaucugauau

SEQ ID NO: 2326364 - RNA, 15 nt, Yersinia pestis KIM
aauugcaccccacau

SEQ ID NO: 2326365 - RNA, 17 nt, Yersinia pestis KIM
aauugccccacauuacu

SEQ ID NO: 2326366 - RNA, 23 nt, Yersinia pestis KIM
aauugcagguggguuuauugauu

SEQ ID NO: 2326367 - RNA, 21 nt, Yersinia pestis KIM
aauugacgccacuuaucccaa

SEQ ID NO: 2326368 - RNA, 22 nt, Yersinia pestis KIM
aauugaagaguugauccgauaa

SEQ ID NO: 2326369 - RNA, 17 nt, Yersinia pestis KIM
aauugaagcagauaaag

SEQ ID NO: 2326370 - RNA, 19 nt, Yersinia pestis KIM
aauugaguaacugauuaau

SEQ ID NO: 2326371 - RNA, 20 nt, Yersinia pestis KIM
aauugagucgcucuuugauu

SEQ ID NO: 2326372 - RNA, 15 nt, Yersinia pestis KIM
aauugacuguauaua

SEQ ID NO: 2326373 - RNA, 15 nt, Yersinia pestis KIM
aauugacuuuaaaaa

SEQ ID NO: 2326374 - RNA, 14 nt, Yersinia pestis KIM
aauugacuuugcca

SEQ ID NO: 2326375 - RNA, 20 nt, Yersinia pestis KIM
aauucuggguacaacacaaa

SEQ ID NO: 2326376 - RNA, 17 nt, Yersinia pestis KIM
aauucuuaggauaacca

SEQ ID NO: 2326377 - RNA, 16 nt, Yersinia pestis KIM
aaggcguuacccacau

SEQ ID NO: 2326378 - RNA, 14 nt, Yersinia pestis KIM
aaggcuauuuuuau

SEQ ID NO: 2326379 - RNA, 18 nt, Yersinia pestis KIM
aaggauggcccaagccau

SEQ ID NO: 2326380 - RNA, 15 nt, Yersinia pestis KIM
aaggauugaccaaua

SEQ ID NO: 2326381 - RNA, 16 nt, Yersinia pestis KIM
aaggcggcagagccaa

SEQ ID NO: 2326382 - RNA, 15 nt, Yersinia pestis KIM
aaggcggccacugag

SEQ ID NO: 2326383 - RNA, 17 nt, Yersinia pestis KIM
aaggcggcaagcaagca

SEQ ID NO: 2326384 - RNA, 17 nt, Yersinia pestis KIM
aaggauggcccaagcca

SEQ ID NO: 2326385 - RNA, 16 nt, Yersinia pestis KIM
aaggaugaauaaauga

SEQ ID NO: 2326386 - RNA, 18 nt, Yersinia pestis KIM
aaggagaccgcaugcugc

SEQ ID NO: 2326387 - RNA, 13 nt, Yersinia pestis KIM
aagggauaugaca

SEQ ID NO: 2326388 - RNA, 15 nt, Yersinia pestis KIM
aagggauaugaauaa

SEQ ID NO: 2326389 - RNA, 11 nt, Yersinia pestis KIM
aagggagccau

SEQ ID NO: 2326390 - RNA, 20 nt, Yersinia pestis KIM
aagggagcuuugcuagugaa

SEQ ID NO: 2326391 - RNA, 22 nt, Yersinia pestis KIM
aagggccacccugccaaaaaau

SEQ ID NO: 2326392 - RNA, 20 nt, Yersinia pestis KIM
aagggccauuuugcugccag

SEQ ID NO: 2326393 - RNA, 15 nt, Yersinia pestis KIM
aagggcgcagccccc

SEQ ID NO: 2326394 - RNA, 16 nt, Yersinia pestis KIM
aaggggagcuuccccc

SEQ ID NO: 2326395 - RNA, 15 nt, Yersinia pestis KIM
aagggcugagcggau

SEQ ID NO: 2326396 - RNA, 17 nt, Yersinia pestis KIM
aaggggcggaaaugccg

SEQ ID NO: 2326397 - RNA, 23 nt, Yersinia pestis KIM
aagggguuucagacuccugcccc

SEQ ID NO: 2326398 - RNA, 23 nt, Yersinia pestis KIM
aaggguaaaauaaauauccuccg

SEQ ID NO: 2326399 - RNA, 14 nt, Yersinia pestis KIM
aaggguacagucua

SEQ ID NO: 2326400 - RNA, 18 nt, Yersinia pestis KIM
aagggggggaagcucccc

SEQ ID NO: 2326401 - RNA, 16 nt, Yersinia pestis KIM
aaggguauugaagaua

SEQ ID NO: 2326402 - RNA, 17 nt, Yersinia pestis KIM
aaggguauugaagauac

SEQ ID NO: 2326403 - RNA, 15 nt, Yersinia pestis KIM
aaggguauaacucau

SEQ ID NO: 2326404 - RNA, 21 nt, Yersinia pestis KIM
aagguccaacucccaaauaua

SEQ ID NO: 2326405 - RNA, 14 nt, Yersinia pestis KIM
aaguaaaucagacc

SEQ ID NO: 2326406 - RNA, 20 nt, Yersinia pestis KIM
aaguaaauuccguggcuuag

SEQ ID NO: 2326407 - RNA, 20 nt, Yersinia pestis KIM
aaguaaaacgugaaacgccu

SEQ ID NO: 2326408 - RNA, 17 nt, Yersinia pestis KIM
aaguaaaagucagcaaa

SEQ ID NO: 2326409 - RNA, 21 nt, Yersinia pestis KIM
aaguaauuuaucaguagucaa

SEQ ID NO: 2326410 - RNA, 21 nt, Yersinia pestis KIM
aaguacuuauuugaaacacuu

SEQ ID NO: 2326411 - RNA, 19 nt, Yersinia pestis KIM
aaguacuuccaauaaguga

SEQ ID NO: 2326412 - RNA, 16 nt, Yersinia pestis KIM
aaguacuuauuugaaa

SEQ ID NO: 2326413 - RNA, 18 nt, Yersinia pestis KIM
aaguaggcaucugccaca

SEQ ID NO: 2326414 - RNA, 23 nt, Yersinia pestis KIM
aaguauugacccucuuaaugaau

SEQ ID NO: 2326415 - RNA, 16 nt, Yersinia pestis KIM
aagucauuaacuguua

SEQ ID NO: 2326416 - RNA, 23 nt, Yersinia pestis KIM
aagucauuaacuguuaaaacagg

SEQ ID NO: 2326417 - RNA, 19 nt, Yersinia pestis KIM
aagucauuggcguuacagc

SEQ ID NO: 2326418 - RNA, 23 nt, Yersinia pestis KIM
aagucauuggcguuacagcaagg

SEQ ID NO: 2326419 - RNA, 22 nt, Yersinia pestis KIM
aaguucacuugagagaaacuuu

SEQ ID NO: 2326420 - RNA, 21 nt, Yersinia pestis KIM
aaguucacuugagagaaacuu

SEQ ID NO: 2326421 - RNA, 17 nt, Yersinia pestis KIM
aaguucacaugaugaau

SEQ ID NO: 2326422 - RNA, 19 nt, Yersinia pestis KIM
aaguucaagaaccgaaaua

SEQ ID NO: 2326423 - RNA, 13 nt, Yersinia pestis KIM
aaguuaucaccaa

SEQ ID NO: 2326424 - RNA, 19 nt, Yersinia pestis KIM
aaguuagugguguuaucca

SEQ ID NO: 2326425 - RNA, 18 nt, Yersinia pestis KIM
aaguuaggguucaguaaa

SEQ ID NO: 2326426 - RNA, 22 nt, Yersinia pestis KIM
aaguuaggguucaguaaaacca

SEQ ID NO: 2326427 - RNA, 18 nt, Yersinia pestis KIM
aaguuagcgauaucugcg

SEQ ID NO: 2326428 - RNA, 22 nt, Yersinia pestis KIM
aaguguauucgcaucuuccaaa

SEQ ID NO: 2326429 - RNA, 21 nt, Yersinia pestis KIM
aagugguagccggacucaaaa

SEQ ID NO: 2326430 - RNA, 21 nt, Yersinia pestis KIM
aagugagaaggguauugaaga

SEQ ID NO: 2326431 - RNA, 20 nt, Yersinia pestis KIM
aagugagaaggguauugaag

SEQ ID NO: 2326432 - RNA, 13 nt, Yersinia pestis KIM
aagugagaagggu

SEQ ID NO: 2326433 - RNA, 16 nt, Yersinia pestis KIM
aagucugaaaugauca

SEQ ID NO: 2326434 - RNA, 19 nt, Yersinia pestis KIM
aagugcgggaaaguaauau

SEQ ID NO: 2326435 - RNA, 20 nt, Yersinia pestis KIM
aagugcgaagcgcacccaaa

SEQ ID NO: 2326436 - RNA, 21 nt, Yersinia pestis KIM
aagugcgaagcgcacccaaaa

SEQ ID NO: 2326437 - RNA, 20 nt, Yersinia pestis KIM
aagugaucagcuaacaaaac

SEQ ID NO: 2326438 - RNA, 14 nt, Yersinia pestis KIM
aagugagcugaacu

SEQ ID NO: 2326439 - RNA, 23 nt, Yersinia pestis KIM
aagcgccugugggcggcuuucau

SEQ ID NO: 2326440 - RNA, 22 nt, Yersinia pestis KIM
aagcgcuauguuggcaaauaau

SEQ ID NO: 2326441 - RNA, 12 nt, Yersinia pestis KIM
aagcgcucaaau

SEQ ID NO: 2326442 - RNA, 13 nt, Yersinia pestis KIM
aagcgguaaaugg

SEQ ID NO: 2326443 - RNA, 21 nt, Yersinia pestis KIM
aagcgggugagauauugcaug

SEQ ID NO: 2326444 - RNA, 12 nt, Yersinia pestis KIM
aagcgcaggaua

SEQ ID NO: 2326445 - RNA, 18 nt, Yersinia pestis KIM
aagcgcagugcucauuaa

SEQ ID NO: 2326446 - RNA, 20 nt, Yersinia pestis KIM
aagcgccguaaaaagcagca

SEQ ID NO: 2326447 - RNA, 14 nt, Yersinia pestis KIM
aagcgccugcgaca

SEQ ID NO: 2326448 - RNA, 12 nt, Yersinia pestis KIM
aagcucaagcug

SEQ ID NO: 2326449 - RNA, 13 nt, Yersinia pestis KIM
aagcugaaauuuu

SEQ ID NO: 2326450 - RNA, 15 nt, Yersinia pestis KIM
aagcguaaauuuacc

SEQ ID NO: 2326451 - RNA, 21 nt, Yersinia pestis KIM
aagcguacugcgguuaaucgg

SEQ ID NO: 2326452 - RNA, 16 nt, Yersinia pestis KIM
aaggagaaaggcguga

SEQ ID NO: 2326453 - RNA, 14 nt, Yersinia pestis KIM
aaggagagauuaga

SEQ ID NO: 2326454 - RNA, 16 nt, Yersinia pestis KIM
aaggacccguuuauaa

SEQ ID NO: 2326455 - RNA, 23 nt, Yersinia pestis KIM
aaggaaaaguagccaauagacaa

SEQ ID NO: 2326456 - RNA, 14 nt, Yersinia pestis KIM
aaggaaacucauga

SEQ ID NO: 2326457 - RNA, 14 nt, Yersinia pestis KIM
aagcuucucccuuu

SEQ ID NO: 2326458 - RNA, 15 nt, Yersinia pestis KIM
aagcuucaacuuaau

SEQ ID NO: 2326459 - RNA, 21 nt, Yersinia pestis KIM
aagcuucaacuuccagugcca

SEQ ID NO: 2326460 - RNA, 14 nt, Yersinia pestis KIM
aagcuucaacuuaa

SEQ ID NO: 2326461 - RNA, 14 nt, Yersinia pestis KIM
aagcuggcccugau

SEQ ID NO: 2326462 - RNA, 14 nt, Yersinia pestis KIM
aagcugggaaggcg

SEQ ID NO: 2326463 - RNA, 20 nt, Yersinia pestis KIM
aagccccagugcgcaaaaau

SEQ ID NO: 2326464 - RNA, 20 nt, Yersinia pestis KIM
aagccgauccgggaaaaaau

SEQ ID NO: 2326465 - RNA, 15 nt, Yersinia pestis KIM
aagcccuguuucauu

SEQ ID NO: 2326466 - RNA, 18 nt, Yersinia pestis KIM
aagcccuugucaggauuu

SEQ ID NO: 2326467 - RNA, 13 nt, Yersinia pestis KIM
aagccagucaggg

SEQ ID NO: 2326468 - RNA, 20 nt, Yersinia pestis KIM
aagccaugacagguugauaa

SEQ ID NO: 2326469 - RNA, 21 nt, Yersinia pestis KIM
aagccaucgccaucgccgaca

SEQ ID NO: 2326470 - RNA, 22 nt, Yersinia pestis KIM
aagccauuuuuuauaaacacuu

SEQ ID NO: 2326471 - RNA, 16 nt, Yersinia pestis KIM
aagcgauccugcucaa

SEQ ID NO: 2326472 - RNA, 21 nt, Yersinia pestis KIM
aagcgaucaccucuugcauac

SEQ ID NO: 2326473 - RNA, 23 nt, Yersinia pestis KIM
aagcgauuagucccuaaagagcg

SEQ ID NO: 2326474 - RNA, 16 nt, Yersinia pestis KIM
aagccuucaaccugaa

SEQ ID NO: 2326475 - RNA, 11 nt, Yersinia pestis KIM
aagccugugcu

SEQ ID NO: 2326476 - RNA, 14 nt, Yersinia pestis KIM
aagccgcgccaucu

SEQ ID NO: 2326477 - RNA, 15 nt, Yersinia pestis KIM
aagccgcguucaaau

SEQ ID NO: 2326478 - RNA, 20 nt, Yersinia pestis KIM
aagccguaauucagauaaga

SEQ ID NO: 2326479 - RNA, 18 nt, Yersinia pestis KIM
aagccucggucacugccu

SEQ ID NO: 2326480 - RNA, 19 nt, Yersinia pestis KIM
aagccucaugaaugaggcu

SEQ ID NO: 2326481 - RNA, 13 nt, Yersinia pestis KIM
aagccgucaguuc

SEQ ID NO: 2326482 - RNA, 15 nt, Yersinia pestis KIM
aagccgugaccaaag

SEQ ID NO: 2326483 - RNA, 15 nt, Yersinia pestis KIM
aauaccgacgugugc

SEQ ID NO: 2326484 - RNA, 21 nt, Yersinia pestis KIM
aauaccgaugagcugaauagc

SEQ ID NO: 2326485 - RNA, 17 nt, Yersinia pestis KIM
aauaccgccacacaaua

SEQ ID NO: 2326486 - RNA, 18 nt, Yersinia pestis KIM
aauaccgccacacaauac

SEQ ID NO: 2326487 - RNA, 18 nt, Yersinia pestis KIM
aauaccgcgaucaacaag

SEQ ID NO: 2326488 - RNA, 21 nt, Yersinia pestis KIM
aauaccggauuguucagcaac

SEQ ID NO: 2326489 - RNA, 19 nt, Yersinia pestis KIM
aauaccgccggcaacagcg

SEQ ID NO: 2326490 - RNA, 20 nt, Yersinia pestis KIM
aauaccgguggcauuguuca

SEQ ID NO: 2326491 - RNA, 19 nt, Yersinia pestis KIM
aauaccguguacccgaucu

SEQ ID NO: 2326492 - RNA, 21 nt, Yersinia pestis KIM
aauaccuuacuguaucaauac

SEQ ID NO: 2326493 - RNA, 18 nt, Yersinia pestis KIM
aauaccugaauagaaguc

SEQ ID NO: 2326494 - RNA, 12 nt, Yersinia pestis KIM
aauacgcaggcg

SEQ ID NO: 2326495 - RNA, 13 nt, Yersinia pestis KIM
aauacggcaccaa

SEQ ID NO: 2326496 - RNA, 22 nt, Yersinia pestis KIM
aauacggcacucaaauagauag

SEQ ID NO: 2326497 - RNA, 20 nt, Yersinia pestis KIM
aauacgcuaucgcgaaacuc

SEQ ID NO: 2326498 - RNA, 21 nt, Yersinia pestis KIM
aauacgccauccgcaccugca

SEQ ID NO: 2326499 - RNA, 14 nt, Yersinia pestis KIM
aauacaaaaauaca

SEQ ID NO: 2326500 - RNA, 13 nt, Yersinia pestis KIM
aauaauuuuaugg

SEQ ID NO: 2326501 - RNA, 20 nt, Yersinia pestis KIM
aauaauuuauacauaucaga

SEQ ID NO: 2326502 - RNA, 13 nt, Yersinia pestis KIM
aauaccacggcac

SEQ ID NO: 2326503 - RNA, 21 nt, Yersinia pestis KIM
aauacccggccaauaaagcuc

SEQ ID NO: 2326504 - RNA, 18 nt, Yersinia pestis KIM
aauacccgguuuccaguu

SEQ ID NO: 2326505 - RNA, 14 nt, Yersinia pestis KIM
aauaccaaauuuac

SEQ ID NO: 2326506 - RNA, 23 nt, Yersinia pestis KIM
aauacggcguuugacaauaucaa

SEQ ID NO: 2326507 - RNA, 18 nt, Yersinia pestis KIM
aauacucuguuaccaaug

SEQ ID NO: 2326508 - RNA, 17 nt, Yersinia pestis KIM
aauacgggugaacaugc

SEQ ID NO: 2326509 - RNA, 20 nt, Yersinia pestis KIM
aauacugcgguccuacccuu

SEQ ID NO: 2326510 - RNA, 19 nt, Yersinia pestis KIM
aauacugcugugccagagu

SEQ ID NO: 2326511 - RNA, 17 nt, Yersinia pestis KIM
aauacugcacguuuaau

SEQ ID NO: 2326512 - RNA, 21 nt, Yersinia pestis KIM
aauacugcacguuuaauuuca

SEQ ID NO: 2326513 - RNA, 16 nt, Yersinia pestis KIM
aauacugccuaacugg

SEQ ID NO: 2326514 - RNA, 18 nt, Yersinia pestis KIM
aauagauagcaaucaaua

SEQ ID NO: 2326515 - RNA, 14 nt, Yersinia pestis KIM
aauagauaguacuu

SEQ ID NO: 2326516 - RNA, 11 nt, Yersinia pestis KIM
aauagauaaaa

SEQ ID NO: 2326517 - RNA, 20 nt, Yersinia pestis KIM
aauagauaaaaacauuuaaa

SEQ ID NO: 2326518 - RNA, 12 nt, Yersinia pestis KIM
aauagaaaaaca

SEQ ID NO: 2326519 - RNA, 14 nt, Yersinia pestis KIM
aauagaaaacagca

SEQ ID NO: 2326520 - RNA, 22 nt, Yersinia pestis KIM
aauagcaagccaaaacagccua

SEQ ID NO: 2326521 - RNA, 18 nt, Yersinia pestis KIM
aauagcaaacccaccuga

SEQ ID NO: 2326522 - RNA, 16 nt, Yersinia pestis KIM
aauagcaaaacugagg

SEQ ID NO: 2326523 - RNA, 20 nt, Yersinia pestis KIM
aauagauaucgaaacacaua

SEQ ID NO: 2326524 - RNA, 18 nt, Yersinia pestis KIM
aauagcccaaauaaccuc

SEQ ID NO: 2326525 - RNA, 14 nt, Yersinia pestis KIM
aauagcaccauuag

SEQ ID NO: 2326526 - RNA, 20 nt, Yersinia pestis KIM
aauaguuacuauauaaauga

SEQ ID NO: 2326527 - RNA, 18 nt, Yersinia pestis KIM
aauauaauaaucuauaua

SEQ ID NO: 2326528 - RNA, 13 nt, Yersinia pestis KIM
aauauacuuuaca

SEQ ID NO: 2326529 - RNA, 20 nt, Yersinia pestis KIM
aauauacuguuaacucgcca

SEQ ID NO: 2326530 - RNA, 14 nt, Yersinia pestis KIM
aauagcccgcgaau

SEQ ID NO: 2326531 - RNA, 22 nt, Yersinia pestis KIM
aauaggcaggcccgcuucccua

SEQ ID NO: 2326532 - RNA, 15 nt, Yersinia pestis KIM
aauaggcaggggagu

SEQ ID NO: 2326533 - RNA, 22 nt, Yersinia pestis KIM
aauagucuuuuuaauaugugac

SEQ ID NO: 2326534 - RNA, 20 nt, Yersinia pestis KIM
aauagugauuguuugauuau

SEQ ID NO: 2326535 - RNA, 20 nt, Yersinia pestis KIM
aauagugcgaucaaaaacgu

SEQ ID NO: 2326536 - RNA, 21 nt, Yersinia pestis KIM
aauaggucagugguuuuauca

SEQ ID NO: 2326537 - RNA, 21 nt, Yersinia pestis KIM
aauagucguuauauaaauggc

SEQ ID NO: 2326538 - RNA, 22 nt, Yersinia pestis KIM
aauaggggcgguggcuaacuga

SEQ ID NO: 2326539 - RNA, 10 nt, Yersinia pestis KIM
aauagggaag

SEQ ID NO: 2326540 - RNA, 20 nt, Yersinia pestis KIM
aauaggucagugguuuuaua

SEQ ID NO: 2326541 - RNA, 22 nt, Yersinia pestis KIM
aauaggucagugguuuuauaaa

SEQ ID NO: 2326542 - RNA, 11 nt, Yersinia pestis KIM
aauagguagug

SEQ ID NO: 2326543 - RNA, 14 nt, Yersinia pestis KIM
aauaggcgucagca

SEQ ID NO: 2326544 - RNA, 16 nt, Yersinia pestis KIM
aauaggcugaucaacg

SEQ ID NO: 2326545 - RNA, 16 nt, Yersinia pestis KIM
aauaucuauuuccauc

SEQ ID NO: 2326546 - RNA, 23 nt, Yersinia pestis KIM
aauauccgugggcaaaggcccaa

SEQ ID NO: 2326547 - RNA, 15 nt, Yersinia pestis KIM
aauauccgugauuaa

SEQ ID NO: 2326548 - RNA, 22 nt, Yersinia pestis KIM
aauauccgugauuaaccuuaau

SEQ ID NO: 2326549 - RNA, 20 nt, Yersinia pestis KIM
aauaugcugugguucaauug

SEQ ID NO: 2326550 - RNA, 18 nt, Yersinia pestis KIM
aauauggcggcaucagca

SEQ ID NO: 2326551 - RNA, 13 nt, Yersinia pestis KIM
aauauggcaugug

SEQ ID NO: 2326552 - RNA, 21 nt, Yersinia pestis KIM
aauauggggugcuucaagccc

SEQ ID NO: 2326553 - RNA, 17 nt, Yersinia pestis KIM
aauaucccgagaaacaa

SEQ ID NO: 2326554 - RNA, 12 nt, Yersinia pestis KIM
aauauccaacca

SEQ ID NO: 2326555 - RNA, 21 nt, Yersinia pestis KIM
aauauccaaccaaccaugcug

SEQ ID NO: 2326556 - RNA, 18 nt, Yersinia pestis KIM
aauaucaucuuuuucugc

SEQ ID NO: 2326557 - RNA, 20 nt, Yersinia pestis KIM
aauaucauccccuuucugcu

SEQ ID NO: 2326558 - RNA, 14 nt, Yersinia pestis KIM
aauaucauccccuu

SEQ ID NO: 2326559 - RNA, 14 nt, Yersinia pestis KIM
aauaucauuaacaa

SEQ ID NO: 2326560 - RNA, 13 nt, Yersinia pestis KIM
aauaucauuauuu

SEQ ID NO: 2326561 - RNA, 13 nt, Yersinia pestis KIM
aauaucaucaucu

SEQ ID NO: 2326562 - RNA, 14 nt, Yersinia pestis KIM
aauauaguugaucu

SEQ ID NO: 2326563 - RNA, 13 nt, Yersinia pestis KIM
aauaucauagcca

SEQ ID NO: 2326564 - RNA, 19 nt, Yersinia pestis KIM
aauaucagucgcuuuuuaa

SEQ ID NO: 2326565 - RNA, 21 nt, Yersinia pestis KIM
aauaucagugacaccauugau

SEQ ID NO: 2326566 - RNA, 16 nt, Yersinia pestis KIM
aauaacguccugauga

SEQ ID NO: 2326567 - RNA, 15 nt, Yersinia pestis KIM
aauaacgcuggauaa

SEQ ID NO: 2326568 - RNA, 16 nt, Yersinia pestis KIM
aauaacucagggcuuu

SEQ ID NO: 2326569 - RNA, 16 nt, Yersinia pestis KIM
aauaacuccacuucuu

SEQ ID NO: 2326570 - RNA, 19 nt, Yersinia pestis KIM
aauaacucagccauugcuu

SEQ ID NO: 2326571 - RNA, 17 nt, Yersinia pestis KIM
aauaacuuaaauaauuu

SEQ ID NO: 2326572 - RNA, 23 nt, Yersinia pestis KIM
aauaacuuauuacaccuuaaaac

SEQ ID NO: 2326573 - RNA, 17 nt, Yersinia pestis KIM
aauaagaucaauauguu

SEQ ID NO: 2326574 - RNA, 21 nt, Yersinia pestis KIM
aauaaccagaauaauccaagc

SEQ ID NO: 2326575 - RNA, 18 nt, Yersinia pestis KIM
aauaacagcuaaaaugau

SEQ ID NO: 2326576 - RNA, 19 nt, Yersinia pestis KIM
aauaacacggccuauugaa

SEQ ID NO: 2326577 - RNA, 23 nt, Yersinia pestis KIM
aauaacacggccuauugaauaac

SEQ ID NO: 2326578 - RNA, 17 nt, Yersinia pestis KIM
aauaacgcggcacauac

SEQ ID NO: 2326579 - RNA, 14 nt, Yersinia pestis KIM
aauaacgauuaauu

SEQ ID NO: 2326580 - RNA, 13 nt, Yersinia pestis KIM
aauaacgcaaaaa

SEQ ID NO: 2326581 - RNA, 18 nt, Yersinia pestis KIM
aauaacgcaaaaaucacu

SEQ ID NO: 2326582 - RNA, 17 nt, Yersinia pestis KIM
aauaaccucaggggcca

SEQ ID NO: 2326583 - RNA, 15 nt, Yersinia pestis KIM
aauaaccucagccuc

SEQ ID NO: 2326584 - RNA, 18 nt, Yersinia pestis KIM
aauaacgaauuucauuuu

SEQ ID NO: 2326585 - RNA, 16 nt, Yersinia pestis KIM
aauaaccguuucagga

SEQ ID NO: 2326586 - RNA, 17 nt, Yersinia pestis KIM
aauaaccguuucaggag

SEQ ID NO: 2326587 - RNA, 17 nt, Yersinia pestis KIM
aauaaccuacaaaaaua

SEQ ID NO: 2326588 - RNA, 23 nt, Yersinia pestis KIM
aauaaccucacgggcuuccauca

SEQ ID NO: 2326589 - RNA, 15 nt, Yersinia pestis KIM
aauaaccucaaaagg

SEQ ID NO: 2326590 - RNA, 19 nt, Yersinia pestis KIM
aauaaaugucacuugcccu

SEQ ID NO: 2326591 - RNA, 16 nt, Yersinia pestis KIM
aauaaauucaaaauag

SEQ ID NO: 2326592 - RNA, 12 nt, Yersinia pestis KIM
aauaaauucagg

SEQ ID NO: 2326593 - RNA, 20 nt, Yersinia pestis KIM
aauaaauucagguugaggca

SEQ ID NO: 2326594 - RNA, 16 nt, Yersinia pestis KIM
aauaacaccagcaggu

SEQ ID NO: 2326595 - RNA, 12 nt, Yersinia pestis KIM
aauaacaacaca

SEQ ID NO: 2326596 - RNA, 20 nt, Yersinia pestis KIM
aauaaauuuucuaagcugcc

SEQ ID NO: 2326597 - RNA, 21 nt, Yersinia pestis KIM
aauaaauuuaauaaguuaaua

SEQ ID NO: 2326598 - RNA, 19 nt, Yersinia pestis KIM
aauaaauacccugcaccau

SEQ ID NO: 2326599 - RNA, 14 nt, Yersinia pestis KIM
aauaaauaaguuca

SEQ ID NO: 2326600 - RNA, 17 nt, Yersinia pestis KIM
aauaaauaauuuguaaa

SEQ ID NO: 2326601 - RNA, 19 nt, Yersinia pestis KIM
aaguugauaacgccggaua

SEQ ID NO: 2326602 - RNA, 17 nt, Yersinia pestis KIM
aaguugagcagcaauaa

SEQ ID NO: 2326603 - RNA, 15 nt, Yersinia pestis KIM
aaguugaugcaguga

SEQ ID NO: 2326604 - RNA, 19 nt, Yersinia pestis KIM
aaguucagguugaaauaaa

SEQ ID NO: 2326605 - RNA, 15 nt, Yersinia pestis KIM
aauaaucauaucaaa

SEQ ID NO: 2326606 - RNA, 22 nt, Yersinia pestis KIM
aauaaucauaucaaaauaaaaa

SEQ ID NO: 2326607 - RNA, 16 nt, Yersinia pestis KIM
aauaaucaccagacaa

SEQ ID NO: 2326608 - RNA, 12 nt, Yersinia pestis KIM
aauaaucaauga

SEQ ID NO: 2326609 - RNA, 14 nt, Yersinia pestis KIM
aauaauauucaaua

SEQ ID NO: 2326610 - RNA, 20 nt, Yersinia pestis KIM
aauaauaucggcggcaaaga

SEQ ID NO: 2326611 - RNA, 15 nt, Yersinia pestis KIM
aauaauaaauaaauu

SEQ ID NO: 2326612 - RNA, 13 nt, Yersinia pestis KIM
aauaauaacgaau

SEQ ID NO: 2326613 - RNA, 11 nt, Yersinia pestis KIM
aauaauaaugc

SEQ ID NO: 2326614 - RNA, 23 nt, Yersinia pestis KIM
aauaagcccaguauugcagagca

SEQ ID NO: 2326615 - RNA, 13 nt, Yersinia pestis KIM
aauaagccacgcu

SEQ ID NO: 2326616 - RNA, 21 nt, Yersinia pestis KIM
aauaagccagauaucacucag

SEQ ID NO: 2326617 - RNA, 21 nt, Yersinia pestis KIM
aauaagccgcaggcaaacaau

SEQ ID NO: 2326618 - RNA, 13 nt, Yersinia pestis KIM
aauaagcucuggg

SEQ ID NO: 2326619 - RNA, 18 nt, Yersinia pestis KIM
aauaagcuaucauuaaau

SEQ ID NO: 2326620 - RNA, 19 nt, Yersinia pestis KIM
aauaaggguagguucaaua

SEQ ID NO: 2326621 - RNA, 18 nt, Yersinia pestis KIM
aauaaggugccacacaga

SEQ ID NO: 2326622 - RNA, 13 nt, Yersinia pestis KIM
aauaagggccacc

SEQ ID NO: 2326623 - RNA, 19 nt, Yersinia pestis KIM
aauaagggauaugaauaaa

SEQ ID NO: 2326624 - RNA, 20 nt, Yersinia pestis KIM
aauaaguguuucaaauaagu

SEQ ID NO: 2326625 - RNA, 21 nt, Yersinia pestis KIM
aauaaguguguguauuuaaaa

SEQ ID NO: 2326626 - RNA, 17 nt, Yersinia pestis KIM
aauaaguguuucaaaua

SEQ ID NO: 2326627 - RNA, 19 nt, Yersinia pestis KIM
aauaaguguuucaaauaag

SEQ ID NO: 2326628 - RNA, 21 nt, Yersinia pestis KIM
aauaaguuacgucagaaauaa

SEQ ID NO: 2326629 - RNA, 22 nt, Yersinia pestis KIM
aauaaguuacgucagaaauaaa

SEQ ID NO: 2326630 - RNA, 12 nt, Yersinia pestis KIM
aauaauaaaaaa

SEQ ID NO: 2326631 - RNA, 16 nt, Yersinia pestis KIM
aauaauaaaaaaaaau

SEQ ID NO: 2326632 - RNA, 13 nt, Yersinia pestis KIM
aauaauaaaaaaa

SEQ ID NO: 2326633 - RNA, 18 nt, Yersinia pestis KIM
aauaauaaaaaaaaauaa

SEQ ID NO: 2326634 - RNA, 15 nt, Yersinia pestis KIM
aauaagugaaacaaa

SEQ ID NO: 2326635 - RNA, 20 nt, Yersinia pestis KIM
aauaagugcaaacuuaaaaa

SEQ ID NO: 2326636 - RNA, 14 nt, Yersinia pestis KIM
aauaaguauuucaa

SEQ ID NO: 2326637 - RNA, 14 nt, Yersinia pestis KIM
aauaauuaauuuca

SEQ ID NO: 2326638 - RNA, 15 nt, Yersinia pestis KIM
aauaauuacagcugg

SEQ ID NO: 2326639 - RNA, 16 nt, Yersinia pestis KIM
aauaauuaaucuuaau

SEQ ID NO: 2326640 - RNA, 21 nt, Yersinia pestis KIM
aauaauguccccuugaguauc

SEQ ID NO: 2326641 - RNA, 20 nt, Yersinia pestis KIM
aauaauugccgcucaaguug

SEQ ID NO: 2326642 - RNA, 19 nt, Yersinia pestis KIM
aauaauugguagccacaau

SEQ ID NO: 2326643 - RNA, 17 nt, Yersinia pestis KIM
aauaauucgaguuucag

SEQ ID NO: 2326644 - RNA, 14 nt, Yersinia pestis KIM
aauaauucagguug

SEQ ID NO: 2326645 - RNA, 20 nt, Yersinia pestis KIM
aauaauuauaccuacccuuu

SEQ ID NO: 2326646 - RNA, 12 nt, Yersinia pestis KIM
aauaauuaggaa

SEQ ID NO: 2326647 - RNA, 20 nt, Yersinia pestis KIM
aauaaucgggaaauugugau

SEQ ID NO: 2326648 - RNA, 14 nt, Yersinia pestis KIM
aauaaugaacaaau

SEQ ID NO: 2326649 - RNA, 16 nt, Yersinia pestis KIM
aauaaugaacaaauau

SEQ ID NO: 2326650 - RNA, 14 nt, Yersinia pestis KIM
aauaaucuugugau

SEQ ID NO: 2326651 - RNA, 16 nt, Yersinia pestis KIM
aauaaugagccauaaa

SEQ ID NO: 2326652 - RNA, 18 nt, Yersinia pestis KIM
uugguugaacauuuccac

SEQ ID NO: 2326653 - RNA, 13 nt, Yersinia pestis KIM
uuggucaaucaag

SEQ ID NO: 2326654 - RNA, 21 nt, Yersinia pestis KIM
uuggucguuuaaauaaaaaag

SEQ ID NO: 2326655 - RNA, 14 nt, Yersinia pestis KIM
uuggucucagaaca

SEQ ID NO: 2326656 - RNA, 17 nt, Yersinia pestis KIM
uuggugacaaacgcuug

SEQ ID NO: 2326657 - RNA, 22 nt, Yersinia pestis KIM
uuggugccgcuggcauacaguu

SEQ ID NO: 2326658 - RNA, 19 nt, Yersinia pestis KIM
uugggcgggaucuccagaa

SEQ ID NO: 2326659 - RNA, 23 nt, Yersinia pestis KIM
uugggugacaacgucacuuccau

SEQ ID NO: 2326660 - RNA, 15 nt, Yersinia pestis KIM
uugggugaacacaga

SEQ ID NO: 2326661 - RNA, 16 nt, Yersinia pestis KIM
uugggucaguuuuauu

SEQ ID NO: 2326662 - RNA, 17 nt, Yersinia pestis KIM
uuggguauaugacugug

SEQ ID NO: 2326663 - RNA, 16 nt, Yersinia pestis KIM
uugguaacgcagaaau

SEQ ID NO: 2326664 - RNA, 20 nt, Yersinia pestis KIM
uugguaaaaccgguuuuggu

SEQ ID NO: 2326665 - RNA, 17 nt, Yersinia pestis KIM
uuggccgcgcacagcac

SEQ ID NO: 2326666 - RNA, 13 nt, Yersinia pestis KIM
uuggccgcuuugg

SEQ ID NO: 2326667 - RNA, 23 nt, Yersinia pestis KIM
uuggcauuaaacugaauaucccc

SEQ ID NO: 2326668 - RNA, 15 nt, Yersinia pestis KIM
uuggcauguucacau

SEQ ID NO: 2326669 - RNA, 15 nt, Yersinia pestis KIM
uuggcaugacaucag

SEQ ID NO: 2326670 - RNA, 23 nt, Yersinia pestis KIM
uuggcgcggacgcuuuacucuuc

SEQ ID NO: 2326671 - RNA, 20 nt, Yersinia pestis KIM
uuggcuuuugccucacuguc

SEQ ID NO: 2326672 - RNA, 15 nt, Yersinia pestis KIM
uuggcuguuguggca

SEQ ID NO: 2326673 - RNA, 22 nt, Yersinia pestis KIM
uuggcggcuauuauugcuguuu

SEQ ID NO: 2326674 - RNA, 23 nt, Yersinia pestis KIM
uuggcucgugaucagcagacuca

SEQ ID NO: 2326675 - RNA, 18 nt, Yersinia pestis KIM
uuggcuggcaaaguuauu

SEQ ID NO: 2326676 - RNA, 16 nt, Yersinia pestis KIM
uuggcuaacuggcgcu

SEQ ID NO: 2326677 - RNA, 21 nt, Yersinia pestis KIM
uugcugcuguuauuacuguca

SEQ ID NO: 2326678 - RNA, 22 nt, Yersinia pestis KIM
uugcuguaaacaucgacaccaa

SEQ ID NO: 2326679 - RNA, 20 nt, Yersinia pestis KIM
uugcuguaacuaccugcuuu

SEQ ID NO: 2326680 - RNA, 19 nt, Yersinia pestis KIM
uugcuggcuaucaucccuu

SEQ ID NO: 2326681 - RNA, 20 nt, Yersinia pestis KIM
uugcuaggcgcagcagggcu

SEQ ID NO: 2326682 - RNA, 15 nt, Yersinia pestis KIM
uugcuaucaauaaac

SEQ ID NO: 2326683 - RNA, 14 nt, Yersinia pestis KIM
uugcuuaucacccc

SEQ ID NO: 2326684 - RNA, 22 nt, Yersinia pestis KIM
uugcuuaucgucaaguucauau

SEQ ID NO: 2326685 - RNA, 21 nt, Yersinia pestis KIM
uugcuguuguuauuacuguca

SEQ ID NO: 2326686 - RNA, 14 nt, Yersinia pestis KIM
uugcuugauuaccu

SEQ ID NO: 2326687 - RNA, 16 nt, Yersinia pestis KIM
uuggcaucaaauuuag

SEQ ID NO: 2326688 - RNA, 17 nt, Yersinia pestis KIM
uuggcaaucacaacccc

SEQ ID NO: 2326689 - RNA, 15 nt, Yersinia pestis KIM
uuggauugagccacc

SEQ ID NO: 2326690 - RNA, 17 nt, Yersinia pestis KIM
uuggaugucaggaucau

SEQ ID NO: 2326691 - RNA, 17 nt, Yersinia pestis KIM
uuggcaaaggccagcgc

SEQ ID NO: 2326692 - RNA, 23 nt, Yersinia pestis KIM
uuggcaaauucaacaaucaauca

SEQ ID NO: 2326693 - RNA, 17 nt, Yersinia pestis KIM
uuggaucaggaucacca

SEQ ID NO: 2326694 - RNA, 15 nt, Yersinia pestis KIM
uuggacccgucacca

SEQ ID NO: 2326695 - RNA, 22 nt, Yersinia pestis KIM
uuggaauagcuguaaaauacca

SEQ ID NO: 2326696 - RNA, 18 nt, Yersinia pestis KIM
uuggauaaaccggcuggg

SEQ ID NO: 2326697 - RNA, 15 nt, Yersinia pestis KIM
uuggagccagccauu

SEQ ID NO: 2326698 - RNA, 14 nt, Yersinia pestis KIM
uuggacucuggaau

SEQ ID NO: 2326699 - RNA, 20 nt, Yersinia pestis KIM
uuggaaaugacaaaucagcg

SEQ ID NO: 2326700 - RNA, 14 nt, Yersinia pestis KIM
uugcuuuuugcuuu

SEQ ID NO: 2326701 - RNA, 13 nt, Yersinia pestis KIM
uugcggaucacau

SEQ ID NO: 2326702 - RNA, 15 nt, Yersinia pestis KIM
uugcgcucaaccgaa

SEQ ID NO: 2326703 - RNA, 22 nt, Yersinia pestis KIM
uugcggcgcacccuccaauaau

SEQ ID NO: 2326704 - RNA, 21 nt, Yersinia pestis KIM
uugcgggcucuuugucaauaa

SEQ ID NO: 2326705 - RNA, 17 nt, Yersinia pestis KIM
uugcggguuaacucuuc

SEQ ID NO: 2326706 - RNA, 13 nt, Yersinia pestis KIM
uugcgcgaaauau

SEQ ID NO: 2326707 - RNA, 14 nt, Yersinia pestis KIM
uugccuuucugggc

SEQ ID NO: 2326708 - RNA, 23 nt, Yersinia pestis KIM
uugccauaagcgacgacauuaau

SEQ ID NO: 2326709 - RNA, 14 nt, Yersinia pestis KIM
uugccagugacucu

SEQ ID NO: 2326710 - RNA, 21 nt, Yersinia pestis KIM
uugcccaaucuaacuggcccu

SEQ ID NO: 2326711 - RNA, 15 nt, Yersinia pestis KIM
uugcccaauggcaaa

SEQ ID NO: 2326712 - RNA, 16 nt, Yersinia pestis KIM
uugcccaauggcaaaa

SEQ ID NO: 2326713 - RNA, 20 nt, Yersinia pestis KIM
uugccgguaugccaaaccca

SEQ ID NO: 2326714 - RNA, 16 nt, Yersinia pestis KIM
uugccgugcugucagc

SEQ ID NO: 2326715 - RNA, 16 nt, Yersinia pestis KIM
uugccgugguucaaau

SEQ ID NO: 2326716 - RNA, 15 nt, Yersinia pestis KIM
uugccuacuaccaaa

SEQ ID NO: 2326717 - RNA, 19 nt, Yersinia pestis KIM
uugccagccaucuugggcc

SEQ ID NO: 2326718 - RNA, 16 nt, Yersinia pestis KIM
uugccagauaaaaauu

SEQ ID NO: 2326719 - RNA, 17 nt, Yersinia pestis KIM
uugccacucauauucaa

SEQ ID NO: 2326720 - RNA, 22 nt, Yersinia pestis KIM
uugccacgccaguaaacagcca

SEQ ID NO: 2326721 - RNA, 17 nt, Yersinia pestis KIM
uugcauacucaggcccu

SEQ ID NO: 2326722 - RNA, 22 nt, Yersinia pestis KIM
uugcauacucaggcccugagau

SEQ ID NO: 2326723 - RNA, 14 nt, Yersinia pestis KIM
uugcagugcguaau

SEQ ID NO: 2326724 - RNA, 19 nt, Yersinia pestis KIM
uugcaguggaugauaaaua

SEQ ID NO: 2326725 - RNA, 14 nt, Yersinia pestis KIM
uugcaucuuuaauu

SEQ ID NO: 2326726 - RNA, 15 nt, Yersinia pestis KIM
uugcaucuuuaauua

SEQ ID NO: 2326727 - RNA, 23 nt, Yersinia pestis KIM
uugcaugaaaucaguguauuacu

SEQ ID NO: 2326728 - RNA, 14 nt, Yersinia pestis KIM
uugcaguauuuugg

SEQ ID NO: 2326729 - RNA, 22 nt, Yersinia pestis KIM
uugcagcaagccgauaaucaau

SEQ ID NO: 2326730 - RNA, 23 nt, Yersinia pestis KIM
uugaugucgggugguugucuaug

SEQ ID NO: 2326731 - RNA, 20 nt, Yersinia pestis KIM
uugauggcgcaguaacugug

SEQ ID NO: 2326732 - RNA, 14 nt, Yersinia pestis KIM
uugauuaaccgauu

SEQ ID NO: 2326733 - RNA, 18 nt, Yersinia pestis KIM
uugauuaccaauaauuaa

SEQ ID NO: 2326734 - RNA, 19 nt, Yersinia pestis KIM
uugauuaucaaguuaaaua

SEQ ID NO: 2326735 - RNA, 20 nt, Yersinia pestis KIM
uugauuaggcaugauaagca

SEQ ID NO: 2326736 - RNA, 15 nt, Yersinia pestis KIM
uugauuuguuaaaac

SEQ ID NO: 2326737 - RNA, 13 nt, Yersinia pestis KIM
uugauuucaaugc

SEQ ID NO: 2326738 - RNA, 22 nt, Yersinia pestis KIM
uugaucugaguuucauuaguca

SEQ ID NO: 2326739 - RNA, 18 nt, Yersinia pestis KIM
uugaugcucauuuaaaau

SEQ ID NO: 2326740 - RNA, 17 nt, Yersinia pestis KIM
uugaugcucuucuucac

SEQ ID NO: 2326741 - RNA, 11 nt, Yersinia pestis KIM
uugaucuaccu

SEQ ID NO: 2326742 - RNA, 16 nt, Yersinia pestis KIM
uugaggagcgauaaca

SEQ ID NO: 2326743 - RNA, 19 nt, Yersinia pestis KIM
uugaggcaggguauauguu

SEQ ID NO: 2326744 - RNA, 19 nt, Yersinia pestis KIM
uugaggauauuagggcuga

SEQ ID NO: 2326745 - RNA, 14 nt, Yersinia pestis KIM
uugaggaaauuuca

SEQ ID NO: 2326746 - RNA, 17 nt, Yersinia pestis KIM
uugaggaaauuucaguu

SEQ ID NO: 2326747 - RNA, 16 nt, Yersinia pestis KIM
uugagguuauugacaa

SEQ ID NO: 2326748 - RNA, 23 nt, Yersinia pestis KIM
uugaguacgcuaagacauuagga

SEQ ID NO: 2326749 - RNA, 18 nt, Yersinia pestis KIM
uugagugaaagccugcac

SEQ ID NO: 2326750 - RNA, 18 nt, Yersinia pestis KIM
uugagucgcgacaucaug

SEQ ID NO: 2326751 - RNA, 23 nt, Yersinia pestis KIM
uugaguagcaggccgacaauacc

SEQ ID NO: 2326752 - RNA, 21 nt, Yersinia pestis KIM
uugagccaccgcauuccagcg

SEQ ID NO: 2326753 - RNA, 20 nt, Yersinia pestis KIM
uugagccaauuaagaaaucu

SEQ ID NO: 2326754 - RNA, 13 nt, Yersinia pestis KIM
uugagcucagcca

SEQ ID NO: 2326755 - RNA, 21 nt, Yersinia pestis KIM
uucuugguacaaggucuugga

SEQ ID NO: 2326756 - RNA, 15 nt, Yersinia pestis KIM
uucuuguuuaguaau

SEQ ID NO: 2326757 - RNA, 12 nt, Yersinia pestis KIM
uucuuguauaua

SEQ ID NO: 2326758 - RNA, 22 nt, Yersinia pestis KIM
uucuugucaccugaguaauauu

SEQ ID NO: 2326759 - RNA, 21 nt, Yersinia pestis KIM
uucuuggaacaggccaaagcu

SEQ ID NO: 2326760 - RNA, 16 nt, Yersinia pestis KIM
uuuauugacuguaaau

SEQ ID NO: 2326761 - RNA, 21 nt, Yersinia pestis KIM
uuuauuggucaauaaaauuaa

SEQ ID NO: 2326762 - RNA, 15 nt, Yersinia pestis KIM
uuuaucuaucuguuc

SEQ ID NO: 2326763 - RNA, 20 nt, Yersinia pestis KIM
uuuaucuuccacucuuucaa

SEQ ID NO: 2326764 - RNA, 15 nt, Yersinia pestis KIM
uuuaucuuccacucu

SEQ ID NO: 2326765 - RNA, 19 nt, Yersinia pestis KIM
uuuaucuuguaaauaguca

SEQ ID NO: 2326766 - RNA, 13 nt, Yersinia pestis KIM
uuuaugacuucuu

SEQ ID NO: 2326767 - RNA, 16 nt, Yersinia pestis KIM
uuuauggauaaugucc

SEQ ID NO: 2326768 - RNA, 15 nt, Yersinia pestis KIM
uuuauggcuuauccc

SEQ ID NO: 2326769 - RNA, 13 nt, Yersinia pestis KIM
uuuaugcugccca

SEQ ID NO: 2326770 - RNA, 15 nt, Yersinia pestis KIM
uuuaucgaccacuuu

SEQ ID NO: 2326771 - RNA, 13 nt, Yersinia pestis KIM
uuuauccccuucg

SEQ ID NO: 2326772 - RNA, 16 nt, Yersinia pestis KIM
uuuauauucuuagcca

SEQ ID NO: 2326773 - RNA, 17 nt, Yersinia pestis KIM
uuuaucaauaggucagu

SEQ ID NO: 2326774 - RNA, 14 nt, Yersinia pestis KIM
uuuaucaaucagcu

SEQ ID NO: 2326775 - RNA, 15 nt, Yersinia pestis KIM
uuuagaugucagauu

SEQ ID NO: 2326776 - RNA, 14 nt, Yersinia pestis KIM
uuuagaucucagaa

SEQ ID NO: 2326777 - RNA, 12 nt, Yersinia pestis KIM
uuuauaucagau

SEQ ID NO: 2326778 - RNA, 21 nt, Yersinia pestis KIM
uuuauauuauuauaaauuuuc

SEQ ID NO: 2326779 - RNA, 14 nt, Yersinia pestis KIM
uuuaccgcaaccac

SEQ ID NO: 2326780 - RNA, 16 nt, Yersinia pestis KIM
uuuacggcucaccugg

SEQ ID NO: 2326781 - RNA, 20 nt, Yersinia pestis KIM
uuuaccuguuugcaacauua

SEQ ID NO: 2326782 - RNA, 16 nt, Yersinia pestis KIM
uuuaccguugggcuuu

SEQ ID NO: 2326783 - RNA, 22 nt, Yersinia pestis KIM
uuuacagcuauuccaaaauugc

SEQ ID NO: 2326784 - RNA, 13 nt, Yersinia pestis KIM
uuuacaggccaca

SEQ ID NO: 2326785 - RNA, 18 nt, Yersinia pestis KIM
uuuacgggcggcauaauc

SEQ ID NO: 2326786 - RNA, 21 nt, Yersinia pestis KIM
uuuacguagggcggccuuugg

SEQ ID NO: 2326787 - RNA, 16 nt, Yersinia pestis KIM
uuuacgugaucaucuu

SEQ ID NO: 2326788 - RNA, 14 nt, Yersinia pestis KIM
uuuacuugauaauu

SEQ ID NO: 2326789 - RNA, 13 nt, Yersinia pestis KIM
uuuacuuuaaauu

SEQ ID NO: 2326790 - RNA, 19 nt, Yersinia pestis KIM
uuuaaucgccugaugcuuu

SEQ ID NO: 2326791 - RNA, 19 nt, Yersinia pestis KIM
uuuaaugauugauuaucaa

SEQ ID NO: 2326792 - RNA, 16 nt, Yersinia pestis KIM
uuuaauaugcaaaaaa

SEQ ID NO: 2326793 - RNA, 20 nt, Yersinia pestis KIM
uuuaauagcccgcgaauuaa

SEQ ID NO: 2326794 - RNA, 13 nt, Yersinia pestis KIM
uuuaauaaccauu

SEQ ID NO: 2326795 - RNA, 16 nt, Yersinia pestis KIM
uuuaauaaccauuaau

SEQ ID NO: 2326796 - RNA, 14 nt, Yersinia pestis KIM
uuuaagccaauaau

SEQ ID NO: 2326797 - RNA, 22 nt, Yersinia pestis KIM
uuuaagccaauaauauaaucag

SEQ ID NO: 2326798 - RNA, 17 nt, Yersinia pestis KIM
uuuaaaacuguggcuga

SEQ ID NO: 2326799 - RNA, 14 nt, Yersinia pestis KIM
uuuaacuuuaucag

SEQ ID NO: 2326800 - RNA, 17 nt, Yersinia pestis KIM
uuuaacuuucaucccuu

SEQ ID NO: 2326801 - RNA, 22 nt, Yersinia pestis KIM
uuuaagcgggcuuuaauagcca

SEQ ID NO: 2326802 - RNA, 22 nt, Yersinia pestis KIM
uuuaagcugcagaggugaacga

SEQ ID NO: 2326803 - RNA, 20 nt, Yersinia pestis KIM
uuuaaguucacuugagagaa

SEQ ID NO: 2326804 - RNA, 16 nt, Yersinia pestis KIM
uugucauguugaccaa

SEQ ID NO: 2326805 - RNA, 19 nt, Yersinia pestis KIM
uuguccaacaucuccgcca

SEQ ID NO: 2326806 - RNA, 17 nt, Yersinia pestis KIM
uugucgcguguaggcga

SEQ ID NO: 2326807 - RNA, 13 nt, Yersinia pestis KIM
uugucagccaugc

SEQ ID NO: 2326808 - RNA, 22 nt, Yersinia pestis KIM
uugucagcagucugaagccuac

SEQ ID NO: 2326809 - RNA, 22 nt, Yersinia pestis KIM
uugucagcagucugagccucau

SEQ ID NO: 2326810 - RNA, 13 nt, Yersinia pestis KIM
uugucauacacgg

SEQ ID NO: 2326811 - RNA, 18 nt, Yersinia pestis KIM
uugucaccuaaccaaaca

SEQ ID NO: 2326812 - RNA, 22 nt, Yersinia pestis KIM
uugucaauaaccucaaaaggau

SEQ ID NO: 2326813 - RNA, 14 nt, Yersinia pestis KIM
uugucaaucacugg

SEQ ID NO: 2326814 - RNA, 21 nt, Yersinia pestis KIM
uugucaauaaccucaaaagga

SEQ ID NO: 2326815 - RNA, 16 nt, Yersinia pestis KIM
uuguauuuaaauaguc

SEQ ID NO: 2326816 - RNA, 14 nt, Yersinia pestis KIM
uuguauugcucagg

SEQ ID NO: 2326817 - RNA, 19 nt, Yersinia pestis KIM
uuguaccgauuuacguguu

SEQ ID NO: 2326818 - RNA, 16 nt, Yersinia pestis KIM
uuguacgugaagauaa

SEQ ID NO: 2326819 - RNA, 16 nt, Yersinia pestis KIM
uuguacuuuauuguua

SEQ ID NO: 2326820 - RNA, 20 nt, Yersinia pestis KIM
uuguagcgccagguaagaaa

SEQ ID NO: 2326821 - RNA, 19 nt, Yersinia pestis KIM
uuguagcccacugacacug

SEQ ID NO: 2326822 - RNA, 18 nt, Yersinia pestis KIM
uuguagcccacugacacu

SEQ ID NO: 2326823 - RNA, 13 nt, Yersinia pestis KIM
uuguaguaaccac

SEQ ID NO: 2326824 - RNA, 17 nt, Yersinia pestis KIM
uuguagguuaugacacc

SEQ ID NO: 2326825 - RNA, 14 nt, Yersinia pestis KIM
uuguagugaaugac

SEQ ID NO: 2326826 - RNA, 20 nt, Yersinia pestis KIM
uuguauacaauugccugauu

SEQ ID NO: 2326827 - RNA, 20 nt, Yersinia pestis KIM
uuguaagcgauccugcucaa

SEQ ID NO: 2326828 - RNA, 20 nt, Yersinia pestis KIM
uuguaagucagauugucaga

SEQ ID NO: 2326829 - RNA, 17 nt, Yersinia pestis KIM
uuguaaccgacuugccc

SEQ ID NO: 2326830 - RNA, 14 nt, Yersinia pestis KIM
uuguaaauuuuuuu

SEQ ID NO: 2326831 - RNA, 15 nt, Yersinia pestis KIM
uugguuuuaauaacc

SEQ ID NO: 2326832 - RNA, 11 nt, Yersinia pestis KIM
uugguuuauaa

SEQ ID NO: 2326833 - RNA, 14 nt, Yersinia pestis KIM
uugguuuauaacaa

SEQ ID NO: 2326834 - RNA, 15 nt, Yersinia pestis KIM
uuguucugcuggauc

SEQ ID NO: 2326835 - RNA, 15 nt, Yersinia pestis KIM
uuguucuaauaauaa

SEQ ID NO: 2326836 - RNA, 22 nt, Yersinia pestis KIM
uuguuuucguuuaaaaaauauc

SEQ ID NO: 2326837 - RNA, 18 nt, Yersinia pestis KIM
uuguuuugacuaaaauuc

SEQ ID NO: 2326838 - RNA, 20 nt, Yersinia pestis KIM
uuguguuucaucgacucuuu

SEQ ID NO: 2326839 - RNA, 22 nt, Yersinia pestis KIM
uuguucagcaccaguugaccau

SEQ ID NO: 2326840 - RNA, 21 nt, Yersinia pestis KIM
uuguucaggcagauaaaucca

SEQ ID NO: 2326841 - RNA, 22 nt, Yersinia pestis KIM
uugugucaucgcggaugccuuu

SEQ ID NO: 2326842 - RNA, 20 nt, Yersinia pestis KIM
uugugucguacacuauuuua

SEQ ID NO: 2326843 - RNA, 17 nt, Yersinia pestis KIM
uuguggcuaccaauuau

SEQ ID NO: 2326844 - RNA, 18 nt, Yersinia pestis KIM
uugucuguaauaauaauu

SEQ ID NO: 2326845 - RNA, 17 nt, Yersinia pestis KIM
uugucucuacucucugu

SEQ ID NO: 2326846 - RNA, 20 nt, Yersinia pestis KIM
uugucggcauaacaggugca

SEQ ID NO: 2326847 - RNA, 17 nt, Yersinia pestis KIM
uugucguuauuuucuau

SEQ ID NO: 2326848 - RNA, 21 nt, Yersinia pestis KIM
uugucuuuaauaaaaucaaaa

SEQ ID NO: 2326849 - RNA, 23 nt, Yersinia pestis KIM
uugucuuuaucgugggcgcagaa

SEQ ID NO: 2326850 - RNA, 16 nt, Yersinia pestis KIM
uugugcuuuuuggcaa

SEQ ID NO: 2326851 - RNA, 16 nt, Yersinia pestis KIM
uugugcguaaagaaaa

SEQ ID NO: 2326852 - RNA, 18 nt, Yersinia pestis KIM
uugugcgccggagaggcu

SEQ ID NO: 2326853 - RNA, 20 nt, Yersinia pestis KIM
uugugcgccaaccgcuugca

SEQ ID NO: 2326854 - RNA, 15 nt, Yersinia pestis KIM
uugugccccaagaag

SEQ ID NO: 2326855 - RNA, 14 nt, Yersinia pestis KIM
uugugcuccugaug

SEQ ID NO: 2326856 - RNA, 17 nt, Yersinia pestis KIM
uugugcuacggcaaaau

SEQ ID NO: 2326857 - RNA, 18 nt, Yersinia pestis KIM
uugugagucauuaauaga

SEQ ID NO: 2326858 - RNA, 21 nt, Yersinia pestis KIM
uugugaugcauauuauaauga

SEQ ID NO: 2326859 - RNA, 11 nt, Yersinia pestis KIM
uucugcugcca

SEQ ID NO: 2326860 - RNA, 12 nt, Yersinia pestis KIM
uucugcuuggac

SEQ ID NO: 2326861 - RNA, 23 nt, Yersinia pestis KIM
uucuggaaugagaugaacacaga

SEQ ID NO: 2326862 - RNA, 15 nt, Yersinia pestis KIM
uucugagauauguag

SEQ ID NO: 2326863 - RNA, 17 nt, Yersinia pestis KIM
uucuccgcgcaaccugg

SEQ ID NO: 2326864 - RNA, 19 nt, Yersinia pestis KIM
uucuccaacaacugccccu

SEQ ID NO: 2326865 - RNA, 16 nt, Yersinia pestis KIM
uucucauuaauaauga

SEQ ID NO: 2326866 - RNA, 22 nt, Yersinia pestis KIM
uucucaaccgcuggcaguugcc

SEQ ID NO: 2326867 - RNA, 18 nt, Yersinia pestis KIM
uucuaucgggcagguaaa

SEQ ID NO: 2326868 - RNA, 23 nt, Yersinia pestis KIM
uucuaucgggcagguaaauccuu

SEQ ID NO: 2326869 - RNA, 17 nt, Yersinia pestis KIM
uucuauccgaaaaauau

SEQ ID NO: 2326870 - RNA, 19 nt, Yersinia pestis KIM
uucuucauaacgcuuuuuc

SEQ ID NO: 2326871 - RNA, 13 nt, Yersinia pestis KIM
uucuucaucuaaa

SEQ ID NO: 2326872 - RNA, 15 nt, Yersinia pestis KIM
uucuucaucuaaaua

SEQ ID NO: 2326873 - RNA, 22 nt, Yersinia pestis KIM
uucuucagcgguagagaucucu

SEQ ID NO: 2326874 - RNA, 21 nt, Yersinia pestis KIM
uucuucauugcugcuguuauu

SEQ ID NO: 2326875 - RNA, 10 nt, Yersinia pestis KIM
uucuuccaac

SEQ ID NO: 2326876 - RNA, 11 nt, Yersinia pestis KIM
uucuuccaacg

SEQ ID NO: 2326877 - RNA, 14 nt, Yersinia pestis KIM
uucuuauuaaucaa

SEQ ID NO: 2326878 - RNA, 13 nt, Yersinia pestis KIM
uucuuaauuuuau

SEQ ID NO: 2326879 - RNA, 15 nt, Yersinia pestis KIM
uucuuacuaaaauau

SEQ ID NO: 2326880 - RNA, 16 nt, Yersinia pestis KIM
uucuuacuaaaauauc

SEQ ID NO: 2326881 - RNA, 17 nt, Yersinia pestis KIM
uucuuaggucaucguca

SEQ ID NO: 2326882 - RNA, 18 nt, Yersinia pestis KIM
uucuuaucaaucaaaaaa

SEQ ID NO: 2326883 - RNA, 14 nt, Yersinia pestis KIM
uucuuaucgauacu

SEQ ID NO: 2326884 - RNA, 13 nt, Yersinia pestis KIM
uucuguuccaggc

SEQ ID NO: 2326885 - RNA, 13 nt, Yersinia pestis KIM
uucuguucagauu

SEQ ID NO: 2326886 - RNA, 22 nt, Yersinia pestis KIM
uucugucggagccugauacacc

SEQ ID NO: 2326887 - RNA, 21 nt, Yersinia pestis KIM
uucuguagcugacacgccaua

SEQ ID NO: 2326888 - RNA, 13 nt, Yersinia pestis KIM
uucuggggucauc

SEQ ID NO: 2326889 - RNA, 23 nt, Yersinia pestis KIM
uucuggggcgguuuuccucuuua

SEQ ID NO: 2326890 - RNA, 17 nt, Yersinia pestis KIM
uucuggguacaacacaa

SEQ ID NO: 2326891 - RNA, 18 nt, Yersinia pestis KIM
uucggcuuucucuugcca

SEQ ID NO: 2326892 - RNA, 15 nt, Yersinia pestis KIM
uucggcuacuguuuu

SEQ ID NO: 2326893 - RNA, 15 nt, Yersinia pestis KIM
uucgcggccugcugu

SEQ ID NO: 2326894 - RNA, 16 nt, Yersinia pestis KIM
uucggcaggcagaaau

SEQ ID NO: 2326895 - RNA, 18 nt, Yersinia pestis KIM
uucgggcugaugaauaga

SEQ ID NO: 2326896 - RNA, 12 nt, Yersinia pestis KIM
uucgugaaagca

SEQ ID NO: 2326897 - RNA, 19 nt, Yersinia pestis KIM
uucgucuucgcccagauca

SEQ ID NO: 2326898 - RNA, 23 nt, Yersinia pestis KIM
uucgucgcgaauagccaagccuu

SEQ ID NO: 2326899 - RNA, 16 nt, Yersinia pestis KIM
uucgcccuaacauuga

SEQ ID NO: 2326900 - RNA, 17 nt, Yersinia pestis KIM
uucgcaaaaugccaaca

SEQ ID NO: 2326901 - RNA, 16 nt, Yersinia pestis KIM
uucgcaaaauuuauau

SEQ ID NO: 2326902 - RNA, 13 nt, Yersinia pestis KIM
uucgcaagaagcg

SEQ ID NO: 2326903 - RNA, 19 nt, Yersinia pestis KIM
uucgagguggcgauaaaga

SEQ ID NO: 2326904 - RNA, 15 nt, Yersinia pestis KIM
uucgagcggcauauc

SEQ ID NO: 2326905 - RNA, 16 nt, Yersinia pestis KIM
uucgagcggcauaucc

SEQ ID NO: 2326906 - RNA, 14 nt, Yersinia pestis KIM
uuccuucagccacc

SEQ ID NO: 2326907 - RNA, 14 nt, Yersinia pestis KIM
uucgacaaaaucag

SEQ ID NO: 2326908 - RNA, 17 nt, Yersinia pestis KIM
uucgacaggcaauuauc

SEQ ID NO: 2326909 - RNA, 18 nt, Yersinia pestis KIM
uucgacaggcaauuaucc

SEQ ID NO: 2326910 - RNA, 13 nt, Yersinia pestis KIM
uucgacauucucu

SEQ ID NO: 2326911 - RNA, 21 nt, Yersinia pestis KIM
uucgacaucagguuguauuuu

SEQ ID NO: 2326912 - RNA, 23 nt, Yersinia pestis KIM
uuccguuauuaaacagucuuauu

SEQ ID NO: 2326913 - RNA, 13 nt, Yersinia pestis KIM
uuccucugugacu

SEQ ID NO: 2326914 - RNA, 18 nt, Yersinia pestis KIM
uuccuuauaaauccgcua

SEQ ID NO: 2326915 - RNA, 13 nt, Yersinia pestis KIM
uuccuuauaaauc

SEQ ID NO: 2326916 - RNA, 16 nt, Yersinia pestis KIM
uuccuuaccugaugug

SEQ ID NO: 2326917 - RNA, 18 nt, Yersinia pestis KIM
uucccuaccguaucaacg

SEQ ID NO: 2326918 - RNA, 13 nt, Yersinia pestis KIM
uucccgugucaau

SEQ ID NO: 2326919 - RNA, 11 nt, Yersinia pestis KIM
uuccccuucaa

SEQ ID NO: 2326920 - RNA, 14 nt, Yersinia pestis KIM
uucccgcucuucac

SEQ ID NO: 2326921 - RNA, 18 nt, Yersinia pestis KIM
uucccggcgauucuccac

SEQ ID NO: 2326922 - RNA, 14 nt, Yersinia pestis KIM
uuccccccagucac

SEQ ID NO: 2326923 - RNA, 16 nt, Yersinia pestis KIM
uuccaaucugcgcccu

SEQ ID NO: 2326924 - RNA, 21 nt, Yersinia pestis KIM
uuccgccucuuuuuccacacc

SEQ ID NO: 2326925 - RNA, 20 nt, Yersinia pestis KIM
uuccgccgccaacagugaau

SEQ ID NO: 2326926 - RNA, 10 nt, Yersinia pestis KIM
uuccggcgua

SEQ ID NO: 2326927 - RNA, 17 nt, Yersinia pestis KIM
uucccuguucucuguuu

SEQ ID NO: 2326928 - RNA, 20 nt, Yersinia pestis KIM
uucccuguucucuguuucca

SEQ ID NO: 2326929 - RNA, 22 nt, Yersinia pestis KIM
uucccuguauaaaaauagccuu

SEQ ID NO: 2326930 - RNA, 17 nt, Yersinia pestis KIM
uucccuucaggaucuuu

SEQ ID NO: 2326931 - RNA, 19 nt, Yersinia pestis KIM
uucaugguaaauuccuaua

SEQ ID NO: 2326932 - RNA, 14 nt, Yersinia pestis KIM
uucauguugcaaca

SEQ ID NO: 2326933 - RNA, 15 nt, Yersinia pestis KIM
uucauuaaaaaauaa

SEQ ID NO: 2326934 - RNA, 17 nt, Yersinia pestis KIM
uucauuaaaaaauaauu

SEQ ID NO: 2326935 - RNA, 21 nt, Yersinia pestis KIM
uucaucugaccaaacauuguc

SEQ ID NO: 2326936 - RNA, 21 nt, Yersinia pestis KIM
uucaucugcacugguaccuuu

SEQ ID NO: 2326937 - RNA, 22 nt, Yersinia pestis KIM
uucaugaggcucagacugcuga

SEQ ID NO: 2326938 - RNA, 17 nt, Yersinia pestis KIM
uucaugacaaauugcaa

SEQ ID NO: 2326939 - RNA, 14 nt, Yersinia pestis KIM
uucaugacagguuu

SEQ ID NO: 2326940 - RNA, 20 nt, Yersinia pestis KIM
uucaucuuuaacaacaacca

SEQ ID NO: 2326941 - RNA, 22 nt, Yersinia pestis KIM
uuccaaaugacagcaucaauau

SEQ ID NO: 2326942 - RNA, 20 nt, Yersinia pestis KIM
uuccaacugauaauucagug

SEQ ID NO: 2326943 - RNA, 22 nt, Yersinia pestis KIM
uucauuuuuugggaugaaaaau

SEQ ID NO: 2326944 - RNA, 15 nt, Yersinia pestis KIM
uucauuuuguauuuu

SEQ ID NO: 2326945 - RNA, 23 nt, Yersinia pestis KIM
uucauuuuaacaacccauuuccc

SEQ ID NO: 2326946 - RNA, 12 nt, Yersinia pestis KIM
uucauuuuaaaa

SEQ ID NO: 2326947 - RNA, 14 nt, Yersinia pestis KIM
uucauuuuaaaaaa

SEQ ID NO: 2326948 - RNA, 16 nt, Yersinia pestis KIM
uucauuuuaaaaaaau

SEQ ID NO: 2326949 - RNA, 16 nt, Yersinia pestis KIM
uucauuuugcuggaaa

SEQ ID NO: 2326950 - RNA, 20 nt, Yersinia pestis KIM
uucauuaucauguaaggcaa

SEQ ID NO: 2326951 - RNA, 21 nt, Yersinia pestis KIM
uucauugccgaugucaauaaa

SEQ ID NO: 2326952 - RNA, 16 nt, Yersinia pestis KIM
uucauucguuagcucu

SEQ ID NO: 2326953 - RNA, 18 nt, Yersinia pestis KIM
uucauugguaauuucagg

SEQ ID NO: 2326954 - RNA, 12 nt, Yersinia pestis KIM
uucauuuaacug

SEQ ID NO: 2326955 - RNA, 14 nt, Yersinia pestis KIM
uucauuuccucugg

SEQ ID NO: 2326956 - RNA, 14 nt, Yersinia pestis KIM
uucauuucaggacu

SEQ ID NO: 2326957 - RNA, 21 nt, Yersinia pestis KIM
uucauauucaugguuucaaaa

SEQ ID NO: 2326958 - RNA, 17 nt, Yersinia pestis KIM
uucauaucguccaaagg

SEQ ID NO: 2326959 - RNA, 21 nt, Yersinia pestis KIM
uucauauccgaugauauaccc

SEQ ID NO: 2326960 - RNA, 20 nt, Yersinia pestis KIM
uucaucaaggauaagaaucu

SEQ ID NO: 2326961 - RNA, 16 nt, Yersinia pestis KIM
uucauauauugcauuu

SEQ ID NO: 2326962 - RNA, 13 nt, Yersinia pestis KIM
uucauacaucauu

SEQ ID NO: 2326963 - RNA, 19 nt, Yersinia pestis KIM
uucauacgaucuuauuaau

SEQ ID NO: 2326964 - RNA, 14 nt, Yersinia pestis KIM
uucauagaacuuaa

SEQ ID NO: 2326965 - RNA, 19 nt, Yersinia pestis KIM
uucauacggcgauauuuau

SEQ ID NO: 2326966 - RNA, 17 nt, Yersinia pestis KIM
uucaucaucaacaacca

SEQ ID NO: 2326967 - RNA, 21 nt, Yersinia pestis KIM
uucaucagucacuaaaccauu

SEQ ID NO: 2326968 - RNA, 18 nt, Yersinia pestis KIM
uucaucaccagucagccu

SEQ ID NO: 2326969 - RNA, 15 nt, Yersinia pestis KIM
uucaucaguaaaaua

SEQ ID NO: 2326970 - RNA, 17 nt, Yersinia pestis KIM
uucaucagagucuguca

SEQ ID NO: 2326971 - RNA, 18 nt, Yersinia pestis KIM
uucauccuaaagauaauu

SEQ ID NO: 2326972 - RNA, 24 nt, Yersinia pestis KIM
uucauccuaaagauaauuaauuca

SEQ ID NO: 2326973 - RNA, 17 nt, Yersinia pestis KIM
uucaucccaaucaucau

SEQ ID NO: 2326974 - RNA, 18 nt, Yersinia pestis KIM
uucaucccaaucaucauc

SEQ ID NO: 2326975 - RNA, 22 nt, Yersinia pestis KIM
uucaucgcccuguaacuuuauu

SEQ ID NO: 2326976 - RNA, 21 nt, Yersinia pestis KIM
uucaucgcgaccaauucauca

SEQ ID NO: 2326977 - RNA, 14 nt, Yersinia pestis KIM
uucaucgacucuuu

SEQ ID NO: 2326978 - RNA, 15 nt, Yersinia pestis KIM
uucagucaguaggcu

SEQ ID NO: 2326979 - RNA, 22 nt, Yersinia pestis KIM
uucagugcgauguuuuccaacu

SEQ ID NO: 2326980 - RNA, 18 nt, Yersinia pestis KIM
uucagcguugacaccaga

SEQ ID NO: 2326981 - RNA, 19 nt, Yersinia pestis KIM
uucagcguuuugaucauca

SEQ ID NO: 2326982 - RNA, 21 nt, Yersinia pestis KIM
uucagguaccccauaaauccc

SEQ ID NO: 2326983 - RNA, 16 nt, Yersinia pestis KIM
uucauaaaaaaagaag

SEQ ID NO: 2326984 - RNA, 19 nt, Yersinia pestis KIM
uucaguuuauuuaagcuga

SEQ ID NO: 2326985 - RNA, 13 nt, Yersinia pestis KIM
uucaguuacucac

SEQ ID NO: 2326986 - RNA, 14 nt, Yersinia pestis KIM
uucaguucuucacg

SEQ ID NO: 2326987 - RNA, 20 nt, Yersinia pestis KIM
uucaguugauugcaaaacau

SEQ ID NO: 2326988 - RNA, 14 nt, Yersinia pestis KIM
uucaauugaaauaa

SEQ ID NO: 2326989 - RNA, 14 nt, Yersinia pestis KIM
uucaauugccaugc

SEQ ID NO: 2326990 - RNA, 21 nt, Yersinia pestis KIM
uucaauugcccccuagugaug

SEQ ID NO: 2326991 - RNA, 22 nt, Yersinia pestis KIM
uucaauuaccgugguuauuggc

SEQ ID NO: 2326992 - RNA, 21 nt, Yersinia pestis KIM
uucaagucaauaaauaaaaac

SEQ ID NO: 2326993 - RNA, 21 nt, Yersinia pestis KIM
uucaaggugacuauuuaaaua

SEQ ID NO: 2326994 - RNA, 15 nt, Yersinia pestis KIM
uucaauggcugccca

SEQ ID NO: 2326995 - RNA, 10 nt, Yersinia pestis KIM
uucaccagua

SEQ ID NO: 2326996 - RNA, 16 nt, Yersinia pestis KIM
uucaccaucugccugc

SEQ ID NO: 2326997 - RNA, 19 nt, Yersinia pestis KIM
uucacgcccuacugagaau

SEQ ID NO: 2326998 - RNA, 17 nt, Yersinia pestis KIM
uucaccaaauugcagaa

SEQ ID NO: 2326999 - RNA, 19 nt, Yersinia pestis KIM
uucaccacgauuagccaua

SEQ ID NO: 2327000 - RNA, 20 nt, Yersinia pestis KIM
uucacggacagcaaccacuu

SEQ ID NO: 2327001 - RNA, 19 nt, Yersinia pestis KIM
uucacuccggcaucauccu

SEQ ID NO: 2327002 - RNA, 18 nt, Yersinia pestis KIM
uucacucuguuuuaaaaa

SEQ ID NO: 2327003 - RNA, 19 nt, Yersinia pestis KIM
uucacugaguugcaggaau

SEQ ID NO: 2327004 - RNA, 23 nt, Yersinia pestis KIM
uucacuggggagaucagugccag

SEQ ID NO: 2327005 - RNA, 21 nt, Yersinia pestis KIM
uucacuggggagaucagugcc

SEQ ID NO: 2327006 - RNA, 13 nt, Yersinia pestis KIM
uucacugguuuuc

SEQ ID NO: 2327007 - RNA, 20 nt, Yersinia pestis KIM
uucacuuacugccaaagaau

SEQ ID NO: 2327008 - RNA, 22 nt, Yersinia pestis KIM
uucacuuuuuaucuaaacagua

SEQ ID NO: 2327009 - RNA, 15 nt, Yersinia pestis KIM
uucacuuucaacuau

SEQ ID NO: 2327010 - RNA, 21 nt, Yersinia pestis KIM
uucagcaaagagucgcaaaac

SEQ ID NO: 2327011 - RNA, 13 nt, Yersinia pestis KIM
uucagauuuacca

SEQ ID NO: 2327012 - RNA, 15 nt, Yersinia pestis KIM
uucagaagacaauaa

SEQ ID NO: 2327013 - RNA, 18 nt, Yersinia pestis KIM
uuauugaugagcuguaga

SEQ ID NO: 2327014 - RNA, 17 nt, Yersinia pestis KIM
uuauugggcugccugug

SEQ ID NO: 2327015 - RNA, 18 nt, Yersinia pestis KIM
uuauuggaaguacuuauu

SEQ ID NO: 2327016 - RNA, 13 nt, Yersinia pestis KIM
uuauuuauaaaac

SEQ ID NO: 2327017 - RNA, 16 nt, Yersinia pestis KIM
uuauugguuauuuuau

SEQ ID NO: 2327018 - RNA, 18 nt, Yersinia pestis KIM
uuauuggucaauaaaauu

SEQ ID NO: 2327019 - RNA, 14 nt, Yersinia pestis KIM
uuauuuacaccgug

SEQ ID NO: 2327020 - RNA, 15 nt, Yersinia pestis KIM
uuauuguacuuuauu

SEQ ID NO: 2327021 - RNA, 23 nt, Yersinia pestis KIM
uuauuucgauucauucagcgucu

SEQ ID NO: 2327022 - RNA, 23 nt, Yersinia pestis KIM
uuauuucacacuguuuaguucac

SEQ ID NO: 2327023 - RNA, 23 nt, Yersinia pestis KIM
uuauuuauaugauaauaguucau

SEQ ID NO: 2327024 - RNA, 17 nt, Yersinia pestis KIM
uuaggcgggcaguauaa

SEQ ID NO: 2327025 - RNA, 18 nt, Yersinia pestis KIM
uuaggccaauuuggccaa

SEQ ID NO: 2327026 - RNA, 21 nt, Yersinia pestis KIM
uuaggcaccacuacacgcuuu

SEQ ID NO: 2327027 - RNA, 17 nt, Yersinia pestis KIM
uuaggauaaccaauucu

SEQ ID NO: 2327028 - RNA, 15 nt, Yersinia pestis KIM
uuauucccacuuauu

SEQ ID NO: 2327029 - RNA, 20 nt, Yersinia pestis KIM
uuauucauaucgcucaucau

SEQ ID NO: 2327030 - RNA, 17 nt, Yersinia pestis KIM
uuauucagcuucagcuc

SEQ ID NO: 2327031 - RNA, 15 nt, Yersinia pestis KIM
uuauucagcaacucg

SEQ ID NO: 2327032 - RNA, 13 nt, Yersinia pestis KIM
uuauucaauacug

SEQ ID NO: 2327033 - RNA, 14 nt, Yersinia pestis KIM
uuauuauguaaaua

SEQ ID NO: 2327034 - RNA, 12 nt, Yersinia pestis KIM
uuauuauuauuu

SEQ ID NO: 2327035 - RNA, 20 nt, Yersinia pestis KIM
uuauuauguuugcuagggcu

SEQ ID NO: 2327036 - RNA, 18 nt, Yersinia pestis KIM
uucaaauaaguguuucaa

SEQ ID NO: 2327037 - RNA, 22 nt, Yersinia pestis KIM
uucaaauaaguauuucaaauaa

SEQ ID NO: 2327038 - RNA, 17 nt, Yersinia pestis KIM
uucaaauaauucagacg

SEQ ID NO: 2327039 - RNA, 21 nt, Yersinia pestis KIM
uuauuuuguuuguaaauuuua

SEQ ID NO: 2327040 - RNA, 12 nt, Yersinia pestis KIM
uuauuuuaauug

SEQ ID NO: 2327041 - RNA, 13 nt, Yersinia pestis KIM
uuauuuucacuuu

SEQ ID NO: 2327042 - RNA, 14 nt, Yersinia pestis KIM
uuauuuucgaccaa

SEQ ID NO: 2327043 - RNA, 22 nt, Yersinia pestis KIM
uucaacguggaaguucagaucc

SEQ ID NO: 2327044 - RNA, 17 nt, Yersinia pestis KIM
uucaagcguacaagaau

SEQ ID NO: 2327045 - RNA, 19 nt, Yersinia pestis KIM
uucaacaaauucaccagca

SEQ ID NO: 2327046 - RNA, 17 nt, Yersinia pestis KIM
uggcgggauccaucuga

SEQ ID NO: 2327047 - RNA, 17 nt, Yersinia pestis KIM
uggcgcuacuuccccua

SEQ ID NO: 2327048 - RNA, 16 nt, Yersinia pestis KIM
uggcgcugaucaucau

SEQ ID NO: 2327049 - RNA, 16 nt, Yersinia pestis KIM
uggcgaucaagguuuc

SEQ ID NO: 2327050 - RNA, 19 nt, Yersinia pestis KIM
uggccgggauuugcucaga

SEQ ID NO: 2327051 - RNA, 17 nt, Yersinia pestis KIM
uggccggcuacugguca

SEQ ID NO: 2327052 - RNA, 17 nt, Yersinia pestis KIM
uggccgccgcggugaag

SEQ ID NO: 2327053 - RNA, 21 nt, Yersinia pestis KIM
uggccuauuaagauaauuauc

SEQ ID NO: 2327054 - RNA, 20 nt, Yersinia pestis KIM
uggccucagacuaaugacaa

SEQ ID NO: 2327055 - RNA, 14 nt, Yersinia pestis KIM
uggccuaacaacug

SEQ ID NO: 2327056 - RNA, 21 nt, Yersinia pestis KIM
uggccuacggaggucaaauga

SEQ ID NO: 2327057 - RNA, 14 nt, Yersinia pestis KIM
uggcauuuaaaagg

SEQ ID NO: 2327058 - RNA, 23 nt, Yersinia pestis KIM
uggcauuuaaaaggcgcuggauu

SEQ ID NO: 2327059 - RNA, 20 nt, Yersinia pestis KIM
uggcagcguuucaccaaaca

SEQ ID NO: 2327060 - RNA, 18 nt, Yersinia pestis KIM
uggccaugaaucaaauua

SEQ ID NO: 2327061 - RNA, 15 nt, Yersinia pestis KIM
uggccaguaaaaccu

SEQ ID NO: 2327062 - RNA, 13 nt, Yersinia pestis KIM
uggcaaucauggg

SEQ ID NO: 2327063 - RNA, 23 nt, Yersinia pestis KIM
uggcaauuaugacguucaguagu

SEQ ID NO: 2327064 - RNA, 19 nt, Yersinia pestis KIM
uggcaaccccuaauccagc

SEQ ID NO: 2327065 - RNA, 16 nt, Yersinia pestis KIM
uggcaacaucaggcuu

SEQ ID NO: 2327066 - RNA, 18 nt, Yersinia pestis KIM
uggcaauaauucagauga

SEQ ID NO: 2327067 - RNA, 19 nt, Yersinia pestis KIM
uggcaccguggauaaacaa

SEQ ID NO: 2327068 - RNA, 17 nt, Yersinia pestis KIM
uggcacgccaguuggga

SEQ ID NO: 2327069 - RNA, 17 nt, Yersinia pestis KIM
uggcaccauuugcccug

SEQ ID NO: 2327070 - RNA, 19 nt, Yersinia pestis KIM
uggcaccacggucagagau

SEQ ID NO: 2327071 - RNA, 15 nt, Yersinia pestis KIM
uggauucuugcugca

SEQ ID NO: 2327072 - RNA, 18 nt, Yersinia pestis KIM
uggcaaaccggacauaau

SEQ ID NO: 2327073 - RNA, 19 nt, Yersinia pestis KIM
uggcaaacauccguuccca

SEQ ID NO: 2327074 - RNA, 13 nt, Yersinia pestis KIM
uggcaaaggccag

SEQ ID NO: 2327075 - RNA, 18 nt, Yersinia pestis KIM
uggcaaauuuagccgcaa

SEQ ID NO: 2327076 - RNA, 14 nt, Yersinia pestis KIM
uggauuuaaugcug

SEQ ID NO: 2327077 - RNA, 19 nt, Yersinia pestis KIM
ugguccacagucaguucau

SEQ ID NO: 2327078 - RNA, 14 nt, Yersinia pestis KIM
uggucauuuuuccc

SEQ ID NO: 2327079 - RNA, 20 nt, Yersinia pestis KIM
uggucauuaauuucaccaca

SEQ ID NO: 2327080 - RNA, 15 nt, Yersinia pestis KIM
ugguccccagagcgc

SEQ ID NO: 2327081 - RNA, 15 nt, Yersinia pestis KIM
uggucgaugaccugc

SEQ ID NO: 2327082 - RNA, 16 nt, Yersinia pestis KIM
uggucagcacaaacag

SEQ ID NO: 2327083 - RNA, 18 nt, Yersinia pestis KIM
uggucagcacuuccaacu

SEQ ID NO: 2327084 - RNA, 14 nt, Yersinia pestis KIM
uggucaguuuaaug

SEQ ID NO: 2327085 - RNA, 17 nt, Yersinia pestis KIM
uggucauaaucaucugc

SEQ ID NO: 2327086 - RNA, 18 nt, Yersinia pestis KIM
uggucaguugaauauucc

SEQ ID NO: 2327087 - RNA, 13 nt, Yersinia pestis KIM
uggucauccacaa

SEQ ID NO: 2327088 - RNA, 18 nt, Yersinia pestis KIM
uggucauccacaaccaga

SEQ ID NO: 2327089 - RNA, 21 nt, Yersinia pestis KIM
uggucagcaauaaccaacggg

SEQ ID NO: 2327090 - RNA, 22 nt, Yersinia pestis KIM
uggucaccgccaaaugaaaacc

SEQ ID NO: 2327091 - RNA, 24 nt, Yersinia pestis KIM
uggucacuguaguaaagcagcauc

SEQ ID NO: 2327092 - RNA, 19 nt, Yersinia pestis KIM
uggucaaggugauuucaaa

SEQ ID NO: 2327093 - RNA, 18 nt, Yersinia pestis KIM
uggucaccacauccgcgg

SEQ ID NO: 2327094 - RNA, 20 nt, Yersinia pestis KIM
ugguaaccgguuugggcagg

SEQ ID NO: 2327095 - RNA, 16 nt, Yersinia pestis KIM
ugguaccaaucuccaa

SEQ ID NO: 2327096 - RNA, 13 nt, Yersinia pestis KIM
ugguaauuucagg

SEQ ID NO: 2327097 - RNA, 13 nt, Yersinia pestis KIM
uggguuaaugcug

SEQ ID NO: 2327098 - RNA, 17 nt, Yersinia pestis KIM
uggguuaaaaacuuuua

SEQ ID NO: 2327099 - RNA, 19 nt, Yersinia pestis KIM
uggguuucgacauccaaca

SEQ ID NO: 2327100 - RNA, 14 nt, Yersinia pestis KIM
uggguucaucaacu

SEQ ID NO: 2327101 - RNA, 17 nt, Yersinia pestis KIM
ugguaccggcaccaaga

SEQ ID NO: 2327102 - RNA, 19 nt, Yersinia pestis KIM
ugguacugugucuuuaggg

SEQ ID NO: 2327103 - RNA, 19 nt, Yersinia pestis KIM
ugguacggaaaauaggggc

SEQ ID NO: 2327104 - RNA, 14 nt, Yersinia pestis KIM
ugguagcaccacau

SEQ ID NO: 2327105 - RNA, 17 nt, Yersinia pestis KIM
ugguauagacuguuuua

SEQ ID NO: 2327106 - RNA, 12 nt, Yersinia pestis KIM
ugguaugccacu

SEQ ID NO: 2327107 - RNA, 22 nt, Yersinia pestis KIM
uggggccaccuaauccaaggcg

SEQ ID NO: 2327108 - RNA, 23 nt, Yersinia pestis KIM
uggggcacaauucuugaaauuau

SEQ ID NO: 2327109 - RNA, 14 nt, Yersinia pestis KIM
ugggugaacacaga

SEQ ID NO: 2327110 - RNA, 17 nt, Yersinia pestis KIM
ugggugaugugacguca

SEQ ID NO: 2327111 - RNA, 22 nt, Yersinia pestis KIM
ugggugccucaacgcaccccac

SEQ ID NO: 2327112 - RNA, 20 nt, Yersinia pestis KIM
ugggcgguaguauuuguagu

SEQ ID NO: 2327113 - RNA, 17 nt, Yersinia pestis KIM
ugggcgggcaccaugcc

SEQ ID NO: 2327114 - RNA, 16 nt, Yersinia pestis KIM
ugggcgggaucuccag

SEQ ID NO: 2327115 - RNA, 21 nt, Yersinia pestis KIM
ugggcgggaucuccagaagca

SEQ ID NO: 2327116 - RNA, 20 nt, Yersinia pestis KIM
ugggcuaaaacucaaauaga

SEQ ID NO: 2327117 - RNA, 18 nt, Yersinia pestis KIM
uggggacaggcuccuccu

SEQ ID NO: 2327118 - RNA, 21 nt, Yersinia pestis KIM
ugggcgcauaaaaugagccug

SEQ ID NO: 2327119 - RNA, 14 nt, Yersinia pestis KIM
ugggcaaucuccag

SEQ ID NO: 2327120 - RNA, 17 nt, Yersinia pestis KIM
ugggauucguuaguaua

SEQ ID NO: 2327121 - RNA, 16 nt, Yersinia pestis KIM
uggcuuugcaccauca

SEQ ID NO: 2327122 - RNA, 14 nt, Yersinia pestis KIM
uggcuuuuucacac

SEQ ID NO: 2327123 - RNA, 23 nt, Yersinia pestis KIM
uggcuuuuuuaauaaaaaacuga

SEQ ID NO: 2327124 - RNA, 13 nt, Yersinia pestis KIM
uggcuuuuuuaau

SEQ ID NO: 2327125 - RNA, 20 nt, Yersinia pestis KIM
uggcguucaccgguaugcag

SEQ ID NO: 2327126 - RNA, 20 nt, Yersinia pestis KIM
uggcguugacagacaacggg

SEQ ID NO: 2327127 - RNA, 23 nt, Yersinia pestis KIM
uggcguugccgugcugucagcca

SEQ ID NO: 2327128 - RNA, 16 nt, Yersinia pestis KIM
uggcguuacagcaagg

SEQ ID NO: 2327129 - RNA, 13 nt, Yersinia pestis KIM
uggcuucugcuuc

SEQ ID NO: 2327130 - RNA, 23 nt, Yersinia pestis KIM
uggcuuuacggcucaccuggccu

SEQ ID NO: 2327131 - RNA, 17 nt, Yersinia pestis KIM
uggcuuagucauuaaga

SEQ ID NO: 2327132 - RNA, 21 nt, Yersinia pestis KIM
ugugcucacaaucuucuucag

SEQ ID NO: 2327133 - RNA, 15 nt, Yersinia pestis KIM
ugugcguuggcagcu

SEQ ID NO: 2327134 - RNA, 15 nt, Yersinia pestis KIM
ugugcguaaagaaaa

SEQ ID NO: 2327135 - RNA, 19 nt, Yersinia pestis KIM
ugugcugcuaauauuuaua

SEQ ID NO: 2327136 - RNA, 18 nt, Yersinia pestis KIM
uguggauccagcaccaca

SEQ ID NO: 2327137 - RNA, 15 nt, Yersinia pestis KIM
ugugggcacucgcaa

SEQ ID NO: 2327138 - RNA, 20 nt, Yersinia pestis KIM
ugugucauuaccuggacgcu

SEQ ID NO: 2327139 - RNA, 17 nt, Yersinia pestis KIM
uguguaaacuccuugga

SEQ ID NO: 2327140 - RNA, 18 nt, Yersinia pestis KIM
ugugguuguuuuuuccca

SEQ ID NO: 2327141 - RNA, 14 nt, Yersinia pestis KIM
ugugguauagguau

SEQ ID NO: 2327142 - RNA, 18 nt, Yersinia pestis KIM
uguuaccuaaccaaacau

SEQ ID NO: 2327143 - RNA, 20 nt, Yersinia pestis KIM
uguuaccuaaccaaacauug

SEQ ID NO: 2327144 - RNA, 18 nt, Yersinia pestis KIM
uguuacccgcgaucauuu

SEQ ID NO: 2327145 - RNA, 22 nt, Yersinia pestis KIM
uguuaccgcgcuugcaucaacu

SEQ ID NO: 2327146 - RNA, 15 nt, Yersinia pestis KIM
uguuaccccuucucc

SEQ ID NO: 2327147 - RNA, 15 nt, Yersinia pestis KIM
uguuacugcuuaccu

SEQ ID NO: 2327148 - RNA, 14 nt, Yersinia pestis KIM
uguuaauuuaaaca

SEQ ID NO: 2327149 - RNA, 17 nt, Yersinia pestis KIM
uguuaauccuaaugaac

SEQ ID NO: 2327150 - RNA, 23 nt, Yersinia pestis KIM
uguuaacucagccacaagauagu

SEQ ID NO: 2327151 - RNA, 20 nt, Yersinia pestis KIM
uguuaacauccagaccuuca

SEQ ID NO: 2327152 - RNA, 13 nt, Yersinia pestis KIM
uguguuuuggcua

SEQ ID NO: 2327153 - RNA, 20 nt, Yersinia pestis KIM
uguuaaauucgcuuuucgca

SEQ ID NO: 2327154 - RNA, 12 nt, Yersinia pestis KIM
uguuaaaccccc

SEQ ID NO: 2327155 - RNA, 11 nt, Yersinia pestis KIM
uguuaaaacag

SEQ ID NO: 2327156 - RNA, 12 nt, Yersinia pestis KIM
uguuaaaacagg

SEQ ID NO: 2327157 - RNA, 14 nt, Yersinia pestis KIM
ugugucuuaagccu

SEQ ID NO: 2327158 - RNA, 16 nt, Yersinia pestis KIM
ugugucgcuauuuccg

SEQ ID NO: 2327159 - RNA, 14 nt, Yersinia pestis KIM
uguguguauuuaaa

SEQ ID NO: 2327160 - RNA, 13 nt, Yersinia pestis KIM
ugugugucuuuaa

SEQ ID NO: 2327161 - RNA, 19 nt, Yersinia pestis KIM
uguguugaaauuuguucaa

SEQ ID NO: 2327162 - RNA, 14 nt, Yersinia pestis KIM
uguguuuaaaucuu

SEQ ID NO: 2327163 - RNA, 21 nt, Yersinia pestis KIM
ugugauaaccguucaagaggg

SEQ ID NO: 2327164 - RNA, 15 nt, Yersinia pestis KIM
ugugcggauggcugc

SEQ ID NO: 2327165 - RNA, 23 nt, Yersinia pestis KIM
ugugcgcggcuagccaccucacu

SEQ ID NO: 2327166 - RNA, 16 nt, Yersinia pestis KIM
ugugagauaacacaua

SEQ ID NO: 2327167 - RNA, 16 nt, Yersinia pestis KIM
ugugacgcuugaauau

SEQ ID NO: 2327168 - RNA, 19 nt, Yersinia pestis KIM
ugucugccgcucaugcccc

SEQ ID NO: 2327169 - RNA, 13 nt, Yersinia pestis KIM
ugucugcuguugc

SEQ ID NO: 2327170 - RNA, 15 nt, Yersinia pestis KIM
ugucugcuguugcca

SEQ ID NO: 2327171 - RNA, 18 nt, Yersinia pestis KIM
ugucuggguggcugaaau

SEQ ID NO: 2327172 - RNA, 20 nt, Yersinia pestis KIM
ugucuggguggcugaaauac

SEQ ID NO: 2327173 - RNA, 12 nt, Yersinia pestis KIM
ugucuuaagccu

SEQ ID NO: 2327174 - RNA, 14 nt, Yersinia pestis KIM
ugucuguaauaaua

SEQ ID NO: 2327175 - RNA, 19 nt, Yersinia pestis KIM
ugugaauuuaucaggcuaa

SEQ ID NO: 2327176 - RNA, 22 nt, Yersinia pestis KIM
ugucuuaugauauagcuguuug

SEQ ID NO: 2327177 - RNA, 21 nt, Yersinia pestis KIM
ugucuuaggugacaggcaaag

SEQ ID NO: 2327178 - RNA, 18 nt, Yersinia pestis KIM
uguccagccaguugaucg

SEQ ID NO: 2327179 - RNA, 20 nt, Yersinia pestis KIM
uguccagccaguugaucggc

SEQ ID NO: 2327180 - RNA, 14 nt, Yersinia pestis KIM
uguccaaaggaagg

SEQ ID NO: 2327181 - RNA, 12 nt, Yersinia pestis KIM
uguccaagaagc

SEQ ID NO: 2327182 - RNA, 20 nt, Yersinia pestis KIM
ugucauugcuguuguuauua

SEQ ID NO: 2327183 - RNA, 13 nt, Yersinia pestis KIM
ugucauuuggauu

SEQ ID NO: 2327184 - RNA, 13 nt, Yersinia pestis KIM
ugucauucuauca

SEQ ID NO: 2327185 - RNA, 19 nt, Yersinia pestis KIM
ugucauguugaccaaacag

SEQ ID NO: 2327186 - RNA, 18 nt, Yersinia pestis KIM
ugucuauguuugaugguu

SEQ ID NO: 2327187 - RNA, 14 nt, Yersinia pestis KIM
ugucuauuuucauu

SEQ ID NO: 2327188 - RNA, 17 nt, Yersinia pestis KIM
ugucaucgcuaaauacu

SEQ ID NO: 2327189 - RNA, 15 nt, Yersinia pestis KIM
ugucauggugcuacc

SEQ ID NO: 2327190 - RNA, 15 nt, Yersinia pestis KIM
ugucaugaguguugg

SEQ ID NO: 2327191 - RNA, 12 nt, Yersinia pestis KIM
ugucagucaaaa

SEQ ID NO: 2327192 - RNA, 19 nt, Yersinia pestis KIM
ugucagucaaaagaaacug

SEQ ID NO: 2327193 - RNA, 23 nt, Yersinia pestis KIM
ugucagauaucugcucauuacca

SEQ ID NO: 2327194 - RNA, 23 nt, Yersinia pestis KIM
ugucaguaucagcgauuuuaaaa

SEQ ID NO: 2327195 - RNA, 17 nt, Yersinia pestis KIM
ugucacuugcccugagu

SEQ ID NO: 2327196 - RNA, 16 nt, Yersinia pestis KIM
uguaugggcugcuaca

SEQ ID NO: 2327197 - RNA, 13 nt, Yersinia pestis KIM
ugucaaaaaccca

SEQ ID NO: 2327198 - RNA, 16 nt, Yersinia pestis KIM
uguauuuuuguauuua

SEQ ID NO: 2327199 - RNA, 13 nt, Yersinia pestis KIM
ugucaccugagua

SEQ ID NO: 2327200 - RNA, 15 nt, Yersinia pestis KIM
uguagcuuuuuaaau

SEQ ID NO: 2327201 - RNA, 19 nt, Yersinia pestis KIM
uguagcuuuuuaaauacca

SEQ ID NO: 2327202 - RNA, 12 nt, Yersinia pestis KIM
uguaggcaccac

SEQ ID NO: 2327203 - RNA, 19 nt, Yersinia pestis KIM
uguaggcaauacaccgcca

SEQ ID NO: 2327204 - RNA, 18 nt, Yersinia pestis KIM
uguagugacguaaaaagg

SEQ ID NO: 2327205 - RNA, 17 nt, Yersinia pestis KIM
uguaguuaaucuacccg

SEQ ID NO: 2327206 - RNA, 21 nt, Yersinia pestis KIM
uguagguuggggaugaaaaug

SEQ ID NO: 2327207 - RNA, 20 nt, Yersinia pestis KIM
uguaguacagcacucaguac

SEQ ID NO: 2327208 - RNA, 13 nt, Yersinia pestis KIM
uguaguacagcac

SEQ ID NO: 2327209 - RNA, 18 nt, Yersinia pestis KIM
uguauaucacuauuucag

SEQ ID NO: 2327210 - RNA, 18 nt, Yersinia pestis KIM
uguauauaaaaaaugaga

SEQ ID NO: 2327211 - RNA, 20 nt, Yersinia pestis KIM
uguauagucuccaaauucau

SEQ ID NO: 2327212 - RNA, 18 nt, Yersinia pestis KIM
uguauagucuccaaauuc

SEQ ID NO: 2327213 - RNA, 13 nt, Yersinia pestis KIM
uguauacaauugc

SEQ ID NO: 2327214 - RNA, 19 nt, Yersinia pestis KIM
uguauacaauugccugauu

SEQ ID NO: 2327215 - RNA, 23 nt, Yersinia pestis KIM
uguauaaaagaaugaauuuuuuu

SEQ ID NO: 2327216 - RNA, 13 nt, Yersinia pestis KIM
uggugaaaaauga

SEQ ID NO: 2327217 - RNA, 17 nt, Yersinia pestis KIM
uggucuuggucauaccg

SEQ ID NO: 2327218 - RNA, 13 nt, Yersinia pestis KIM
ugguuuccgcuga

SEQ ID NO: 2327219 - RNA, 12 nt, Yersinia pestis KIM
ugguuuuuuaaa

SEQ ID NO: 2327220 - RNA, 14 nt, Yersinia pestis KIM
ugguuuuuacaccc

SEQ ID NO: 2327221 - RNA, 14 nt, Yersinia pestis KIM
ugguuuauaacaag

SEQ ID NO: 2327222 - RNA, 15 nt, Yersinia pestis KIM
uguaaaauaccaauu

SEQ ID NO: 2327223 - RNA, 21 nt, Yersinia pestis KIM
uguaaaauaccaauuaauaag

SEQ ID NO: 2327224 - RNA, 21 nt, Yersinia pestis KIM
uguaaaaacuuaucuaaaaaa

SEQ ID NO: 2327225 - RNA, 20 nt, Yersinia pestis KIM
uguaaaaacuuaucuaaaaa

SEQ ID NO: 2327226 - RNA, 20 nt, Yersinia pestis KIM
uguaaaaaccaucugaugca

SEQ ID NO: 2327227 - RNA, 20 nt, Yersinia pestis KIM
uguaacaauccgaacaaaau

SEQ ID NO: 2327228 - RNA, 15 nt, Yersinia pestis KIM
uguaacacauauuuc

SEQ ID NO: 2327229 - RNA, 13 nt, Yersinia pestis KIM
uguaacagcggcg

SEQ ID NO: 2327230 - RNA, 20 nt, Yersinia pestis KIM
uguaacagcggcgauuaucg

SEQ ID NO: 2327231 - RNA, 16 nt, Yersinia pestis KIM
uguacuuucccugcug

SEQ ID NO: 2327232 - RNA, 20 nt, Yersinia pestis KIM
uguaccaaaacgaacaaaau

SEQ ID NO: 2327233 - RNA, 20 nt, Yersinia pestis KIM
uguacaacuucuucauaacg

SEQ ID NO: 2327234 - RNA, 18 nt, Yersinia pestis KIM
uguaacgaugaauuauca

SEQ ID NO: 2327235 - RNA, 17 nt, Yersinia pestis KIM
uguaacgggcaauggua

SEQ ID NO: 2327236 - RNA, 21 nt, Yersinia pestis KIM
uguaacuaccugcuuuaccau

SEQ ID NO: 2327237 - RNA, 22 nt, Yersinia pestis KIM
uguaacugccaguucaucagcc

SEQ ID NO: 2327238 - RNA, 16 nt, Yersinia pestis KIM
uguaauccggcaaaaa

SEQ ID NO: 2327239 - RNA, 18 nt, Yersinia pestis KIM
uguacaacaagaucccaa

SEQ ID NO: 2327240 - RNA, 16 nt, Yersinia pestis KIM
uguaaugccacacuca

SEQ ID NO: 2327241 - RNA, 17 nt, Yersinia pestis KIM
uguuuaacccaaugcuc

SEQ ID NO: 2327242 - RNA, 12 nt, Yersinia pestis KIM
uguuuaaaucuu

SEQ ID NO: 2327243 - RNA, 22 nt, Yersinia pestis KIM
uguuuaaucaccgcuguggaau

SEQ ID NO: 2327244 - RNA, 19 nt, Yersinia pestis KIM
uguuguuauuacugucacu

SEQ ID NO: 2327245 - RNA, 16 nt, Yersinia pestis KIM
uguuuauaaauuaaaa

SEQ ID NO: 2327246 - RNA, 20 nt, Yersinia pestis KIM
uguuuaguaauuuccuuggc

SEQ ID NO: 2327247 - RNA, 13 nt, Yersinia pestis KIM
uguuggggcacaa

SEQ ID NO: 2327248 - RNA, 13 nt, Yersinia pestis KIM
uguuggcaaauaa

SEQ ID NO: 2327249 - RNA, 13 nt, Yersinia pestis KIM
uguugucaccugg

SEQ ID NO: 2327250 - RNA, 20 nt, Yersinia pestis KIM
uguugccggcggcgcuggcg

SEQ ID NO: 2327251 - RNA, 22 nt, Yersinia pestis KIM
uguugauuaacauccauuguau

SEQ ID NO: 2327252 - RNA, 21 nt, Yersinia pestis KIM
uguugauuacgggucagcuca

SEQ ID NO: 2327253 - RNA, 22 nt, Yersinia pestis KIM
uguugcaagcugagauaagccu

SEQ ID NO: 2327254 - RNA, 16 nt, Yersinia pestis KIM
uguugaugaguaaaca

SEQ ID NO: 2327255 - RNA, 16 nt, Yersinia pestis KIM
uguugccacagagggg

SEQ ID NO: 2327256 - RNA, 15 nt, Yersinia pestis KIM
uguugccaugccaug

SEQ ID NO: 2327257 - RNA, 21 nt, Yersinia pestis KIM
uguugauaaaaaucuuuuaau

SEQ ID NO: 2327258 - RNA, 19 nt, Yersinia pestis KIM
uguucugguaccguuuuau

SEQ ID NO: 2327259 - RNA, 15 nt, Yersinia pestis KIM
uguucuuaauuuuau

SEQ ID NO: 2327260 - RNA, 15 nt, Yersinia pestis KIM
uguucuuccugugcg

SEQ ID NO: 2327261 - RNA, 14 nt, Yersinia pestis KIM
uguucugcuggauc

SEQ ID NO: 2327262 - RNA, 20 nt, Yersinia pestis KIM
uguucugcuggaucaugaaa

SEQ ID NO: 2327263 - RNA, 13 nt, Yersinia pestis KIM
uguucuggcaggc

SEQ ID NO: 2327264 - RNA, 22 nt, Yersinia pestis KIM
uguuccggcgcgauguccacaa

SEQ ID NO: 2327265 - RNA, 16 nt, Yersinia pestis KIM
uguuccugauuccaaa

SEQ ID NO: 2327266 - RNA, 20 nt, Yersinia pestis KIM
uguuccagugcguuuuauuc

SEQ ID NO: 2327267 - RNA, 21 nt, Yersinia pestis KIM
uguuccagugcguuuuauuca

SEQ ID NO: 2327268 - RNA, 16 nt, Yersinia pestis KIM
uguucauaaauuaaaa

SEQ ID NO: 2327269 - RNA, 14 nt, Yersinia pestis KIM
uguucauaaauuaa

SEQ ID NO: 2327270 - RNA, 17 nt, Yersinia pestis KIM
uguucauucggcgcggu

SEQ ID NO: 2327271 - RNA, 22 nt, Yersinia pestis KIM
uguucauggugccugcacuuaa

SEQ ID NO: 2327272 - RNA, 14 nt, Yersinia pestis KIM
uguucguagguuug

SEQ ID NO: 2327273 - RNA, 20 nt, Yersinia pestis KIM
uguucggggguugucagcag

SEQ ID NO: 2327274 - RNA, 21 nt, Yersinia pestis KIM
uguucggggguugucagcagu

SEQ ID NO: 2327275 - RNA, 22 nt, Yersinia pestis KIM
uguucgaucaaaacaauaaaaa

SEQ ID NO: 2327276 - RNA, 15 nt, Yersinia pestis KIM
uguucgcacugcucu

SEQ ID NO: 2327277 - RNA, 18 nt, Yersinia pestis KIM
uguucgcacugcucugcc

SEQ ID NO: 2327278 - RNA, 19 nt, Yersinia pestis KIM
uguucgcacugcucugccc

SEQ ID NO: 2327279 - RNA, 19 nt, Yersinia pestis KIM
uguucugauuuagcuaucg

SEQ ID NO: 2327280 - RNA, 14 nt, Yersinia pestis KIM
uguucuacagggaa

SEQ ID NO: 2327281 - RNA, 19 nt, Yersinia pestis KIM
uguucagcauaaauauuca

SEQ ID NO: 2327282 - RNA, 13 nt, Yersinia pestis KIM
uguucauaaauua

SEQ ID NO: 2327283 - RNA, 14 nt, Yersinia pestis KIM
uguucaaaaacgca

SEQ ID NO: 2327284 - RNA, 18 nt, Yersinia pestis KIM
uguucaagcguacaagaa

SEQ ID NO: 2327285 - RNA, 15 nt, Yersinia pestis KIM
uguuauuacugucac

SEQ ID NO: 2327286 - RNA, 16 nt, Yersinia pestis KIM
uguuauuaaugauaac

SEQ ID NO: 2327287 - RNA, 15 nt, Yersinia pestis KIM
uguuauuucugggau

SEQ ID NO: 2327288 - RNA, 20 nt, Yersinia pestis KIM
uguuauuggacaucaggcag

SEQ ID NO: 2327289 - RNA, 20 nt, Yersinia pestis KIM
uguuauggauuuuuaaggac

SEQ ID NO: 2327290 - RNA, 15 nt, Yersinia pestis KIM
uguuagcaauuugag

SEQ ID NO: 2327291 - RNA, 23 nt, Yersinia pestis KIM
uguuagcccgcagaugaggccca

SEQ ID NO: 2327292 - RNA, 11 nt, Yersinia pestis KIM
uguuagcucaa

SEQ ID NO: 2327293 - RNA, 19 nt, Yersinia pestis KIM
uguuaguucagacguacau

SEQ ID NO: 2327294 - RNA, 22 nt, Yersinia pestis KIM
uuaaaauaguggcacaaauaaa

SEQ ID NO: 2327295 - RNA, 14 nt, Yersinia pestis KIM
uuaaaauaguggca

SEQ ID NO: 2327296 - RNA, 23 nt, Yersinia pestis KIM
uuaaaauaguggcacaaauaaaa

SEQ ID NO: 2327297 - RNA, 16 nt, Yersinia pestis KIM
uuaaaacagauaaaaa

SEQ ID NO: 2327298 - RNA, 20 nt, Yersinia pestis KIM
uuaaaacagauaaaaaauaa

SEQ ID NO: 2327299 - RNA, 15 nt, Yersinia pestis KIM
uuaaaaaaauuauca

SEQ ID NO: 2327300 - RNA, 20 nt, Yersinia pestis KIM
uguuuuuuugauauucucac

SEQ ID NO: 2327301 - RNA, 15 nt, Yersinia pestis KIM
uuaaaaauacaacca

SEQ ID NO: 2327302 - RNA, 18 nt, Yersinia pestis KIM
uuaaaaauacaaccaaca

SEQ ID NO: 2327303 - RNA, 20 nt, Yersinia pestis KIM
uuaaaaagucauuaacuguu

SEQ ID NO: 2327304 - RNA, 15 nt, Yersinia pestis KIM
uuaaaaagccugaau

SEQ ID NO: 2327305 - RNA, 13 nt, Yersinia pestis KIM
uuaaaaaauuaug

SEQ ID NO: 2327306 - RNA, 16 nt, Yersinia pestis KIM
uuaaaccucagaaaaa

SEQ ID NO: 2327307 - RNA, 17 nt, Yersinia pestis KIM
uuaaacgcacaucaauc

SEQ ID NO: 2327308 - RNA, 20 nt, Yersinia pestis KIM
uuaaacagucuuauuacuca

SEQ ID NO: 2327309 - RNA, 13 nt, Yersinia pestis KIM
uuaaaauuaauaa

SEQ ID NO: 2327310 - RNA, 16 nt, Yersinia pestis KIM
uuaaagaagacgagua

SEQ ID NO: 2327311 - RNA, 13 nt, Yersinia pestis KIM
uuaaacuuugcua

SEQ ID NO: 2327312 - RNA, 22 nt, Yersinia pestis KIM
uuaaagauuucaucauucaaua

SEQ ID NO: 2327313 - RNA, 16 nt, Yersinia pestis KIM
uuaaacgcucaucaac

SEQ ID NO: 2327314 - RNA, 16 nt, Yersinia pestis KIM
uuaaacuguuauuggg

SEQ ID NO: 2327315 - RNA, 21 nt, Yersinia pestis KIM
uguuucuauccgaaaaauauu

SEQ ID NO: 2327316 - RNA, 16 nt, Yersinia pestis KIM
uguuucuauuuucagc

SEQ ID NO: 2327317 - RNA, 21 nt, Yersinia pestis KIM
uguuucggguauucggcggcu

SEQ ID NO: 2327318 - RNA, 21 nt, Yersinia pestis KIM
uguuugcgcagcaaauaaaca

SEQ ID NO: 2327319 - RNA, 21 nt, Yersinia pestis KIM
uguuugaugguuauguguauu

SEQ ID NO: 2327320 - RNA, 15 nt, Yersinia pestis KIM
uguuugcaacauuau

SEQ ID NO: 2327321 - RNA, 22 nt, Yersinia pestis KIM
uguuugauaaggccaugucacu

SEQ ID NO: 2327322 - RNA, 16 nt, Yersinia pestis KIM
uguuucaguucuucac

SEQ ID NO: 2327323 - RNA, 13 nt, Yersinia pestis KIM
uguuucaaauaag

SEQ ID NO: 2327324 - RNA, 22 nt, Yersinia pestis KIM
uguuucaaauaaguacuuccaa

SEQ ID NO: 2327325 - RNA, 20 nt, Yersinia pestis KIM
uguuuggcauggauaucagc

SEQ ID NO: 2327326 - RNA, 20 nt, Yersinia pestis KIM
uguuugugugucuuuaagua

SEQ ID NO: 2327327 - RNA, 12 nt, Yersinia pestis KIM
uguuuuaaaaaa

SEQ ID NO: 2327328 - RNA, 19 nt, Yersinia pestis KIM
uguuuguugauguaagcug

SEQ ID NO: 2327329 - RNA, 22 nt, Yersinia pestis KIM
uguuuuauuauauauuuugaau

SEQ ID NO: 2327330 - RNA, 15 nt, Yersinia pestis KIM
uguuuuguaaaugcu

SEQ ID NO: 2327331 - RNA, 18 nt, Yersinia pestis KIM
uguuuucuuguauauaaa

SEQ ID NO: 2327332 - RNA, 21 nt, Yersinia pestis KIM
uuacacacccucaacucaaaa

SEQ ID NO: 2327333 - RNA, 20 nt, Yersinia pestis KIM
uuacaccgugcaauagcuag

SEQ ID NO: 2327334 - RNA, 19 nt, Yersinia pestis KIM
uuacaaauuugacauuucc

SEQ ID NO: 2327335 - RNA, 18 nt, Yersinia pestis KIM
uuaauuuuucauaauaau

SEQ ID NO: 2327336 - RNA, 19 nt, Yersinia pestis KIM
uuacaaaauauacugauaa

SEQ ID NO: 2327337 - RNA, 18 nt, Yersinia pestis KIM
uuaauuggcccauaacaa

SEQ ID NO: 2327338 - RNA, 22 nt, Yersinia pestis KIM
uuaauuucagucaauaaacauu

SEQ ID NO: 2327339 - RNA, 14 nt, Yersinia pestis KIM
uuaauuucacuucc

SEQ ID NO: 2327340 - RNA, 18 nt, Yersinia pestis KIM
uuaauuucaccacaucuu

SEQ ID NO: 2327341 - RNA, 21 nt, Yersinia pestis KIM
uuaauccccggucacuuaaau

SEQ ID NO: 2327342 - RNA, 12 nt, Yersinia pestis KIM
uuaaucugcugc

SEQ ID NO: 2327343 - RNA, 17 nt, Yersinia pestis KIM
uuaaucuuguaaagacg

SEQ ID NO: 2327344 - RNA, 13 nt, Yersinia pestis KIM
uuaaucuuuaauu

SEQ ID NO: 2327345 - RNA, 20 nt, Yersinia pestis KIM
uuaaucuuuaauucaucaga

SEQ ID NO: 2327346 - RNA, 14 nt, Yersinia pestis KIM
uuaccauccacuag

SEQ ID NO: 2327347 - RNA, 22 nt, Yersinia pestis KIM
uuaccauccacuagguccauaa

SEQ ID NO: 2327348 - RNA, 17 nt, Yersinia pestis KIM
uuaccauccguccucag

SEQ ID NO: 2327349 - RNA, 13 nt, Yersinia pestis KIM
uuaccaugcucau

SEQ ID NO: 2327350 - RNA, 18 nt, Yersinia pestis KIM
uuacccacauucaggccg

SEQ ID NO: 2327351 - RNA, 15 nt, Yersinia pestis KIM
uuaccggccucuuuc

SEQ ID NO: 2327352 - RNA, 19 nt, Yersinia pestis KIM
uuacaucaugaguaaaaga

SEQ ID NO: 2327353 - RNA, 16 nt, Yersinia pestis KIM
uuaccacggccaagua

SEQ ID NO: 2327354 - RNA, 14 nt, Yersinia pestis KIM
uuacauaugauggc

SEQ ID NO: 2327355 - RNA, 21 nt, Yersinia pestis KIM
uuaccuauuuuagguccaggc

SEQ ID NO: 2327356 - RNA, 13 nt, Yersinia pestis KIM
uuaccuauuuauu

SEQ ID NO: 2327357 - RNA, 15 nt, Yersinia pestis KIM
uuaccguugauugga

SEQ ID NO: 2327358 - RNA, 12 nt, Yersinia pestis KIM
uuaccugcauau

SEQ ID NO: 2327359 - RNA, 22 nt, Yersinia pestis KIM
uuaccuguuucgauccagcuac

SEQ ID NO: 2327360 - RNA, 16 nt, Yersinia pestis KIM
uuacgaucaacccccu

SEQ ID NO: 2327361 - RNA, 22 nt, Yersinia pestis KIM
uuacgcaacguaauaucugcca

SEQ ID NO: 2327362 - RNA, 14 nt, Yersinia pestis KIM
uuacgcaaguaaaa

SEQ ID NO: 2327363 - RNA, 14 nt, Yersinia pestis KIM
uuacgcaacaagcc

SEQ ID NO: 2327364 - RNA, 15 nt, Yersinia pestis KIM
uuacgaucugccugu

SEQ ID NO: 2327365 - RNA, 17 nt, Yersinia pestis KIM
uuagcgccgcuucgguc

SEQ ID NO: 2327366 - RNA, 13 nt, Yersinia pestis KIM
uuagcuacgcugc

SEQ ID NO: 2327367 - RNA, 19 nt, Yersinia pestis KIM
uuagcuacgcugcugaauu

SEQ ID NO: 2327368 - RNA, 15 nt, Yersinia pestis KIM
uuagcgagaaaguca

SEQ ID NO: 2327369 - RNA, 15 nt, Yersinia pestis KIM
uuagcgaugacugag

SEQ ID NO: 2327370 - RNA, 18 nt, Yersinia pestis KIM
uuagcgcacggggaaaca

SEQ ID NO: 2327371 - RNA, 14 nt, Yersinia pestis KIM
uuagcgagaaaguc

SEQ ID NO: 2327372 - RNA, 20 nt, Yersinia pestis KIM
uuagauguguuuaaaucuuu

SEQ ID NO: 2327373 - RNA, 15 nt, Yersinia pestis KIM
uuagaucaacauuau

SEQ ID NO: 2327374 - RNA, 19 nt, Yersinia pestis KIM
uuagaauguguaguugaag

SEQ ID NO: 2327375 - RNA, 22 nt, Yersinia pestis KIM
uuagacacgccggcuuuuuucu

SEQ ID NO: 2327376 - RNA, 21 nt, Yersinia pestis KIM
uuacuuccugccaacaacuua

SEQ ID NO: 2327377 - RNA, 21 nt, Yersinia pestis KIM
uuacucuucagccuauccuca

SEQ ID NO: 2327378 - RNA, 14 nt, Yersinia pestis KIM
uuacuaucuuuauu

SEQ ID NO: 2327379 - RNA, 21 nt, Yersinia pestis KIM
uuacuccucugccuauccuca

SEQ ID NO: 2327380 - RNA, 12 nt, Yersinia pestis KIM
uuacuauauaaa

SEQ ID NO: 2327381 - RNA, 19 nt, Yersinia pestis KIM
uuacucucuauugaucaca

SEQ ID NO: 2327382 - RNA, 18 nt, Yersinia pestis KIM
uuacucuucagccuaucc

SEQ ID NO: 2327383 - RNA, 17 nt, Yersinia pestis KIM
uuacucguuuuacauug

SEQ ID NO: 2327384 - RNA, 15 nt, Yersinia pestis KIM
uuacucguuuuacau

SEQ ID NO: 2327385 - RNA, 16 nt, Yersinia pestis KIM
uuacucguauaaaaaa

SEQ ID NO: 2327386 - RNA, 14 nt, Yersinia pestis KIM
uuacucgcuccgag

SEQ ID NO: 2327387 - RNA, 22 nt, Yersinia pestis KIM
uuacgcuaucaacuuucacccc

SEQ ID NO: 2327388 - RNA, 20 nt, Yersinia pestis KIM
uuacgcgucaucauauucaa

SEQ ID NO: 2327389 - RNA, 20 nt, Yersinia pestis KIM
uuacgucaaaacuauuuauu

SEQ ID NO: 2327390 - RNA, 14 nt, Yersinia pestis KIM
uuacgucagaaaua

SEQ ID NO: 2327391 - RNA, 15 nt, Yersinia pestis KIM
uuacgucagaaauaa

SEQ ID NO: 2327392 - RNA, 22 nt, Yersinia pestis KIM
uuacgguauuugaacuucaaau

SEQ ID NO: 2327393 - RNA, 22 nt, Yersinia pestis KIM
uuacgggcggcauaauccucaa

SEQ ID NO: 2327394 - RNA, 23 nt, Yersinia pestis KIM
uuacggcgggucguauucaggua

SEQ ID NO: 2327395 - RNA, 17 nt, Yersinia pestis KIM
uuaaucaucaucacaaa

SEQ ID NO: 2327396 - RNA, 12 nt, Yersinia pestis KIM
uuaaucagugac

SEQ ID NO: 2327397 - RNA, 17 nt, Yersinia pestis KIM
uuaaucagugacaagaa

SEQ ID NO: 2327398 - RNA, 16 nt, Yersinia pestis KIM
uuaaucauuuguuucu

SEQ ID NO: 2327399 - RNA, 13 nt, Yersinia pestis KIM
uuaaucaccucac

SEQ ID NO: 2327400 - RNA, 12 nt, Yersinia pestis KIM
uuaaucagggcu

SEQ ID NO: 2327401 - RNA, 16 nt, Yersinia pestis KIM
uuaauacaucaucaaa

SEQ ID NO: 2327402 - RNA, 18 nt, Yersinia pestis KIM
uuaauacaucaucaaaac

SEQ ID NO: 2327403 - RNA, 18 nt, Yersinia pestis KIM
uuaauacaauagagaaua

SEQ ID NO: 2327404 - RNA, 14 nt, Yersinia pestis KIM
uuaauauauuuaau

SEQ ID NO: 2327405 - RNA, 15 nt, Yersinia pestis KIM
uuaauauauuuaauu

SEQ ID NO: 2327406 - RNA, 23 nt, Yersinia pestis KIM
uuaaguuuucuggcaauuucugu

SEQ ID NO: 2327407 - RNA, 16 nt, Yersinia pestis KIM
uuaauaaaaaacugac

SEQ ID NO: 2327408 - RNA, 19 nt, Yersinia pestis KIM
uuaauaaauuuucuaagcu

SEQ ID NO: 2327409 - RNA, 23 nt, Yersinia pestis KIM
uuaaggguuaaccagaagaacag

SEQ ID NO: 2327410 - RNA, 13 nt, Yersinia pestis KIM
uuaaggcgcgacu

SEQ ID NO: 2327411 - RNA, 16 nt, Yersinia pestis KIM
uuaaggcgcgacugau

SEQ ID NO: 2327412 - RNA, 17 nt, Yersinia pestis KIM
uuaacgauauagucuug

SEQ ID NO: 2327413 - RNA, 22 nt, Yersinia pestis KIM
uuaacgaugaccgugacauuuu

SEQ ID NO: 2327414 - RNA, 19 nt, Yersinia pestis KIM
uuaacugcauagcuaaccu

SEQ ID NO: 2327415 - RNA, 16 nt, Yersinia pestis KIM
uuaacugcaguaaaaa

SEQ ID NO: 2327416 - RNA, 20 nt, Yersinia pestis KIM
uuaacugcaguaaaaauauu

SEQ ID NO: 2327417 - RNA, 11 nt, Yersinia pestis KIM
uuaacugcacg

SEQ ID NO: 2327418 - RNA, 12 nt, Yersinia pestis KIM
uuaacugaaagc

SEQ ID NO: 2327419 - RNA, 13 nt, Yersinia pestis KIM
uuaacucuucaac

SEQ ID NO: 2327420 - RNA, 23 nt, Yersinia pestis KIM
uuaacggcgugcgaacaaaaauu

SEQ ID NO: 2327421 - RNA, 16 nt, Yersinia pestis KIM
uuaagauuaagccaug

SEQ ID NO: 2327422 - RNA, 20 nt, Yersinia pestis KIM
uuaagaugacuacugucuuu

SEQ ID NO: 2327423 - RNA, 13 nt, Yersinia pestis KIM
uuaagaacgcuug

SEQ ID NO: 2327424 - RNA, 17 nt, Yersinia pestis KIM
uuaagaaaucugcagua

SEQ ID NO: 2327425 - RNA, 21 nt, Yersinia pestis KIM
uuaagcaauauuuuagcauuu

SEQ ID NO: 2327426 - RNA, 17 nt, Yersinia pestis KIM
uuaacuguuuuauauuu

SEQ ID NO: 2327427 - RNA, 15 nt, Yersinia pestis KIM
uuaacuguuaaaaca

SEQ ID NO: 2327428 - RNA, 22 nt, Yersinia pestis KIM
uuaacugcauagcuaaccuuaa

SEQ ID NO: 2327429 - RNA, 21 nt, Yersinia pestis KIM
uuaacugccguuucaguaaaa

SEQ ID NO: 2327430 - RNA, 22 nt, Yersinia pestis KIM
uuaacuuuucuucauugcugcu

SEQ ID NO: 2327431 - RNA, 19 nt, Yersinia pestis KIM
uuaacuuuucuucauugcu

SEQ ID NO: 2327432 - RNA, 19 nt, Yersinia pestis KIM
uuaacuuuuucuaucccua

SEQ ID NO: 2327433 - RNA, 18 nt, Yersinia pestis KIM
uuaacuuuaaauccaucg

SEQ ID NO: 2327434 - RNA, 15 nt, Yersinia pestis KIM
uuaaauaccagagac

SEQ ID NO: 2327435 - RNA, 15 nt, Yersinia pestis KIM
uuaaauacaaaaaua

SEQ ID NO: 2327436 - RNA, 17 nt, Yersinia pestis KIM
uuaaauacaaaaauaca

SEQ ID NO: 2327437 - RNA, 20 nt, Yersinia pestis KIM
uuaaauaacagcuaaaauga

SEQ ID NO: 2327438 - RNA, 15 nt, Yersinia pestis KIM
uuaaauaacuaaaaa

SEQ ID NO: 2327439 - RNA, 11 nt, Yersinia pestis KIM
uuaaauaacuc

SEQ ID NO: 2327440 - RNA, 17 nt, Yersinia pestis KIM
uuaaauaagaaguagaa

SEQ ID NO: 2327441 - RNA, 22 nt, Yersinia pestis KIM
uuaaauaagauccagaacacca

SEQ ID NO: 2327442 - RNA, 18 nt, Yersinia pestis KIM
uuaaauagucaccuugaa

SEQ ID NO: 2327443 - RNA, 17 nt, Yersinia pestis KIM
uuaaaguuuagcaaagc

SEQ ID NO: 2327444 - RNA, 18 nt, Yersinia pestis KIM
uuaaagugagaaggguau

SEQ ID NO: 2327445 - RNA, 19 nt, Yersinia pestis KIM
uuaaagccuuucagcgcug

SEQ ID NO: 2327446 - RNA, 17 nt, Yersinia pestis KIM
uuaacaaagcuauuuuu

SEQ ID NO: 2327447 - RNA, 15 nt, Yersinia pestis KIM
uuaaauuuuuauaua

SEQ ID NO: 2327448 - RNA, 13 nt, Yersinia pestis KIM
uuaaauuuuuaua

SEQ ID NO: 2327449 - RNA, 14 nt, Yersinia pestis KIM
uuaaauuucuucaa

SEQ ID NO: 2327450 - RNA, 15 nt, Yersinia pestis KIM
uuaaauuuuauauua

SEQ ID NO: 2327451 - RNA, 19 nt, Yersinia pestis KIM
uuaacaaucagugcaauaa

SEQ ID NO: 2327452 - RNA, 19 nt, Yersinia pestis KIM
uuaacacauuaauuuaucu

SEQ ID NO: 2327453 - RNA, 19 nt, Yersinia pestis KIM
uuaacaauuacuuuggcau

SEQ ID NO: 2327454 - RNA, 13 nt, Yersinia pestis KIM
uuaacaauucucu

SEQ ID NO: 2327455 - RNA, 15 nt, Yersinia pestis KIM
uuaacaauuuuauug

SEQ ID NO: 2327456 - RNA, 18 nt, Yersinia pestis KIM
uuaaauugcuuccaggca

SEQ ID NO: 2327457 - RNA, 20 nt, Yersinia pestis KIM
uuaaauuaucccguucaaua

SEQ ID NO: 2327458 - RNA, 21 nt, Yersinia pestis KIM
uuaaauuaucccguucaauaa

SEQ ID NO: 2327459 - RNA, 21 nt, Yersinia pestis KIM
uuaaauuacgguuuaccaccu

SEQ ID NO: 2327460 - RNA, 19 nt, Yersinia pestis KIM
uuaaaugaaccaaaauuca

SEQ ID NO: 2327461 - RNA, 14 nt, Yersinia pestis KIM
uuaaaugagaauaa

SEQ ID NO: 2327462 - RNA, 14 nt, Yersinia pestis KIM
uuaaauggagggca

SEQ ID NO: 2327463 - RNA, 18 nt, Yersinia pestis KIM
uuaaaugcguagagucag

SEQ ID NO: 2327464 - RNA, 18 nt, Yersinia pestis KIM
ucuaugccaguuauuauu

SEQ ID NO: 2327465 - RNA, 20 nt, Yersinia pestis KIM
ucuaucuugucguuauuuuc

SEQ ID NO: 2327466 - RNA, 22 nt, Yersinia pestis KIM
ucuaucuucuucucagauauca

SEQ ID NO: 2327467 - RNA, 21 nt, Yersinia pestis KIM
ucuaucugguuuaaauucuau

SEQ ID NO: 2327468 - RNA, 13 nt, Yersinia pestis KIM
ucuaucucaggcu

SEQ ID NO: 2327469 - RNA, 14 nt, Yersinia pestis KIM
ucuaucccuauuuu

SEQ ID NO: 2327470 - RNA, 13 nt, Yersinia pestis KIM
ucuaucggugcag

SEQ ID NO: 2327471 - RNA, 21 nt, Yersinia pestis KIM
ucuaucaggucaaucuuauug

SEQ ID NO: 2327472 - RNA, 20 nt, Yersinia pestis KIM
ucuauccaauccuuuggauu

SEQ ID NO: 2327473 - RNA, 19 nt, Yersinia pestis KIM
ucuauauuggacaguaagu

SEQ ID NO: 2327474 - RNA, 12 nt, Yersinia pestis KIM
ucuauaauucag

SEQ ID NO: 2327475 - RNA, 19 nt, Yersinia pestis KIM
ucuagcaacacaucgguau

SEQ ID NO: 2327476 - RNA, 17 nt, Yersinia pestis KIM
ucuagcagugauuucag

SEQ ID NO: 2327477 - RNA, 17 nt, Yersinia pestis KIM
ucuagcccuucagcaaa

SEQ ID NO: 2327478 - RNA, 22 nt, Yersinia pestis KIM
ucuagcgacggagagucagcaa

SEQ ID NO: 2327479 - RNA, 21 nt, Yersinia pestis KIM
ucuagaccugaggauaaaaac

SEQ ID NO: 2327480 - RNA, 22 nt, Yersinia pestis KIM
aaaugauaugcuuauaaaccua

SEQ ID NO: 2327481 - RNA, 19 nt, Yersinia pestis KIM
ucuagcuguguuuuaucug

SEQ ID NO: 2327482 - RNA, 16 nt, Yersinia pestis KIM
ucuaguacguaaauuu

SEQ ID NO: 2327483 - RNA, 20 nt, Yersinia pestis KIM
ucuaguacguaaauuuauuu

SEQ ID NO: 2327484 - RNA, 19 nt, Yersinia pestis KIM
aaaugcaccgcccagauuc

SEQ ID NO: 2327485 - RNA, 24 nt, Yersinia pestis KIM
aaaugauuauuuauuuacagccac

SEQ ID NO: 2327486 - RNA, 16 nt, Yersinia pestis KIM
ucucacccaauaagau

SEQ ID NO: 2327487 - RNA, 17 nt, Yersinia pestis KIM
aaaugccguacaacaau

SEQ ID NO: 2327488 - RNA, 15 nt, Yersinia pestis KIM
ucucagaauuuuuuu

SEQ ID NO: 2327489 - RNA, 15 nt, Yersinia pestis KIM
ucucaucggcauacu

SEQ ID NO: 2327490 - RNA, 15 nt, Yersinia pestis KIM
ucucaguugaaaccc

SEQ ID NO: 2327491 - RNA, 18 nt, Yersinia pestis KIM
ucuauucugcuuuuugcu

SEQ ID NO: 2327492 - RNA, 15 nt, Yersinia pestis KIM
ucuauucugcuuuuu

SEQ ID NO: 2327493 - RNA, 14 nt, Yersinia pestis KIM
ucuauugaaaaaau

SEQ ID NO: 2327494 - RNA, 12 nt, Yersinia pestis KIM
ucuauuuccauc

SEQ ID NO: 2327495 - RNA, 11 nt, Yersinia pestis KIM
ucuauuuccac

SEQ ID NO: 2327496 - RNA, 18 nt, Yersinia pestis KIM
ucuauuucaugauucucu

SEQ ID NO: 2327497 - RNA, 18 nt, Yersinia pestis KIM
ucuauuuauuuauaaaac

SEQ ID NO: 2327498 - RNA, 18 nt, Yersinia pestis KIM
ucuauuguuacuuuuaau

SEQ ID NO: 2327499 - RNA, 19 nt, Yersinia pestis KIM
ucuauugaucacaguaaau

SEQ ID NO: 2327500 - RNA, 16 nt, Yersinia pestis KIM
ucuauugauuacaaaa

SEQ ID NO: 2327501 - RNA, 13 nt, Yersinia pestis KIM
ucuauuuuuauuu

SEQ ID NO: 2327502 - RNA, 23 nt, Yersinia pestis KIM
ucuauuuuuauuucuccuuacua

SEQ ID NO: 2327503 - RNA, 12 nt, Yersinia pestis KIM
ucucaauaauau

SEQ ID NO: 2327504 - RNA, 17 nt, Yersinia pestis KIM
ucucaauauauucucuu

SEQ ID NO: 2327505 - RNA, 19 nt, Yersinia pestis KIM
ucucaauauuaauaaugcc

SEQ ID NO: 2327506 - RNA, 15 nt, Yersinia pestis KIM
ucucaaccgcuggca

SEQ ID NO: 2327507 - RNA, 17 nt, Yersinia pestis KIM
ucuacauaaucuuuacu

SEQ ID NO: 2327508 - RNA, 16 nt, Yersinia pestis KIM
ucuacagggaaaaacg

SEQ ID NO: 2327509 - RNA, 16 nt, Yersinia pestis KIM
ucuacagggcauaucg

SEQ ID NO: 2327510 - RNA, 16 nt, Yersinia pestis KIM
ucuacauugacuaauu

SEQ ID NO: 2327511 - RNA, 11 nt, Yersinia pestis KIM
ucuacaacauc

SEQ ID NO: 2327512 - RNA, 21 nt, Yersinia pestis KIM
ucuaaugacuacuaaucaauc

SEQ ID NO: 2327513 - RNA, 15 nt, Yersinia pestis KIM
ucuaaucuccucucc

SEQ ID NO: 2327514 - RNA, 20 nt, Yersinia pestis KIM
ucuaaucgcgcauuucuucu

SEQ ID NO: 2327515 - RNA, 22 nt, Yersinia pestis KIM
ucuaaucacuuauuccauaacg

SEQ ID NO: 2327516 - RNA, 21 nt, Yersinia pestis KIM
ucuaauagggccuccaacugc

SEQ ID NO: 2327517 - RNA, 15 nt, Yersinia pestis KIM
ucuaauugcugccca

SEQ ID NO: 2327518 - RNA, 15 nt, Yersinia pestis KIM
ucuaauuuucucaga

SEQ ID NO: 2327519 - RNA, 19 nt, Yersinia pestis KIM
aaaugacauauugugcuau

SEQ ID NO: 2327520 - RNA, 21 nt, Yersinia pestis KIM
aaaugacuaucccuucaauca

SEQ ID NO: 2327521 - RNA, 23 nt, Yersinia pestis KIM
ucuaccuucaggccuuuacuguu

SEQ ID NO: 2327522 - RNA, 20 nt, Yersinia pestis KIM
ucuaccuucaggccuuuacu

SEQ ID NO: 2327523 - RNA, 18 nt, Yersinia pestis KIM
ucuacgccgucaucaucu

SEQ ID NO: 2327524 - RNA, 15 nt, Yersinia pestis KIM
ucuaacuaauaauaa

SEQ ID NO: 2327525 - RNA, 14 nt, Yersinia pestis KIM
ucuaacucauucau

SEQ ID NO: 2327526 - RNA, 14 nt, Yersinia pestis KIM
ucuaacuaauaaua

SEQ ID NO: 2327527 - RNA, 15 nt, Yersinia pestis KIM
ucuaacucauucaua

SEQ ID NO: 2327528 - RNA, 19 nt, Yersinia pestis KIM
ucuaacugauguauucccu

SEQ ID NO: 2327529 - RNA, 19 nt, Yersinia pestis KIM
aaaucuuguuaauuuaaac

SEQ ID NO: 2327530 - RNA, 15 nt, Yersinia pestis KIM
ucuaagcugccugug

SEQ ID NO: 2327531 - RNA, 19 nt, Yersinia pestis KIM
ucuaaggaaaauacccaaa

SEQ ID NO: 2327532 - RNA, 17 nt, Yersinia pestis KIM
ucuaagugccaguuaau

SEQ ID NO: 2327533 - RNA, 22 nt, Yersinia pestis KIM
ucuaaguucagcgcuuaauauu

SEQ ID NO: 2327534 - RNA, 19 nt, Yersinia pestis KIM
ucuaagggaaauacccaaa

SEQ ID NO: 2327535 - RNA, 20 nt, Yersinia pestis KIM
aaaugaagggggcuuauucu

SEQ ID NO: 2327536 - RNA, 12 nt, Yersinia pestis KIM
aaaugaaaauau

SEQ ID NO: 2327537 - RNA, 21 nt, Yersinia pestis KIM
ucuaaacgaccaauuucaaua

SEQ ID NO: 2327538 - RNA, 16 nt, Yersinia pestis KIM
ucuaaaauuuuaaguu

SEQ ID NO: 2327539 - RNA, 16 nt, Yersinia pestis KIM
ucguuuguaccuguuc

SEQ ID NO: 2327540 - RNA, 15 nt, Yersinia pestis KIM
ucuaacauacucaga

SEQ ID NO: 2327541 - RNA, 14 nt, Yersinia pestis KIM
ucuaaauugcuuaa

SEQ ID NO: 2327542 - RNA, 17 nt, Yersinia pestis KIM
ucuaacagggaugaaua

SEQ ID NO: 2327543 - RNA, 17 nt, Yersinia pestis KIM
ucuaaauccugcaaauu

SEQ ID NO: 2327544 - RNA, 19 nt, Yersinia pestis KIM
ucugccagauagucaucuu

SEQ ID NO: 2327545 - RNA, 16 nt, Yersinia pestis KIM
ucugcuuaguuggugc

SEQ ID NO: 2327546 - RNA, 23 nt, Yersinia pestis KIM
ucugcuuaacucaaucuuugccu

SEQ ID NO: 2327547 - RNA, 18 nt, Yersinia pestis KIM
ucugccaauuuggggcug

SEQ ID NO: 2327548 - RNA, 18 nt, Yersinia pestis KIM
ucugccaccgcuccuuuc

SEQ ID NO: 2327549 - RNA, 15 nt, Yersinia pestis KIM
ucugccaaccaggcc

SEQ ID NO: 2327550 - RNA, 21 nt, Yersinia pestis KIM
ucugccaauaaaguccaccuc

SEQ ID NO: 2327551 - RNA, 17 nt, Yersinia pestis KIM
ucugccaauucaaggcc

SEQ ID NO: 2327552 - RNA, 19 nt, Yersinia pestis KIM
ucugccaaauauugcacaa

SEQ ID NO: 2327553 - RNA, 13 nt, Yersinia pestis KIM
ucuggugccaacg

SEQ ID NO: 2327554 - RNA, 17 nt, Yersinia pestis KIM
ucuggugccguuuugcu

SEQ ID NO: 2327555 - RNA, 21 nt, Yersinia pestis KIM
ucuggcuuaaucgccagcaaa

SEQ ID NO: 2327556 - RNA, 17 nt, Yersinia pestis KIM
ucuggcuaauagcguca

SEQ ID NO: 2327557 - RNA, 21 nt, Yersinia pestis KIM
ucuggcguugccgugcuguca

SEQ ID NO: 2327558 - RNA, 16 nt, Yersinia pestis KIM
ucuguacgcaauauug

SEQ ID NO: 2327559 - RNA, 17 nt, Yersinia pestis KIM
ucuguaccacugauacc

SEQ ID NO: 2327560 - RNA, 14 nt, Yersinia pestis KIM
ucuguaauaaaggc

SEQ ID NO: 2327561 - RNA, 12 nt, Yersinia pestis KIM
ucuguaauaaua

SEQ ID NO: 2327562 - RNA, 17 nt, Yersinia pestis KIM
ucuguagagaaauucau

SEQ ID NO: 2327563 - RNA, 18 nt, Yersinia pestis KIM
ucuguagaguaaaacuga

SEQ ID NO: 2327564 - RNA, 15 nt, Yersinia pestis KIM
ucuguaucauauguu

SEQ ID NO: 2327565 - RNA, 22 nt, Yersinia pestis KIM
ucugucagcccuaauauccuca

SEQ ID NO: 2327566 - RNA, 15 nt, Yersinia pestis KIM
ucugucgggaacacu

SEQ ID NO: 2327567 - RNA, 19 nt, Yersinia pestis KIM
ucugucgggaacacuuugc

SEQ ID NO: 2327568 - RNA, 17 nt, Yersinia pestis KIM
ucugucguacuuuccuu

SEQ ID NO: 2327569 - RNA, 13 nt, Yersinia pestis KIM
ucugucugagucg

SEQ ID NO: 2327570 - RNA, 21 nt, Yersinia pestis KIM
ucugucucugguaguuuugca

SEQ ID NO: 2327571 - RNA, 22 nt, Yersinia pestis KIM
ucugucuuccauuuuauuuaac

SEQ ID NO: 2327572 - RNA, 13 nt, Yersinia pestis KIM
ucugucuuacuau

SEQ ID NO: 2327573 - RNA, 14 nt, Yersinia pestis KIM
ucugugauaaccag

SEQ ID NO: 2327574 - RNA, 19 nt, Yersinia pestis KIM
ucugugucaguaccugaug

SEQ ID NO: 2327575 - RNA, 17 nt, Yersinia pestis KIM
ucuguguaguggggcuu

SEQ ID NO: 2327576 - RNA, 15 nt, Yersinia pestis KIM
ucuguggugccauaa

SEQ ID NO: 2327577 - RNA, 18 nt, Yersinia pestis KIM
ucugugccagucuaaaau

SEQ ID NO: 2327578 - RNA, 13 nt, Yersinia pestis KIM
ucuuccuaacccg

SEQ ID NO: 2327579 - RNA, 20 nt, Yersinia pestis KIM
ucuuccugugcgccacgcuc

SEQ ID NO: 2327580 - RNA, 22 nt, Yersinia pestis KIM
ucuucgcggaggguaaaacugc

SEQ ID NO: 2327581 - RNA, 13 nt, Yersinia pestis KIM
ucuuccagcggca

SEQ ID NO: 2327582 - RNA, 18 nt, Yersinia pestis KIM
ucuucacguacaacucgu

SEQ ID NO: 2327583 - RNA, 19 nt, Yersinia pestis KIM
ucuucacgaagaauugcau

SEQ ID NO: 2327584 - RNA, 13 nt, Yersinia pestis KIM
ucuucaccaauga

SEQ ID NO: 2327585 - RNA, 22 nt, Yersinia pestis KIM
ucuucaaugguguuaucuucac

SEQ ID NO: 2327586 - RNA, 16 nt, Yersinia pestis KIM
ucuuccaacgcuucac

SEQ ID NO: 2327587 - RNA, 15 nt, Yersinia pestis KIM
ucuuaucaaucaaaa

SEQ ID NO: 2327588 - RNA, 16 nt, Yersinia pestis KIM
ucuuaucacggccaaa

SEQ ID NO: 2327589 - RNA, 15 nt, Yersinia pestis KIM
ucuuauauaaaucca

SEQ ID NO: 2327590 - RNA, 20 nt, Yersinia pestis KIM
ucuucaaugaccggaugaua

SEQ ID NO: 2327591 - RNA, 15 nt, Yersinia pestis KIM
ucuuaucuuuucuga

SEQ ID NO: 2327592 - RNA, 21 nt, Yersinia pestis KIM
ucuucaaccuggaaccaagcc

SEQ ID NO: 2327593 - RNA, 21 nt, Yersinia pestis KIM
ucuguucagcauaaauauuca

SEQ ID NO: 2327594 - RNA, 20 nt, Yersinia pestis KIM
ucuguuaauccuaaugaaca

SEQ ID NO: 2327595 - RNA, 14 nt, Yersinia pestis KIM
ucuguuauaaaaaa

SEQ ID NO: 2327596 - RNA, 20 nt, Yersinia pestis KIM
ucuguugauaaaaaucuuuu

SEQ ID NO: 2327597 - RNA, 15 nt, Yersinia pestis KIM
ucuuaauuuuaucac

SEQ ID NO: 2327598 - RNA, 17 nt, Yersinia pestis KIM
ucuuaggucaucgucac

SEQ ID NO: 2327599 - RNA, 21 nt, Yersinia pestis KIM
ucuuaggugacaggcaaagac

SEQ ID NO: 2327600 - RNA, 13 nt, Yersinia pestis KIM
ucuuacuaaaaua

SEQ ID NO: 2327601 - RNA, 14 nt, Yersinia pestis KIM
ucucuccagugcaa

SEQ ID NO: 2327602 - RNA, 13 nt, Yersinia pestis KIM
ucucuccaugaua

SEQ ID NO: 2327603 - RNA, 14 nt, Yersinia pestis KIM
ucucuauucugcuu

SEQ ID NO: 2327604 - RNA, 19 nt, Yersinia pestis KIM
ucucggccaacaucuucca

SEQ ID NO: 2327605 - RNA, 17 nt, Yersinia pestis KIM
ucucugcugcgaauauu

SEQ ID NO: 2327606 - RNA, 22 nt, Yersinia pestis KIM
ucucuggcaacggcacauccca

SEQ ID NO: 2327607 - RNA, 18 nt, Yersinia pestis KIM
ucucuggcacgcuuucug

SEQ ID NO: 2327608 - RNA, 14 nt, Yersinia pestis KIM
ucucugcaucucug

SEQ ID NO: 2327609 - RNA, 17 nt, Yersinia pestis KIM
ucucuugauuaccaaua

SEQ ID NO: 2327610 - RNA, 20 nt, Yersinia pestis KIM
ucucuugauuaccaauaauu

SEQ ID NO: 2327611 - RNA, 15 nt, Yersinia pestis KIM
ucucuugcaaugaag

SEQ ID NO: 2327612 - RNA, 18 nt, Yersinia pestis KIM
aaauggaauaaaaaguca

SEQ ID NO: 2327613 - RNA, 13 nt, Yersinia pestis KIM
ucugcaauagcuc

SEQ ID NO: 2327614 - RNA, 19 nt, Yersinia pestis KIM
ucugcacaccacacuggau

SEQ ID NO: 2327615 - RNA, 14 nt, Yersinia pestis KIM
ucugauacugaacg

SEQ ID NO: 2327616 - RNA, 20 nt, Yersinia pestis KIM
ucugagugauuuuccuccca

SEQ ID NO: 2327617 - RNA, 19 nt, Yersinia pestis KIM
ucugagucgauagcuuucu

SEQ ID NO: 2327618 - RNA, 21 nt, Yersinia pestis KIM
ucugagucgauagcuuucucc

SEQ ID NO: 2327619 - RNA, 15 nt, Yersinia pestis KIM
ucugagucagucagg

SEQ ID NO: 2327620 - RNA, 23 nt, Yersinia pestis KIM
ucugaguuucauuagucaauguu

SEQ ID NO: 2327621 - RNA, 12 nt, Yersinia pestis KIM
ucugauaauccc

SEQ ID NO: 2327622 - RNA, 16 nt, Yersinia pestis KIM
ucugaguaccagcaaa

SEQ ID NO: 2327623 - RNA, 19 nt, Yersinia pestis KIM
ucugagguggcacccagug

SEQ ID NO: 2327624 - RNA, 19 nt, Yersinia pestis KIM
ucugaggauguaguccccc

SEQ ID NO: 2327625 - RNA, 13 nt, Yersinia pestis KIM
ucugaggccaaca

SEQ ID NO: 2327626 - RNA, 15 nt, Yersinia pestis KIM
ucugaaacuucaaaa

SEQ ID NO: 2327627 - RNA, 18 nt, Yersinia pestis KIM
ucugaaacggugaggaua

SEQ ID NO: 2327628 - RNA, 15 nt, Yersinia pestis KIM
ucugaaaccccuugu

SEQ ID NO: 2327629 - RNA, 15 nt, Yersinia pestis KIM
ucucuuuauauucaa

SEQ ID NO: 2327630 - RNA, 15 nt, Yersinia pestis KIM
ucucuuuccagcaaa

SEQ ID NO: 2327631 - RNA, 16 nt, Yersinia pestis KIM
ucucuuuccagcaaaa

SEQ ID NO: 2327632 - RNA, 18 nt, Yersinia pestis KIM
ucugaaacgccagccucu

SEQ ID NO: 2327633 - RNA, 23 nt, Yersinia pestis KIM
ucuccguugcaggcacuuuguca

SEQ ID NO: 2327634 - RNA, 15 nt, Yersinia pestis KIM
ucuccguugaaaccu

SEQ ID NO: 2327635 - RNA, 21 nt, Yersinia pestis KIM
ucucgacaaauccuuuuaaaa

SEQ ID NO: 2327636 - RNA, 20 nt, Yersinia pestis KIM
ucucgacauccaauucagua

SEQ ID NO: 2327637 - RNA, 21 nt, Yersinia pestis KIM
ucucgagguguuuuccccaau

SEQ ID NO: 2327638 - RNA, 15 nt, Yersinia pestis KIM
ucucauuuagcauua

SEQ ID NO: 2327639 - RNA, 23 nt, Yersinia pestis KIM
ucucauuuagcauuauucuucac

SEQ ID NO: 2327640 - RNA, 17 nt, Yersinia pestis KIM
ucuccaccaacggccca

SEQ ID NO: 2327641 - RNA, 12 nt, Yersinia pestis KIM
ucuccaagcaca

SEQ ID NO: 2327642 - RNA, 20 nt, Yersinia pestis KIM
ucuccaguaaaagaauaaau

SEQ ID NO: 2327643 - RNA, 18 nt, Yersinia pestis KIM
ucuccagugcaaauuuau

SEQ ID NO: 2327644 - RNA, 21 nt, Yersinia pestis KIM
ucuccaguuggcgcacguucc

SEQ ID NO: 2327645 - RNA, 17 nt, Yersinia pestis KIM
ucuccaucucuaauugu

SEQ ID NO: 2327646 - RNA, 21 nt, Yersinia pestis KIM
ucuccaugauauaucagucuu

SEQ ID NO: 2327647 - RNA, 18 nt, Yersinia pestis KIM
ucuccccuaccucauccg

SEQ ID NO: 2327648 - RNA, 13 nt, Yersinia pestis KIM
ucggguagcaucc

SEQ ID NO: 2327649 - RNA, 19 nt, Yersinia pestis KIM
ucggggguugucagcaguc

SEQ ID NO: 2327650 - RNA, 16 nt, Yersinia pestis KIM
ucgggguuugucagca

SEQ ID NO: 2327651 - RNA, 16 nt, Yersinia pestis KIM
ucggggguugucagca

SEQ ID NO: 2327652 - RNA, 14 nt, Yersinia pestis KIM
ucgguaaccugaaa

SEQ ID NO: 2327653 - RNA, 19 nt, Yersinia pestis KIM
ucggguucuaaauccugca

SEQ ID NO: 2327654 - RNA, 19 nt, Yersinia pestis KIM
ucgguaggcgggugaaaua

SEQ ID NO: 2327655 - RNA, 17 nt, Yersinia pestis KIM
ucgggcuugguguugca

SEQ ID NO: 2327656 - RNA, 16 nt, Yersinia pestis KIM
ucgggcuaucaucaaa

SEQ ID NO: 2327657 - RNA, 19 nt, Yersinia pestis KIM
ucgggaugaccuucccuuc

SEQ ID NO: 2327658 - RNA, 11 nt, Yersinia pestis KIM
ucgguggcccu

SEQ ID NO: 2327659 - RNA, 22 nt, Yersinia pestis KIM
ucgguuaauauugaauaaccua

SEQ ID NO: 2327660 - RNA, 14 nt, Yersinia pestis KIM
ucgguugccgccuu

SEQ ID NO: 2327661 - RNA, 16 nt, Yersinia pestis KIM
ucgguuucacccucuu

SEQ ID NO: 2327662 - RNA, 23 nt, Yersinia pestis KIM
ucggugcauguaacuguaacgau

SEQ ID NO: 2327663 - RNA, 12 nt, Yersinia pestis KIM
ucggugcaaaac

SEQ ID NO: 2327664 - RNA, 16 nt, Yersinia pestis KIM
ucggucuauaaaaccg

SEQ ID NO: 2327665 - RNA, 20 nt, Yersinia pestis KIM
ucggucacacuggcacgggc

SEQ ID NO: 2327666 - RNA, 17 nt, Yersinia pestis KIM
ucgggaaaacaggcaau

SEQ ID NO: 2327667 - RNA, 22 nt, Yersinia pestis KIM
ucgggaaauugugauucaacug

SEQ ID NO: 2327668 - RNA, 15 nt, Yersinia pestis KIM
ucggccccuuaccua

SEQ ID NO: 2327669 - RNA, 22 nt, Yersinia pestis KIM
ucggcccaacuugcuggcagga

SEQ ID NO: 2327670 - RNA, 20 nt, Yersinia pestis KIM
ucggccauauuaccgcugaa

SEQ ID NO: 2327671 - RNA, 19 nt, Yersinia pestis KIM
ucggcgauugaacaugaug

SEQ ID NO: 2327672 - RNA, 19 nt, Yersinia pestis KIM
ucguaauggcgauaauauu

SEQ ID NO: 2327673 - RNA, 20 nt, Yersinia pestis KIM
ucguacaucuccgcuauuuu

SEQ ID NO: 2327674 - RNA, 16 nt, Yersinia pestis KIM
ucguacuuuccuuccu

SEQ ID NO: 2327675 - RNA, 17 nt, Yersinia pestis KIM
ucguaguaauagguggu

SEQ ID NO: 2327676 - RNA, 18 nt, Yersinia pestis KIM
ucguauaacauaauaaau

SEQ ID NO: 2327677 - RNA, 20 nt, Yersinia pestis KIM
ucguaugaauggaaguuaaa

SEQ ID NO: 2327678 - RNA, 21 nt, Yersinia pestis KIM
ucguaugaauggaaguuaaaa

SEQ ID NO: 2327679 - RNA, 23 nt, Yersinia pestis KIM
ucguaugaauggaaguuaaaaaa

SEQ ID NO: 2327680 - RNA, 15 nt, Yersinia pestis KIM
ucgucaaguucauau

SEQ ID NO: 2327681 - RNA, 20 nt, Yersinia pestis KIM
ucgucacacuggugcucacu

SEQ ID NO: 2327682 - RNA, 14 nt, Yersinia pestis KIM
ucgucggcccggcc

SEQ ID NO: 2327683 - RNA, 19 nt, Yersinia pestis KIM
ucgucggcccggccaggcu

SEQ ID NO: 2327684 - RNA, 20 nt, Yersinia pestis KIM
ucgucggcccggccaggcuc

SEQ ID NO: 2327685 - RNA, 14 nt, Yersinia pestis KIM
ucgucgagaauaac

SEQ ID NO: 2327686 - RNA, 14 nt, Yersinia pestis KIM
ucguccugcuuaau

SEQ ID NO: 2327687 - RNA, 13 nt, Yersinia pestis KIM
ucgucagccccug

SEQ ID NO: 2327688 - RNA, 18 nt, Yersinia pestis KIM
ucguugccccaucagcac

SEQ ID NO: 2327689 - RNA, 21 nt, Yersinia pestis KIM
ucguugcggguuaacucuuca

SEQ ID NO: 2327690 - RNA, 22 nt, Yersinia pestis KIM
ucguugaccuuagauaaauaga

SEQ ID NO: 2327691 - RNA, 13 nt, Yersinia pestis KIM
ucguuucugucug

SEQ ID NO: 2327692 - RNA, 16 nt, Yersinia pestis KIM
ucguuucucuaaaauu

SEQ ID NO: 2327693 - RNA, 15 nt, Yersinia pestis KIM
ucguuuccagcggcg

SEQ ID NO: 2327694 - RNA, 22 nt, Yersinia pestis KIM
ucguuuccagcggcguaucaaa

SEQ ID NO: 2327695 - RNA, 15 nt, Yersinia pestis KIM
ucguuuacuugaugg

SEQ ID NO: 2327696 - RNA, 18 nt, Yersinia pestis KIM
ucguucacuuaucccuua

SEQ ID NO: 2327697 - RNA, 16 nt, Yersinia pestis KIM
ucguuaucuucauaua

SEQ ID NO: 2327698 - RNA, 18 nt, Yersinia pestis KIM
ucguucgcccuucuucca

SEQ ID NO: 2327699 - RNA, 21 nt, Yersinia pestis KIM
ucguguggagaacucauuuuu

SEQ ID NO: 2327700 - RNA, 16 nt, Yersinia pestis KIM
ucgucugucgggaaca

SEQ ID NO: 2327701 - RNA, 24 nt, Yersinia pestis KIM
ucgugaaaacuuucuuucaguaau

SEQ ID NO: 2327702 - RNA, 16 nt, Yersinia pestis KIM
ucgcugacaauuuaca

SEQ ID NO: 2327703 - RNA, 17 nt, Yersinia pestis KIM
ucgcucugcguuuuucc

SEQ ID NO: 2327704 - RNA, 21 nt, Yersinia pestis KIM
ucgcugaaaucaggcuguucu

SEQ ID NO: 2327705 - RNA, 16 nt, Yersinia pestis KIM
ucgcuaucugugucag

SEQ ID NO: 2327706 - RNA, 12 nt, Yersinia pestis KIM
ucgcuauuuccg

SEQ ID NO: 2327707 - RNA, 19 nt, Yersinia pestis KIM
ucgcuauuucucucuacuu

SEQ ID NO: 2327708 - RNA, 18 nt, Yersinia pestis KIM
ucgcuaaaaccuaauaac

SEQ ID NO: 2327709 - RNA, 15 nt, Yersinia pestis KIM
ucgcuccucagccuu

SEQ ID NO: 2327710 - RNA, 18 nt, Yersinia pestis KIM
ucgcucggcucgaaccug

SEQ ID NO: 2327711 - RNA, 18 nt, Yersinia pestis KIM
ucgcucgauacuaauuuc

SEQ ID NO: 2327712 - RNA, 13 nt, Yersinia pestis KIM
ucgcgcuucaggu

SEQ ID NO: 2327713 - RNA, 20 nt, Yersinia pestis KIM
ucgcgggcgcgcugcugcuc

SEQ ID NO: 2327714 - RNA, 22 nt, Yersinia pestis KIM
ucgcgugcgcccgguaauaaug

SEQ ID NO: 2327715 - RNA, 23 nt, Yersinia pestis KIM
ucgcgugcgcccgguaauaauga

SEQ ID NO: 2327716 - RNA, 14 nt, Yersinia pestis KIM
ucgcguaucaugag

SEQ ID NO: 2327717 - RNA, 16 nt, Yersinia pestis KIM
ucggcaauauaaagcc

SEQ ID NO: 2327718 - RNA, 18 nt, Yersinia pestis KIM
ucggaugccgcuccagca

SEQ ID NO: 2327719 - RNA, 19 nt, Yersinia pestis KIM
ucggauaaccgcauucccu

SEQ ID NO: 2327720 - RNA, 16 nt, Yersinia pestis KIM
ucggcaggcaacugag

SEQ ID NO: 2327721 - RNA, 23 nt, Yersinia pestis KIM
ucggccacccgccaucaggcaaa

SEQ ID NO: 2327722 - RNA, 14 nt, Yersinia pestis KIM
ucggccaacaucuu

SEQ ID NO: 2327723 - RNA, 18 nt, Yersinia pestis KIM
ucggcauacuccauuuuu

SEQ ID NO: 2327724 - RNA, 19 nt, Yersinia pestis KIM
ucggcauugccagcgguac

SEQ ID NO: 2327725 - RNA, 21 nt, Yersinia pestis KIM
ucgcugugaauuuaucaggcu

SEQ ID NO: 2327726 - RNA, 15 nt, Yersinia pestis KIM
ucgcuguggcuacca

SEQ ID NO: 2327727 - RNA, 16 nt, Yersinia pestis KIM
ucggacgcuccucacu

SEQ ID NO: 2327728 - RNA, 17 nt, Yersinia pestis KIM
ucgcgacuacagaaaac

SEQ ID NO: 2327729 - RNA, 21 nt, Yersinia pestis KIM
ucgcgauaaaauucagccacu

SEQ ID NO: 2327730 - RNA, 14 nt, Yersinia pestis KIM
ucgccugcugagcc

SEQ ID NO: 2327731 - RNA, 22 nt, Yersinia pestis KIM
ucgccuuucacgcguucaaucu

SEQ ID NO: 2327732 - RNA, 14 nt, Yersinia pestis KIM
ucgccgccuccgau

SEQ ID NO: 2327733 - RNA, 13 nt, Yersinia pestis KIM
ucgccuauaaaaa

SEQ ID NO: 2327734 - RNA, 14 nt, Yersinia pestis KIM
ucgcccucuggugc

SEQ ID NO: 2327735 - RNA, 17 nt, Yersinia pestis KIM
ucgcccgcugauucugg

SEQ ID NO: 2327736 - RNA, 16 nt, Yersinia pestis KIM
ucgccgccgccagccc

SEQ ID NO: 2327737 - RNA, 19 nt, Yersinia pestis KIM
ucgccgcaaauuaacacau

SEQ ID NO: 2327738 - RNA, 14 nt, Yersinia pestis KIM
ucgcccuucuucca

SEQ ID NO: 2327739 - RNA, 17 nt, Yersinia pestis KIM
ucgccaucgucucugca

SEQ ID NO: 2327740 - RNA, 17 nt, Yersinia pestis KIM
ucgccacggauaaggug

SEQ ID NO: 2327741 - RNA, 19 nt, Yersinia pestis KIM
ucgccaauucguuuuucau

SEQ ID NO: 2327742 - RNA, 20 nt, Yersinia pestis KIM
ucgccaacaggccuaaugcc

SEQ ID NO: 2327743 - RNA, 14 nt, Yersinia pestis KIM
ucgccaaucucaaa

SEQ ID NO: 2327744 - RNA, 17 nt, Yersinia pestis KIM
ugaaggcugauuaauau

SEQ ID NO: 2327745 - RNA, 18 nt, Yersinia pestis KIM
ugaaggcugauuaauauc

SEQ ID NO: 2327746 - RNA, 21 nt, Yersinia pestis KIM
ugaagguacgcaccauugagc

SEQ ID NO: 2327747 - RNA, 19 nt, Yersinia pestis KIM
ugaaggguauugaagauac

SEQ ID NO: 2327748 - RNA, 23 nt, Yersinia pestis KIM
ugaagauacccuucucuuuauca

SEQ ID NO: 2327749 - RNA, 20 nt, Yersinia pestis KIM
ugaagauacccuucucuuua

SEQ ID NO: 2327750 - RNA, 18 nt, Yersinia pestis KIM
ugaagauucaaccaauua

SEQ ID NO: 2327751 - RNA, 23 nt, Yersinia pestis KIM
ugaagccgccggagaacuugaac

SEQ ID NO: 2327752 - RNA, 16 nt, Yersinia pestis KIM
ugaagcgacacuuauu

SEQ ID NO: 2327753 - RNA, 18 nt, Yersinia pestis KIM
ugaagagugaccaaagca

SEQ ID NO: 2327754 - RNA, 15 nt, Yersinia pestis KIM
ugaagagaaauaacc

SEQ ID NO: 2327755 - RNA, 13 nt, Yersinia pestis KIM
ugaagaaaccuaa

SEQ ID NO: 2327756 - RNA, 12 nt, Yersinia pestis KIM
ugaagaacagca

SEQ ID NO: 2327757 - RNA, 15 nt, Yersinia pestis KIM
ugaacgauaaauugc

SEQ ID NO: 2327758 - RNA, 13 nt, Yersinia pestis KIM
ugaacgcaaaccc

SEQ ID NO: 2327759 - RNA, 13 nt, Yersinia pestis KIM
ugaauaucaucuu

SEQ ID NO: 2327760 - RNA, 15 nt, Yersinia pestis KIM
ugaauauccaauggu

SEQ ID NO: 2327761 - RNA, 15 nt, Yersinia pestis KIM
ugaauaucaucuuuu

SEQ ID NO: 2327762 - RNA, 23 nt, Yersinia pestis KIM
ugaauaucccccuccggaaucag

SEQ ID NO: 2327763 - RNA, 19 nt, Yersinia pestis KIM
ugaauagggaauaaguaga

SEQ ID NO: 2327764 - RNA, 17 nt, Yersinia pestis KIM
ugaauagggaauaagua

SEQ ID NO: 2327765 - RNA, 19 nt, Yersinia pestis KIM
ugaauagagaauaaauuua

SEQ ID NO: 2327766 - RNA, 17 nt, Yersinia pestis KIM
ugaauacgaauuuuuuc

SEQ ID NO: 2327767 - RNA, 20 nt, Yersinia pestis KIM
ugaauacgguguaaaccgca

SEQ ID NO: 2327768 - RNA, 21 nt, Yersinia pestis KIM
ugaauagcgcugcaucagcag

SEQ ID NO: 2327769 - RNA, 18 nt, Yersinia pestis KIM
ugaauacguucaaaugau

SEQ ID NO: 2327770 - RNA, 16 nt, Yersinia pestis KIM
ugaauacuuugcggcu

SEQ ID NO: 2327771 - RNA, 15 nt, Yersinia pestis KIM
ugaaguugauaaaag

SEQ ID NO: 2327772 - RNA, 20 nt, Yersinia pestis KIM
ugaaguucucaucaaacuca

SEQ ID NO: 2327773 - RNA, 16 nt, Yersinia pestis KIM
ugaauaauacugucaa

SEQ ID NO: 2327774 - RNA, 15 nt, Yersinia pestis KIM
ugaauaauauucaau

SEQ ID NO: 2327775 - RNA, 14 nt, Yersinia pestis KIM
ugaauaccauaaca

SEQ ID NO: 2327776 - RNA, 15 nt, Yersinia pestis KIM
ugaauaccauaacaa

SEQ ID NO: 2327777 - RNA, 17 nt, Yersinia pestis KIM
ugaauacaaucauuuaa

SEQ ID NO: 2327778 - RNA, 20 nt, Yersinia pestis KIM
ugaaaccauugguaauaaug

SEQ ID NO: 2327779 - RNA, 22 nt, Yersinia pestis KIM
ugaaaccuacaucacacccagc

SEQ ID NO: 2327780 - RNA, 21 nt, Yersinia pestis KIM
ugaaaccuacaucacacccag

SEQ ID NO: 2327781 - RNA, 19 nt, Yersinia pestis KIM
ugaaaccccuuguuuuaca

SEQ ID NO: 2327782 - RNA, 18 nt, Yersinia pestis KIM
ucuucggccuaucaucac

SEQ ID NO: 2327783 - RNA, 22 nt, Yersinia pestis KIM
ucuucggcggcuaaagcugcuu

SEQ ID NO: 2327784 - RNA, 16 nt, Yersinia pestis KIM
ucuucgggaggaggua

SEQ ID NO: 2327785 - RNA, 17 nt, Yersinia pestis KIM
ugaaaguggccacucac

SEQ ID NO: 2327786 - RNA, 19 nt, Yersinia pestis KIM
ugaaaguggccacucaccu

SEQ ID NO: 2327787 - RNA, 18 nt, Yersinia pestis KIM
ugaaauagucacauuuca

SEQ ID NO: 2327788 - RNA, 20 nt, Yersinia pestis KIM
ugaaauagucacauuucagc

SEQ ID NO: 2327789 - RNA, 18 nt, Yersinia pestis KIM
ugaaauaguaauuaauua

SEQ ID NO: 2327790 - RNA, 21 nt, Yersinia pestis KIM
ugaaacuuuucaguuuuaauu

SEQ ID NO: 2327791 - RNA, 22 nt, Yersinia pestis KIM
ugaaauuuuauucgcguuucau

SEQ ID NO: 2327792 - RNA, 23 nt, Yersinia pestis KIM
ugaaauuaaaaugauaugcuuau

SEQ ID NO: 2327793 - RNA, 15 nt, Yersinia pestis KIM
ugaacacuuaauucc

SEQ ID NO: 2327794 - RNA, 17 nt, Yersinia pestis KIM
ugaacacuuaauuccau

SEQ ID NO: 2327795 - RNA, 23 nt, Yersinia pestis KIM
ugaacacgacgccauaaaagaau

SEQ ID NO: 2327796 - RNA, 16 nt, Yersinia pestis KIM
ugaacauagcuaacac

SEQ ID NO: 2327797 - RNA, 15 nt, Yersinia pestis KIM
ugaacauuauuuuuc

SEQ ID NO: 2327798 - RNA, 20 nt, Yersinia pestis KIM
ugaacauuauuuuucacgag

SEQ ID NO: 2327799 - RNA, 18 nt, Yersinia pestis KIM
ugaaccagauaacaacaa

SEQ ID NO: 2327800 - RNA, 17 nt, Yersinia pestis KIM
ugaacaauugccaggcc

SEQ ID NO: 2327801 - RNA, 15 nt, Yersinia pestis KIM
ugaaauuuuuuaauu

SEQ ID NO: 2327802 - RNA, 16 nt, Yersinia pestis KIM
ugaaauuuuuuaauuu

SEQ ID NO: 2327803 - RNA, 21 nt, Yersinia pestis KIM
ugaauggcaacgcgcagugcc

SEQ ID NO: 2327804 - RNA, 18 nt, Yersinia pestis KIM
ugaauggaaguuaaaaaa

SEQ ID NO: 2327805 - RNA, 23 nt, Yersinia pestis KIM
ugaaugaguuucaagucaauaaa

SEQ ID NO: 2327806 - RNA, 14 nt, Yersinia pestis KIM
ugaaugacuggcua

SEQ ID NO: 2327807 - RNA, 20 nt, Yersinia pestis KIM
ugaaugaccaagguuauaca

SEQ ID NO: 2327808 - RNA, 18 nt, Yersinia pestis KIM
ugaaucaaggcuuuaaua

SEQ ID NO: 2327809 - RNA, 17 nt, Yersinia pestis KIM
ugaauauuuuuaaucug

SEQ ID NO: 2327810 - RNA, 15 nt, Yersinia pestis KIM
ugaaucaaaauaccc

SEQ ID NO: 2327811 - RNA, 15 nt, Yersinia pestis KIM
ugaauauuuuuaauc

SEQ ID NO: 2327812 - RNA, 19 nt, Yersinia pestis KIM
ugaaucacuaacguguccc

SEQ ID NO: 2327813 - RNA, 21 nt, Yersinia pestis KIM
ugaaucagauacggcuccaga

SEQ ID NO: 2327814 - RNA, 14 nt, Yersinia pestis KIM
ugaaucaucaauac

SEQ ID NO: 2327815 - RNA, 23 nt, Yersinia pestis KIM
ugaaucccagaaccucaacauuc

SEQ ID NO: 2327816 - RNA, 17 nt, Yersinia pestis KIM
ugaauccauaagauuga

SEQ ID NO: 2327817 - RNA, 16 nt, Yersinia pestis KIM
ugaaucgccguuaccc

SEQ ID NO: 2327818 - RNA, 14 nt, Yersinia pestis KIM
ugaaugugaagagc

SEQ ID NO: 2327819 - RNA, 18 nt, Yersinia pestis KIM
ugaauggugcuguauuua

SEQ ID NO: 2327820 - RNA, 19 nt, Yersinia pestis KIM
ugaauggggggcaaccugg

SEQ ID NO: 2327821 - RNA, 14 nt, Yersinia pestis KIM
ugaauuaaccuuac

SEQ ID NO: 2327822 - RNA, 17 nt, Yersinia pestis KIM
ugaauuaaauuuuauau

SEQ ID NO: 2327823 - RNA, 22 nt, Yersinia pestis KIM
ugaauugauuuauuccucucug

SEQ ID NO: 2327824 - RNA, 23 nt, Yersinia pestis KIM
ugaauugagagagcuuacauuaa

SEQ ID NO: 2327825 - RNA, 16 nt, Yersinia pestis KIM
ugaauuauuucaguag

SEQ ID NO: 2327826 - RNA, 12 nt, Yersinia pestis KIM
ugaauuucuucc

SEQ ID NO: 2327827 - RNA, 22 nt, Yersinia pestis KIM
ugacaaaaacagcacuaucccc

SEQ ID NO: 2327828 - RNA, 12 nt, Yersinia pestis KIM
ugaauugccccc

SEQ ID NO: 2327829 - RNA, 16 nt, Yersinia pestis KIM
ugaccauuuauuucca

SEQ ID NO: 2327830 - RNA, 17 nt, Yersinia pestis KIM
ugaccgcacugcccagg

SEQ ID NO: 2327831 - RNA, 14 nt, Yersinia pestis KIM
ugaccgcagccuuc

SEQ ID NO: 2327832 - RNA, 18 nt, Yersinia pestis KIM
ugaccuggaagaacagcu

SEQ ID NO: 2327833 - RNA, 22 nt, Yersinia pestis KIM
ugaccagcgaaucaaacagguu

SEQ ID NO: 2327834 - RNA, 14 nt, Yersinia pestis KIM
ugaccauaaaagga

SEQ ID NO: 2327835 - RNA, 19 nt, Yersinia pestis KIM
ugaccagcauacgugccaa

SEQ ID NO: 2327836 - RNA, 21 nt, Yersinia pestis KIM
ugaccagcauacgugccaaaa

SEQ ID NO: 2327837 - RNA, 22 nt, Yersinia pestis KIM
ugacaucagccauauguugcca

SEQ ID NO: 2327838 - RNA, 13 nt, Yersinia pestis KIM
ugacauaaacacg

SEQ ID NO: 2327839 - RNA, 14 nt, Yersinia pestis KIM
ugacauaaacacgc

SEQ ID NO: 2327840 - RNA, 22 nt, Yersinia pestis KIM
ugacacucggcgguuugagcca

SEQ ID NO: 2327841 - RNA, 13 nt, Yersinia pestis KIM
ugacacugcaucu

SEQ ID NO: 2327842 - RNA, 16 nt, Yersinia pestis KIM
ugacacugcaucucug

SEQ ID NO: 2327843 - RNA, 22 nt, Yersinia pestis KIM
ugacacggguauuggcugcuug

SEQ ID NO: 2327844 - RNA, 16 nt, Yersinia pestis KIM
ugacacgagaaggguu

SEQ ID NO: 2327845 - RNA, 20 nt, Yersinia pestis KIM
ugacaccauugauaauaaua

SEQ ID NO: 2327846 - RNA, 22 nt, Yersinia pestis KIM
ugacaguagaauaccucacugg

SEQ ID NO: 2327847 - RNA, 16 nt, Yersinia pestis KIM
ugacaguauuuguagu

SEQ ID NO: 2327848 - RNA, 21 nt, Yersinia pestis KIM
ugacaggggauagcaacugcc

SEQ ID NO: 2327849 - RNA, 21 nt, Yersinia pestis KIM
ugacagaaaaaucacaugcgg

SEQ ID NO: 2327850 - RNA, 13 nt, Yersinia pestis KIM
ugacacaauuccc

SEQ ID NO: 2327851 - RNA, 17 nt, Yersinia pestis KIM
ugacaaugcguuauaac

SEQ ID NO: 2327852 - RNA, 19 nt, Yersinia pestis KIM
ugacaaugcguuauaacca

SEQ ID NO: 2327853 - RNA, 16 nt, Yersinia pestis KIM
ugacaaaguuaaauga

SEQ ID NO: 2327854 - RNA, 16 nt, Yersinia pestis KIM
ugacaaacagauacau

SEQ ID NO: 2327855 - RNA, 21 nt, Yersinia pestis KIM
ugacaaaaugccagaaugcgu

SEQ ID NO: 2327856 - RNA, 18 nt, Yersinia pestis KIM
ugacaacaucaaaugaag

SEQ ID NO: 2327857 - RNA, 12 nt, Yersinia pestis KIM
ugacaacaccgu

SEQ ID NO: 2327858 - RNA, 12 nt, Yersinia pestis KIM
ugauuaauauca

SEQ ID NO: 2327859 - RNA, 13 nt, Yersinia pestis KIM
ugauuaaccuuaa

SEQ ID NO: 2327860 - RNA, 14 nt, Yersinia pestis KIM
ugauuaaaagucaa

SEQ ID NO: 2327861 - RNA, 20 nt, Yersinia pestis KIM
ugauuaaaagucaacugcuc

SEQ ID NO: 2327862 - RNA, 15 nt, Yersinia pestis KIM
ugauguuuuaggcaa

SEQ ID NO: 2327863 - RNA, 16 nt, Yersinia pestis KIM
ugauguucugccaacc

SEQ ID NO: 2327864 - RNA, 21 nt, Yersinia pestis KIM
ugauuaauaucaaaacugauu

SEQ ID NO: 2327865 - RNA, 14 nt, Yersinia pestis KIM
ugauuaauuuuuca

SEQ ID NO: 2327866 - RNA, 14 nt, Yersinia pestis KIM
ugauuaauuuuaau

SEQ ID NO: 2327867 - RNA, 15 nt, Yersinia pestis KIM
ugauuaauuuuaaua

SEQ ID NO: 2327868 - RNA, 15 nt, Yersinia pestis KIM
ugauuacaucacuuu

SEQ ID NO: 2327869 - RNA, 18 nt, Yersinia pestis KIM
ugauuacgggucagcuca

SEQ ID NO: 2327870 - RNA, 21 nt, Yersinia pestis KIM
ugauuaccaauaauuaauuuc

SEQ ID NO: 2327871 - RNA, 17 nt, Yersinia pestis KIM
ugauuaccaauaauuaa

SEQ ID NO: 2327872 - RNA, 20 nt, Yersinia pestis KIM
ugauguggcugcuguugcca

SEQ ID NO: 2327873 - RNA, 17 nt, Yersinia pestis KIM
ugauguuaacucagcca

SEQ ID NO: 2327874 - RNA, 20 nt, Yersinia pestis KIM
ugaugugacgucacugaugc

SEQ ID NO: 2327875 - RNA, 12 nt, Yersinia pestis KIM
ugauguaggcaa

SEQ ID NO: 2327876 - RNA, 15 nt, Yersinia pestis KIM
ugauucaauuucgac

SEQ ID NO: 2327877 - RNA, 17 nt, Yersinia pestis KIM
ugauucacuggcaaaaa

SEQ ID NO: 2327878 - RNA, 12 nt, Yersinia pestis KIM
ugauucagaaag

SEQ ID NO: 2327879 - RNA, 17 nt, Yersinia pestis KIM
ugauucacugauuagcc

SEQ ID NO: 2327880 - RNA, 17 nt, Yersinia pestis KIM
ugauucaacugccgcaa

SEQ ID NO: 2327881 - RNA, 16 nt, Yersinia pestis KIM
ugauucgucugccauu

SEQ ID NO: 2327882 - RNA, 17 nt, Yersinia pestis KIM
ugauuaggcaugauaag

SEQ ID NO: 2327883 - RNA, 18 nt, Yersinia pestis KIM
ugauuaggcauaaauaau

SEQ ID NO: 2327884 - RNA, 20 nt, Yersinia pestis KIM
ugauuaggcauaaauaauaa

SEQ ID NO: 2327885 - RNA, 17 nt, Yersinia pestis KIM
ugauuaggcauaaauaa

SEQ ID NO: 2327886 - RNA, 16 nt, Yersinia pestis KIM
ugauuagcuggcuguu

SEQ ID NO: 2327887 - RNA, 18 nt, Yersinia pestis KIM
ugauuaucaaguuaaaua

SEQ ID NO: 2327888 - RNA, 13 nt, Yersinia pestis KIM
ugauuauucugcu

SEQ ID NO: 2327889 - RNA, 22 nt, Yersinia pestis KIM
ugauuggcgaugcgcuccgcca

SEQ ID NO: 2327890 - RNA, 16 nt, Yersinia pestis KIM
ugauugaaaaacagag

SEQ ID NO: 2327891 - RNA, 23 nt, Yersinia pestis KIM
ugauugaaaaucaguuuacauga

SEQ ID NO: 2327892 - RNA, 15 nt, Yersinia pestis KIM
ugauuuauaaauaau

SEQ ID NO: 2327893 - RNA, 19 nt, Yersinia pestis KIM
ugauuuauaaauaauuauc

SEQ ID NO: 2327894 - RNA, 15 nt, Yersinia pestis KIM
ugauuucagccaggc

SEQ ID NO: 2327895 - RNA, 17 nt, Yersinia pestis KIM
ugaugcauauuauaaug

SEQ ID NO: 2327896 - RNA, 14 nt, Yersinia pestis KIM
ugaugccaaauuaa

SEQ ID NO: 2327897 - RNA, 15 nt, Yersinia pestis KIM
ugaugcgaucuaucc

SEQ ID NO: 2327898 - RNA, 16 nt, Yersinia pestis KIM
ugaugccgaucaucuc

SEQ ID NO: 2327899 - RNA, 19 nt, Yersinia pestis KIM
ugaugccgguauccccgcu

SEQ ID NO: 2327900 - RNA, 13 nt, Yersinia pestis KIM
ugaucuuuauuau

SEQ ID NO: 2327901 - RNA, 18 nt, Yersinia pestis KIM
ugaugcuggguauauaua

SEQ ID NO: 2327902 - RNA, 14 nt, Yersinia pestis KIM
ugaugcuggguaua

SEQ ID NO: 2327903 - RNA, 16 nt, Yersinia pestis KIM
ugaugcucuucuucac

SEQ ID NO: 2327904 - RNA, 17 nt, Yersinia pestis KIM
ugauggccuugaaucaa

SEQ ID NO: 2327905 - RNA, 18 nt, Yersinia pestis KIM
ugauggcaucuuauuauu

SEQ ID NO: 2327906 - RNA, 22 nt, Yersinia pestis KIM
ugauggcaccgugggcaaagaa

SEQ ID NO: 2327907 - RNA, 22 nt, Yersinia pestis KIM
ugauggcuaauuaauuuaaaca

SEQ ID NO: 2327908 - RNA, 18 nt, Yersinia pestis KIM
ugaugggaggaaacugcc

SEQ ID NO: 2327909 - RNA, 17 nt, Yersinia pestis KIM
ugaucgguuagcuacug

SEQ ID NO: 2327910 - RNA, 14 nt, Yersinia pestis KIM
ugaucccccaaauu

SEQ ID NO: 2327911 - RNA, 14 nt, Yersinia pestis KIM
ugauccaggggucg

SEQ ID NO: 2327912 - RNA, 16 nt, Yersinia pestis KIM
ugaucauuucccccac

SEQ ID NO: 2327913 - RNA, 15 nt, Yersinia pestis KIM
ugaucagcagacuca

SEQ ID NO: 2327914 - RNA, 15 nt, Yersinia pestis KIM
ugauauuaauaucag

SEQ ID NO: 2327915 - RNA, 23 nt, Yersinia pestis KIM
ugauauuaaucagccuucagggu

SEQ ID NO: 2327916 - RNA, 15 nt, Yersinia pestis KIM
ugauauuauuauugc

SEQ ID NO: 2327917 - RNA, 12 nt, Yersinia pestis KIM
ugauauuagucg

SEQ ID NO: 2327918 - RNA, 19 nt, Yersinia pestis KIM
ugauauucucaccugcuua

SEQ ID NO: 2327919 - RNA, 18 nt, Yersinia pestis KIM
ugaucaacgcgcaaguaa

SEQ ID NO: 2327920 - RNA, 17 nt, Yersinia pestis KIM
ugauacaggaaacucca

SEQ ID NO: 2327921 - RNA, 13 nt, Yersinia pestis KIM
ugauacagcaguu

SEQ ID NO: 2327922 - RNA, 15 nt, Yersinia pestis KIM
ugauaauugcuacga

SEQ ID NO: 2327923 - RNA, 17 nt, Yersinia pestis KIM
ugauaauuuauuucaga

SEQ ID NO: 2327924 - RNA, 19 nt, Yersinia pestis KIM
ugauaacgccggauaaauu

SEQ ID NO: 2327925 - RNA, 21 nt, Yersinia pestis KIM
ugauaacgccggauaaauuaa

SEQ ID NO: 2327926 - RNA, 21 nt, Yersinia pestis KIM
ugauaaccucgguggcucaau

SEQ ID NO: 2327927 - RNA, 24 nt, Yersinia pestis KIM
ugauaaccguuuuuucaacuggcu

SEQ ID NO: 2327928 - RNA, 15 nt, Yersinia pestis KIM
ugauaacaacccuaa

SEQ ID NO: 2327929 - RNA, 22 nt, Yersinia pestis KIM
ugauaaugccuuuuaaaugaag

SEQ ID NO: 2327930 - RNA, 15 nt, Yersinia pestis KIM
ugauaaugccuuuua

SEQ ID NO: 2327931 - RNA, 19 nt, Yersinia pestis KIM
ugaguaucggccgcaaauu

SEQ ID NO: 2327932 - RNA, 21 nt, Yersinia pestis KIM
ugagucacuggggugaaucaa

SEQ ID NO: 2327933 - RNA, 18 nt, Yersinia pestis KIM
ugagucagguggcuauuc

SEQ ID NO: 2327934 - RNA, 12 nt, Yersinia pestis KIM
ugagucagucag

SEQ ID NO: 2327935 - RNA, 13 nt, Yersinia pestis KIM
ugagucuauuuau

SEQ ID NO: 2327936 - RNA, 22 nt, Yersinia pestis KIM
ugagucgucugucgggaacacu

SEQ ID NO: 2327937 - RNA, 16 nt, Yersinia pestis KIM
ugaguuggcauucuag

SEQ ID NO: 2327938 - RNA, 16 nt, Yersinia pestis KIM
ugaguuucauuaguca

SEQ ID NO: 2327939 - RNA, 22 nt, Yersinia pestis KIM
ugaguuuuagcccaaaauagaa

SEQ ID NO: 2327940 - RNA, 14 nt, Yersinia pestis KIM
ugagcuugcugcug

SEQ ID NO: 2327941 - RNA, 16 nt, Yersinia pestis KIM
ugagcuguaaauauaa

SEQ ID NO: 2327942 - RNA, 15 nt, Yersinia pestis KIM
ugaggauucaagaac

SEQ ID NO: 2327943 - RNA, 17 nt, Yersinia pestis KIM
ugaggaugggcagaaga

SEQ ID NO: 2327944 - RNA, 15 nt, Yersinia pestis KIM
ugaggaaauuucagu

SEQ ID NO: 2327945 - RNA, 18 nt, Yersinia pestis KIM
ugagcuuucgaccucagu

SEQ ID NO: 2327946 - RNA, 21 nt, Yersinia pestis KIM
ugagcgccaugcgcuuucagc

SEQ ID NO: 2327947 - RNA, 14 nt, Yersinia pestis KIM
ugagcgcuauuuau

SEQ ID NO: 2327948 - RNA, 18 nt, Yersinia pestis KIM
ugagcuggcaaaacucag

SEQ ID NO: 2327949 - RNA, 19 nt, Yersinia pestis KIM
ugaggcaacauuuguugca

SEQ ID NO: 2327950 - RNA, 20 nt, Yersinia pestis KIM
ugagguuuuaccaauccccg

SEQ ID NO: 2327951 - RNA, 23 nt, Yersinia pestis KIM
ugaguaaaaauucaagagaggua

SEQ ID NO: 2327952 - RNA, 24 nt, Yersinia pestis KIM
ugaguaaaaauucaagagagguaa

SEQ ID NO: 2327953 - RNA, 15 nt, Yersinia pestis KIM
ugaguaaaagauuca

SEQ ID NO: 2327954 - RNA, 20 nt, Yersinia pestis KIM
ugaguaaaccguacauuaaa

SEQ ID NO: 2327955 - RNA, 21 nt, Yersinia pestis KIM
ugagguuauugacaaagugcc

SEQ ID NO: 2327956 - RNA, 23 nt, Yersinia pestis KIM
ugaguauccaauaagcguauuuu

SEQ ID NO: 2327957 - RNA, 22 nt, Yersinia pestis KIM
ugaguagcuaauaaaauggcua

SEQ ID NO: 2327958 - RNA, 15 nt, Yersinia pestis KIM
ugaguagcauaaaaa

SEQ ID NO: 2327959 - RNA, 18 nt, Yersinia pestis KIM
ugaguauacuaaaacagc

SEQ ID NO: 2327960 - RNA, 13 nt, Yersinia pestis KIM
ugaguaguggagc

SEQ ID NO: 2327961 - RNA, 17 nt, Yersinia pestis KIM
ugaguaauuucagauaa

SEQ ID NO: 2327962 - RNA, 15 nt, Yersinia pestis KIM
ugaccuucccuucag

SEQ ID NO: 2327963 - RNA, 21 nt, Yersinia pestis KIM
ugacgaaauuuaagaaaucua

SEQ ID NO: 2327964 - RNA, 21 nt, Yersinia pestis KIM
ugacuuuaaaaaaauuaucau

SEQ ID NO: 2327965 - RNA, 15 nt, Yersinia pestis KIM
ugacuggcuauuaga

SEQ ID NO: 2327966 - RNA, 13 nt, Yersinia pestis KIM
ugacuguaaauau

SEQ ID NO: 2327967 - RNA, 20 nt, Yersinia pestis KIM
ugacugugcgcggcuagcca

SEQ ID NO: 2327968 - RNA, 17 nt, Yersinia pestis KIM
ugacuuuccuugcuuaa

SEQ ID NO: 2327969 - RNA, 15 nt, Yersinia pestis KIM
ugagauccuccauau

SEQ ID NO: 2327970 - RNA, 18 nt, Yersinia pestis KIM
ugagauccugaaaauaga

SEQ ID NO: 2327971 - RNA, 21 nt, Yersinia pestis KIM
ugagaucgaacugauaacugc

SEQ ID NO: 2327972 - RNA, 19 nt, Yersinia pestis KIM
ugagaauuauaacuauuau

SEQ ID NO: 2327973 - RNA, 16 nt, Yersinia pestis KIM
ugagaauaucuauaua

SEQ ID NO: 2327974 - RNA, 21 nt, Yersinia pestis KIM
ugagaaggguauugaagauac

SEQ ID NO: 2327975 - RNA, 18 nt, Yersinia pestis KIM
ugagaaacauccuaaaaa

SEQ ID NO: 2327976 - RNA, 21 nt, Yersinia pestis KIM
ugagcagcaacuguuuuauug

SEQ ID NO: 2327977 - RNA, 22 nt, Yersinia pestis KIM
ugagcacgauuaccauuacuuc

SEQ ID NO: 2327978 - RNA, 13 nt, Yersinia pestis KIM
ugagauuauuggc

SEQ ID NO: 2327979 - RNA, 15 nt, Yersinia pestis KIM
ugagaugaacacaga

SEQ ID NO: 2327980 - RNA, 15 nt, Yersinia pestis KIM
ugagcauauucagua

SEQ ID NO: 2327981 - RNA, 19 nt, Yersinia pestis KIM
ugagcauauucaguaacaa

SEQ ID NO: 2327982 - RNA, 18 nt, Yersinia pestis KIM
ugagcaucacuucauaca

SEQ ID NO: 2327983 - RNA, 21 nt, Yersinia pestis KIM
ugagcaucaacauuguccugc

SEQ ID NO: 2327984 - RNA, 20 nt, Yersinia pestis KIM
ugagccacaacgcacugaag

SEQ ID NO: 2327985 - RNA, 20 nt, Yersinia pestis KIM
ugagccgcauugauccucgu

SEQ ID NO: 2327986 - RNA, 13 nt, Yersinia pestis KIM
ugcgacaggcuca

SEQ ID NO: 2327987 - RNA, 15 nt, Yersinia pestis KIM
ugccuccaguugagu

SEQ ID NO: 2327988 - RNA, 14 nt, Yersinia pestis KIM
ugcgacgcagaaua

SEQ ID NO: 2327989 - RNA, 14 nt, Yersinia pestis KIM
ugcgcagcaaauaa

SEQ ID NO: 2327990 - RNA, 21 nt, Yersinia pestis KIM
ugcgauuuaauguucauucaa

SEQ ID NO: 2327991 - RNA, 12 nt, Yersinia pestis KIM
ugcgcgcagcaa

SEQ ID NO: 2327992 - RNA, 16 nt, Yersinia pestis KIM
ugcgcgaaauauugcc

SEQ ID NO: 2327993 - RNA, 14 nt, Yersinia pestis KIM
aaauggucaggaac

SEQ ID NO: 2327994 - RNA, 18 nt, Yersinia pestis KIM
aaauggguauauuuacca

SEQ ID NO: 2327995 - RNA, 17 nt, Yersinia pestis KIM
aaaugguuugcuguucu

SEQ ID NO: 2327996 - RNA, 20 nt, Yersinia pestis KIM
aaauggcacuggaaacaaaa

SEQ ID NO: 2327997 - RNA, 18 nt, Yersinia pestis KIM
aaauggcagcccuuauuc

SEQ ID NO: 2327998 - RNA, 16 nt, Yersinia pestis KIM
aaauggcaacaucagg

SEQ ID NO: 2327999 - RNA, 15 nt, Yersinia pestis KIM
aaauggccuugccca

SEQ ID NO: 2328000 - RNA, 14 nt, Yersinia pestis KIM
ugcgcaucagccag

SEQ ID NO: 2328001 - RNA, 23 nt, Yersinia pestis KIM
ugcggauuuuuuugcaauuaauu

SEQ ID NO: 2328002 - RNA, 14 nt, Yersinia pestis KIM
ugcggacagcgcgc

SEQ ID NO: 2328003 - RNA, 17 nt, Yersinia pestis KIM
ugcgcugagugauagug

SEQ ID NO: 2328004 - RNA, 18 nt, Yersinia pestis KIM
ugcgcugaguuugcuacu

SEQ ID NO: 2328005 - RNA, 18 nt, Yersinia pestis KIM
ugcgcuccauuucugguu

SEQ ID NO: 2328006 - RNA, 15 nt, Yersinia pestis KIM
ugcgcucuaaacgaa

SEQ ID NO: 2328007 - RNA, 17 nt, Yersinia pestis KIM
ugcgcucacuuuuauug

SEQ ID NO: 2328008 - RNA, 18 nt, Yersinia pestis KIM
ugcgcggguaacaacuca

SEQ ID NO: 2328009 - RNA, 22 nt, Yersinia pestis KIM
ugcgcggguaacaacucaccgc

SEQ ID NO: 2328010 - RNA, 19 nt, Yersinia pestis KIM
ugcgggcuaaaacuggcac

SEQ ID NO: 2328011 - RNA, 17 nt, Yersinia pestis KIM
ugcgggauucgaaccug

SEQ ID NO: 2328012 - RNA, 19 nt, Yersinia pestis KIM
ugcggguucaagucccgcc

SEQ ID NO: 2328013 - RNA, 15 nt, Yersinia pestis KIM
ugcgguacgcaggcc

SEQ ID NO: 2328014 - RNA, 23 nt, Yersinia pestis KIM
ugcgguaaccagcaucaguagca

SEQ ID NO: 2328015 - RNA, 19 nt, Yersinia pestis KIM
ugccgagaacagaauguug

SEQ ID NO: 2328016 - RNA, 17 nt, Yersinia pestis KIM
ugcccuuuuugguuuuc

SEQ ID NO: 2328017 - RNA, 14 nt, Yersinia pestis KIM
ugccgacaaccaac

SEQ ID NO: 2328018 - RNA, 17 nt, Yersinia pestis KIM
ugcccuuugcuauucag

SEQ ID NO: 2328019 - RNA, 18 nt, Yersinia pestis KIM
ugcccuuacuauuuuucu

SEQ ID NO: 2328020 - RNA, 17 nt, Yersinia pestis KIM
ugcccugccugguauuu

SEQ ID NO: 2328021 - RNA, 17 nt, Yersinia pestis KIM
ugcccguuaauauuaau

SEQ ID NO: 2328022 - RNA, 19 nt, Yersinia pestis KIM
ugcccguuaauauuaaucg

SEQ ID NO: 2328023 - RNA, 16 nt, Yersinia pestis KIM
ugccgccccuuccaau

SEQ ID NO: 2328024 - RNA, 19 nt, Yersinia pestis KIM
ugccgcaagaaagaaaaau

SEQ ID NO: 2328025 - RNA, 18 nt, Yersinia pestis KIM
ugccgaugagcuucuuca

SEQ ID NO: 2328026 - RNA, 16 nt, Yersinia pestis KIM
ugccgaugucaauaaa

SEQ ID NO: 2328027 - RNA, 12 nt, Yersinia pestis KIM
ugccgcuuuagu

SEQ ID NO: 2328028 - RNA, 18 nt, Yersinia pestis KIM
ugccgcggcggccagcgg

SEQ ID NO: 2328029 - RNA, 15 nt, Yersinia pestis KIM
ugccgcucaugcccc

SEQ ID NO: 2328030 - RNA, 13 nt, Yersinia pestis KIM
ugccgccucugcu

SEQ ID NO: 2328031 - RNA, 19 nt, Yersinia pestis KIM
ugccgccucugcuccggua

SEQ ID NO: 2328032 - RNA, 17 nt, Yersinia pestis KIM
ugccgcgcccccagcca

SEQ ID NO: 2328033 - RNA, 21 nt, Yersinia pestis KIM
ugccgucaaugccuguuauaa

SEQ ID NO: 2328034 - RNA, 17 nt, Yersinia pestis KIM
ugccgggcaauguguag

SEQ ID NO: 2328035 - RNA, 24 nt, Yersinia pestis KIM
ugccgggcggauccccugauaauu

SEQ ID NO: 2328036 - RNA, 15 nt, Yersinia pestis KIM
ugccggcggcgcugg

SEQ ID NO: 2328037 - RNA, 15 nt, Yersinia pestis KIM
ugccgugucuuccag

SEQ ID NO: 2328038 - RNA, 20 nt, Yersinia pestis KIM
ugccguuaauugugaucagu

SEQ ID NO: 2328039 - RNA, 22 nt, Yersinia pestis KIM
ugccguucuccaguugccagca

SEQ ID NO: 2328040 - RNA, 23 nt, Yersinia pestis KIM
ugccuauccucaccguucaagau

SEQ ID NO: 2328041 - RNA, 16 nt, Yersinia pestis KIM
ugccuaucuuaaaaau

SEQ ID NO: 2328042 - RNA, 12 nt, Yersinia pestis KIM
ugccucacuguc

SEQ ID NO: 2328043 - RNA, 15 nt, Yersinia pestis KIM
ugccucacugucuuu

SEQ ID NO: 2328044 - RNA, 21 nt, Yersinia pestis KIM
ugcccgaucaggugaugucag

SEQ ID NO: 2328045 - RNA, 24 nt, Yersinia pestis KIM
ugccccuaagaaucggccagugcc

SEQ ID NO: 2328046 - RNA, 21 nt, Yersinia pestis KIM
ugcccgcacacugagccgccc

SEQ ID NO: 2328047 - RNA, 19 nt, Yersinia pestis KIM
ugcccgcgcuuccaggcug

SEQ ID NO: 2328048 - RNA, 14 nt, Yersinia pestis KIM
ugcccgcgcuucca

SEQ ID NO: 2328049 - RNA, 13 nt, Yersinia pestis KIM
ugccccacuucac

SEQ ID NO: 2328050 - RNA, 21 nt, Yersinia pestis KIM
ugcccaucacaucgcccugag

SEQ ID NO: 2328051 - RNA, 11 nt, Yersinia pestis KIM
ugcccauccuc

SEQ ID NO: 2328052 - RNA, 18 nt, Yersinia pestis KIM
ugcccaucuuuuaguaac

SEQ ID NO: 2328053 - RNA, 23 nt, Yersinia pestis KIM
ugccccaucagcacuccccgccc

SEQ ID NO: 2328054 - RNA, 21 nt, Yersinia pestis KIM
ugcccagucacuaccgcucag

SEQ ID NO: 2328055 - RNA, 20 nt, Yersinia pestis KIM
ugcccaguuuaccauccacu

SEQ ID NO: 2328056 - RNA, 16 nt, Yersinia pestis KIM
ugcccagccucuggau

SEQ ID NO: 2328057 - RNA, 17 nt, Yersinia pestis KIM
ugcccagccugguuuuu

SEQ ID NO: 2328058 - RNA, 14 nt, Yersinia pestis KIM
ugcccagagcgcgg

SEQ ID NO: 2328059 - RNA, 13 nt, Yersinia pestis KIM
ugcccagaaaacc

SEQ ID NO: 2328060 - RNA, 16 nt, Yersinia pestis KIM
ugccagccccaaucac

SEQ ID NO: 2328061 - RNA, 13 nt, Yersinia pestis KIM
ugccagcccugau

SEQ ID NO: 2328062 - RNA, 17 nt, Yersinia pestis KIM
ugccagcagcaaguuag

SEQ ID NO: 2328063 - RNA, 18 nt, Yersinia pestis KIM
ugccagccggugauuggg

SEQ ID NO: 2328064 - RNA, 18 nt, Yersinia pestis KIM
ugccagcgcaaaaggcau

SEQ ID NO: 2328065 - RNA, 19 nt, Yersinia pestis KIM
ugccagcgcuuuaggcaag

SEQ ID NO: 2328066 - RNA, 20 nt, Yersinia pestis KIM
ugccaguuauuauuuuuaau

SEQ ID NO: 2328067 - RNA, 16 nt, Yersinia pestis KIM
ugccagucuaaaaugg

SEQ ID NO: 2328068 - RNA, 18 nt, Yersinia pestis KIM
ugccagugaaucagccag

SEQ ID NO: 2328069 - RNA, 11 nt, Yersinia pestis KIM
ugccagugaau

SEQ ID NO: 2328070 - RNA, 22 nt, Yersinia pestis KIM
ugccauaaaguuuuuccucaaa

SEQ ID NO: 2328071 - RNA, 21 nt, Yersinia pestis KIM
ugccaguuauuauuuuuaaug

SEQ ID NO: 2328072 - RNA, 14 nt, Yersinia pestis KIM
ugccauaacaucgu

SEQ ID NO: 2328073 - RNA, 21 nt, Yersinia pestis KIM
ugccauaaccgcuaaggccaa

SEQ ID NO: 2328074 - RNA, 14 nt, Yersinia pestis KIM
ugccaguaauucac

SEQ ID NO: 2328075 - RNA, 21 nt, Yersinia pestis KIM
ugccaguaauucacugcuuaa

SEQ ID NO: 2328076 - RNA, 22 nt, Yersinia pestis KIM
ugccagggcguuuaccauccag

SEQ ID NO: 2328077 - RNA, 12 nt, Yersinia pestis KIM
ugccauucaagc

SEQ ID NO: 2328078 - RNA, 15 nt, Yersinia pestis KIM
ugccaugucggcagg

SEQ ID NO: 2328079 - RNA, 22 nt, Yersinia pestis KIM
ugccauguugaguuuacgcagu

SEQ ID NO: 2328080 - RNA, 15 nt, Yersinia pestis KIM
ugccauggucaguuu

SEQ ID NO: 2328081 - RNA, 18 nt, Yersinia pestis KIM
ugcccaauggcaaaacag

SEQ ID NO: 2328082 - RNA, 12 nt, Yersinia pestis KIM
ugccauccugcc

SEQ ID NO: 2328083 - RNA, 16 nt, Yersinia pestis KIM
ugccaugcacuccacu

SEQ ID NO: 2328084 - RNA, 15 nt, Yersinia pestis KIM
ugccaucgccaacag

SEQ ID NO: 2328085 - RNA, 18 nt, Yersinia pestis KIM
ugccaucgcuugauaaca

SEQ ID NO: 2328086 - RNA, 22 nt, Yersinia pestis KIM
ugccaucuuguucuaauaauaa

SEQ ID NO: 2328087 - RNA, 23 nt, Yersinia pestis KIM
ugccauagcugcugcuuucagug

SEQ ID NO: 2328088 - RNA, 14 nt, Yersinia pestis KIM
ugccauagcugcug

SEQ ID NO: 2328089 - RNA, 21 nt, Yersinia pestis KIM
ugccauacccugguagcacca

SEQ ID NO: 2328090 - RNA, 14 nt, Yersinia pestis KIM
ugccauaccaggcc

SEQ ID NO: 2328091 - RNA, 21 nt, Yersinia pestis KIM
ugccauauucgcggccugcug

SEQ ID NO: 2328092 - RNA, 14 nt, Yersinia pestis KIM
ugccaucaggauuu

SEQ ID NO: 2328093 - RNA, 13 nt, Yersinia pestis KIM
ugccacauuuccc

SEQ ID NO: 2328094 - RNA, 12 nt, Yersinia pestis KIM
ugccacuguuca

SEQ ID NO: 2328095 - RNA, 18 nt, Yersinia pestis KIM
ugccagcaccgcuuucaa

SEQ ID NO: 2328096 - RNA, 14 nt, Yersinia pestis KIM
ugccagcagcaagu

SEQ ID NO: 2328097 - RNA, 23 nt, Yersinia pestis KIM
ugccaauaaaguccaccucgaaa

SEQ ID NO: 2328098 - RNA, 14 nt, Yersinia pestis KIM
ugccaagucucuag

SEQ ID NO: 2328099 - RNA, 20 nt, Yersinia pestis KIM
ugccacacagaaucaccaac

SEQ ID NO: 2328100 - RNA, 19 nt, Yersinia pestis KIM
ugccaagguucgaaaaaac

SEQ ID NO: 2328101 - RNA, 21 nt, Yersinia pestis KIM
ugccaacagcgagauagucag

SEQ ID NO: 2328102 - RNA, 16 nt, Yersinia pestis KIM
ugccaaauauugcaca

SEQ ID NO: 2328103 - RNA, 18 nt, Yersinia pestis KIM
ugccaaauaucuuucagc

SEQ ID NO: 2328104 - RNA, 22 nt, Yersinia pestis KIM
ugccaacaacuggguggccagu

SEQ ID NO: 2328105 - RNA, 23 nt, Yersinia pestis KIM
ugccaaaaugccuaccguuagca

SEQ ID NO: 2328106 - RNA, 18 nt, Yersinia pestis KIM
ugcauccgcaaaaugggu

SEQ ID NO: 2328107 - RNA, 17 nt, Yersinia pestis KIM
ugcaugaaaacccuguu

SEQ ID NO: 2328108 - RNA, 21 nt, Yersinia pestis KIM
ugcaucuuuaauuaaugguca

SEQ ID NO: 2328109 - RNA, 17 nt, Yersinia pestis KIM
ugcaggcugucaggaac

SEQ ID NO: 2328110 - RNA, 14 nt, Yersinia pestis KIM
ugcaggcuaccaga

SEQ ID NO: 2328111 - RNA, 20 nt, Yersinia pestis KIM
ugcaggcuaccagaaauaac

SEQ ID NO: 2328112 - RNA, 21 nt, Yersinia pestis KIM
ugcauccacuuuuucucuccu

SEQ ID NO: 2328113 - RNA, 14 nt, Yersinia pestis KIM
ugcauauuucucuu

SEQ ID NO: 2328114 - RNA, 21 nt, Yersinia pestis KIM
ugcauauuauuuugcacacga

SEQ ID NO: 2328115 - RNA, 19 nt, Yersinia pestis KIM
ugcauauaaaacacgcaua

SEQ ID NO: 2328116 - RNA, 14 nt, Yersinia pestis KIM
ugcauagcuaaccu

SEQ ID NO: 2328117 - RNA, 13 nt, Yersinia pestis KIM
ugcaggcccagca

SEQ ID NO: 2328118 - RNA, 15 nt, Yersinia pestis KIM
ugcagagaugcagug

SEQ ID NO: 2328119 - RNA, 20 nt, Yersinia pestis KIM
ugcagagguacccuugcaaa

SEQ ID NO: 2328120 - RNA, 14 nt, Yersinia pestis KIM
ugcagacucuuaua

SEQ ID NO: 2328121 - RNA, 23 nt, Yersinia pestis KIM
ugcagaauaucuuccacaugcuu

SEQ ID NO: 2328122 - RNA, 18 nt, Yersinia pestis KIM
ugcagcgauauacaucac

SEQ ID NO: 2328123 - RNA, 17 nt, Yersinia pestis KIM
ugcagcgauauacauca

SEQ ID NO: 2328124 - RNA, 23 nt, Yersinia pestis KIM
ugcagcauuuucagcaacugacc

SEQ ID NO: 2328125 - RNA, 18 nt, Yersinia pestis KIM
ugcagccaacgcccugca

SEQ ID NO: 2328126 - RNA, 21 nt, Yersinia pestis KIM
ugcagccaacgcccugcaucu

SEQ ID NO: 2328127 - RNA, 18 nt, Yersinia pestis KIM
ugcagaagggcggccagc

SEQ ID NO: 2328128 - RNA, 14 nt, Yersinia pestis KIM
ugcacccccuucgg

SEQ ID NO: 2328129 - RNA, 19 nt, Yersinia pestis KIM
ugcaccccacaugccaccc

SEQ ID NO: 2328130 - RNA, 14 nt, Yersinia pestis KIM
ugcacccaauggca

SEQ ID NO: 2328131 - RNA, 17 nt, Yersinia pestis KIM
ugcacccaauggcaaca

SEQ ID NO: 2328132 - RNA, 16 nt, Yersinia pestis KIM
ugauuuguuaaaacag

SEQ ID NO: 2328133 - RNA, 18 nt, Yersinia pestis KIM
ugauuuguuaaaacaguu

SEQ ID NO: 2328134 - RNA, 15 nt, Yersinia pestis KIM
uccaguauuucagua

SEQ ID NO: 2328135 - RNA, 22 nt, Yersinia pestis KIM
uccauaaaaucgaacccuucag

SEQ ID NO: 2328136 - RNA, 13 nt, Yersinia pestis KIM
uccaguaagccug

SEQ ID NO: 2328137 - RNA, 16 nt, Yersinia pestis KIM
uccaggguaauaagug

SEQ ID NO: 2328138 - RNA, 14 nt, Yersinia pestis KIM
uccaggcuggccac

SEQ ID NO: 2328139 - RNA, 21 nt, Yersinia pestis KIM
uccaggcuuuuguuaauucac

SEQ ID NO: 2328140 - RNA, 15 nt, Yersinia pestis KIM
uccagccugguuggu

SEQ ID NO: 2328141 - RNA, 21 nt, Yersinia pestis KIM
uccagcaccacaauggcagag

SEQ ID NO: 2328142 - RNA, 20 nt, Yersinia pestis KIM
uccagcagccucuaacauac

SEQ ID NO: 2328143 - RNA, 18 nt, Yersinia pestis KIM
uccaccgggccuaaucau

SEQ ID NO: 2328144 - RNA, 14 nt, Yersinia pestis KIM
uccacgaaggcacc

SEQ ID NO: 2328145 - RNA, 16 nt, Yersinia pestis KIM
uccagaauauaaaagc

SEQ ID NO: 2328146 - RNA, 23 nt, Yersinia pestis KIM
uccagaugaauauguuccaucag

SEQ ID NO: 2328147 - RNA, 13 nt, Yersinia pestis KIM
uccagauaauccg

SEQ ID NO: 2328148 - RNA, 15 nt, Yersinia pestis KIM
uccagcaaaagccuc

SEQ ID NO: 2328149 - RNA, 17 nt, Yersinia pestis KIM
uccagaccgcguaagcc

SEQ ID NO: 2328150 - RNA, 19 nt, Yersinia pestis KIM
uccacauauauagagaaau

SEQ ID NO: 2328151 - RNA, 19 nt, Yersinia pestis KIM
uccacaugcuuuuuuuaag

SEQ ID NO: 2328152 - RNA, 22 nt, Yersinia pestis KIM
uccacccggcauuguuggcccg

SEQ ID NO: 2328153 - RNA, 18 nt, Yersinia pestis KIM
uccacauaaaaagaaaaa

SEQ ID NO: 2328154 - RNA, 21 nt, Yersinia pestis KIM
uccacauaaaaagaaaaaaac

SEQ ID NO: 2328155 - RNA, 20 nt, Yersinia pestis KIM
uccacauaaaauagcccagu

SEQ ID NO: 2328156 - RNA, 23 nt, Yersinia pestis KIM
uccacauaaaauagcccagugcg

SEQ ID NO: 2328157 - RNA, 14 nt, Yersinia pestis KIM
uccaaaggaagggg

SEQ ID NO: 2328158 - RNA, 23 nt, Yersinia pestis KIM
uccaaaggaagggguucuuccaa

SEQ ID NO: 2328159 - RNA, 14 nt, Yersinia pestis KIM
uccaaaauugcauu

SEQ ID NO: 2328160 - RNA, 22 nt, Yersinia pestis KIM
uccaaaugacagcaucaauauc

SEQ ID NO: 2328161 - RNA, 18 nt, Yersinia pestis KIM
ucaucgggguuugucagc

SEQ ID NO: 2328162 - RNA, 13 nt, Yersinia pestis KIM
ucaucgguaccag

SEQ ID NO: 2328163 - RNA, 21 nt, Yersinia pestis KIM
ucaucgucggcccggccaggc

SEQ ID NO: 2328164 - RNA, 22 nt, Yersinia pestis KIM
ucaucuacaacaucaucgucaa

SEQ ID NO: 2328165 - RNA, 16 nt, Yersinia pestis KIM
ucaucugaccaaacau

SEQ ID NO: 2328166 - RNA, 15 nt, Yersinia pestis KIM
ucaucucugccccua

SEQ ID NO: 2328167 - RNA, 22 nt, Yersinia pestis KIM
ucaucugcgguaaccaauaaca

SEQ ID NO: 2328168 - RNA, 17 nt, Yersinia pestis KIM
ucaucuuuugcuauuaa

SEQ ID NO: 2328169 - RNA, 13 nt, Yersinia pestis KIM
ucaucuuucucau

SEQ ID NO: 2328170 - RNA, 16 nt, Yersinia pestis KIM
ucaucuuuaacaacaa

SEQ ID NO: 2328171 - RNA, 16 nt, Yersinia pestis KIM
ucaucuuuaauaauag

SEQ ID NO: 2328172 - RNA, 20 nt, Yersinia pestis KIM
ucaucuugggcgggaucucc

SEQ ID NO: 2328173 - RNA, 12 nt, Yersinia pestis KIM
ucaucuucuuca

SEQ ID NO: 2328174 - RNA, 14 nt, Yersinia pestis KIM
ucaugcgcagaaaa

SEQ ID NO: 2328175 - RNA, 19 nt, Yersinia pestis KIM
ucaugcugaaucuguaagu

SEQ ID NO: 2328176 - RNA, 18 nt, Yersinia pestis KIM
ucaugcugcggguagcau

SEQ ID NO: 2328177 - RNA, 19 nt, Yersinia pestis KIM
ucaugcucacaaucaucgu

SEQ ID NO: 2328178 - RNA, 14 nt, Yersinia pestis KIM
ucaugauucucuau

SEQ ID NO: 2328179 - RNA, 17 nt, Yersinia pestis KIM
ucaugauagacagcaaa

SEQ ID NO: 2328180 - RNA, 17 nt, Yersinia pestis KIM
ucaugaguguuggccuc

SEQ ID NO: 2328181 - RNA, 21 nt, Yersinia pestis KIM
ucaugauaaaacuauucugcu

SEQ ID NO: 2328182 - RNA, 15 nt, Yersinia pestis KIM
ucaugaugaauacga

SEQ ID NO: 2328183 - RNA, 23 nt, Yersinia pestis KIM
ucaugacaucccagcacaaugca

SEQ ID NO: 2328184 - RNA, 16 nt, Yersinia pestis KIM
ucaugaggcucagacu

SEQ ID NO: 2328185 - RNA, 15 nt, Yersinia pestis KIM
ucaugacgcuggaaa

SEQ ID NO: 2328186 - RNA, 15 nt, Yersinia pestis KIM
ucaugaaugaggcug

SEQ ID NO: 2328187 - RNA, 21 nt, Yersinia pestis KIM
ucauuauuaaacugauuuaac

SEQ ID NO: 2328188 - RNA, 14 nt, Yersinia pestis KIM
ucauuauggauaau

SEQ ID NO: 2328189 - RNA, 21 nt, Yersinia pestis KIM
ucauuaucccccuaugcuaac

SEQ ID NO: 2328190 - RNA, 13 nt, Yersinia pestis KIM
ucauuacaucauc

SEQ ID NO: 2328191 - RNA, 22 nt, Yersinia pestis KIM
ucauuacccucauguaagccaa

SEQ ID NO: 2328192 - RNA, 16 nt, Yersinia pestis KIM
ucauuaccgcacacua

SEQ ID NO: 2328193 - RNA, 19 nt, Yersinia pestis KIM
ucauuauuuucaaccaguu

SEQ ID NO: 2328194 - RNA, 21 nt, Yersinia pestis KIM
ucauucugaucgaguucagug

SEQ ID NO: 2328195 - RNA, 13 nt, Yersinia pestis KIM
ucauguaagccaa

SEQ ID NO: 2328196 - RNA, 19 nt, Yersinia pestis KIM
ucauguaaggcaauaccaa

SEQ ID NO: 2328197 - RNA, 21 nt, Yersinia pestis KIM
ucauguaaggcaauaccaaua

SEQ ID NO: 2328198 - RNA, 23 nt, Yersinia pestis KIM
ucauggcgcuuuagccagucacc

SEQ ID NO: 2328199 - RNA, 17 nt, Yersinia pestis KIM
ucaugggaaacaagggc

SEQ ID NO: 2328200 - RNA, 16 nt, Yersinia pestis KIM
ucaugguacaacugcg

SEQ ID NO: 2328201 - RNA, 23 nt, Yersinia pestis KIM
ucauuaauccccggucacuuaaa

SEQ ID NO: 2328202 - RNA, 21 nt, Yersinia pestis KIM
ucauuaauuucaccacaucuu

SEQ ID NO: 2328203 - RNA, 13 nt, Yersinia pestis KIM
ucauuaacuguua

SEQ ID NO: 2328204 - RNA, 22 nt, Yersinia pestis KIM
ucauuuccucugggaaaccauu

SEQ ID NO: 2328205 - RNA, 17 nt, Yersinia pestis KIM
ucauuuccguuaaccca

SEQ ID NO: 2328206 - RNA, 14 nt, Yersinia pestis KIM
ucauuucagguaaa

SEQ ID NO: 2328207 - RNA, 15 nt, Yersinia pestis KIM
ucauuuaucuaaaac

SEQ ID NO: 2328208 - RNA, 21 nt, Yersinia pestis KIM
ucauuuaucuaaaacugccua

SEQ ID NO: 2328209 - RNA, 16 nt, Yersinia pestis KIM
ucauucugucaucaag

SEQ ID NO: 2328210 - RNA, 18 nt, Yersinia pestis KIM
ucauugcuguuguuauua

SEQ ID NO: 2328211 - RNA, 18 nt, Yersinia pestis KIM
ucauugcugcuguuauua

SEQ ID NO: 2328212 - RNA, 14 nt, Yersinia pestis KIM
ucauugguaauuuc

SEQ ID NO: 2328213 - RNA, 23 nt, Yersinia pestis KIM
ucauuggcguuacagcaaggcag

SEQ ID NO: 2328214 - RNA, 20 nt, Yersinia pestis KIM
uccaaaacaucggccagcgu

SEQ ID NO: 2328215 - RNA, 22 nt, Yersinia pestis KIM
uccaaaauaauauaauucaaua

SEQ ID NO: 2328216 - RNA, 22 nt, Yersinia pestis KIM
ucauuuuuugggaugaaaaaua

SEQ ID NO: 2328217 - RNA, 14 nt, Yersinia pestis KIM
ucauuuuuuaucuu

SEQ ID NO: 2328218 - RNA, 21 nt, Yersinia pestis KIM
ucauuuuucuugccuuuuuau

SEQ ID NO: 2328219 - RNA, 13 nt, Yersinia pestis KIM
ucauuuuucccuu

SEQ ID NO: 2328220 - RNA, 15 nt, Yersinia pestis KIM
ucauuuguuucucac

SEQ ID NO: 2328221 - RNA, 15 nt, Yersinia pestis KIM
ucauuuuaggugcag

SEQ ID NO: 2328222 - RNA, 13 nt, Yersinia pestis KIM
ucagcuagccugc

SEQ ID NO: 2328223 - RNA, 15 nt, Yersinia pestis KIM
ucagcucaccaccuc

SEQ ID NO: 2328224 - RNA, 21 nt, Yersinia pestis KIM
ucagcuuaccgguaaguaauu

SEQ ID NO: 2328225 - RNA, 18 nt, Yersinia pestis KIM
ucagcguggaauuaauau

SEQ ID NO: 2328226 - RNA, 21 nt, Yersinia pestis KIM
ucagcguuuuaaucacaucuc

SEQ ID NO: 2328227 - RNA, 23 nt, Yersinia pestis KIM
ucagcuuuuagggauauuucucc

SEQ ID NO: 2328228 - RNA, 23 nt, Yersinia pestis KIM
ucagcuucuucugggucuaucag

SEQ ID NO: 2328229 - RNA, 17 nt, Yersinia pestis KIM
ucaggaucaccagcaaa

SEQ ID NO: 2328230 - RNA, 15 nt, Yersinia pestis KIM
ucaggaucaccagca

SEQ ID NO: 2328231 - RNA, 14 nt, Yersinia pestis KIM
ucaggaagagaaaa

SEQ ID NO: 2328232 - RNA, 19 nt, Yersinia pestis KIM
ucaggaagagaaaagcaga

SEQ ID NO: 2328233 - RNA, 18 nt, Yersinia pestis KIM
ucaggaaggcggccacug

SEQ ID NO: 2328234 - RNA, 18 nt, Yersinia pestis KIM
ucaggaaaugcagacucu

SEQ ID NO: 2328235 - RNA, 14 nt, Yersinia pestis KIM
ucaggaaauuacca

SEQ ID NO: 2328236 - RNA, 23 nt, Yersinia pestis KIM
ucagccguaucuucugccagccc

SEQ ID NO: 2328237 - RNA, 19 nt, Yersinia pestis KIM
ucagccgcgaaaaaccaug

SEQ ID NO: 2328238 - RNA, 16 nt, Yersinia pestis KIM
ucagccucauucauga

SEQ ID NO: 2328239 - RNA, 21 nt, Yersinia pestis KIM
ucagccucuaaaggguaggua

SEQ ID NO: 2328240 - RNA, 15 nt, Yersinia pestis KIM
ucagccucauucaug

SEQ ID NO: 2328241 - RNA, 12 nt, Yersinia pestis KIM
ucagccuuuuuu

SEQ ID NO: 2328242 - RNA, 15 nt, Yersinia pestis KIM
ucagcgaaaaauuuc

SEQ ID NO: 2328243 - RNA, 22 nt, Yersinia pestis KIM
ucagcgacgucccuaaagccau

SEQ ID NO: 2328244 - RNA, 18 nt, Yersinia pestis KIM
ucagcgacuccuggcaau

SEQ ID NO: 2328245 - RNA, 14 nt, Yersinia pestis KIM
ucacuuaaauaacu

SEQ ID NO: 2328246 - RNA, 13 nt, Yersinia pestis KIM
ucacuuaaauaac

SEQ ID NO: 2328247 - RNA, 23 nt, Yersinia pestis KIM
ucacuguuggcgggauccaucug

SEQ ID NO: 2328248 - RNA, 22 nt, Yersinia pestis KIM
ucacugucuauuuuuauaauca

SEQ ID NO: 2328249 - RNA, 14 nt, Yersinia pestis KIM
ucacugucuauuuu

SEQ ID NO: 2328250 - RNA, 17 nt, Yersinia pestis KIM
ucacuguccaagaagcc

SEQ ID NO: 2328251 - RNA, 13 nt, Yersinia pestis KIM
ucacuguuagcua

SEQ ID NO: 2328252 - RNA, 21 nt, Yersinia pestis KIM
ucacugucaaaaagcaccuuu

SEQ ID NO: 2328253 - RNA, 18 nt, Yersinia pestis KIM
ucacucuucgcaaaauuu

SEQ ID NO: 2328254 - RNA, 13 nt, Yersinia pestis KIM
ucaguaauucacc

SEQ ID NO: 2328255 - RNA, 18 nt, Yersinia pestis KIM
ucaguaacuggauauuuu

SEQ ID NO: 2328256 - RNA, 23 nt, Yersinia pestis KIM
ucaguacauaaaccgugugcuuc

SEQ ID NO: 2328257 - RNA, 19 nt, Yersinia pestis KIM
ucaguacagucccugugcg

SEQ ID NO: 2328258 - RNA, 12 nt, Yersinia pestis KIM
ucaguaaaacca

SEQ ID NO: 2328259 - RNA, 16 nt, Yersinia pestis KIM
ucaguaaaaccagcag

SEQ ID NO: 2328260 - RNA, 18 nt, Yersinia pestis KIM
ucaggguuagccgacugg

SEQ ID NO: 2328261 - RNA, 22 nt, Yersinia pestis KIM
ucagguugaaauaaauaaguuc

SEQ ID NO: 2328262 - RNA, 13 nt, Yersinia pestis KIM
ucagguuguuccg

SEQ ID NO: 2328263 - RNA, 18 nt, Yersinia pestis KIM
ucagguugaaauaaauaa

SEQ ID NO: 2328264 - RNA, 19 nt, Yersinia pestis KIM
ucagggcauaagcgcccug

SEQ ID NO: 2328265 - RNA, 12 nt, Yersinia pestis KIM
ucagggccacuu

SEQ ID NO: 2328266 - RNA, 21 nt, Yersinia pestis KIM
ucagggcguauaaacagagcc

SEQ ID NO: 2328267 - RNA, 22 nt, Yersinia pestis KIM
ucaggggcaauuaucuuaucca

SEQ ID NO: 2328268 - RNA, 14 nt, Yersinia pestis KIM
ucagggugaaagcc

SEQ ID NO: 2328269 - RNA, 15 nt, Yersinia pestis KIM
ucagggagccaauag

SEQ ID NO: 2328270 - RNA, 17 nt, Yersinia pestis KIM
ucagggagccaauagag

SEQ ID NO: 2328271 - RNA, 16 nt, Yersinia pestis KIM
ucagggagucagggag

SEQ ID NO: 2328272 - RNA, 13 nt, Yersinia pestis KIM
ucagggcaauaac

SEQ ID NO: 2328273 - RNA, 21 nt, Yersinia pestis KIM
ucagggcaauaacaaacacau

SEQ ID NO: 2328274 - RNA, 18 nt, Yersinia pestis KIM
ucagucagggugaaagcc

SEQ ID NO: 2328275 - RNA, 20 nt, Yersinia pestis KIM
ucagucacuuugggcugauc

SEQ ID NO: 2328276 - RNA, 21 nt, Yersinia pestis KIM
ucagucaguguuucuauuuuc

SEQ ID NO: 2328277 - RNA, 20 nt, Yersinia pestis KIM
ucagucgccuuaaaugcgua

SEQ ID NO: 2328278 - RNA, 12 nt, Yersinia pestis KIM
ucaguuauaaaa

SEQ ID NO: 2328279 - RNA, 13 nt, Yersinia pestis KIM
ucaguuauaaaaa

SEQ ID NO: 2328280 - RNA, 16 nt, Yersinia pestis KIM
ucagucgcuuuuuaac

SEQ ID NO: 2328281 - RNA, 14 nt, Yersinia pestis KIM
ucaguuccugauuc

SEQ ID NO: 2328282 - RNA, 21 nt, Yersinia pestis KIM
ucaguuccuggcccguuaaca

SEQ ID NO: 2328283 - RNA, 13 nt, Yersinia pestis KIM
ucaguucaguauu

SEQ ID NO: 2328284 - RNA, 20 nt, Yersinia pestis KIM
ucaguuuuaauuuaugaaca

SEQ ID NO: 2328285 - RNA, 19 nt, Yersinia pestis KIM
ucauaaaaauacauaucaa

SEQ ID NO: 2328286 - RNA, 21 nt, Yersinia pestis KIM
ucauaaaaaaagccggguggc

SEQ ID NO: 2328287 - RNA, 22 nt, Yersinia pestis KIM
ucauaaaucacaauuucacccc

SEQ ID NO: 2328288 - RNA, 16 nt, Yersinia pestis KIM
ucauaaaucacaauuu

SEQ ID NO: 2328289 - RNA, 23 nt, Yersinia pestis KIM
ucauaagacuaacagaauauuga

SEQ ID NO: 2328290 - RNA, 13 nt, Yersinia pestis KIM
ucauaauaaugau

SEQ ID NO: 2328291 - RNA, 15 nt, Yersinia pestis KIM
ucauaauaaugauua

SEQ ID NO: 2328292 - RNA, 18 nt, Yersinia pestis KIM
ucauaaauuaaaacugaa

SEQ ID NO: 2328293 - RNA, 12 nt, Yersinia pestis KIM
ucauaaauuaaa

SEQ ID NO: 2328294 - RNA, 23 nt, Yersinia pestis KIM
ucauaacuaagagucacagcauu

SEQ ID NO: 2328295 - RNA, 18 nt, Yersinia pestis KIM
ucauaacuaagagucaca

SEQ ID NO: 2328296 - RNA, 14 nt, Yersinia pestis KIM
ucauccuaaagaua

SEQ ID NO: 2328297 - RNA, 14 nt, Yersinia pestis KIM
ucaucgaaauuccc

SEQ ID NO: 2328298 - RNA, 18 nt, Yersinia pestis KIM
ucaucccaaucaucaucc

SEQ ID NO: 2328299 - RNA, 15 nt, Yersinia pestis KIM
ucaucccuaaaauca

SEQ ID NO: 2328300 - RNA, 23 nt, Yersinia pestis KIM
ucaucccuaaaaucauugacguu

SEQ ID NO: 2328301 - RNA, 20 nt, Yersinia pestis KIM
ucaucccuuuagcgucuaac

SEQ ID NO: 2328302 - RNA, 20 nt, Yersinia pestis KIM
ucaucgcggguuuuuaacuu

SEQ ID NO: 2328303 - RNA, 16 nt, Yersinia pestis KIM
ucaucgcggaugccuu

SEQ ID NO: 2328304 - RNA, 21 nt, Yersinia pestis KIM
ucaucggcauacuccuuaauc

SEQ ID NO: 2328305 - RNA, 22 nt, Yersinia pestis KIM
ucaucgggaacaggaucugcuc

SEQ ID NO: 2328306 - RNA, 18 nt, Yersinia pestis KIM
ucaucgcuaaauacugcu

SEQ ID NO: 2328307 - RNA, 23 nt, Yersinia pestis KIM
ucaucgauugcuggcgcugauca

SEQ ID NO: 2328308 - RNA, 18 nt, Yersinia pestis KIM
ucaucgauugcuggcgcu

SEQ ID NO: 2328309 - RNA, 14 nt, Yersinia pestis KIM
ucaucaucgguacc

SEQ ID NO: 2328310 - RNA, 14 nt, Yersinia pestis KIM
ucaucaucuucuuc

SEQ ID NO: 2328311 - RNA, 15 nt, Yersinia pestis KIM
ucaucaucuucuuca

SEQ ID NO: 2328312 - RNA, 22 nt, Yersinia pestis KIM
ucaucauucauuuuaaaaaaau

SEQ ID NO: 2328313 - RNA, 20 nt, Yersinia pestis KIM
ucaucaugguucugcucaau

SEQ ID NO: 2328314 - RNA, 18 nt, Yersinia pestis KIM
ucaucaugguuucgcagg

SEQ ID NO: 2328315 - RNA, 21 nt, Yersinia pestis KIM
ucauccaacuuaccuugaucc

SEQ ID NO: 2328316 - RNA, 15 nt, Yersinia pestis KIM
ucaucacugaaagug

SEQ ID NO: 2328317 - RNA, 21 nt, Yersinia pestis KIM
ucaucacugccgucaaugccu

SEQ ID NO: 2328318 - RNA, 16 nt, Yersinia pestis KIM
ucaucagagucuguca

SEQ ID NO: 2328319 - RNA, 13 nt, Yersinia pestis KIM
ucaucagcccagc

SEQ ID NO: 2328320 - RNA, 13 nt, Yersinia pestis KIM
ucaucagcagcag

SEQ ID NO: 2328321 - RNA, 24 nt, Yersinia pestis KIM
ucaucagcguuacccagauaguag

SEQ ID NO: 2328322 - RNA, 13 nt, Yersinia pestis KIM
ucaucagcgccuu

SEQ ID NO: 2328323 - RNA, 14 nt, Yersinia pestis KIM
ucaucagcgcuggc

SEQ ID NO: 2328324 - RNA, 18 nt, Yersinia pestis KIM
ucaucauaaaaauacaua

SEQ ID NO: 2328325 - RNA, 14 nt, Yersinia pestis KIM
ucaucauaaaaaua

SEQ ID NO: 2328326 - RNA, 20 nt, Yersinia pestis KIM
ucaucaguuggucuuuaauc

SEQ ID NO: 2328327 - RNA, 11 nt, Yersinia pestis KIM
ucaucaguuua

SEQ ID NO: 2328328 - RNA, 16 nt, Yersinia pestis KIM
ucaucaucacaaauaa

SEQ ID NO: 2328329 - RNA, 12 nt, Yersinia pestis KIM
ucaucaucaaca

SEQ ID NO: 2328330 - RNA, 14 nt, Yersinia pestis KIM
ucaucaucaaugga

SEQ ID NO: 2328331 - RNA, 22 nt, Yersinia pestis KIM
ucauauguucgaucaaaacaau

SEQ ID NO: 2328332 - RNA, 19 nt, Yersinia pestis KIM
ucauaugcgccuauaaggc

SEQ ID NO: 2328333 - RNA, 19 nt, Yersinia pestis KIM
ucauaucgcuaaaacacag

SEQ ID NO: 2328334 - RNA, 18 nt, Yersinia pestis KIM
ucauaucgcucaucaugg

SEQ ID NO: 2328335 - RNA, 15 nt, Yersinia pestis KIM
ucauaucgcuaaaac

SEQ ID NO: 2328336 - RNA, 16 nt, Yersinia pestis KIM
ucauaucgcuaaaaca

SEQ ID NO: 2328337 - RNA, 22 nt, Yersinia pestis KIM
ucauaucccccccaagagaaac

SEQ ID NO: 2328338 - RNA, 15 nt, Yersinia pestis KIM
ucauaucaaaauaaa

SEQ ID NO: 2328339 - RNA, 13 nt, Yersinia pestis KIM
ucauauuggccag

SEQ ID NO: 2328340 - RNA, 21 nt, Yersinia pestis KIM
ucauauucagccgauguguuu

SEQ ID NO: 2328341 - RNA, 15 nt, Yersinia pestis KIM
ucauauugaauuaaa

SEQ ID NO: 2328342 - RNA, 18 nt, Yersinia pestis KIM
ucauauugaauuaaauuu

SEQ ID NO: 2328343 - RNA, 19 nt, Yersinia pestis KIM
ucaucaaucgagaagaauu

SEQ ID NO: 2328344 - RNA, 19 nt, Yersinia pestis KIM
ucaucaccagucagccuua

SEQ ID NO: 2328345 - RNA, 18 nt, Yersinia pestis KIM
ucaucacccagcaaaaua

SEQ ID NO: 2328346 - RNA, 20 nt, Yersinia pestis KIM
ucaucaccuuauccaauaga

SEQ ID NO: 2328347 - RNA, 20 nt, Yersinia pestis KIM
ucaucaccguugaaaugucc

SEQ ID NO: 2328348 - RNA, 18 nt, Yersinia pestis KIM
ucaucaaccucagccuca

SEQ ID NO: 2328349 - RNA, 15 nt, Yersinia pestis KIM
ucaucaacgcgccuu

SEQ ID NO: 2328350 - RNA, 15 nt, Yersinia pestis KIM
ucaucaaccucagcc

SEQ ID NO: 2328351 - RNA, 15 nt, Yersinia pestis KIM
ucaucaaauucaggu

SEQ ID NO: 2328352 - RNA, 15 nt, Yersinia pestis KIM
ucaucaacugguuga

SEQ ID NO: 2328353 - RNA, 12 nt, Yersinia pestis KIM
ucaucaaaggca

SEQ ID NO: 2328354 - RNA, 15 nt, Yersinia pestis KIM
ucaucaaacuauuca

SEQ ID NO: 2328355 - RNA, 21 nt, Yersinia pestis KIM
ucaucaaccgggauaucaaau

SEQ ID NO: 2328356 - RNA, 21 nt, Yersinia pestis KIM
ucaucaaaauugauggucugu

SEQ ID NO: 2328357 - RNA, 22 nt, Yersinia pestis KIM
ucauacugacggggaguuuuua

SEQ ID NO: 2328358 - RNA, 21 nt, Yersinia pestis KIM
ucauacucccccauuuccugu

SEQ ID NO: 2328359 - RNA, 19 nt, Yersinia pestis KIM
ucauagaacuuaagcaaua

SEQ ID NO: 2328360 - RNA, 23 nt, Yersinia pestis KIM
ucauagaaggcggagaauguuaa

SEQ ID NO: 2328361 - RNA, 22 nt, Yersinia pestis KIM
ucauagcuacgggcaaacuccu

SEQ ID NO: 2328362 - RNA, 17 nt, Yersinia pestis KIM
ucauaguuaagacaauu

SEQ ID NO: 2328363 - RNA, 14 nt, Yersinia pestis KIM
ucauagguugcgcc

SEQ ID NO: 2328364 - RNA, 16 nt, Yersinia pestis KIM
ucauauaagcaauacc

SEQ ID NO: 2328365 - RNA, 20 nt, Yersinia pestis KIM
ucauaguuuuuauagacacg

SEQ ID NO: 2328366 - RNA, 21 nt, Yersinia pestis KIM
ucauacccaaauuacggcuca

SEQ ID NO: 2328367 - RNA, 12 nt, Yersinia pestis KIM
ucauacucaguc

SEQ ID NO: 2328368 - RNA, 19 nt, Yersinia pestis KIM
ucauacggcgauauuuauu

SEQ ID NO: 2328369 - RNA, 18 nt, Yersinia pestis KIM
ucaccgcuggaagccgcc

SEQ ID NO: 2328370 - RNA, 15 nt, Yersinia pestis KIM
ucaccgcccauaucc

SEQ ID NO: 2328371 - RNA, 23 nt, Yersinia pestis KIM
ucaccgcccccaauaagggccac

SEQ ID NO: 2328372 - RNA, 13 nt, Yersinia pestis KIM
ucaccgccgacca

SEQ ID NO: 2328373 - RNA, 22 nt, Yersinia pestis KIM
ucaccgccgaccaguggugcuc

SEQ ID NO: 2328374 - RNA, 20 nt, Yersinia pestis KIM
ucaccguauacgcugaauga

SEQ ID NO: 2328375 - RNA, 16 nt, Yersinia pestis KIM
ucaccguauacgcuga

SEQ ID NO: 2328376 - RNA, 13 nt, Yersinia pestis KIM
ucaccguagaacg

SEQ ID NO: 2328377 - RNA, 22 nt, Yersinia pestis KIM
ucaccgugacuguuaacaucca

SEQ ID NO: 2328378 - RNA, 23 nt, Yersinia pestis KIM
ucaccgaugauaagugaauaaau

SEQ ID NO: 2328379 - RNA, 14 nt, Yersinia pestis KIM
ucaccgcaaccugu

SEQ ID NO: 2328380 - RNA, 19 nt, Yersinia pestis KIM
ucacccgcaaaacugaagc

SEQ ID NO: 2328381 - RNA, 16 nt, Yersinia pestis KIM
ucaccgaaagaagaca

SEQ ID NO: 2328382 - RNA, 16 nt, Yersinia pestis KIM
ucacccauaccaacca

SEQ ID NO: 2328383 - RNA, 15 nt, Yersinia pestis KIM
ucaccagcaaaggcc

SEQ ID NO: 2328384 - RNA, 18 nt, Yersinia pestis KIM
ucaccagacaaccaauac

SEQ ID NO: 2328385 - RNA, 21 nt, Yersinia pestis KIM
ucaccagacaaccaauacaca

SEQ ID NO: 2328386 - RNA, 15 nt, Yersinia pestis KIM
ucaccacaugccaua

SEQ ID NO: 2328387 - RNA, 16 nt, Yersinia pestis KIM
ucaccauuuaggcguu

SEQ ID NO: 2328388 - RNA, 15 nt, Yersinia pestis KIM
ucaccauuaauaaua

SEQ ID NO: 2328389 - RNA, 14 nt, Yersinia pestis KIM
ucacauuuuuaaua

SEQ ID NO: 2328390 - RNA, 18 nt, Yersinia pestis KIM
ucacauuuuuaauaaugu

SEQ ID NO: 2328391 - RNA, 20 nt, Yersinia pestis KIM
ucaccaacaccaccaucacu

SEQ ID NO: 2328392 - RNA, 19 nt, Yersinia pestis KIM
ucaccaagaggaaaugccg

SEQ ID NO: 2328393 - RNA, 17 nt, Yersinia pestis KIM
ucaccaagauaccgagu

SEQ ID NO: 2328394 - RNA, 15 nt, Yersinia pestis KIM
ucaccaagaccaguu

SEQ ID NO: 2328395 - RNA, 16 nt, Yersinia pestis KIM
ucaccaagcuuuuauc

SEQ ID NO: 2328396 - RNA, 15 nt, Yersinia pestis KIM
ucaccaagcuuuuau

SEQ ID NO: 2328397 - RNA, 23 nt, Yersinia pestis KIM
ucaccaauauguucaucagggaa

SEQ ID NO: 2328398 - RNA, 14 nt, Yersinia pestis KIM
ucacacgcccaggc

SEQ ID NO: 2328399 - RNA, 18 nt, Yersinia pestis KIM
ucacacguuaaacccugu

SEQ ID NO: 2328400 - RNA, 19 nt, Yersinia pestis KIM
ucacacuguuuaguucacg

SEQ ID NO: 2328401 - RNA, 19 nt, Yersinia pestis KIM
ucacacuggcggacaucuu

SEQ ID NO: 2328402 - RNA, 17 nt, Yersinia pestis KIM
ucacacuggugcucacu

SEQ ID NO: 2328403 - RNA, 18 nt, Yersinia pestis KIM
ucacagacguuuaaauaa

SEQ ID NO: 2328404 - RNA, 13 nt, Yersinia pestis KIM
ucacgggcuucca

SEQ ID NO: 2328405 - RNA, 17 nt, Yersinia pestis KIM
ucacgggcuuccaucag

SEQ ID NO: 2328406 - RNA, 21 nt, Yersinia pestis KIM
ucacgggcuuccaucaggaag

SEQ ID NO: 2328407 - RNA, 18 nt, Yersinia pestis KIM
ucacgguagguuucuggg

SEQ ID NO: 2328408 - RNA, 17 nt, Yersinia pestis KIM
ucacgcucuugcucuuc

SEQ ID NO: 2328409 - RNA, 23 nt, Yersinia pestis KIM
ucacgcacucgaaucacuuauug

SEQ ID NO: 2328410 - RNA, 14 nt, Yersinia pestis KIM
ucacgcacgguaca

SEQ ID NO: 2328411 - RNA, 20 nt, Yersinia pestis KIM
ucacucaauuggacuaaccc

SEQ ID NO: 2328412 - RNA, 13 nt, Yersinia pestis KIM
ucacucaccgcca

SEQ ID NO: 2328413 - RNA, 20 nt, Yersinia pestis KIM
ucacuauuucaggcauauca

SEQ ID NO: 2328414 - RNA, 21 nt, Yersinia pestis KIM
ucacuauuucguguauaucac

SEQ ID NO: 2328415 - RNA, 21 nt, Yersinia pestis KIM
ucacucgcgugccguucaggu

SEQ ID NO: 2328416 - RNA, 14 nt, Yersinia pestis KIM
ucacuaaaucaaaa

SEQ ID NO: 2328417 - RNA, 18 nt, Yersinia pestis KIM
ucacuaaaucaaaaggaa

SEQ ID NO: 2328418 - RNA, 17 nt, Yersinia pestis KIM
ucacgguucaccccuca

SEQ ID NO: 2328419 - RNA, 16 nt, Yersinia pestis KIM
ucaccuaaaucauaca

SEQ ID NO: 2328420 - RNA, 14 nt, Yersinia pestis KIM
ucaccuaaaucaua

SEQ ID NO: 2328421 - RNA, 13 nt, Yersinia pestis KIM
ucaccucaucagu

SEQ ID NO: 2328422 - RNA, 15 nt, Yersinia pestis KIM
ucaccuccacuucaa

SEQ ID NO: 2328423 - RNA, 12 nt, Yersinia pestis KIM
ucaccucaucag

SEQ ID NO: 2328424 - RNA, 18 nt, Yersinia pestis KIM
ucaccucaccagcaucuu

SEQ ID NO: 2328425 - RNA, 18 nt, Yersinia pestis KIM
ucaccugaaugccauuca

SEQ ID NO: 2328426 - RNA, 23 nt, Yersinia pestis KIM
ucaccucuugcauacucaggccc

SEQ ID NO: 2328427 - RNA, 12 nt, Yersinia pestis KIM
ucaccuggccag

SEQ ID NO: 2328428 - RNA, 14 nt, Yersinia pestis KIM
ucaccuucugcccg

SEQ ID NO: 2328429 - RNA, 22 nt, Yersinia pestis KIM
ucaccuuccgucccaagaaaag

SEQ ID NO: 2328430 - RNA, 17 nt, Yersinia pestis KIM
ucaccuuccaaacuuug

SEQ ID NO: 2328431 - RNA, 15 nt, Yersinia pestis KIM
ucacgauggaaaaaa

SEQ ID NO: 2328432 - RNA, 18 nt, Yersinia pestis KIM
ucacgauaaucaaugcca

SEQ ID NO: 2328433 - RNA, 13 nt, Yersinia pestis KIM
ucaccuuggaaaa

SEQ ID NO: 2328434 - RNA, 17 nt, Yersinia pestis KIM
ucaccuuggaaaacagc

SEQ ID NO: 2328435 - RNA, 20 nt, Yersinia pestis KIM
ucacaccauagcgguuuauu

SEQ ID NO: 2328436 - RNA, 22 nt, Yersinia pestis KIM
ucacaccagacagaauauccag

SEQ ID NO: 2328437 - RNA, 20 nt, Yersinia pestis KIM
ucacaaugcuguuuugucau

SEQ ID NO: 2328438 - RNA, 12 nt, Yersinia pestis KIM
ucacaauuucac

SEQ ID NO: 2328439 - RNA, 14 nt, Yersinia pestis KIM
ucacaccaacacug

SEQ ID NO: 2328440 - RNA, 18 nt, Yersinia pestis KIM
ucacaaucucuggcaacg

SEQ ID NO: 2328441 - RNA, 16 nt, Yersinia pestis KIM
ucacaacuuucccagu

SEQ ID NO: 2328442 - RNA, 13 nt, Yersinia pestis KIM
ucacaacuuuuau

SEQ ID NO: 2328443 - RNA, 17 nt, Yersinia pestis KIM
ucacaacuuuuauuggc

SEQ ID NO: 2328444 - RNA, 13 nt, Yersinia pestis KIM
ucaauuaucaaaa

SEQ ID NO: 2328445 - RNA, 18 nt, Yersinia pestis KIM
ucaauguuggcccaagau

SEQ ID NO: 2328446 - RNA, 23 nt, Yersinia pestis KIM
ucaauuuuugcgugauauugaug

SEQ ID NO: 2328447 - RNA, 21 nt, Yersinia pestis KIM
ucaauuugguauuggcuagaa

SEQ ID NO: 2328448 - RNA, 15 nt, Yersinia pestis KIM
ucacaaccccaccuc

SEQ ID NO: 2328449 - RNA, 19 nt, Yersinia pestis KIM
ucacaacccccccgaccca

SEQ ID NO: 2328450 - RNA, 22 nt, Yersinia pestis KIM
ucaauccuacaauaucuucccu

SEQ ID NO: 2328451 - RNA, 14 nt, Yersinia pestis KIM
ucaaucgagaagaa

SEQ ID NO: 2328452 - RNA, 15 nt, Yersinia pestis KIM
ucaaucaauugcccc

SEQ ID NO: 2328453 - RNA, 20 nt, Yersinia pestis KIM
ucaaguuagcaggcagcacg

SEQ ID NO: 2328454 - RNA, 18 nt, Yersinia pestis KIM
ucaagugcucacucggua

SEQ ID NO: 2328455 - RNA, 19 nt, Yersinia pestis KIM
ucaaucgucaauccaauca

SEQ ID NO: 2328456 - RNA, 18 nt, Yersinia pestis KIM
ucaaucggcggcaucuau

SEQ ID NO: 2328457 - RNA, 23 nt, Yersinia pestis KIM
ucaaucuagaggacggcggccuu

SEQ ID NO: 2328458 - RNA, 20 nt, Yersinia pestis KIM
ucaaucucuucauggcgcuu

SEQ ID NO: 2328459 - RNA, 21 nt, Yersinia pestis KIM
ucaaucucuugcggcgcaccc

SEQ ID NO: 2328460 - RNA, 23 nt, Yersinia pestis KIM
ucaauggauucuugcugcaaccg

SEQ ID NO: 2328461 - RNA, 12 nt, Yersinia pestis KIM
ucaauggccagc

SEQ ID NO: 2328462 - RNA, 14 nt, Yersinia pestis KIM
ucaaugccuuggca

SEQ ID NO: 2328463 - RNA, 17 nt, Yersinia pestis KIM
ucaaugccgauccacgg

SEQ ID NO: 2328464 - RNA, 15 nt, Yersinia pestis KIM
ucaagccaccgcugg

SEQ ID NO: 2328465 - RNA, 20 nt, Yersinia pestis KIM
ucaagcccaguuuugcucug

SEQ ID NO: 2328466 - RNA, 17 nt, Yersinia pestis KIM
ucaagcccgaaauucag

SEQ ID NO: 2328467 - RNA, 20 nt, Yersinia pestis KIM
ucaagcgcaucggaaaucug

SEQ ID NO: 2328468 - RNA, 15 nt, Yersinia pestis KIM
ucaagcguacaucag

SEQ ID NO: 2328469 - RNA, 17 nt, Yersinia pestis KIM
ucaagccguuguuggca

SEQ ID NO: 2328470 - RNA, 14 nt, Yersinia pestis KIM
ucaagccaguaacu

SEQ ID NO: 2328471 - RNA, 12 nt, Yersinia pestis KIM
ucaagaugcaua

SEQ ID NO: 2328472 - RNA, 13 nt, Yersinia pestis KIM
ucaagaugcaggg

SEQ ID NO: 2328473 - RNA, 15 nt, Yersinia pestis KIM
ucaagaucgcgucau

SEQ ID NO: 2328474 - RNA, 19 nt, Yersinia pestis KIM
ucaagcaccucaagaaauu

SEQ ID NO: 2328475 - RNA, 17 nt, Yersinia pestis KIM
ucaaggcuuucuggcga

SEQ ID NO: 2328476 - RNA, 15 nt, Yersinia pestis KIM
ucaagucaauaaaua

SEQ ID NO: 2328477 - RNA, 22 nt, Yersinia pestis KIM
ucaagcuguuacugcccugauc

SEQ ID NO: 2328478 - RNA, 15 nt, Yersinia pestis KIM
ucaagacaacaaaca

SEQ ID NO: 2328479 - RNA, 22 nt, Yersinia pestis KIM
ucaagagggcgguuaaauacag

SEQ ID NO: 2328480 - RNA, 14 nt, Yersinia pestis KIM
ucaagaaauuuaaa

SEQ ID NO: 2328481 - RNA, 18 nt, Yersinia pestis KIM
ucaagaaauuuaaaaacc

SEQ ID NO: 2328482 - RNA, 19 nt, Yersinia pestis KIM
ucaagaaccgaaauaucau

SEQ ID NO: 2328483 - RNA, 17 nt, Yersinia pestis KIM
ucaacugcucaacugcu

SEQ ID NO: 2328484 - RNA, 18 nt, Yersinia pestis KIM
ucaacugcucaacugcuc

SEQ ID NO: 2328485 - RNA, 14 nt, Yersinia pestis KIM
uauuaggcuuuguu

SEQ ID NO: 2328486 - RNA, 20 nt, Yersinia pestis KIM
uauuagcgcugcucaaucac

SEQ ID NO: 2328487 - RNA, 18 nt, Yersinia pestis KIM
uauuagccaaauacccua

SEQ ID NO: 2328488 - RNA, 22 nt, Yersinia pestis KIM
uauuaucgggaacguagccaau

SEQ ID NO: 2328489 - RNA, 12 nt, Yersinia pestis KIM
uauuaucaucac

SEQ ID NO: 2328490 - RNA, 21 nt, Yersinia pestis KIM
uauuaucaucaccaucagaca

SEQ ID NO: 2328491 - RNA, 13 nt, Yersinia pestis KIM
uauuauauucaau

SEQ ID NO: 2328492 - RNA, 15 nt, Yersinia pestis KIM
uauccggauuaaauu

SEQ ID NO: 2328493 - RNA, 18 nt, Yersinia pestis KIM
uauuaccugcuauuuuau

SEQ ID NO: 2328494 - RNA, 21 nt, Yersinia pestis KIM
uauuacuacaaacgcguuaau

SEQ ID NO: 2328495 - RNA, 15 nt, Yersinia pestis KIM
uauuacugucauugc

SEQ ID NO: 2328496 - RNA, 21 nt, Yersinia pestis KIM
uauuacucagcacauuuuuau

SEQ ID NO: 2328497 - RNA, 13 nt, Yersinia pestis KIM
uauuacggcccca

SEQ ID NO: 2328498 - RNA, 13 nt, Yersinia pestis KIM
uauuacuugauau

SEQ ID NO: 2328499 - RNA, 13 nt, Yersinia pestis KIM
uauuacuuaugau

SEQ ID NO: 2328500 - RNA, 15 nt, Yersinia pestis KIM
uaucccuguuuucua

SEQ ID NO: 2328501 - RNA, 15 nt, Yersinia pestis KIM
uauccgccaaagauu

SEQ ID NO: 2328502 - RNA, 20 nt, Yersinia pestis KIM
uauucauaucgcuaaaacac

SEQ ID NO: 2328503 - RNA, 13 nt, Yersinia pestis KIM
uauucauauugaa

SEQ ID NO: 2328504 - RNA, 16 nt, Yersinia pestis KIM
uauucaguaaaaacug

SEQ ID NO: 2328505 - RNA, 16 nt, Yersinia pestis KIM
uauucaguaacaacau

SEQ ID NO: 2328506 - RNA, 18 nt, Yersinia pestis KIM
uauucauauuucacuguu

SEQ ID NO: 2328507 - RNA, 13 nt, Yersinia pestis KIM
uauucauuaaaaa

SEQ ID NO: 2328508 - RNA, 21 nt, Yersinia pestis KIM
uauucauuaaaaaauaauuuu

SEQ ID NO: 2328509 - RNA, 14 nt, Yersinia pestis KIM
uauucaauugaaau

SEQ ID NO: 2328510 - RNA, 18 nt, Yersinia pestis KIM
uauucaaugacuccugaa

SEQ ID NO: 2328511 - RNA, 21 nt, Yersinia pestis KIM
uauucaaugacuccugaaaua

SEQ ID NO: 2328512 - RNA, 16 nt, Yersinia pestis KIM
uauucagcaacucggu

SEQ ID NO: 2328513 - RNA, 22 nt, Yersinia pestis KIM
uauucagcaacucgguuuuaau

SEQ ID NO: 2328514 - RNA, 15 nt, Yersinia pestis KIM
uauuccuuucguuca

SEQ ID NO: 2328515 - RNA, 18 nt, Yersinia pestis KIM
uauuccauagccaggcag

SEQ ID NO: 2328516 - RNA, 16 nt, Yersinia pestis KIM
uauucucaaccgcugg

SEQ ID NO: 2328517 - RNA, 14 nt, Yersinia pestis KIM
uauucugccuaucc

SEQ ID NO: 2328518 - RNA, 18 nt, Yersinia pestis KIM
uauucugauggugucaac

SEQ ID NO: 2328519 - RNA, 21 nt, Yersinia pestis KIM
uauuuagccugccaauaucca

SEQ ID NO: 2328520 - RNA, 16 nt, Yersinia pestis KIM
uauuuagagcguccug

SEQ ID NO: 2328521 - RNA, 14 nt, Yersinia pestis KIM
uauuuauaugauaa

SEQ ID NO: 2328522 - RNA, 19 nt, Yersinia pestis KIM
uauuuauaugauaauaguu

SEQ ID NO: 2328523 - RNA, 18 nt, Yersinia pestis KIM
uauuuaaauuuuuauaua

SEQ ID NO: 2328524 - RNA, 19 nt, Yersinia pestis KIM
uauuuaaauuuuuauauaa

SEQ ID NO: 2328525 - RNA, 20 nt, Yersinia pestis KIM
uauuuaccugcucaacugcu

SEQ ID NO: 2328526 - RNA, 18 nt, Yersinia pestis KIM
uauuuaccuguuugcaac

SEQ ID NO: 2328527 - RNA, 16 nt, Yersinia pestis KIM
uauuuauucaaaaaau

SEQ ID NO: 2328528 - RNA, 18 nt, Yersinia pestis KIM
uauuuauccauuuaauaa

SEQ ID NO: 2328529 - RNA, 20 nt, Yersinia pestis KIM
uauuuauccauuuaauaacu

SEQ ID NO: 2328530 - RNA, 20 nt, Yersinia pestis KIM
uauuuauugccauuuuaauc

SEQ ID NO: 2328531 - RNA, 14 nt, Yersinia pestis KIM
uauuuauuguaagg

SEQ ID NO: 2328532 - RNA, 17 nt, Yersinia pestis KIM
uauuuauuuacagccac

SEQ ID NO: 2328533 - RNA, 19 nt, Yersinia pestis KIM
uauuucaacccgaucacca

SEQ ID NO: 2328534 - RNA, 16 nt, Yersinia pestis KIM
uauuucaaauaagugu

SEQ ID NO: 2328535 - RNA, 19 nt, Yersinia pestis KIM
uauuucacgcuaauuauuu

SEQ ID NO: 2328536 - RNA, 22 nt, Yersinia pestis KIM
uauuucaagcuacaugugcauu

SEQ ID NO: 2328537 - RNA, 17 nt, Yersinia pestis KIM
uauuucaugauucucua

SEQ ID NO: 2328538 - RNA, 20 nt, Yersinia pestis KIM
uauuucacguucaucaauac

SEQ ID NO: 2328539 - RNA, 16 nt, Yersinia pestis KIM
uauuucacguucauca

SEQ ID NO: 2328540 - RNA, 17 nt, Yersinia pestis KIM
uauugucucuacucucu

SEQ ID NO: 2328541 - RNA, 22 nt, Yersinia pestis KIM
uauuguguggcacgccaaucaa

SEQ ID NO: 2328542 - RNA, 17 nt, Yersinia pestis KIM
uauuguggauaguaaac

SEQ ID NO: 2328543 - RNA, 20 nt, Yersinia pestis KIM
uauuguggggccuuuauuca

SEQ ID NO: 2328544 - RNA, 12 nt, Yersinia pestis KIM
uauuuaaauagu

SEQ ID NO: 2328545 - RNA, 13 nt, Yersinia pestis KIM
uauuuaaauacaa

SEQ ID NO: 2328546 - RNA, 17 nt, Yersinia pestis KIM
uauuuaaauacaaaaau

SEQ ID NO: 2328547 - RNA, 20 nt, Yersinia pestis KIM
uauuuaaauacaaaaauaca

SEQ ID NO: 2328548 - RNA, 13 nt, Yersinia pestis KIM
uauugcuccagag

SEQ ID NO: 2328549 - RNA, 16 nt, Yersinia pestis KIM
uauugcucagggccac

SEQ ID NO: 2328550 - RNA, 22 nt, Yersinia pestis KIM
uauuggucguaccaauggugcc

SEQ ID NO: 2328551 - RNA, 14 nt, Yersinia pestis KIM
uauuguaagucagc

SEQ ID NO: 2328552 - RNA, 15 nt, Yersinia pestis KIM
uauugguuauugauu

SEQ ID NO: 2328553 - RNA, 15 nt, Yersinia pestis KIM
uauugaccaauauaa

SEQ ID NO: 2328554 - RNA, 21 nt, Yersinia pestis KIM
uauugaauuaaauuuuauauu

SEQ ID NO: 2328555 - RNA, 16 nt, Yersinia pestis KIM
uauucugcuuuuugcu

SEQ ID NO: 2328556 - RNA, 16 nt, Yersinia pestis KIM
uauugccgcaguccaa

SEQ ID NO: 2328557 - RNA, 22 nt, Yersinia pestis KIM
uauugccgcaguccaaaaaacu

SEQ ID NO: 2328558 - RNA, 19 nt, Yersinia pestis KIM
uauugaugacgcuaaccac

SEQ ID NO: 2328559 - RNA, 18 nt, Yersinia pestis KIM
uauugauggauuuacguu

SEQ ID NO: 2328560 - RNA, 19 nt, Yersinia pestis KIM
uauugaugggggauauuca

SEQ ID NO: 2328561 - RNA, 21 nt, Yersinia pestis KIM
uauugaugggggauauucauu

SEQ ID NO: 2328562 - RNA, 23 nt, Yersinia pestis KIM
uauugauguuaacucagccacaa

SEQ ID NO: 2328563 - RNA, 15 nt, Yersinia pestis KIM
uauugauaaaaccac

SEQ ID NO: 2328564 - RNA, 21 nt, Yersinia pestis KIM
uauugauaaaaauauccagca

SEQ ID NO: 2328565 - RNA, 12 nt, Yersinia pestis KIM
uauugauaaaac

SEQ ID NO: 2328566 - RNA, 16 nt, Yersinia pestis KIM
uauugagagcaggcgc

SEQ ID NO: 2328567 - RNA, 12 nt, Yersinia pestis KIM
ucaaaaaugaua

SEQ ID NO: 2328568 - RNA, 23 nt, Yersinia pestis KIM
ucaaaaccgaugagugaaaucuc

SEQ ID NO: 2328569 - RNA, 20 nt, Yersinia pestis KIM
ucaaaaacccauuaaaaaca

SEQ ID NO: 2328570 - RNA, 14 nt, Yersinia pestis KIM
ucaaaaacccauua

SEQ ID NO: 2328571 - RNA, 18 nt, Yersinia pestis KIM
uauuuuuguauuuaaaua

SEQ ID NO: 2328572 - RNA, 12 nt, Yersinia pestis KIM
uauuuuuauuaa

SEQ ID NO: 2328573 - RNA, 21 nt, Yersinia pestis KIM
ucaaacgggugcgccaaucgc

SEQ ID NO: 2328574 - RNA, 17 nt, Yersinia pestis KIM
ucaaacggugugcaaug

SEQ ID NO: 2328575 - RNA, 14 nt, Yersinia pestis KIM
ucaaagaauaacug

SEQ ID NO: 2328576 - RNA, 17 nt, Yersinia pestis KIM
ucaaagaaaaaucgcca

SEQ ID NO: 2328577 - RNA, 22 nt, Yersinia pestis KIM
ucaaaaucacuucuucaauaga

SEQ ID NO: 2328578 - RNA, 21 nt, Yersinia pestis KIM
ucaaaauagaggaaauaaaug

SEQ ID NO: 2328579 - RNA, 22 nt, Yersinia pestis KIM
ucaaaauacuuaacaaucagug

SEQ ID NO: 2328580 - RNA, 16 nt, Yersinia pestis KIM
ucaaaauagaggaaau

SEQ ID NO: 2328581 - RNA, 13 nt, Yersinia pestis KIM
ucaaaauacccau

SEQ ID NO: 2328582 - RNA, 15 nt, Yersinia pestis KIM
ucaaaauaaaucagu

SEQ ID NO: 2328583 - RNA, 11 nt, Yersinia pestis KIM
ucaaaauaccc

SEQ ID NO: 2328584 - RNA, 21 nt, Yersinia pestis KIM
ucaaaauaaaaauucacaaca

SEQ ID NO: 2328585 - RNA, 12 nt, Yersinia pestis KIM
ucaaauaaguau

SEQ ID NO: 2328586 - RNA, 20 nt, Yersinia pestis KIM
ucaaauacgaccgucaccaa

SEQ ID NO: 2328587 - RNA, 20 nt, Yersinia pestis KIM
ucaaauacggcaccaauggc

SEQ ID NO: 2328588 - RNA, 19 nt, Yersinia pestis KIM
ucaaagacuaaccucugca

SEQ ID NO: 2328589 - RNA, 21 nt, Yersinia pestis KIM
uauuuucugauguguauauuu

SEQ ID NO: 2328590 - RNA, 18 nt, Yersinia pestis KIM
uauuuugaauauuuuuaa

SEQ ID NO: 2328591 - RNA, 18 nt, Yersinia pestis KIM
uauuuucauuauuuucaa

SEQ ID NO: 2328592 - RNA, 14 nt, Yersinia pestis KIM
uauuuucccuuucu

SEQ ID NO: 2328593 - RNA, 15 nt, Yersinia pestis KIM
uauuuucuauaccaa

SEQ ID NO: 2328594 - RNA, 17 nt, Yersinia pestis KIM
uauuuucgacaaaauca

SEQ ID NO: 2328595 - RNA, 13 nt, Yersinia pestis KIM
uauuuuguuugua

SEQ ID NO: 2328596 - RNA, 22 nt, Yersinia pestis KIM
uauuuuguuuguaaauuuuaaa

SEQ ID NO: 2328597 - RNA, 23 nt, Yersinia pestis KIM
uauuuugggcuaaaacucaaaua

SEQ ID NO: 2328598 - RNA, 18 nt, Yersinia pestis KIM
uauuuuggguauauaguu

SEQ ID NO: 2328599 - RNA, 13 nt, Yersinia pestis KIM
uauuuuauuuaau

SEQ ID NO: 2328600 - RNA, 22 nt, Yersinia pestis KIM
uauuuguagugacguaaaaagg

SEQ ID NO: 2328601 - RNA, 13 nt, Yersinia pestis KIM
uauuuuaagaaaa

SEQ ID NO: 2328602 - RNA, 14 nt, Yersinia pestis KIM
uauuuuaagaaaac

SEQ ID NO: 2328603 - RNA, 16 nt, Yersinia pestis KIM
uauuuuaccuauuuau

SEQ ID NO: 2328604 - RNA, 23 nt, Yersinia pestis KIM
uauuuuaccuauuuauugccauu

SEQ ID NO: 2328605 - RNA, 13 nt, Yersinia pestis KIM
uauuuuaaauaug

SEQ ID NO: 2328606 - RNA, 15 nt, Yersinia pestis KIM
uauuugcgugaaaac

SEQ ID NO: 2328607 - RNA, 13 nt, Yersinia pestis KIM
uauuugcagaaag

SEQ ID NO: 2328608 - RNA, 13 nt, Yersinia pestis KIM
uauuugcaaugcg

SEQ ID NO: 2328609 - RNA, 17 nt, Yersinia pestis KIM
uauuugcaaugcggagc

SEQ ID NO: 2328610 - RNA, 22 nt, Yersinia pestis KIM
uauuuggauuaaguccaagaag

SEQ ID NO: 2328611 - RNA, 17 nt, Yersinia pestis KIM
uauuuggugaguaaaug

SEQ ID NO: 2328612 - RNA, 17 nt, Yersinia pestis KIM
uauuuguacauccaacu

SEQ ID NO: 2328613 - RNA, 15 nt, Yersinia pestis KIM
uauuugaaauacuua

SEQ ID NO: 2328614 - RNA, 16 nt, Yersinia pestis KIM
uauuugaacuucaaau

SEQ ID NO: 2328615 - RNA, 21 nt, Yersinia pestis KIM
uauuugaaauacuuauuugaa

SEQ ID NO: 2328616 - RNA, 14 nt, Yersinia pestis KIM
uauuugaguuuuag

SEQ ID NO: 2328617 - RNA, 12 nt, Yersinia pestis KIM
uauuucucucua

SEQ ID NO: 2328618 - RNA, 15 nt, Yersinia pestis KIM
uauuucuuacucugu

SEQ ID NO: 2328619 - RNA, 13 nt, Yersinia pestis KIM
uauuucuucauac

SEQ ID NO: 2328620 - RNA, 22 nt, Yersinia pestis KIM
uauuucuugcagugcuucauca

SEQ ID NO: 2328621 - RNA, 18 nt, Yersinia pestis KIM
uauuuccacgacaugagc

SEQ ID NO: 2328622 - RNA, 23 nt, Yersinia pestis KIM
uauuucgccuuucauacaucauu

SEQ ID NO: 2328623 - RNA, 23 nt, Yersinia pestis KIM
uacacagcacggcaacaggcuuu

SEQ ID NO: 2328624 - RNA, 23 nt, Yersinia pestis KIM
uacacacccucaacucaaaacaa

SEQ ID NO: 2328625 - RNA, 15 nt, Yersinia pestis KIM
uacacaugaaaauca

SEQ ID NO: 2328626 - RNA, 13 nt, Yersinia pestis KIM
uacacagucuuuu

SEQ ID NO: 2328627 - RNA, 17 nt, Yersinia pestis KIM
uacacagucuuuuuccc

SEQ ID NO: 2328628 - RNA, 18 nt, Yersinia pestis KIM
uacacagucuuuuuccca

SEQ ID NO: 2328629 - RNA, 13 nt, Yersinia pestis KIM
uacaauaugggua

SEQ ID NO: 2328630 - RNA, 21 nt, Yersinia pestis KIM
uacaaucucugggugcugcuc

SEQ ID NO: 2328631 - RNA, 15 nt, Yersinia pestis KIM
uacaauaaaucaauu

SEQ ID NO: 2328632 - RNA, 17 nt, Yersinia pestis KIM
uacaauagagaauagac

SEQ ID NO: 2328633 - RNA, 14 nt, Yersinia pestis KIM
uacaaccaacaaac

SEQ ID NO: 2328634 - RNA, 16 nt, Yersinia pestis KIM
uacaaccaacaaacaa

SEQ ID NO: 2328635 - RNA, 14 nt, Yersinia pestis KIM
uacagacuggccaa

SEQ ID NO: 2328636 - RNA, 20 nt, Yersinia pestis KIM
uacagauauauccaggcacu

SEQ ID NO: 2328637 - RNA, 20 nt, Yersinia pestis KIM
uacacuuucuuugaugcaua

SEQ ID NO: 2328638 - RNA, 22 nt, Yersinia pestis KIM
uacacuuucuuugaugcauaug

SEQ ID NO: 2328639 - RNA, 18 nt, Yersinia pestis KIM
uacagaaaaauaggccau

SEQ ID NO: 2328640 - RNA, 22 nt, Yersinia pestis KIM
uacaccaccgccgcaacaauaa

SEQ ID NO: 2328641 - RNA, 17 nt, Yersinia pestis KIM
uacaccagacucugcua

SEQ ID NO: 2328642 - RNA, 14 nt, Yersinia pestis KIM
uacaccauuuucaa

SEQ ID NO: 2328643 - RNA, 18 nt, Yersinia pestis KIM
uacaccauuuccaggcua

SEQ ID NO: 2328644 - RNA, 14 nt, Yersinia pestis KIM
uacaccgcuaaccu

SEQ ID NO: 2328645 - RNA, 13 nt, Yersinia pestis KIM
uacacccgcuugc

SEQ ID NO: 2328646 - RNA, 21 nt, Yersinia pestis KIM
uacaccugcuggugccacugu

SEQ ID NO: 2328647 - RNA, 19 nt, Yersinia pestis KIM
uacaccuucuuuaucuguc

SEQ ID NO: 2328648 - RNA, 18 nt, Yersinia pestis KIM
uacaccuuaaaacagcag

SEQ ID NO: 2328649 - RNA, 16 nt, Yersinia pestis KIM
uacacgguuaauucau

SEQ ID NO: 2328650 - RNA, 15 nt, Yersinia pestis KIM
uacacuggcagugcc

SEQ ID NO: 2328651 - RNA, 14 nt, Yersinia pestis KIM
uacacuauuuuacc

SEQ ID NO: 2328652 - RNA, 19 nt, Yersinia pestis KIM
uacacuauuuuaccuauuu

SEQ ID NO: 2328653 - RNA, 24 nt, Yersinia pestis KIM
uaccaaggcaugauaggcacggca

SEQ ID NO: 2328654 - RNA, 15 nt, Yersinia pestis KIM
uaccaauaauuaauu

SEQ ID NO: 2328655 - RNA, 14 nt, Yersinia pestis KIM
uaccaauaaaaccu

SEQ ID NO: 2328656 - RNA, 18 nt, Yersinia pestis KIM
uaccaaaacgaacaaaau

SEQ ID NO: 2328657 - RNA, 16 nt, Yersinia pestis KIM
uacaugcguaaaugaa

SEQ ID NO: 2328658 - RNA, 16 nt, Yersinia pestis KIM
uacaugauugaaaaac

SEQ ID NO: 2328659 - RNA, 15 nt, Yersinia pestis KIM
uacaugaguaaguga

SEQ ID NO: 2328660 - RNA, 17 nt, Yersinia pestis KIM
uacaugaguaagugauu

SEQ ID NO: 2328661 - RNA, 16 nt, Yersinia pestis KIM
uacauauaaccaucaa

SEQ ID NO: 2328662 - RNA, 20 nt, Yersinia pestis KIM
uacauauaaccaucaaauac

SEQ ID NO: 2328663 - RNA, 22 nt, Yersinia pestis KIM
uacauauaauccaaaauaauau

SEQ ID NO: 2328664 - RNA, 18 nt, Yersinia pestis KIM
uacauauaucacuauuuc

SEQ ID NO: 2328665 - RNA, 14 nt, Yersinia pestis KIM
uacauauaucacua

SEQ ID NO: 2328666 - RNA, 12 nt, Yersinia pestis KIM
uacauauaucac

SEQ ID NO: 2328667 - RNA, 15 nt, Yersinia pestis KIM
uacagggaagccggc

SEQ ID NO: 2328668 - RNA, 12 nt, Yersinia pestis KIM
uacauaaaauca

SEQ ID NO: 2328669 - RNA, 17 nt, Yersinia pestis KIM
uacagcccaagagaaau

SEQ ID NO: 2328670 - RNA, 22 nt, Yersinia pestis KIM
uacagccgcccccuuucuuauc

SEQ ID NO: 2328671 - RNA, 12 nt, Yersinia pestis KIM
uacagccacgau

SEQ ID NO: 2328672 - RNA, 16 nt, Yersinia pestis KIM
uacagccguguagcau

SEQ ID NO: 2328673 - RNA, 17 nt, Yersinia pestis KIM
uacagccggauaggcuu

SEQ ID NO: 2328674 - RNA, 22 nt, Yersinia pestis KIM
uacagcaccauucaauguaaaa

SEQ ID NO: 2328675 - RNA, 15 nt, Yersinia pestis KIM
uacagcacucaguac

SEQ ID NO: 2328676 - RNA, 16 nt, Yersinia pestis KIM
uacagcagguggcuga

SEQ ID NO: 2328677 - RNA, 23 nt, Yersinia pestis KIM
uacagcagguggcugaggccagc

SEQ ID NO: 2328678 - RNA, 14 nt, Yersinia pestis KIM
uacagcaaauaccg

SEQ ID NO: 2328679 - RNA, 18 nt, Yersinia pestis KIM
uacagcaaacaucgguaa

SEQ ID NO: 2328680 - RNA, 17 nt, Yersinia pestis KIM
uacagcaaauagguuuu

SEQ ID NO: 2328681 - RNA, 13 nt, Yersinia pestis KIM
uacagaucauuag

SEQ ID NO: 2328682 - RNA, 17 nt, Yersinia pestis KIM
uacaggccacacaccag

SEQ ID NO: 2328683 - RNA, 18 nt, Yersinia pestis KIM
uacagugcgcaaguauug

SEQ ID NO: 2328684 - RNA, 23 nt, Yersinia pestis KIM
uacaguggcgagcgcagggucag

SEQ ID NO: 2328685 - RNA, 16 nt, Yersinia pestis KIM
uacaguuuuuucucaa

SEQ ID NO: 2328686 - RNA, 22 nt, Yersinia pestis KIM
uacaguuuuuucucaaugaagu

SEQ ID NO: 2328687 - RNA, 14 nt, Yersinia pestis KIM
uaaucuauuaauau

SEQ ID NO: 2328688 - RNA, 17 nt, Yersinia pestis KIM
uaaucguggcuguaaau

SEQ ID NO: 2328689 - RNA, 18 nt, Yersinia pestis KIM
uaaucgggaaauugugau

SEQ ID NO: 2328690 - RNA, 21 nt, Yersinia pestis KIM
uaaucggaaaccgcuguuuua

SEQ ID NO: 2328691 - RNA, 22 nt, Yersinia pestis KIM
uaaucgucccacaugaacucaa

SEQ ID NO: 2328692 - RNA, 22 nt, Yersinia pestis KIM
uaauccgccugagauuaaccgc

SEQ ID NO: 2328693 - RNA, 21 nt, Yersinia pestis KIM
uaacgauaaccaaaucaccug

SEQ ID NO: 2328694 - RNA, 22 nt, Yersinia pestis KIM
uaaucgccucgaccuuaaccgc

SEQ ID NO: 2328695 - RNA, 22 nt, Yersinia pestis KIM
uaaucgccgccuccgauucaua

SEQ ID NO: 2328696 - RNA, 18 nt, Yersinia pestis KIM
uaaucgcgcauuucuucu

SEQ ID NO: 2328697 - RNA, 16 nt, Yersinia pestis KIM
uaaucgcugaacagac

SEQ ID NO: 2328698 - RNA, 22 nt, Yersinia pestis KIM
uaaucgcgcauuucuucucuca

SEQ ID NO: 2328699 - RNA, 19 nt, Yersinia pestis KIM
uaauccuaaugaacacuua

SEQ ID NO: 2328700 - RNA, 20 nt, Yersinia pestis KIM
uaaugccccgcauaaauacu

SEQ ID NO: 2328701 - RNA, 15 nt, Yersinia pestis KIM
uaauggcauuuucag

SEQ ID NO: 2328702 - RNA, 12 nt, Yersinia pestis KIM
uaauggauagcu

SEQ ID NO: 2328703 - RNA, 21 nt, Yersinia pestis KIM
uaauggauugaucauucucug

SEQ ID NO: 2328704 - RNA, 13 nt, Yersinia pestis KIM
uaaugccaauuga

SEQ ID NO: 2328705 - RNA, 12 nt, Yersinia pestis KIM
uaaugccacacu

SEQ ID NO: 2328706 - RNA, 19 nt, Yersinia pestis KIM
uaaugccacccccagugcu

SEQ ID NO: 2328707 - RNA, 18 nt, Yersinia pestis KIM
uaaugcauucugcugguu

SEQ ID NO: 2328708 - RNA, 17 nt, Yersinia pestis KIM
uaaugccgaaugauuca

SEQ ID NO: 2328709 - RNA, 17 nt, Yersinia pestis KIM
uaaugcagguuuugcca

SEQ ID NO: 2328710 - RNA, 22 nt, Yersinia pestis KIM
uaaugaccacgcaucaauaaua

SEQ ID NO: 2328711 - RNA, 23 nt, Yersinia pestis KIM
uaaucuggcucaggaaucuucaa

SEQ ID NO: 2328712 - RNA, 18 nt, Yersinia pestis KIM
uaaucugggguuccaggc

SEQ ID NO: 2328713 - RNA, 14 nt, Yersinia pestis KIM
uaaucuugugauga

SEQ ID NO: 2328714 - RNA, 14 nt, Yersinia pestis KIM
uaaugaaauaguaa

SEQ ID NO: 2328715 - RNA, 13 nt, Yersinia pestis KIM
uaaugaaaucuaa

SEQ ID NO: 2328716 - RNA, 13 nt, Yersinia pestis KIM
uaaugaaaaggca

SEQ ID NO: 2328717 - RNA, 20 nt, Yersinia pestis KIM
uaaugaaaauagccaaccag

SEQ ID NO: 2328718 - RNA, 13 nt, Yersinia pestis KIM
uaauucuccuuuc

SEQ ID NO: 2328719 - RNA, 16 nt, Yersinia pestis KIM
uaauucauuauuacuc

SEQ ID NO: 2328720 - RNA, 13 nt, Yersinia pestis KIM
uaauucauuauua

SEQ ID NO: 2328721 - RNA, 19 nt, Yersinia pestis KIM
uaauucagcaucaaauuau

SEQ ID NO: 2328722 - RNA, 21 nt, Yersinia pestis KIM
uaauucagcaucaaauuauuu

SEQ ID NO: 2328723 - RNA, 17 nt, Yersinia pestis KIM
uaauucacugcuuaauc

SEQ ID NO: 2328724 - RNA, 18 nt, Yersinia pestis KIM
uaauucacugcuuaaucc

SEQ ID NO: 2328725 - RNA, 22 nt, Yersinia pestis KIM
uaauucaauauauacaauccaa

SEQ ID NO: 2328726 - RNA, 19 nt, Yersinia pestis KIM
uaauucaggcaaauucuca

SEQ ID NO: 2328727 - RNA, 14 nt, Yersinia pestis KIM
uaauucaguuaaua

SEQ ID NO: 2328728 - RNA, 16 nt, Yersinia pestis KIM
uaauuauagugaaaac

SEQ ID NO: 2328729 - RNA, 15 nt, Yersinia pestis KIM
uaauuauagugaaaa

SEQ ID NO: 2328730 - RNA, 14 nt, Yersinia pestis KIM
uaauuaguuuuaau

SEQ ID NO: 2328731 - RNA, 15 nt, Yersinia pestis KIM
uaauuaguuuuaaua

SEQ ID NO: 2328732 - RNA, 14 nt, Yersinia pestis KIM
uaauuaauuauaag

SEQ ID NO: 2328733 - RNA, 14 nt, Yersinia pestis KIM
uaauuagugacagu

SEQ ID NO: 2328734 - RNA, 13 nt, Yersinia pestis KIM
uaauuaauuuaaa

SEQ ID NO: 2328735 - RNA, 23 nt, Yersinia pestis KIM
uaauggcgguauagaccaauuca

SEQ ID NO: 2328736 - RNA, 15 nt, Yersinia pestis KIM
uaauggucaagguga

SEQ ID NO: 2328737 - RNA, 21 nt, Yersinia pestis KIM
uaauggucaaggugauuucaa

SEQ ID NO: 2328738 - RNA, 16 nt, Yersinia pestis KIM
uaauggugaaccagau

SEQ ID NO: 2328739 - RNA, 21 nt, Yersinia pestis KIM
uaaugguuguuaauuaagauu

SEQ ID NO: 2328740 - RNA, 14 nt, Yersinia pestis KIM
uaauugguuuuaau

SEQ ID NO: 2328741 - RNA, 16 nt, Yersinia pestis KIM
uaauugguuuuaauaa

SEQ ID NO: 2328742 - RNA, 16 nt, Yersinia pestis KIM
uaauuggguucaucau

SEQ ID NO: 2328743 - RNA, 15 nt, Yersinia pestis KIM
uaauugaagauuuaa

SEQ ID NO: 2328744 - RNA, 17 nt, Yersinia pestis KIM
uaauugaagauuuaaau

SEQ ID NO: 2328745 - RNA, 22 nt, Yersinia pestis KIM
uaauugaauugccccccaauau

SEQ ID NO: 2328746 - RNA, 19 nt, Yersinia pestis KIM
uaauucuggguacaacaca

SEQ ID NO: 2328747 - RNA, 21 nt, Yersinia pestis KIM
uaauuucuacgccgucaucau

SEQ ID NO: 2328748 - RNA, 13 nt, Yersinia pestis KIM
uaauuuauacaua

SEQ ID NO: 2328749 - RNA, 22 nt, Yersinia pestis KIM
uaauuuauacauaucagaacag

SEQ ID NO: 2328750 - RNA, 20 nt, Yersinia pestis KIM
uaauuuaaacaaccaaaaau

SEQ ID NO: 2328751 - RNA, 17 nt, Yersinia pestis KIM
uaauuuaaauaagaucc

SEQ ID NO: 2328752 - RNA, 21 nt, Yersinia pestis KIM
uaauuuacugguaccaaauaa

SEQ ID NO: 2328753 - RNA, 23 nt, Yersinia pestis KIM
uaauuuacugguaccaaauaaca

SEQ ID NO: 2328754 - RNA, 14 nt, Yersinia pestis KIM
uaauuuauaaacaa

SEQ ID NO: 2328755 - RNA, 16 nt, Yersinia pestis KIM
uacuuagcaauaauag

SEQ ID NO: 2328756 - RNA, 13 nt, Yersinia pestis KIM
uacuuauaaacac

SEQ ID NO: 2328757 - RNA, 14 nt, Yersinia pestis KIM
uacuuauaaacacu

SEQ ID NO: 2328758 - RNA, 22 nt, Yersinia pestis KIM
uacuuaacaaucagugcaauaa

SEQ ID NO: 2328759 - RNA, 18 nt, Yersinia pestis KIM
uacuuaacaaucagugca

SEQ ID NO: 2328760 - RNA, 16 nt, Yersinia pestis KIM
uacuccucugccuauc

SEQ ID NO: 2328761 - RNA, 11 nt, Yersinia pestis KIM
uacuccugcuc

SEQ ID NO: 2328762 - RNA, 22 nt, Yersinia pestis KIM
uacucgagcguauugccuucuc

SEQ ID NO: 2328763 - RNA, 20 nt, Yersinia pestis KIM
uacuccuuaaucguccgguc

SEQ ID NO: 2328764 - RNA, 14 nt, Yersinia pestis KIM
uacuccucugccua

SEQ ID NO: 2328765 - RNA, 16 nt, Yersinia pestis KIM
uacuuuccuuccucuu

SEQ ID NO: 2328766 - RNA, 18 nt, Yersinia pestis KIM
uacuuugaaauuauauuu

SEQ ID NO: 2328767 - RNA, 13 nt, Yersinia pestis KIM
uacuuucccugcu

SEQ ID NO: 2328768 - RNA, 12 nt, Yersinia pestis KIM
uacuuuaaauuu

SEQ ID NO: 2328769 - RNA, 20 nt, Yersinia pestis KIM
uacuucgaugauuauuuugu

SEQ ID NO: 2328770 - RNA, 23 nt, Yersinia pestis KIM
uagaaaaaucacauacuggcauu

SEQ ID NO: 2328771 - RNA, 14 nt, Yersinia pestis KIM
uagaaaagcgaauc

SEQ ID NO: 2328772 - RNA, 17 nt, Yersinia pestis KIM
uacuuuuuuauuuuacu

SEQ ID NO: 2328773 - RNA, 18 nt, Yersinia pestis KIM
uacuuuuaauacaggcug

SEQ ID NO: 2328774 - RNA, 18 nt, Yersinia pestis KIM
uacuuugucaauagccua

SEQ ID NO: 2328775 - RNA, 19 nt, Yersinia pestis KIM
uacuuuuuccuuauuucuu

SEQ ID NO: 2328776 - RNA, 19 nt, Yersinia pestis KIM
uacuuuucauuuccucugg

SEQ ID NO: 2328777 - RNA, 15 nt, Yersinia pestis KIM
uagaaacguucaaua

SEQ ID NO: 2328778 - RNA, 15 nt, Yersinia pestis KIM
uagaaaucacacugg

SEQ ID NO: 2328779 - RNA, 19 nt, Yersinia pestis KIM
uagacgacacaaaugcugu

SEQ ID NO: 2328780 - RNA, 20 nt, Yersinia pestis KIM
uagacgacacaaaugcugug

SEQ ID NO: 2328781 - RNA, 17 nt, Yersinia pestis KIM
uagacgaaggcacggcc

SEQ ID NO: 2328782 - RNA, 12 nt, Yersinia pestis KIM
uagacgacacaa

SEQ ID NO: 2328783 - RNA, 17 nt, Yersinia pestis KIM
uagacuguuuuauuaua

SEQ ID NO: 2328784 - RNA, 21 nt, Yersinia pestis KIM
uagacuguuuuauuauauauu

SEQ ID NO: 2328785 - RNA, 19 nt, Yersinia pestis KIM
uagacucaucuaauuuucu

SEQ ID NO: 2328786 - RNA, 15 nt, Yersinia pestis KIM
uagaauuuaccucca

SEQ ID NO: 2328787 - RNA, 22 nt, Yersinia pestis KIM
uagacagaagcguaaagcaccc

SEQ ID NO: 2328788 - RNA, 15 nt, Yersinia pestis KIM
uagacaccuucccua

SEQ ID NO: 2328789 - RNA, 19 nt, Yersinia pestis KIM
uagacagcuuaaaaucugu

SEQ ID NO: 2328790 - RNA, 14 nt, Yersinia pestis KIM
uagacaagcgcagu

SEQ ID NO: 2328791 - RNA, 16 nt, Yersinia pestis KIM
uagaccaaugaauuac

SEQ ID NO: 2328792 - RNA, 18 nt, Yersinia pestis KIM
uagaccugaggauaaaaa

SEQ ID NO: 2328793 - RNA, 16 nt, Yersinia pestis KIM
uagacaguaacuaaag

SEQ ID NO: 2328794 - RNA, 20 nt, Yersinia pestis KIM
uagaauaaguugaugcagua

SEQ ID NO: 2328795 - RNA, 21 nt, Yersinia pestis KIM
uagaagguaaucagacugcug

SEQ ID NO: 2328796 - RNA, 13 nt, Yersinia pestis KIM
uagaagcggaaua

SEQ ID NO: 2328797 - RNA, 12 nt, Yersinia pestis KIM
uagaagcccuga

SEQ ID NO: 2328798 - RNA, 14 nt, Yersinia pestis KIM
uagaacuuaagcaa

SEQ ID NO: 2328799 - RNA, 19 nt, Yersinia pestis KIM
uagaagagauagauuuuaa

SEQ ID NO: 2328800 - RNA, 19 nt, Yersinia pestis KIM
uagaaccggaauaaaucag

SEQ ID NO: 2328801 - RNA, 20 nt, Yersinia pestis KIM
uagaacggcggacuguuaau

SEQ ID NO: 2328802 - RNA, 15 nt, Yersinia pestis KIM
uacggcauuagugaa

SEQ ID NO: 2328803 - RNA, 22 nt, Yersinia pestis KIM
uacggcagacauuccgucagca

SEQ ID NO: 2328804 - RNA, 15 nt, Yersinia pestis KIM
uacgugaucaucuuu

SEQ ID NO: 2328805 - RNA, 17 nt, Yersinia pestis KIM
uacguaaauagguuuua

SEQ ID NO: 2328806 - RNA, 22 nt, Yersinia pestis KIM
uacgguuuugccaauauugccu

SEQ ID NO: 2328807 - RNA, 12 nt, Yersinia pestis KIM
uacggucacuga

SEQ ID NO: 2328808 - RNA, 13 nt, Yersinia pestis KIM
uacggucaaaagc

SEQ ID NO: 2328809 - RNA, 16 nt, Yersinia pestis KIM
uacgguccauaaaauc

SEQ ID NO: 2328810 - RNA, 19 nt, Yersinia pestis KIM
uacgggugaacaugcguug

SEQ ID NO: 2328811 - RNA, 18 nt, Yersinia pestis KIM
uacgguagcgauauccuu

SEQ ID NO: 2328812 - RNA, 14 nt, Yersinia pestis KIM
uacgguaauaaaca

SEQ ID NO: 2328813 - RNA, 19 nt, Yersinia pestis KIM
uacgguaauaaacagacaa

SEQ ID NO: 2328814 - RNA, 15 nt, Yersinia pestis KIM
uacgaucuuauuaau

SEQ ID NO: 2328815 - RNA, 19 nt, Yersinia pestis KIM
uacgaucuuauuaauuggu

SEQ ID NO: 2328816 - RNA, 20 nt, Yersinia pestis KIM
uacgaucugccuguucucuc

SEQ ID NO: 2328817 - RNA, 22 nt, Yersinia pestis KIM
uacgcuggccaguuucgguacc

SEQ ID NO: 2328818 - RNA, 14 nt, Yersinia pestis KIM
uacguugcagguca

SEQ ID NO: 2328819 - RNA, 11 nt, Yersinia pestis KIM
uacuaaaacag

SEQ ID NO: 2328820 - RNA, 21 nt, Yersinia pestis KIM
uacucaauaugcaguuuuccu

SEQ ID NO: 2328821 - RNA, 20 nt, Yersinia pestis KIM
uacuauuuuuuauauugcuc

SEQ ID NO: 2328822 - RNA, 13 nt, Yersinia pestis KIM
uacuauuuucauu

SEQ ID NO: 2328823 - RNA, 16 nt, Yersinia pestis KIM
uacuaugggauaaacu

SEQ ID NO: 2328824 - RNA, 17 nt, Yersinia pestis KIM
uacuccccaaagccuac

SEQ ID NO: 2328825 - RNA, 21 nt, Yersinia pestis KIM
uacuccauuuuuuugaugcau

SEQ ID NO: 2328826 - RNA, 17 nt, Yersinia pestis KIM
uacucaggcccugagau

SEQ ID NO: 2328827 - RNA, 22 nt, Yersinia pestis KIM
uacucaggauuagcuucugcua

SEQ ID NO: 2328828 - RNA, 14 nt, Yersinia pestis KIM
uacucaugauggca

SEQ ID NO: 2328829 - RNA, 14 nt, Yersinia pestis KIM
uacucauuauggau

SEQ ID NO: 2328830 - RNA, 19 nt, Yersinia pestis KIM
uaccuuuaacuguuuuaua

SEQ ID NO: 2328831 - RNA, 19 nt, Yersinia pestis KIM
uaccuuuaaaacuggucag

SEQ ID NO: 2328832 - RNA, 13 nt, Yersinia pestis KIM
uaccuucccaucc

SEQ ID NO: 2328833 - RNA, 17 nt, Yersinia pestis KIM
uaccuucgguaaucaau

SEQ ID NO: 2328834 - RNA, 18 nt, Yersinia pestis KIM
uaccuucacauuuucucc

SEQ ID NO: 2328835 - RNA, 21 nt, Yersinia pestis KIM
uaccuucaggccuuuacuguu

SEQ ID NO: 2328836 - RNA, 17 nt, Yersinia pestis KIM
uaccuuuacggccgcua

SEQ ID NO: 2328837 - RNA, 23 nt, Yersinia pestis KIM
uaccuuucagguaagcagagaau

SEQ ID NO: 2328838 - RNA, 18 nt, Yersinia pestis KIM
uaccuuuugcauauuucu

SEQ ID NO: 2328839 - RNA, 20 nt, Yersinia pestis KIM
uaccuuuugcauauuucucu

SEQ ID NO: 2328840 - RNA, 22 nt, Yersinia pestis KIM
uaccuuuugcauauuucucuuu

SEQ ID NO: 2328841 - RNA, 14 nt, Yersinia pestis KIM
uaccugacacugca

SEQ ID NO: 2328842 - RNA, 19 nt, Yersinia pestis KIM
uaccugacacugcaucucu

SEQ ID NO: 2328843 - RNA, 23 nt, Yersinia pestis KIM
uaccuccggugguuucgccgcca

SEQ ID NO: 2328844 - RNA, 19 nt, Yersinia pestis KIM
uaccugauuccuaagcaaa

SEQ ID NO: 2328845 - RNA, 20 nt, Yersinia pestis KIM
uaccugaguagcauaaaaau

SEQ ID NO: 2328846 - RNA, 13 nt, Yersinia pestis KIM
uaccuuaggcuug

SEQ ID NO: 2328847 - RNA, 21 nt, Yersinia pestis KIM
uaccugucccguuccaaccgg

SEQ ID NO: 2328848 - RNA, 13 nt, Yersinia pestis KIM
uaccaauuaauaa

SEQ ID NO: 2328849 - RNA, 15 nt, Yersinia pestis KIM
uaccaauuaauaaga

SEQ ID NO: 2328850 - RNA, 15 nt, Yersinia pestis KIM
uaccaauugauguca

SEQ ID NO: 2328851 - RNA, 23 nt, Yersinia pestis KIM
uaccaaugucucaggauacaaau

SEQ ID NO: 2328852 - RNA, 13 nt, Yersinia pestis KIM
uaccaaugcacgu

SEQ ID NO: 2328853 - RNA, 17 nt, Yersinia pestis KIM
uaccacgguaaugaaug

SEQ ID NO: 2328854 - RNA, 16 nt, Yersinia pestis KIM
uaccggcauuggcugg

SEQ ID NO: 2328855 - RNA, 23 nt, Yersinia pestis KIM
uaccucauccguaaaaaaccuua

SEQ ID NO: 2328856 - RNA, 12 nt, Yersinia pestis KIM
uaccucaucauu

SEQ ID NO: 2328857 - RNA, 20 nt, Yersinia pestis KIM
uaccucaguuaucagggccu

SEQ ID NO: 2328858 - RNA, 23 nt, Yersinia pestis KIM
uaccuauuuauugccauuuuaau

SEQ ID NO: 2328859 - RNA, 16 nt, Yersinia pestis KIM
uaccguuuuauuuccc

SEQ ID NO: 2328860 - RNA, 18 nt, Yersinia pestis KIM
uaccggguucaaggaaac

SEQ ID NO: 2328861 - RNA, 17 nt, Yersinia pestis KIM
uaccggucauauuuauc

SEQ ID NO: 2328862 - RNA, 14 nt, Yersinia pestis KIM
uagauuauuuucuu

SEQ ID NO: 2328863 - RNA, 16 nt, Yersinia pestis KIM
uagauuaagaaaacau

SEQ ID NO: 2328864 - RNA, 13 nt, Yersinia pestis KIM
uagauuaaucgaa

SEQ ID NO: 2328865 - RNA, 17 nt, Yersinia pestis KIM
uagauucaucaccaguc

SEQ ID NO: 2328866 - RNA, 18 nt, Yersinia pestis KIM
uagaucggccaaugcuuu

SEQ ID NO: 2328867 - RNA, 21 nt, Yersinia pestis KIM
uagaucuccugcaacgccuuc

SEQ ID NO: 2328868 - RNA, 19 nt, Yersinia pestis KIM
uagaucucuguuuuccauc

SEQ ID NO: 2328869 - RNA, 18 nt, Yersinia pestis KIM
uagauccacuccagugcc

SEQ ID NO: 2328870 - RNA, 13 nt, Yersinia pestis KIM
uagaucagccaaa

SEQ ID NO: 2328871 - RNA, 21 nt, Yersinia pestis KIM
uagaucccauacccacuaaua

SEQ ID NO: 2328872 - RNA, 20 nt, Yersinia pestis KIM
uagaucccauacccacuaau

SEQ ID NO: 2328873 - RNA, 19 nt, Yersinia pestis KIM
uagaucgagucaucggguu

SEQ ID NO: 2328874 - RNA, 18 nt, Yersinia pestis KIM
uagauaggcaguauucca

SEQ ID NO: 2328875 - RNA, 14 nt, Yersinia pestis KIM
uagauagccauaau

SEQ ID NO: 2328876 - RNA, 21 nt, Yersinia pestis KIM
uagaucacagacguuuaaaua

SEQ ID NO: 2328877 - RNA, 14 nt, Yersinia pestis KIM
uagaguaaaacuga

SEQ ID NO: 2328878 - RNA, 13 nt, Yersinia pestis KIM
uagaggccuuaca

SEQ ID NO: 2328879 - RNA, 22 nt, Yersinia pestis KIM
uagagcuguuuggcauggauau

SEQ ID NO: 2328880 - RNA, 20 nt, Yersinia pestis KIM
uagagcgguuuguugcuacu

SEQ ID NO: 2328881 - RNA, 19 nt, Yersinia pestis KIM
uagaggcucccuuccauuu

SEQ ID NO: 2328882 - RNA, 21 nt, Yersinia pestis KIM
uagagcaccaaaucuuccagc

SEQ ID NO: 2328883 - RNA, 14 nt, Yersinia pestis KIM
uagagaugaaaccc

SEQ ID NO: 2328884 - RNA, 17 nt, Yersinia pestis KIM
uagaguugauaaacaau

SEQ ID NO: 2328885 - RNA, 19 nt, Yersinia pestis KIM
uagagugaaguaucaccac

SEQ ID NO: 2328886 - RNA, 16 nt, Yersinia pestis KIM
uagagugcauccagcg

SEQ ID NO: 2328887 - RNA, 14 nt, Yersinia pestis KIM
uagauaaaaacauu

SEQ ID NO: 2328888 - RNA, 18 nt, Yersinia pestis KIM
uagauaaaaacauuuaaa

SEQ ID NO: 2328889 - RNA, 23 nt, Yersinia pestis KIM
uagauuucaccuauaauuaacag

SEQ ID NO: 2328890 - RNA, 18 nt, Yersinia pestis KIM
uagauuuaaccccaauuc

SEQ ID NO: 2328891 - RNA, 19 nt, Yersinia pestis KIM
uagauuuuaaugaaaacua

SEQ ID NO: 2328892 - RNA, 18 nt, Yersinia pestis KIM
uagcaaacccaccugaau

SEQ ID NO: 2328893 - RNA, 20 nt, Yersinia pestis KIM
uagcaaacccaccugaaucu

SEQ ID NO: 2328894 - RNA, 14 nt, Yersinia pestis KIM
uagcaaaaaaaaag

SEQ ID NO: 2328895 - RNA, 22 nt, Yersinia pestis KIM
uagcaaagcgauaucguuauca

SEQ ID NO: 2328896 - RNA, 22 nt, Yersinia pestis KIM
uagcaauaccuugcccuaggcc

SEQ ID NO: 2328897 - RNA, 15 nt, Yersinia pestis KIM
uagcaauauaauaau

SEQ ID NO: 2328898 - RNA, 19 nt, Yersinia pestis KIM
uagcaagccaaaacagccu

SEQ ID NO: 2328899 - RNA, 13 nt, Yersinia pestis KIM
uagcaacugccaa

SEQ ID NO: 2328900 - RNA, 14 nt, Yersinia pestis KIM
uagcacauaugcag

SEQ ID NO: 2328901 - RNA, 13 nt, Yersinia pestis KIM
uagcaauuugagg

SEQ ID NO: 2328902 - RNA, 12 nt, Yersinia pestis KIM
uagcagggccgc

SEQ ID NO: 2328903 - RNA, 20 nt, Yersinia pestis KIM
uagcagggcaguaaaaugcc

SEQ ID NO: 2328904 - RNA, 19 nt, Yersinia pestis KIM
uagcagccacaugguuuca

SEQ ID NO: 2328905 - RNA, 12 nt, Yersinia pestis KIM
uagcagcaccau

SEQ ID NO: 2328906 - RNA, 20 nt, Yersinia pestis KIM
uagccaacacaugcugcuug

SEQ ID NO: 2328907 - RNA, 20 nt, Yersinia pestis KIM
uagccaaucccgauaaaaac

SEQ ID NO: 2328908 - RNA, 14 nt, Yersinia pestis KIM
uagccaauucuaac

SEQ ID NO: 2328909 - RNA, 13 nt, Yersinia pestis KIM
uagcauuggcaca

SEQ ID NO: 2328910 - RNA, 20 nt, Yersinia pestis KIM
uagcauugcagauuucuucu

SEQ ID NO: 2328911 - RNA, 16 nt, Yersinia pestis KIM
uagcauggucaucgcu

SEQ ID NO: 2328912 - RNA, 18 nt, Yersinia pestis KIM
uagcauggcuuuaugacc

SEQ ID NO: 2328913 - RNA, 23 nt, Yersinia pestis KIM
uagcaucggcuagcguuuacuuu

SEQ ID NO: 2328914 - RNA, 13 nt, Yersinia pestis KIM
uagcaucauccag

SEQ ID NO: 2328915 - RNA, 23 nt, Yersinia pestis KIM
uagcccuucagcaaaugauugca

SEQ ID NO: 2328916 - RNA, 18 nt, Yersinia pestis KIM
uagccgaaccccuagcca

SEQ ID NO: 2328917 - RNA, 19 nt, Yersinia pestis KIM
uagccccaacacuggggcg

SEQ ID NO: 2328918 - RNA, 12 nt, Yersinia pestis KIM
uagcccagugcg

SEQ ID NO: 2328919 - RNA, 24 nt, Yersinia pestis KIM
uagcccacuggaggaacugagucu

SEQ ID NO: 2328920 - RNA, 17 nt, Yersinia pestis KIM
uagcccaguaccgcugg

SEQ ID NO: 2328921 - RNA, 12 nt, Yersinia pestis KIM
uagcccaaggcg

SEQ ID NO: 2328922 - RNA, 16 nt, Yersinia pestis KIM
uagcccaaggcgacuu

SEQ ID NO: 2328923 - RNA, 12 nt, Yersinia pestis KIM
uagccauuucaa

SEQ ID NO: 2328924 - RNA, 22 nt, Yersinia pestis KIM
uagcccguugagugaaagccug

SEQ ID NO: 2328925 - RNA, 22 nt, Yersinia pestis KIM
uagccacgucugcggaucagag

SEQ ID NO: 2328926 - RNA, 22 nt, Yersinia pestis KIM
uagccagcgugguguuggcugu

SEQ ID NO: 2328927 - RNA, 16 nt, Yersinia pestis KIM
uagccagccaauggcc

SEQ ID NO: 2328928 - RNA, 13 nt, Yersinia pestis KIM
uagcgagaaaguc

SEQ ID NO: 2328929 - RNA, 16 nt, Yersinia pestis KIM
uagcgauaaacguuca

SEQ ID NO: 2328930 - RNA, 14 nt, Yersinia pestis KIM
uagcgaugacugag

SEQ ID NO: 2328931 - RNA, 21 nt, Yersinia pestis KIM
uagcgaaauaucaggaugaac

SEQ ID NO: 2328932 - RNA, 20 nt, Yersinia pestis KIM
uagccuuuuugcaucaccau

SEQ ID NO: 2328933 - RNA, 17 nt, Yersinia pestis KIM
uagcgacacccucagag

SEQ ID NO: 2328934 - RNA, 19 nt, Yersinia pestis KIM
uagccugcaccucaucaac

SEQ ID NO: 2328935 - RNA, 22 nt, Yersinia pestis KIM
uagcgccuuuuuuauaauaaug

SEQ ID NO: 2328936 - RNA, 20 nt, Yersinia pestis KIM
uagcgcgcguuuaaucgaua

SEQ ID NO: 2328937 - RNA, 16 nt, Yersinia pestis KIM
uagcgcugcaucagca

SEQ ID NO: 2328938 - RNA, 17 nt, Yersinia pestis KIM
uagcgcugcaucugguc

SEQ ID NO: 2328939 - RNA, 23 nt, Yersinia pestis KIM
uagcgcugcaucuggucaucaug

SEQ ID NO: 2328940 - RNA, 19 nt, Yersinia pestis KIM
uagcgcuucagugauuuua

SEQ ID NO: 2328941 - RNA, 23 nt, Yersinia pestis KIM
uagcgcgggugaucgucaucagc

SEQ ID NO: 2328942 - RNA, 18 nt, Yersinia pestis KIM
uagcggaaggguuuugug

SEQ ID NO: 2328943 - RNA, 16 nt, Yersinia pestis KIM
uagcggcguucagcaa

SEQ ID NO: 2328944 - RNA, 21 nt, Yersinia pestis KIM
uagcggauuuauaaggaaaug

SEQ ID NO: 2328945 - RNA, 22 nt, Yersinia pestis KIM
uagcgguguuagcccaaggcga

SEQ ID NO: 2328946 - RNA, 14 nt, Yersinia pestis KIM
uagcguacaagaca

SEQ ID NO: 2328947 - RNA, 15 nt, Yersinia pestis KIM
uagcguacaagacaa

SEQ ID NO: 2328948 - RNA, 16 nt, Yersinia pestis KIM
uaggauguuauggauu

SEQ ID NO: 2328949 - RNA, 23 nt, Yersinia pestis KIM
uaggaucgaaugaucagaggcug

SEQ ID NO: 2328950 - RNA, 14 nt, Yersinia pestis KIM
uaggcaacuaagcu

SEQ ID NO: 2328951 - RNA, 17 nt, Yersinia pestis KIM
uaggagaacagcggcuu

SEQ ID NO: 2328952 - RNA, 15 nt, Yersinia pestis KIM
uaggacggugccaug

SEQ ID NO: 2328953 - RNA, 13 nt, Yersinia pestis KIM
uagcuuuuuaaau

SEQ ID NO: 2328954 - RNA, 15 nt, Yersinia pestis KIM
uagcucagaaaauaa

SEQ ID NO: 2328955 - RNA, 12 nt, Yersinia pestis KIM
uagcuacugaug

SEQ ID NO: 2328956 - RNA, 14 nt, Yersinia pestis KIM
uagcuaaccuuaac

SEQ ID NO: 2328957 - RNA, 16 nt, Yersinia pestis KIM
uagcuuauccagaucc

SEQ ID NO: 2328958 - RNA, 17 nt, Yersinia pestis KIM
uagcuucagcauugauu

SEQ ID NO: 2328959 - RNA, 20 nt, Yersinia pestis KIM
uagcuucagcauugauuuca

SEQ ID NO: 2328960 - RNA, 21 nt, Yersinia pestis KIM
uagcuggcuucaaaaucaccu

SEQ ID NO: 2328961 - RNA, 18 nt, Yersinia pestis KIM
uagcugcgcccgguuacu

SEQ ID NO: 2328962 - RNA, 19 nt, Yersinia pestis KIM
uauaccaacucugaaguaa

SEQ ID NO: 2328963 - RNA, 14 nt, Yersinia pestis KIM
uauacauaccacuu

SEQ ID NO: 2328964 - RNA, 14 nt, Yersinia pestis KIM
uauacccaccagag

SEQ ID NO: 2328965 - RNA, 16 nt, Yersinia pestis KIM
uauacccaccagagac

SEQ ID NO: 2328966 - RNA, 22 nt, Yersinia pestis KIM
uauacagcccgguaucaccuuu

SEQ ID NO: 2328967 - RNA, 21 nt, Yersinia pestis KIM
uauacuguuuauuaauggaua

SEQ ID NO: 2328968 - RNA, 14 nt, Yersinia pestis KIM
uauacugccaccgg

SEQ ID NO: 2328969 - RNA, 13 nt, Yersinia pestis KIM
uauacuaaaacag

SEQ ID NO: 2328970 - RNA, 19 nt, Yersinia pestis KIM
uauacuaaaacagcucacu

SEQ ID NO: 2328971 - RNA, 19 nt, Yersinia pestis KIM
uauacggcggcuacuggua

SEQ ID NO: 2328972 - RNA, 16 nt, Yersinia pestis KIM
uauacggacaaugcca

SEQ ID NO: 2328973 - RNA, 23 nt, Yersinia pestis KIM
uauacuaaauagauaaaaacauu

SEQ ID NO: 2328974 - RNA, 22 nt, Yersinia pestis KIM
uauagcgugcuacauagaaaau

SEQ ID NO: 2328975 - RNA, 22 nt, Yersinia pestis KIM
uauagcagggccgguuaauuga

SEQ ID NO: 2328976 - RNA, 20 nt, Yersinia pestis KIM
uauagacuguuuuauuauau

SEQ ID NO: 2328977 - RNA, 13 nt, Yersinia pestis KIM
uauagagaaaucu

SEQ ID NO: 2328978 - RNA, 14 nt, Yersinia pestis KIM
uauagagaaaucua

SEQ ID NO: 2328979 - RNA, 23 nt, Yersinia pestis KIM
uauagacucaucuaauuuucuca

SEQ ID NO: 2328980 - RNA, 16 nt, Yersinia pestis KIM
uauauauuuugaauau

SEQ ID NO: 2328981 - RNA, 12 nt, Yersinia pestis KIM
uauaucacuauu

SEQ ID NO: 2328982 - RNA, 24 nt, Yersinia pestis KIM
uauaucaaggcggcagagccaauc

SEQ ID NO: 2328983 - RNA, 17 nt, Yersinia pestis KIM
uauauagagaaaucuac

SEQ ID NO: 2328984 - RNA, 16 nt, Yersinia pestis KIM
uauauagagaaaucua

SEQ ID NO: 2328985 - RNA, 20 nt, Yersinia pestis KIM
uauauacccgucauaaauaa

SEQ ID NO: 2328986 - RNA, 23 nt, Yersinia pestis KIM
uauauaauugaagauuuaaauaa

SEQ ID NO: 2328987 - RNA, 13 nt, Yersinia pestis KIM
uauauacagucaa

SEQ ID NO: 2328988 - RNA, 20 nt, Yersinia pestis KIM
uauauacagucaauugagaa

SEQ ID NO: 2328989 - RNA, 15 nt, Yersinia pestis KIM
uauauaagagaugaa

SEQ ID NO: 2328990 - RNA, 23 nt, Yersinia pestis KIM
uauauaagagaugaaauuuuauu

SEQ ID NO: 2328991 - RNA, 14 nt, Yersinia pestis KIM
uauaguaucacugc

SEQ ID NO: 2328992 - RNA, 17 nt, Yersinia pestis KIM
uauaucacuauuucaga

SEQ ID NO: 2328993 - RNA, 15 nt, Yersinia pestis KIM
uauaucacuucugcu

SEQ ID NO: 2328994 - RNA, 17 nt, Yersinia pestis KIM
uauaucacuucugcugu

SEQ ID NO: 2328995 - RNA, 17 nt, Yersinia pestis KIM
uauauucauauuucacu

SEQ ID NO: 2328996 - RNA, 14 nt, Yersinia pestis KIM
uauauccaaaauaa

SEQ ID NO: 2328997 - RNA, 23 nt, Yersinia pestis KIM
uauauucuauugaggacaauuca

SEQ ID NO: 2328998 - RNA, 12 nt, Yersinia pestis KIM
uaucaaaacuga

SEQ ID NO: 2328999 - RNA, 16 nt, Yersinia pestis KIM
uaucaaaacgccagau

SEQ ID NO: 2329000 - RNA, 19 nt, Yersinia pestis KIM
uaucaaaacugauuaauag

SEQ ID NO: 2329001 - RNA, 13 nt, Yersinia pestis KIM
uaucaaaacugau

SEQ ID NO: 2329002 - RNA, 13 nt, Yersinia pestis KIM
uauauuuuucuuu

SEQ ID NO: 2329003 - RNA, 17 nt, Yersinia pestis KIM
uauauuggccugcacau

SEQ ID NO: 2329004 - RNA, 23 nt, Yersinia pestis KIM
uauauugccaucgggcaauugaa

SEQ ID NO: 2329005 - RNA, 17 nt, Yersinia pestis KIM
uaucaaucaaaaaauaa

SEQ ID NO: 2329006 - RNA, 13 nt, Yersinia pestis KIM
uaucaauagguca

SEQ ID NO: 2329007 - RNA, 16 nt, Yersinia pestis KIM
uaucaaucaaaaaaua

SEQ ID NO: 2329008 - RNA, 14 nt, Yersinia pestis KIM
uaucaaugagucuc

SEQ ID NO: 2329009 - RNA, 16 nt, Yersinia pestis KIM
uaucaauugcuggcua

SEQ ID NO: 2329010 - RNA, 15 nt, Yersinia pestis KIM
uaucacuauuucaga

SEQ ID NO: 2329011 - RNA, 19 nt, Yersinia pestis KIM
uaucacuauaauuauuucu

SEQ ID NO: 2329012 - RNA, 19 nt, Yersinia pestis KIM
uaucacucgggauaugacu

SEQ ID NO: 2329013 - RNA, 15 nt, Yersinia pestis KIM
uaucacggccaaaaa

SEQ ID NO: 2329014 - RNA, 19 nt, Yersinia pestis KIM
uaucaaagugcuuaaccca

SEQ ID NO: 2329015 - RNA, 16 nt, Yersinia pestis KIM
uaucaauaagugcaaa

SEQ ID NO: 2329016 - RNA, 18 nt, Yersinia pestis KIM
uaucaauacugcaaaugg

SEQ ID NO: 2329017 - RNA, 11 nt, Yersinia pestis KIM
uaucaacagaa

SEQ ID NO: 2329018 - RNA, 12 nt, Yersinia pestis KIM
uaucaacagaac

SEQ ID NO: 2329019 - RNA, 17 nt, Yersinia pestis KIM
uaucaucuuuuucugcc

SEQ ID NO: 2329020 - RNA, 19 nt, Yersinia pestis KIM
uaucaucuuuuucugccug

SEQ ID NO: 2329021 - RNA, 20 nt, Yersinia pestis KIM
uaucacucuguacguaaaua

SEQ ID NO: 2329022 - RNA, 21 nt, Yersinia pestis KIM
uaucacuggaggcguuuuuau

SEQ ID NO: 2329023 - RNA, 14 nt, Yersinia pestis KIM
uaucagaaauacgc

SEQ ID NO: 2329024 - RNA, 16 nt, Yersinia pestis KIM
uaucacuugggcauga

SEQ ID NO: 2329025 - RNA, 17 nt, Yersinia pestis KIM
uaucagugacaccauug

SEQ ID NO: 2329026 - RNA, 18 nt, Yersinia pestis KIM
uauccauauuaaaugcau

SEQ ID NO: 2329027 - RNA, 22 nt, Yersinia pestis KIM
uauccaccugaucaugccacga

SEQ ID NO: 2329028 - RNA, 19 nt, Yersinia pestis KIM
uauccaauggcucaccuuu

SEQ ID NO: 2329029 - RNA, 20 nt, Yersinia pestis KIM
uauccaaucuugguuaauag

SEQ ID NO: 2329030 - RNA, 16 nt, Yersinia pestis KIM
uaucauucaagaaaau

SEQ ID NO: 2329031 - RNA, 13 nt, Yersinia pestis KIM
uauccaaaauaau

SEQ ID NO: 2329032 - RNA, 21 nt, Yersinia pestis KIM
uauaaaagcacagacaaacaa

SEQ ID NO: 2329033 - RNA, 18 nt, Yersinia pestis KIM
uauaaacauuuacuuaua

SEQ ID NO: 2329034 - RNA, 20 nt, Yersinia pestis KIM
uauaaacauuuacuuauaaa

SEQ ID NO: 2329035 - RNA, 17 nt, Yersinia pestis KIM
uauaaacuaauaucuuu

SEQ ID NO: 2329036 - RNA, 15 nt, Yersinia pestis KIM
uauaaacuugauuca

SEQ ID NO: 2329037 - RNA, 13 nt, Yersinia pestis KIM
uauaaauuaaaaa

SEQ ID NO: 2329038 - RNA, 11 nt, Yersinia pestis KIM
uauaaaaauag

SEQ ID NO: 2329039 - RNA, 15 nt, Yersinia pestis KIM
uagucccccuccggc

SEQ ID NO: 2329040 - RNA, 21 nt, Yersinia pestis KIM
uagugaugggggcaauugauu

SEQ ID NO: 2329041 - RNA, 20 nt, Yersinia pestis KIM
uagugcaaaauuccaccauu

SEQ ID NO: 2329042 - RNA, 13 nt, Yersinia pestis KIM
uagugccacaaca

SEQ ID NO: 2329043 - RNA, 22 nt, Yersinia pestis KIM
uaguuauugauuaauuuuucau

SEQ ID NO: 2329044 - RNA, 11 nt, Yersinia pestis KIM
uaguucagucg

SEQ ID NO: 2329045 - RNA, 19 nt, Yersinia pestis KIM
uaguucacgauggaaaaaa

SEQ ID NO: 2329046 - RNA, 14 nt, Yersinia pestis KIM
uaguguguuuucuu

SEQ ID NO: 2329047 - RNA, 13 nt, Yersinia pestis KIM
uaguuuauuuuau

SEQ ID NO: 2329048 - RNA, 17 nt, Yersinia pestis KIM
uaguuuauuuuauuuaa

SEQ ID NO: 2329049 - RNA, 22 nt, Yersinia pestis KIM
uaguuuagauagaaaucacuga

SEQ ID NO: 2329050 - RNA, 18 nt, Yersinia pestis KIM
uaguaaaaaaucuauuga

SEQ ID NO: 2329051 - RNA, 15 nt, Yersinia pestis KIM
uaguaaacaguuuca

SEQ ID NO: 2329052 - RNA, 17 nt, Yersinia pestis KIM
uaguaguaauagauugu

SEQ ID NO: 2329053 - RNA, 15 nt, Yersinia pestis KIM
uaguaucauugugau

SEQ ID NO: 2329054 - RNA, 13 nt, Yersinia pestis KIM
uagguuucugggc

SEQ ID NO: 2329055 - RNA, 16 nt, Yersinia pestis KIM
uaggucagugguuuua

SEQ ID NO: 2329056 - RNA, 13 nt, Yersinia pestis KIM
uaggucagugguu

SEQ ID NO: 2329057 - RNA, 20 nt, Yersinia pestis KIM
uaggucagugguuuuauaaa

SEQ ID NO: 2329058 - RNA, 17 nt, Yersinia pestis KIM
uaggucaucccagcaca

SEQ ID NO: 2329059 - RNA, 20 nt, Yersinia pestis KIM
uaggguuguuggucagcaga

SEQ ID NO: 2329060 - RNA, 17 nt, Yersinia pestis KIM
uagguaacuaagcugcc

SEQ ID NO: 2329061 - RNA, 20 nt, Yersinia pestis KIM
uaggcgaaauugacuuuaaa

SEQ ID NO: 2329062 - RNA, 23 nt, Yersinia pestis KIM
uaggcgaauuggcaaguuaauca

SEQ ID NO: 2329063 - RNA, 23 nt, Yersinia pestis KIM
uaggcgcugaggauucuguuacc

SEQ ID NO: 2329064 - RNA, 21 nt, Yersinia pestis KIM
uaggcccgaugguuucuccac

SEQ ID NO: 2329065 - RNA, 20 nt, Yersinia pestis KIM
uaggcaggcccgcuucccua

SEQ ID NO: 2329066 - RNA, 16 nt, Yersinia pestis KIM
uaggcaauccaaacau

SEQ ID NO: 2329067 - RNA, 21 nt, Yersinia pestis KIM
uaggccaauagaaaaacacug

SEQ ID NO: 2329068 - RNA, 23 nt, Yersinia pestis KIM
uaggccagacccggcaaauaaau

SEQ ID NO: 2329069 - RNA, 22 nt, Yersinia pestis KIM
uaggcuauugacaaaguaccua

SEQ ID NO: 2329070 - RNA, 17 nt, Yersinia pestis KIM
uaggcuauugacaaagu

SEQ ID NO: 2329071 - RNA, 15 nt, Yersinia pestis KIM
uaggcuucuaacaau

SEQ ID NO: 2329072 - RNA, 16 nt, Yersinia pestis KIM
uagggaacgccagcgg

SEQ ID NO: 2329073 - RNA, 18 nt, Yersinia pestis KIM
uagggaagguguuuaaaa

SEQ ID NO: 2329074 - RNA, 20 nt, Yersinia pestis KIM
uagggagagucuauuauauu

SEQ ID NO: 2329075 - RNA, 12 nt, Yersinia pestis KIM
uagggagccaau

SEQ ID NO: 2329076 - RNA, 14 nt, Yersinia pestis KIM
uagggaugaguguu

SEQ ID NO: 2329077 - RNA, 19 nt, Yersinia pestis KIM
uagggauuuaugcaaauaa

SEQ ID NO: 2329078 - RNA, 18 nt, Yersinia pestis KIM
uagggauuuuaagcagcc

SEQ ID NO: 2329079 - RNA, 13 nt, Yersinia pestis KIM
uagggcuggcaag

SEQ ID NO: 2329080 - RNA, 18 nt, Yersinia pestis KIM
uaaaugguuuauuuaagc

SEQ ID NO: 2329081 - RNA, 16 nt, Yersinia pestis KIM
uaaauggucaguuuaa

SEQ ID NO: 2329082 - RNA, 20 nt, Yersinia pestis KIM
uaaauguacagucauuuacu

SEQ ID NO: 2329083 - RNA, 22 nt, Yersinia pestis KIM
uaaaugggguaaugaccacuga

SEQ ID NO: 2329084 - RNA, 16 nt, Yersinia pestis KIM
uaaaucuacuuuauuc

SEQ ID NO: 2329085 - RNA, 19 nt, Yersinia pestis KIM
uaaaucacgcagcaggcca

SEQ ID NO: 2329086 - RNA, 23 nt, Yersinia pestis KIM
uaaaugaaauugggggucagggc

SEQ ID NO: 2329087 - RNA, 21 nt, Yersinia pestis KIM
uaaaugaagcaguucacugag

SEQ ID NO: 2329088 - RNA, 14 nt, Yersinia pestis KIM
uaaaucuuucucca

SEQ ID NO: 2329089 - RNA, 18 nt, Yersinia pestis KIM
uaaauuugauacaguaau

SEQ ID NO: 2329090 - RNA, 15 nt, Yersinia pestis KIM
uaaauuuuacggcaa

SEQ ID NO: 2329091 - RNA, 15 nt, Yersinia pestis KIM
uaaauuuuauauuau

SEQ ID NO: 2329092 - RNA, 17 nt, Yersinia pestis KIM
uaaauuuuauauuaucu

SEQ ID NO: 2329093 - RNA, 19 nt, Yersinia pestis KIM
uaacaacaucgagcgggcu

SEQ ID NO: 2329094 - RNA, 20 nt, Yersinia pestis KIM
uaacaaauggucaggaaccc

SEQ ID NO: 2329095 - RNA, 21 nt, Yersinia pestis KIM
uaacaaagccgcuuaauuuau

SEQ ID NO: 2329096 - RNA, 14 nt, Yersinia pestis KIM
uaaauuuaauauga

SEQ ID NO: 2329097 - RNA, 11 nt, Yersinia pestis KIM
uaaauugcuca

SEQ ID NO: 2329098 - RNA, 15 nt, Yersinia pestis KIM
uaaauugcuuaaaaa

SEQ ID NO: 2329099 - RNA, 16 nt, Yersinia pestis KIM
uaaauugcuuaaaaaa

SEQ ID NO: 2329100 - RNA, 15 nt, Yersinia pestis KIM
uaaauuagaaaacaa

SEQ ID NO: 2329101 - RNA, 19 nt, Yersinia pestis KIM
uaaauuacucguauaaaaa

SEQ ID NO: 2329102 - RNA, 16 nt, Yersinia pestis KIM
uaaauuaccggugguc

SEQ ID NO: 2329103 - RNA, 15 nt, Yersinia pestis KIM
uaaauuagccacugg

SEQ ID NO: 2329104 - RNA, 20 nt, Yersinia pestis KIM
uaaauuaucccguucaauaa

SEQ ID NO: 2329105 - RNA, 23 nt, Yersinia pestis KIM
uaaccugcuggcgcaacuguagu

SEQ ID NO: 2329106 - RNA, 14 nt, Yersinia pestis KIM
uaaccucagccuca

SEQ ID NO: 2329107 - RNA, 20 nt, Yersinia pestis KIM
uaaccucagccucauucaug

SEQ ID NO: 2329108 - RNA, 15 nt, Yersinia pestis KIM
uaaccucagggagcc

SEQ ID NO: 2329109 - RNA, 21 nt, Yersinia pestis KIM
uaaccucagggagccaauaga

SEQ ID NO: 2329110 - RNA, 20 nt, Yersinia pestis KIM
uaacgaauauucaagagauu

SEQ ID NO: 2329111 - RNA, 16 nt, Yersinia pestis KIM
uaacgacgauaagaau

SEQ ID NO: 2329112 - RNA, 16 nt, Yersinia pestis KIM
uaacgaagguaacuua

SEQ ID NO: 2329113 - RNA, 13 nt, Yersinia pestis KIM
uaacccauugguu

SEQ ID NO: 2329114 - RNA, 21 nt, Yersinia pestis KIM
uaaccccacucgguuagcugu

SEQ ID NO: 2329115 - RNA, 15 nt, Yersinia pestis KIM
uaaccgccgcaggcc

SEQ ID NO: 2329116 - RNA, 15 nt, Yersinia pestis KIM
uaaccgcagcaggca

SEQ ID NO: 2329117 - RNA, 20 nt, Yersinia pestis KIM
uaaccaagccagugcgggag

SEQ ID NO: 2329118 - RNA, 17 nt, Yersinia pestis KIM
uaaccaauaacauuucg

SEQ ID NO: 2329119 - RNA, 13 nt, Yersinia pestis KIM
uaacccaaagccc

SEQ ID NO: 2329120 - RNA, 15 nt, Yersinia pestis KIM
uaacccaaugccaua

SEQ ID NO: 2329121 - RNA, 16 nt, Yersinia pestis KIM
uaaccaugaugacaau

SEQ ID NO: 2329122 - RNA, 15 nt, Yersinia pestis KIM
uaaccaugaugacaa

SEQ ID NO: 2329123 - RNA, 18 nt, Yersinia pestis KIM
uaacauaucaauaagugc

SEQ ID NO: 2329124 - RNA, 15 nt, Yersinia pestis KIM
uaacauauaaaccag

SEQ ID NO: 2329125 - RNA, 16 nt, Yersinia pestis KIM
uaacauauccugugcc

SEQ ID NO: 2329126 - RNA, 17 nt, Yersinia pestis KIM
uaacauauccugugcca

SEQ ID NO: 2329127 - RNA, 20 nt, Yersinia pestis KIM
uaacauauccugugccaaca

SEQ ID NO: 2329128 - RNA, 11 nt, Yersinia pestis KIM
uaacauuuuuu

SEQ ID NO: 2329129 - RNA, 15 nt, Yersinia pestis KIM
uaacauuauugaacg

SEQ ID NO: 2329130 - RNA, 21 nt, Yersinia pestis KIM
uaacagcguugaccaacuguc

SEQ ID NO: 2329131 - RNA, 16 nt, Yersinia pestis KIM
uaacaguaucaaguau

SEQ ID NO: 2329132 - RNA, 20 nt, Yersinia pestis KIM
uaacaauggccggacucauu

SEQ ID NO: 2329133 - RNA, 22 nt, Yersinia pestis KIM
uaacagauauuacgcagccaua

SEQ ID NO: 2329134 - RNA, 22 nt, Yersinia pestis KIM
uaacagaucggucgggaaucaa

SEQ ID NO: 2329135 - RNA, 14 nt, Yersinia pestis KIM
uaacaauauucauu

SEQ ID NO: 2329136 - RNA, 14 nt, Yersinia pestis KIM
uaaacgguaaccau

SEQ ID NO: 2329137 - RNA, 23 nt, Yersinia pestis KIM
uaaacgguaaccauccauauuug

SEQ ID NO: 2329138 - RNA, 16 nt, Yersinia pestis KIM
uaaacgccagucagcu

SEQ ID NO: 2329139 - RNA, 13 nt, Yersinia pestis KIM
uaaacgggccgcg

SEQ ID NO: 2329140 - RNA, 14 nt, Yersinia pestis KIM
uaaacgggcuucca

SEQ ID NO: 2329141 - RNA, 18 nt, Yersinia pestis KIM
uaaacgggcuuccaucag

SEQ ID NO: 2329142 - RNA, 21 nt, Yersinia pestis KIM
uaaacgggcuuccaucaggaa

SEQ ID NO: 2329143 - RNA, 21 nt, Yersinia pestis KIM
uaaacgcacaucaauccgcau

SEQ ID NO: 2329144 - RNA, 15 nt, Yersinia pestis KIM
uaaacgcauacucaa

SEQ ID NO: 2329145 - RNA, 20 nt, Yersinia pestis KIM
uaaacgcauacucaaaaaug

SEQ ID NO: 2329146 - RNA, 13 nt, Yersinia pestis KIM
uaaacgccaacaa

SEQ ID NO: 2329147 - RNA, 18 nt, Yersinia pestis KIM
uaaacccggcaucaacca

SEQ ID NO: 2329148 - RNA, 20 nt, Yersinia pestis KIM
uaaacccgcuaauauuuuca

SEQ ID NO: 2329149 - RNA, 20 nt, Yersinia pestis KIM
uaaacccugucguuacugcc

SEQ ID NO: 2329150 - RNA, 18 nt, Yersinia pestis KIM
uaaaccugcaauaaccag

SEQ ID NO: 2329151 - RNA, 23 nt, Yersinia pestis KIM
uaaaccugcaauaaccagaauaa

SEQ ID NO: 2329152 - RNA, 18 nt, Yersinia pestis KIM
uaaacgucucuuuuucau

SEQ ID NO: 2329153 - RNA, 19 nt, Yersinia pestis KIM
uaaacguggcccuuucgca

SEQ ID NO: 2329154 - RNA, 19 nt, Yersinia pestis KIM
uaaacuaauaucuuucaua

SEQ ID NO: 2329155 - RNA, 16 nt, Yersinia pestis KIM
uaaacuuccagcguau

SEQ ID NO: 2329156 - RNA, 13 nt, Yersinia pestis KIM
uaaagaaaagagg

SEQ ID NO: 2329157 - RNA, 23 nt, Yersinia pestis KIM
uaaagaaaaacccguugaagccu

SEQ ID NO: 2329158 - RNA, 15 nt, Yersinia pestis KIM
uaaagaaaaaacguu

SEQ ID NO: 2329159 - RNA, 15 nt, Yersinia pestis KIM
uaaacagcuuaucag

SEQ ID NO: 2329160 - RNA, 16 nt, Yersinia pestis KIM
uaaacacaaaauagaa

SEQ ID NO: 2329161 - RNA, 19 nt, Yersinia pestis KIM
uaaacaucaugacaaaaau

SEQ ID NO: 2329162 - RNA, 23 nt, Yersinia pestis KIM
uaaacaucaugagauaaauauuu

SEQ ID NO: 2329163 - RNA, 20 nt, Yersinia pestis KIM
uaaacauaaaaaaugccagc

SEQ ID NO: 2329164 - RNA, 16 nt, Yersinia pestis KIM
uaaacaaguugaacca

SEQ ID NO: 2329165 - RNA, 20 nt, Yersinia pestis KIM
uaaacaaucugaugaauuaa

SEQ ID NO: 2329166 - RNA, 16 nt, Yersinia pestis KIM
uaaaauuuuggcaacc

SEQ ID NO: 2329167 - RNA, 22 nt, Yersinia pestis KIM
uaaaauucguuucucuaaaauu

SEQ ID NO: 2329168 - RNA, 15 nt, Yersinia pestis KIM
uaaaauucgcuauga

SEQ ID NO: 2329169 - RNA, 22 nt, Yersinia pestis KIM
uaaauacccagcuucuuuuaaa

SEQ ID NO: 2329170 - RNA, 22 nt, Yersinia pestis KIM
uaaauaccaauuucauacaggc

SEQ ID NO: 2329171 - RNA, 15 nt, Yersinia pestis KIM
uaaauaccagagacg

SEQ ID NO: 2329172 - RNA, 14 nt, Yersinia pestis KIM
uaaauacauccaug

SEQ ID NO: 2329173 - RNA, 13 nt, Yersinia pestis KIM
uaaauaauugggg

SEQ ID NO: 2329174 - RNA, 22 nt, Yersinia pestis KIM
uaaauaaugucgucaauuaaaa

SEQ ID NO: 2329175 - RNA, 13 nt, Yersinia pestis KIM
uaaauaauuaaug

SEQ ID NO: 2329176 - RNA, 14 nt, Yersinia pestis KIM
uaaauaauuacuua

SEQ ID NO: 2329177 - RNA, 20 nt, Yersinia pestis KIM
uaaauaauuacuuauaaacc

SEQ ID NO: 2329178 - RNA, 14 nt, Yersinia pestis KIM
uaaauaaaauaaua

SEQ ID NO: 2329179 - RNA, 18 nt, Yersinia pestis KIM
uaaauaaaauaauaaugg

SEQ ID NO: 2329180 - RNA, 15 nt, Yersinia pestis KIM
uaaauaaaauaauaa

SEQ ID NO: 2329181 - RNA, 14 nt, Yersinia pestis KIM
uaaauaaaauagcg

SEQ ID NO: 2329182 - RNA, 20 nt, Yersinia pestis KIM
uaaaguaaaagccagucagg

SEQ ID NO: 2329183 - RNA, 15 nt, Yersinia pestis KIM
uaaauaaauagaaaa

SEQ ID NO: 2329184 - RNA, 19 nt, Yersinia pestis KIM
uaaauaaagugcuucucug

SEQ ID NO: 2329185 - RNA, 16 nt, Yersinia pestis KIM
uaaauacugaaaucau

SEQ ID NO: 2329186 - RNA, 23 nt, Yersinia pestis KIM
uaaauagagugaaguaucaccac

SEQ ID NO: 2329187 - RNA, 14 nt, Yersinia pestis KIM
uaaauagauaaaaa

SEQ ID NO: 2329188 - RNA, 18 nt, Yersinia pestis KIM
uaaauagcaaaacugagg

SEQ ID NO: 2329189 - RNA, 16 nt, Yersinia pestis KIM
uaaauauucauuaaaa

SEQ ID NO: 2329190 - RNA, 13 nt, Yersinia pestis KIM
uaaauauugggca

SEQ ID NO: 2329191 - RNA, 21 nt, Yersinia pestis KIM
uaaauauugguacauaggucu

SEQ ID NO: 2329192 - RNA, 17 nt, Yersinia pestis KIM
uaaagagugaaauauac

SEQ ID NO: 2329193 - RNA, 16 nt, Yersinia pestis KIM
uaaagacgcaugagcu

SEQ ID NO: 2329194 - RNA, 20 nt, Yersinia pestis KIM
uaaagacgccggcuucccug

SEQ ID NO: 2329195 - RNA, 15 nt, Yersinia pestis KIM
uaaagaauaaugggu

SEQ ID NO: 2329196 - RNA, 16 nt, Yersinia pestis KIM
uaaagaccucgcgcca

SEQ ID NO: 2329197 - RNA, 18 nt, Yersinia pestis KIM
uaaagacgcuaauuaaag

SEQ ID NO: 2329198 - RNA, 19 nt, Yersinia pestis KIM
uaaagacgccguaaauaca

SEQ ID NO: 2329199 - RNA, 13 nt, Yersinia pestis KIM
uaaagacuucagc

SEQ ID NO: 2329200 - RNA, 20 nt, Yersinia pestis KIM
uaaagcaggccuucuaacuc

SEQ ID NO: 2329201 - RNA, 17 nt, Yersinia pestis KIM
uaaagauuuuaagcacu

SEQ ID NO: 2329202 - RNA, 19 nt, Yersinia pestis KIM
uaaaggcccaaucuugcaa

SEQ ID NO: 2329203 - RNA, 13 nt, Yersinia pestis KIM
uaaaggcaaagaa

SEQ ID NO: 2329204 - RNA, 18 nt, Yersinia pestis KIM
uaaagguauagcgauaga

SEQ ID NO: 2329205 - RNA, 19 nt, Yersinia pestis KIM
uaaagguacguaauuuacg

SEQ ID NO: 2329206 - RNA, 14 nt, Yersinia pestis KIM
uaaaggugauauca

SEQ ID NO: 2329207 - RNA, 17 nt, Yersinia pestis KIM
uaaagccuuucagcgcu

SEQ ID NO: 2329208 - RNA, 16 nt, Yersinia pestis KIM
uaaagcgaugcucaau

SEQ ID NO: 2329209 - RNA, 16 nt, Yersinia pestis KIM
uaaagcgguaaauggc

SEQ ID NO: 2329210 - RNA, 15 nt, Yersinia pestis KIM
uaaaauauggcaggu

SEQ ID NO: 2329211 - RNA, 17 nt, Yersinia pestis KIM
uaaaauccccauuccaa

SEQ ID NO: 2329212 - RNA, 16 nt, Yersinia pestis KIM
uaaaauccccauucca

SEQ ID NO: 2329213 - RNA, 12 nt, Yersinia pestis KIM
uaaaauccccau

SEQ ID NO: 2329214 - RNA, 20 nt, Yersinia pestis KIM
uaaaauccccauuccaauua

SEQ ID NO: 2329215 - RNA, 15 nt, Yersinia pestis KIM
uaaaaucgauaguca

SEQ ID NO: 2329216 - RNA, 12 nt, Yersinia pestis KIM
uaaaauuaauua

SEQ ID NO: 2329217 - RNA, 20 nt, Yersinia pestis KIM
uaaaauuaauaaauuauaau

SEQ ID NO: 2329218 - RNA, 20 nt, Yersinia pestis KIM
uaaaaugggccugagugggg

SEQ ID NO: 2329219 - RNA, 16 nt, Yersinia pestis KIM
uaaaaucuugugccgc

SEQ ID NO: 2329220 - RNA, 20 nt, Yersinia pestis KIM
uaaaaucugcuucuccugua

SEQ ID NO: 2329221 - RNA, 17 nt, Yersinia pestis KIM
uaaaaucuguaauuaau

SEQ ID NO: 2329222 - RNA, 21 nt, Yersinia pestis KIM
uaaaaugauaugcuuauaaac

SEQ ID NO: 2329223 - RNA, 22 nt, Yersinia pestis KIM
uaaaauaaaucgucgaacauuu

SEQ ID NO: 2329224 - RNA, 17 nt, Yersinia pestis KIM
uaaaauaccaauuaaua

SEQ ID NO: 2329225 - RNA, 18 nt, Yersinia pestis KIM
uaaaauaccaauuaauaa

SEQ ID NO: 2329226 - RNA, 21 nt, Yersinia pestis KIM
uaaaauaagcaggcaguaaaa

SEQ ID NO: 2329227 - RNA, 22 nt, Yersinia pestis KIM
uaaaauaagcaggcaguaaaau

SEQ ID NO: 2329228 - RNA, 13 nt, Yersinia pestis KIM
uaaaauaauaaug

SEQ ID NO: 2329229 - RNA, 20 nt, Yersinia pestis KIM
uaaaauaguggcacaaauaa

SEQ ID NO: 2329230 - RNA, 12 nt, Yersinia pestis KIM
uaaaaggcccgc

SEQ ID NO: 2329231 - RNA, 13 nt, Yersinia pestis KIM
uaaaaggauaggg

SEQ ID NO: 2329232 - RNA, 19 nt, Yersinia pestis KIM
uaaaaggauggcccaagcc

SEQ ID NO: 2329233 - RNA, 15 nt, Yersinia pestis KIM
uaaaaggggauaaca

SEQ ID NO: 2329234 - RNA, 15 nt, Yersinia pestis KIM
uaaaaggcuauuuaa

SEQ ID NO: 2329235 - RNA, 19 nt, Yersinia pestis KIM
uaaaaggcuauuuaaauuu

SEQ ID NO: 2329236 - RNA, 14 nt, Yersinia pestis KIM
uaaaagucagcaaa

SEQ ID NO: 2329237 - RNA, 18 nt, Yersinia pestis KIM
uaaaagugaccacacuca

SEQ ID NO: 2329238 - RNA, 19 nt, Yersinia pestis KIM
uaaaaauucacaacagugc

SEQ ID NO: 2329239 - RNA, 12 nt, Yersinia pestis KIM
uaaaaauuaauu

SEQ ID NO: 2329240 - RNA, 13 nt, Yersinia pestis KIM
uaaaaauauuaac

SEQ ID NO: 2329241 - RNA, 20 nt, Yersinia pestis KIM
uaaaaaucaccucaaacuga

SEQ ID NO: 2329242 - RNA, 20 nt, Yersinia pestis KIM
uaaaaaucccggcauauuau

SEQ ID NO: 2329243 - RNA, 22 nt, Yersinia pestis KIM
uaaaaaucugcaauaucaucag

SEQ ID NO: 2329244 - RNA, 20 nt, Yersinia pestis KIM
uaaaacagcagccaccaaaa

SEQ ID NO: 2329245 - RNA, 21 nt, Yersinia pestis KIM
uaaaacagcagccaccaaaaa

SEQ ID NO: 2329246 - RNA, 16 nt, Yersinia pestis KIM
uaaaacagcuaacacu

SEQ ID NO: 2329247 - RNA, 14 nt, Yersinia pestis KIM
uaaaacagccacga

SEQ ID NO: 2329248 - RNA, 19 nt, Yersinia pestis KIM
uaaaacauuucauuccaga

SEQ ID NO: 2329249 - RNA, 17 nt, Yersinia pestis KIM
uaaaacaucucuuccca

SEQ ID NO: 2329250 - RNA, 22 nt, Yersinia pestis KIM
uaaaaccagcagcgcauaaaaa

SEQ ID NO: 2329251 - RNA, 18 nt, Yersinia pestis KIM
uaaaaccaagaagacuaa

SEQ ID NO: 2329252 - RNA, 14 nt, Yersinia pestis KIM
uaaaacaaaguagu

SEQ ID NO: 2329253 - RNA, 15 nt, Yersinia pestis KIM
uaaaacagaaccccc

SEQ ID NO: 2329254 - RNA, 15 nt, Yersinia pestis KIM
uaaaacagauaaaaa

SEQ ID NO: 2329255 - RNA, 17 nt, Yersinia pestis KIM
uaaaacagauaaaaaau

SEQ ID NO: 2329256 - RNA, 14 nt, Yersinia pestis KIM
uaaaacugaagcau

SEQ ID NO: 2329257 - RNA, 20 nt, Yersinia pestis KIM
uaaaacugauauaaagcauu

SEQ ID NO: 2329258 - RNA, 18 nt, Yersinia pestis KIM
uaaaacugaagcaucaau

SEQ ID NO: 2329259 - RNA, 23 nt, Yersinia pestis KIM
uaaaacgcuaaccgauguagccu

SEQ ID NO: 2329260 - RNA, 15 nt, Yersinia pestis KIM
uaaaacgaguaaaua

SEQ ID NO: 2329261 - RNA, 19 nt, Yersinia pestis KIM
uaaaaccuaauaacgcuca

SEQ ID NO: 2329262 - RNA, 15 nt, Yersinia pestis KIM
uaaaagaaaaccuug

SEQ ID NO: 2329263 - RNA, 18 nt, Yersinia pestis KIM
uaaaacuuuggcugaggg

SEQ ID NO: 2329264 - RNA, 17 nt, Yersinia pestis KIM
uaaaagaaaaccuugac

SEQ ID NO: 2329265 - RNA, 21 nt, Yersinia pestis KIM
uaaaagaaaaccuugacucuu

SEQ ID NO: 2329266 - RNA, 19 nt, Yersinia pestis KIM
uaaaagaauaaaugucacu

SEQ ID NO: 2329267 - RNA, 15 nt, Yersinia pestis KIM
uaaaagccagucagg

SEQ ID NO: 2329268 - RNA, 17 nt, Yersinia pestis KIM
uaaaagcacagacaaac

SEQ ID NO: 2329269 - RNA, 12 nt, Yersinia pestis KIM
uaaaagauaacg

SEQ ID NO: 2329270 - RNA, 18 nt, Yersinia pestis KIM
guuuuguuuccccuaauu

SEQ ID NO: 2329271 - RNA, 21 nt, Yersinia pestis KIM
guuuugucauaaagcccauac

SEQ ID NO: 2329272 - RNA, 12 nt, Yersinia pestis KIM
guuuuuaaggac

SEQ ID NO: 2329273 - RNA, 18 nt, Yersinia pestis KIM
guuuucuggcaauuucug

SEQ ID NO: 2329274 - RNA, 18 nt, Yersinia pestis KIM
guuuucuccacaccaacg

SEQ ID NO: 2329275 - RNA, 20 nt, Yersinia pestis KIM
guuuucuuguauauaaaaaa

SEQ ID NO: 2329276 - RNA, 16 nt, Yersinia pestis KIM
guuuucguuuaaaaaa

SEQ ID NO: 2329277 - RNA, 17 nt, Yersinia pestis KIM
guuuucauuauuuucac

SEQ ID NO: 2329278 - RNA, 15 nt, Yersinia pestis KIM
guuuuaucaauaggu

SEQ ID NO: 2329279 - RNA, 14 nt, Yersinia pestis KIM
aaauccagaucagc

SEQ ID NO: 2329280 - RNA, 23 nt, Yersinia pestis KIM
aaaucaucgcucaucgccaaagc

SEQ ID NO: 2329281 - RNA, 21 nt, Yersinia pestis KIM
aaaucaugcauugcaugauga

SEQ ID NO: 2329282 - RNA, 17 nt, Yersinia pestis KIM
guuucaaauaaguauuu

SEQ ID NO: 2329283 - RNA, 13 nt, Yersinia pestis KIM
guuugaugguuau

SEQ ID NO: 2329284 - RNA, 15 nt, Yersinia pestis KIM
aaaucagcuucauua

SEQ ID NO: 2329285 - RNA, 13 nt, Yersinia pestis KIM
guuuuaauaacca

SEQ ID NO: 2329286 - RNA, 18 nt, Yersinia pestis KIM
guuuuaccaucaccauau

SEQ ID NO: 2329287 - RNA, 12 nt, Yersinia pestis KIM
guuuuaaauaca

SEQ ID NO: 2329288 - RNA, 16 nt, Yersinia pestis KIM
guuuuugaaauaccac

SEQ ID NO: 2329289 - RNA, 15 nt, Yersinia pestis KIM
guuuuuucaacuggc

SEQ ID NO: 2329290 - RNA, 14 nt, Yersinia pestis KIM
guuuuuucuuucuu

SEQ ID NO: 2329291 - RNA, 12 nt, Yersinia pestis KIM
guuuuuuuaaau

SEQ ID NO: 2329292 - RNA, 21 nt, Yersinia pestis KIM
guuuuuuuacauauaauccaa

SEQ ID NO: 2329293 - RNA, 20 nt, Yersinia pestis KIM
uaaaaaagugcuauccucuu

SEQ ID NO: 2329294 - RNA, 13 nt, Yersinia pestis KIM
uaaaaaaauuaaa

SEQ ID NO: 2329295 - RNA, 18 nt, Yersinia pestis KIM
uaaaaaaauuaaaauaau

SEQ ID NO: 2329296 - RNA, 19 nt, Yersinia pestis KIM
uaaaaaaauuaaaauaaug

SEQ ID NO: 2329297 - RNA, 10 nt, Yersinia pestis KIM
uaaaaaaagc

SEQ ID NO: 2329298 - RNA, 16 nt, Yersinia pestis KIM
uaaaaaaaaauaaaau

SEQ ID NO: 2329299 - RNA, 14 nt, Yersinia pestis KIM
uaaaaaaaaccugg

SEQ ID NO: 2329300 - RNA, 11 nt, Yersinia pestis KIM
uaaaaaaaacc

SEQ ID NO: 2329301 - RNA, 18 nt, Yersinia pestis KIM
uaaaaacccucuucaauc

SEQ ID NO: 2329302 - RNA, 17 nt, Yersinia pestis KIM
uaaaaacucacuguuca

SEQ ID NO: 2329303 - RNA, 21 nt, Yersinia pestis KIM
uaaaaaccaucugaugcaggu

SEQ ID NO: 2329304 - RNA, 15 nt, Yersinia pestis KIM
uaaaaaccauuuuua

SEQ ID NO: 2329305 - RNA, 12 nt, Yersinia pestis KIM
uaaaaacauuga

SEQ ID NO: 2329306 - RNA, 17 nt, Yersinia pestis KIM
uaaaaacauuuaaauau

SEQ ID NO: 2329307 - RNA, 21 nt, Yersinia pestis KIM
uaaaaacauuuaaauaugaau

SEQ ID NO: 2329308 - RNA, 17 nt, Yersinia pestis KIM
uaaaaaaucuauugauu

SEQ ID NO: 2329309 - RNA, 13 nt, Yersinia pestis KIM
uaaaaaauuauua

SEQ ID NO: 2329310 - RNA, 23 nt, Yersinia pestis KIM
uaaaaacuuaucuaaaaaaccag

SEQ ID NO: 2329311 - RNA, 19 nt, Yersinia pestis KIM
uaaaaacuuaucuaaaaaa

SEQ ID NO: 2329312 - RNA, 17 nt, Yersinia pestis KIM
uaaaaagaaaaagacau

SEQ ID NO: 2329313 - RNA, 22 nt, Yersinia pestis KIM
uaaaaagaaaaagacauaaaga

SEQ ID NO: 2329314 - RNA, 21 nt, Yersinia pestis KIM
uaaaaagcgacugauauuagu

SEQ ID NO: 2329315 - RNA, 19 nt, Yersinia pestis KIM
uaaaaagcagcaaacgaac

SEQ ID NO: 2329316 - RNA, 18 nt, Yersinia pestis KIM
uaaaaagcagcaaacgaa

SEQ ID NO: 2329317 - RNA, 20 nt, Yersinia pestis KIM
uaaaaagaucugcauugauu

SEQ ID NO: 2329318 - RNA, 23 nt, Yersinia pestis KIM
uaaaaagaucugcauugauuaaa

SEQ ID NO: 2329319 - RNA, 19 nt, Yersinia pestis KIM
uaaaaauacauaauaauga

SEQ ID NO: 2329320 - RNA, 13 nt, Yersinia pestis KIM
uaaaaagucagcu

SEQ ID NO: 2329321 - RNA, 17 nt, Yersinia pestis KIM
guugggccuugcuucug

SEQ ID NO: 2329322 - RNA, 15 nt, Yersinia pestis KIM
guugggaaaaguggc

SEQ ID NO: 2329323 - RNA, 13 nt, Yersinia pestis KIM
guuggguuagggc

SEQ ID NO: 2329324 - RNA, 18 nt, Yersinia pestis KIM
guuguaccuguuuuuguu

SEQ ID NO: 2329325 - RNA, 14 nt, Yersinia pestis KIM
guugugcauauauu

SEQ ID NO: 2329326 - RNA, 19 nt, Yersinia pestis KIM
guugcccgaauaauuggua

SEQ ID NO: 2329327 - RNA, 19 nt, Yersinia pestis KIM
guugccauggccgccagca

SEQ ID NO: 2329328 - RNA, 23 nt, Yersinia pestis KIM
guugcccccugcuccaaagcuuc

SEQ ID NO: 2329329 - RNA, 13 nt, Yersinia pestis KIM
guugccaaccgga

SEQ ID NO: 2329330 - RNA, 22 nt, Yersinia pestis KIM
guugccaccagcguugacacuc

SEQ ID NO: 2329331 - RNA, 14 nt, Yersinia pestis KIM
guuggauaaccccc

SEQ ID NO: 2329332 - RNA, 22 nt, Yersinia pestis KIM
guuggaucauccgcucagcaaa

SEQ ID NO: 2329333 - RNA, 18 nt, Yersinia pestis KIM
guuggauauacauauuca

SEQ ID NO: 2329334 - RNA, 21 nt, Yersinia pestis KIM
guuggcaauaaauauccuccg

SEQ ID NO: 2329335 - RNA, 13 nt, Yersinia pestis KIM
guuggcaaacauc

SEQ ID NO: 2329336 - RNA, 18 nt, Yersinia pestis KIM
guuuacgacaauccuauc

SEQ ID NO: 2329337 - RNA, 12 nt, Yersinia pestis KIM
guuuaauuucac

SEQ ID NO: 2329338 - RNA, 21 nt, Yersinia pestis KIM
guuuaauuucacuuccauucc

SEQ ID NO: 2329339 - RNA, 14 nt, Yersinia pestis KIM
guuuagcucucaga

SEQ ID NO: 2329340 - RNA, 17 nt, Yersinia pestis KIM
guuuauuuaacacauuc

SEQ ID NO: 2329341 - RNA, 14 nt, Yersinia pestis KIM
guuguugccacaga

SEQ ID NO: 2329342 - RNA, 23 nt, Yersinia pestis KIM
guuguuagccacucaacugaugu

SEQ ID NO: 2329343 - RNA, 18 nt, Yersinia pestis KIM
guugugggguuuuuuaau

SEQ ID NO: 2329344 - RNA, 15 nt, Yersinia pestis KIM
guuguuucugaaggg

SEQ ID NO: 2329345 - RNA, 20 nt, Yersinia pestis KIM
guuguuggguaugauuuuua

SEQ ID NO: 2329346 - RNA, 14 nt, Yersinia pestis KIM
guuuaaaaaauauc

SEQ ID NO: 2329347 - RNA, 20 nt, Yersinia pestis KIM
guuuaaaucuuucuccagua

SEQ ID NO: 2329348 - RNA, 23 nt, Yersinia pestis KIM
guuuaaaucuuucuccaguaaaa

SEQ ID NO: 2329349 - RNA, 16 nt, Yersinia pestis KIM
guuuaauucaggccaa

SEQ ID NO: 2329350 - RNA, 19 nt, Yersinia pestis KIM
guuuaaagccuguaaaaua

SEQ ID NO: 2329351 - RNA, 12 nt, Yersinia pestis KIM
guugaacucaua

SEQ ID NO: 2329352 - RNA, 16 nt, Yersinia pestis KIM
guugcauuuuucuguu

SEQ ID NO: 2329353 - RNA, 18 nt, Yersinia pestis KIM
guugcaaacggauaaugu

SEQ ID NO: 2329354 - RNA, 22 nt, Yersinia pestis KIM
guugcaaacggauaauguugca

SEQ ID NO: 2329355 - RNA, 16 nt, Yersinia pestis KIM
guugaugaguaaacag

SEQ ID NO: 2329356 - RNA, 20 nt, Yersinia pestis KIM
guugaugcucauuuaaaaua

SEQ ID NO: 2329357 - RNA, 20 nt, Yersinia pestis KIM
guugauccgauaaacuucac

SEQ ID NO: 2329358 - RNA, 17 nt, Yersinia pestis KIM
guugauccgauaaacuu

SEQ ID NO: 2329359 - RNA, 19 nt, Yersinia pestis KIM
guugauaguuaccauggca

SEQ ID NO: 2329360 - RNA, 19 nt, Yersinia pestis KIM
guucuucugauaaaacagu

SEQ ID NO: 2329361 - RNA, 20 nt, Yersinia pestis KIM
guucuuccugugcgccacgc

SEQ ID NO: 2329362 - RNA, 23 nt, Yersinia pestis KIM
guucuucacgaagaauugcaugu

SEQ ID NO: 2329363 - RNA, 18 nt, Yersinia pestis KIM
guucugcucaauagccgc

SEQ ID NO: 2329364 - RNA, 14 nt, Yersinia pestis KIM
guucugucacaauc

SEQ ID NO: 2329365 - RNA, 16 nt, Yersinia pestis KIM
guucuguagcugacac

SEQ ID NO: 2329366 - RNA, 23 nt, Yersinia pestis KIM
guucugccaauuuggggcugcuu

SEQ ID NO: 2329367 - RNA, 16 nt, Yersinia pestis KIM
guucugcccguagaga

SEQ ID NO: 2329368 - RNA, 19 nt, Yersinia pestis KIM
guucguagccacgaucgau

SEQ ID NO: 2329369 - RNA, 23 nt, Yersinia pestis KIM
guucgguuaagagugcuggcaag

SEQ ID NO: 2329370 - RNA, 19 nt, Yersinia pestis KIM
guucgaggauaucacucug

SEQ ID NO: 2329371 - RNA, 15 nt, Yersinia pestis KIM
guucgcaaugaaccc

SEQ ID NO: 2329372 - RNA, 23 nt, Yersinia pestis KIM
guucccgauuauugugccgccuu

SEQ ID NO: 2329373 - RNA, 12 nt, Yersinia pestis KIM
guucccaucccu

SEQ ID NO: 2329374 - RNA, 14 nt, Yersinia pestis KIM
guucccaugacgau

SEQ ID NO: 2329375 - RNA, 13 nt, Yersinia pestis KIM
guucccacuucca

SEQ ID NO: 2329376 - RNA, 17 nt, Yersinia pestis KIM
guuccaggcaagaaacu

SEQ ID NO: 2329377 - RNA, 20 nt, Yersinia pestis KIM
guucacuugagagaaacuuu

SEQ ID NO: 2329378 - RNA, 20 nt, Yersinia pestis KIM
guucacugaguugcaggaau

SEQ ID NO: 2329379 - RNA, 17 nt, Yersinia pestis KIM
guucagauaaucccuug

SEQ ID NO: 2329380 - RNA, 19 nt, Yersinia pestis KIM
guucaaucggcagugccau

SEQ ID NO: 2329381 - RNA, 19 nt, Yersinia pestis KIM
guucaauggucaugcacag

SEQ ID NO: 2329382 - RNA, 18 nt, Yersinia pestis KIM
guucacaugaugaaugcg

SEQ ID NO: 2329383 - RNA, 14 nt, Yersinia pestis KIM
guucaagagugagu

SEQ ID NO: 2329384 - RNA, 13 nt, Yersinia pestis KIM
guucaagagugag

SEQ ID NO: 2329385 - RNA, 15 nt, Yersinia pestis KIM
guucaagcagcuuuu

SEQ ID NO: 2329386 - RNA, 14 nt, Yersinia pestis KIM
guucaaaugauuca

SEQ ID NO: 2329387 - RNA, 22 nt, Yersinia pestis KIM
guucaacaccacaacauacaac

SEQ ID NO: 2329388 - RNA, 14 nt, Yersinia pestis KIM
guucaaggaaacca

SEQ ID NO: 2329389 - RNA, 18 nt, Yersinia pestis KIM
guucaaucggcagugcca

SEQ ID NO: 2329390 - RNA, 17 nt, Yersinia pestis KIM
guucaauaucauagcca

SEQ ID NO: 2329391 - RNA, 15 nt, Yersinia pestis KIM
guucauauuggccag

SEQ ID NO: 2329392 - RNA, 16 nt, Yersinia pestis KIM
guucauauuggccagu

SEQ ID NO: 2329393 - RNA, 19 nt, Yersinia pestis KIM
guucaucaauaccgugacu

SEQ ID NO: 2329394 - RNA, 19 nt, Yersinia pestis KIM
guucaucaaucgagaagaa

SEQ ID NO: 2329395 - RNA, 18 nt, Yersinia pestis KIM
guucauaaauuaaaacug

SEQ ID NO: 2329396 - RNA, 15 nt, Yersinia pestis KIM
guucagcaauaugaa

SEQ ID NO: 2329397 - RNA, 16 nt, Yersinia pestis KIM
guucagguuguuaucg

SEQ ID NO: 2329398 - RNA, 19 nt, Yersinia pestis KIM
guucauggccaugaaucaa

SEQ ID NO: 2329399 - RNA, 17 nt, Yersinia pestis KIM
guucauuccccaucgcc

SEQ ID NO: 2329400 - RNA, 22 nt, Yersinia pestis KIM
guucauuuagcagcgcacuggg

SEQ ID NO: 2329401 - RNA, 13 nt, Yersinia pestis KIM
guuaaucgcagca

SEQ ID NO: 2329402 - RNA, 23 nt, Yersinia pestis KIM
guuaaucaguggcugaaggggcu

SEQ ID NO: 2329403 - RNA, 16 nt, Yersinia pestis KIM
guuaaucaagcgccau

SEQ ID NO: 2329404 - RNA, 17 nt, Yersinia pestis KIM
guuaccagaaaaccuuc

SEQ ID NO: 2329405 - RNA, 20 nt, Yersinia pestis KIM
guuacaucaugaguaaaaga

SEQ ID NO: 2329406 - RNA, 17 nt, Yersinia pestis KIM
guuacaguaaggcagca

SEQ ID NO: 2329407 - RNA, 17 nt, Yersinia pestis KIM
guuacagcaaggcagca

SEQ ID NO: 2329408 - RNA, 23 nt, Yersinia pestis KIM
guuacaacgagggcucaaucucu

SEQ ID NO: 2329409 - RNA, 17 nt, Yersinia pestis KIM
guuaaacgguaaccauc

SEQ ID NO: 2329410 - RNA, 17 nt, Yersinia pestis KIM
guguuuuggcuaaacca

SEQ ID NO: 2329411 - RNA, 12 nt, Yersinia pestis KIM
guguugggcagu

SEQ ID NO: 2329412 - RNA, 12 nt, Yersinia pestis KIM
guguuggcaaaa

SEQ ID NO: 2329413 - RNA, 18 nt, Yersinia pestis KIM
guuauaaaucagggcaga

SEQ ID NO: 2329414 - RNA, 15 nt, Yersinia pestis KIM
guuagccuacuggcg

SEQ ID NO: 2329415 - RNA, 17 nt, Yersinia pestis KIM
guuagcauuaaacggug

SEQ ID NO: 2329416 - RNA, 13 nt, Yersinia pestis KIM
guuauaaaaaccc

SEQ ID NO: 2329417 - RNA, 15 nt, Yersinia pestis KIM
guuacgucaaaacua

SEQ ID NO: 2329418 - RNA, 16 nt, Yersinia pestis KIM
guuagcagauaauaaa

SEQ ID NO: 2329419 - RNA, 20 nt, Yersinia pestis KIM
guuaucaucccuugacugac

SEQ ID NO: 2329420 - RNA, 15 nt, Yersinia pestis KIM
guuaucauugcuccu

SEQ ID NO: 2329421 - RNA, 22 nt, Yersinia pestis KIM
guuaucauugcuccuguauauu

SEQ ID NO: 2329422 - RNA, 14 nt, Yersinia pestis KIM
guuaucgcucuuga

SEQ ID NO: 2329423 - RNA, 14 nt, Yersinia pestis KIM
guuauccuaagaau

SEQ ID NO: 2329424 - RNA, 13 nt, Yersinia pestis KIM
guuaucggugcug

SEQ ID NO: 2329425 - RNA, 16 nt, Yersinia pestis KIM
guuaucgugcgucaau

SEQ ID NO: 2329426 - RNA, 13 nt, Yersinia pestis KIM
guucaaaaggugc

SEQ ID NO: 2329427 - RNA, 20 nt, Yersinia pestis KIM
guuauuacugucauugcugu

SEQ ID NO: 2329428 - RNA, 15 nt, Yersinia pestis KIM
gugcggauggcugcu

SEQ ID NO: 2329429 - RNA, 15 nt, Yersinia pestis KIM
gugcggcagugaacg

SEQ ID NO: 2329430 - RNA, 16 nt, Yersinia pestis KIM
gugcgggccagaauaa

SEQ ID NO: 2329431 - RNA, 13 nt, Yersinia pestis KIM
gugcguaaagaaa

SEQ ID NO: 2329432 - RNA, 16 nt, Yersinia pestis KIM
gugcguaaagaaaaaa

SEQ ID NO: 2329433 - RNA, 18 nt, Yersinia pestis KIM
gugcgcccgguaauaaug

SEQ ID NO: 2329434 - RNA, 19 nt, Yersinia pestis KIM
gugcgcccgguaauaauga

SEQ ID NO: 2329435 - RNA, 22 nt, Yersinia pestis KIM
gugcgccacgcagugccgauga

SEQ ID NO: 2329436 - RNA, 14 nt, Yersinia pestis KIM
gugcgcaucaauga

SEQ ID NO: 2329437 - RNA, 21 nt, Yersinia pestis KIM
gugcgcaaaaauuagaggccu

SEQ ID NO: 2329438 - RNA, 19 nt, Yersinia pestis KIM
gugcuuuauccaauggcuc

SEQ ID NO: 2329439 - RNA, 15 nt, Yersinia pestis KIM
gugcuucagacagua

SEQ ID NO: 2329440 - RNA, 18 nt, Yersinia pestis KIM
gugcuuacauuucaucuu

SEQ ID NO: 2329441 - RNA, 14 nt, Yersinia pestis KIM
guggaaucggccuu

SEQ ID NO: 2329442 - RNA, 12 nt, Yersinia pestis KIM
gugcuuugccau

SEQ ID NO: 2329443 - RNA, 19 nt, Yersinia pestis KIM
gugcugcuaauauuuauaa

SEQ ID NO: 2329444 - RNA, 20 nt, Yersinia pestis KIM
gugcuccgcacuuggcccca

SEQ ID NO: 2329445 - RNA, 18 nt, Yersinia pestis KIM
gugcucgucuucgacagc

SEQ ID NO: 2329446 - RNA, 14 nt, Yersinia pestis KIM
gugcucugccuuau

SEQ ID NO: 2329447 - RNA, 23 nt, Yersinia pestis KIM
gugcugaauuggaagagccugaa

SEQ ID NO: 2329448 - RNA, 15 nt, Yersinia pestis KIM
gugcucacgucacca

SEQ ID NO: 2329449 - RNA, 21 nt, Yersinia pestis KIM
gugcucacaaucuucuucagu

SEQ ID NO: 2329450 - RNA, 14 nt, Yersinia pestis KIM
gugcucauuaaaac

SEQ ID NO: 2329451 - RNA, 24 nt, Yersinia pestis KIM
gugcguuuuauucaagugcucacu

SEQ ID NO: 2329452 - RNA, 23 nt, Yersinia pestis KIM
gugcuaaaucccaggcguucugu

SEQ ID NO: 2329453 - RNA, 14 nt, Yersinia pestis KIM
gugcuacagcagca

SEQ ID NO: 2329454 - RNA, 20 nt, Yersinia pestis KIM
guggcugaggccagcggcau

SEQ ID NO: 2329455 - RNA, 23 nt, Yersinia pestis KIM
guggcugaaaucgaucauaaucu

SEQ ID NO: 2329456 - RNA, 13 nt, Yersinia pestis KIM
guggcuuggcaug

SEQ ID NO: 2329457 - RNA, 21 nt, Yersinia pestis KIM
guggcuguaaauaaauaauca

SEQ ID NO: 2329458 - RNA, 16 nt, Yersinia pestis KIM
gugguaauuucuggcu

SEQ ID NO: 2329459 - RNA, 23 nt, Yersinia pestis KIM
guggguucuucaaagugguggca

SEQ ID NO: 2329460 - RNA, 22 nt, Yersinia pestis KIM
gugggccugccaugucacuguu

SEQ ID NO: 2329461 - RNA, 20 nt, Yersinia pestis KIM
gugggccuguuugcagcgaa

SEQ ID NO: 2329462 - RNA, 16 nt, Yersinia pestis KIM
guggccgccgcgguga

SEQ ID NO: 2329463 - RNA, 14 nt, Yersinia pestis KIM
gugguccccagagc

SEQ ID NO: 2329464 - RNA, 15 nt, Yersinia pestis KIM
gugguaccuacuuua

SEQ ID NO: 2329465 - RNA, 16 nt, Yersinia pestis KIM
gugguauggauauuuu

SEQ ID NO: 2329466 - RNA, 22 nt, Yersinia pestis KIM
gugguauucacguuuuucauca

SEQ ID NO: 2329467 - RNA, 17 nt, Yersinia pestis KIM
guguaugggcugcuaca

SEQ ID NO: 2329468 - RNA, 22 nt, Yersinia pestis KIM
gugucaaaccaauuucucggcc

SEQ ID NO: 2329469 - RNA, 15 nt, Yersinia pestis KIM
guguauuuaaaagau

SEQ ID NO: 2329470 - RNA, 19 nt, Yersinia pestis KIM
guguccgcgccauaaaaga

SEQ ID NO: 2329471 - RNA, 10 nt, Yersinia pestis KIM
gugguuuggu

SEQ ID NO: 2329472 - RNA, 20 nt, Yersinia pestis KIM
gugccgaagugcauauuauc

SEQ ID NO: 2329473 - RNA, 21 nt, Yersinia pestis KIM
gugcccuuuuugguuuucuau

SEQ ID NO: 2329474 - RNA, 12 nt, Yersinia pestis KIM
gugccccaagaa

SEQ ID NO: 2329475 - RNA, 14 nt, Yersinia pestis KIM
gugcccagaaaacc

SEQ ID NO: 2329476 - RNA, 17 nt, Yersinia pestis KIM
gugcccagaaaaccccc

SEQ ID NO: 2329477 - RNA, 13 nt, Yersinia pestis KIM
gugccaaaaaaag

SEQ ID NO: 2329478 - RNA, 16 nt, Yersinia pestis KIM
gugccaaauagugauu

SEQ ID NO: 2329479 - RNA, 23 nt, Yersinia pestis KIM
gugccaaauggaauaaaaaguca

SEQ ID NO: 2329480 - RNA, 15 nt, Yersinia pestis KIM
gugccaauccccacc

SEQ ID NO: 2329481 - RNA, 19 nt, Yersinia pestis KIM
gugccaacucagcggccug

SEQ ID NO: 2329482 - RNA, 15 nt, Yersinia pestis KIM
gugccaaugccucuu

SEQ ID NO: 2329483 - RNA, 14 nt, Yersinia pestis KIM
gugccacaacaagc

SEQ ID NO: 2329484 - RNA, 21 nt, Yersinia pestis KIM
gugccacaacaagccucgcug

SEQ ID NO: 2329485 - RNA, 15 nt, Yersinia pestis KIM
gugccagauccucuu

SEQ ID NO: 2329486 - RNA, 17 nt, Yersinia pestis KIM
gugccauaaauaccaau

SEQ ID NO: 2329487 - RNA, 12 nt, Yersinia pestis KIM
gugcccaaaaac

SEQ ID NO: 2329488 - RNA, 13 nt, Yersinia pestis KIM
gugccgcggcggc

SEQ ID NO: 2329489 - RNA, 22 nt, Yersinia pestis KIM
gugccguagguaauuaaacgcu

SEQ ID NO: 2329490 - RNA, 20 nt, Yersinia pestis KIM
gugcgaagcgcacccaaaau

SEQ ID NO: 2329491 - RNA, 11 nt, Yersinia pestis KIM
gugccugcugg

SEQ ID NO: 2329492 - RNA, 20 nt, Yersinia pestis KIM
gugccugcacuuaacgcuuu

SEQ ID NO: 2329493 - RNA, 18 nt, Yersinia pestis KIM
gugccugaauggaaaaau

SEQ ID NO: 2329494 - RNA, 20 nt, Yersinia pestis KIM
gugccucaaauugcuaacaa

SEQ ID NO: 2329495 - RNA, 14 nt, Yersinia pestis KIM
gugccguucuccag

SEQ ID NO: 2329496 - RNA, 22 nt, Yersinia pestis KIM
gucucacuaaaucaaaaggaac

SEQ ID NO: 2329497 - RNA, 17 nt, Yersinia pestis KIM
gugauauaaauccaagg

SEQ ID NO: 2329498 - RNA, 21 nt, Yersinia pestis KIM
gugauauaacgaauauucaag

SEQ ID NO: 2329499 - RNA, 14 nt, Yersinia pestis KIM
gugauauaaaucca

SEQ ID NO: 2329500 - RNA, 21 nt, Yersinia pestis KIM
gugauaucagccagcuccugc

SEQ ID NO: 2329501 - RNA, 13 nt, Yersinia pestis KIM
gugauagcgggcc

SEQ ID NO: 2329502 - RNA, 14 nt, Yersinia pestis KIM
gugaucaccugagc

SEQ ID NO: 2329503 - RNA, 17 nt, Yersinia pestis KIM
gugauauugggccggag

SEQ ID NO: 2329504 - RNA, 14 nt, Yersinia pestis KIM
gucuauaaaaccgu

SEQ ID NO: 2329505 - RNA, 22 nt, Yersinia pestis KIM
gucuauugaaaaaauaaugucc

SEQ ID NO: 2329506 - RNA, 16 nt, Yersinia pestis KIM
gucuauuauauucaau

SEQ ID NO: 2329507 - RNA, 17 nt, Yersinia pestis KIM
gucuauugaaaaaauaa

SEQ ID NO: 2329508 - RNA, 14 nt, Yersinia pestis KIM
gugauggcggcugg

SEQ ID NO: 2329509 - RNA, 20 nt, Yersinia pestis KIM
gugauguggcuugcaaucag

SEQ ID NO: 2329510 - RNA, 16 nt, Yersinia pestis KIM
gugauuuuaaccacuc

SEQ ID NO: 2329511 - RNA, 12 nt, Yersinia pestis KIM
gugauuuuuaua

SEQ ID NO: 2329512 - RNA, 23 nt, Yersinia pestis KIM
gugauuuuuuucacccauguauc

SEQ ID NO: 2329513 - RNA, 20 nt, Yersinia pestis KIM
gugaugaaacuaaaauaauc

SEQ ID NO: 2329514 - RNA, 15 nt, Yersinia pestis KIM
gugaugaaauuaaaa

SEQ ID NO: 2329515 - RNA, 16 nt, Yersinia pestis KIM
gugaugaaauuaaaau

SEQ ID NO: 2329516 - RNA, 20 nt, Yersinia pestis KIM
gugaugcagagaugcagaga

SEQ ID NO: 2329517 - RNA, 18 nt, Yersinia pestis KIM
gugcaucuuccaauucau

SEQ ID NO: 2329518 - RNA, 19 nt, Yersinia pestis KIM
gugcagcgcgcagccaacg

SEQ ID NO: 2329519 - RNA, 17 nt, Yersinia pestis KIM
gugcaacauuaaaaaua

SEQ ID NO: 2329520 - RNA, 20 nt, Yersinia pestis KIM
gugcaacaucaggccuucuu

SEQ ID NO: 2329521 - RNA, 16 nt, Yersinia pestis KIM
gugcaaacuuaaaaau

SEQ ID NO: 2329522 - RNA, 13 nt, Yersinia pestis KIM
gugcaccacacag

SEQ ID NO: 2329523 - RNA, 22 nt, Yersinia pestis KIM
gugcaccacacagcguagacaa

SEQ ID NO: 2329524 - RNA, 18 nt, Yersinia pestis KIM
gucccaagaaaagcaccg

SEQ ID NO: 2329525 - RNA, 15 nt, Yersinia pestis KIM
guccagcaucgcuga

SEQ ID NO: 2329526 - RNA, 21 nt, Yersinia pestis KIM
guccaggcuuucacggugcgu

SEQ ID NO: 2329527 - RNA, 18 nt, Yersinia pestis KIM
gucccuaaagccaucgcc

SEQ ID NO: 2329528 - RNA, 16 nt, Yersinia pestis KIM
gucccucuugaauaau

SEQ ID NO: 2329529 - RNA, 13 nt, Yersinia pestis KIM
gucauuauuaaac

SEQ ID NO: 2329530 - RNA, 14 nt, Yersinia pestis KIM
gucauauauuuuuc

SEQ ID NO: 2329531 - RNA, 18 nt, Yersinia pestis KIM
gucaugaugaauacgaua

SEQ ID NO: 2329532 - RNA, 20 nt, Yersinia pestis KIM
gucaugauagacagcaaacg

SEQ ID NO: 2329533 - RNA, 15 nt, Yersinia pestis KIM
gucauaauugccaaa

SEQ ID NO: 2329534 - RNA, 13 nt, Yersinia pestis KIM
gucaguuucagua

SEQ ID NO: 2329535 - RNA, 23 nt, Yersinia pestis KIM
gucaguugaauauuccauuuguc

SEQ ID NO: 2329536 - RNA, 20 nt, Yersinia pestis KIM
gucauaccggcggcacacug

SEQ ID NO: 2329537 - RNA, 22 nt, Yersinia pestis KIM
guccagaacaauaccgccaaua

SEQ ID NO: 2329538 - RNA, 12 nt, Yersinia pestis KIM
guccagaugcca

SEQ ID NO: 2329539 - RNA, 20 nt, Yersinia pestis KIM
gucauucuugguggagccug

SEQ ID NO: 2329540 - RNA, 17 nt, Yersinia pestis KIM
gucauugguguuacagc

SEQ ID NO: 2329541 - RNA, 17 nt, Yersinia pestis KIM
gucauuggcguuacagc

SEQ ID NO: 2329542 - RNA, 21 nt, Yersinia pestis KIM
gucaugcuguagcagccugua

SEQ ID NO: 2329543 - RNA, 19 nt, Yersinia pestis KIM
gucauuugcucgauuucac

SEQ ID NO: 2329544 - RNA, 14 nt, Yersinia pestis KIM
gucaguaaugaauu

SEQ ID NO: 2329545 - RNA, 17 nt, Yersinia pestis KIM
gucaguaacuggauauu

SEQ ID NO: 2329546 - RNA, 22 nt, Yersinia pestis KIM
gucaguaacuggauauuuuuaa

SEQ ID NO: 2329547 - RNA, 12 nt, Yersinia pestis KIM
gucaggaagaga

SEQ ID NO: 2329548 - RNA, 23 nt, Yersinia pestis KIM
gucagugauucgggugagugagc

SEQ ID NO: 2329549 - RNA, 18 nt, Yersinia pestis KIM
gucagugcggccaccuau

SEQ ID NO: 2329550 - RNA, 13 nt, Yersinia pestis KIM
gucaguaucaccc

SEQ ID NO: 2329551 - RNA, 22 nt, Yersinia pestis KIM
gucaguaucagcgauuuuaaaa

SEQ ID NO: 2329552 - RNA, 14 nt, Yersinia pestis KIM
gucagucaaaagaa

SEQ ID NO: 2329553 - RNA, 14 nt, Yersinia pestis KIM
gucaguccaaaaua

SEQ ID NO: 2329554 - RNA, 15 nt, Yersinia pestis KIM
gucagugguuuuaua

SEQ ID NO: 2329555 - RNA, 19 nt, Yersinia pestis KIM
gucagugguuuuaucaaua

SEQ ID NO: 2329556 - RNA, 12 nt, Yersinia pestis KIM
gucagugguggu

SEQ ID NO: 2329557 - RNA, 23 nt, Yersinia pestis KIM
gucaguguuucggcauugagcac

SEQ ID NO: 2329558 - RNA, 22 nt, Yersinia pestis KIM
gucagacacgguauucaggaug

SEQ ID NO: 2329559 - RNA, 13 nt, Yersinia pestis KIM
gucagaaccuguu

SEQ ID NO: 2329560 - RNA, 16 nt, Yersinia pestis KIM
gucagaaccuguuaca

SEQ ID NO: 2329561 - RNA, 17 nt, Yersinia pestis KIM
gucacuuugggcugauc

SEQ ID NO: 2329562 - RNA, 17 nt, Yersinia pestis KIM
gucagcaaaucaaacaa

SEQ ID NO: 2329563 - RNA, 22 nt, Yersinia pestis KIM
gucagcacaaacagcuuuuuaa

SEQ ID NO: 2329564 - RNA, 20 nt, Yersinia pestis KIM
gucagauuaguuuuagacgu

SEQ ID NO: 2329565 - RNA, 20 nt, Yersinia pestis KIM
gucagcuggaacaagagauc

SEQ ID NO: 2329566 - RNA, 12 nt, Yersinia pestis KIM
gucagcgguauc

SEQ ID NO: 2329567 - RNA, 20 nt, Yersinia pestis KIM
gucaccuugaacugagccag

SEQ ID NO: 2329568 - RNA, 22 nt, Yersinia pestis KIM
gucacuggcaccauuugcccug

SEQ ID NO: 2329569 - RNA, 17 nt, Yersinia pestis KIM
gucacuuaaauaacuca

SEQ ID NO: 2329570 - RNA, 15 nt, Yersinia pestis KIM
gucaccaaauauuac

SEQ ID NO: 2329571 - RNA, 19 nt, Yersinia pestis KIM
gucaccaacggccccucag

SEQ ID NO: 2329572 - RNA, 13 nt, Yersinia pestis KIM
gucacauuuuuaa

SEQ ID NO: 2329573 - RNA, 16 nt, Yersinia pestis KIM
gucaccaucaauauaa

SEQ ID NO: 2329574 - RNA, 22 nt, Yersinia pestis KIM
gucaccaucaauauaagagaaa

SEQ ID NO: 2329575 - RNA, 13 nt, Yersinia pestis KIM
gucacccacuaau

SEQ ID NO: 2329576 - RNA, 12 nt, Yersinia pestis KIM
gucaccaucuug

SEQ ID NO: 2329577 - RNA, 18 nt, Yersinia pestis KIM
gucaagguacccauuauu

SEQ ID NO: 2329578 - RNA, 14 nt, Yersinia pestis KIM
gucaacgauuguua

SEQ ID NO: 2329579 - RNA, 18 nt, Yersinia pestis KIM
gucaauaaccucagaggc

SEQ ID NO: 2329580 - RNA, 21 nt, Yersinia pestis KIM
gucaauaaccucagaggcgcu

SEQ ID NO: 2329581 - RNA, 17 nt, Yersinia pestis KIM
gucaauaaccucagccu

SEQ ID NO: 2329582 - RNA, 23 nt, Yersinia pestis KIM
gucaauaaaaugggccugagugg

SEQ ID NO: 2329583 - RNA, 23 nt, Yersinia pestis KIM
gucaaguucuaagggaaauaccc

SEQ ID NO: 2329584 - RNA, 21 nt, Yersinia pestis KIM
gucaauaaccucaggcccgcu

SEQ ID NO: 2329585 - RNA, 19 nt, Yersinia pestis KIM
gucaauaaccucagccuca

SEQ ID NO: 2329586 - RNA, 13 nt, Yersinia pestis KIM
gucaauaauaaaa

SEQ ID NO: 2329587 - RNA, 17 nt, Yersinia pestis KIM
gucacacguuaaacccu

SEQ ID NO: 2329588 - RNA, 22 nt, Yersinia pestis KIM
gucaauuuuugccuuucugggc

SEQ ID NO: 2329589 - RNA, 23 nt, Yersinia pestis KIM
gucaauuuuugccuuucugggcu

SEQ ID NO: 2329590 - RNA, 15 nt, Yersinia pestis KIM
gucaauauaacguuu

SEQ ID NO: 2329591 - RNA, 15 nt, Yersinia pestis KIM
gucgcuccucagccu

SEQ ID NO: 2329592 - RNA, 22 nt, Yersinia pestis KIM
gucgguaaccugaaagucagga

SEQ ID NO: 2329593 - RNA, 17 nt, Yersinia pestis KIM
gucguauagaaaauuuc

SEQ ID NO: 2329594 - RNA, 14 nt, Yersinia pestis KIM
gucguaccggccca

SEQ ID NO: 2329595 - RNA, 21 nt, Yersinia pestis KIM
gucuaaauugcuuaaaaaaag

SEQ ID NO: 2329596 - RNA, 20 nt, Yersinia pestis KIM
gucgaaggguaucagcgacc

SEQ ID NO: 2329597 - RNA, 16 nt, Yersinia pestis KIM
guccgucuuguauuua

SEQ ID NO: 2329598 - RNA, 15 nt, Yersinia pestis KIM
guauuuucaaucgcu

SEQ ID NO: 2329599 - RNA, 22 nt, Yersinia pestis KIM
guauuugcuucgcugggcugcc

SEQ ID NO: 2329600 - RNA, 20 nt, Yersinia pestis KIM
guauuuguagugaaugacag

SEQ ID NO: 2329601 - RNA, 13 nt, Yersinia pestis KIM
guauuuguauuua

SEQ ID NO: 2329602 - RNA, 18 nt, Yersinia pestis KIM
guauuuuaagaaaacugu

SEQ ID NO: 2329603 - RNA, 17 nt, Yersinia pestis KIM
guauuucaaauaagugu

SEQ ID NO: 2329604 - RNA, 17 nt, Yersinia pestis KIM
guauuuauucaaaaaau

SEQ ID NO: 2329605 - RNA, 12 nt, Yersinia pestis KIM
guauugcucagg

SEQ ID NO: 2329606 - RNA, 19 nt, Yersinia pestis KIM
guauugguaacgcagaaau

SEQ ID NO: 2329607 - RNA, 20 nt, Yersinia pestis KIM
guauuguugccaaaaaugua

SEQ ID NO: 2329608 - RNA, 21 nt, Yersinia pestis KIM
gucaacagaacuaauaucaac

SEQ ID NO: 2329609 - RNA, 23 nt, Yersinia pestis KIM
guauuuugcacaaagcuuacugu

SEQ ID NO: 2329610 - RNA, 18 nt, Yersinia pestis KIM
guauuuuuguauuuaaau

SEQ ID NO: 2329611 - RNA, 19 nt, Yersinia pestis KIM
gucaaaaacccauuaaaaa

SEQ ID NO: 2329612 - RNA, 23 nt, Yersinia pestis KIM
gucaaaaacccauuaaaaacaaa

SEQ ID NO: 2329613 - RNA, 23 nt, Yersinia pestis KIM
gucaaaagaaacugccagcuaaa

SEQ ID NO: 2329614 - RNA, 13 nt, Yersinia pestis KIM
guauugaugcaug

SEQ ID NO: 2329615 - RNA, 20 nt, Yersinia pestis KIM
guauugagcgcgguaacuaa

SEQ ID NO: 2329616 - RNA, 22 nt, Yersinia pestis KIM
guauugacacaauagaugcagu

SEQ ID NO: 2329617 - RNA, 17 nt, Yersinia pestis KIM
guauugauaaaaauauc

SEQ ID NO: 2329618 - RNA, 18 nt, Yersinia pestis KIM
guauucuuaucaaucaaa

SEQ ID NO: 2329619 - RNA, 16 nt, Yersinia pestis KIM
guauucaguaaaaacu

SEQ ID NO: 2329620 - RNA, 17 nt, Yersinia pestis KIM
guauucagccgccagcc

SEQ ID NO: 2329621 - RNA, 13 nt, Yersinia pestis KIM
guauucagguaau

SEQ ID NO: 2329622 - RNA, 13 nt, Yersinia pestis KIM
guauuaucaucac

SEQ ID NO: 2329623 - RNA, 17 nt, Yersinia pestis KIM
guauucauaucgcuaaa

SEQ ID NO: 2329624 - RNA, 19 nt, Yersinia pestis KIM
guauucauaucgcuaaaac

SEQ ID NO: 2329625 - RNA, 20 nt, Yersinia pestis KIM
guauuccgagcaaucaaaag

SEQ ID NO: 2329626 - RNA, 22 nt, Yersinia pestis KIM
guauggcuugcucaauaccauu

SEQ ID NO: 2329627 - RNA, 12 nt, Yersinia pestis KIM
guaugggggaug

SEQ ID NO: 2329628 - RNA, 13 nt, Yersinia pestis KIM
guaugggggaugg

SEQ ID NO: 2329629 - RNA, 17 nt, Yersinia pestis KIM
guauuacaggccccuuc

SEQ ID NO: 2329630 - RNA, 11 nt, Yersinia pestis KIM
guauuacccac

SEQ ID NO: 2329631 - RNA, 16 nt, Yersinia pestis KIM
guauuaccucaucauu

SEQ ID NO: 2329632 - RNA, 21 nt, Yersinia pestis KIM
guaugcgcaccgaaauagucg

SEQ ID NO: 2329633 - RNA, 19 nt, Yersinia pestis KIM
guaugauauugaugacgcu

SEQ ID NO: 2329634 - RNA, 20 nt, Yersinia pestis KIM
guaucauuuuccugcauauu

SEQ ID NO: 2329635 - RNA, 22 nt, Yersinia pestis KIM
guaucccuggcucaucaaagga

SEQ ID NO: 2329636 - RNA, 21 nt, Yersinia pestis KIM
guauccgcgccagacuggccg

SEQ ID NO: 2329637 - RNA, 14 nt, Yersinia pestis KIM
guaucauggaagac

SEQ ID NO: 2329638 - RNA, 22 nt, Yersinia pestis KIM
guaucagccccuaaauccugca

SEQ ID NO: 2329639 - RNA, 23 nt, Yersinia pestis KIM
guaucagccccuaaauccugcaa

SEQ ID NO: 2329640 - RNA, 17 nt, Yersinia pestis KIM
guaucagcgauuuuaaa

SEQ ID NO: 2329641 - RNA, 23 nt, Yersinia pestis KIM
guaucagcgauuuuaaaaaauca

SEQ ID NO: 2329642 - RNA, 21 nt, Yersinia pestis KIM
guaucuguuuuuuaucccuac

SEQ ID NO: 2329643 - RNA, 15 nt, Yersinia pestis KIM
guaucuuuccagcca

SEQ ID NO: 2329644 - RNA, 22 nt, Yersinia pestis KIM
guaucgaauugaucugauauua

SEQ ID NO: 2329645 - RNA, 22 nt, Yersinia pestis KIM
guaucgcccuggcuaauuuuau

SEQ ID NO: 2329646 - RNA, 22 nt, Yersinia pestis KIM
guaguucagucgcgauaaaauu

SEQ ID NO: 2329647 - RNA, 19 nt, Yersinia pestis KIM
guauacaauugccugauuu

SEQ ID NO: 2329648 - RNA, 17 nt, Yersinia pestis KIM
guauaacucaucaguaa

SEQ ID NO: 2329649 - RNA, 21 nt, Yersinia pestis KIM
guauauugguacgguuagccu

SEQ ID NO: 2329650 - RNA, 14 nt, Yersinia pestis KIM
guauaccccugcuc

SEQ ID NO: 2329651 - RNA, 20 nt, Yersinia pestis KIM
guauaccccugcucacgcaa

SEQ ID NO: 2329652 - RNA, 16 nt, Yersinia pestis KIM
guauacggucaaaagc

SEQ ID NO: 2329653 - RNA, 17 nt, Yersinia pestis KIM
guauacggucaaaagcu

SEQ ID NO: 2329654 - RNA, 16 nt, Yersinia pestis KIM
guauacgugucacauu

SEQ ID NO: 2329655 - RNA, 23 nt, Yersinia pestis KIM
guauacuaaaacagcucacucgg

SEQ ID NO: 2329656 - RNA, 18 nt, Yersinia pestis KIM
guauacuaugggauaaac

SEQ ID NO: 2329657 - RNA, 18 nt, Yersinia pestis KIM
guauacuggcuagccugc

SEQ ID NO: 2329658 - RNA, 14 nt, Yersinia pestis KIM
guagcccuuugcuu

SEQ ID NO: 2329659 - RNA, 16 nt, Yersinia pestis KIM
guagccugcacggcuc

SEQ ID NO: 2329660 - RNA, 12 nt, Yersinia pestis KIM
guaggcaacuaa

SEQ ID NO: 2329661 - RNA, 22 nt, Yersinia pestis KIM
guagcucgccuucauuaucaug

SEQ ID NO: 2329662 - RNA, 20 nt, Yersinia pestis KIM
guagcucggccccuaacuga

SEQ ID NO: 2329663 - RNA, 14 nt, Yersinia pestis KIM
guagcucagcuggu

SEQ ID NO: 2329664 - RNA, 12 nt, Yersinia pestis KIM
guagcuaauaaa

SEQ ID NO: 2329665 - RNA, 13 nt, Yersinia pestis KIM
guagcuaacaccg

SEQ ID NO: 2329666 - RNA, 21 nt, Yersinia pestis KIM
guaggcuaaagacuucagccc

SEQ ID NO: 2329667 - RNA, 19 nt, Yersinia pestis KIM
guaggcaucucugaagccu

SEQ ID NO: 2329668 - RNA, 11 nt, Yersinia pestis KIM
guaggggaggu

SEQ ID NO: 2329669 - RNA, 15 nt, Yersinia pestis KIM
guagguaacuaagcu

SEQ ID NO: 2329670 - RNA, 17 nt, Yersinia pestis KIM
guaguuacagcaaauac

SEQ ID NO: 2329671 - RNA, 22 nt, Yersinia pestis KIM
guagugacguaaaaaggcagug

SEQ ID NO: 2329672 - RNA, 21 nt, Yersinia pestis KIM
guagugccgccagugcuuccg

SEQ ID NO: 2329673 - RNA, 23 nt, Yersinia pestis KIM
guagucauacaaaaugagccugu

SEQ ID NO: 2329674 - RNA, 21 nt, Yersinia pestis KIM
guagucauacaaaaugagccu

SEQ ID NO: 2329675 - RNA, 20 nt, Yersinia pestis KIM
guaguauuaacgaaauacuc

SEQ ID NO: 2329676 - RNA, 16 nt, Yersinia pestis KIM
guaguauuuguaguga

SEQ ID NO: 2329677 - RNA, 15 nt, Yersinia pestis KIM
guacuuugucaauag

SEQ ID NO: 2329678 - RNA, 16 nt, Yersinia pestis KIM
guacuuggucacugua

SEQ ID NO: 2329679 - RNA, 13 nt, Yersinia pestis KIM
guacuucucuggc

SEQ ID NO: 2329680 - RNA, 13 nt, Yersinia pestis KIM
guacuuagcaaua

SEQ ID NO: 2329681 - RNA, 18 nt, Yersinia pestis KIM
guacuucagguaauaacg

SEQ ID NO: 2329682 - RNA, 18 nt, Yersinia pestis KIM
guagaaaaucguuguauu

SEQ ID NO: 2329683 - RNA, 16 nt, Yersinia pestis KIM
guacuguuaacucaug

SEQ ID NO: 2329684 - RNA, 23 nt, Yersinia pestis KIM
guacugauuauuuggugaguaaa

SEQ ID NO: 2329685 - RNA, 14 nt, Yersinia pestis KIM
guacugcauguacg

SEQ ID NO: 2329686 - RNA, 17 nt, Yersinia pestis KIM
guacuagaucacagacg

SEQ ID NO: 2329687 - RNA, 17 nt, Yersinia pestis KIM
guacuaacgucaacaga

SEQ ID NO: 2329688 - RNA, 20 nt, Yersinia pestis KIM
guagccacaauaauuaggaa

SEQ ID NO: 2329689 - RNA, 20 nt, Yersinia pestis KIM
guagccaacacaugcugcuu

SEQ ID NO: 2329690 - RNA, 21 nt, Yersinia pestis KIM
guagcauggcuuuaugaccaa

SEQ ID NO: 2329691 - RNA, 12 nt, Yersinia pestis KIM
guagcaaauaac

SEQ ID NO: 2329692 - RNA, 18 nt, Yersinia pestis KIM
guagauggccaucucaau

SEQ ID NO: 2329693 - RNA, 16 nt, Yersinia pestis KIM
guagacgucauaaaaa

SEQ ID NO: 2329694 - RNA, 19 nt, Yersinia pestis KIM
guagacuuuguacuucgaa

SEQ ID NO: 2329695 - RNA, 17 nt, Yersinia pestis KIM
guagauaauuucuacgc

SEQ ID NO: 2329696 - RNA, 20 nt, Yersinia pestis KIM
guagaucaaacauaaccugc

SEQ ID NO: 2329697 - RNA, 12 nt, Yersinia pestis KIM
guaaauccuucu

SEQ ID NO: 2329698 - RNA, 20 nt, Yersinia pestis KIM
guaaauaguuacuauauaaa

SEQ ID NO: 2329699 - RNA, 19 nt, Yersinia pestis KIM
guaaaugccccauuuuggc

SEQ ID NO: 2329700 - RNA, 23 nt, Yersinia pestis KIM
guaaauguacagucauuuacuga

SEQ ID NO: 2329701 - RNA, 18 nt, Yersinia pestis KIM
guaaaugcuguaagaauu

SEQ ID NO: 2329702 - RNA, 15 nt, Yersinia pestis KIM
guaacaacugaacca

SEQ ID NO: 2329703 - RNA, 13 nt, Yersinia pestis KIM
guaacagagcaga

SEQ ID NO: 2329704 - RNA, 22 nt, Yersinia pestis KIM
guaacacuucagacugaaagua

SEQ ID NO: 2329705 - RNA, 13 nt, Yersinia pestis KIM
guaacacacagca

SEQ ID NO: 2329706 - RNA, 15 nt, Yersinia pestis KIM
guaaauuggcacggg

SEQ ID NO: 2329707 - RNA, 16 nt, Yersinia pestis KIM
guaacaacggcuggcc

SEQ ID NO: 2329708 - RNA, 13 nt, Yersinia pestis KIM
guaacaacucacc

SEQ ID NO: 2329709 - RNA, 23 nt, Yersinia pestis KIM
guaacauauaaaccagccaguga

SEQ ID NO: 2329710 - RNA, 18 nt, Yersinia pestis KIM
guaacaguucagcgccag

SEQ ID NO: 2329711 - RNA, 15 nt, Yersinia pestis KIM
guaaaaggcccgcua

SEQ ID NO: 2329712 - RNA, 18 nt, Yersinia pestis KIM
guaaaagucagcaaauca

SEQ ID NO: 2329713 - RNA, 19 nt, Yersinia pestis KIM
guaaaauuauugccgcaga

SEQ ID NO: 2329714 - RNA, 23 nt, Yersinia pestis KIM
guaaaccgcaccacaaaggcaaa

SEQ ID NO: 2329715 - RNA, 16 nt, Yersinia pestis KIM
guaaacacaaaauaga

SEQ ID NO: 2329716 - RNA, 16 nt, Yersinia pestis KIM
guaaacagacacagca

SEQ ID NO: 2329717 - RNA, 23 nt, Yersinia pestis KIM
guaaacguggcccuuucgcagcc

SEQ ID NO: 2329718 - RNA, 16 nt, Yersinia pestis KIM
guaaaccguacauuaa

SEQ ID NO: 2329719 - RNA, 19 nt, Yersinia pestis KIM
guaaagacgcuaauuaaag

SEQ ID NO: 2329720 - RNA, 20 nt, Yersinia pestis KIM
guaaagacgccguaaauaca

SEQ ID NO: 2329721 - RNA, 22 nt, Yersinia pestis KIM
guaaagacgccggcuucccugu

SEQ ID NO: 2329722 - RNA, 18 nt, Yersinia pestis KIM
guaaagaaauacccccca

SEQ ID NO: 2329723 - RNA, 12 nt, Yersinia pestis KIM
guaaagaaaaaa

SEQ ID NO: 2329724 - RNA, 15 nt, Yersinia pestis KIM
guaaagcccagcagg

SEQ ID NO: 2329725 - RNA, 16 nt, Yersinia pestis KIM
guaaagcacccacacc

SEQ ID NO: 2329726 - RNA, 17 nt, Yersinia pestis KIM
guaaagguauagcgaua

SEQ ID NO: 2329727 - RNA, 17 nt, Yersinia pestis KIM
guaaggccaauuggcuu

SEQ ID NO: 2329728 - RNA, 11 nt, Yersinia pestis KIM
guaagccaacg

SEQ ID NO: 2329729 - RNA, 14 nt, Yersinia pestis KIM
guaagcugauaguu

SEQ ID NO: 2329730 - RNA, 20 nt, Yersinia pestis KIM
guaaguaccaccgcagugcc

SEQ ID NO: 2329731 - RNA, 16 nt, Yersinia pestis KIM
guaaguucgucaguga

SEQ ID NO: 2329732 - RNA, 17 nt, Yersinia pestis KIM
guaaguuaaaaagaaaa

SEQ ID NO: 2329733 - RNA, 13 nt, Yersinia pestis KIM
guaauauuauuca

SEQ ID NO: 2329734 - RNA, 18 nt, Yersinia pestis KIM
guaauacuggcaguaaaa

SEQ ID NO: 2329735 - RNA, 22 nt, Yersinia pestis KIM
guaauacuauggcuaaugggua

SEQ ID NO: 2329736 - RNA, 12 nt, Yersinia pestis KIM
guaauaaaucau

SEQ ID NO: 2329737 - RNA, 15 nt, Yersinia pestis KIM
guaauaacgggcggc

SEQ ID NO: 2329738 - RNA, 20 nt, Yersinia pestis KIM
guaauaacucagccauugcu

SEQ ID NO: 2329739 - RNA, 17 nt, Yersinia pestis KIM
guaauaaacagacaaaa

SEQ ID NO: 2329740 - RNA, 22 nt, Yersinia pestis KIM
guaauacccucgacaccaaaac

SEQ ID NO: 2329741 - RNA, 18 nt, Yersinia pestis KIM
guaauaccacaccuuauc

SEQ ID NO: 2329742 - RNA, 15 nt, Yersinia pestis KIM
guaauaaggucacug

SEQ ID NO: 2329743 - RNA, 14 nt, Yersinia pestis KIM
guaacccgcuggcg

SEQ ID NO: 2329744 - RNA, 20 nt, Yersinia pestis KIM
guaaccccgcguucacuuuc

SEQ ID NO: 2329745 - RNA, 16 nt, Yersinia pestis KIM
guaacgcagauaaauc

SEQ ID NO: 2329746 - RNA, 17 nt, Yersinia pestis KIM
guaaccugaaagucagg

SEQ ID NO: 2329747 - RNA, 13 nt, Yersinia pestis KIM
guaacgaacgcuc

SEQ ID NO: 2329748 - RNA, 21 nt, Yersinia pestis KIM
guaacgaacgcucuuuaacaa

SEQ ID NO: 2329749 - RNA, 22 nt, Yersinia pestis KIM
guaacgaaucugcacuguaauu

SEQ ID NO: 2329750 - RNA, 22 nt, Yersinia pestis KIM
guaacucaggauccucgucgua

SEQ ID NO: 2329751 - RNA, 17 nt, Yersinia pestis KIM
guaacguuuagcgauga

SEQ ID NO: 2329752 - RNA, 22 nt, Yersinia pestis KIM
guaacgcagauaaaucaguggg

SEQ ID NO: 2329753 - RNA, 17 nt, Yersinia pestis KIM
guaacggaaggggaaua

SEQ ID NO: 2329754 - RNA, 20 nt, Yersinia pestis KIM
guaacugaguuggaaaugac

SEQ ID NO: 2329755 - RNA, 24 nt, Yersinia pestis KIM
guaacuccaguaagccugaugccu

SEQ ID NO: 2329756 - RNA, 18 nt, Yersinia pestis KIM
guaacuguguuugauuaa

SEQ ID NO: 2329757 - RNA, 16 nt, Yersinia pestis KIM
guaacuguaaggccaa

SEQ ID NO: 2329758 - RNA, 21 nt, Yersinia pestis KIM
guaagaauaaauaauaucaau

SEQ ID NO: 2329759 - RNA, 14 nt, Yersinia pestis KIM
guaagcaugccauc

SEQ ID NO: 2329760 - RNA, 15 nt, Yersinia pestis KIM
guaagcagagaauuu

SEQ ID NO: 2329761 - RNA, 19 nt, Yersinia pestis KIM
guaagauccaccacaucau

SEQ ID NO: 2329762 - RNA, 18 nt, Yersinia pestis KIM
guacgacgccagauagca

SEQ ID NO: 2329763 - RNA, 17 nt, Yersinia pestis KIM
guacccgaucugagcca

SEQ ID NO: 2329764 - RNA, 13 nt, Yersinia pestis KIM
guacccucauugg

SEQ ID NO: 2329765 - RNA, 23 nt, Yersinia pestis KIM
guaccgggccauagcccaugauu

SEQ ID NO: 2329766 - RNA, 18 nt, Yersinia pestis KIM
guaccugcacugagccag

SEQ ID NO: 2329767 - RNA, 17 nt, Yersinia pestis KIM
guaccugcacugagcca

SEQ ID NO: 2329768 - RNA, 18 nt, Yersinia pestis KIM
guaccugaucagcauuuc

SEQ ID NO: 2329769 - RNA, 18 nt, Yersinia pestis KIM
guaccaccaccaacagca

SEQ ID NO: 2329770 - RNA, 21 nt, Yersinia pestis KIM
guaccaaauaaaccagaugug

SEQ ID NO: 2329771 - RNA, 16 nt, Yersinia pestis KIM
guacauuaaaugaaua

SEQ ID NO: 2329772 - RNA, 14 nt, Yersinia pestis KIM
guacauuaaaugaa

SEQ ID NO: 2329773 - RNA, 15 nt, Yersinia pestis KIM
guacauauaucacua

SEQ ID NO: 2329774 - RNA, 15 nt, Yersinia pestis KIM
guacaugaauaaugu

SEQ ID NO: 2329775 - RNA, 23 nt, Yersinia pestis KIM
guacacuauuuuaccuauuuauu

SEQ ID NO: 2329776 - RNA, 24 nt, Yersinia pestis KIM
guacacuauuuuaccuauuuauug

SEQ ID NO: 2329777 - RNA, 16 nt, Yersinia pestis KIM
guaaugaguaaaaauu

SEQ ID NO: 2329778 - RNA, 16 nt, Yersinia pestis KIM
guaaugacucuggcag

SEQ ID NO: 2329779 - RNA, 17 nt, Yersinia pestis KIM
guaaugaugaugaguau

SEQ ID NO: 2329780 - RNA, 20 nt, Yersinia pestis KIM
guaaugacgcccgcagcggc

SEQ ID NO: 2329781 - RNA, 13 nt, Yersinia pestis KIM
guaaucugacugu

SEQ ID NO: 2329782 - RNA, 15 nt, Yersinia pestis KIM
guaaugccacacuca

SEQ ID NO: 2329783 - RNA, 18 nt, Yersinia pestis KIM
guaaugcaccuguuaaaa

SEQ ID NO: 2329784 - RNA, 14 nt, Yersinia pestis KIM
aaauagagcaccaa

SEQ ID NO: 2329785 - RNA, 18 nt, Yersinia pestis KIM
aaauagagcaccaaaucu

SEQ ID NO: 2329786 - RNA, 21 nt, Yersinia pestis KIM
aaauagagcaccaaaucuucc

SEQ ID NO: 2329787 - RNA, 17 nt, Yersinia pestis KIM
aaauagaggaaauaaau

SEQ ID NO: 2329788 - RNA, 14 nt, Yersinia pestis KIM
aaauagauaaaaac

SEQ ID NO: 2329789 - RNA, 15 nt, Yersinia pestis KIM
guaaucagacugcug

SEQ ID NO: 2329790 - RNA, 21 nt, Yersinia pestis KIM
guaaucccgauauaaauaaaa

SEQ ID NO: 2329791 - RNA, 19 nt, Yersinia pestis KIM
guaauccauacagaacugg

SEQ ID NO: 2329792 - RNA, 19 nt, Yersinia pestis KIM
guaaucccgauauaaauaa

SEQ ID NO: 2329793 - RNA, 21 nt, Yersinia pestis KIM
guaauucacccuuuaaaucua

SEQ ID NO: 2329794 - RNA, 18 nt, Yersinia pestis KIM
guaauucagauaagaucu

SEQ ID NO: 2329795 - RNA, 19 nt, Yersinia pestis KIM
guaauucccaccacuugcu

SEQ ID NO: 2329796 - RNA, 18 nt, Yersinia pestis KIM
guaauucauuauuacuca

SEQ ID NO: 2329797 - RNA, 14 nt, Yersinia pestis KIM
guaauucgcagaca

SEQ ID NO: 2329798 - RNA, 20 nt, Yersinia pestis KIM
guaauuaauuaguaauaaga

SEQ ID NO: 2329799 - RNA, 15 nt, Yersinia pestis KIM
guaauuaauuauaag

SEQ ID NO: 2329800 - RNA, 19 nt, Yersinia pestis KIM
guaauuacaguugauauua

SEQ ID NO: 2329801 - RNA, 22 nt, Yersinia pestis KIM
guaauuacaguugauauuauua

SEQ ID NO: 2329802 - RNA, 19 nt, Yersinia pestis KIM
guaauuggcgcauaaucgc

SEQ ID NO: 2329803 - RNA, 20 nt, Yersinia pestis KIM
guaauuucagauaaaaauaa

SEQ ID NO: 2329804 - RNA, 22 nt, Yersinia pestis KIM
guacaaucucugggugcugcuc

SEQ ID NO: 2329805 - RNA, 16 nt, Yersinia pestis KIM
guacacauuauuuaua

SEQ ID NO: 2329806 - RNA, 23 nt, Yersinia pestis KIM
guacaacauccagauauggcauu

SEQ ID NO: 2329807 - RNA, 16 nt, Yersinia pestis KIM
guacaaaaaacaaacc

SEQ ID NO: 2329808 - RNA, 15 nt, Yersinia pestis KIM
ggugggucgugcggg

SEQ ID NO: 2329809 - RNA, 22 nt, Yersinia pestis KIM
gguggcgcuguuggucagugcg

SEQ ID NO: 2329810 - RNA, 21 nt, Yersinia pestis KIM
gguggcaggccccaucauaaa

SEQ ID NO: 2329811 - RNA, 16 nt, Yersinia pestis KIM
ggugcuucaagcccga

SEQ ID NO: 2329812 - RNA, 15 nt, Yersinia pestis KIM
ggugcgccaguggca

SEQ ID NO: 2329813 - RNA, 14 nt, Yersinia pestis KIM
ggugccucaacgca

SEQ ID NO: 2329814 - RNA, 17 nt, Yersinia pestis KIM
ggugcgccacuguucuu

SEQ ID NO: 2329815 - RNA, 23 nt, Yersinia pestis KIM
ggugacuauuuaaauacaaaaau

SEQ ID NO: 2329816 - RNA, 16 nt, Yersinia pestis KIM
ggugaccgcgauuaaa

SEQ ID NO: 2329817 - RNA, 15 nt, Yersinia pestis KIM
ggugacccgugcggc

SEQ ID NO: 2329818 - RNA, 20 nt, Yersinia pestis KIM
ggugaucgguuagcuacuga

SEQ ID NO: 2329819 - RNA, 22 nt, Yersinia pestis KIM
ggugaugaauuugauacaguga

SEQ ID NO: 2329820 - RNA, 14 nt, Yersinia pestis KIM
ggugaucaacugcc

SEQ ID NO: 2329821 - RNA, 15 nt, Yersinia pestis KIM
ggugauauaugccau

SEQ ID NO: 2329822 - RNA, 12 nt, Yersinia pestis KIM
ggugagugagcg

SEQ ID NO: 2329823 - RNA, 14 nt, Yersinia pestis KIM
ggugagugagcgcg

SEQ ID NO: 2329824 - RNA, 24 nt, Yersinia pestis KIM
ggugaugugacgucacugaugcuu

SEQ ID NO: 2329825 - RNA, 12 nt, Yersinia pestis KIM
ggugccacacag

SEQ ID NO: 2329826 - RNA, 13 nt, Yersinia pestis KIM
ggugccagcagca

SEQ ID NO: 2329827 - RNA, 23 nt, Yersinia pestis KIM
gguugccauuaauuggccgggac

SEQ ID NO: 2329828 - RNA, 16 nt, Yersinia pestis KIM
gguugaggauuauaau

SEQ ID NO: 2329829 - RNA, 20 nt, Yersinia pestis KIM
gguugagcaucugaaagcuu

SEQ ID NO: 2329830 - RNA, 18 nt, Yersinia pestis KIM
gguugcauuugggcagau

SEQ ID NO: 2329831 - RNA, 15 nt, Yersinia pestis KIM
gguugaaauaaauaa

SEQ ID NO: 2329832 - RNA, 23 nt, Yersinia pestis KIM
gguugggaaaaguggcuaucuga

SEQ ID NO: 2329833 - RNA, 16 nt, Yersinia pestis KIM
gguuggcaucaaauuu

SEQ ID NO: 2329834 - RNA, 13 nt, Yersinia pestis KIM
gguugcuguaaug

SEQ ID NO: 2329835 - RNA, 21 nt, Yersinia pestis KIM
gguugucuauguuugaugguu

SEQ ID NO: 2329836 - RNA, 17 nt, Yersinia pestis KIM
gguuuaacaauguggua

SEQ ID NO: 2329837 - RNA, 17 nt, Yersinia pestis KIM
gguuuguaagucagauu

SEQ ID NO: 2329838 - RNA, 13 nt, Yersinia pestis KIM
gguuugucagcag

SEQ ID NO: 2329839 - RNA, 12 nt, Yersinia pestis KIM
gguuuuccccuc

SEQ ID NO: 2329840 - RNA, 10 nt, Yersinia pestis KIM
gguuuuaauc

SEQ ID NO: 2329841 - RNA, 20 nt, Yersinia pestis KIM
gguuuuaucaauaggucagu

SEQ ID NO: 2329842 - RNA, 17 nt, Yersinia pestis KIM
gguuuuaccaucaccau

SEQ ID NO: 2329843 - RNA, 15 nt, Yersinia pestis KIM
gguuuaggccuauaa

SEQ ID NO: 2329844 - RNA, 17 nt, Yersinia pestis KIM
gguuucugccuuaucaa

SEQ ID NO: 2329845 - RNA, 14 nt, Yersinia pestis KIM
guaaaacauuucau

SEQ ID NO: 2329846 - RNA, 19 nt, Yersinia pestis KIM
guaaaacagggagccgccc

SEQ ID NO: 2329847 - RNA, 18 nt, Yersinia pestis KIM
guaaaaauucaagagagg

SEQ ID NO: 2329848 - RNA, 20 nt, Yersinia pestis KIM
guaaaaacucacuguucaga

SEQ ID NO: 2329849 - RNA, 22 nt, Yersinia pestis KIM
gguuuugauuuuuucugugauu

SEQ ID NO: 2329850 - RNA, 14 nt, Yersinia pestis KIM
gguuuuggccggga

SEQ ID NO: 2329851 - RNA, 12 nt, Yersinia pestis KIM
guaaaaaaauag

SEQ ID NO: 2329852 - RNA, 23 nt, Yersinia pestis KIM
guaaaaaaaccccguacaugaau

SEQ ID NO: 2329853 - RNA, 15 nt, Yersinia pestis KIM
gguucuccaacaacc

SEQ ID NO: 2329854 - RNA, 12 nt, Yersinia pestis KIM
gguucuaaaccu

SEQ ID NO: 2329855 - RNA, 18 nt, Yersinia pestis KIM
gguucgagacaacguuuc

SEQ ID NO: 2329856 - RNA, 15 nt, Yersinia pestis KIM
gguucauauuggcca

SEQ ID NO: 2329857 - RNA, 20 nt, Yersinia pestis KIM
gguucaucaaucgagaagaa

SEQ ID NO: 2329858 - RNA, 23 nt, Yersinia pestis KIM
gguuacgauacguugcaggucaa

SEQ ID NO: 2329859 - RNA, 23 nt, Yersinia pestis KIM
gguuaucacacccuaaagaucuu

SEQ ID NO: 2329860 - RNA, 14 nt, Yersinia pestis KIM
gguuaucacagcaa

SEQ ID NO: 2329861 - RNA, 16 nt, Yersinia pestis KIM
gguuacgucauauccc

SEQ ID NO: 2329862 - RNA, 20 nt, Yersinia pestis KIM
gguucaccuuucgguugcau

SEQ ID NO: 2329863 - RNA, 11 nt, Yersinia pestis KIM
gguucacggaa

SEQ ID NO: 2329864 - RNA, 13 nt, Yersinia pestis KIM
gguucaauucccg

SEQ ID NO: 2329865 - RNA, 18 nt, Yersinia pestis KIM
gguucaaguccaguaggg

SEQ ID NO: 2329866 - RNA, 18 nt, Yersinia pestis KIM
gguucaaggaaaccaaug

SEQ ID NO: 2329867 - RNA, 16 nt, Yersinia pestis KIM
gguuauuauguaaaua

SEQ ID NO: 2329868 - RNA, 20 nt, Yersinia pestis KIM
gguguuauuuacaccgugca

SEQ ID NO: 2329869 - RNA, 12 nt, Yersinia pestis KIM
gguguuuaaaau

SEQ ID NO: 2329870 - RNA, 17 nt, Yersinia pestis KIM
gguuaacuuuuucuauc

SEQ ID NO: 2329871 - RNA, 13 nt, Yersinia pestis KIM
gguuaaaacagau

SEQ ID NO: 2329872 - RNA, 15 nt, Yersinia pestis KIM
gguguguugaaauuu

SEQ ID NO: 2329873 - RNA, 18 nt, Yersinia pestis KIM
gguguaaaugcccgucgg

SEQ ID NO: 2329874 - RNA, 23 nt, Yersinia pestis KIM
gguguaccgcuucgcgcccgccc

SEQ ID NO: 2329875 - RNA, 12 nt, Yersinia pestis KIM
gguguaguguuu

SEQ ID NO: 2329876 - RNA, 20 nt, Yersinia pestis KIM
ggugucaguacgcuggccag

SEQ ID NO: 2329877 - RNA, 14 nt, Yersinia pestis KIM
gccggcggcccaua

SEQ ID NO: 2329878 - RNA, 10 nt, Yersinia pestis KIM
gccggcggcc

SEQ ID NO: 2329879 - RNA, 22 nt, Yersinia pestis KIM
gccggagucuaucugcaguauu

SEQ ID NO: 2329880 - RNA, 18 nt, Yersinia pestis KIM
gccggcaacagcgccugc

SEQ ID NO: 2329881 - RNA, 18 nt, Yersinia pestis KIM
gccgggucaggaagagaa

SEQ ID NO: 2329882 - RNA, 21 nt, Yersinia pestis KIM
gccgggucguaccggcccaac

SEQ ID NO: 2329883 - RNA, 21 nt, Yersinia pestis KIM
gccggguuauaaaucagggca

SEQ ID NO: 2329884 - RNA, 21 nt, Yersinia pestis KIM
gccguaaacugccguaaacaa

SEQ ID NO: 2329885 - RNA, 13 nt, Yersinia pestis KIM
gccguacaacaau

SEQ ID NO: 2329886 - RNA, 16 nt, Yersinia pestis KIM
gccgucagcucuuguu

SEQ ID NO: 2329887 - RNA, 13 nt, Yersinia pestis KIM
gccgugccugcug

SEQ ID NO: 2329888 - RNA, 15 nt, Yersinia pestis KIM
gccguggcgaagccc

SEQ ID NO: 2329889 - RNA, 14 nt, Yersinia pestis KIM
gccguuuugcucgg

SEQ ID NO: 2329890 - RNA, 19 nt, Yersinia pestis KIM
gccguuuuggcuauuuauu

SEQ ID NO: 2329891 - RNA, 18 nt, Yersinia pestis KIM
gccuaaaaaugauuucag

SEQ ID NO: 2329892 - RNA, 15 nt, Yersinia pestis KIM
gccuaacaacacgcu

SEQ ID NO: 2329893 - RNA, 19 nt, Yersinia pestis KIM
gccuaaggccaucaauaaa

SEQ ID NO: 2329894 - RNA, 19 nt, Yersinia pestis KIM
gccuaccaucaaaauaugu

SEQ ID NO: 2329895 - RNA, 21 nt, Yersinia pestis KIM
gccuaccaucaaaauauguuc

SEQ ID NO: 2329896 - RNA, 17 nt, Yersinia pestis KIM
gccugcaccagugccaa

SEQ ID NO: 2329897 - RNA, 18 nt, Yersinia pestis KIM
gccugcaccagugccaau

SEQ ID NO: 2329898 - RNA, 22 nt, Yersinia pestis KIM
gccugccagaacagcaggccgc

SEQ ID NO: 2329899 - RNA, 14 nt, Yersinia pestis KIM
gccugcgacagcac

SEQ ID NO: 2329900 - RNA, 11 nt, Yersinia pestis KIM
gccugcucaac

SEQ ID NO: 2329901 - RNA, 21 nt, Yersinia pestis KIM
gccugauaaaauuaccgcccc

SEQ ID NO: 2329902 - RNA, 19 nt, Yersinia pestis KIM
gccugagguucccaacggc

SEQ ID NO: 2329903 - RNA, 21 nt, Yersinia pestis KIM
gccugagguucccaacggcag

SEQ ID NO: 2329904 - RNA, 17 nt, Yersinia pestis KIM
gccugacugcccgccug

SEQ ID NO: 2329905 - RNA, 20 nt, Yersinia pestis KIM
gccugaucgauaacccccaa

SEQ ID NO: 2329906 - RNA, 15 nt, Yersinia pestis KIM
gccugauccaacauc

SEQ ID NO: 2329907 - RNA, 14 nt, Yersinia pestis KIM
gccugauacaccau

SEQ ID NO: 2329908 - RNA, 16 nt, Yersinia pestis KIM
gccucaacgcacccca

SEQ ID NO: 2329909 - RNA, 15 nt, Yersinia pestis KIM
gccuauuucagggcg

SEQ ID NO: 2329910 - RNA, 19 nt, Yersinia pestis KIM
gccuauuugcagaaaguaa

SEQ ID NO: 2329911 - RNA, 18 nt, Yersinia pestis KIM
gccugaauggaaaaauua

SEQ ID NO: 2329912 - RNA, 17 nt, Yersinia pestis KIM
gccugaauauucaccau

SEQ ID NO: 2329913 - RNA, 19 nt, Yersinia pestis KIM
gccucacaacuuucccagu

SEQ ID NO: 2329914 - RNA, 16 nt, Yersinia pestis KIM
gccuguaaaucuuguu

SEQ ID NO: 2329915 - RNA, 14 nt, Yersinia pestis KIM
gccuguaccaccac

SEQ ID NO: 2329916 - RNA, 16 nt, Yersinia pestis KIM
gccuguaccaccacca

SEQ ID NO: 2329917 - RNA, 22 nt, Yersinia pestis KIM
gccuguaccaccaccaacagca

SEQ ID NO: 2329918 - RNA, 17 nt, Yersinia pestis KIM
gccugucuuaggugaca

SEQ ID NO: 2329919 - RNA, 18 nt, Yersinia pestis KIM
gccuucauguugcaacau

SEQ ID NO: 2329920 - RNA, 17 nt, Yersinia pestis KIM
gccuuaucagcgaaaaa

SEQ ID NO: 2329921 - RNA, 19 nt, Yersinia pestis KIM
gccuguuacugaccgugca

SEQ ID NO: 2329922 - RNA, 16 nt, Yersinia pestis KIM
gccugugcggcaguga

SEQ ID NO: 2329923 - RNA, 18 nt, Yersinia pestis KIM
gccugugcggcagugaac

SEQ ID NO: 2329924 - RNA, 21 nt, Yersinia pestis KIM
gccugugcggcagugaaccug

SEQ ID NO: 2329925 - RNA, 18 nt, Yersinia pestis KIM
gccuuaauggccgccauu

SEQ ID NO: 2329926 - RNA, 22 nt, Yersinia pestis KIM
gccuucuuggguggcaauuucu

SEQ ID NO: 2329927 - RNA, 17 nt, Yersinia pestis KIM
gccuucuccuuucuguu

SEQ ID NO: 2329928 - RNA, 20 nt, Yersinia pestis KIM
gccuuccuuggcgcggacgc

SEQ ID NO: 2329929 - RNA, 18 nt, Yersinia pestis KIM
gccuuuuuuauaauaaug

SEQ ID NO: 2329930 - RNA, 22 nt, Yersinia pestis KIM
gccuuuuuugaacgauauuuuu

SEQ ID NO: 2329931 - RNA, 22 nt, Yersinia pestis KIM
gccuuguccaucacgcagcuuu

SEQ ID NO: 2329932 - RNA, 13 nt, Yersinia pestis KIM
gcgaccagcagaa

SEQ ID NO: 2329933 - RNA, 12 nt, Yersinia pestis KIM
gcgaccagcaga

SEQ ID NO: 2329934 - RNA, 17 nt, Yersinia pestis KIM
gcgacauuucggccacc

SEQ ID NO: 2329935 - RNA, 15 nt, Yersinia pestis KIM
gcgaccuugauucuc

SEQ ID NO: 2329936 - RNA, 18 nt, Yersinia pestis KIM
gcgacaggcucagcacaa

SEQ ID NO: 2329937 - RNA, 16 nt, Yersinia pestis KIM
gcgacaggcgccacaa

SEQ ID NO: 2329938 - RNA, 19 nt, Yersinia pestis KIM
gcgacaaucaauggccagc

SEQ ID NO: 2329939 - RNA, 15 nt, Yersinia pestis KIM
gcgacacuuauuggu

SEQ ID NO: 2329940 - RNA, 21 nt, Yersinia pestis KIM
gcgaaugcccugcuaauuuga

SEQ ID NO: 2329941 - RNA, 13 nt, Yersinia pestis KIM
gcgaauuaucauc

SEQ ID NO: 2329942 - RNA, 18 nt, Yersinia pestis KIM
gcgaauccagguaaacaa

SEQ ID NO: 2329943 - RNA, 16 nt, Yersinia pestis KIM
gcgaauaauggcagcc

SEQ ID NO: 2329944 - RNA, 14 nt, Yersinia pestis KIM
gcgagcacugcccc

SEQ ID NO: 2329945 - RNA, 18 nt, Yersinia pestis KIM
gcgagauagucagcgacg

SEQ ID NO: 2329946 - RNA, 13 nt, Yersinia pestis KIM
gcgacuuuuauuu

SEQ ID NO: 2329947 - RNA, 15 nt, Yersinia pestis KIM
gcgacgugaugccag

SEQ ID NO: 2329948 - RNA, 18 nt, Yersinia pestis KIM
gcgacugugcuuugccau

SEQ ID NO: 2329949 - RNA, 19 nt, Yersinia pestis KIM
gcgacugcgcgcugaacgu

SEQ ID NO: 2329950 - RNA, 15 nt, Yersinia pestis KIM
gcgagucucaucaag

SEQ ID NO: 2329951 - RNA, 18 nt, Yersinia pestis KIM
gcgauacggucaucgccg

SEQ ID NO: 2329952 - RNA, 17 nt, Yersinia pestis KIM
gcgagugaaccgcgcuc

SEQ ID NO: 2329953 - RNA, 21 nt, Yersinia pestis KIM
gcgagugaaccgcgcucugcu

SEQ ID NO: 2329954 - RNA, 15 nt, Yersinia pestis KIM
gcgaggcuucucagc

SEQ ID NO: 2329955 - RNA, 15 nt, Yersinia pestis KIM
gccgccaacagugaa

SEQ ID NO: 2329956 - RNA, 15 nt, Yersinia pestis KIM
gccgcacacagcccu

SEQ ID NO: 2329957 - RNA, 12 nt, Yersinia pestis KIM
gccgcaccaucu

SEQ ID NO: 2329958 - RNA, 19 nt, Yersinia pestis KIM
gccgaguucgucgggggug

SEQ ID NO: 2329959 - RNA, 13 nt, Yersinia pestis KIM
gccgaguaaguca

SEQ ID NO: 2329960 - RNA, 20 nt, Yersinia pestis KIM
gccgaugaucucuggccgug

SEQ ID NO: 2329961 - RNA, 16 nt, Yersinia pestis KIM
gccgcgccauccuugg

SEQ ID NO: 2329962 - RNA, 20 nt, Yersinia pestis KIM
gccgcccuuuagccagcggc

SEQ ID NO: 2329963 - RNA, 16 nt, Yersinia pestis KIM
gcccgguaucaccuuu

SEQ ID NO: 2329964 - RNA, 16 nt, Yersinia pestis KIM
gcccuaauaaccgaca

SEQ ID NO: 2329965 - RNA, 20 nt, Yersinia pestis KIM
gcccuaauauccucaaaauu

SEQ ID NO: 2329966 - RNA, 23 nt, Yersinia pestis KIM
gcccuaaccgcuuuuuacccagu

SEQ ID NO: 2329967 - RNA, 22 nt, Yersinia pestis KIM
gcccuaaccgcuuuuuacccag

SEQ ID NO: 2329968 - RNA, 19 nt, Yersinia pestis KIM
gcccucccuggcgcggacg

SEQ ID NO: 2329969 - RNA, 12 nt, Yersinia pestis KIM
gcccuacuggcu

SEQ ID NO: 2329970 - RNA, 21 nt, Yersinia pestis KIM
gcccuaacugcucagccgacu

SEQ ID NO: 2329971 - RNA, 17 nt, Yersinia pestis KIM
gcccugccauaaccgcu

SEQ ID NO: 2329972 - RNA, 14 nt, Yersinia pestis KIM
gcccugaguuaagu

SEQ ID NO: 2329973 - RNA, 18 nt, Yersinia pestis KIM
gcccugaguuaucuguuu

SEQ ID NO: 2329974 - RNA, 22 nt, Yersinia pestis KIM
gcccugagguuauugacaaagu

SEQ ID NO: 2329975 - RNA, 22 nt, Yersinia pestis KIM
gcccugaauuucaauaacaccg

SEQ ID NO: 2329976 - RNA, 17 nt, Yersinia pestis KIM
gcccuuuuuuauugcgu

SEQ ID NO: 2329977 - RNA, 18 nt, Yersinia pestis KIM
gcccuuucgcagcccaau

SEQ ID NO: 2329978 - RNA, 19 nt, Yersinia pestis KIM
gcccuucggacggcugaca

SEQ ID NO: 2329979 - RNA, 19 nt, Yersinia pestis KIM
gcccuuaucuacugggcca

SEQ ID NO: 2329980 - RNA, 21 nt, Yersinia pestis KIM
gcccuucagaugaauccagcc

SEQ ID NO: 2329981 - RNA, 15 nt, Yersinia pestis KIM
gcccuguuucauuuc

SEQ ID NO: 2329982 - RNA, 16 nt, Yersinia pestis KIM
gcccuguugcccagca

SEQ ID NO: 2329983 - RNA, 18 nt, Yersinia pestis KIM
aaagcgggccagcaacca

SEQ ID NO: 2329984 - RNA, 14 nt, Yersinia pestis KIM
aaagcgguuaucac

SEQ ID NO: 2329985 - RNA, 23 nt, Yersinia pestis KIM
aaagcguccgcgccaaggauggc

SEQ ID NO: 2329986 - RNA, 18 nt, Yersinia pestis KIM
aaagcguccgcgccaggg

SEQ ID NO: 2329987 - RNA, 20 nt, Yersinia pestis KIM
aaagcguccgcgccagggag

SEQ ID NO: 2329988 - RNA, 18 nt, Yersinia pestis KIM
gccccgcgcuaaccaacg

SEQ ID NO: 2329989 - RNA, 16 nt, Yersinia pestis KIM
gccccgcuaccaagcc

SEQ ID NO: 2329990 - RNA, 15 nt, Yersinia pestis KIM
gccccgcaggugggc

SEQ ID NO: 2329991 - RNA, 15 nt, Yersinia pestis KIM
gcccgcacacugagc

SEQ ID NO: 2329992 - RNA, 17 nt, Yersinia pestis KIM
gcccgcacacugagccg

SEQ ID NO: 2329993 - RNA, 21 nt, Yersinia pestis KIM
gcccgcacacugagccgcccu

SEQ ID NO: 2329994 - RNA, 21 nt, Yersinia pestis KIM
gcccgcagcggcuagcagcag

SEQ ID NO: 2329995 - RNA, 16 nt, Yersinia pestis KIM
gcccgcaacgggagag

SEQ ID NO: 2329996 - RNA, 17 nt, Yersinia pestis KIM
gccccucagacugcuga

SEQ ID NO: 2329997 - RNA, 21 nt, Yersinia pestis KIM
gccccugaauucgauaacagc

SEQ ID NO: 2329998 - RNA, 19 nt, Yersinia pestis KIM
gccccugauagucaauaaa

SEQ ID NO: 2329999 - RNA, 23 nt, Yersinia pestis KIM
gcccaguauugcagagcaaaacu

SEQ ID NO: 2330000 - RNA, 14 nt, Yersinia pestis KIM
gcccaguggagcca

SEQ ID NO: 2330001 - RNA, 12 nt, Yersinia pestis KIM
gccccacauuac

SEQ ID NO: 2330002 - RNA, 15 nt, Yersinia pestis KIM
gccccaaaugccagc

SEQ ID NO: 2330003 - RNA, 18 nt, Yersinia pestis KIM
gccccaacacuggggcgc

SEQ ID NO: 2330004 - RNA, 16 nt, Yersinia pestis KIM
gcccagccucuggaua

SEQ ID NO: 2330005 - RNA, 20 nt, Yersinia pestis KIM
gcccagccgggguaucauag

SEQ ID NO: 2330006 - RNA, 21 nt, Yersinia pestis KIM
gcccagauucauuagccagcc

SEQ ID NO: 2330007 - RNA, 18 nt, Yersinia pestis KIM
gcccagcaaggcgggcaa

SEQ ID NO: 2330008 - RNA, 13 nt, Yersinia pestis KIM
gcccagagcgcgg

SEQ ID NO: 2330009 - RNA, 21 nt, Yersinia pestis KIM
gcccaauaagugaaacaaaua

SEQ ID NO: 2330010 - RNA, 22 nt, Yersinia pestis KIM
gcccaauaaaaacgccuccagu

SEQ ID NO: 2330011 - RNA, 21 nt, Yersinia pestis KIM
gccauaaccugagcaccagaa

SEQ ID NO: 2330012 - RNA, 17 nt, Yersinia pestis KIM
gccauaaccgcaaucag

SEQ ID NO: 2330013 - RNA, 20 nt, Yersinia pestis KIM
gccauaagcccccguaucau

SEQ ID NO: 2330014 - RNA, 18 nt, Yersinia pestis KIM
gccauaauccagaagcca

SEQ ID NO: 2330015 - RNA, 13 nt, Yersinia pestis KIM
gccauagcugcug

SEQ ID NO: 2330016 - RNA, 18 nt, Yersinia pestis KIM
gccauagguacuuuguca

SEQ ID NO: 2330017 - RNA, 17 nt, Yersinia pestis KIM
gccaguuuagugcucau

SEQ ID NO: 2330018 - RNA, 20 nt, Yersinia pestis KIM
gccaucgccgacaaaauccc

SEQ ID NO: 2330019 - RNA, 21 nt, Yersinia pestis KIM
gccaucgcuaaucauauccau

SEQ ID NO: 2330020 - RNA, 12 nt, Yersinia pestis KIM
gccaucaauaaa

SEQ ID NO: 2330021 - RNA, 14 nt, Yersinia pestis KIM
gccaucaauaaagc

SEQ ID NO: 2330022 - RNA, 22 nt, Yersinia pestis KIM
gccaucaauaaagcuggcuaac

SEQ ID NO: 2330023 - RNA, 19 nt, Yersinia pestis KIM
gcccaacucuuuagccgcu

SEQ ID NO: 2330024 - RNA, 15 nt, Yersinia pestis KIM
gccauuuuuuauaaa

SEQ ID NO: 2330025 - RNA, 11 nt, Yersinia pestis KIM
gcccaagccau

SEQ ID NO: 2330026 - RNA, 12 nt, Yersinia pestis KIM
gccauuuugcug

SEQ ID NO: 2330027 - RNA, 20 nt, Yersinia pestis KIM
gccauuuguuaaucgcugaa

SEQ ID NO: 2330028 - RNA, 17 nt, Yersinia pestis KIM
gccauggcgaaaauccu

SEQ ID NO: 2330029 - RNA, 14 nt, Yersinia pestis KIM
gccaugggaaauca

SEQ ID NO: 2330030 - RNA, 12 nt, Yersinia pestis KIM
gccacuucggug

SEQ ID NO: 2330031 - RNA, 15 nt, Yersinia pestis KIM
gccacuucgguggcc

SEQ ID NO: 2330032 - RNA, 17 nt, Yersinia pestis KIM
gccacuucgguggcccu

SEQ ID NO: 2330033 - RNA, 14 nt, Yersinia pestis KIM
gccaggucaggaag

SEQ ID NO: 2330034 - RNA, 23 nt, Yersinia pestis KIM
gccaggucgaugaacugcacguc

SEQ ID NO: 2330035 - RNA, 21 nt, Yersinia pestis KIM
gccagguaagaaagagaugac

SEQ ID NO: 2330036 - RNA, 21 nt, Yersinia pestis KIM
gccaguaaacagccagcauca

SEQ ID NO: 2330037 - RNA, 17 nt, Yersinia pestis KIM
gccagugccgcggcggc

SEQ ID NO: 2330038 - RNA, 16 nt, Yersinia pestis KIM
gccaguggcuuugcac

SEQ ID NO: 2330039 - RNA, 20 nt, Yersinia pestis KIM
gccaguggcuuugcaccauc

SEQ ID NO: 2330040 - RNA, 15 nt, Yersinia pestis KIM
gccagugacugagca

SEQ ID NO: 2330041 - RNA, 22 nt, Yersinia pestis KIM
gccagugccaccguaaaaaacc

SEQ ID NO: 2330042 - RNA, 19 nt, Yersinia pestis KIM
gccagugacaacuuagguu

SEQ ID NO: 2330043 - RNA, 22 nt, Yersinia pestis KIM
gccagugaaucagccagagaau

SEQ ID NO: 2330044 - RNA, 17 nt, Yersinia pestis KIM
gccaguguuuucuccac

SEQ ID NO: 2330045 - RNA, 15 nt, Yersinia pestis KIM
gccaguuaauaccag

SEQ ID NO: 2330046 - RNA, 23 nt, Yersinia pestis KIM
gccagucaaaagaaacugucagu

SEQ ID NO: 2330047 - RNA, 18 nt, Yersinia pestis KIM
gccaguauccagaugauu

SEQ ID NO: 2330048 - RNA, 21 nt, Yersinia pestis KIM
gccaguagcaauaaggugcca

SEQ ID NO: 2330049 - RNA, 23 nt, Yersinia pestis KIM
gccacgggcauccgcuucgcugg

SEQ ID NO: 2330050 - RNA, 16 nt, Yersinia pestis KIM
gccacucacauaagaa

SEQ ID NO: 2330051 - RNA, 21 nt, Yersinia pestis KIM
gccacuacggcgacuugccgu

SEQ ID NO: 2330052 - RNA, 20 nt, Yersinia pestis KIM
gccacucuagcuguguuuua

SEQ ID NO: 2330053 - RNA, 19 nt, Yersinia pestis KIM
gccaccccguggcaggccu

SEQ ID NO: 2330054 - RNA, 14 nt, Yersinia pestis KIM
gccacccauugcuc

SEQ ID NO: 2330055 - RNA, 14 nt, Yersinia pestis KIM
gccacagcaacagg

SEQ ID NO: 2330056 - RNA, 13 nt, Yersinia pestis KIM
gccacacucagac

SEQ ID NO: 2330057 - RNA, 15 nt, Yersinia pestis KIM
gccaccggcaguuca

SEQ ID NO: 2330058 - RNA, 23 nt, Yersinia pestis KIM
gccaccgcacaguuaauuuucac

SEQ ID NO: 2330059 - RNA, 17 nt, Yersinia pestis KIM
gccaccgcauuccagcg

SEQ ID NO: 2330060 - RNA, 18 nt, Yersinia pestis KIM
gccaccgcauuccagcgu

SEQ ID NO: 2330061 - RNA, 18 nt, Yersinia pestis KIM
gccacccugccaaaaaau

SEQ ID NO: 2330062 - RNA, 22 nt, Yersinia pestis KIM
gccaaugcgguuuuucuugcca

SEQ ID NO: 2330063 - RNA, 22 nt, Yersinia pestis KIM
gccaaugccaagaauaauuacu

SEQ ID NO: 2330064 - RNA, 12 nt, Yersinia pestis KIM
gccaauccccag

SEQ ID NO: 2330065 - RNA, 17 nt, Yersinia pestis KIM
gccacaacccaauaaua

SEQ ID NO: 2330066 - RNA, 20 nt, Yersinia pestis KIM
gccaaggccagcgccccauc

SEQ ID NO: 2330067 - RNA, 20 nt, Yersinia pestis KIM
gccaagguccaacucccaaa

SEQ ID NO: 2330068 - RNA, 16 nt, Yersinia pestis KIM
gccaaucaaaaaaccg

SEQ ID NO: 2330069 - RNA, 15 nt, Yersinia pestis KIM
gccaaucaaaaugac

SEQ ID NO: 2330070 - RNA, 21 nt, Yersinia pestis KIM
gccaaucaaaaugaccuuauc

SEQ ID NO: 2330071 - RNA, 18 nt, Yersinia pestis KIM
gccaauauugccuucacc

SEQ ID NO: 2330072 - RNA, 15 nt, Yersinia pestis KIM
gccaauaggccccuc

SEQ ID NO: 2330073 - RNA, 19 nt, Yersinia pestis KIM
gccaauauguuagcagcac

SEQ ID NO: 2330074 - RNA, 18 nt, Yersinia pestis KIM
gccaauauccauauuaaa

SEQ ID NO: 2330075 - RNA, 22 nt, Yersinia pestis KIM
gccaauagaaaaacacuggcag

SEQ ID NO: 2330076 - RNA, 15 nt, Yersinia pestis KIM
gccaauagaggcucc

SEQ ID NO: 2330077 - RNA, 16 nt, Yersinia pestis KIM
gccaauagcaaaccca

SEQ ID NO: 2330078 - RNA, 14 nt, Yersinia pestis KIM
gccaauaaagucca

SEQ ID NO: 2330079 - RNA, 19 nt, Yersinia pestis KIM
gccaauaaccgcagcaggc

SEQ ID NO: 2330080 - RNA, 14 nt, Yersinia pestis KIM
gccaaacaaaugaa

SEQ ID NO: 2330081 - RNA, 20 nt, Yersinia pestis KIM
gccaaaauaaacaucaaugu

SEQ ID NO: 2330082 - RNA, 13 nt, Yersinia pestis KIM
gccaaacaguaaa

SEQ ID NO: 2330083 - RNA, 21 nt, Yersinia pestis KIM
gccaacaacuggguggccagu

SEQ ID NO: 2330084 - RNA, 13 nt, Yersinia pestis KIM
gccaacaggcccc

SEQ ID NO: 2330085 - RNA, 14 nt, Yersinia pestis KIM
gccaacaggccccu

SEQ ID NO: 2330086 - RNA, 12 nt, Yersinia pestis KIM
gccaacagugaa

SEQ ID NO: 2330087 - RNA, 18 nt, Yersinia pestis KIM
gccaacagugaauaacug

SEQ ID NO: 2330088 - RNA, 21 nt, Yersinia pestis KIM
gccaacaucgcgcugcuuucc

SEQ ID NO: 2330089 - RNA, 14 nt, Yersinia pestis KIM
gccaacgucucuuc

SEQ ID NO: 2330090 - RNA, 22 nt, Yersinia pestis KIM
gccaacgauaaugacauaauca

SEQ ID NO: 2330091 - RNA, 11 nt, Yersinia pestis KIM
gccaacgugua

SEQ ID NO: 2330092 - RNA, 19 nt, Yersinia pestis KIM
gcaucgucaaauuccccca

SEQ ID NO: 2330093 - RNA, 24 nt, Yersinia pestis KIM
gcaugacuagugccacaacaagcc

SEQ ID NO: 2330094 - RNA, 12 nt, Yersinia pestis KIM
gcaugaauaaua

SEQ ID NO: 2330095 - RNA, 15 nt, Yersinia pestis KIM
gcauggcgcugggca

SEQ ID NO: 2330096 - RNA, 15 nt, Yersinia pestis KIM
gcauuaaaaucaccc

SEQ ID NO: 2330097 - RNA, 16 nt, Yersinia pestis KIM
gcauguggaagcgggc

SEQ ID NO: 2330098 - RNA, 17 nt, Yersinia pestis KIM
gcauguuauuggcuaaa

SEQ ID NO: 2330099 - RNA, 20 nt, Yersinia pestis KIM
gcauguuccugcacuaaacc

SEQ ID NO: 2330100 - RNA, 16 nt, Yersinia pestis KIM
gcauucaggcuuuuuu

SEQ ID NO: 2330101 - RNA, 16 nt, Yersinia pestis KIM
gcauucugcugguuca

SEQ ID NO: 2330102 - RNA, 15 nt, Yersinia pestis KIM
gcauuaucuuuaauu

SEQ ID NO: 2330103 - RNA, 15 nt, Yersinia pestis KIM
gcauuagacauucaa

SEQ ID NO: 2330104 - RNA, 17 nt, Yersinia pestis KIM
gcauugaccgccaaauc

SEQ ID NO: 2330105 - RNA, 20 nt, Yersinia pestis KIM
gcauuggguaauaucaccau

SEQ ID NO: 2330106 - RNA, 24 nt, Yersinia pestis KIM
gcauugugcuuuuuggcaaacuca

SEQ ID NO: 2330107 - RNA, 16 nt, Yersinia pestis KIM
gcauuuuuugccagau

SEQ ID NO: 2330108 - RNA, 22 nt, Yersinia pestis KIM
gcauuuuuuucacaccacggcg

SEQ ID NO: 2330109 - RNA, 15 nt, Yersinia pestis KIM
gccaaaaaaagggcg

SEQ ID NO: 2330110 - RNA, 13 nt, Yersinia pestis KIM
gccaaaaauguaa

SEQ ID NO: 2330111 - RNA, 13 nt, Yersinia pestis KIM
gcauuuaaaaggc

SEQ ID NO: 2330112 - RNA, 18 nt, Yersinia pestis KIM
gcauccgcuucgcugguc

SEQ ID NO: 2330113 - RNA, 19 nt, Yersinia pestis KIM
gcauccgcuuucacauuac

SEQ ID NO: 2330114 - RNA, 14 nt, Yersinia pestis KIM
gcauccccggcacc

SEQ ID NO: 2330115 - RNA, 14 nt, Yersinia pestis KIM
gcauccccaucgcc

SEQ ID NO: 2330116 - RNA, 23 nt, Yersinia pestis KIM
gcauccccacugacaucauuuua

SEQ ID NO: 2330117 - RNA, 19 nt, Yersinia pestis KIM
gcauccccacuuguaccug

SEQ ID NO: 2330118 - RNA, 17 nt, Yersinia pestis KIM
gcaucagacggcagcaa

SEQ ID NO: 2330119 - RNA, 18 nt, Yersinia pestis KIM
gcaucagcccauugcugu

SEQ ID NO: 2330120 - RNA, 12 nt, Yersinia pestis KIM
gcaucgcgggcg

SEQ ID NO: 2330121 - RNA, 23 nt, Yersinia pestis KIM
gcauccgggaaccccuucaggcc

SEQ ID NO: 2330122 - RNA, 19 nt, Yersinia pestis KIM
gcauccggcgguaaaucug

SEQ ID NO: 2330123 - RNA, 15 nt, Yersinia pestis KIM
gcaucgcgggcgcgc

SEQ ID NO: 2330124 - RNA, 14 nt, Yersinia pestis KIM
gcaucgcuugcuca

SEQ ID NO: 2330125 - RNA, 21 nt, Yersinia pestis KIM
gcaucgguaauacucuggcca

SEQ ID NO: 2330126 - RNA, 19 nt, Yersinia pestis KIM
gcauacgugccaaaaugcc

SEQ ID NO: 2330127 - RNA, 18 nt, Yersinia pestis KIM
gcauaccggucauauuua

SEQ ID NO: 2330128 - RNA, 15 nt, Yersinia pestis KIM
gcauauaucccaaua

SEQ ID NO: 2330129 - RNA, 23 nt, Yersinia pestis KIM
gcauauacuggagcuauggaaga

SEQ ID NO: 2330130 - RNA, 13 nt, Yersinia pestis KIM
gcauauaaaacac

SEQ ID NO: 2330131 - RNA, 14 nt, Yersinia pestis KIM
gcaucaauaaaauu

SEQ ID NO: 2330132 - RNA, 16 nt, Yersinia pestis KIM
gcaucaauaaauagag

SEQ ID NO: 2330133 - RNA, 15 nt, Yersinia pestis KIM
gcaucaauaauaacg

SEQ ID NO: 2330134 - RNA, 16 nt, Yersinia pestis KIM
gcaucaccaaacagug

SEQ ID NO: 2330135 - RNA, 16 nt, Yersinia pestis KIM
gcaucacgauagccag

SEQ ID NO: 2330136 - RNA, 13 nt, Yersinia pestis KIM
gcagcauccagcu

SEQ ID NO: 2330137 - RNA, 21 nt, Yersinia pestis KIM
gcagcaaaaccaagcugauga

SEQ ID NO: 2330138 - RNA, 14 nt, Yersinia pestis KIM
gcagcaagcugagu

SEQ ID NO: 2330139 - RNA, 22 nt, Yersinia pestis KIM
gcagcaaguuagcgauaucugc

SEQ ID NO: 2330140 - RNA, 14 nt, Yersinia pestis KIM
gcagcacaccggcc

SEQ ID NO: 2330141 - RNA, 21 nt, Yersinia pestis KIM
gcagacucuuauauaaaucca

SEQ ID NO: 2330142 - RNA, 16 nt, Yersinia pestis KIM
gcagacucgacagcau

SEQ ID NO: 2330143 - RNA, 20 nt, Yersinia pestis KIM
gcagacggcguaagccuuca

SEQ ID NO: 2330144 - RNA, 22 nt, Yersinia pestis KIM
gcagacauuccgucagcaugaa

SEQ ID NO: 2330145 - RNA, 16 nt, Yersinia pestis KIM
gcagaaccauggcacu

SEQ ID NO: 2330146 - RNA, 14 nt, Yersinia pestis KIM
gcagaaagcagcag

SEQ ID NO: 2330147 - RNA, 12 nt, Yersinia pestis KIM
gcagaaacggug

SEQ ID NO: 2330148 - RNA, 14 nt, Yersinia pestis KIM
gcagaacaaaacaa

SEQ ID NO: 2330149 - RNA, 13 nt, Yersinia pestis KIM
gcagaaagugacc

SEQ ID NO: 2330150 - RNA, 12 nt, Yersinia pestis KIM
gcagaagagguu

SEQ ID NO: 2330151 - RNA, 19 nt, Yersinia pestis KIM
gcagaagggcggccagcaa

SEQ ID NO: 2330152 - RNA, 20 nt, Yersinia pestis KIM
gcagaaguccugauucgcga

SEQ ID NO: 2330153 - RNA, 19 nt, Yersinia pestis KIM
gcagauauuggcgaccauc

SEQ ID NO: 2330154 - RNA, 17 nt, Yersinia pestis KIM
gcagaucggcauuauua

SEQ ID NO: 2330155 - RNA, 20 nt, Yersinia pestis KIM
gcagauggugggcaucaaaa

SEQ ID NO: 2330156 - RNA, 20 nt, Yersinia pestis KIM
gcagaugaggcccauggacg

SEQ ID NO: 2330157 - RNA, 18 nt, Yersinia pestis KIM
gcagauaaaucuguggca

SEQ ID NO: 2330158 - RNA, 21 nt, Yersinia pestis KIM
gcagaguucggucauaaaaac

SEQ ID NO: 2330159 - RNA, 19 nt, Yersinia pestis KIM
gcagauaucagccagugcu

SEQ ID NO: 2330160 - RNA, 19 nt, Yersinia pestis KIM
gcagauaugaugcggaaga

SEQ ID NO: 2330161 - RNA, 18 nt, Yersinia pestis KIM
gcagauaauccccuugug

SEQ ID NO: 2330162 - RNA, 23 nt, Yersinia pestis KIM
gcagagccaauccccagaagcgc

SEQ ID NO: 2330163 - RNA, 15 nt, Yersinia pestis KIM
gcagagaugcagugu

SEQ ID NO: 2330164 - RNA, 15 nt, Yersinia pestis KIM
gcagagcaaaacugg

SEQ ID NO: 2330165 - RNA, 18 nt, Yersinia pestis KIM
gcagaguccucucaccaa

SEQ ID NO: 2330166 - RNA, 19 nt, Yersinia pestis KIM
gcagaguccucucaccaag

SEQ ID NO: 2330167 - RNA, 14 nt, Yersinia pestis KIM
gcagccgccgcugg

SEQ ID NO: 2330168 - RNA, 16 nt, Yersinia pestis KIM
gcagcgacaaccugua

SEQ ID NO: 2330169 - RNA, 15 nt, Yersinia pestis KIM
gcagccugcggcggc

SEQ ID NO: 2330170 - RNA, 19 nt, Yersinia pestis KIM
gcagccuuuauccagccac

SEQ ID NO: 2330171 - RNA, 21 nt, Yersinia pestis KIM
gcagccuuuauccagccaccu

SEQ ID NO: 2330172 - RNA, 22 nt, Yersinia pestis KIM
gcagccuuuauccagccaccuu

SEQ ID NO: 2330173 - RNA, 14 nt, Yersinia pestis KIM
gcaggcuucaacua

SEQ ID NO: 2330174 - RNA, 15 nt, Yersinia pestis KIM
gcaggcuucaacuac

SEQ ID NO: 2330175 - RNA, 19 nt, Yersinia pestis KIM
gcaggcccuuucaccgcug

SEQ ID NO: 2330176 - RNA, 15 nt, Yersinia pestis KIM
gcaggcggaugauga

SEQ ID NO: 2330177 - RNA, 23 nt, Yersinia pestis KIM
gcaggccauuggcaaaggccagc

SEQ ID NO: 2330178 - RNA, 18 nt, Yersinia pestis KIM
gcaggcccagcagugcug

SEQ ID NO: 2330179 - RNA, 14 nt, Yersinia pestis KIM
gcaggcccugguug

SEQ ID NO: 2330180 - RNA, 22 nt, Yersinia pestis KIM
gcaggccagacccauuucugcu

SEQ ID NO: 2330181 - RNA, 13 nt, Yersinia pestis KIM
gcaggauuucaau

SEQ ID NO: 2330182 - RNA, 22 nt, Yersinia pestis KIM
gcaggucucgcaaugaaagugg

SEQ ID NO: 2330183 - RNA, 19 nt, Yersinia pestis KIM
gcaggugcguuaucuucac

SEQ ID NO: 2330184 - RNA, 20 nt, Yersinia pestis KIM
gcagguucggcgcaaucaua

SEQ ID NO: 2330185 - RNA, 13 nt, Yersinia pestis KIM
gcagguuaaacag

SEQ ID NO: 2330186 - RNA, 19 nt, Yersinia pestis KIM
gcagguagggcggcccacu

SEQ ID NO: 2330187 - RNA, 21 nt, Yersinia pestis KIM
gcaggucaaagaagcgcagga

SEQ ID NO: 2330188 - RNA, 22 nt, Yersinia pestis KIM
gcagguauaggcgcagaauuag

SEQ ID NO: 2330189 - RNA, 19 nt, Yersinia pestis KIM
gcagguaaugucacugcca

SEQ ID NO: 2330190 - RNA, 13 nt, Yersinia pestis KIM
gcacaaugguuga

SEQ ID NO: 2330191 - RNA, 16 nt, Yersinia pestis KIM
gcacacacagccuacg

SEQ ID NO: 2330192 - RNA, 23 nt, Yersinia pestis KIM
gcacaaugacuuaacugaaagcc

SEQ ID NO: 2330193 - RNA, 14 nt, Yersinia pestis KIM
gcacacagcccugc

SEQ ID NO: 2330194 - RNA, 19 nt, Yersinia pestis KIM
gcacacaguuauuaggcau

SEQ ID NO: 2330195 - RNA, 20 nt, Yersinia pestis KIM
gcacacaguuauuaggcauu

SEQ ID NO: 2330196 - RNA, 22 nt, Yersinia pestis KIM
gcacaaucgcgcuguacaacaa

SEQ ID NO: 2330197 - RNA, 14 nt, Yersinia pestis KIM
gcacaaucagggca

SEQ ID NO: 2330198 - RNA, 23 nt, Yersinia pestis KIM
gcacaacggaaggcccagccggg

SEQ ID NO: 2330199 - RNA, 14 nt, Yersinia pestis KIM
gcacaccacacugg

SEQ ID NO: 2330200 - RNA, 21 nt, Yersinia pestis KIM
gcacacccgauggaacuguaa

SEQ ID NO: 2330201 - RNA, 12 nt, Yersinia pestis KIM
gcacagacgccc

SEQ ID NO: 2330202 - RNA, 23 nt, Yersinia pestis KIM
gcacauaccccauuuaucgccaa

SEQ ID NO: 2330203 - RNA, 19 nt, Yersinia pestis KIM
gcacauacucaccucccug

SEQ ID NO: 2330204 - RNA, 19 nt, Yersinia pestis KIM
gcacaucauuuauuuccaa

SEQ ID NO: 2330205 - RNA, 18 nt, Yersinia pestis KIM
gcacaucgccauuagacg

SEQ ID NO: 2330206 - RNA, 23 nt, Yersinia pestis KIM
gcaccaaacagaccccagaagau

SEQ ID NO: 2330207 - RNA, 14 nt, Yersinia pestis KIM
gcaccaaaucuucc

SEQ ID NO: 2330208 - RNA, 18 nt, Yersinia pestis KIM
gcaccaaaucuuccagcg

SEQ ID NO: 2330209 - RNA, 20 nt, Yersinia pestis KIM
gcaccaaaucuuccagcggc

SEQ ID NO: 2330210 - RNA, 21 nt, Yersinia pestis KIM
gcaccaaaucuuccagcggca

SEQ ID NO: 2330211 - RNA, 13 nt, Yersinia pestis KIM
gcacaguuuucuu

SEQ ID NO: 2330212 - RNA, 14 nt, Yersinia pestis KIM
gcacauaaagcgca

SEQ ID NO: 2330213 - RNA, 18 nt, Yersinia pestis KIM
gcacaguuaauuuucacc

SEQ ID NO: 2330214 - RNA, 23 nt, Yersinia pestis KIM
gcacaguuuaucucgcugugccc

SEQ ID NO: 2330215 - RNA, 21 nt, Yersinia pestis KIM
gcaauuucucuguauuuucaa

SEQ ID NO: 2330216 - RNA, 23 nt, Yersinia pestis KIM
gcaauuucuguuaccagaaaacc

SEQ ID NO: 2330217 - RNA, 12 nt, Yersinia pestis KIM
gcaauuucucug

SEQ ID NO: 2330218 - RNA, 23 nt, Yersinia pestis KIM
gcacaaacauggcggcagcacag

SEQ ID NO: 2330219 - RNA, 17 nt, Yersinia pestis KIM
gcacaaacauggcuguc

SEQ ID NO: 2330220 - RNA, 21 nt, Yersinia pestis KIM
gcaauuggccuuccaucguca

SEQ ID NO: 2330221 - RNA, 21 nt, Yersinia pestis KIM
gcaaugucaccugaaccugac

SEQ ID NO: 2330222 - RNA, 16 nt, Yersinia pestis KIM
gcaauuaagcaaaaag

SEQ ID NO: 2330223 - RNA, 18 nt, Yersinia pestis KIM
gcaauuaagcaaaaaggc

SEQ ID NO: 2330224 - RNA, 17 nt, Yersinia pestis KIM
gcaaugcuuauuucaca

SEQ ID NO: 2330225 - RNA, 21 nt, Yersinia pestis KIM
gcaaugcuaccuguaacauua

SEQ ID NO: 2330226 - RNA, 16 nt, Yersinia pestis KIM
gcaauggcgauugugc

SEQ ID NO: 2330227 - RNA, 17 nt, Yersinia pestis KIM
gcaauggcguuccaaua

SEQ ID NO: 2330228 - RNA, 17 nt, Yersinia pestis KIM
gcaaugcagauaaccgu

SEQ ID NO: 2330229 - RNA, 15 nt, Yersinia pestis KIM
gcaaugccaugacuu

SEQ ID NO: 2330230 - RNA, 22 nt, Yersinia pestis KIM
gcaaugagugcagccaacgccc

SEQ ID NO: 2330231 - RNA, 18 nt, Yersinia pestis KIM
gcaaucuccaguaaaucu

SEQ ID NO: 2330232 - RNA, 19 nt, Yersinia pestis KIM
gcaaucaauguauugcucc

SEQ ID NO: 2330233 - RNA, 14 nt, Yersinia pestis KIM
gcaaucaauaagcu

SEQ ID NO: 2330234 - RNA, 13 nt, Yersinia pestis KIM
gcaaucaauaagc

SEQ ID NO: 2330235 - RNA, 16 nt, Yersinia pestis KIM
gcaaucagaggccauc

SEQ ID NO: 2330236 - RNA, 14 nt, Yersinia pestis KIM
gcaauccaaacaua

SEQ ID NO: 2330237 - RNA, 22 nt, Yersinia pestis KIM
gcaaucaugggccaauccaaua

SEQ ID NO: 2330238 - RNA, 17 nt, Yersinia pestis KIM
gcaagaaagaaaaauag

SEQ ID NO: 2330239 - RNA, 15 nt, Yersinia pestis KIM
aaagcggaucguguu

SEQ ID NO: 2330240 - RNA, 14 nt, Yersinia pestis KIM
aaagcgccuuccuu

SEQ ID NO: 2330241 - RNA, 14 nt, Yersinia pestis KIM
aaagcgccuuuuau

SEQ ID NO: 2330242 - RNA, 15 nt, Yersinia pestis KIM
aaagcgccuuuuauu

SEQ ID NO: 2330243 - RNA, 20 nt, Yersinia pestis KIM
aaagcgauaucguuaucaac

SEQ ID NO: 2330244 - RNA, 22 nt, Yersinia pestis KIM
gcaacugaguaguggagccacu

SEQ ID NO: 2330245 - RNA, 16 nt, Yersinia pestis KIM
gcaacugcaaauguuc

SEQ ID NO: 2330246 - RNA, 22 nt, Yersinia pestis KIM
gcaacguuuuaccugcacaggu

SEQ ID NO: 2330247 - RNA, 18 nt, Yersinia pestis KIM
gcaacuccuuaccacugc

SEQ ID NO: 2330248 - RNA, 23 nt, Yersinia pestis KIM
gcaacucuucuucuguugcuuca

SEQ ID NO: 2330249 - RNA, 20 nt, Yersinia pestis KIM
gcaacgguuucaacuucaac

SEQ ID NO: 2330250 - RNA, 21 nt, Yersinia pestis KIM
gcaacguaauaucugccaccg

SEQ ID NO: 2330251 - RNA, 18 nt, Yersinia pestis KIM
gcaacguuaaagaugaag

SEQ ID NO: 2330252 - RNA, 17 nt, Yersinia pestis KIM
gcaacgccgaugaaggu

SEQ ID NO: 2330253 - RNA, 15 nt, Yersinia pestis KIM
gcaacgccagugacu

SEQ ID NO: 2330254 - RNA, 20 nt, Yersinia pestis KIM
gcaacgcggaauagccggcg

SEQ ID NO: 2330255 - RNA, 20 nt, Yersinia pestis KIM
gaucacaucacagugccaaa

SEQ ID NO: 2330256 - RNA, 22 nt, Yersinia pestis KIM
gaucacaucacagugccaaaag

SEQ ID NO: 2330257 - RNA, 19 nt, Yersinia pestis KIM
gaucacagcucucugagcc

SEQ ID NO: 2330258 - RNA, 18 nt, Yersinia pestis KIM
gaucaauguuaucgccaa

SEQ ID NO: 2330259 - RNA, 18 nt, Yersinia pestis KIM
gcaacgacguuaucaaua

SEQ ID NO: 2330260 - RNA, 21 nt, Yersinia pestis KIM
gcaacgaaaugucgaaagaua

SEQ ID NO: 2330261 - RNA, 17 nt, Yersinia pestis KIM
gcaagccaaaacagccu

SEQ ID NO: 2330262 - RNA, 16 nt, Yersinia pestis KIM
gcaagcgcguuagccu

SEQ ID NO: 2330263 - RNA, 16 nt, Yersinia pestis KIM
gcaagcaaccgcaaug

SEQ ID NO: 2330264 - RNA, 16 nt, Yersinia pestis KIM
gcaagacgguauuuag

SEQ ID NO: 2330265 - RNA, 20 nt, Yersinia pestis KIM
gcaagcguuuuacugcuucu

SEQ ID NO: 2330266 - RNA, 18 nt, Yersinia pestis KIM
gcaauaacaccagcaggu

SEQ ID NO: 2330267 - RNA, 15 nt, Yersinia pestis KIM
gcaauaaaccacugg

SEQ ID NO: 2330268 - RNA, 21 nt, Yersinia pestis KIM
gcaaguggguaauguugcaaa

SEQ ID NO: 2330269 - RNA, 13 nt, Yersinia pestis KIM
gcaagguucucgc

SEQ ID NO: 2330270 - RNA, 23 nt, Yersinia pestis KIM
gcaauauccgugauuaaccuuaa

SEQ ID NO: 2330271 - RNA, 17 nt, Yersinia pestis KIM
gcaauauaauaaucuau

SEQ ID NO: 2330272 - RNA, 16 nt, Yersinia pestis KIM
gcaauaauagccaccg

SEQ ID NO: 2330273 - RNA, 20 nt, Yersinia pestis KIM
gcaauaaggugccacacaga

SEQ ID NO: 2330274 - RNA, 15 nt, Yersinia pestis KIM
gcaauaaccaacggg

SEQ ID NO: 2330275 - RNA, 14 nt, Yersinia pestis KIM
gcaccacggucaga

SEQ ID NO: 2330276 - RNA, 16 nt, Yersinia pestis KIM
gcaccacuaaggucau

SEQ ID NO: 2330277 - RNA, 14 nt, Yersinia pestis KIM
gcaccaaugccggu

SEQ ID NO: 2330278 - RNA, 18 nt, Yersinia pestis KIM
gcaccaacgcuaccgacu

SEQ ID NO: 2330279 - RNA, 23 nt, Yersinia pestis KIM
gcacccggcuggcaccaagcagc

SEQ ID NO: 2330280 - RNA, 14 nt, Yersinia pestis KIM
gcaccagugccaau

SEQ ID NO: 2330281 - RNA, 14 nt, Yersinia pestis KIM
gcaccauccagcaa

SEQ ID NO: 2330282 - RNA, 14 nt, Yersinia pestis KIM
gcaccauuugcccu

SEQ ID NO: 2330283 - RNA, 21 nt, Yersinia pestis KIM
gcacccacggcgggcaacaga

SEQ ID NO: 2330284 - RNA, 23 nt, Yersinia pestis KIM
gcacccacggcgggcaacagaga

SEQ ID NO: 2330285 - RNA, 15 nt, Yersinia pestis KIM
gcaccgguguucacu

SEQ ID NO: 2330286 - RNA, 23 nt, Yersinia pestis KIM
gcaccgguguucacucgcgugcc

SEQ ID NO: 2330287 - RNA, 20 nt, Yersinia pestis KIM
gcaccucugcugaugucagu

SEQ ID NO: 2330288 - RNA, 15 nt, Yersinia pestis KIM
gcaccucggggcacu

SEQ ID NO: 2330289 - RNA, 16 nt, Yersinia pestis KIM
gcaccugaucgugcca

SEQ ID NO: 2330290 - RNA, 21 nt, Yersinia pestis KIM
gcaccgcugauaaccagcagc

SEQ ID NO: 2330291 - RNA, 21 nt, Yersinia pestis KIM
gcaccgcgcuauaaaacagcu

SEQ ID NO: 2330292 - RNA, 13 nt, Yersinia pestis KIM
gcaccgcgcuaua

SEQ ID NO: 2330293 - RNA, 22 nt, Yersinia pestis KIM
gcaccgccgucaaaccaagccc

SEQ ID NO: 2330294 - RNA, 15 nt, Yersinia pestis KIM
gcacgcuuucugcaa

SEQ ID NO: 2330295 - RNA, 13 nt, Yersinia pestis KIM
gcacgggccuugg

SEQ ID NO: 2330296 - RNA, 15 nt, Yersinia pestis KIM
gcacggccgggugca

SEQ ID NO: 2330297 - RNA, 15 nt, Yersinia pestis KIM
gcacggcaacaggcu

SEQ ID NO: 2330298 - RNA, 23 nt, Yersinia pestis KIM
gcacgacggauuugguuggcuuu

SEQ ID NO: 2330299 - RNA, 22 nt, Yersinia pestis KIM
gcacgaaccguggcgcggaugc

SEQ ID NO: 2330300 - RNA, 22 nt, Yersinia pestis KIM
gcacgaaccugagcgaucaaua

SEQ ID NO: 2330301 - RNA, 22 nt, Yersinia pestis KIM
gcaccuucaacgauauagagcu

SEQ ID NO: 2330302 - RNA, 22 nt, Yersinia pestis KIM
gcacugugagcggcauccagua

SEQ ID NO: 2330303 - RNA, 19 nt, Yersinia pestis KIM
gcacuucaaccugauccag

SEQ ID NO: 2330304 - RNA, 14 nt, Yersinia pestis KIM
gcacuucaaccuga

SEQ ID NO: 2330305 - RNA, 18 nt, Yersinia pestis KIM
gcacugccccgaagcuca

SEQ ID NO: 2330306 - RNA, 20 nt, Yersinia pestis KIM
gcacugccccgaagcucaag

SEQ ID NO: 2330307 - RNA, 13 nt, Yersinia pestis KIM
gcacugccccgaa

SEQ ID NO: 2330308 - RNA, 22 nt, Yersinia pestis KIM
gcacugcagaaaaugcggcggc

SEQ ID NO: 2330309 - RNA, 15 nt, Yersinia pestis KIM
gcacugcagaaaaug

SEQ ID NO: 2330310 - RNA, 17 nt, Yersinia pestis KIM
gcacugcaucugaccag

SEQ ID NO: 2330311 - RNA, 23 nt, Yersinia pestis KIM
gcacugcagaaaaugcggcggcu

SEQ ID NO: 2330312 - RNA, 14 nt, Yersinia pestis KIM
gcacugcucugccc

SEQ ID NO: 2330313 - RNA, 18 nt, Yersinia pestis KIM
gcacugcgcgaucccaga

SEQ ID NO: 2330314 - RNA, 15 nt, Yersinia pestis KIM
gcacuuuaaauaccc

SEQ ID NO: 2330315 - RNA, 17 nt, Yersinia pestis KIM
gcacuuuaaauacccag

SEQ ID NO: 2330316 - RNA, 22 nt, Yersinia pestis KIM
gcacuuuuauacauucgagcua

SEQ ID NO: 2330317 - RNA, 17 nt, Yersinia pestis KIM
gcacucgaaucacuuau

SEQ ID NO: 2330318 - RNA, 19 nt, Yersinia pestis KIM
gcacuccacuaugcccagu

SEQ ID NO: 2330319 - RNA, 22 nt, Yersinia pestis KIM
gcacuccccgcccguagaaaau

SEQ ID NO: 2330320 - RNA, 17 nt, Yersinia pestis KIM
gcacugauucucuucac

SEQ ID NO: 2330321 - RNA, 18 nt, Yersinia pestis KIM
gcacugauucucuucacc

SEQ ID NO: 2330322 - RNA, 21 nt, Yersinia pestis KIM
gcacugauuuuuucgaguagu

SEQ ID NO: 2330323 - RNA, 16 nt, Yersinia pestis KIM
gcacugauagccaaca

SEQ ID NO: 2330324 - RNA, 17 nt, Yersinia pestis KIM
gcacugauagccaacac

SEQ ID NO: 2330325 - RNA, 14 nt, Yersinia pestis KIM
gcacugaguucugc

SEQ ID NO: 2330326 - RNA, 18 nt, Yersinia pestis KIM
gcacugagccgaagaaca

SEQ ID NO: 2330327 - RNA, 16 nt, Yersinia pestis KIM
gcacguuuccccuuca

SEQ ID NO: 2330328 - RNA, 16 nt, Yersinia pestis KIM
gcacguuuaauuucac

SEQ ID NO: 2330329 - RNA, 12 nt, Yersinia pestis KIM
gcacuaucaccg

SEQ ID NO: 2330330 - RNA, 23 nt, Yersinia pestis KIM
gcugcccaaccgcaucgugcucc

SEQ ID NO: 2330331 - RNA, 15 nt, Yersinia pestis KIM
gcugcccgcacacug

SEQ ID NO: 2330332 - RNA, 16 nt, Yersinia pestis KIM
gcugcccgcacacuga

SEQ ID NO: 2330333 - RNA, 20 nt, Yersinia pestis KIM
gcugcaucuggucaucaugu

SEQ ID NO: 2330334 - RNA, 15 nt, Yersinia pestis KIM
gcugcacaucauuua

SEQ ID NO: 2330335 - RNA, 21 nt, Yersinia pestis KIM
gcugcacaucauuuauuucca

SEQ ID NO: 2330336 - RNA, 22 nt, Yersinia pestis KIM
gcugcacaaguuggugcaguug

SEQ ID NO: 2330337 - RNA, 18 nt, Yersinia pestis KIM
gcugcaccucugcugaug

SEQ ID NO: 2330338 - RNA, 15 nt, Yersinia pestis KIM
gcugaugcaauaacu

SEQ ID NO: 2330339 - RNA, 18 nt, Yersinia pestis KIM
gcugaguaaagaucccca

SEQ ID NO: 2330340 - RNA, 20 nt, Yersinia pestis KIM
gcugaguaaagcccagcagg

SEQ ID NO: 2330341 - RNA, 18 nt, Yersinia pestis KIM
gcugaggucagugcugca

SEQ ID NO: 2330342 - RNA, 19 nt, Yersinia pestis KIM
gcugaggcgacacccgcuu

SEQ ID NO: 2330343 - RNA, 14 nt, Yersinia pestis KIM
gcugauaauuuauu

SEQ ID NO: 2330344 - RNA, 14 nt, Yersinia pestis KIM
gcugagugaagaca

SEQ ID NO: 2330345 - RNA, 15 nt, Yersinia pestis KIM
gcugagugaagacau

SEQ ID NO: 2330346 - RNA, 15 nt, Yersinia pestis KIM
gcugauaaccagcag

SEQ ID NO: 2330347 - RNA, 18 nt, Yersinia pestis KIM
gcugaggauaggccgggg

SEQ ID NO: 2330348 - RNA, 21 nt, Yersinia pestis KIM
gcugaccauggcgaucaaagg

SEQ ID NO: 2330349 - RNA, 16 nt, Yersinia pestis KIM
gcugacauuuucuauc

SEQ ID NO: 2330350 - RNA, 16 nt, Yersinia pestis KIM
gcucuuugauuccucu

SEQ ID NO: 2330351 - RNA, 18 nt, Yersinia pestis KIM
gcucuaacgucagauaaa

SEQ ID NO: 2330352 - RNA, 22 nt, Yersinia pestis KIM
gcucuccacucggucaaccguu

SEQ ID NO: 2330353 - RNA, 18 nt, Yersinia pestis KIM
gcucucugagccauccag

SEQ ID NO: 2330354 - RNA, 19 nt, Yersinia pestis KIM
gcucucugaguaccagcaa

SEQ ID NO: 2330355 - RNA, 18 nt, Yersinia pestis KIM
gcucucauauccccccca

SEQ ID NO: 2330356 - RNA, 19 nt, Yersinia pestis KIM
gcucucacugcuccagcca

SEQ ID NO: 2330357 - RNA, 20 nt, Yersinia pestis KIM
gcucuaugccaguuauuauu

SEQ ID NO: 2330358 - RNA, 22 nt, Yersinia pestis KIM
gcucuauuucaugauucucuau

SEQ ID NO: 2330359 - RNA, 19 nt, Yersinia pestis KIM
gcucugccuuaugaauaua

SEQ ID NO: 2330360 - RNA, 14 nt, Yersinia pestis KIM
gcucugccaauaaa

SEQ ID NO: 2330361 - RNA, 17 nt, Yersinia pestis KIM
gcucugauaguauuaga

SEQ ID NO: 2330362 - RNA, 21 nt, Yersinia pestis KIM
gcucucuuuuuucucuuucuu

SEQ ID NO: 2330363 - RNA, 18 nt, Yersinia pestis KIM
gcucuucaccaaaggaag

SEQ ID NO: 2330364 - RNA, 17 nt, Yersinia pestis KIM
gcucuucccugcgcuga

SEQ ID NO: 2330365 - RNA, 16 nt, Yersinia pestis KIM
gcucuucuucacugag

SEQ ID NO: 2330366 - RNA, 19 nt, Yersinia pestis KIM
gcucugggacgugcauaaa

SEQ ID NO: 2330367 - RNA, 21 nt, Yersinia pestis KIM
gcucugggacgugcauaaaac

SEQ ID NO: 2330368 - RNA, 13 nt, Yersinia pestis KIM
gcuggcgagagcu

SEQ ID NO: 2330369 - RNA, 17 nt, Yersinia pestis KIM
gcuggcccccaaugaca

SEQ ID NO: 2330370 - RNA, 20 nt, Yersinia pestis KIM
gcuggccaguuucgguacca

SEQ ID NO: 2330371 - RNA, 13 nt, Yersinia pestis KIM
gcuggcauacuga

SEQ ID NO: 2330372 - RNA, 14 nt, Yersinia pestis KIM
gcuggcauacugac

SEQ ID NO: 2330373 - RNA, 12 nt, Yersinia pestis KIM
gcuggcauuuuu

SEQ ID NO: 2330374 - RNA, 13 nt, Yersinia pestis KIM
gcuggaucagcag

SEQ ID NO: 2330375 - RNA, 22 nt, Yersinia pestis KIM
gcuggcagccuuuauccagcca

SEQ ID NO: 2330376 - RNA, 15 nt, Yersinia pestis KIM
gcugcugcagccggg

SEQ ID NO: 2330377 - RNA, 23 nt, Yersinia pestis KIM
gcugcuguugccaugccauggca

SEQ ID NO: 2330378 - RNA, 19 nt, Yersinia pestis KIM
gcugcuuuuacgcaaguaa

SEQ ID NO: 2330379 - RNA, 20 nt, Yersinia pestis KIM
gcugcggcuugggagucaga

SEQ ID NO: 2330380 - RNA, 23 nt, Yersinia pestis KIM
gcugcgucuuuaucgccagcugc

SEQ ID NO: 2330381 - RNA, 20 nt, Yersinia pestis KIM
gcugcucgacuugggcuucc

SEQ ID NO: 2330382 - RNA, 20 nt, Yersinia pestis KIM
gcugguaauccacccggcau

SEQ ID NO: 2330383 - RNA, 18 nt, Yersinia pestis KIM
gcugguagugauccccca

SEQ ID NO: 2330384 - RNA, 13 nt, Yersinia pestis KIM
aaagcuguaucga

SEQ ID NO: 2330385 - RNA, 14 nt, Yersinia pestis KIM
aaagcugucauaaa

SEQ ID NO: 2330386 - RNA, 23 nt, Yersinia pestis KIM
gcuggcuuuuugcugacgggguc

SEQ ID NO: 2330387 - RNA, 16 nt, Yersinia pestis KIM
gcuggcuuuuuuguuu

SEQ ID NO: 2330388 - RNA, 19 nt, Yersinia pestis KIM
gcuguacugcugcaacuca

SEQ ID NO: 2330389 - RNA, 13 nt, Yersinia pestis KIM
gcugugagccaga

SEQ ID NO: 2330390 - RNA, 14 nt, Yersinia pestis KIM
gcugucugaauagu

SEQ ID NO: 2330391 - RNA, 23 nt, Yersinia pestis KIM
gcuguaacuaccugcuuuaccau

SEQ ID NO: 2330392 - RNA, 14 nt, Yersinia pestis KIM
gcuguaaauaaaua

SEQ ID NO: 2330393 - RNA, 17 nt, Yersinia pestis KIM
gcuguaaacuggcagau

SEQ ID NO: 2330394 - RNA, 17 nt, Yersinia pestis KIM
gcugguuaucacagcaa

SEQ ID NO: 2330395 - RNA, 20 nt, Yersinia pestis KIM
gcugguuaucacagcaaauu

SEQ ID NO: 2330396 - RNA, 19 nt, Yersinia pestis KIM
gcugguguaacggcugcug

SEQ ID NO: 2330397 - RNA, 21 nt, Yersinia pestis KIM
aaagcuuccaauauugagcag

SEQ ID NO: 2330398 - RNA, 19 nt, Yersinia pestis KIM
gcuauuggcugauucaaca

SEQ ID NO: 2330399 - RNA, 21 nt, Yersinia pestis KIM
gcuauugcuuuuauugccuac

SEQ ID NO: 2330400 - RNA, 22 nt, Yersinia pestis KIM
gcuauugcuuuuauugccuaca

SEQ ID NO: 2330401 - RNA, 13 nt, Yersinia pestis KIM
gcuauugcaacgc

SEQ ID NO: 2330402 - RNA, 14 nt, Yersinia pestis KIM
gcuauucuuagccu

SEQ ID NO: 2330403 - RNA, 20 nt, Yersinia pestis KIM
gcuauuagccagaaauagca

SEQ ID NO: 2330404 - RNA, 13 nt, Yersinia pestis KIM
gcuauucagauca

SEQ ID NO: 2330405 - RNA, 18 nt, Yersinia pestis KIM
gcuauuaaacauuuaugu

SEQ ID NO: 2330406 - RNA, 18 nt, Yersinia pestis KIM
gcuauguuggcaaauaau

SEQ ID NO: 2330407 - RNA, 11 nt, Yersinia pestis KIM
gcuaucuguua

SEQ ID NO: 2330408 - RNA, 16 nt, Yersinia pestis KIM
gcuaucuuauuuaccu

SEQ ID NO: 2330409 - RNA, 15 nt, Yersinia pestis KIM
gcuaugcagcccaga

SEQ ID NO: 2330410 - RNA, 22 nt, Yersinia pestis KIM
gcuauggauaaauccugaacau

SEQ ID NO: 2330411 - RNA, 15 nt, Yersinia pestis KIM
gcuauggauaaaucc

SEQ ID NO: 2330412 - RNA, 15 nt, Yersinia pestis KIM
gcuauuuuuucucac

SEQ ID NO: 2330413 - RNA, 15 nt, Yersinia pestis KIM
gcucaacugcucaac

SEQ ID NO: 2330414 - RNA, 16 nt, Yersinia pestis KIM
gcucaacugcucaacu

SEQ ID NO: 2330415 - RNA, 17 nt, Yersinia pestis KIM
gcucaacugcucaacug

SEQ ID NO: 2330416 - RNA, 13 nt, Yersinia pestis KIM
gcucaagccucua

SEQ ID NO: 2330417 - RNA, 12 nt, Yersinia pestis KIM
gcucaagcuggu

SEQ ID NO: 2330418 - RNA, 16 nt, Yersinia pestis KIM
gcuagcaaauuccgcu

SEQ ID NO: 2330419 - RNA, 17 nt, Yersinia pestis KIM
gcuagcccccagggagg

SEQ ID NO: 2330420 - RNA, 21 nt, Yersinia pestis KIM
gcuacuuaauaucuaacugau

SEQ ID NO: 2330421 - RNA, 14 nt, Yersinia pestis KIM
gcuagaaaucacac

SEQ ID NO: 2330422 - RNA, 22 nt, Yersinia pestis KIM
gcuaucgcgaaacucuuccuug

SEQ ID NO: 2330423 - RNA, 22 nt, Yersinia pestis KIM
gcuaucacgauaaucaaugcca

SEQ ID NO: 2330424 - RNA, 23 nt, Yersinia pestis KIM
gcuauauugcgcugcgccaauac

SEQ ID NO: 2330425 - RNA, 15 nt, Yersinia pestis KIM
gcuauaucaucagca

SEQ ID NO: 2330426 - RNA, 22 nt, Yersinia pestis KIM
gcucacgcaaagggcaacaaua

SEQ ID NO: 2330427 - RNA, 15 nt, Yersinia pestis KIM
gcucacgucaccacg

SEQ ID NO: 2330428 - RNA, 19 nt, Yersinia pestis KIM
gcucacccauuuuauccuc

SEQ ID NO: 2330429 - RNA, 12 nt, Yersinia pestis KIM
gcucaccacuga

SEQ ID NO: 2330430 - RNA, 15 nt, Yersinia pestis KIM
gcucaauuaaccuga

SEQ ID NO: 2330431 - RNA, 16 nt, Yersinia pestis KIM
gcucaauggcgggggc

SEQ ID NO: 2330432 - RNA, 15 nt, Yersinia pestis KIM
gcucagcgggcuaaa

SEQ ID NO: 2330433 - RNA, 14 nt, Yersinia pestis KIM
gcucaggaaucuuc

SEQ ID NO: 2330434 - RNA, 13 nt, Yersinia pestis KIM
gcucagccaggca

SEQ ID NO: 2330435 - RNA, 15 nt, Yersinia pestis KIM
gcucagccaggcagc

SEQ ID NO: 2330436 - RNA, 14 nt, Yersinia pestis KIM
gcucagcaagaacu

SEQ ID NO: 2330437 - RNA, 17 nt, Yersinia pestis KIM
gcucagauacaucaaug

SEQ ID NO: 2330438 - RNA, 20 nt, Yersinia pestis KIM
gcucacuuuuauccagccau

SEQ ID NO: 2330439 - RNA, 16 nt, Yersinia pestis KIM
gcucacuuuuauccag

SEQ ID NO: 2330440 - RNA, 16 nt, Yersinia pestis KIM
gcucaguauucgccag

SEQ ID NO: 2330441 - RNA, 15 nt, Yersinia pestis KIM
gcucaguugaugcaa

SEQ ID NO: 2330442 - RNA, 13 nt, Yersinia pestis KIM
gcucagggccacu

SEQ ID NO: 2330443 - RNA, 22 nt, Yersinia pestis KIM
gcucagggccacuucgguggcc

SEQ ID NO: 2330444 - RNA, 18 nt, Yersinia pestis KIM
gcucaggcucaucaccuu

SEQ ID NO: 2330445 - RNA, 16 nt, Yersinia pestis KIM
gcucauuaaacuguuc

SEQ ID NO: 2330446 - RNA, 21 nt, Yersinia pestis KIM
gcucauuaaacuguucuuauu

SEQ ID NO: 2330447 - RNA, 15 nt, Yersinia pestis KIM
gcucauuaccaauac

SEQ ID NO: 2330448 - RNA, 19 nt, Yersinia pestis KIM
gcuccaccguucagguuua

SEQ ID NO: 2330449 - RNA, 21 nt, Yersinia pestis KIM
gcuccacuacucaguugcagu

SEQ ID NO: 2330450 - RNA, 20 nt, Yersinia pestis KIM
gcucccccggaucacuggcu

SEQ ID NO: 2330451 - RNA, 14 nt, Yersinia pestis KIM
gcuaaauacugcug

SEQ ID NO: 2330452 - RNA, 15 nt, Yersinia pestis KIM
gcuaaauacugcugg

SEQ ID NO: 2330453 - RNA, 15 nt, Yersinia pestis KIM
gcuaaaugacauauu

SEQ ID NO: 2330454 - RNA, 22 nt, Yersinia pestis KIM
gcuaacaugguaugccacuuaa

SEQ ID NO: 2330455 - RNA, 17 nt, Yersinia pestis KIM
gcuaaccccugcaucuu

SEQ ID NO: 2330456 - RNA, 16 nt, Yersinia pestis KIM
gcuaaccacagcaaug

SEQ ID NO: 2330457 - RNA, 22 nt, Yersinia pestis KIM
gcuaaacuaaaacagcuaacac

SEQ ID NO: 2330458 - RNA, 22 nt, Yersinia pestis KIM
gcuaaagggcugagcggaucga

SEQ ID NO: 2330459 - RNA, 10 nt, Yersinia pestis KIM
gcuaaacaag

SEQ ID NO: 2330460 - RNA, 12 nt, Yersinia pestis KIM
gcuaaacagggu

SEQ ID NO: 2330461 - RNA, 18 nt, Yersinia pestis KIM
gcuaaugagauuaauuca

SEQ ID NO: 2330462 - RNA, 21 nt, Yersinia pestis KIM
gcuaaugaguagcuaauaaaa

SEQ ID NO: 2330463 - RNA, 22 nt, Yersinia pestis KIM
gcuaaugcccgacgugagcguu

SEQ ID NO: 2330464 - RNA, 15 nt, Yersinia pestis KIM
gcuaauaauuguuca

SEQ ID NO: 2330465 - RNA, 19 nt, Yersinia pestis KIM
gcuaauauuuauaaaaaau

SEQ ID NO: 2330466 - RNA, 19 nt, Yersinia pestis KIM
gcuaauauuuucagcccua

SEQ ID NO: 2330467 - RNA, 14 nt, Yersinia pestis KIM
gcuaaucaguuccc

SEQ ID NO: 2330468 - RNA, 19 nt, Yersinia pestis KIM
gcuaauagaucagccaaau

SEQ ID NO: 2330469 - RNA, 21 nt, Yersinia pestis KIM
gcuaacgcuuucagguuguua

SEQ ID NO: 2330470 - RNA, 22 nt, Yersinia pestis KIM
gcuaacguuuauuuauaagaac

SEQ ID NO: 2330471 - RNA, 16 nt, Yersinia pestis KIM
gcuaacugucauuguc

SEQ ID NO: 2330472 - RNA, 21 nt, Yersinia pestis KIM
gcuaacuggcggggcaaauag

SEQ ID NO: 2330473 - RNA, 19 nt, Yersinia pestis KIM
gcuaagcggcguacugucu

SEQ ID NO: 2330474 - RNA, 19 nt, Yersinia pestis KIM
gcuaccgcgcugcuugcaa

SEQ ID NO: 2330475 - RNA, 13 nt, Yersinia pestis KIM
gcuaccugcacca

SEQ ID NO: 2330476 - RNA, 20 nt, Yersinia pestis KIM
gcuacgggcaaacuccucca

SEQ ID NO: 2330477 - RNA, 18 nt, Yersinia pestis KIM
gcuacggcaccuuuuuug

SEQ ID NO: 2330478 - RNA, 23 nt, Yersinia pestis KIM
gcuacugcuuuuuauugucucua

SEQ ID NO: 2330479 - RNA, 18 nt, Yersinia pestis KIM
gcuacugguaauaaugcu

SEQ ID NO: 2330480 - RNA, 17 nt, Yersinia pestis KIM
gcuacagcucagacugg

SEQ ID NO: 2330481 - RNA, 21 nt, Yersinia pestis KIM
gcuaccaaggcugguggcuga

SEQ ID NO: 2330482 - RNA, 19 nt, Yersinia pestis KIM
gcuaccaggaagcggccag

SEQ ID NO: 2330483 - RNA, 21 nt, Yersinia pestis KIM
gcuaauuauuuuauuuaaaau

SEQ ID NO: 2330484 - RNA, 13 nt, Yersinia pestis KIM
gcuaaugugauga

SEQ ID NO: 2330485 - RNA, 20 nt, Yersinia pestis KIM
gcuaaugugaugaaacuaaa

SEQ ID NO: 2330486 - RNA, 23 nt, Yersinia pestis KIM
gcuaauucuggguacaacacaaa

SEQ ID NO: 2330487 - RNA, 19 nt, Yersinia pestis KIM
gcuaauucugcgccuauac

SEQ ID NO: 2330488 - RNA, 15 nt, Yersinia pestis KIM
gcuaauuuucccugu

SEQ ID NO: 2330489 - RNA, 17 nt, Yersinia pestis KIM
gcuacaagcaugugaug

SEQ ID NO: 2330490 - RNA, 13 nt, Yersinia pestis KIM
gcuacagcagcag

SEQ ID NO: 2330491 - RNA, 13 nt, Yersinia pestis KIM
gcuacagcgucag

SEQ ID NO: 2330492 - RNA, 16 nt, Yersinia pestis KIM
gcguugucagccaugc

SEQ ID NO: 2330493 - RNA, 15 nt, Yersinia pestis KIM
gcguuguaauaacgc

SEQ ID NO: 2330494 - RNA, 19 nt, Yersinia pestis KIM
gcguugacuuucuaagcug

SEQ ID NO: 2330495 - RNA, 22 nt, Yersinia pestis KIM
gcguugacuuucuaagcugccu

SEQ ID NO: 2330496 - RNA, 23 nt, Yersinia pestis KIM
gcguugacuuucuaagcugccug

SEQ ID NO: 2330497 - RNA, 16 nt, Yersinia pestis KIM
gcguucugcaaacccu

SEQ ID NO: 2330498 - RNA, 21 nt, Yersinia pestis KIM
gcguugacagacaacgggcgg

SEQ ID NO: 2330499 - RNA, 18 nt, Yersinia pestis KIM
gcguuuaaaguaaaucag

SEQ ID NO: 2330500 - RNA, 23 nt, Yersinia pestis KIM
gcguuuacucgcuccgagcgugc

SEQ ID NO: 2330501 - RNA, 22 nt, Yersinia pestis KIM
gcguuucauuuuaacaauuuua

SEQ ID NO: 2330502 - RNA, 15 nt, Yersinia pestis KIM
gcguuuuuuugccag

SEQ ID NO: 2330503 - RNA, 13 nt, Yersinia pestis KIM
gcguuuuuucggg

SEQ ID NO: 2330504 - RNA, 19 nt, Yersinia pestis KIM
gcguuuuuucguuuacuug

SEQ ID NO: 2330505 - RNA, 19 nt, Yersinia pestis KIM
gcguuacagcaaggcagaa

SEQ ID NO: 2330506 - RNA, 19 nt, Yersinia pestis KIM
gcguuacacaucaggcugu

SEQ ID NO: 2330507 - RNA, 20 nt, Yersinia pestis KIM
gcguuacaguaaggcagcaa

SEQ ID NO: 2330508 - RNA, 20 nt, Yersinia pestis KIM
gcguuauugcgacauaaagc

SEQ ID NO: 2330509 - RNA, 21 nt, Yersinia pestis KIM
gcguuagcguacaagacaaua

SEQ ID NO: 2330510 - RNA, 15 nt, Yersinia pestis KIM
gcguuaauuaagacc

SEQ ID NO: 2330511 - RNA, 16 nt, Yersinia pestis KIM
gcguggugcgguaguu

SEQ ID NO: 2330512 - RNA, 19 nt, Yersinia pestis KIM
gcgcgcccagacgccggcc

SEQ ID NO: 2330513 - RNA, 22 nt, Yersinia pestis KIM
gcgcgaucccagaauggcaaag

SEQ ID NO: 2330514 - RNA, 16 nt, Yersinia pestis KIM
gcgaucagguuguucc

SEQ ID NO: 2330515 - RNA, 23 nt, Yersinia pestis KIM
gcgauccaaaacaucggccagcg

SEQ ID NO: 2330516 - RNA, 21 nt, Yersinia pestis KIM
gcgcgggaaaagguaaacaga

SEQ ID NO: 2330517 - RNA, 13 nt, Yersinia pestis KIM
gcgcgucgccugg

SEQ ID NO: 2330518 - RNA, 19 nt, Yersinia pestis KIM
gcgcgucgccauaaccaga

SEQ ID NO: 2330519 - RNA, 15 nt, Yersinia pestis KIM
gcgcucauacucagu

SEQ ID NO: 2330520 - RNA, 17 nt, Yersinia pestis KIM
gcgcuccacgccccaac

SEQ ID NO: 2330521 - RNA, 21 nt, Yersinia pestis KIM
gcggccuuaauggccgccauu

SEQ ID NO: 2330522 - RNA, 17 nt, Yersinia pestis KIM
gcggcgauuucaucagc

SEQ ID NO: 2330523 - RNA, 22 nt, Yersinia pestis KIM
gcggccaucaauuuggcaugug

SEQ ID NO: 2330524 - RNA, 17 nt, Yersinia pestis KIM
gcggcauauaaccaugc

SEQ ID NO: 2330525 - RNA, 11 nt, Yersinia pestis KIM
gcgcugacggu

SEQ ID NO: 2330526 - RNA, 21 nt, Yersinia pestis KIM
gcgcugaauuuuugugcuagc

SEQ ID NO: 2330527 - RNA, 12 nt, Yersinia pestis KIM
gcgcugaccuaa

SEQ ID NO: 2330528 - RNA, 16 nt, Yersinia pestis KIM
gcggauaacggcggca

SEQ ID NO: 2330529 - RNA, 21 nt, Yersinia pestis KIM
gcggauaaucuaggccugggu

SEQ ID NO: 2330530 - RNA, 15 nt, Yersinia pestis KIM
gcggaucaaccgccc

SEQ ID NO: 2330531 - RNA, 19 nt, Yersinia pestis KIM
gcggcagcacagagcacaa

SEQ ID NO: 2330532 - RNA, 13 nt, Yersinia pestis KIM
gcggcagagccaa

SEQ ID NO: 2330533 - RNA, 20 nt, Yersinia pestis KIM
gcggauucacccauuaauag

SEQ ID NO: 2330534 - RNA, 16 nt, Yersinia pestis KIM
gcggcaauaagcauua

SEQ ID NO: 2330535 - RNA, 13 nt, Yersinia pestis KIM
gcgggccugaggu

SEQ ID NO: 2330536 - RNA, 14 nt, Yersinia pestis KIM
gcgggcgcgcugcu

SEQ ID NO: 2330537 - RNA, 20 nt, Yersinia pestis KIM
gcggguuaucacauaaauaa

SEQ ID NO: 2330538 - RNA, 20 nt, Yersinia pestis KIM
gcgggugucuuuaaaaucuu

SEQ ID NO: 2330539 - RNA, 12 nt, Yersinia pestis KIM
gcggugaacagu

SEQ ID NO: 2330540 - RNA, 15 nt, Yersinia pestis KIM
gcggugacaaugaau

SEQ ID NO: 2330541 - RNA, 14 nt, Yersinia pestis KIM
gcgguggccgccuu

SEQ ID NO: 2330542 - RNA, 18 nt, Yersinia pestis KIM
gcgguuggcccuuuucaa

SEQ ID NO: 2330543 - RNA, 15 nt, Yersinia pestis KIM
gcgguuaucuggaau

SEQ ID NO: 2330544 - RNA, 13 nt, Yersinia pestis KIM
gcgguuauuuuua

SEQ ID NO: 2330545 - RNA, 16 nt, Yersinia pestis KIM
gcgguuucauggcugg

SEQ ID NO: 2330546 - RNA, 23 nt, Yersinia pestis KIM
gcgguuucaaccccuucuucacc

SEQ ID NO: 2330547 - RNA, 20 nt, Yersinia pestis KIM
gcgguugucggcauaacagg

SEQ ID NO: 2330548 - RNA, 19 nt, Yersinia pestis KIM
gcgguuuuuucuuucuuca

SEQ ID NO: 2330549 - RNA, 16 nt, Yersinia pestis KIM
gcguaaaauauuguug

SEQ ID NO: 2330550 - RNA, 14 nt, Yersinia pestis KIM
gcguaacuccuuug

SEQ ID NO: 2330551 - RNA, 12 nt, Yersinia pestis KIM
gcguaaauaaaa

SEQ ID NO: 2330552 - RNA, 19 nt, Yersinia pestis KIM
gcgucauggucucacugcg

SEQ ID NO: 2330553 - RNA, 19 nt, Yersinia pestis KIM
gcguccgcgccaaggcaag

SEQ ID NO: 2330554 - RNA, 17 nt, Yersinia pestis KIM
gcguccgcgccagggag

SEQ ID NO: 2330555 - RNA, 23 nt, Yersinia pestis KIM
gcgucaagccaacccccauuagc

SEQ ID NO: 2330556 - RNA, 22 nt, Yersinia pestis KIM
gcgucacuaaauccaaaugccc

SEQ ID NO: 2330557 - RNA, 13 nt, Yersinia pestis KIM
gcgucauaccauu

SEQ ID NO: 2330558 - RNA, 21 nt, Yersinia pestis KIM
gcgucaucgggguuugucagc

SEQ ID NO: 2330559 - RNA, 13 nt, Yersinia pestis KIM
gcguauaaacaga

SEQ ID NO: 2330560 - RNA, 20 nt, Yersinia pestis KIM
gcguaggcagcgcuccgcuu

SEQ ID NO: 2330561 - RNA, 13 nt, Yersinia pestis KIM
gcguagagucagu

SEQ ID NO: 2330562 - RNA, 23 nt, Yersinia pestis KIM
gcgugaaacguauuauucuuccc

SEQ ID NO: 2330563 - RNA, 22 nt, Yersinia pestis KIM
gcgugaaacgauaugcuccaga

SEQ ID NO: 2330564 - RNA, 21 nt, Yersinia pestis KIM
gcgucuuuagauuucaccuau

SEQ ID NO: 2330565 - RNA, 17 nt, Yersinia pestis KIM
gcgugaguuccagcccc

SEQ ID NO: 2330566 - RNA, 15 nt, Yersinia pestis KIM
gcgugcugcuuccug

SEQ ID NO: 2330567 - RNA, 15 nt, Yersinia pestis KIM
gcguggaugaccagu

SEQ ID NO: 2330568 - RNA, 20 nt, Yersinia pestis KIM
gcgugcgcccgguaauaaug

SEQ ID NO: 2330569 - RNA, 15 nt, Yersinia pestis KIM
gcgugcgaacaaaaa

SEQ ID NO: 2330570 - RNA, 12 nt, Yersinia pestis KIM
gcgugccgcagu

SEQ ID NO: 2330571 - RNA, 22 nt, Yersinia pestis KIM
gcgucucuacgacgcccgcaga

SEQ ID NO: 2330572 - RNA, 18 nt, Yersinia pestis KIM
ggcagugacaguagugag

SEQ ID NO: 2330573 - RNA, 19 nt, Yersinia pestis KIM
ggcagugacugaauggcua

SEQ ID NO: 2330574 - RNA, 15 nt, Yersinia pestis KIM
ggcagcuaaagcaaa

SEQ ID NO: 2330575 - RNA, 22 nt, Yersinia pestis KIM
ggcagucacugcugcacuggcg

SEQ ID NO: 2330576 - RNA, 22 nt, Yersinia pestis KIM
ggcauaaaaagcgacacuuauu

SEQ ID NO: 2330577 - RNA, 16 nt, Yersinia pestis KIM
ggcauuaaacugaaua

SEQ ID NO: 2330578 - RNA, 15 nt, Yersinia pestis KIM
ggccaacaggccccu

SEQ ID NO: 2330579 - RNA, 20 nt, Yersinia pestis KIM
ggccaacaucgaagggcggg

SEQ ID NO: 2330580 - RNA, 12 nt, Yersinia pestis KIM
ggccaacauaau

SEQ ID NO: 2330581 - RNA, 16 nt, Yersinia pestis KIM
ggccauguguguucuu

SEQ ID NO: 2330582 - RNA, 15 nt, Yersinia pestis KIM
ggccauuagcgcggg

SEQ ID NO: 2330583 - RNA, 14 nt, Yersinia pestis KIM
ggccaguguuuucu

SEQ ID NO: 2330584 - RNA, 14 nt, Yersinia pestis KIM
ggccaucaucuuca

SEQ ID NO: 2330585 - RNA, 17 nt, Yersinia pestis KIM
ggccagucaaaagaaac

SEQ ID NO: 2330586 - RNA, 20 nt, Yersinia pestis KIM
ggccaggcaaugagugcagc

SEQ ID NO: 2330587 - RNA, 15 nt, Yersinia pestis KIM
ggccagcauucaggc

SEQ ID NO: 2330588 - RNA, 18 nt, Yersinia pestis KIM
aaaguaucgcuaucaccg

SEQ ID NO: 2330589 - RNA, 13 nt, Yersinia pestis KIM
aaaguaucgcuau

SEQ ID NO: 2330590 - RNA, 23 nt, Yersinia pestis KIM
ggcacugcagaaaaugcggcggc

SEQ ID NO: 2330591 - RNA, 16 nt, Yersinia pestis KIM
ggcacugcagaaaaug

SEQ ID NO: 2330592 - RNA, 15 nt, Yersinia pestis KIM
ggcacugcagaaaau

SEQ ID NO: 2330593 - RNA, 20 nt, Yersinia pestis KIM
ggcacugcccugccugguau

SEQ ID NO: 2330594 - RNA, 11 nt, Yersinia pestis KIM
ggcagaaacaa

SEQ ID NO: 2330595 - RNA, 16 nt, Yersinia pestis KIM
ggcagaaacggcuauu

SEQ ID NO: 2330596 - RNA, 12 nt, Yersinia pestis KIM
ggcagcaagcaa

SEQ ID NO: 2330597 - RNA, 18 nt, Yersinia pestis KIM
ggcagaaauaauaucaag

SEQ ID NO: 2330598 - RNA, 13 nt, Yersinia pestis KIM
ggcaccaugccca

SEQ ID NO: 2330599 - RNA, 15 nt, Yersinia pestis KIM
ggcacgggcgaucac

SEQ ID NO: 2330600 - RNA, 21 nt, Yersinia pestis KIM
ggcacgccaaucaauuccaua

SEQ ID NO: 2330601 - RNA, 17 nt, Yersinia pestis KIM
ggcaauuaagcaaaaag

SEQ ID NO: 2330602 - RNA, 23 nt, Yersinia pestis KIM
ggcaauuaagcaaaaaggcugca

SEQ ID NO: 2330603 - RNA, 19 nt, Yersinia pestis KIM
ggcaauggcucaggcucau

SEQ ID NO: 2330604 - RNA, 15 nt, Yersinia pestis KIM
ggcaauacaccgcca

SEQ ID NO: 2330605 - RNA, 23 nt, Yersinia pestis KIM
ggcaauaacacggccuauugaau

SEQ ID NO: 2330606 - RNA, 16 nt, Yersinia pestis KIM
ggcaauaacaaacaca

SEQ ID NO: 2330607 - RNA, 14 nt, Yersinia pestis KIM
ggcaaucacaaccc

SEQ ID NO: 2330608 - RNA, 14 nt, Yersinia pestis KIM
ggcaccaauggcua

SEQ ID NO: 2330609 - RNA, 14 nt, Yersinia pestis KIM
ggcacaguuuaucu

SEQ ID NO: 2330610 - RNA, 22 nt, Yersinia pestis KIM
ggaucgagcuguuugcuguaaa

SEQ ID NO: 2330611 - RNA, 19 nt, Yersinia pestis KIM
ggaucgacgugaagugagc

SEQ ID NO: 2330612 - RNA, 14 nt, Yersinia pestis KIM
ggauuuaaaauccc

SEQ ID NO: 2330613 - RNA, 21 nt, Yersinia pestis KIM
ggauuucaauccgaccacuga

SEQ ID NO: 2330614 - RNA, 19 nt, Yersinia pestis KIM
ggauuuaugcaaauaauaa

SEQ ID NO: 2330615 - RNA, 20 nt, Yersinia pestis KIM
ggcaaacgcuuuuaacugug

SEQ ID NO: 2330616 - RNA, 16 nt, Yersinia pestis KIM
ggcaaauaggccgcau

SEQ ID NO: 2330617 - RNA, 18 nt, Yersinia pestis KIM
ggcaaauagagcaccaaa

SEQ ID NO: 2330618 - RNA, 19 nt, Yersinia pestis KIM
ggcaaauagaggggcgcug

SEQ ID NO: 2330619 - RNA, 14 nt, Yersinia pestis KIM
ggcaaaguguaauu

SEQ ID NO: 2330620 - RNA, 23 nt, Yersinia pestis KIM
ggcaaaguuauugaccaauauaa

SEQ ID NO: 2330621 - RNA, 12 nt, Yersinia pestis KIM
ggcaaagaagaa

SEQ ID NO: 2330622 - RNA, 22 nt, Yersinia pestis KIM
ggcaaacggguaacgaacgcuc

SEQ ID NO: 2330623 - RNA, 15 nt, Yersinia pestis KIM
ggcaacgacauguug

SEQ ID NO: 2330624 - RNA, 23 nt, Yersinia pestis KIM
gcuuuuagauaaaggcaaaagca

SEQ ID NO: 2330625 - RNA, 15 nt, Yersinia pestis KIM
gcuuuucugccuauc

SEQ ID NO: 2330626 - RNA, 16 nt, Yersinia pestis KIM
gcuuuucugccuaucu

SEQ ID NO: 2330627 - RNA, 15 nt, Yersinia pestis KIM
gcuuuuuaucauuua

SEQ ID NO: 2330628 - RNA, 13 nt, Yersinia pestis KIM
gcuuuuuaucauu

SEQ ID NO: 2330629 - RNA, 15 nt, Yersinia pestis KIM
gcuuuuuacgccuau

SEQ ID NO: 2330630 - RNA, 11 nt, Yersinia pestis KIM
gcuuuuugcuu

SEQ ID NO: 2330631 - RNA, 12 nt, Yersinia pestis KIM
gcuuuuugcuuu

SEQ ID NO: 2330632 - RNA, 17 nt, Yersinia pestis KIM
gcuuuuugcuuuuugcu

SEQ ID NO: 2330633 - RNA, 23 nt, Yersinia pestis KIM
gcuuuuuuaauaaaaaacugacu

SEQ ID NO: 2330634 - RNA, 16 nt, Yersinia pestis KIM
gcuuuuuucuagcugu

SEQ ID NO: 2330635 - RNA, 13 nt, Yersinia pestis KIM
gcuuuuuuguuuu

SEQ ID NO: 2330636 - RNA, 13 nt, Yersinia pestis KIM
ggaaaacagcaac

SEQ ID NO: 2330637 - RNA, 11 nt, Yersinia pestis KIM
gcuuugcuucu

SEQ ID NO: 2330638 - RNA, 22 nt, Yersinia pestis KIM
gcuuugguugccagauaauguu

SEQ ID NO: 2330639 - RNA, 19 nt, Yersinia pestis KIM
gcuuugaugccuaauaauu

SEQ ID NO: 2330640 - RNA, 16 nt, Yersinia pestis KIM
gcuuugacuaauacug

SEQ ID NO: 2330641 - RNA, 19 nt, Yersinia pestis KIM
gcuuugacugacaaguuuu

SEQ ID NO: 2330642 - RNA, 19 nt, Yersinia pestis KIM
gcuuugcgauacaccauuu

SEQ ID NO: 2330643 - RNA, 15 nt, Yersinia pestis KIM
gcuuucuugccauaa

SEQ ID NO: 2330644 - RNA, 17 nt, Yersinia pestis KIM
gcuuucuugccauaagc

SEQ ID NO: 2330645 - RNA, 18 nt, Yersinia pestis KIM
ggaaaauuaacuuauuga

SEQ ID NO: 2330646 - RNA, 15 nt, Yersinia pestis KIM
ggaaacaaaaccuaa

SEQ ID NO: 2330647 - RNA, 17 nt, Yersinia pestis KIM
ggaaaucaccaaaucca

SEQ ID NO: 2330648 - RNA, 23 nt, Yersinia pestis KIM
ggaauauuccauacuguugcuag

SEQ ID NO: 2330649 - RNA, 17 nt, Yersinia pestis KIM
ggaagggguucuuccaa

SEQ ID NO: 2330650 - RNA, 16 nt, Yersinia pestis KIM
ggaaggcccagccggg

SEQ ID NO: 2330651 - RNA, 21 nt, Yersinia pestis KIM
ggaaggguuuugugggagagg

SEQ ID NO: 2330652 - RNA, 16 nt, Yersinia pestis KIM
ggaauagagccucuau

SEQ ID NO: 2330653 - RNA, 20 nt, Yersinia pestis KIM
ggaauagcuguaaaauacca

SEQ ID NO: 2330654 - RNA, 16 nt, Yersinia pestis KIM
ggaagcaagaaacugu

SEQ ID NO: 2330655 - RNA, 21 nt, Yersinia pestis KIM
ggaagacuuccagcaccacua

SEQ ID NO: 2330656 - RNA, 16 nt, Yersinia pestis KIM
ggaagagauagagcag

SEQ ID NO: 2330657 - RNA, 14 nt, Yersinia pestis KIM
ggaacuuacucccu

SEQ ID NO: 2330658 - RNA, 21 nt, Yersinia pestis KIM
ggagucagaugccgcuuuagu

SEQ ID NO: 2330659 - RNA, 16 nt, Yersinia pestis KIM
ggagucgcuccucagc

SEQ ID NO: 2330660 - RNA, 12 nt, Yersinia pestis KIM
ggaguaaagcgu

SEQ ID NO: 2330661 - RNA, 20 nt, Yersinia pestis KIM
ggagugauguaauccauaca

SEQ ID NO: 2330662 - RNA, 20 nt, Yersinia pestis KIM
ggaucaccagcaaaggccac

SEQ ID NO: 2330663 - RNA, 22 nt, Yersinia pestis KIM
ggaucacauagugcaaaauucc

SEQ ID NO: 2330664 - RNA, 16 nt, Yersinia pestis KIM
ggauccuugggucagu

SEQ ID NO: 2330665 - RNA, 23 nt, Yersinia pestis KIM
ggagauacccauagcgcauuaua

SEQ ID NO: 2330666 - RNA, 15 nt, Yersinia pestis KIM
ggaggagguagcaac

SEQ ID NO: 2330667 - RNA, 15 nt, Yersinia pestis KIM
ggaggcguuuccccu

SEQ ID NO: 2330668 - RNA, 12 nt, Yersinia pestis KIM
ggaggggggauc

SEQ ID NO: 2330669 - RNA, 21 nt, Yersinia pestis KIM
ggacgauaaauucaaauauca

SEQ ID NO: 2330670 - RNA, 19 nt, Yersinia pestis KIM
ggacggcggccuuauuggg

SEQ ID NO: 2330671 - RNA, 21 nt, Yersinia pestis KIM
ggagaacaaugguucaucauu

SEQ ID NO: 2330672 - RNA, 18 nt, Yersinia pestis KIM
aaagguuggaacaccaaa

SEQ ID NO: 2330673 - RNA, 21 nt, Yersinia pestis KIM
aaagguuucugccuuaucaau

SEQ ID NO: 2330674 - RNA, 22 nt, Yersinia pestis KIM
aaagguuucugccuuaucaauc

SEQ ID NO: 2330675 - RNA, 19 nt, Yersinia pestis KIM
aaagggauuacgccaucca

SEQ ID NO: 2330676 - RNA, 15 nt, Yersinia pestis KIM
aaagggcaacaauau

SEQ ID NO: 2330677 - RNA, 20 nt, Yersinia pestis KIM
ggaaucagcguuuuauucgu

SEQ ID NO: 2330678 - RNA, 23 nt, Yersinia pestis KIM
ggaaucuugauuagcuggcuguu

SEQ ID NO: 2330679 - RNA, 12 nt, Yersinia pestis KIM
ggacaucugcuu

SEQ ID NO: 2330680 - RNA, 16 nt, Yersinia pestis KIM
ggacauuuagcacugu

SEQ ID NO: 2330681 - RNA, 14 nt, Yersinia pestis KIM
ggcgcuacuucccc

SEQ ID NO: 2330682 - RNA, 23 nt, Yersinia pestis KIM
ggcgcguuucuuagcugauuuga

SEQ ID NO: 2330683 - RNA, 20 nt, Yersinia pestis KIM
ggcgcugagguucuccaaca

SEQ ID NO: 2330684 - RNA, 16 nt, Yersinia pestis KIM
aaauacuuaacaauca

SEQ ID NO: 2330685 - RNA, 13 nt, Yersinia pestis KIM
aaauacuguuggu

SEQ ID NO: 2330686 - RNA, 23 nt, Yersinia pestis KIM
aaauacugcacguuuaauuucac

SEQ ID NO: 2330687 - RNA, 13 nt, Yersinia pestis KIM
ggcgcauccccac

SEQ ID NO: 2330688 - RNA, 19 nt, Yersinia pestis KIM
ggcgcaucgcgaucugaca

SEQ ID NO: 2330689 - RNA, 16 nt, Yersinia pestis KIM
aaauacccgguuucca

SEQ ID NO: 2330690 - RNA, 18 nt, Yersinia pestis KIM
ggcgaucaggaagcccgu

SEQ ID NO: 2330691 - RNA, 24 nt, Yersinia pestis KIM
ggcgaguuucccuuuuccaucaga

SEQ ID NO: 2330692 - RNA, 14 nt, Yersinia pestis KIM
ggcgaucucuucgg

SEQ ID NO: 2330693 - RNA, 12 nt, Yersinia pestis KIM
ggcgauccgccc

SEQ ID NO: 2330694 - RNA, 14 nt, Yersinia pestis KIM
ggcgcaauggaaga

SEQ ID NO: 2330695 - RNA, 14 nt, Yersinia pestis KIM
ggcgcacugauucu

SEQ ID NO: 2330696 - RNA, 18 nt, Yersinia pestis KIM
ggcggcuaaccugcacgc

SEQ ID NO: 2330697 - RNA, 18 nt, Yersinia pestis KIM
ggcggaaauuaaaaauua

SEQ ID NO: 2330698 - RNA, 17 nt, Yersinia pestis KIM
ggcggaaauaaggcgca

SEQ ID NO: 2330699 - RNA, 14 nt, Yersinia pestis KIM
ggcgcuguugcaug

SEQ ID NO: 2330700 - RNA, 11 nt, Yersinia pestis KIM
ggcguaaguac

SEQ ID NO: 2330701 - RNA, 17 nt, Yersinia pestis KIM
ggcguaauugcggucag

SEQ ID NO: 2330702 - RNA, 21 nt, Yersinia pestis KIM
ggcguaacauauccugugcca

SEQ ID NO: 2330703 - RNA, 17 nt, Yersinia pestis KIM
ggcguuauugagaagaa

SEQ ID NO: 2330704 - RNA, 15 nt, Yersinia pestis KIM
ggcguuaucggcgca

SEQ ID NO: 2330705 - RNA, 20 nt, Yersinia pestis KIM
ggcguucuacugcguccuuu

SEQ ID NO: 2330706 - RNA, 17 nt, Yersinia pestis KIM
ggcguucccgcaggcgg

SEQ ID NO: 2330707 - RNA, 23 nt, Yersinia pestis KIM
ggcgugaguuccagccccaaaca

SEQ ID NO: 2330708 - RNA, 17 nt, Yersinia pestis KIM
ggcguuucucagacugu

SEQ ID NO: 2330709 - RNA, 16 nt, Yersinia pestis KIM
ggcuaaaacucaaaua

SEQ ID NO: 2330710 - RNA, 17 nt, Yersinia pestis KIM
ggcuaaccugcacgccu

SEQ ID NO: 2330711 - RNA, 18 nt, Yersinia pestis KIM
ggcuaacgguaaauaagu

SEQ ID NO: 2330712 - RNA, 19 nt, Yersinia pestis KIM
ggcuaauuaauuuaaacaa

SEQ ID NO: 2330713 - RNA, 17 nt, Yersinia pestis KIM
ggcuaauaccaggcugg

SEQ ID NO: 2330714 - RNA, 20 nt, Yersinia pestis KIM
ggcuaauauaucucuucuug

SEQ ID NO: 2330715 - RNA, 20 nt, Yersinia pestis KIM
ggcucacacacuaauaauaa

SEQ ID NO: 2330716 - RNA, 12 nt, Yersinia pestis KIM
ggcucaaauuug

SEQ ID NO: 2330717 - RNA, 15 nt, Yersinia pestis KIM
ggcucaaagaaaaau

SEQ ID NO: 2330718 - RNA, 21 nt, Yersinia pestis KIM
ggcuauagaucggccaguaag

SEQ ID NO: 2330719 - RNA, 18 nt, Yersinia pestis KIM
ggcuacugguagcagcca

SEQ ID NO: 2330720 - RNA, 18 nt, Yersinia pestis KIM
ggcuagcccccagggagg

SEQ ID NO: 2330721 - RNA, 13 nt, Yersinia pestis KIM
ggccuucuaacuc

SEQ ID NO: 2330722 - RNA, 19 nt, Yersinia pestis KIM
ggcgaagggcgcagccccc

SEQ ID NO: 2330723 - RNA, 22 nt, Yersinia pestis KIM
ggccuguaccaccaccaacagc

SEQ ID NO: 2330724 - RNA, 13 nt, Yersinia pestis KIM
aaauaaacuuuua

SEQ ID NO: 2330725 - RNA, 11 nt, Yersinia pestis KIM
aaauaaauaag

SEQ ID NO: 2330726 - RNA, 18 nt, Yersinia pestis KIM
ggccugcaaacggcucau

SEQ ID NO: 2330727 - RNA, 20 nt, Yersinia pestis KIM
aaauaaacgcgaguuaggaa

SEQ ID NO: 2330728 - RNA, 14 nt, Yersinia pestis KIM
aaauaaacaucaau

SEQ ID NO: 2330729 - RNA, 17 nt, Yersinia pestis KIM
aaauaaaauaauaaugg

SEQ ID NO: 2330730 - RNA, 14 nt, Yersinia pestis KIM
aaauaaaauagcgu

SEQ ID NO: 2330731 - RNA, 21 nt, Yersinia pestis KIM
aaauaaaaacgcagauuugua

SEQ ID NO: 2330732 - RNA, 11 nt, Yersinia pestis KIM
aaauaaaaaug

SEQ ID NO: 2330733 - RNA, 12 nt, Yersinia pestis KIM
ggccugagaacc

SEQ ID NO: 2330734 - RNA, 20 nt, Yersinia pestis KIM
ggccguugaugcucauuuaa

SEQ ID NO: 2330735 - RNA, 17 nt, Yersinia pestis KIM
ggccguguuuuucccua

SEQ ID NO: 2330736 - RNA, 23 nt, Yersinia pestis KIM
ggccgugcgggaugacucggccu

SEQ ID NO: 2330737 - RNA, 20 nt, Yersinia pestis KIM
ggccguuugcccuuuuugcg

SEQ ID NO: 2330738 - RNA, 22 nt, Yersinia pestis KIM
ggccuaagccggucuuuuuaca

SEQ ID NO: 2330739 - RNA, 21 nt, Yersinia pestis KIM
ggccuaaugccgcgcccccag

SEQ ID NO: 2330740 - RNA, 22 nt, Yersinia pestis KIM
ggccuaucaucaccauucaaga

SEQ ID NO: 2330741 - RNA, 20 nt, Yersinia pestis KIM
ggccuacggaggucaaauga

SEQ ID NO: 2330742 - RNA, 15 nt, Yersinia pestis KIM
aaaguuuuuugaaau

SEQ ID NO: 2330743 - RNA, 17 nt, Yersinia pestis KIM
aaaguuuuuugaaauua

SEQ ID NO: 2330744 - RNA, 22 nt, Yersinia pestis KIM
aaagugcuauccucuuaauguc

SEQ ID NO: 2330745 - RNA, 12 nt, Yersinia pestis KIM
aaaguguaauuu

SEQ ID NO: 2330746 - RNA, 17 nt, Yersinia pestis KIM
ggccauuguuaugguau

SEQ ID NO: 2330747 - RNA, 16 nt, Yersinia pestis KIM
ggccauuugcucuggc

SEQ ID NO: 2330748 - RNA, 14 nt, Yersinia pestis KIM
ggcccaauaaaagg

SEQ ID NO: 2330749 - RNA, 21 nt, Yersinia pestis KIM
ggccgauacgcgccgcagcag

SEQ ID NO: 2330750 - RNA, 18 nt, Yersinia pestis KIM
ggccgauaucauggccau

SEQ ID NO: 2330751 - RNA, 20 nt, Yersinia pestis KIM
ggccgaucaacaggccaccu

SEQ ID NO: 2330752 - RNA, 22 nt, Yersinia pestis KIM
ggccgcccagauaaagaugaag

SEQ ID NO: 2330753 - RNA, 23 nt, Yersinia pestis KIM
aaaguuaggguucaguaaaacca

SEQ ID NO: 2330754 - RNA, 14 nt, Yersinia pestis KIM
aaaguuaucaccaa

SEQ ID NO: 2330755 - RNA, 18 nt, Yersinia pestis KIM
aaaguugagcagcaauaa

SEQ ID NO: 2330756 - RNA, 21 nt, Yersinia pestis KIM
aaaguugagcagcaauaacuc

SEQ ID NO: 2330757 - RNA, 16 nt, Yersinia pestis KIM
aaaguucuucgaucaa

SEQ ID NO: 2330758 - RNA, 17 nt, Yersinia pestis KIM
aaaguuuagcaaagcau

SEQ ID NO: 2330759 - RNA, 20 nt, Yersinia pestis KIM
aaaguuuauaugcuugacug

SEQ ID NO: 2330760 - RNA, 20 nt, Yersinia pestis KIM
ggccgcuugccaaucacggu

SEQ ID NO: 2330761 - RNA, 13 nt, Yersinia pestis KIM
gagcuugcugcug

SEQ ID NO: 2330762 - RNA, 11 nt, Yersinia pestis KIM
gagcuugcugc

SEQ ID NO: 2330763 - RNA, 16 nt, Yersinia pestis KIM
gagcuucuucaaaagc

SEQ ID NO: 2330764 - RNA, 21 nt, Yersinia pestis KIM
gagcuuccagugcauuaucuu

SEQ ID NO: 2330765 - RNA, 22 nt, Yersinia pestis KIM
gagcuguagaacuuguucauau

SEQ ID NO: 2330766 - RNA, 21 nt, Yersinia pestis KIM
gaggaauagccagcguggugu

SEQ ID NO: 2330767 - RNA, 22 nt, Yersinia pestis KIM
gaggaaggcgguuaucuggaau

SEQ ID NO: 2330768 - RNA, 17 nt, Yersinia pestis KIM
gaggauuuuccgcagcu

SEQ ID NO: 2330769 - RNA, 18 nt, Yersinia pestis KIM
gaggauuuuccgcagcuc

SEQ ID NO: 2330770 - RNA, 14 nt, Yersinia pestis KIM
gaggauucaagaac

SEQ ID NO: 2330771 - RNA, 21 nt, Yersinia pestis KIM
gaggaucccuucugaaacuuc

SEQ ID NO: 2330772 - RNA, 23 nt, Yersinia pestis KIM
gaggcucuggucacuaaaacuga

SEQ ID NO: 2330773 - RNA, 13 nt, Yersinia pestis KIM
gagggagucaggg

SEQ ID NO: 2330774 - RNA, 17 nt, Yersinia pestis KIM
gagggagucagggaguc

SEQ ID NO: 2330775 - RNA, 15 nt, Yersinia pestis KIM
gauaaaaacauugaa

SEQ ID NO: 2330776 - RNA, 20 nt, Yersinia pestis KIM
gauaaaaagagggucacaag

SEQ ID NO: 2330777 - RNA, 21 nt, Yersinia pestis KIM
gaguuuucccugcgccagcag

SEQ ID NO: 2330778 - RNA, 14 nt, Yersinia pestis KIM
gauaaaaccacuga

SEQ ID NO: 2330779 - RNA, 16 nt, Yersinia pestis KIM
gauaaaaaucuuuuaa

SEQ ID NO: 2330780 - RNA, 13 nt, Yersinia pestis KIM
gauaaaacaauag

SEQ ID NO: 2330781 - RNA, 15 nt, Yersinia pestis KIM
gauaaauaaccgagc

SEQ ID NO: 2330782 - RNA, 14 nt, Yersinia pestis KIM
gauaaagucugaaa

SEQ ID NO: 2330783 - RNA, 13 nt, Yersinia pestis KIM
gauaaauaaaaua

SEQ ID NO: 2330784 - RNA, 22 nt, Yersinia pestis KIM
gauaaaggcggugauaaacccu

SEQ ID NO: 2330785 - RNA, 18 nt, Yersinia pestis KIM
gaguggacgauaaauuca

SEQ ID NO: 2330786 - RNA, 18 nt, Yersinia pestis KIM
gagugcuggcaagcccug

SEQ ID NO: 2330787 - RNA, 19 nt, Yersinia pestis KIM
gaguuaucuguuucaaaua

SEQ ID NO: 2330788 - RNA, 15 nt, Yersinia pestis KIM
gaguuacgucaaaac

SEQ ID NO: 2330789 - RNA, 22 nt, Yersinia pestis KIM
gaguugauaaacaauaaacaga

SEQ ID NO: 2330790 - RNA, 17 nt, Yersinia pestis KIM
gaguugaugcaauggca

SEQ ID NO: 2330791 - RNA, 22 nt, Yersinia pestis KIM
gaguauacuaaaacagcucacu

SEQ ID NO: 2330792 - RNA, 14 nt, Yersinia pestis KIM
gaguauacuaaaac

SEQ ID NO: 2330793 - RNA, 19 nt, Yersinia pestis KIM
gaguauacggucaaaagcu

SEQ ID NO: 2330794 - RNA, 14 nt, Yersinia pestis KIM
gagguuaucagccu

SEQ ID NO: 2330795 - RNA, 21 nt, Yersinia pestis KIM
gagguuauugacaaagagccc

SEQ ID NO: 2330796 - RNA, 22 nt, Yersinia pestis KIM
gagucguaaaauuuuggcaacc

SEQ ID NO: 2330797 - RNA, 15 nt, Yersinia pestis KIM
gagucaucgggguuu

SEQ ID NO: 2330798 - RNA, 21 nt, Yersinia pestis KIM
gagucagucagggugaaagcc

SEQ ID NO: 2330799 - RNA, 19 nt, Yersinia pestis KIM
gagucaguaauucacccuu

SEQ ID NO: 2330800 - RNA, 21 nt, Yersinia pestis KIM
gagucaguacggagaauauag

SEQ ID NO: 2330801 - RNA, 16 nt, Yersinia pestis KIM
gagucagucaggguga

SEQ ID NO: 2330802 - RNA, 16 nt, Yersinia pestis KIM
gagucagggagucagg

SEQ ID NO: 2330803 - RNA, 17 nt, Yersinia pestis KIM
gagucagggagucaggg

SEQ ID NO: 2330804 - RNA, 18 nt, Yersinia pestis KIM
gagucagggagucaggga

SEQ ID NO: 2330805 - RNA, 21 nt, Yersinia pestis KIM
gagucagggagucagggaguc

SEQ ID NO: 2330806 - RNA, 14 nt, Yersinia pestis KIM
gagugcggccacac

SEQ ID NO: 2330807 - RNA, 20 nt, Yersinia pestis KIM
gagugccagcaaagacaaua

SEQ ID NO: 2330808 - RNA, 18 nt, Yersinia pestis KIM
gagucuauugaaaaaaua

SEQ ID NO: 2330809 - RNA, 21 nt, Yersinia pestis KIM
gagucucaucaaggaaaaugg

SEQ ID NO: 2330810 - RNA, 23 nt, Yersinia pestis KIM
gauauuccggugaucuugaccga

SEQ ID NO: 2330811 - RNA, 15 nt, Yersinia pestis KIM
gauauuauucucuac

SEQ ID NO: 2330812 - RNA, 20 nt, Yersinia pestis KIM
gauauucacguuuuuccauu

SEQ ID NO: 2330813 - RNA, 18 nt, Yersinia pestis KIM
gauauucacguuuuucca

SEQ ID NO: 2330814 - RNA, 20 nt, Yersinia pestis KIM
gauaucuaugugcaaucuaa

SEQ ID NO: 2330815 - RNA, 15 nt, Yersinia pestis KIM
gauauccugcgucuc

SEQ ID NO: 2330816 - RNA, 18 nt, Yersinia pestis KIM
gauaucccaacugaaacg

SEQ ID NO: 2330817 - RNA, 23 nt, Yersinia pestis KIM
gauauuuauuuauccuauuuuua

SEQ ID NO: 2330818 - RNA, 18 nt, Yersinia pestis KIM
gauauuuaagccaugaca

SEQ ID NO: 2330819 - RNA, 18 nt, Yersinia pestis KIM
gauauuucacguucauca

SEQ ID NO: 2330820 - RNA, 20 nt, Yersinia pestis KIM
gauauuuuaccaaugcacgu

SEQ ID NO: 2330821 - RNA, 16 nt, Yersinia pestis KIM
gauauugauagccaca

SEQ ID NO: 2330822 - RNA, 13 nt, Yersinia pestis KIM
gauauugaugacg

SEQ ID NO: 2330823 - RNA, 14 nt, Yersinia pestis KIM
gauauugaugacgc

SEQ ID NO: 2330824 - RNA, 19 nt, Yersinia pestis KIM
gaucaaaggcgaccaaugg

SEQ ID NO: 2330825 - RNA, 21 nt, Yersinia pestis KIM
gaucaaaaucacuucuucaau

SEQ ID NO: 2330826 - RNA, 12 nt, Yersinia pestis KIM
gauauuuugcag

SEQ ID NO: 2330827 - RNA, 21 nt, Yersinia pestis KIM
gauauuuucgacaaaaucagu

SEQ ID NO: 2330828 - RNA, 16 nt, Yersinia pestis KIM
gauauuuuuuugucug

SEQ ID NO: 2330829 - RNA, 18 nt, Yersinia pestis KIM
gauagccuauuucaccgc

SEQ ID NO: 2330830 - RNA, 16 nt, Yersinia pestis KIM
gauaguuaucucccau

SEQ ID NO: 2330831 - RNA, 13 nt, Yersinia pestis KIM
gauaguuaucugg

SEQ ID NO: 2330832 - RNA, 15 nt, Yersinia pestis KIM
gauaguuaucuccca

SEQ ID NO: 2330833 - RNA, 17 nt, Yersinia pestis KIM
gauaguuaaauuauccc

SEQ ID NO: 2330834 - RNA, 17 nt, Yersinia pestis KIM
gauaucaauaaccugac

SEQ ID NO: 2330835 - RNA, 14 nt, Yersinia pestis KIM
gauaucagccagug

SEQ ID NO: 2330836 - RNA, 16 nt, Yersinia pestis KIM
gauaucagccagugcu

SEQ ID NO: 2330837 - RNA, 18 nt, Yersinia pestis KIM
gauauaaauaaaauagcg

SEQ ID NO: 2330838 - RNA, 13 nt, Yersinia pestis KIM
gauauaacucaac

SEQ ID NO: 2330839 - RNA, 12 nt, Yersinia pestis KIM
gauaguuuccau

SEQ ID NO: 2330840 - RNA, 22 nt, Yersinia pestis KIM
gauaccugagcgcugaguugua

SEQ ID NO: 2330841 - RNA, 14 nt, Yersinia pestis KIM
gauacgguccagca

SEQ ID NO: 2330842 - RNA, 14 nt, Yersinia pestis KIM
gauagccccauaua

SEQ ID NO: 2330843 - RNA, 15 nt, Yersinia pestis KIM
gauagccacuaacua

SEQ ID NO: 2330844 - RNA, 22 nt, Yersinia pestis KIM
gauagcccaucuuaugcauguu

SEQ ID NO: 2330845 - RNA, 12 nt, Yersinia pestis KIM
gauagccauaau

SEQ ID NO: 2330846 - RNA, 23 nt, Yersinia pestis KIM
gauagccaaccccucugguguga

SEQ ID NO: 2330847 - RNA, 17 nt, Yersinia pestis KIM
gauagcaucauccagcu

SEQ ID NO: 2330848 - RNA, 19 nt, Yersinia pestis KIM
gauagcauuuugucaugag

SEQ ID NO: 2330849 - RNA, 20 nt, Yersinia pestis KIM
gauaaucaauuugucauguu

SEQ ID NO: 2330850 - RNA, 21 nt, Yersinia pestis KIM
gauaaucagaggugaaaaaau

SEQ ID NO: 2330851 - RNA, 12 nt, Yersinia pestis KIM
gauaaucaucag

SEQ ID NO: 2330852 - RNA, 20 nt, Yersinia pestis KIM
gauaauggaugaauauccac

SEQ ID NO: 2330853 - RNA, 21 nt, Yersinia pestis KIM
gauaaugcugaugcaauaacu

SEQ ID NO: 2330854 - RNA, 23 nt, Yersinia pestis KIM
gauaauuauccauuuucugccaa

SEQ ID NO: 2330855 - RNA, 18 nt, Yersinia pestis KIM
gauaauuauccauuuucu

SEQ ID NO: 2330856 - RNA, 19 nt, Yersinia pestis KIM
gauaaguuuuaauaucugc

SEQ ID NO: 2330857 - RNA, 13 nt, Yersinia pestis KIM
gauaauaaauugc

SEQ ID NO: 2330858 - RNA, 17 nt, Yersinia pestis KIM
gauaauaaccugauauu

SEQ ID NO: 2330859 - RNA, 20 nt, Yersinia pestis KIM
gauaauaguucauuuuguau

SEQ ID NO: 2330860 - RNA, 17 nt, Yersinia pestis KIM
gauaagugaauaaauca

SEQ ID NO: 2330861 - RNA, 19 nt, Yersinia pestis KIM
gauaacauuuuuucuuuua

SEQ ID NO: 2330862 - RNA, 14 nt, Yersinia pestis KIM
gauaacaguuuacg

SEQ ID NO: 2330863 - RNA, 12 nt, Yersinia pestis KIM
gauaaccagcag

SEQ ID NO: 2330864 - RNA, 20 nt, Yersinia pestis KIM
aaagcauuuaucauauuaac

SEQ ID NO: 2330865 - RNA, 14 nt, Yersinia pestis KIM
aaagcauuuaucau

SEQ ID NO: 2330866 - RNA, 13 nt, Yersinia pestis KIM
aaagcaugcagaa

SEQ ID NO: 2330867 - RNA, 15 nt, Yersinia pestis KIM
aaagcaugcagaaua

SEQ ID NO: 2330868 - RNA, 17 nt, Yersinia pestis KIM
aaagcaugcagaauauc

SEQ ID NO: 2330869 - RNA, 15 nt, Yersinia pestis KIM
gauacacaugguugc

SEQ ID NO: 2330870 - RNA, 19 nt, Yersinia pestis KIM
gauacaccguaucugccaa

SEQ ID NO: 2330871 - RNA, 22 nt, Yersinia pestis KIM
gauacaauagauaacugaaaga

SEQ ID NO: 2330872 - RNA, 13 nt, Yersinia pestis KIM
gauacaauuuuug

SEQ ID NO: 2330873 - RNA, 22 nt, Yersinia pestis KIM
gauacaaaugagagcgcagcag

SEQ ID NO: 2330874 - RNA, 20 nt, Yersinia pestis KIM
aaagcaggccuucuaacucu

SEQ ID NO: 2330875 - RNA, 16 nt, Yersinia pestis KIM
gauaauuucagcagca

SEQ ID NO: 2330876 - RNA, 21 nt, Yersinia pestis KIM
aaagcagucgacaguguaaaa

SEQ ID NO: 2330877 - RNA, 12 nt, Yersinia pestis KIM
aaagcagugcug

SEQ ID NO: 2330878 - RNA, 14 nt, Yersinia pestis KIM
aaagcagugcugaa

SEQ ID NO: 2330879 - RNA, 22 nt, Yersinia pestis KIM
gauaccgauaauaaauauccuc

SEQ ID NO: 2330880 - RNA, 21 nt, Yersinia pestis KIM
gauacccgccauaaauaaaga

SEQ ID NO: 2330881 - RNA, 13 nt, Yersinia pestis KIM
gauaccagcgacu

SEQ ID NO: 2330882 - RNA, 18 nt, Yersinia pestis KIM
gauaccacccguugcauu

SEQ ID NO: 2330883 - RNA, 14 nt, Yersinia pestis KIM
gauacaucaaauca

SEQ ID NO: 2330884 - RNA, 16 nt, Yersinia pestis KIM
gagauguauccaaggc

SEQ ID NO: 2330885 - RNA, 15 nt, Yersinia pestis KIM
gagaugcaaucuaac

SEQ ID NO: 2330886 - RNA, 13 nt, Yersinia pestis KIM
gagcaccgcagga

SEQ ID NO: 2330887 - RNA, 15 nt, Yersinia pestis KIM
gagcaccgcaggaac

SEQ ID NO: 2330888 - RNA, 13 nt, Yersinia pestis KIM
gagcaccaaaucu

SEQ ID NO: 2330889 - RNA, 16 nt, Yersinia pestis KIM
gagcaccaaaucuucc

SEQ ID NO: 2330890 - RNA, 17 nt, Yersinia pestis KIM
gagcaccaaaucuucca

SEQ ID NO: 2330891 - RNA, 11 nt, Yersinia pestis KIM
gagcaccagaa

SEQ ID NO: 2330892 - RNA, 13 nt, Yersinia pestis KIM
aaagcagcagcuu

SEQ ID NO: 2330893 - RNA, 20 nt, Yersinia pestis KIM
gagcaguaauagcaaaaaaa

SEQ ID NO: 2330894 - RNA, 18 nt, Yersinia pestis KIM
gagcaguaaguuaaaaag

SEQ ID NO: 2330895 - RNA, 22 nt, Yersinia pestis KIM
gagcaggcuuugugccaaauag

SEQ ID NO: 2330896 - RNA, 16 nt, Yersinia pestis KIM
aaagcaggccuucuaa

SEQ ID NO: 2330897 - RNA, 22 nt, Yersinia pestis KIM
gagcauaacugguggcaggccc

SEQ ID NO: 2330898 - RNA, 22 nt, Yersinia pestis KIM
gagcauaccgguuugggcauca

SEQ ID NO: 2330899 - RNA, 17 nt, Yersinia pestis KIM
gagccauccaggcaagc

SEQ ID NO: 2330900 - RNA, 20 nt, Yersinia pestis KIM
gagccgcuagcgcaggugua

SEQ ID NO: 2330901 - RNA, 15 nt, Yersinia pestis KIM
gagccgcgcccuccc

SEQ ID NO: 2330902 - RNA, 16 nt, Yersinia pestis KIM
gagaucagugccagua

SEQ ID NO: 2330903 - RNA, 12 nt, Yersinia pestis KIM
gagaucaguuca

SEQ ID NO: 2330904 - RNA, 15 nt, Yersinia pestis KIM
gagaguucacuuauu

SEQ ID NO: 2330905 - RNA, 20 nt, Yersinia pestis KIM
gagauaaucguggcuguaaa

SEQ ID NO: 2330906 - RNA, 12 nt, Yersinia pestis KIM
gagagcagggcc

SEQ ID NO: 2330907 - RNA, 16 nt, Yersinia pestis KIM
gagagcgcagcaguga

SEQ ID NO: 2330908 - RNA, 14 nt, Yersinia pestis KIM
gagaauaucuauau

SEQ ID NO: 2330909 - RNA, 21 nt, Yersinia pestis KIM
gagaauaucuauauagggaaa

SEQ ID NO: 2330910 - RNA, 23 nt, Yersinia pestis KIM
gagaaugguacuugacgcugcag

SEQ ID NO: 2330911 - RNA, 14 nt, Yersinia pestis KIM
gagacggaaagagc

SEQ ID NO: 2330912 - RNA, 20 nt, Yersinia pestis KIM
gagaccagguauuucuccau

SEQ ID NO: 2330913 - RNA, 15 nt, Yersinia pestis KIM
gagacccgauuucac

SEQ ID NO: 2330914 - RNA, 14 nt, Yersinia pestis KIM
gagacauaaagccc

SEQ ID NO: 2330915 - RNA, 17 nt, Yersinia pestis KIM
gacuuuuuuaucgccag

SEQ ID NO: 2330916 - RNA, 19 nt, Yersinia pestis KIM
gagaaacugaugccgguau

SEQ ID NO: 2330917 - RNA, 22 nt, Yersinia pestis KIM
gagaaaggauuugaagacaacu

SEQ ID NO: 2330918 - RNA, 22 nt, Yersinia pestis KIM
aaagauuucaucggcaaaaaca

SEQ ID NO: 2330919 - RNA, 14 nt, Yersinia pestis KIM
aaagauuuccuuuc

SEQ ID NO: 2330920 - RNA, 20 nt, Yersinia pestis KIM
aaagauuuccuuucgcacuu

SEQ ID NO: 2330921 - RNA, 18 nt, Yersinia pestis KIM
gagaacgggcaaccugua

SEQ ID NO: 2330922 - RNA, 22 nt, Yersinia pestis KIM
gagaaccgauaacgccccggcc

SEQ ID NO: 2330923 - RNA, 21 nt, Yersinia pestis KIM
gagaacacaaaagacgccuuc

SEQ ID NO: 2330924 - RNA, 20 nt, Yersinia pestis KIM
gagaacaaugguucaucauu

SEQ ID NO: 2330925 - RNA, 15 nt, Yersinia pestis KIM
gagaacaaugguuca

SEQ ID NO: 2330926 - RNA, 23 nt, Yersinia pestis KIM
aaagcaaacaauuagucacuaaa

SEQ ID NO: 2330927 - RNA, 18 nt, Yersinia pestis KIM
aaagcaaagaucucucga

SEQ ID NO: 2330928 - RNA, 24 nt, Yersinia pestis KIM
gacuuacccuacccauuauaaaua

SEQ ID NO: 2330929 - RNA, 12 nt, Yersinia pestis KIM
gacuucuuaucu

SEQ ID NO: 2330930 - RNA, 17 nt, Yersinia pestis KIM
gacuucuuauuaaucaa

SEQ ID NO: 2330931 - RNA, 20 nt, Yersinia pestis KIM
gacuugauuaacaucgccac

SEQ ID NO: 2330932 - RNA, 15 nt, Yersinia pestis KIM
gacuuuaucugccaa

SEQ ID NO: 2330933 - RNA, 19 nt, Yersinia pestis KIM
gacuuucuaagcugccugu

SEQ ID NO: 2330934 - RNA, 21 nt, Yersinia pestis KIM
gacuuucuaagcugccugugc

SEQ ID NO: 2330935 - RNA, 13 nt, Yersinia pestis KIM
gacuuuccccaga

SEQ ID NO: 2330936 - RNA, 14 nt, Yersinia pestis KIM
gacuaaaaaccauc

SEQ ID NO: 2330937 - RNA, 23 nt, Yersinia pestis KIM
gacuccaguuucgucaugauaau

SEQ ID NO: 2330938 - RNA, 18 nt, Yersinia pestis KIM
gacucccucaccgccuag

SEQ ID NO: 2330939 - RNA, 15 nt, Yersinia pestis KIM
gacucccugacuccc

SEQ ID NO: 2330940 - RNA, 16 nt, Yersinia pestis KIM
gacucccugacucccu

SEQ ID NO: 2330941 - RNA, 18 nt, Yersinia pestis KIM
gacucccugacucccuca

SEQ ID NO: 2330942 - RNA, 15 nt, Yersinia pestis KIM
gacucgaucuugaac

SEQ ID NO: 2330943 - RNA, 15 nt, Yersinia pestis KIM
gacuccugccccccc

SEQ ID NO: 2330944 - RNA, 23 nt, Yersinia pestis KIM
gacugaaaguagaaauaaaaacc

SEQ ID NO: 2330945 - RNA, 18 nt, Yersinia pestis KIM
gacugaaaguagaaauaa

SEQ ID NO: 2330946 - RNA, 21 nt, Yersinia pestis KIM
gacucuuuauuuauggcgggu

SEQ ID NO: 2330947 - RNA, 19 nt, Yersinia pestis KIM
gacugcuaauaccaccacc

SEQ ID NO: 2330948 - RNA, 15 nt, Yersinia pestis KIM
gacugcuggcagggu

SEQ ID NO: 2330949 - RNA, 15 nt, Yersinia pestis KIM
gacuggacaaauaaa

SEQ ID NO: 2330950 - RNA, 23 nt, Yersinia pestis KIM
gacuggcgauauggcacaggcaa

SEQ ID NO: 2330951 - RNA, 15 nt, Yersinia pestis KIM
gacugguugcugguu

SEQ ID NO: 2330952 - RNA, 20 nt, Yersinia pestis KIM
gacuggucacucgaugacgu

SEQ ID NO: 2330953 - RNA, 22 nt, Yersinia pestis KIM
gacuguacggcgcguuucuuag

SEQ ID NO: 2330954 - RNA, 12 nt, Yersinia pestis KIM
gacuguggcugc

SEQ ID NO: 2330955 - RNA, 18 nt, Yersinia pestis KIM
gacugauaccggaaaaug

SEQ ID NO: 2330956 - RNA, 22 nt, Yersinia pestis KIM
gacugauagcaaacaaacagua

SEQ ID NO: 2330957 - RNA, 16 nt, Yersinia pestis KIM
gacugcccgccugcuu

SEQ ID NO: 2330958 - RNA, 11 nt, Yersinia pestis KIM
gacugcccaaa

SEQ ID NO: 2330959 - RNA, 21 nt, Yersinia pestis KIM
gacugcccaaaauaauguuug

SEQ ID NO: 2330960 - RNA, 22 nt, Yersinia pestis KIM
gaccggggaucaauaaacgcuu

SEQ ID NO: 2330961 - RNA, 18 nt, Yersinia pestis KIM
gaccgaguguaaaaagca

SEQ ID NO: 2330962 - RNA, 17 nt, Yersinia pestis KIM
gaccgauaaacgccagu

SEQ ID NO: 2330963 - RNA, 22 nt, Yersinia pestis KIM
gaccgcagccuucagaugaaug

SEQ ID NO: 2330964 - RNA, 16 nt, Yersinia pestis KIM
gaccgucaccaaauag

SEQ ID NO: 2330965 - RNA, 22 nt, Yersinia pestis KIM
gaccguagccaacacaugcugc

SEQ ID NO: 2330966 - RNA, 16 nt, Yersinia pestis KIM
gaccuccguaggccaa

SEQ ID NO: 2330967 - RNA, 18 nt, Yersinia pestis KIM
gaccuauugauaaaaccg

SEQ ID NO: 2330968 - RNA, 12 nt, Yersinia pestis KIM
gacgaucuugcc

SEQ ID NO: 2330969 - RNA, 16 nt, Yersinia pestis KIM
gacgaggguaauaaug

SEQ ID NO: 2330970 - RNA, 16 nt, Yersinia pestis KIM
gacgagcccaggcgac

SEQ ID NO: 2330971 - RNA, 15 nt, Yersinia pestis KIM
gacgagcggcauuga

SEQ ID NO: 2330972 - RNA, 20 nt, Yersinia pestis KIM
gaccuuagauaaauagacuc

SEQ ID NO: 2330973 - RNA, 23 nt, Yersinia pestis KIM
gacgacacaaaugcugugccaug

SEQ ID NO: 2330974 - RNA, 15 nt, Yersinia pestis KIM
gacgcgaucuugaac

SEQ ID NO: 2330975 - RNA, 19 nt, Yersinia pestis KIM
gacgcaaacggguggccgc

SEQ ID NO: 2330976 - RNA, 20 nt, Yersinia pestis KIM
gacgccuguuucggcaggca

SEQ ID NO: 2330977 - RNA, 16 nt, Yersinia pestis KIM
gacgcuggcagccuuu

SEQ ID NO: 2330978 - RNA, 15 nt, Yersinia pestis KIM
gacgcggugacaaug

SEQ ID NO: 2330979 - RNA, 15 nt, Yersinia pestis KIM
gacgcucgcugcugg

SEQ ID NO: 2330980 - RNA, 18 nt, Yersinia pestis KIM
gacggcuucuguaauaaa

SEQ ID NO: 2330981 - RNA, 13 nt, Yersinia pestis KIM
gacguccaaccca

SEQ ID NO: 2330982 - RNA, 18 nt, Yersinia pestis KIM
gacgugagcguucaaaau

SEQ ID NO: 2330983 - RNA, 20 nt, Yersinia pestis KIM
gacguaaaaaggcagugaca

SEQ ID NO: 2330984 - RNA, 21 nt, Yersinia pestis KIM
gacguaaaaaggcagugacag

SEQ ID NO: 2330985 - RNA, 23 nt, Yersinia pestis KIM
gaccagugcacccagcucgguga

SEQ ID NO: 2330986 - RNA, 12 nt, Yersinia pestis KIM
gaccauuucucu

SEQ ID NO: 2330987 - RNA, 13 nt, Yersinia pestis KIM
gacccgauuucaa

SEQ ID NO: 2330988 - RNA, 13 nt, Yersinia pestis KIM
gaccauuucucug

SEQ ID NO: 2330989 - RNA, 15 nt, Yersinia pestis KIM
gacccaagggcuauu

SEQ ID NO: 2330990 - RNA, 15 nt, Yersinia pestis KIM
gacccguuuauaaag

SEQ ID NO: 2330991 - RNA, 17 nt, Yersinia pestis KIM
gacccucuuaaugaaug

SEQ ID NO: 2330992 - RNA, 17 nt, Yersinia pestis KIM
gaccaaauagcaagcca

SEQ ID NO: 2330993 - RNA, 23 nt, Yersinia pestis KIM
gaccaaauagcaagccaaaacag

SEQ ID NO: 2330994 - RNA, 17 nt, Yersinia pestis KIM
gacauucuggcuuuuca

SEQ ID NO: 2330995 - RNA, 21 nt, Yersinia pestis KIM
gaccacuugcugaugcccauc

SEQ ID NO: 2330996 - RNA, 13 nt, Yersinia pestis KIM
gaccacuuccugu

SEQ ID NO: 2330997 - RNA, 23 nt, Yersinia pestis KIM
gaccacuuccuguauugauacuc

SEQ ID NO: 2330998 - RNA, 16 nt, Yersinia pestis KIM
gaccagauaaucgcca

SEQ ID NO: 2330999 - RNA, 15 nt, Yersinia pestis KIM
gacagaaaaaucaca

SEQ ID NO: 2331000 - RNA, 23 nt, Yersinia pestis KIM
gacacucggcgguuugagccacc

SEQ ID NO: 2331001 - RNA, 13 nt, Yersinia pestis KIM
gacacugcaucuc

SEQ ID NO: 2331002 - RNA, 17 nt, Yersinia pestis KIM
gacacugcaucucugca

SEQ ID NO: 2331003 - RNA, 18 nt, Yersinia pestis KIM
gacagaacugauuucagg

SEQ ID NO: 2331004 - RNA, 15 nt, Yersinia pestis KIM
gacagaauauccagc

SEQ ID NO: 2331005 - RNA, 14 nt, Yersinia pestis KIM
gacagccugugccc

SEQ ID NO: 2331006 - RNA, 23 nt, Yersinia pestis KIM
gacacguaaaacagggagccgcc

SEQ ID NO: 2331007 - RNA, 17 nt, Yersinia pestis KIM
gacacugacaucaucac

SEQ ID NO: 2331008 - RNA, 15 nt, Yersinia pestis KIM
gacauacuuugccuu

SEQ ID NO: 2331009 - RNA, 12 nt, Yersinia pestis KIM
gacauuaagcau

SEQ ID NO: 2331010 - RNA, 19 nt, Yersinia pestis KIM
gacaggauaagcagggcga

SEQ ID NO: 2331011 - RNA, 13 nt, Yersinia pestis KIM
gacauaagaugac

SEQ ID NO: 2331012 - RNA, 14 nt, Yersinia pestis KIM
gacauaaagaaaag

SEQ ID NO: 2331013 - RNA, 12 nt, Yersinia pestis KIM
gacauaaaccgc

SEQ ID NO: 2331014 - RNA, 18 nt, Yersinia pestis KIM
gacauaaugccggcggcc

SEQ ID NO: 2331015 - RNA, 14 nt, Yersinia pestis KIM
gacaggcaaagacu

SEQ ID NO: 2331016 - RNA, 17 nt, Yersinia pestis KIM
gacaggcaaagacuaca

SEQ ID NO: 2331017 - RNA, 12 nt, Yersinia pestis KIM
gaauauuuacac

SEQ ID NO: 2331018 - RNA, 19 nt, Yersinia pestis KIM
gaauauuuacggugagaau

SEQ ID NO: 2331019 - RNA, 12 nt, Yersinia pestis KIM
gaauauuauuca

SEQ ID NO: 2331020 - RNA, 13 nt, Yersinia pestis KIM
gaauauguucuuc

SEQ ID NO: 2331021 - RNA, 20 nt, Yersinia pestis KIM
gaaucaccgaaagaagacau

SEQ ID NO: 2331022 - RNA, 18 nt, Yersinia pestis KIM
gaaucaccaacaccacca

SEQ ID NO: 2331023 - RNA, 15 nt, Yersinia pestis KIM
gaaucaccacccgcu

SEQ ID NO: 2331024 - RNA, 19 nt, Yersinia pestis KIM
gaauaucaucuuuuucugc

SEQ ID NO: 2331025 - RNA, 16 nt, Yersinia pestis KIM
gaauaucuagcaacac

SEQ ID NO: 2331026 - RNA, 20 nt, Yersinia pestis KIM
gaauaucugugauaaccagc

SEQ ID NO: 2331027 - RNA, 16 nt, Yersinia pestis KIM
gaauaggcaggggagu

SEQ ID NO: 2331028 - RNA, 20 nt, Yersinia pestis KIM
gaauagucacgcggcggcgu

SEQ ID NO: 2331029 - RNA, 18 nt, Yersinia pestis KIM
gaauauacuuuacauaua

SEQ ID NO: 2331030 - RNA, 14 nt, Yersinia pestis KIM
gaaugcagauauca

SEQ ID NO: 2331031 - RNA, 20 nt, Yersinia pestis KIM
gaaugcagggagguuauauu

SEQ ID NO: 2331032 - RNA, 16 nt, Yersinia pestis KIM
gaaugcagucagcacu

SEQ ID NO: 2331033 - RNA, 16 nt, Yersinia pestis KIM
gaaugcaucgcaucag

SEQ ID NO: 2331034 - RNA, 19 nt, Yersinia pestis KIM
gaaugcacccaauggcaac

SEQ ID NO: 2331035 - RNA, 22 nt, Yersinia pestis KIM
gaaugaugguauuaaucaacag

SEQ ID NO: 2331036 - RNA, 21 nt, Yersinia pestis KIM
gaaugcuauauuuggcuuuca

SEQ ID NO: 2331037 - RNA, 21 nt, Yersinia pestis KIM
gaaugcucuuuuuaugcaggg

SEQ ID NO: 2331038 - RNA, 19 nt, Yersinia pestis KIM
gaaugcguugccgaaagcc

SEQ ID NO: 2331039 - RNA, 22 nt, Yersinia pestis KIM
gaaugcguugccgaaagccaag

SEQ ID NO: 2331040 - RNA, 19 nt, Yersinia pestis KIM
gaaugaguuuuguccugag

SEQ ID NO: 2331041 - RNA, 15 nt, Yersinia pestis KIM
gaaugaguuucaagu

SEQ ID NO: 2331042 - RNA, 22 nt, Yersinia pestis KIM
gaaucucuccagugcaaauuua

SEQ ID NO: 2331043 - RNA, 19 nt, Yersinia pestis KIM
gaaucuaccgcagaaccuu

SEQ ID NO: 2331044 - RNA, 22 nt, Yersinia pestis KIM
gaaucacuuauuggaaguacuu

SEQ ID NO: 2331045 - RNA, 21 nt, Yersinia pestis KIM
gaaucacugucaaaaagcacc

SEQ ID NO: 2331046 - RNA, 12 nt, Yersinia pestis KIM
gaaucacuuauu

SEQ ID NO: 2331047 - RNA, 14 nt, Yersinia pestis KIM
gaaucacuuuauuu

SEQ ID NO: 2331048 - RNA, 17 nt, Yersinia pestis KIM
gaaucccuaacgagaaa

SEQ ID NO: 2331049 - RNA, 18 nt, Yersinia pestis KIM
gaaucgcugccauaugca

SEQ ID NO: 2331050 - RNA, 18 nt, Yersinia pestis KIM
gaaugguacuugacgcug

SEQ ID NO: 2331051 - RNA, 21 nt, Yersinia pestis KIM
gaauggcuauuuacucucuuu

SEQ ID NO: 2331052 - RNA, 17 nt, Yersinia pestis KIM
gaauucaccaaauugca

SEQ ID NO: 2331053 - RNA, 14 nt, Yersinia pestis KIM
gaauucaccaaauu

SEQ ID NO: 2331054 - RNA, 12 nt, Yersinia pestis KIM
gaauucaccaaa

SEQ ID NO: 2331055 - RNA, 21 nt, Yersinia pestis KIM
gaauuucgucuucgcccagau

SEQ ID NO: 2331056 - RNA, 19 nt, Yersinia pestis KIM
gacaaauaaaacagaaccc

SEQ ID NO: 2331057 - RNA, 21 nt, Yersinia pestis KIM
gacaaauaaaacagaaccccc

SEQ ID NO: 2331058 - RNA, 20 nt, Yersinia pestis KIM
gaauuuucucauuaauaaug

SEQ ID NO: 2331059 - RNA, 21 nt, Yersinia pestis KIM
gaauuuucucauuaauaauga

SEQ ID NO: 2331060 - RNA, 17 nt, Yersinia pestis KIM
gacaaauccuuuuaaaa

SEQ ID NO: 2331061 - RNA, 16 nt, Yersinia pestis KIM
gacaacaaacaguaac

SEQ ID NO: 2331062 - RNA, 14 nt, Yersinia pestis KIM
gacaauauaauaau

SEQ ID NO: 2331063 - RNA, 15 nt, Yersinia pestis KIM
gacaauaguguugcu

SEQ ID NO: 2331064 - RNA, 13 nt, Yersinia pestis KIM
gacacaauucccg

SEQ ID NO: 2331065 - RNA, 18 nt, Yersinia pestis KIM
gacacaauagaugcagua

SEQ ID NO: 2331066 - RNA, 14 nt, Yersinia pestis KIM
gacaauauuccaaa

SEQ ID NO: 2331067 - RNA, 23 nt, Yersinia pestis KIM
gaagugguagccggacucaaaau

SEQ ID NO: 2331068 - RNA, 13 nt, Yersinia pestis KIM
gaagugagcugaa

SEQ ID NO: 2331069 - RNA, 21 nt, Yersinia pestis KIM
gaagguguuuaaaauuaauaa

SEQ ID NO: 2331070 - RNA, 14 nt, Yersinia pestis KIM
gaagguugccccca

SEQ ID NO: 2331071 - RNA, 16 nt, Yersinia pestis KIM
gaaggcuauuuuuaua

SEQ ID NO: 2331072 - RNA, 17 nt, Yersinia pestis KIM
gaaggcgguuaucugga

SEQ ID NO: 2331073 - RNA, 20 nt, Yersinia pestis KIM
gaagggccgcuauauuuuua

SEQ ID NO: 2331074 - RNA, 20 nt, Yersinia pestis KIM
gaagcugauaacgcacggcc

SEQ ID NO: 2331075 - RNA, 15 nt, Yersinia pestis KIM
gaauacacagcgaga

SEQ ID NO: 2331076 - RNA, 21 nt, Yersinia pestis KIM
gaauaacggcaguaaccuuga

SEQ ID NO: 2331077 - RNA, 15 nt, Yersinia pestis KIM
gaauaaccuacaaaa

SEQ ID NO: 2331078 - RNA, 12 nt, Yersinia pestis KIM
gaauaaaucaaa

SEQ ID NO: 2331079 - RNA, 18 nt, Yersinia pestis KIM
gaaguuuaccgcaugaau

SEQ ID NO: 2331080 - RNA, 17 nt, Yersinia pestis KIM
gaauaaaggggguuuuc

SEQ ID NO: 2331081 - RNA, 21 nt, Yersinia pestis KIM
gaaguugauaaaagucuauau

SEQ ID NO: 2331082 - RNA, 17 nt, Yersinia pestis KIM
gaaguguuuaccacggc

SEQ ID NO: 2331083 - RNA, 14 nt, Yersinia pestis KIM
gaaguuaaaaaaau

SEQ ID NO: 2331084 - RNA, 22 nt, Yersinia pestis KIM
gaaguuauugacaggugguucu

SEQ ID NO: 2331085 - RNA, 18 nt, Yersinia pestis KIM
aaagauaauuuagcaaag

SEQ ID NO: 2331086 - RNA, 20 nt, Yersinia pestis KIM
aaagauacaguggaacauuu

SEQ ID NO: 2331087 - RNA, 21 nt, Yersinia pestis KIM
aaagauagcaaaagaaucagu

SEQ ID NO: 2331088 - RNA, 15 nt, Yersinia pestis KIM
aaagauagccacuaa

SEQ ID NO: 2331089 - RNA, 18 nt, Yersinia pestis KIM
aaagauagccacuaacua

SEQ ID NO: 2331090 - RNA, 22 nt, Yersinia pestis KIM
gaagaugccaaucaaaaaaccg

SEQ ID NO: 2331091 - RNA, 18 nt, Yersinia pestis KIM
gaagaucagugaacugcu

SEQ ID NO: 2331092 - RNA, 18 nt, Yersinia pestis KIM
gaagacgaguaaugaaau

SEQ ID NO: 2331093 - RNA, 19 nt, Yersinia pestis KIM
gaagacgaguaaugaaauc

SEQ ID NO: 2331094 - RNA, 15 nt, Yersinia pestis KIM
gaagacgaguaauga

SEQ ID NO: 2331095 - RNA, 18 nt, Yersinia pestis KIM
gaagagccugaaucugaa

SEQ ID NO: 2331096 - RNA, 16 nt, Yersinia pestis KIM
gaagagauagauuuua

SEQ ID NO: 2331097 - RNA, 22 nt, Yersinia pestis KIM
gaagacaucgccagauucgcaa

SEQ ID NO: 2331098 - RNA, 19 nt, Yersinia pestis KIM
gaagaaucaccgaaagaag

SEQ ID NO: 2331099 - RNA, 21 nt, Yersinia pestis KIM
gaagaauccacauaaaaagaa

SEQ ID NO: 2331100 - RNA, 17 nt, Yersinia pestis KIM
gaagccucaugaaugag

SEQ ID NO: 2331101 - RNA, 22 nt, Yersinia pestis KIM
gaagccucaugaaugaggcuga

SEQ ID NO: 2331102 - RNA, 15 nt, Yersinia pestis KIM
gaagcucauaugcag

SEQ ID NO: 2331103 - RNA, 14 nt, Yersinia pestis KIM
gaaacuuugcuuug

SEQ ID NO: 2331104 - RNA, 14 nt, Yersinia pestis KIM
gaaagaaauaaaag

SEQ ID NO: 2331105 - RNA, 19 nt, Yersinia pestis KIM
gaaagaaauaaaagaaaac

SEQ ID NO: 2331106 - RNA, 13 nt, Yersinia pestis KIM
gaaagaaaaauag

SEQ ID NO: 2331107 - RNA, 15 nt, Yersinia pestis KIM
gaaagaaaaauagac

SEQ ID NO: 2331108 - RNA, 16 nt, Yersinia pestis KIM
gaaacggcuauuuuuu

SEQ ID NO: 2331109 - RNA, 19 nt, Yersinia pestis KIM
gaaacgccccgauaaacca

SEQ ID NO: 2331110 - RNA, 20 nt, Yersinia pestis KIM
gaaacgccagccucugcgcu

SEQ ID NO: 2331111 - RNA, 14 nt, Yersinia pestis KIM
gaaacgccagccuc

SEQ ID NO: 2331112 - RNA, 17 nt, Yersinia pestis KIM
gaaacgauuacccacca

SEQ ID NO: 2331113 - RNA, 14 nt, Yersinia pestis KIM
gaaagagccagcac

SEQ ID NO: 2331114 - RNA, 16 nt, Yersinia pestis KIM
gaaauaucaggaugaa

SEQ ID NO: 2331115 - RNA, 21 nt, Yersinia pestis KIM
gaaauagucacauuucagcgu

SEQ ID NO: 2331116 - RNA, 13 nt, Yersinia pestis KIM
gaaauccaaaucu

SEQ ID NO: 2331117 - RNA, 18 nt, Yersinia pestis KIM
gaaaucagaucaacagau

SEQ ID NO: 2331118 - RNA, 16 nt, Yersinia pestis KIM
gaaaucagcuucauua

SEQ ID NO: 2331119 - RNA, 15 nt, Yersinia pestis KIM
gaaaucaggcuguuc

SEQ ID NO: 2331120 - RNA, 17 nt, Yersinia pestis KIM
gaaaucaggcuguucuu

SEQ ID NO: 2331121 - RNA, 15 nt, Yersinia pestis KIM
gaaaucagaucaaca

SEQ ID NO: 2331122 - RNA, 14 nt, Yersinia pestis KIM
gaaaguguauuucu

SEQ ID NO: 2331123 - RNA, 15 nt, Yersinia pestis KIM
gaaaguugagcagca

SEQ ID NO: 2331124 - RNA, 13 nt, Yersinia pestis KIM
gaaaguggccacu

SEQ ID NO: 2331125 - RNA, 17 nt, Yersinia pestis KIM
gaaagguaugugccaaa

SEQ ID NO: 2331126 - RNA, 16 nt, Yersinia pestis KIM
gaaaggaauaucugug

SEQ ID NO: 2331127 - RNA, 17 nt, Yersinia pestis KIM
gaaaggaacaaaagaga

SEQ ID NO: 2331128 - RNA, 16 nt, Yersinia pestis KIM
gaacaacagcauccgc

SEQ ID NO: 2331129 - RNA, 15 nt, Yersinia pestis KIM
gaacaacagcauccg

SEQ ID NO: 2331130 - RNA, 16 nt, Yersinia pestis KIM
gaacaagacuuucccc

SEQ ID NO: 2331131 - RNA, 16 nt, Yersinia pestis KIM
gaacaccaacaccaca

SEQ ID NO: 2331132 - RNA, 14 nt, Yersinia pestis KIM
gaacagccccaacc

SEQ ID NO: 2331133 - RNA, 15 nt, Yersinia pestis KIM
gaacagcccuccagc

SEQ ID NO: 2331134 - RNA, 16 nt, Yersinia pestis KIM
gaacagugccaacagc

SEQ ID NO: 2331135 - RNA, 17 nt, Yersinia pestis KIM
gaacagugccaacagcg

SEQ ID NO: 2331136 - RNA, 21 nt, Yersinia pestis KIM
gaaaugccgccugacugcccg

SEQ ID NO: 2331137 - RNA, 17 nt, Yersinia pestis KIM
gaaaugccgauaaaaac

SEQ ID NO: 2331138 - RNA, 19 nt, Yersinia pestis KIM
gaaaugccgauaaaaacua

SEQ ID NO: 2331139 - RNA, 21 nt, Yersinia pestis KIM
gaaaucuccuguggcacauca

SEQ ID NO: 2331140 - RNA, 16 nt, Yersinia pestis KIM
gaaaucuaaguucagc

SEQ ID NO: 2331141 - RNA, 20 nt, Yersinia pestis KIM
gaaauuuaagaaaucuauua

SEQ ID NO: 2331142 - RNA, 13 nt, Yersinia pestis KIM
gaaauuauauucu

SEQ ID NO: 2331143 - RNA, 23 nt, Yersinia pestis KIM
aaagagcccgcaacgggagagaa

SEQ ID NO: 2331144 - RNA, 20 nt, Yersinia pestis KIM
gaaauuaaaaauuaauuauu

SEQ ID NO: 2331145 - RNA, 22 nt, Yersinia pestis KIM
aaagagcgcucuggcgcucuug

SEQ ID NO: 2331146 - RNA, 22 nt, Yersinia pestis KIM
cuuuuuacgccuauccucauga

SEQ ID NO: 2331147 - RNA, 17 nt, Yersinia pestis KIM
cuuuuuacguauuaucc

SEQ ID NO: 2331148 - RNA, 19 nt, Yersinia pestis KIM
cuuuuuaacuuacugcucu

SEQ ID NO: 2331149 - RNA, 13 nt, Yersinia pestis KIM
cuuuuuaaauacc

SEQ ID NO: 2331150 - RNA, 20 nt, Yersinia pestis KIM
cuuuuuauaagcguuauuuu

SEQ ID NO: 2331151 - RNA, 13 nt, Yersinia pestis KIM
cuuuuuauuuaag

SEQ ID NO: 2331152 - RNA, 20 nt, Yersinia pestis KIM
cuuuuucacacgcccaggcc

SEQ ID NO: 2331153 - RNA, 22 nt, Yersinia pestis KIM
gaaaaaauacgcuuucccccau

SEQ ID NO: 2331154 - RNA, 21 nt, Yersinia pestis KIM
gaaaaaaggauuuuauuaaau

SEQ ID NO: 2331155 - RNA, 18 nt, Yersinia pestis KIM
gaaaaaauaauggccaag

SEQ ID NO: 2331156 - RNA, 14 nt, Yersinia pestis KIM
gaaaaaauaauguc

SEQ ID NO: 2331157 - RNA, 12 nt, Yersinia pestis KIM
cuuuuuuguuuu

SEQ ID NO: 2331158 - RNA, 20 nt, Yersinia pestis KIM
cuuuuuuuauggugugggcg

SEQ ID NO: 2331159 - RNA, 17 nt, Yersinia pestis KIM
gaaaaacacuggcagcc

SEQ ID NO: 2331160 - RNA, 20 nt, Yersinia pestis KIM
gaaaaacgugaauauccugg

SEQ ID NO: 2331161 - RNA, 20 nt, Yersinia pestis KIM
cuuuuuugccugcucagcuc

SEQ ID NO: 2331162 - RNA, 20 nt, Yersinia pestis KIM
cuuuuugguugaacauuucc

SEQ ID NO: 2331163 - RNA, 10 nt, Yersinia pestis KIM
cuuuuugcuu

SEQ ID NO: 2331164 - RNA, 17 nt, Yersinia pestis KIM
cuuuuugcccgcgcuuc

SEQ ID NO: 2331165 - RNA, 15 nt, Yersinia pestis KIM
cuuuuuccacacccu

SEQ ID NO: 2331166 - RNA, 15 nt, Yersinia pestis KIM
gaaaccaaaucugac

SEQ ID NO: 2331167 - RNA, 21 nt, Yersinia pestis KIM
gaaaccacggcguuacuggcg

SEQ ID NO: 2331168 - RNA, 21 nt, Yersinia pestis KIM
gaaacaugcugaagccagcac

SEQ ID NO: 2331169 - RNA, 21 nt, Yersinia pestis KIM
gaaacagguaguggaaauagg

SEQ ID NO: 2331170 - RNA, 19 nt, Yersinia pestis KIM
gaaacaaaaccuaacgcca

SEQ ID NO: 2331171 - RNA, 20 nt, Yersinia pestis KIM
gaaacaaaaccaaccccacg

SEQ ID NO: 2331172 - RNA, 14 nt, Yersinia pestis KIM
gaaacaaaaccuaa

SEQ ID NO: 2331173 - RNA, 23 nt, Yersinia pestis KIM
gaaacacacuucgccgggucagg

SEQ ID NO: 2331174 - RNA, 17 nt, Yersinia pestis KIM
gaaacaccguguuccag

SEQ ID NO: 2331175 - RNA, 17 nt, Yersinia pestis KIM
gaaaaguggcuaucuga

SEQ ID NO: 2331176 - RNA, 14 nt, Yersinia pestis KIM
gaaaauagccaacc

SEQ ID NO: 2331177 - RNA, 17 nt, Yersinia pestis KIM
gaaaaaugagcaauuca

SEQ ID NO: 2331178 - RNA, 14 nt, Yersinia pestis KIM
gaaaagguauauuu

SEQ ID NO: 2331179 - RNA, 17 nt, Yersinia pestis KIM
gaaaagguuaacugcag

SEQ ID NO: 2331180 - RNA, 20 nt, Yersinia pestis KIM
cuuucagauaaugccuaagc

SEQ ID NO: 2331181 - RNA, 12 nt, Yersinia pestis KIM
cuuuccagcaaa

SEQ ID NO: 2331182 - RNA, 16 nt, Yersinia pestis KIM
cuuuccagccaauaca

SEQ ID NO: 2331183 - RNA, 13 nt, Yersinia pestis KIM
cuuucacguuggu

SEQ ID NO: 2331184 - RNA, 11 nt, Yersinia pestis KIM
cuuucaacgca

SEQ ID NO: 2331185 - RNA, 20 nt, Yersinia pestis KIM
cuuucaaaauugagauauuu

SEQ ID NO: 2331186 - RNA, 22 nt, Yersinia pestis KIM
cuuucaacaaauucaccagcaa

SEQ ID NO: 2331187 - RNA, 12 nt, Yersinia pestis KIM
cuuuaucugcca

SEQ ID NO: 2331188 - RNA, 17 nt, Yersinia pestis KIM
cuuuauacccaaaauaa

SEQ ID NO: 2331189 - RNA, 18 nt, Yersinia pestis KIM
cuuuauacccaaaauaau

SEQ ID NO: 2331190 - RNA, 13 nt, Yersinia pestis KIM
cuuuaguggguga

SEQ ID NO: 2331191 - RNA, 14 nt, Yersinia pestis KIM
cuuuacuugguuac

SEQ ID NO: 2331192 - RNA, 21 nt, Yersinia pestis KIM
aaagaaucagcgguugaaaag

SEQ ID NO: 2331193 - RNA, 21 nt, Yersinia pestis KIM
aaagaauaacuggagaauuua

SEQ ID NO: 2331194 - RNA, 16 nt, Yersinia pestis KIM
aaagaaugaauuuuuu

SEQ ID NO: 2331195 - RNA, 18 nt, Yersinia pestis KIM
cuuuacugguuugaauuc

SEQ ID NO: 2331196 - RNA, 23 nt, Yersinia pestis KIM
cuuuacuccccugccuauccuca

SEQ ID NO: 2331197 - RNA, 18 nt, Yersinia pestis KIM
cuuuacuccccugccuau

SEQ ID NO: 2331198 - RNA, 14 nt, Yersinia pestis KIM
cuuuacucuucaau

SEQ ID NO: 2331199 - RNA, 21 nt, Yersinia pestis KIM
cuuuacucuucugcccauccu

SEQ ID NO: 2331200 - RNA, 20 nt, Yersinia pestis KIM
cuuuacgggcggcauaaucc

SEQ ID NO: 2331201 - RNA, 22 nt, Yersinia pestis KIM
cuuuaccagccccgguuaaauu

SEQ ID NO: 2331202 - RNA, 15 nt, Yersinia pestis KIM
cuuuaauuuuucccu

SEQ ID NO: 2331203 - RNA, 22 nt, Yersinia pestis KIM
cuuuaaccaaagaacggccugc

SEQ ID NO: 2331204 - RNA, 22 nt, Yersinia pestis KIM
cuuucgauagucagcuucacuu

SEQ ID NO: 2331205 - RNA, 20 nt, Yersinia pestis KIM
cuuucgaccucaguuuugcu

SEQ ID NO: 2331206 - RNA, 21 nt, Yersinia pestis KIM
cuuucgaccucaguuuugcua

SEQ ID NO: 2331207 - RNA, 14 nt, Yersinia pestis KIM
cuuuccuuccucuu

SEQ ID NO: 2331208 - RNA, 14 nt, Yersinia pestis KIM
cuuucgacacauuu

SEQ ID NO: 2331209 - RNA, 23 nt, Yersinia pestis KIM
cuuuccagguuuuggcuaccuuc

SEQ ID NO: 2331210 - RNA, 16 nt, Yersinia pestis KIM
cuuugaacugcacccc

SEQ ID NO: 2331211 - RNA, 14 nt, Yersinia pestis KIM
cuuucuucagcggu

SEQ ID NO: 2331212 - RNA, 14 nt, Yersinia pestis KIM
cuuucugcaauagc

SEQ ID NO: 2331213 - RNA, 21 nt, Yersinia pestis KIM
cuuugagaaaggauuugaaga

SEQ ID NO: 2331214 - RNA, 18 nt, Yersinia pestis KIM
cuuugcccuuacuauuuu

SEQ ID NO: 2331215 - RNA, 14 nt, Yersinia pestis KIM
cuuuggaaccgcca

SEQ ID NO: 2331216 - RNA, 21 nt, Yersinia pestis KIM
cuuuggcaaucacaacccccc

SEQ ID NO: 2331217 - RNA, 13 nt, Yersinia pestis KIM
cuuuggcaucaau

SEQ ID NO: 2331218 - RNA, 21 nt, Yersinia pestis KIM
cuuuggcaaauuuagccgcaa

SEQ ID NO: 2331219 - RNA, 15 nt, Yersinia pestis KIM
cuuuggaaccgccau

SEQ ID NO: 2331220 - RNA, 15 nt, Yersinia pestis KIM
cuuugggcugaucau

SEQ ID NO: 2331221 - RNA, 18 nt, Yersinia pestis KIM
cuuugggauucaauaagu

SEQ ID NO: 2331222 - RNA, 11 nt, Yersinia pestis KIM
cuuguauuuaa

SEQ ID NO: 2331223 - RNA, 23 nt, Yersinia pestis KIM
cuugucaccguaaccauuggcac

SEQ ID NO: 2331224 - RNA, 17 nt, Yersinia pestis KIM
cuugucaccugaguaau

SEQ ID NO: 2331225 - RNA, 15 nt, Yersinia pestis KIM
cuugucaggauuuac

SEQ ID NO: 2331226 - RNA, 13 nt, Yersinia pestis KIM
aaacuuuucaguu

SEQ ID NO: 2331227 - RNA, 21 nt, Yersinia pestis KIM
aaacuuuuaugcaucuuuuag

SEQ ID NO: 2331228 - RNA, 22 nt, Yersinia pestis KIM
cuuggggcuuauugugccccaa

SEQ ID NO: 2331229 - RNA, 14 nt, Yersinia pestis KIM
cuugggugaagaca

SEQ ID NO: 2331230 - RNA, 19 nt, Yersinia pestis KIM
cuuggucauaccggcggca

SEQ ID NO: 2331231 - RNA, 22 nt, Yersinia pestis KIM
cuuggccgauaugaagcacaaa

SEQ ID NO: 2331232 - RNA, 21 nt, Yersinia pestis KIM
cuuggcauugucugcuggccu

SEQ ID NO: 2331233 - RNA, 16 nt, Yersinia pestis KIM
cuuggcauugucugcu

SEQ ID NO: 2331234 - RNA, 23 nt, Yersinia pestis KIM
cuuggagccagccauucugaauc

SEQ ID NO: 2331235 - RNA, 18 nt, Yersinia pestis KIM
cuuggaacuuacucccuu

SEQ ID NO: 2331236 - RNA, 21 nt, Yersinia pestis KIM
cuuggcgcggacgcuuuacuc

SEQ ID NO: 2331237 - RNA, 16 nt, Yersinia pestis KIM
aaagaaaaaucgccaa

SEQ ID NO: 2331238 - RNA, 19 nt, Yersinia pestis KIM
aaagaaauaaaagaaaacc

SEQ ID NO: 2331239 - RNA, 16 nt, Yersinia pestis KIM
cuuguggauccagcac

SEQ ID NO: 2331240 - RNA, 13 nt, Yersinia pestis KIM
cuuguuaggagaa

SEQ ID NO: 2331241 - RNA, 21 nt, Yersinia pestis KIM
cuuguguucuucaucuaaaua

SEQ ID NO: 2331242 - RNA, 16 nt, Yersinia pestis KIM
cuuguuaauuuaaaca

SEQ ID NO: 2331243 - RNA, 20 nt, Yersinia pestis KIM
aaagaagaauccacauaaaa

SEQ ID NO: 2331244 - RNA, 12 nt, Yersinia pestis KIM
aaagaagaauaa

SEQ ID NO: 2331245 - RNA, 23 nt, Yersinia pestis KIM
aaagaagacgaguaaugaaaucu

SEQ ID NO: 2331246 - RNA, 14 nt, Yersinia pestis KIM
aaagaagacauauc

SEQ ID NO: 2331247 - RNA, 20 nt, Yersinia pestis KIM
aaagaagacgaguaaugaaa

SEQ ID NO: 2331248 - RNA, 14 nt, Yersinia pestis KIM
aaagaaauaaucau

SEQ ID NO: 2331249 - RNA, 23 nt, Yersinia pestis KIM
cuuguuugcgccguaaacugccg

SEQ ID NO: 2331250 - RNA, 23 nt, Yersinia pestis KIM
cuuguuuaguaauuuccuuggca

SEQ ID NO: 2331251 - RNA, 19 nt, Yersinia pestis KIM
cuuguuucuggcacaagaa

SEQ ID NO: 2331252 - RNA, 19 nt, Yersinia pestis KIM
cuuuaaaccccgugcgcuc

SEQ ID NO: 2331253 - RNA, 16 nt, Yersinia pestis KIM
cuuuaaaucuagcccu

SEQ ID NO: 2331254 - RNA, 21 nt, Yersinia pestis KIM
cuuuaaauaacgcaaaaauca

SEQ ID NO: 2331255 - RNA, 14 nt, Yersinia pestis KIM
cuuauauaaaucca

SEQ ID NO: 2331256 - RNA, 16 nt, Yersinia pestis KIM
cuuauauuauucauau

SEQ ID NO: 2331257 - RNA, 22 nt, Yersinia pestis KIM
cuuauaucaauagugauuguuu

SEQ ID NO: 2331258 - RNA, 22 nt, Yersinia pestis KIM
cuuagcgcacacccgauggaac

SEQ ID NO: 2331259 - RNA, 15 nt, Yersinia pestis KIM
cuuauccguuaaccc

SEQ ID NO: 2331260 - RNA, 19 nt, Yersinia pestis KIM
cuuauuuaccuguuugcaa

SEQ ID NO: 2331261 - RNA, 22 nt, Yersinia pestis KIM
cuuauuuaccuguuugcaacau

SEQ ID NO: 2331262 - RNA, 17 nt, Yersinia pestis KIM
cuuaugguuaucacauc

SEQ ID NO: 2331263 - RNA, 18 nt, Yersinia pestis KIM
cuuauuugaaauacuuau

SEQ ID NO: 2331264 - RNA, 13 nt, Yersinia pestis KIM
cuuauuugaaaca

SEQ ID NO: 2331265 - RNA, 15 nt, Yersinia pestis KIM
cuuacccuacccauu

SEQ ID NO: 2331266 - RNA, 23 nt, Yersinia pestis KIM
cuuacauuucaucuugauuagcg

SEQ ID NO: 2331267 - RNA, 22 nt, Yersinia pestis KIM
cuuacauucgagcaacuuuuac

SEQ ID NO: 2331268 - RNA, 20 nt, Yersinia pestis KIM
cuuacagugaucaugggaaa

SEQ ID NO: 2331269 - RNA, 17 nt, Yersinia pestis KIM
cuuaaugucuuuacuaa

SEQ ID NO: 2331270 - RNA, 14 nt, Yersinia pestis KIM
cuuacauaaguaag

SEQ ID NO: 2331271 - RNA, 14 nt, Yersinia pestis KIM
cuuaaugaaugagu

SEQ ID NO: 2331272 - RNA, 16 nt, Yersinia pestis KIM
cuuaauggucuucuuu

SEQ ID NO: 2331273 - RNA, 23 nt, Yersinia pestis KIM
cuuaauggcaccguggauaaaca

SEQ ID NO: 2331274 - RNA, 15 nt, Yersinia pestis KIM
cuuaauucccagcca

SEQ ID NO: 2331275 - RNA, 14 nt, Yersinia pestis KIM
cuuaauuaacucuu

SEQ ID NO: 2331276 - RNA, 15 nt, Yersinia pestis KIM
cuuaauuaacucuuc

SEQ ID NO: 2331277 - RNA, 21 nt, Yersinia pestis KIM
cuuagcacguuuuucagcuuc

SEQ ID NO: 2331278 - RNA, 13 nt, Yersinia pestis KIM
cuuagcaggcccu

SEQ ID NO: 2331279 - RNA, 20 nt, Yersinia pestis KIM
cuuacugguaccaaucucca

SEQ ID NO: 2331280 - RNA, 14 nt, Yersinia pestis KIM
cuuacuguucaccg

SEQ ID NO: 2331281 - RNA, 22 nt, Yersinia pestis KIM
cuuacuguuuucauuauuuuca

SEQ ID NO: 2331282 - RNA, 16 nt, Yersinia pestis KIM
cuuacugcaucaauaa

SEQ ID NO: 2331283 - RNA, 16 nt, Yersinia pestis KIM
cuuacgaucacuuacc

SEQ ID NO: 2331284 - RNA, 18 nt, Yersinia pestis KIM
cuuacucccuuguugccu

SEQ ID NO: 2331285 - RNA, 14 nt, Yersinia pestis KIM
cuuacuauuuuucu

SEQ ID NO: 2331286 - RNA, 19 nt, Yersinia pestis KIM
cuuaccuucaguuuauuua

SEQ ID NO: 2331287 - RNA, 13 nt, Yersinia pestis KIM
cuggcccgccagc

SEQ ID NO: 2331288 - RNA, 17 nt, Yersinia pestis KIM
cuggcccccaaugacac

SEQ ID NO: 2331289 - RNA, 20 nt, Yersinia pestis KIM
cuguuacgguauuugaacuu

SEQ ID NO: 2331290 - RNA, 20 nt, Yersinia pestis KIM
cuguuauaaggcuaacaccu

SEQ ID NO: 2331291 - RNA, 14 nt, Yersinia pestis KIM
cuguuauaaaaaag

SEQ ID NO: 2331292 - RNA, 12 nt, Yersinia pestis KIM
cuguucaaaaug

SEQ ID NO: 2331293 - RNA, 21 nt, Yersinia pestis KIM
cuguuaucugguuauauugac

SEQ ID NO: 2331294 - RNA, 16 nt, Yersinia pestis KIM
cuguuauuacugucau

SEQ ID NO: 2331295 - RNA, 14 nt, Yersinia pestis KIM
cuguuuaguucacg

SEQ ID NO: 2331296 - RNA, 21 nt, Yersinia pestis KIM
cuguuuaguucacgauggaaa

SEQ ID NO: 2331297 - RNA, 22 nt, Yersinia pestis KIM
cuguuucaaauaaguauuucaa

SEQ ID NO: 2331298 - RNA, 12 nt, Yersinia pestis KIM
cuguuucaacau

SEQ ID NO: 2331299 - RNA, 17 nt, Yersinia pestis KIM
cuguuuugguuuccgcu

SEQ ID NO: 2331300 - RNA, 16 nt, Yersinia pestis KIM
cuguuugcaacauuau

SEQ ID NO: 2331301 - RNA, 14 nt, Yersinia pestis KIM
cuguuugcaccuuu

SEQ ID NO: 2331302 - RNA, 14 nt, Yersinia pestis KIM
cuguuuuuuauccc

SEQ ID NO: 2331303 - RNA, 13 nt, Yersinia pestis KIM
cuuaaaaaaagca

SEQ ID NO: 2331304 - RNA, 13 nt, Yersinia pestis KIM
cuuaaaaaucaaa

SEQ ID NO: 2331305 - RNA, 16 nt, Yersinia pestis KIM
cuuaaagaaauaaaua

SEQ ID NO: 2331306 - RNA, 15 nt, Yersinia pestis KIM
cuuaaagcccagguu

SEQ ID NO: 2331307 - RNA, 15 nt, Yersinia pestis KIM
cuuaaauaauuuucu

SEQ ID NO: 2331308 - RNA, 22 nt, Yersinia pestis KIM
cuuaaauauaccgccaagcgcc

SEQ ID NO: 2331309 - RNA, 14 nt, Yersinia pestis KIM
cuuaaauaguucuu

SEQ ID NO: 2331310 - RNA, 21 nt, Yersinia pestis KIM
cuuaacaaucagugcaauaaa

SEQ ID NO: 2331311 - RNA, 18 nt, Yersinia pestis KIM
aaacuggcccagcuuuau

SEQ ID NO: 2331312 - RNA, 22 nt, Yersinia pestis KIM
cuuaacgauauuuacucaucua

SEQ ID NO: 2331313 - RNA, 16 nt, Yersinia pestis KIM
cuucggucucuggaug

SEQ ID NO: 2331314 - RNA, 17 nt, Yersinia pestis KIM
cuucgcgaacacaauug

SEQ ID NO: 2331315 - RNA, 12 nt, Yersinia pestis KIM
cuucgagcaccg

SEQ ID NO: 2331316 - RNA, 19 nt, Yersinia pestis KIM
cuucccgaguaauaccaaa

SEQ ID NO: 2331317 - RNA, 23 nt, Yersinia pestis KIM
cuuccauaaacggaacucaucuu

SEQ ID NO: 2331318 - RNA, 23 nt, Yersinia pestis KIM
cuuccaggauauucacguuuuuc

SEQ ID NO: 2331319 - RNA, 14 nt, Yersinia pestis KIM
cuuccggcaucuuu

SEQ ID NO: 2331320 - RNA, 15 nt, Yersinia pestis KIM
cuuccggcaucuuuu

SEQ ID NO: 2331321 - RNA, 16 nt, Yersinia pestis KIM
cuucccuauucaaaau

SEQ ID NO: 2331322 - RNA, 16 nt, Yersinia pestis KIM
cuuccaacucaccuaa

SEQ ID NO: 2331323 - RNA, 21 nt, Yersinia pestis KIM
aaacuuccagcguauguuccu

SEQ ID NO: 2331324 - RNA, 16 nt, Yersinia pestis KIM
aaacuucacuuucuuu

SEQ ID NO: 2331325 - RNA, 17 nt, Yersinia pestis KIM
aaacuucacaaugcaca

SEQ ID NO: 2331326 - RNA, 15 nt, Yersinia pestis KIM
cuucauuucaggacu

SEQ ID NO: 2331327 - RNA, 17 nt, Yersinia pestis KIM
cuucauugccuucuauc

SEQ ID NO: 2331328 - RNA, 17 nt, Yersinia pestis KIM
cuucaguggcuggaaag

SEQ ID NO: 2331329 - RNA, 22 nt, Yersinia pestis KIM
cuucagaugaauccagccaugc

SEQ ID NO: 2331330 - RNA, 16 nt, Yersinia pestis KIM
cuucagagccauagau

SEQ ID NO: 2331331 - RNA, 14 nt, Yersinia pestis KIM
cuucagccaccaga

SEQ ID NO: 2331332 - RNA, 15 nt, Yersinia pestis KIM
cuucagcucuucuaa

SEQ ID NO: 2331333 - RNA, 22 nt, Yersinia pestis KIM
cuucagcucuucuaacacuuca

SEQ ID NO: 2331334 - RNA, 20 nt, Yersinia pestis KIM
cuucaggaauaaacagcagu

SEQ ID NO: 2331335 - RNA, 19 nt, Yersinia pestis KIM
cuucaggccaagccugugc

SEQ ID NO: 2331336 - RNA, 14 nt, Yersinia pestis KIM
cuucaggccaagcc

SEQ ID NO: 2331337 - RNA, 20 nt, Yersinia pestis KIM
cuucaggccaagccugugcu

SEQ ID NO: 2331338 - RNA, 12 nt, Yersinia pestis KIM
cuucaccaauac

SEQ ID NO: 2331339 - RNA, 14 nt, Yersinia pestis KIM
cuucaccaauacaa

SEQ ID NO: 2331340 - RNA, 22 nt, Yersinia pestis KIM
cuucaccacugugauaaacccc

SEQ ID NO: 2331341 - RNA, 15 nt, Yersinia pestis KIM
cuucacauuuucucc

SEQ ID NO: 2331342 - RNA, 13 nt, Yersinia pestis KIM
cuucacucagcgc

SEQ ID NO: 2331343 - RNA, 19 nt, Yersinia pestis KIM
cuucacucagcgcuggcga

SEQ ID NO: 2331344 - RNA, 15 nt, Yersinia pestis KIM
cuucacccuggcucu

SEQ ID NO: 2331345 - RNA, 16 nt, Yersinia pestis KIM
cuucacccuggcucug

SEQ ID NO: 2331346 - RNA, 20 nt, Yersinia pestis KIM
cuucacggacagcaaccacu

SEQ ID NO: 2331347 - RNA, 11 nt, Yersinia pestis KIM
cuucaagcccg

SEQ ID NO: 2331348 - RNA, 16 nt, Yersinia pestis KIM
cuucaaucauugagau

SEQ ID NO: 2331349 - RNA, 13 nt, Yersinia pestis KIM
cuucaacuuuuuu

SEQ ID NO: 2331350 - RNA, 18 nt, Yersinia pestis KIM
aaacuugauucaccagau

SEQ ID NO: 2331351 - RNA, 18 nt, Yersinia pestis KIM
cuugcccuuugcuauuca

SEQ ID NO: 2331352 - RNA, 17 nt, Yersinia pestis KIM
cuugcccuuuuuugugu

SEQ ID NO: 2331353 - RNA, 21 nt, Yersinia pestis KIM
cuugcugguauucaucagcaa

SEQ ID NO: 2331354 - RNA, 15 nt, Yersinia pestis KIM
cuuggaaaacagcaa

SEQ ID NO: 2331355 - RNA, 21 nt, Yersinia pestis KIM
cuugcuaccaagacuucauga

SEQ ID NO: 2331356 - RNA, 13 nt, Yersinia pestis KIM
cuugcugcaaccg

SEQ ID NO: 2331357 - RNA, 14 nt, Yersinia pestis KIM
cuugcugaugccca

SEQ ID NO: 2331358 - RNA, 22 nt, Yersinia pestis KIM
cuugcugaaaacaauauaauaa

SEQ ID NO: 2331359 - RNA, 19 nt, Yersinia pestis KIM
cuugcucucuucauagcua

SEQ ID NO: 2331360 - RNA, 21 nt, Yersinia pestis KIM
cuugcgccgaaauaaaaccau

SEQ ID NO: 2331361 - RNA, 13 nt, Yersinia pestis KIM
cuugcgcgccugu

SEQ ID NO: 2331362 - RNA, 15 nt, Yersinia pestis KIM
cuugcgcgaaauauu

SEQ ID NO: 2331363 - RNA, 22 nt, Yersinia pestis KIM
cuugcgcgcugggacgcuuaau

SEQ ID NO: 2331364 - RNA, 21 nt, Yersinia pestis KIM
cuugcgcguuaaucugcugcu

SEQ ID NO: 2331365 - RNA, 15 nt, Yersinia pestis KIM
cuugcgcuccacgcc

SEQ ID NO: 2331366 - RNA, 21 nt, Yersinia pestis KIM
cuugcaacaacgccucaucuu

SEQ ID NO: 2331367 - RNA, 15 nt, Yersinia pestis KIM
cuugcaacauuaucc

SEQ ID NO: 2331368 - RNA, 20 nt, Yersinia pestis KIM
cuugcaauucauguugccaa

SEQ ID NO: 2331369 - RNA, 12 nt, Yersinia pestis KIM
cuugauuaaaug

SEQ ID NO: 2331370 - RNA, 16 nt, Yersinia pestis KIM
cuugauuagcuggcug

SEQ ID NO: 2331371 - RNA, 15 nt, Yersinia pestis KIM
cuugauucucaaagg

SEQ ID NO: 2331372 - RNA, 13 nt, Yersinia pestis KIM
cuugauggcauca

SEQ ID NO: 2331373 - RNA, 22 nt, Yersinia pestis KIM
cuugaugaaguuauuuuuauua

SEQ ID NO: 2331374 - RNA, 19 nt, Yersinia pestis KIM
cuugccacucugcuccgca

SEQ ID NO: 2331375 - RNA, 22 nt, Yersinia pestis KIM
cuugcccaccgacgccacacca

SEQ ID NO: 2331376 - RNA, 13 nt, Yersinia pestis KIM
cuugcaucaacuu

SEQ ID NO: 2331377 - RNA, 19 nt, Yersinia pestis KIM
cuugcagugcuucaucacu

SEQ ID NO: 2331378 - RNA, 17 nt, Yersinia pestis KIM
cuugcagcgucaugguc

SEQ ID NO: 2331379 - RNA, 22 nt, Yersinia pestis KIM
cuugcagcacaccggccaaaau

SEQ ID NO: 2331380 - RNA, 13 nt, Yersinia pestis KIM
cuugaucaacuca

SEQ ID NO: 2331381 - RNA, 19 nt, Yersinia pestis KIM
cuugaucgcauccucaaca

SEQ ID NO: 2331382 - RNA, 22 nt, Yersinia pestis KIM
cuugauagggcugaagacccaa

SEQ ID NO: 2331383 - RNA, 21 nt, Yersinia pestis KIM
cuugauagggcugaagaccca

SEQ ID NO: 2331384 - RNA, 22 nt, Yersinia pestis KIM
cuugauaucuucggcggcuaaa

SEQ ID NO: 2331385 - RNA, 18 nt, Yersinia pestis KIM
cuugaguccaaccaccaa

SEQ ID NO: 2331386 - RNA, 18 nt, Yersinia pestis KIM
cuugaguauccaauaagc

SEQ ID NO: 2331387 - RNA, 19 nt, Yersinia pestis KIM
cuugaggugcuugaacaac

SEQ ID NO: 2331388 - RNA, 16 nt, Yersinia pestis KIM
cuugacuaacacgacu

SEQ ID NO: 2331389 - RNA, 16 nt, Yersinia pestis KIM
cuugaccuucccucuu

SEQ ID NO: 2331390 - RNA, 21 nt, Yersinia pestis KIM
cuugacgacaauauaauaaug

SEQ ID NO: 2331391 - RNA, 14 nt, Yersinia pestis KIM
cuugagauccucca

SEQ ID NO: 2331392 - RNA, 21 nt, Yersinia pestis KIM
cuugacugaccauaaaaggau

SEQ ID NO: 2331393 - RNA, 15 nt, Yersinia pestis KIM
cuugacucuucagcg

SEQ ID NO: 2331394 - RNA, 19 nt, Yersinia pestis KIM
cuugacucuucagcgggaa

SEQ ID NO: 2331395 - RNA, 14 nt, Yersinia pestis KIM
cuugaaccaauuuu

SEQ ID NO: 2331396 - RNA, 16 nt, Yersinia pestis KIM
cuugaaccaauuuuuc

SEQ ID NO: 2331397 - RNA, 20 nt, Yersinia pestis KIM
cuugaaacaacccaaagggg

SEQ ID NO: 2331398 - RNA, 18 nt, Yersinia pestis KIM
cuucuuuuaaagaagaau

SEQ ID NO: 2331399 - RNA, 11 nt, Yersinia pestis KIM
cuugaagagug

SEQ ID NO: 2331400 - RNA, 17 nt, Yersinia pestis KIM
cuugaacggugaggaua

SEQ ID NO: 2331401 - RNA, 21 nt, Yersinia pestis KIM
cuugaaguacggugccagcag

SEQ ID NO: 2331402 - RNA, 22 nt, Yersinia pestis KIM
cuugaagugcgaagcgcaccca

SEQ ID NO: 2331403 - RNA, 13 nt, Yersinia pestis KIM
cuugaccaaccug

SEQ ID NO: 2331404 - RNA, 15 nt, Yersinia pestis KIM
cuugaccaaccuguu

SEQ ID NO: 2331405 - RNA, 16 nt, Yersinia pestis KIM
cuugaauaauauucaa

SEQ ID NO: 2331406 - RNA, 17 nt, Yersinia pestis KIM
cuugaaucaaaauaccc

SEQ ID NO: 2331407 - RNA, 13 nt, Yersinia pestis KIM
cuucuucauccca

SEQ ID NO: 2331408 - RNA, 20 nt, Yersinia pestis KIM
cuucuucgauuuuagcuuug

SEQ ID NO: 2331409 - RNA, 18 nt, Yersinia pestis KIM
cuucuuggguggcaauuu

SEQ ID NO: 2331410 - RNA, 15 nt, Yersinia pestis KIM
cuucuggcgugucau

SEQ ID NO: 2331411 - RNA, 19 nt, Yersinia pestis KIM
cuucugguggugucacauu

SEQ ID NO: 2331412 - RNA, 23 nt, Yersinia pestis KIM
cuucugggaucaucgcuugauca

SEQ ID NO: 2331413 - RNA, 18 nt, Yersinia pestis KIM
cuucuguauaugaagaua

SEQ ID NO: 2331414 - RNA, 19 nt, Yersinia pestis KIM
cuucuguugcccccugcuc

SEQ ID NO: 2331415 - RNA, 23 nt, Yersinia pestis KIM
cuucuguugcuucacggacagca

SEQ ID NO: 2331416 - RNA, 13 nt, Yersinia pestis KIM
cuucuuaucuuuu

SEQ ID NO: 2331417 - RNA, 18 nt, Yersinia pestis KIM
cuucuaggugcucugccu

SEQ ID NO: 2331418 - RNA, 18 nt, Yersinia pestis KIM
cuucuaccguaucagccc

SEQ ID NO: 2331419 - RNA, 14 nt, Yersinia pestis KIM
cuucuaacacuuca

SEQ ID NO: 2331420 - RNA, 17 nt, Yersinia pestis KIM
cuucguagggcacuuuc

SEQ ID NO: 2331421 - RNA, 16 nt, Yersinia pestis KIM
cuucucguauccccug

SEQ ID NO: 2331422 - RNA, 15 nt, Yersinia pestis KIM
cuucuccuguauuug

SEQ ID NO: 2331423 - RNA, 20 nt, Yersinia pestis KIM
cuucuccgcgcaaccuggcc

SEQ ID NO: 2331424 - RNA, 20 nt, Yersinia pestis KIM
cuucugcccauccucaccgu

SEQ ID NO: 2331425 - RNA, 18 nt, Yersinia pestis KIM
cuucugauuuuuuguucu

SEQ ID NO: 2331426 - RNA, 14 nt, Yersinia pestis KIM
cggcgucugauaac

SEQ ID NO: 2331427 - RNA, 18 nt, Yersinia pestis KIM
cggcguuaaugccacccc

SEQ ID NO: 2331428 - RNA, 15 nt, Yersinia pestis KIM
cggcgucaaggacgc

SEQ ID NO: 2331429 - RNA, 18 nt, Yersinia pestis KIM
cggcgucgccaccccauu

SEQ ID NO: 2331430 - RNA, 19 nt, Yersinia pestis KIM
cggcuagccaccucacuca

SEQ ID NO: 2331431 - RNA, 22 nt, Yersinia pestis KIM
cggcguuaaugccacccccagu

SEQ ID NO: 2331432 - RNA, 20 nt, Yersinia pestis KIM
cggcguuacaguaaggcagc

SEQ ID NO: 2331433 - RNA, 15 nt, Yersinia pestis KIM
cggcguucagcaaua

SEQ ID NO: 2331434 - RNA, 17 nt, Yersinia pestis KIM
cggcucaccuggccucc

SEQ ID NO: 2331435 - RNA, 15 nt, Yersinia pestis KIM
cggcuaugugaaugc

SEQ ID NO: 2331436 - RNA, 15 nt, Yersinia pestis KIM
cggcuccaggcauua

SEQ ID NO: 2331437 - RNA, 17 nt, Yersinia pestis KIM
cggcuccaggcauuaaa

SEQ ID NO: 2331438 - RNA, 23 nt, Yersinia pestis KIM
cgggaacaggaucugcuccucuu

SEQ ID NO: 2331439 - RNA, 16 nt, Yersinia pestis KIM
cggcuuuuaucuucca

SEQ ID NO: 2331440 - RNA, 20 nt, Yersinia pestis KIM
cggcuuuauuugcugccugu

SEQ ID NO: 2331441 - RNA, 15 nt, Yersinia pestis KIM
cggcuuuacuggcug

SEQ ID NO: 2331442 - RNA, 16 nt, Yersinia pestis KIM
cggcuuuauaguccuu

SEQ ID NO: 2331443 - RNA, 14 nt, Yersinia pestis KIM
cggcuucagcaccu

SEQ ID NO: 2331444 - RNA, 15 nt, Yersinia pestis KIM
cggcuguaaccgccu

SEQ ID NO: 2331445 - RNA, 16 nt, Yersinia pestis KIM
cggcuguaaccgccug

SEQ ID NO: 2331446 - RNA, 20 nt, Yersinia pestis KIM
cggcucuaucgauaaaguca

SEQ ID NO: 2331447 - RNA, 17 nt, Yersinia pestis KIM
cggcugaccacaaaaac

SEQ ID NO: 2331448 - RNA, 22 nt, Yersinia pestis KIM
cggcugaccacaaaaacagugu

SEQ ID NO: 2331449 - RNA, 17 nt, Yersinia pestis KIM
cggcucucuuucuccaa

SEQ ID NO: 2331450 - RNA, 13 nt, Yersinia pestis KIM
cggcugcaauaag

SEQ ID NO: 2331451 - RNA, 17 nt, Yersinia pestis KIM
cggcuggucaucacgcu

SEQ ID NO: 2331452 - RNA, 15 nt, Yersinia pestis KIM
cgggcggccucugcu

SEQ ID NO: 2331453 - RNA, 23 nt, Yersinia pestis KIM
cgggcggcauaauccucaaccug

SEQ ID NO: 2331454 - RNA, 19 nt, Yersinia pestis KIM
cgggcggaaauaaggcgca

SEQ ID NO: 2331455 - RNA, 20 nt, Yersinia pestis KIM
cgggcgcugagcgggcggca

SEQ ID NO: 2331456 - RNA, 22 nt, Yersinia pestis KIM
cgggcgcagccacaugauuacc

SEQ ID NO: 2331457 - RNA, 14 nt, Yersinia pestis KIM
cgggccuaauuuaa

SEQ ID NO: 2331458 - RNA, 22 nt, Yersinia pestis KIM
cgggccuuugcuuuucugccua

SEQ ID NO: 2331459 - RNA, 22 nt, Yersinia pestis KIM
cgggccagcaaccacgguauca

SEQ ID NO: 2331460 - RNA, 22 nt, Yersinia pestis KIM
cgggauggaaauugaacgguuu

SEQ ID NO: 2331461 - RNA, 18 nt, Yersinia pestis KIM
cgggauccaucugauaag

SEQ ID NO: 2331462 - RNA, 22 nt, Yersinia pestis KIM
cgggaggauaaguuccggcaga

SEQ ID NO: 2331463 - RNA, 22 nt, Yersinia pestis KIM
cgggaggaaggcuugaacguga

SEQ ID NO: 2331464 - RNA, 12 nt, Yersinia pestis KIM
cgggauaauaga

SEQ ID NO: 2331465 - RNA, 18 nt, Yersinia pestis KIM
cgggaaucuugauuagcu

SEQ ID NO: 2331466 - RNA, 23 nt, Yersinia pestis KIM
cgggaauucuuuggcaaauuuag

SEQ ID NO: 2331467 - RNA, 15 nt, Yersinia pestis KIM
cgggcauucacugcu

SEQ ID NO: 2331468 - RNA, 19 nt, Yersinia pestis KIM
cgggcacuuugucaauaac

SEQ ID NO: 2331469 - RNA, 22 nt, Yersinia pestis KIM
cgggcaaacgccagugcaaaau

SEQ ID NO: 2331470 - RNA, 14 nt, Yersinia pestis KIM
cgggcaacagagaa

SEQ ID NO: 2331471 - RNA, 15 nt, Yersinia pestis KIM
cgggcaacagagaaa

SEQ ID NO: 2331472 - RNA, 13 nt, Yersinia pestis KIM
cgggcaccaugcc

SEQ ID NO: 2331473 - RNA, 21 nt, Yersinia pestis KIM
cgggcaccugacgcagaagua

SEQ ID NO: 2331474 - RNA, 18 nt, Yersinia pestis KIM
cggggguggcugccugga

SEQ ID NO: 2331475 - RNA, 17 nt, Yersinia pestis KIM
cggggauccauaggauc

SEQ ID NO: 2331476 - RNA, 18 nt, Yersinia pestis KIM
cgggcuuccaucaggaag

SEQ ID NO: 2331477 - RNA, 15 nt, Yersinia pestis KIM
cgggcuucaccaucu

SEQ ID NO: 2331478 - RNA, 18 nt, Yersinia pestis KIM
cgggcugucuugcguucu

SEQ ID NO: 2331479 - RNA, 22 nt, Yersinia pestis KIM
cgggcuaucaucaaaggcaaua

SEQ ID NO: 2331480 - RNA, 14 nt, Yersinia pestis KIM
cgggugagugagcg

SEQ ID NO: 2331481 - RNA, 19 nt, Yersinia pestis KIM
cgggucucucaccgcugcu

SEQ ID NO: 2331482 - RNA, 20 nt, Yersinia pestis KIM
cgggucgucucuugcaauga

SEQ ID NO: 2331483 - RNA, 14 nt, Yersinia pestis KIM
cggguauauugccc

SEQ ID NO: 2331484 - RNA, 14 nt, Yersinia pestis KIM
cggguauaucacuu

SEQ ID NO: 2331485 - RNA, 15 nt, Yersinia pestis KIM
cgggucagcucacca

SEQ ID NO: 2331486 - RNA, 13 nt, Yersinia pestis KIM
cggguucuaaauc

SEQ ID NO: 2331487 - RNA, 18 nt, Yersinia pestis KIM
cggguucgcgcucacgca

SEQ ID NO: 2331488 - RNA, 15 nt, Yersinia pestis KIM
cggguucaaggaaac

SEQ ID NO: 2331489 - RNA, 17 nt, Yersinia pestis KIM
cggguucaaggaaacca

SEQ ID NO: 2331490 - RNA, 17 nt, Yersinia pestis KIM
cggguuaacucuucaac

SEQ ID NO: 2331491 - RNA, 17 nt, Yersinia pestis KIM
cggguuaacuuuuucua

SEQ ID NO: 2331492 - RNA, 21 nt, Yersinia pestis KIM
cggguuaauagcaagcacggc

SEQ ID NO: 2331493 - RNA, 20 nt, Yersinia pestis KIM
cggguugcccaucagcauca

SEQ ID NO: 2331494 - RNA, 19 nt, Yersinia pestis KIM
cggguuuaauucaggccaa

SEQ ID NO: 2331495 - RNA, 23 nt, Yersinia pestis KIM
cgguaacauauaaaccagccagu

SEQ ID NO: 2331496 - RNA, 17 nt, Yersinia pestis KIM
cggugacccgugcggca

SEQ ID NO: 2331497 - RNA, 21 nt, Yersinia pestis KIM
cggugacauccgcuugcagca

SEQ ID NO: 2331498 - RNA, 18 nt, Yersinia pestis KIM
cggugaggauaggcagag

SEQ ID NO: 2331499 - RNA, 19 nt, Yersinia pestis KIM
cggugagggagucagggag

SEQ ID NO: 2331500 - RNA, 12 nt, Yersinia pestis KIM
cggucagggaaa

SEQ ID NO: 2331501 - RNA, 20 nt, Yersinia pestis KIM
cggucauuguagauggccau

SEQ ID NO: 2331502 - RNA, 23 nt, Yersinia pestis KIM
cggucgcccgcuaccacuccuua

SEQ ID NO: 2331503 - RNA, 14 nt, Yersinia pestis KIM
cgguagaccaccaa

SEQ ID NO: 2331504 - RNA, 15 nt, Yersinia pestis KIM
cgguacugaaaucca

SEQ ID NO: 2331505 - RNA, 13 nt, Yersinia pestis KIM
cgguacugaggca

SEQ ID NO: 2331506 - RNA, 15 nt, Yersinia pestis KIM
cgguagcgauaaacg

SEQ ID NO: 2331507 - RNA, 17 nt, Yersinia pestis KIM
cgguaauggccaauuuu

SEQ ID NO: 2331508 - RNA, 15 nt, Yersinia pestis KIM
cgguaauaaaucaug

SEQ ID NO: 2331509 - RNA, 16 nt, Yersinia pestis KIM
cgguaacgcagauaaa

SEQ ID NO: 2331510 - RNA, 18 nt, Yersinia pestis KIM
cgguaacgcagauaaauc

SEQ ID NO: 2331511 - RNA, 14 nt, Yersinia pestis KIM
cgguaaccagcauc

SEQ ID NO: 2331512 - RNA, 16 nt, Yersinia pestis KIM
aaacuaacgcgugaag

SEQ ID NO: 2331513 - RNA, 13 nt, Yersinia pestis KIM
aaacuaaaauaau

SEQ ID NO: 2331514 - RNA, 13 nt, Yersinia pestis KIM
cggucacaccaga

SEQ ID NO: 2331515 - RNA, 13 nt, Yersinia pestis KIM
cuaaauaauucca

SEQ ID NO: 2331516 - RNA, 17 nt, Yersinia pestis KIM
cuaaauagauaaaaaca

SEQ ID NO: 2331517 - RNA, 18 nt, Yersinia pestis KIM
cuaaagcgccuuccuuuu

SEQ ID NO: 2331518 - RNA, 23 nt, Yersinia pestis KIM
cuaaagcguaagugcaauuauuu

SEQ ID NO: 2331519 - RNA, 17 nt, Yersinia pestis KIM
cuaaagcugucagucca

SEQ ID NO: 2331520 - RNA, 24 nt, Yersinia pestis KIM
cuaaauuagaaaacaaguuucacu

SEQ ID NO: 2331521 - RNA, 18 nt, Yersinia pestis KIM
cuaaauugcuuaaaaaaa

SEQ ID NO: 2331522 - RNA, 14 nt, Yersinia pestis KIM
cuaaauuguacauu

SEQ ID NO: 2331523 - RNA, 22 nt, Yersinia pestis KIM
cuaaauucuccuugagcggcau

SEQ ID NO: 2331524 - RNA, 22 nt, Yersinia pestis KIM
cuaaaugacauauugugcuauc

SEQ ID NO: 2331525 - RNA, 14 nt, Yersinia pestis KIM
cguuuccaaaacuc

SEQ ID NO: 2331526 - RNA, 24 nt, Yersinia pestis KIM
cguuucauuuuaacaauuuuauug

SEQ ID NO: 2331527 - RNA, 16 nt, Yersinia pestis KIM
cguuucagcuccgauu

SEQ ID NO: 2331528 - RNA, 13 nt, Yersinia pestis KIM
cguuucucuuuca

SEQ ID NO: 2331529 - RNA, 19 nt, Yersinia pestis KIM
cuaaaaaccauccccagaa

SEQ ID NO: 2331530 - RNA, 20 nt, Yersinia pestis KIM
cuaaaaacucgcgccugaaa

SEQ ID NO: 2331531 - RNA, 14 nt, Yersinia pestis KIM
cuaaagcaaagauc

SEQ ID NO: 2331532 - RNA, 21 nt, Yersinia pestis KIM
cuaaacgccgcgucaauaaca

SEQ ID NO: 2331533 - RNA, 17 nt, Yersinia pestis KIM
cuaaaaugaauaacgcc

SEQ ID NO: 2331534 - RNA, 18 nt, Yersinia pestis KIM
cuaaaaugaucuuuauua

SEQ ID NO: 2331535 - RNA, 19 nt, Yersinia pestis KIM
cuaaaauaucacuauaauu

SEQ ID NO: 2331536 - RNA, 16 nt, Yersinia pestis KIM
cguuccaaucugcgcc

SEQ ID NO: 2331537 - RNA, 15 nt, Yersinia pestis KIM
cguuaaccaguagcg

SEQ ID NO: 2331538 - RNA, 13 nt, Yersinia pestis KIM
cguuccagugguc

SEQ ID NO: 2331539 - RNA, 14 nt, Yersinia pestis KIM
cguucccacuucca

SEQ ID NO: 2331540 - RNA, 14 nt, Yersinia pestis KIM
cguucugucacaau

SEQ ID NO: 2331541 - RNA, 20 nt, Yersinia pestis KIM
cguugacuuucuaagcugcc

SEQ ID NO: 2331542 - RNA, 21 nt, Yersinia pestis KIM
cguuggaucaucgggaacagg

SEQ ID NO: 2331543 - RNA, 20 nt, Yersinia pestis KIM
cguuggaucaucgggaacag

SEQ ID NO: 2331544 - RNA, 14 nt, Yersinia pestis KIM
cguuuacugccuug

SEQ ID NO: 2331545 - RNA, 19 nt, Yersinia pestis KIM
cguuggccggccaacaucg

SEQ ID NO: 2331546 - RNA, 13 nt, Yersinia pestis KIM
cguuuaaauaaaa

SEQ ID NO: 2331547 - RNA, 16 nt, Yersinia pestis KIM
cguggcguucccgcag

SEQ ID NO: 2331548 - RNA, 13 nt, Yersinia pestis KIM
cguggcugaaauc

SEQ ID NO: 2331549 - RNA, 15 nt, Yersinia pestis KIM
cguggguucuucaaa

SEQ ID NO: 2331550 - RNA, 14 nt, Yersinia pestis KIM
cgugggcauuuuuu

SEQ ID NO: 2331551 - RNA, 15 nt, Yersinia pestis KIM
cgugggcgcagguaa

SEQ ID NO: 2331552 - RNA, 21 nt, Yersinia pestis KIM
cguggccccaagcauagaaga

SEQ ID NO: 2331553 - RNA, 21 nt, Yersinia pestis KIM
cguggcccuuucgcagcccaa

SEQ ID NO: 2331554 - RNA, 20 nt, Yersinia pestis KIM
cguggccgugaccaccgcag

SEQ ID NO: 2331555 - RNA, 21 nt, Yersinia pestis KIM
cguggccgugaccaccgcagc

SEQ ID NO: 2331556 - RNA, 18 nt, Yersinia pestis KIM
cguggaguagagcuucca

SEQ ID NO: 2331557 - RNA, 20 nt, Yersinia pestis KIM
cgugcucaucaaccucagcc

SEQ ID NO: 2331558 - RNA, 21 nt, Yersinia pestis KIM
cgugcucaucaaccucagccu

SEQ ID NO: 2331559 - RNA, 20 nt, Yersinia pestis KIM
cgugguugcggcaccugccc

SEQ ID NO: 2331560 - RNA, 16 nt, Yersinia pestis KIM
cguguaagaacuggcu

SEQ ID NO: 2331561 - RNA, 16 nt, Yersinia pestis KIM
cgugucaaugguucac

SEQ ID NO: 2331562 - RNA, 23 nt, Yersinia pestis KIM
cguguauaucacuauuucagaca

SEQ ID NO: 2331563 - RNA, 20 nt, Yersinia pestis KIM
cgugguaccuacuuuauuuu

SEQ ID NO: 2331564 - RNA, 13 nt, Yersinia pestis KIM
cgugugauaaacu

SEQ ID NO: 2331565 - RNA, 21 nt, Yersinia pestis KIM
cguguggagaacucauuuuuu

SEQ ID NO: 2331566 - RNA, 18 nt, Yersinia pestis KIM
cgugugcuguaagaaaaa

SEQ ID NO: 2331567 - RNA, 22 nt, Yersinia pestis KIM
cgugcaauaaagcgauaaauac

SEQ ID NO: 2331568 - RNA, 16 nt, Yersinia pestis KIM
cgugccagauccucuu

SEQ ID NO: 2331569 - RNA, 20 nt, Yersinia pestis KIM
cgugagucagguggcuauuc

SEQ ID NO: 2331570 - RNA, 18 nt, Yersinia pestis KIM
cgugaguaucgauaagaa

SEQ ID NO: 2331571 - RNA, 14 nt, Yersinia pestis KIM
cgugcaauaaagcg

SEQ ID NO: 2331572 - RNA, 13 nt, Yersinia pestis KIM
cgugauaucccca

SEQ ID NO: 2331573 - RNA, 17 nt, Yersinia pestis KIM
cgugauaugccugaagu

SEQ ID NO: 2331574 - RNA, 17 nt, Yersinia pestis KIM
cgucuuuuaccaaugaa

SEQ ID NO: 2331575 - RNA, 14 nt, Yersinia pestis KIM
cgucuucagcuucc

SEQ ID NO: 2331576 - RNA, 22 nt, Yersinia pestis KIM
cgugaaacgauaugcuccagau

SEQ ID NO: 2331577 - RNA, 22 nt, Yersinia pestis KIM
cgugaacccgauuugaacgcga

SEQ ID NO: 2331578 - RNA, 16 nt, Yersinia pestis KIM
cgugacggcagcgagc

SEQ ID NO: 2331579 - RNA, 23 nt, Yersinia pestis KIM
cgugacggcggcgagcacugccc

SEQ ID NO: 2331580 - RNA, 14 nt, Yersinia pestis KIM
cgugaccaccgcag

SEQ ID NO: 2331581 - RNA, 17 nt, Yersinia pestis KIM
cgugaccaccgcagcaa

SEQ ID NO: 2331582 - RNA, 18 nt, Yersinia pestis KIM
cgucucuaacccauuggu

SEQ ID NO: 2331583 - RNA, 12 nt, Yersinia pestis KIM
cgucgcaagaga

SEQ ID NO: 2331584 - RNA, 21 nt, Yersinia pestis KIM
cgucgcaagagagccaaaaug

SEQ ID NO: 2331585 - RNA, 14 nt, Yersinia pestis KIM
cgucugccauugcu

SEQ ID NO: 2331586 - RNA, 13 nt, Yersinia pestis KIM
cgucucuuuuuca

SEQ ID NO: 2331587 - RNA, 19 nt, Yersinia pestis KIM
cgucugagguggcacccag

SEQ ID NO: 2331588 - RNA, 13 nt, Yersinia pestis KIM
cgguggccgccuu

SEQ ID NO: 2331589 - RNA, 15 nt, Yersinia pestis KIM
cggugugcaaugcag

SEQ ID NO: 2331590 - RNA, 13 nt, Yersinia pestis KIM
cgguuaaauacag

SEQ ID NO: 2331591 - RNA, 20 nt, Yersinia pestis KIM
cgguguaauaagacguucac

SEQ ID NO: 2331592 - RNA, 23 nt, Yersinia pestis KIM
cggugccgcaucaccgcccauau

SEQ ID NO: 2331593 - RNA, 16 nt, Yersinia pestis KIM
cggugcaaaaccccaa

SEQ ID NO: 2331594 - RNA, 22 nt, Yersinia pestis KIM
cggugcaaaaccccaauacacu

SEQ ID NO: 2331595 - RNA, 17 nt, Yersinia pestis KIM
cgguuaauugaauugcc

SEQ ID NO: 2331596 - RNA, 22 nt, Yersinia pestis KIM
cgguuaacgacgcauuaauccg

SEQ ID NO: 2331597 - RNA, 15 nt, Yersinia pestis KIM
cgguuaucuggaauu

SEQ ID NO: 2331598 - RNA, 23 nt, Yersinia pestis KIM
cgguucgucaugaugcucaccgc

SEQ ID NO: 2331599 - RNA, 19 nt, Yersinia pestis KIM
cgguucuaguauucaggaa

SEQ ID NO: 2331600 - RNA, 18 nt, Yersinia pestis KIM
cgguugacguuugccaaa

SEQ ID NO: 2331601 - RNA, 13 nt, Yersinia pestis KIM
cgguugccgccuu

SEQ ID NO: 2331602 - RNA, 19 nt, Yersinia pestis KIM
cgguugcuuuuaacuccuu

SEQ ID NO: 2331603 - RNA, 15 nt, Yersinia pestis KIM
cgguuucaacuucaa

SEQ ID NO: 2331604 - RNA, 21 nt, Yersinia pestis KIM
cgguuucaaccccuucuucac

SEQ ID NO: 2331605 - RNA, 19 nt, Yersinia pestis KIM
cgguuucaaauagccuggu

SEQ ID NO: 2331606 - RNA, 15 nt, Yersinia pestis KIM
cgguuucaacaucca

SEQ ID NO: 2331607 - RNA, 16 nt, Yersinia pestis KIM
cgguuucacccucuuu

SEQ ID NO: 2331608 - RNA, 16 nt, Yersinia pestis KIM
cgguuucagcuugcaa

SEQ ID NO: 2331609 - RNA, 23 nt, Yersinia pestis KIM
cgguuuaccggggcgaucccuga

SEQ ID NO: 2331610 - RNA, 15 nt, Yersinia pestis KIM
cguaaauacauccau

SEQ ID NO: 2331611 - RNA, 14 nt, Yersinia pestis KIM
cguaaauuuauuua

SEQ ID NO: 2331612 - RNA, 19 nt, Yersinia pestis KIM
cguaagccgugccugcugg

SEQ ID NO: 2331613 - RNA, 23 nt, Yersinia pestis KIM
cguaacuccuuuguuauuucugg

SEQ ID NO: 2331614 - RNA, 17 nt, Yersinia pestis KIM
cgguuuuaucaauaggu

SEQ ID NO: 2331615 - RNA, 20 nt, Yersinia pestis KIM
cgguuuucacccccacauca

SEQ ID NO: 2331616 - RNA, 12 nt, Yersinia pestis KIM
cguaaaaagcag

SEQ ID NO: 2331617 - RNA, 15 nt, Yersinia pestis KIM
cguaaacacaaaaua

SEQ ID NO: 2331618 - RNA, 14 nt, Yersinia pestis KIM
cguaaagacgccgu

SEQ ID NO: 2331619 - RNA, 18 nt, Yersinia pestis KIM
cguaaacugccguaaaca

SEQ ID NO: 2331620 - RNA, 23 nt, Yersinia pestis KIM
cguaaacauggcucucuuuuuuc

SEQ ID NO: 2331621 - RNA, 16 nt, Yersinia pestis KIM
cguccggcggcuagca

SEQ ID NO: 2331622 - RNA, 21 nt, Yersinia pestis KIM
cgucccauuccguuuaaacuc

SEQ ID NO: 2331623 - RNA, 17 nt, Yersinia pestis KIM
cguccgcgccagggagg

SEQ ID NO: 2331624 - RNA, 16 nt, Yersinia pestis KIM
cgucaucaucuucuuc

SEQ ID NO: 2331625 - RNA, 22 nt, Yersinia pestis KIM
cgucccaagaaaagcaccgcag

SEQ ID NO: 2331626 - RNA, 16 nt, Yersinia pestis KIM
cgucgaggaucaccac

SEQ ID NO: 2331627 - RNA, 23 nt, Yersinia pestis KIM
cgucacggguuccgcguuuaucg

SEQ ID NO: 2331628 - RNA, 17 nt, Yersinia pestis KIM
cgucacuaaauccaaau

SEQ ID NO: 2331629 - RNA, 21 nt, Yersinia pestis KIM
cgucagucuugcugccaacgc

SEQ ID NO: 2331630 - RNA, 14 nt, Yersinia pestis KIM
cgucauaaauaaag

SEQ ID NO: 2331631 - RNA, 16 nt, Yersinia pestis KIM
cgucauaaauaaagau

SEQ ID NO: 2331632 - RNA, 15 nt, Yersinia pestis KIM
cgucagccccugcca

SEQ ID NO: 2331633 - RNA, 14 nt, Yersinia pestis KIM
cgucaacagaacua

SEQ ID NO: 2331634 - RNA, 12 nt, Yersinia pestis KIM
cgucaccaucaa

SEQ ID NO: 2331635 - RNA, 15 nt, Yersinia pestis KIM
cguagccuucaaggu

SEQ ID NO: 2331636 - RNA, 15 nt, Yersinia pestis KIM
cguagcgauaacaga

SEQ ID NO: 2331637 - RNA, 13 nt, Yersinia pestis KIM
cguagcuaacacc

SEQ ID NO: 2331638 - RNA, 17 nt, Yersinia pestis KIM
cguagcuaacaccgcug

SEQ ID NO: 2331639 - RNA, 14 nt, Yersinia pestis KIM
cguagcucagcgcg

SEQ ID NO: 2331640 - RNA, 21 nt, Yersinia pestis KIM
cguaauaguuaaucgcagcag

SEQ ID NO: 2331641 - RNA, 23 nt, Yersinia pestis KIM
cguaauaguuaaucgcagcagag

SEQ ID NO: 2331642 - RNA, 16 nt, Yersinia pestis KIM
cguauggcaugacuua

SEQ ID NO: 2331643 - RNA, 12 nt, Yersinia pestis KIM
cguauuaucugc

SEQ ID NO: 2331644 - RNA, 14 nt, Yersinia pestis KIM
cguauucagcacug

SEQ ID NO: 2331645 - RNA, 12 nt, Yersinia pestis KIM
cgucaaaacuau

SEQ ID NO: 2331646 - RNA, 14 nt, Yersinia pestis KIM
cguauaaaacugug

SEQ ID NO: 2331647 - RNA, 15 nt, Yersinia pestis KIM
cucuccguugcaggc

SEQ ID NO: 2331648 - RNA, 17 nt, Yersinia pestis KIM
cucuccgggcauaaaug

SEQ ID NO: 2331649 - RNA, 14 nt, Yersinia pestis KIM
cucuccgcaaugcc

SEQ ID NO: 2331650 - RNA, 18 nt, Yersinia pestis KIM
cucuccguugcaggcacu

SEQ ID NO: 2331651 - RNA, 18 nt, Yersinia pestis KIM
cucuccuauaucucaguu

SEQ ID NO: 2331652 - RNA, 13 nt, Yersinia pestis KIM
cucucgaacccgc

SEQ ID NO: 2331653 - RNA, 17 nt, Yersinia pestis KIM
cucuccagugcaaauuu

SEQ ID NO: 2331654 - RNA, 13 nt, Yersinia pestis KIM
cucucauuuaaua

SEQ ID NO: 2331655 - RNA, 14 nt, Yersinia pestis KIM
cucucagaacaggu

SEQ ID NO: 2331656 - RNA, 20 nt, Yersinia pestis KIM
cucucaccgcugcuccgccc

SEQ ID NO: 2331657 - RNA, 17 nt, Yersinia pestis KIM
cucucauauccccccca

SEQ ID NO: 2331658 - RNA, 16 nt, Yersinia pestis KIM
cucucauauccccccc

SEQ ID NO: 2331659 - RNA, 20 nt, Yersinia pestis KIM
cucuauucugcuuuuugcuu

SEQ ID NO: 2331660 - RNA, 18 nt, Yersinia pestis KIM
cucuaucgcgguuuuaaa

SEQ ID NO: 2331661 - RNA, 14 nt, Yersinia pestis KIM
cucuagcuaacagu

SEQ ID NO: 2331662 - RNA, 16 nt, Yersinia pestis KIM
cucucugagccaucca

SEQ ID NO: 2331663 - RNA, 19 nt, Yersinia pestis KIM
cucucuacuucgucugccc

SEQ ID NO: 2331664 - RNA, 16 nt, Yersinia pestis KIM
cucucuccgcaaugcc

SEQ ID NO: 2331665 - RNA, 15 nt, Yersinia pestis KIM
cucucuuuuuucucu

SEQ ID NO: 2331666 - RNA, 17 nt, Yersinia pestis KIM
cucucuuuuuucucuuu

SEQ ID NO: 2331667 - RNA, 14 nt, Yersinia pestis KIM
cucugacaaaaugc

SEQ ID NO: 2331668 - RNA, 13 nt, Yersinia pestis KIM
cucugcguagcca

SEQ ID NO: 2331669 - RNA, 19 nt, Yersinia pestis KIM
cucugcuaauacgcuauca

SEQ ID NO: 2331670 - RNA, 14 nt, Yersinia pestis KIM
cucugcgacaucag

SEQ ID NO: 2331671 - RNA, 17 nt, Yersinia pestis KIM
cucugcgcucauacuca

SEQ ID NO: 2331672 - RNA, 13 nt, Yersinia pestis KIM
cucugccgcugaa

SEQ ID NO: 2331673 - RNA, 22 nt, Yersinia pestis KIM
cucugccuauccucaccguuca

SEQ ID NO: 2331674 - RNA, 16 nt, Yersinia pestis KIM
cucugcaucucugcau

SEQ ID NO: 2331675 - RNA, 16 nt, Yersinia pestis KIM
cucugaugaacggaga

SEQ ID NO: 2331676 - RNA, 18 nt, Yersinia pestis KIM
cucugauaguauuagaug

SEQ ID NO: 2331677 - RNA, 16 nt, Yersinia pestis KIM
cucugaggauguaguc

SEQ ID NO: 2331678 - RNA, 18 nt, Yersinia pestis KIM
cucugacacugacauuua

SEQ ID NO: 2331679 - RNA, 18 nt, Yersinia pestis KIM
cucugaugguaucagaaa

SEQ ID NO: 2331680 - RNA, 19 nt, Yersinia pestis KIM
cucugcaaugcccagagcg

SEQ ID NO: 2331681 - RNA, 18 nt, Yersinia pestis KIM
cucugcaguacagauaau

SEQ ID NO: 2331682 - RNA, 19 nt, Yersinia pestis KIM
cucgcucaacaugccagaa

SEQ ID NO: 2331683 - RNA, 19 nt, Yersinia pestis KIM
cucgcucgauacuaauuuc

SEQ ID NO: 2331684 - RNA, 21 nt, Yersinia pestis KIM
cucggaugguuguucugcugg

SEQ ID NO: 2331685 - RNA, 15 nt, Yersinia pestis KIM
cucggcucgaaccug

SEQ ID NO: 2331686 - RNA, 22 nt, Yersinia pestis KIM
cucggucugaauaagagagacg

SEQ ID NO: 2331687 - RNA, 14 nt, Yersinia pestis KIM
cucguauaaaaaau

SEQ ID NO: 2331688 - RNA, 13 nt, Yersinia pestis KIM
cucguaauuauug

SEQ ID NO: 2331689 - RNA, 23 nt, Yersinia pestis KIM
cuccgauuaaguccgguuguggc

SEQ ID NO: 2331690 - RNA, 20 nt, Yersinia pestis KIM
cucccuguuacgguauuuga

SEQ ID NO: 2331691 - RNA, 24 nt, Yersinia pestis KIM
cucccuguuuggcccccaguugau

SEQ ID NO: 2331692 - RNA, 23 nt, Yersinia pestis KIM
cucccuuuccagcgguuuuuucu

SEQ ID NO: 2331693 - RNA, 19 nt, Yersinia pestis KIM
cuccgcgcaaccuggccaa

SEQ ID NO: 2331694 - RNA, 16 nt, Yersinia pestis KIM
cucccugacucccuga

SEQ ID NO: 2331695 - RNA, 14 nt, Yersinia pestis KIM
cucccgcuaacgca

SEQ ID NO: 2331696 - RNA, 15 nt, Yersinia pestis KIM
cucccucauuuauau

SEQ ID NO: 2331697 - RNA, 16 nt, Yersinia pestis KIM
cuccagugccugacgc

SEQ ID NO: 2331698 - RNA, 14 nt, Yersinia pestis KIM
cuccaguaagccug

SEQ ID NO: 2331699 - RNA, 21 nt, Yersinia pestis KIM
cuccaguaagccugaugccuu

SEQ ID NO: 2331700 - RNA, 18 nt, Yersinia pestis KIM
cuccauccccaacucuuu

SEQ ID NO: 2331701 - RNA, 22 nt, Yersinia pestis KIM
cuccaguugcacaccaucagua

SEQ ID NO: 2331702 - RNA, 18 nt, Yersinia pestis KIM
cuccaguugccagcaggc

SEQ ID NO: 2331703 - RNA, 12 nt, Yersinia pestis KIM
cuccaguugagu

SEQ ID NO: 2331704 - RNA, 18 nt, Yersinia pestis KIM
cuccaguuggcgcacguu

SEQ ID NO: 2331705 - RNA, 13 nt, Yersinia pestis KIM
cuccaguucgacu

SEQ ID NO: 2331706 - RNA, 17 nt, Yersinia pestis KIM
cuccaguugauacagga

SEQ ID NO: 2331707 - RNA, 20 nt, Yersinia pestis KIM
cuccaguuggcgcacguucc

SEQ ID NO: 2331708 - RNA, 21 nt, Yersinia pestis KIM
cucauguucauguucaugguc

SEQ ID NO: 2331709 - RNA, 18 nt, Yersinia pestis KIM
cuccaggcauuaaaauca

SEQ ID NO: 2331710 - RNA, 15 nt, Yersinia pestis KIM
cuccuggcaugcauu

SEQ ID NO: 2331711 - RNA, 17 nt, Yersinia pestis KIM
cuccugaugacucaucu

SEQ ID NO: 2331712 - RNA, 13 nt, Yersinia pestis KIM
cuccugaggguga

SEQ ID NO: 2331713 - RNA, 18 nt, Yersinia pestis KIM
cuccugagggugaugaca

SEQ ID NO: 2331714 - RNA, 22 nt, Yersinia pestis KIM
cuccugccacagacuuucuuua

SEQ ID NO: 2331715 - RNA, 21 nt, Yersinia pestis KIM
cuccggcgcccuucccauuua

SEQ ID NO: 2331716 - RNA, 19 nt, Yersinia pestis KIM
cuccggcgacuaagacugu

SEQ ID NO: 2331717 - RNA, 18 nt, Yersinia pestis KIM
cuccucucucuggggagg

SEQ ID NO: 2331718 - RNA, 23 nt, Yersinia pestis KIM
cuccucuuuauacauauguugag

SEQ ID NO: 2331719 - RNA, 19 nt, Yersinia pestis KIM
cucgacucucaagcccagu

SEQ ID NO: 2331720 - RNA, 16 nt, Yersinia pestis KIM
cucgagccgcgcccuc

SEQ ID NO: 2331721 - RNA, 19 nt, Yersinia pestis KIM
cucgagccuacauggaugu

SEQ ID NO: 2331722 - RNA, 22 nt, Yersinia pestis KIM
cucgagccuacuacauggaugu

SEQ ID NO: 2331723 - RNA, 17 nt, Yersinia pestis KIM
cucgaauaaacggauuu

SEQ ID NO: 2331724 - RNA, 20 nt, Yersinia pestis KIM
cucgacaccaaaacucccug

SEQ ID NO: 2331725 - RNA, 22 nt, Yersinia pestis KIM
cuccuuuaccuacaaccuggug

SEQ ID NO: 2331726 - RNA, 19 nt, Yersinia pestis KIM
cuccuuuguuauuucuggg

SEQ ID NO: 2331727 - RNA, 16 nt, Yersinia pestis KIM
cuccuuacuaucuuua

SEQ ID NO: 2331728 - RNA, 14 nt, Yersinia pestis KIM
cuccuugaaguguu

SEQ ID NO: 2331729 - RNA, 15 nt, Yersinia pestis KIM
cucaucaccuuccaa

SEQ ID NO: 2331730 - RNA, 21 nt, Yersinia pestis KIM
cucaucaguuggucuuuaauc

SEQ ID NO: 2331731 - RNA, 17 nt, Yersinia pestis KIM
cucaucauccaucacaa

SEQ ID NO: 2331732 - RNA, 12 nt, Yersinia pestis KIM
cucauccagauu

SEQ ID NO: 2331733 - RNA, 17 nt, Yersinia pestis KIM
cucauaugcagcaucca

SEQ ID NO: 2331734 - RNA, 17 nt, Yersinia pestis KIM
cucauauuguccaaagg

SEQ ID NO: 2331735 - RNA, 16 nt, Yersinia pestis KIM
cucauauuguccaaag

SEQ ID NO: 2331736 - RNA, 18 nt, Yersinia pestis KIM
cucaucaccaaaaugaca

SEQ ID NO: 2331737 - RNA, 11 nt, Yersinia pestis KIM
cucaucacccg

SEQ ID NO: 2331738 - RNA, 16 nt, Yersinia pestis KIM
cucaucaaccucagcc

SEQ ID NO: 2331739 - RNA, 14 nt, Yersinia pestis KIM
cucaucaaccucag

SEQ ID NO: 2331740 - RNA, 22 nt, Yersinia pestis KIM
cucaucuugggcgggaucucca

SEQ ID NO: 2331741 - RNA, 14 nt, Yersinia pestis KIM
cucaucugaacuau

SEQ ID NO: 2331742 - RNA, 16 nt, Yersinia pestis KIM
cucaugaaugaggcug

SEQ ID NO: 2331743 - RNA, 17 nt, Yersinia pestis KIM
cucaugaaugaggcuga

SEQ ID NO: 2331744 - RNA, 20 nt, Yersinia pestis KIM
cucaugaaugaggcugaggu

SEQ ID NO: 2331745 - RNA, 19 nt, Yersinia pestis KIM
cucagaugaaaaacugugc

SEQ ID NO: 2331746 - RNA, 18 nt, Yersinia pestis KIM
cucagauaaauucaacuu

SEQ ID NO: 2331747 - RNA, 12 nt, Yersinia pestis KIM
cucagauaucag

SEQ ID NO: 2331748 - RNA, 13 nt, Yersinia pestis KIM
cucaggcucauca

SEQ ID NO: 2331749 - RNA, 15 nt, Yersinia pestis KIM
cucaggcucaucacc

SEQ ID NO: 2331750 - RNA, 16 nt, Yersinia pestis KIM
cucagaggccuguugg

SEQ ID NO: 2331751 - RNA, 22 nt, Yersinia pestis KIM
cucacuggcuuuauuauaugau

SEQ ID NO: 2331752 - RNA, 16 nt, Yersinia pestis KIM
cucaguagcaggcgca

SEQ ID NO: 2331753 - RNA, 16 nt, Yersinia pestis KIM
cucaguaucuuuccag

SEQ ID NO: 2331754 - RNA, 17 nt, Yersinia pestis KIM
cucaguaucuuuccagc

SEQ ID NO: 2331755 - RNA, 21 nt, Yersinia pestis KIM
cucaguaucuuuccagccaau

SEQ ID NO: 2331756 - RNA, 13 nt, Yersinia pestis KIM
cucaguugaaacc

SEQ ID NO: 2331757 - RNA, 21 nt, Yersinia pestis KIM
cucaguucgguugccaaaauu

SEQ ID NO: 2331758 - RNA, 21 nt, Yersinia pestis KIM
cucaguuaaacgguaaccauc

SEQ ID NO: 2331759 - RNA, 16 nt, Yersinia pestis KIM
cucaguguggaauaca

SEQ ID NO: 2331760 - RNA, 12 nt, Yersinia pestis KIM
cucaguuuugcu

SEQ ID NO: 2331761 - RNA, 13 nt, Yersinia pestis KIM
cucauacucaguc

SEQ ID NO: 2331762 - RNA, 14 nt, Yersinia pestis KIM
cucaccgagcauau

SEQ ID NO: 2331763 - RNA, 23 nt, Yersinia pestis KIM
cucaccaagaggaaaugccgcgc

SEQ ID NO: 2331764 - RNA, 21 nt, Yersinia pestis KIM
cucacccgaaucacugaccug

SEQ ID NO: 2331765 - RNA, 15 nt, Yersinia pestis KIM
cucacauaagaaagu

SEQ ID NO: 2331766 - RNA, 14 nt, Yersinia pestis KIM
cucaauauuaauaa

SEQ ID NO: 2331767 - RNA, 16 nt, Yersinia pestis KIM
cucaauauuaauaaug

SEQ ID NO: 2331768 - RNA, 17 nt, Yersinia pestis KIM
cucaauauuaauaaugc

SEQ ID NO: 2331769 - RNA, 20 nt, Yersinia pestis KIM
cucaaucaccgaaucaccga

SEQ ID NO: 2331770 - RNA, 19 nt, Yersinia pestis KIM
cucaauaugcaguuuuccu

SEQ ID NO: 2331771 - RNA, 18 nt, Yersinia pestis KIM
cucaccgcugcuccgccc

SEQ ID NO: 2331772 - RNA, 13 nt, Yersinia pestis KIM
cucaccgcuggaa

SEQ ID NO: 2331773 - RNA, 16 nt, Yersinia pestis KIM
cucaccgcuggaagcc

SEQ ID NO: 2331774 - RNA, 12 nt, Yersinia pestis KIM
cucaccgccuag

SEQ ID NO: 2331775 - RNA, 22 nt, Yersinia pestis KIM
cucaccguucaagagugaguca

SEQ ID NO: 2331776 - RNA, 13 nt, Yersinia pestis KIM
cucacuaaaucaa

SEQ ID NO: 2331777 - RNA, 14 nt, Yersinia pestis KIM
cucacgcaaagggc

SEQ ID NO: 2331778 - RNA, 13 nt, Yersinia pestis KIM
cucacucugugaa

SEQ ID NO: 2331779 - RNA, 15 nt, Yersinia pestis KIM
cucacugcuccagcc

SEQ ID NO: 2331780 - RNA, 13 nt, Yersinia pestis KIM
cucacucaccgcc

SEQ ID NO: 2331781 - RNA, 16 nt, Yersinia pestis KIM
cucaacagcaucauca

SEQ ID NO: 2331782 - RNA, 13 nt, Yersinia pestis KIM
cucaacacagguu

SEQ ID NO: 2331783 - RNA, 21 nt, Yersinia pestis KIM
cuauuaaugggcgauauauuu

SEQ ID NO: 2331784 - RNA, 19 nt, Yersinia pestis KIM
cucaagcuggccagugaga

SEQ ID NO: 2331785 - RNA, 16 nt, Yersinia pestis KIM
cucaacucaaaacaau

SEQ ID NO: 2331786 - RNA, 14 nt, Yersinia pestis KIM
cucaacucaaaaca

SEQ ID NO: 2331787 - RNA, 21 nt, Yersinia pestis KIM
cucaacugcucaacugcucaa

SEQ ID NO: 2331788 - RNA, 22 nt, Yersinia pestis KIM
cucaagaaauuuaaaaacccuc

SEQ ID NO: 2331789 - RNA, 14 nt, Yersinia pestis KIM
cucaagaaauuuaa

SEQ ID NO: 2331790 - RNA, 16 nt, Yersinia pestis KIM
cuauccucuuaauguc

SEQ ID NO: 2331791 - RNA, 22 nt, Yersinia pestis KIM
cuauccgaaaaauauucucaau

SEQ ID NO: 2331792 - RNA, 12 nt, Yersinia pestis KIM
cuauccgccccg

SEQ ID NO: 2331793 - RNA, 15 nt, Yersinia pestis KIM
cuauccgaaaaauau

SEQ ID NO: 2331794 - RNA, 12 nt, Yersinia pestis KIM
cuauccuuugau

SEQ ID NO: 2331795 - RNA, 17 nt, Yersinia pestis KIM
cuaucgaacuauugaug

SEQ ID NO: 2331796 - RNA, 16 nt, Yersinia pestis KIM
cuaucgcgaaacucuu

SEQ ID NO: 2331797 - RNA, 20 nt, Yersinia pestis KIM
cuaucgaugguuggcuauca

SEQ ID NO: 2331798 - RNA, 15 nt, Yersinia pestis KIM
cuaucgcacguugca

SEQ ID NO: 2331799 - RNA, 17 nt, Yersinia pestis KIM
cuaucaucaccauucaa

SEQ ID NO: 2331800 - RNA, 13 nt, Yersinia pestis KIM
cuaucaucaccau

SEQ ID NO: 2331801 - RNA, 13 nt, Yersinia pestis KIM
cuaugcuaacucg

SEQ ID NO: 2331802 - RNA, 17 nt, Yersinia pestis KIM
cuaucgcuguaugguau

SEQ ID NO: 2331803 - RNA, 13 nt, Yersinia pestis KIM
cuauauauggaua

SEQ ID NO: 2331804 - RNA, 16 nt, Yersinia pestis KIM
cuauaucaucagcaga

SEQ ID NO: 2331805 - RNA, 22 nt, Yersinia pestis KIM
cuauauacccgucauaaauaaa

SEQ ID NO: 2331806 - RNA, 18 nt, Yersinia pestis KIM
cuauauaacugcccaauu

SEQ ID NO: 2331807 - RNA, 14 nt, Yersinia pestis KIM
cuauauaaaugauu

SEQ ID NO: 2331808 - RNA, 12 nt, Yersinia pestis KIM
cuauauuuuuac

SEQ ID NO: 2331809 - RNA, 15 nt, Yersinia pestis KIM
cuaucaacuuucacc

SEQ ID NO: 2331810 - RNA, 17 nt, Yersinia pestis KIM
cuagggauuuuaagcag

SEQ ID NO: 2331811 - RNA, 16 nt, Yersinia pestis KIM
cuauaauuauuucucu

SEQ ID NO: 2331812 - RNA, 16 nt, Yersinia pestis KIM
cuagauagccauaaua

SEQ ID NO: 2331813 - RNA, 15 nt, Yersinia pestis KIM
cuagauggaaaucac

SEQ ID NO: 2331814 - RNA, 12 nt, Yersinia pestis KIM
cuacuuccccua

SEQ ID NO: 2331815 - RNA, 19 nt, Yersinia pestis KIM
cuagcuguuguuguugauu

SEQ ID NO: 2331816 - RNA, 18 nt, Yersinia pestis KIM
cuagcuguguuuuaucug

SEQ ID NO: 2331817 - RNA, 19 nt, Yersinia pestis KIM
cuaggcucagcauggaaga

SEQ ID NO: 2331818 - RNA, 12 nt, Yersinia pestis KIM
cuagcaaauucc

SEQ ID NO: 2331819 - RNA, 15 nt, Yersinia pestis KIM
cuagcucugaggcuu

SEQ ID NO: 2331820 - RNA, 20 nt, Yersinia pestis KIM
cuaccuuuugcauauuucuc

SEQ ID NO: 2331821 - RNA, 19 nt, Yersinia pestis KIM
cuaccuugcuccgcaauuu

SEQ ID NO: 2331822 - RNA, 20 nt, Yersinia pestis KIM
cuacgccccaugcaccuucc

SEQ ID NO: 2331823 - RNA, 20 nt, Yersinia pestis KIM
cuaacaguuguuucaauaaa

SEQ ID NO: 2331824 - RNA, 17 nt, Yersinia pestis KIM
cuaacauaaucaagaaa

SEQ ID NO: 2331825 - RNA, 18 nt, Yersinia pestis KIM
cuaacagggaugaauaua

SEQ ID NO: 2331826 - RNA, 14 nt, Yersinia pestis KIM
cuaacaaaccuaaa

SEQ ID NO: 2331827 - RNA, 13 nt, Yersinia pestis KIM
cuaacagcagugc

SEQ ID NO: 2331828 - RNA, 21 nt, Yersinia pestis KIM
cuaaauuuuguacaacuucuu

SEQ ID NO: 2331829 - RNA, 21 nt, Yersinia pestis KIM
cuaaccaaacauuguuaccua

SEQ ID NO: 2331830 - RNA, 17 nt, Yersinia pestis KIM
cuaaccaaacauuguca

SEQ ID NO: 2331831 - RNA, 21 nt, Yersinia pestis KIM
cuaaccaccgucaccaaauau

SEQ ID NO: 2331832 - RNA, 17 nt, Yersinia pestis KIM
cuaacaugccagccugu

SEQ ID NO: 2331833 - RNA, 16 nt, Yersinia pestis KIM
cuaacaugccacauag

SEQ ID NO: 2331834 - RNA, 14 nt, Yersinia pestis KIM
cuacuuauuuccgc

SEQ ID NO: 2331835 - RNA, 15 nt, Yersinia pestis KIM
cuacugucuuuuuug

SEQ ID NO: 2331836 - RNA, 14 nt, Yersinia pestis KIM
cuacugguagcagc

SEQ ID NO: 2331837 - RNA, 20 nt, Yersinia pestis KIM
cuacugcuuuuuauugucuc

SEQ ID NO: 2331838 - RNA, 16 nt, Yersinia pestis KIM
cuacuggaauauucca

SEQ ID NO: 2331839 - RNA, 19 nt, Yersinia pestis KIM
cuacugcguccuuugccca

SEQ ID NO: 2331840 - RNA, 20 nt, Yersinia pestis KIM
cuacuggcccgcccauaaau

SEQ ID NO: 2331841 - RNA, 21 nt, Yersinia pestis KIM
cuacuggcccgcccauaaauu

SEQ ID NO: 2331842 - RNA, 22 nt, Yersinia pestis KIM
cuacugcaagccguaauucaga

SEQ ID NO: 2331843 - RNA, 16 nt, Yersinia pestis KIM
cuacuccauccccaac

SEQ ID NO: 2331844 - RNA, 19 nt, Yersinia pestis KIM
cuacuccauccccaacucu

SEQ ID NO: 2331845 - RNA, 23 nt, Yersinia pestis KIM
cuacugaaaagaguacgaacagu

SEQ ID NO: 2331846 - RNA, 14 nt, Yersinia pestis KIM
cugccugccugagg

SEQ ID NO: 2331847 - RNA, 14 nt, Yersinia pestis KIM
cugccugagguucc

SEQ ID NO: 2331848 - RNA, 15 nt, Yersinia pestis KIM
cugccugugcggcag

SEQ ID NO: 2331849 - RNA, 15 nt, Yersinia pestis KIM
cugccuguucucucc

SEQ ID NO: 2331850 - RNA, 21 nt, Yersinia pestis KIM
cugccgccagauuauccagcc

SEQ ID NO: 2331851 - RNA, 15 nt, Yersinia pestis KIM
cugccgccccuucca

SEQ ID NO: 2331852 - RNA, 19 nt, Yersinia pestis KIM
cugccgccccuuccaaugu

SEQ ID NO: 2331853 - RNA, 17 nt, Yersinia pestis KIM
cugccuauccucaccgu

SEQ ID NO: 2331854 - RNA, 12 nt, Yersinia pestis KIM
cugccuauccuc

SEQ ID NO: 2331855 - RNA, 13 nt, Yersinia pestis KIM
cugccuauccuca

SEQ ID NO: 2331856 - RNA, 20 nt, Yersinia pestis KIM
cugccugaacaaucugcucg

SEQ ID NO: 2331857 - RNA, 22 nt, Yersinia pestis KIM
cugcgcccuuaucuaucucagg

SEQ ID NO: 2331858 - RNA, 14 nt, Yersinia pestis KIM
cugcgccagcagca

SEQ ID NO: 2331859 - RNA, 17 nt, Yersinia pestis KIM
cugcgccacgcuuuagc

SEQ ID NO: 2331860 - RNA, 20 nt, Yersinia pestis KIM
cugcgccacccauugcucaa

SEQ ID NO: 2331861 - RNA, 13 nt, Yersinia pestis KIM
cugcauucacaua

SEQ ID NO: 2331862 - RNA, 16 nt, Yersinia pestis KIM
cugccaaauuaaauaa

SEQ ID NO: 2331863 - RNA, 21 nt, Yersinia pestis KIM
cugccaaaaaauaagggccac

SEQ ID NO: 2331864 - RNA, 13 nt, Yersinia pestis KIM
cugccaaaaaaua

SEQ ID NO: 2331865 - RNA, 13 nt, Yersinia pestis KIM
cugcaucaucaca

SEQ ID NO: 2331866 - RNA, 20 nt, Yersinia pestis KIM
cugcacaccacacuggaugc

SEQ ID NO: 2331867 - RNA, 23 nt, Yersinia pestis KIM
cugcagugaaaagguuaacugca

SEQ ID NO: 2331868 - RNA, 12 nt, Yersinia pestis KIM
cugcagugaaaa

SEQ ID NO: 2331869 - RNA, 20 nt, Yersinia pestis KIM
cugcaauucggcuaaugagc

SEQ ID NO: 2331870 - RNA, 14 nt, Yersinia pestis KIM
cugcaaugcauaag

SEQ ID NO: 2331871 - RNA, 20 nt, Yersinia pestis KIM
cugcaauggcuggcaaggca

SEQ ID NO: 2331872 - RNA, 12 nt, Yersinia pestis KIM
cugcaauccucc

SEQ ID NO: 2331873 - RNA, 23 nt, Yersinia pestis KIM
cugccaaucgcucugcguuuuuc

SEQ ID NO: 2331874 - RNA, 14 nt, Yersinia pestis KIM
cugccaaucgcucu

SEQ ID NO: 2331875 - RNA, 13 nt, Yersinia pestis KIM
cugccaauaucca

SEQ ID NO: 2331876 - RNA, 12 nt, Yersinia pestis KIM
cugccaaauuug

SEQ ID NO: 2331877 - RNA, 20 nt, Yersinia pestis KIM
cugccaacaacuuaauuccc

SEQ ID NO: 2331878 - RNA, 23 nt, Yersinia pestis KIM
cugccacacuuuugcugguguca

SEQ ID NO: 2331879 - RNA, 15 nt, Yersinia pestis KIM
cugccagauagucau

SEQ ID NO: 2331880 - RNA, 19 nt, Yersinia pestis KIM
cugccagauagucaucuuu

SEQ ID NO: 2331881 - RNA, 22 nt, Yersinia pestis KIM
cugccauacggcgucuugauca

SEQ ID NO: 2331882 - RNA, 19 nt, Yersinia pestis KIM
cugccauaugcauggcaua

SEQ ID NO: 2331883 - RNA, 14 nt, Yersinia pestis KIM
cugccauaaccgcu

SEQ ID NO: 2331884 - RNA, 22 nt, Yersinia pestis KIM
cugccauaaccgcuaaggccaa

SEQ ID NO: 2331885 - RNA, 20 nt, Yersinia pestis KIM
cugccauaauccagaagcca

SEQ ID NO: 2331886 - RNA, 20 nt, Yersinia pestis KIM
cugccaguucaucagcccag

SEQ ID NO: 2331887 - RNA, 21 nt, Yersinia pestis KIM
cugccaguucaucagcccagc

SEQ ID NO: 2331888 - RNA, 17 nt, Yersinia pestis KIM
cugcggcgucugauaac

SEQ ID NO: 2331889 - RNA, 16 nt, Yersinia pestis KIM
cugcgguggccagagc

SEQ ID NO: 2331890 - RNA, 12 nt, Yersinia pestis KIM
cugcgggcacua

SEQ ID NO: 2331891 - RNA, 19 nt, Yersinia pestis KIM
cugcgcuaaacggcccugu

SEQ ID NO: 2331892 - RNA, 21 nt, Yersinia pestis KIM
cugcgcuaauacggcuugcaa

SEQ ID NO: 2331893 - RNA, 14 nt, Yersinia pestis KIM
cugcgcuagaccag

SEQ ID NO: 2331894 - RNA, 12 nt, Yersinia pestis KIM
cugcguaaacaa

SEQ ID NO: 2331895 - RNA, 14 nt, Yersinia pestis KIM
cugcguucuucuug

SEQ ID NO: 2331896 - RNA, 20 nt, Yersinia pestis KIM
cugcucaacugcucaacugc

SEQ ID NO: 2331897 - RNA, 17 nt, Yersinia pestis KIM
cugcucacgcaaauaaa

SEQ ID NO: 2331898 - RNA, 20 nt, Yersinia pestis KIM
cugcucaacugcucaacgcc

SEQ ID NO: 2331899 - RNA, 16 nt, Yersinia pestis KIM
cugcucaacugcucaa

SEQ ID NO: 2331900 - RNA, 12 nt, Yersinia pestis KIM
cugcucaacugc

SEQ ID NO: 2331901 - RNA, 24 nt, Yersinia pestis KIM
cugcuaauacgcuaucaacguagc

SEQ ID NO: 2331902 - RNA, 20 nt, Yersinia pestis KIM
cugcugaaaaaugagucauu

SEQ ID NO: 2331903 - RNA, 15 nt, Yersinia pestis KIM
cugcucuaucucuuc

SEQ ID NO: 2331904 - RNA, 14 nt, Yersinia pestis KIM
cugcucuaucucuu

SEQ ID NO: 2331905 - RNA, 19 nt, Yersinia pestis KIM
cugcucggugauaaacuca

SEQ ID NO: 2331906 - RNA, 23 nt, Yersinia pestis KIM
cugcucacgguagguuucugggc

SEQ ID NO: 2331907 - RNA, 23 nt, Yersinia pestis KIM
cugcucccguaaacguucugcca

SEQ ID NO: 2331908 - RNA, 16 nt, Yersinia pestis KIM
cuggcaaacgcugggc

SEQ ID NO: 2331909 - RNA, 23 nt, Yersinia pestis KIM
cuggcaaaguuauugaccaauau

SEQ ID NO: 2331910 - RNA, 14 nt, Yersinia pestis KIM
cuggcaacugcaaa

SEQ ID NO: 2331911 - RNA, 18 nt, Yersinia pestis KIM
cuggcaugcauuggaaaa

SEQ ID NO: 2331912 - RNA, 19 nt, Yersinia pestis KIM
cuggcaugcauuggaaaaa

SEQ ID NO: 2331913 - RNA, 14 nt, Yersinia pestis KIM
cuggauuugagaau

SEQ ID NO: 2331914 - RNA, 14 nt, Yersinia pestis KIM
cuggacgcaucaga

SEQ ID NO: 2331915 - RNA, 23 nt, Yersinia pestis KIM
cuggacgcuggcagccuuuaucc

SEQ ID NO: 2331916 - RNA, 20 nt, Yersinia pestis KIM
cugcuuauacgcuuccugcg

SEQ ID NO: 2331917 - RNA, 16 nt, Yersinia pestis KIM
cugcuuaccuuguuug

SEQ ID NO: 2331918 - RNA, 16 nt, Yersinia pestis KIM
cugcuuauuuuuucaa

SEQ ID NO: 2331919 - RNA, 17 nt, Yersinia pestis KIM
cugcuuauuuuuucaau

SEQ ID NO: 2331920 - RNA, 13 nt, Yersinia pestis KIM
cugcugcuuuagg

SEQ ID NO: 2331921 - RNA, 22 nt, Yersinia pestis KIM
cugcuguuuaccuaucucagug

SEQ ID NO: 2331922 - RNA, 24 nt, Yersinia pestis KIM
cugcuggaaugcagugccacggau

SEQ ID NO: 2331923 - RNA, 16 nt, Yersinia pestis KIM
cugcuuuuugcuuuuu

SEQ ID NO: 2331924 - RNA, 17 nt, Yersinia pestis KIM
cugcuuuguuuuugugg

SEQ ID NO: 2331925 - RNA, 21 nt, Yersinia pestis KIM
cugcuuugugggcuuuugcug

SEQ ID NO: 2331926 - RNA, 15 nt, Yersinia pestis KIM
cugcuuuuaccgcag

SEQ ID NO: 2331927 - RNA, 12 nt, Yersinia pestis KIM
cuggaaaaccaa

SEQ ID NO: 2331928 - RNA, 17 nt, Yersinia pestis KIM
cuggaaacaaaaccuaa

SEQ ID NO: 2331929 - RNA, 16 nt, Yersinia pestis KIM
cugauucucuucaccu

SEQ ID NO: 2331930 - RNA, 16 nt, Yersinia pestis KIM
cugauuuauaaauaau

SEQ ID NO: 2331931 - RNA, 22 nt, Yersinia pestis KIM
cugauucgcgaccagcagaagu

SEQ ID NO: 2331932 - RNA, 21 nt, Yersinia pestis KIM
cugaucucaucaaacaccccg

SEQ ID NO: 2331933 - RNA, 18 nt, Yersinia pestis KIM
cugaucuucauugccuuc

SEQ ID NO: 2331934 - RNA, 17 nt, Yersinia pestis KIM
cugcaaacuggcaggga

SEQ ID NO: 2331935 - RNA, 14 nt, Yersinia pestis KIM
cugcaacucauuaa

SEQ ID NO: 2331936 - RNA, 21 nt, Yersinia pestis KIM
cugcaacguuaaagaugaagg

SEQ ID NO: 2331937 - RNA, 14 nt, Yersinia pestis KIM
cugcaacgccuuca

SEQ ID NO: 2331938 - RNA, 17 nt, Yersinia pestis KIM
cugcaagauaaccgguu

SEQ ID NO: 2331939 - RNA, 14 nt, Yersinia pestis KIM
cugcaacucaguga

SEQ ID NO: 2331940 - RNA, 21 nt, Yersinia pestis KIM
cugcaacuucagccaccagau

SEQ ID NO: 2331941 - RNA, 20 nt, Yersinia pestis KIM
cugaucacgcugaauuugug

SEQ ID NO: 2331942 - RNA, 14 nt, Yersinia pestis KIM
cugaucaucaucaa

SEQ ID NO: 2331943 - RNA, 18 nt, Yersinia pestis KIM
cugauaucuucacucagc

SEQ ID NO: 2331944 - RNA, 15 nt, Yersinia pestis KIM
cugauaucucuuuau

SEQ ID NO: 2331945 - RNA, 15 nt, Yersinia pestis KIM
cugagucgucugucg

SEQ ID NO: 2331946 - RNA, 18 nt, Yersinia pestis KIM
cugaguggacgauaaauu

SEQ ID NO: 2331947 - RNA, 18 nt, Yersinia pestis KIM
cugagucuguuuccacuc

SEQ ID NO: 2331948 - RNA, 18 nt, Yersinia pestis KIM
cugaguuaucuguuucaa

SEQ ID NO: 2331949 - RNA, 16 nt, Yersinia pestis KIM
cugaguucugcugcca

SEQ ID NO: 2331950 - RNA, 16 nt, Yersinia pestis KIM
cugaccccaaauuuga

SEQ ID NO: 2331951 - RNA, 21 nt, Yersinia pestis KIM
cugacccccaauuucauuuac

SEQ ID NO: 2331952 - RNA, 22 nt, Yersinia pestis KIM
cugaccuauugauaaaaccgcu

SEQ ID NO: 2331953 - RNA, 14 nt, Yersinia pestis KIM
cugaccuaaaccgc

SEQ ID NO: 2331954 - RNA, 21 nt, Yersinia pestis KIM
cugaccuguuguaacacuuga

SEQ ID NO: 2331955 - RNA, 14 nt, Yersinia pestis KIM
cugaccacaaaaac

SEQ ID NO: 2331956 - RNA, 17 nt, Yersinia pestis KIM
cugaccacaaaaacagu

SEQ ID NO: 2331957 - RNA, 20 nt, Yersinia pestis KIM
cugaccaaacauugucaccu

SEQ ID NO: 2331958 - RNA, 13 nt, Yersinia pestis KIM
cugacacuuucga

SEQ ID NO: 2331959 - RNA, 16 nt, Yersinia pestis KIM
cugacagaacgcaauc

SEQ ID NO: 2331960 - RNA, 18 nt, Yersinia pestis KIM
cugacacugacauuuaug

SEQ ID NO: 2331961 - RNA, 15 nt, Yersinia pestis KIM
cugacacugcaucuc

SEQ ID NO: 2331962 - RNA, 16 nt, Yersinia pestis KIM
cugacacugcaucucu

SEQ ID NO: 2331963 - RNA, 22 nt, Yersinia pestis KIM
cugacauuuucuaucucaucca

SEQ ID NO: 2331964 - RNA, 23 nt, Yersinia pestis KIM
cugacauuugcaucuauggauua

SEQ ID NO: 2331965 - RNA, 21 nt, Yersinia pestis KIM
cugacaccggggauccauagg

SEQ ID NO: 2331966 - RNA, 20 nt, Yersinia pestis KIM
cugacacaacacauuacugc

SEQ ID NO: 2331967 - RNA, 14 nt, Yersinia pestis KIM
cugacacacaccag

SEQ ID NO: 2331968 - RNA, 12 nt, Yersinia pestis KIM
cugacaaacccc

SEQ ID NO: 2331969 - RNA, 19 nt, Yersinia pestis KIM
cugaagcgacacuuauugg

SEQ ID NO: 2331970 - RNA, 21 nt, Yersinia pestis KIM
cugacugagugccagcaaaga

SEQ ID NO: 2331971 - RNA, 18 nt, Yersinia pestis KIM
cugacucacguauuuuca

SEQ ID NO: 2331972 - RNA, 20 nt, Yersinia pestis KIM
cugacugccauaauccagaa

SEQ ID NO: 2331973 - RNA, 15 nt, Yersinia pestis KIM
cugacucccucaccg

SEQ ID NO: 2331974 - RNA, 16 nt, Yersinia pestis KIM
cugacucccugacucc

SEQ ID NO: 2331975 - RNA, 13 nt, Yersinia pestis KIM
cugacgaaaugcc

SEQ ID NO: 2331976 - RNA, 22 nt, Yersinia pestis KIM
cugagauagauaagggcgcaga

SEQ ID NO: 2331977 - RNA, 14 nt, Yersinia pestis KIM
cugagauaagccuc

SEQ ID NO: 2331978 - RNA, 20 nt, Yersinia pestis KIM
cugagaucaucgggcauuca

SEQ ID NO: 2331979 - RNA, 22 nt, Yersinia pestis KIM
cugagaucaucgggcauucacu

SEQ ID NO: 2331980 - RNA, 20 nt, Yersinia pestis KIM
cugagcagcaaacgccucgu

SEQ ID NO: 2331981 - RNA, 12 nt, Yersinia pestis KIM
cugagcaccaga

SEQ ID NO: 2331982 - RNA, 17 nt, Yersinia pestis KIM
cugagcaccgcaggaac

SEQ ID NO: 2331983 - RNA, 21 nt, Yersinia pestis KIM
cugagauuauugggcugccug

SEQ ID NO: 2331984 - RNA, 20 nt, Yersinia pestis KIM
cugaagaugccaaucaaaaa

SEQ ID NO: 2331985 - RNA, 18 nt, Yersinia pestis KIM
cugaacgaggacuuccug

SEQ ID NO: 2331986 - RNA, 19 nt, Yersinia pestis KIM
cugaacuucugggaucauc

SEQ ID NO: 2331987 - RNA, 19 nt, Yersinia pestis KIM
cugaacugcacauacucac

SEQ ID NO: 2331988 - RNA, 12 nt, Yersinia pestis KIM
cugaaauuuuuu

SEQ ID NO: 2331989 - RNA, 21 nt, Yersinia pestis KIM
cugaacaaaauagucaguggg

SEQ ID NO: 2331990 - RNA, 14 nt, Yersinia pestis KIM
cugaaccauuuuuu

SEQ ID NO: 2331991 - RNA, 11 nt, Yersinia pestis KIM
cugaaccaugg

SEQ ID NO: 2331992 - RNA, 19 nt, Yersinia pestis KIM
cugaaaguguauuucucaa

SEQ ID NO: 2331993 - RNA, 16 nt, Yersinia pestis KIM
cugaaaguguauuucu

SEQ ID NO: 2331994 - RNA, 20 nt, Yersinia pestis KIM
cugaaaguguauuucucaaa

SEQ ID NO: 2331995 - RNA, 20 nt, Yersinia pestis KIM
cugaaaucauagcuaaauga

SEQ ID NO: 2331996 - RNA, 12 nt, Yersinia pestis KIM
cugaaauuuauu

SEQ ID NO: 2331997 - RNA, 22 nt, Yersinia pestis KIM
cucuuugauuccucugugacuc

SEQ ID NO: 2331998 - RNA, 16 nt, Yersinia pestis KIM
cucuuuccagcaaaag

SEQ ID NO: 2331999 - RNA, 12 nt, Yersinia pestis KIM
cucuuucccuuc

SEQ ID NO: 2332000 - RNA, 14 nt, Yersinia pestis KIM
cucuuucaauggcu

SEQ ID NO: 2332001 - RNA, 21 nt, Yersinia pestis KIM
cugaaagcaaacaauuaguca

SEQ ID NO: 2332002 - RNA, 12 nt, Yersinia pestis KIM
cugaaagauccu

SEQ ID NO: 2332003 - RNA, 17 nt, Yersinia pestis KIM
cugaaacuucaaaauca

SEQ ID NO: 2332004 - RNA, 18 nt, Yersinia pestis KIM
cugaaacuucaaaaucaa

SEQ ID NO: 2332005 - RNA, 18 nt, Yersinia pestis KIM
cugaaaccuacgccuaaa

SEQ ID NO: 2332006 - RNA, 17 nt, Yersinia pestis KIM
cugaaacggugaggaua

SEQ ID NO: 2332007 - RNA, 13 nt, Yersinia pestis KIM
cugaaaaucauga

SEQ ID NO: 2332008 - RNA, 17 nt, Yersinia pestis KIM
cucuggcuaaugucucu

SEQ ID NO: 2332009 - RNA, 15 nt, Yersinia pestis KIM
cucugggaaaccauu

SEQ ID NO: 2332010 - RNA, 16 nt, Yersinia pestis KIM
cucuggguaagaacag

SEQ ID NO: 2332011 - RNA, 16 nt, Yersinia pestis KIM
cucugggacgugcaua

SEQ ID NO: 2332012 - RNA, 14 nt, Yersinia pestis KIM
cucuggagcuucug

SEQ ID NO: 2332013 - RNA, 16 nt, Yersinia pestis KIM
cucuggagcuucuggc

SEQ ID NO: 2332014 - RNA, 15 nt, Yersinia pestis KIM
cucugcugggacaga

SEQ ID NO: 2332015 - RNA, 21 nt, Yersinia pestis KIM
cucuggcaacggcacauccca

SEQ ID NO: 2332016 - RNA, 23 nt, Yersinia pestis KIM
cucugucagcccuaauauccuca

SEQ ID NO: 2332017 - RNA, 12 nt, Yersinia pestis KIM
cucugugacucu

SEQ ID NO: 2332018 - RNA, 20 nt, Yersinia pestis KIM
cucuucagguaagccuuucu

SEQ ID NO: 2332019 - RNA, 11 nt, Yersinia pestis KIM
cucuucaccaa

SEQ ID NO: 2332020 - RNA, 13 nt, Yersinia pestis KIM
cucuguuuuaaaa

SEQ ID NO: 2332021 - RNA, 16 nt, Yersinia pestis KIM
cucuguuuuaaaaaaa

SEQ ID NO: 2332022 - RNA, 12 nt, Yersinia pestis KIM
cucuuauauaaa

SEQ ID NO: 2332023 - RNA, 11 nt, Yersinia pestis KIM
cucuuccugua

SEQ ID NO: 2332024 - RNA, 13 nt, Yersinia pestis KIM
cucuucugggcug

SEQ ID NO: 2332025 - RNA, 18 nt, Yersinia pestis KIM
cucuucugcccauccuca

SEQ ID NO: 2332026 - RNA, 11 nt, Yersinia pestis KIM
cucuucugcca

SEQ ID NO: 2332027 - RNA, 16 nt, Yersinia pestis KIM
cucuucuaacacuuca

SEQ ID NO: 2332028 - RNA, 20 nt, Yersinia pestis KIM
cucuuuaacaauuuaucaga

SEQ ID NO: 2332029 - RNA, 18 nt, Yersinia pestis KIM
cucuuguuuugcaaugcu

SEQ ID NO: 2332030 - RNA, 13 nt, Yersinia pestis KIM
cucuuggagccag

SEQ ID NO: 2332031 - RNA, 13 nt, Yersinia pestis KIM
cucuuguaaacca

SEQ ID NO: 2332032 - RNA, 23 nt, Yersinia pestis KIM
cucuugacgccgacaaacccaca

SEQ ID NO: 2332033 - RNA, 11 nt, Yersinia pestis KIM
cucuucuuuua

SEQ ID NO: 2332034 - RNA, 17 nt, Yersinia pestis KIM
cucuugcgcuccacgcc

SEQ ID NO: 2332035 - RNA, 10 nt, Yersinia pestis KIM
aaaaaacagc

SEQ ID NO: 2332036 - RNA, 13 nt, Yersinia pestis KIM
aaaaaaauuaaaa

SEQ ID NO: 2332037 - RNA, 12 nt, Yersinia pestis KIM
aaaaaaaauaaa

SEQ ID NO: 2332038 - RNA, 12 nt, Yersinia pestis KIM
aaaaaaagacac

SEQ ID NO: 2332039 - RNA, 11 nt, Yersinia pestis KIM
aaaaaaauaaa

SEQ ID NO: 2332040 - RNA, 17 nt, Yersinia pestis KIM
aaaaaaccaccaaaaua

SEQ ID NO: 2332041 - RNA, 13 nt, Yersinia pestis KIM
aaaaaauacgcuu

SEQ ID NO: 2332042 - RNA, 14 nt, Yersinia pestis KIM
aaaaaauaauuaaa

SEQ ID NO: 2332043 - RNA, 18 nt, Yersinia pestis KIM
aaaaaagcugucauaaaa

SEQ ID NO: 2332044 - RNA, 23 nt, Yersinia pestis KIM
aaaaaaccccgacauuauucaug

SEQ ID NO: 2332045 - RNA, 19 nt, Yersinia pestis KIM
aaaaacagcgaucuauucu

SEQ ID NO: 2332046 - RNA, 17 nt, Yersinia pestis KIM
aaaaacagacuaaaaac

SEQ ID NO: 2332047 - RNA, 13 nt, Yersinia pestis KIM
aaaaaauuaaaau

SEQ ID NO: 2332048 - RNA, 16 nt, Yersinia pestis KIM
aaaaacagacuaaaaa

SEQ ID NO: 2332049 - RNA, 12 nt, Yersinia pestis KIM
aaaaaauaucuu

SEQ ID NO: 2332050 - RNA, 13 nt, Yersinia pestis KIM
aaaaaauaucuuu

SEQ ID NO: 2332051 - RNA, 21 nt, Yersinia pestis KIM
aaaaacccauuaaaaacaaau

SEQ ID NO: 2332052 - RNA, 18 nt, Yersinia pestis KIM
aaaaaccccuuuugauuu

SEQ ID NO: 2332053 - RNA, 15 nt, Yersinia pestis KIM
aaaaacagucauuaa

SEQ ID NO: 2332054 - RNA, 21 nt, Yersinia pestis KIM
aaaaacagucauuaacacauc

SEQ ID NO: 2332055 - RNA, 19 nt, Yersinia pestis KIM
aaaaacagucauuaacaca

SEQ ID NO: 2332056 - RNA, 23 nt, Yersinia pestis KIM
aaaaacccucuucaaucggauaa

SEQ ID NO: 2332057 - RNA, 22 nt, Yersinia pestis KIM
aaaaaccgcagcagacaacuga

SEQ ID NO: 2332058 - RNA, 15 nt, Yersinia pestis KIM
aaaaauaaucaauga

SEQ ID NO: 2332059 - RNA, 12 nt, Yersinia pestis KIM
aaaaauacaacc

SEQ ID NO: 2332060 - RNA, 16 nt, Yersinia pestis KIM
aaaaauaauuaaaccu

SEQ ID NO: 2332061 - RNA, 18 nt, Yersinia pestis KIM
aaaaauacaaccaacaaa

SEQ ID NO: 2332062 - RNA, 21 nt, Yersinia pestis KIM
aaaaauacaggugucaucaag

SEQ ID NO: 2332063 - RNA, 18 nt, Yersinia pestis KIM
aaaaauaucuauuuccau

SEQ ID NO: 2332064 - RNA, 13 nt, Yersinia pestis KIM
aaaacaauaaaaa

SEQ ID NO: 2332065 - RNA, 15 nt, Yersinia pestis KIM
aaaacaauaaaaaga

SEQ ID NO: 2332066 - RNA, 18 nt, Yersinia pestis KIM
aaaacaauauaauaacuc

SEQ ID NO: 2332067 - RNA, 21 nt, Yersinia pestis KIM
aaaacaauuucgaaaacucaa

SEQ ID NO: 2332068 - RNA, 15 nt, Yersinia pestis KIM
aaaacaucacacuug

SEQ ID NO: 2332069 - RNA, 20 nt, Yersinia pestis KIM
aaaagcacagacaaacaacc

SEQ ID NO: 2332070 - RNA, 22 nt, Yersinia pestis KIM
aaaagcacagacaaacaaccua

SEQ ID NO: 2332071 - RNA, 13 nt, Yersinia pestis KIM
aaaagcacagaca

SEQ ID NO: 2332072 - RNA, 14 nt, Yersinia pestis KIM
aaaagcagcaaacg

SEQ ID NO: 2332073 - RNA, 12 nt, Yersinia pestis KIM
aaaagcagcagu

SEQ ID NO: 2332074 - RNA, 11 nt, Yersinia pestis KIM
aaaagauaacg

SEQ ID NO: 2332075 - RNA, 13 nt, Yersinia pestis KIM
aaaagaucugcau

SEQ ID NO: 2332076 - RNA, 22 nt, Yersinia pestis KIM
aaaagaauaaaugucacuugcc

SEQ ID NO: 2332077 - RNA, 23 nt, Yersinia pestis KIM
aaaagaaaauggcuuuuuuaaua

SEQ ID NO: 2332078 - RNA, 14 nt, Yersinia pestis KIM
aaaagaaaaagaca

SEQ ID NO: 2332079 - RNA, 23 nt, Yersinia pestis KIM
aaaacgugaaacgccuccucuug

SEQ ID NO: 2332080 - RNA, 18 nt, Yersinia pestis KIM
aaaacuauuuauuuuauc

SEQ ID NO: 2332081 - RNA, 17 nt, Yersinia pestis KIM
aaaacguuaacugcagu

SEQ ID NO: 2332082 - RNA, 18 nt, Yersinia pestis KIM
aaaacugaagcaucaaua

SEQ ID NO: 2332083 - RNA, 14 nt, Yersinia pestis KIM
aaaacucaaacuga

SEQ ID NO: 2332084 - RNA, 15 nt, Yersinia pestis KIM
aaaacucaaacugau

SEQ ID NO: 2332085 - RNA, 14 nt, Yersinia pestis KIM
aaaacucaaagauu

SEQ ID NO: 2332086 - RNA, 22 nt, Yersinia pestis KIM
aaaacugacugccauaauccag

SEQ ID NO: 2332087 - RNA, 12 nt, Yersinia pestis KIM
aaaacugagguc

SEQ ID NO: 2332088 - RNA, 13 nt, Yersinia pestis KIM
aaaacugaaaagu

SEQ ID NO: 2332089 - RNA, 17 nt, Yersinia pestis KIM
aaaacuuaucuaaaaaa

SEQ ID NO: 2332090 - RNA, 22 nt, Yersinia pestis KIM
aaaacugugcgaauggaaaaac

SEQ ID NO: 2332091 - RNA, 16 nt, Yersinia pestis KIM
aaaacuuuggcugagg

SEQ ID NO: 2332092 - RNA, 16 nt, Yersinia pestis KIM
aaaagcgaucagcaau

SEQ ID NO: 2332093 - RNA, 21 nt, Yersinia pestis KIM
aaaagccccagugcgcaaaaa

SEQ ID NO: 2332094 - RNA, 14 nt, Yersinia pestis KIM
aaaagcaugcccag

SEQ ID NO: 2332095 - RNA, 23 nt, Yersinia pestis KIM
aaaagcccguucguugccaaaac

SEQ ID NO: 2332096 - RNA, 19 nt, Yersinia pestis KIM
aaaagcccggucacucaau

SEQ ID NO: 2332097 - RNA, 17 nt, Yersinia pestis KIM
aaaagcgacuaauauca

SEQ ID NO: 2332098 - RNA, 17 nt, Yersinia pestis KIM
aaaagcgacugauauua

SEQ ID NO: 2332099 - RNA, 17 nt, Yersinia pestis KIM
aaaaguggcuaucugaa

SEQ ID NO: 2332100 - RNA, 15 nt, Yersinia pestis KIM
aaaauaauuaaaccu

SEQ ID NO: 2332101 - RNA, 16 nt, Yersinia pestis KIM
aaaauaaaauucguuu

SEQ ID NO: 2332102 - RNA, 22 nt, Yersinia pestis KIM
aaaauaggccauucaaugucca

SEQ ID NO: 2332103 - RNA, 12 nt, Yersinia pestis KIM
aaaauagccuuc

SEQ ID NO: 2332104 - RNA, 15 nt, Yersinia pestis KIM
aaaauagccuuccuu

SEQ ID NO: 2332105 - RNA, 19 nt, Yersinia pestis KIM
aaaauagagcauaccaaua

SEQ ID NO: 2332106 - RNA, 17 nt, Yersinia pestis KIM
aaaauagaggaaauaaa

SEQ ID NO: 2332107 - RNA, 17 nt, Yersinia pestis KIM
aaaauacugccaaucgc

SEQ ID NO: 2332108 - RNA, 17 nt, Yersinia pestis KIM
aaaauacggccagucaa

SEQ ID NO: 2332109 - RNA, 19 nt, Yersinia pestis KIM
aaaauacggccagucaaaa

SEQ ID NO: 2332110 - RNA, 23 nt, Yersinia pestis KIM
aaaaucaccuggccaggaauuaa

SEQ ID NO: 2332111 - RNA, 22 nt, Yersinia pestis KIM
aaaaucacgcggguuaucacau

SEQ ID NO: 2332112 - RNA, 18 nt, Yersinia pestis KIM
aaaaucacguuuccaaaa

SEQ ID NO: 2332113 - RNA, 23 nt, Yersinia pestis KIM
aaaaucccgaugagucuauuuau

SEQ ID NO: 2332114 - RNA, 19 nt, Yersinia pestis KIM
aaaauccgguaauggccaa

SEQ ID NO: 2332115 - RNA, 22 nt, Yersinia pestis KIM
aaaaucguauaacauaauaaau

SEQ ID NO: 2332116 - RNA, 18 nt, Yersinia pestis KIM
aaaaugauuuuauucacu

SEQ ID NO: 2332117 - RNA, 18 nt, Yersinia pestis KIM
aaaaugaucaucagcagc

SEQ ID NO: 2332118 - RNA, 17 nt, Yersinia pestis KIM
aaaaugaucuuuauuau

SEQ ID NO: 2332119 - RNA, 13 nt, Yersinia pestis KIM
aaaaucgcacuga

SEQ ID NO: 2332120 - RNA, 18 nt, Yersinia pestis KIM
aaaaucgcgaccagcaga

SEQ ID NO: 2332121 - RNA, 19 nt, Yersinia pestis KIM
aaaaucgcgaccagcagaa

SEQ ID NO: 2332122 - RNA, 20 nt, Yersinia pestis KIM
aaaaucgcgaccagcagaau

SEQ ID NO: 2332123 - RNA, 18 nt, Yersinia pestis KIM
aaaaucguauaacauaau

SEQ ID NO: 2332124 - RNA, 17 nt, Yersinia pestis KIM
aaaaucgauagucaacu

SEQ ID NO: 2332125 - RNA, 19 nt, Yersinia pestis KIM
aaaaucgauagucaacuuu

SEQ ID NO: 2332126 - RNA, 18 nt, Yersinia pestis KIM
aaaauccugaauaauacu

SEQ ID NO: 2332127 - RNA, 17 nt, Yersinia pestis KIM
aaaaugccguacaacaa

SEQ ID NO: 2332128 - RNA, 19 nt, Yersinia pestis KIM
aaaaugccguacaacaaua

SEQ ID NO: 2332129 - RNA, 12 nt, Yersinia pestis KIM
aaaaugcucuuc

SEQ ID NO: 2332130 - RNA, 20 nt, Yersinia pestis KIM
aaaauuauggcuauacuuaa

SEQ ID NO: 2332131 - RNA, 15 nt, Yersinia pestis KIM
aaaauuagccaagca

SEQ ID NO: 2332132 - RNA, 19 nt, Yersinia pestis KIM
aaacaacgccgcucaauua

SEQ ID NO: 2332133 - RNA, 22 nt, Yersinia pestis KIM
aaacaacgccgcucaauuaacc

SEQ ID NO: 2332134 - RNA, 19 nt, Yersinia pestis KIM
aaacaacccgaauuaauaa

SEQ ID NO: 2332135 - RNA, 21 nt, Yersinia pestis KIM
aaacaaaucuuaaauugaaga

SEQ ID NO: 2332136 - RNA, 15 nt, Yersinia pestis KIM
aaacaaaucuuaaau

SEQ ID NO: 2332137 - RNA, 12 nt, Yersinia pestis KIM
aaacaaauacac

SEQ ID NO: 2332138 - RNA, 13 nt, Yersinia pestis KIM
aaaauucacaaca

SEQ ID NO: 2332139 - RNA, 20 nt, Yersinia pestis KIM
aaaauucaucuuuaacaaca

SEQ ID NO: 2332140 - RNA, 22 nt, Yersinia pestis KIM
aaaauucguuucucuaaaauuu

SEQ ID NO: 2332141 - RNA, 18 nt, Yersinia pestis KIM
aaaucauggcauaaaccg

SEQ ID NO: 2332142 - RNA, 15 nt, Yersinia pestis KIM
aaaucaugaaauuuu

SEQ ID NO: 2332143 - RNA, 23 nt, Yersinia pestis KIM
aaaucaucgcugacaauuuacac

SEQ ID NO: 2332144 - RNA, 24 nt, Yersinia pestis KIM
aaaucgcacugaguucugcugcca

SEQ ID NO: 2332145 - RNA, 23 nt, Yersinia pestis KIM
aaaucgccaauagaaaggcuauc

SEQ ID NO: 2332146 - RNA, 17 nt, Yersinia pestis KIM
aaaucauugacguuaca

SEQ ID NO: 2332147 - RNA, 14 nt, Yersinia pestis KIM
aaaucgauacuuuu

SEQ ID NO: 2332148 - RNA, 16 nt, Yersinia pestis KIM
aaaucgauacuuuuua

SEQ ID NO: 2332149 - RNA, 16 nt, Yersinia pestis KIM
aaaucucaucggcaua

SEQ ID NO: 2332150 - RNA, 16 nt, Yersinia pestis KIM
aaaucuagcccuucag

SEQ ID NO: 2332151 - RNA, 14 nt, Yersinia pestis KIM
aaaucuaaguucag

SEQ ID NO: 2332152 - RNA, 17 nt, Yersinia pestis KIM
aaaugccgauaaaaacu

SEQ ID NO: 2332153 - RNA, 15 nt, Yersinia pestis KIM
aaaugccgccugacu

SEQ ID NO: 2332154 - RNA, 19 nt, Yersinia pestis KIM
aaaugcggcggcugaccac

SEQ ID NO: 2332155 - RNA, 23 nt, Yersinia pestis KIM
aaaucuuuuuguaauguuucuau

SEQ ID NO: 2332156 - RNA, 21 nt, Yersinia pestis KIM
aaaucuuccuuuccauuuuca

SEQ ID NO: 2332157 - RNA, 16 nt, Yersinia pestis KIM
aaaucuuccagcggca

SEQ ID NO: 2332158 - RNA, 16 nt, Yersinia pestis KIM
aaaucuuuguuacaua

SEQ ID NO: 2332159 - RNA, 21 nt, Yersinia pestis KIM
aaaugaugaaaauugcaggug

SEQ ID NO: 2332160 - RNA, 14 nt, Yersinia pestis KIM
aaaugauuuaauuu

SEQ ID NO: 2332161 - RNA, 14 nt, Yersinia pestis KIM
aaauuaaauaacua

SEQ ID NO: 2332162 - RNA, 20 nt, Yersinia pestis KIM
aaaugcuuuuugcgcugcgu

SEQ ID NO: 2332163 - RNA, 23 nt, Yersinia pestis KIM
aaauguguuuucugugcuugagu

SEQ ID NO: 2332164 - RNA, 16 nt, Yersinia pestis KIM
aaaaaggcaccagcgc

SEQ ID NO: 2332165 - RNA, 19 nt, Yersinia pestis KIM
aaauuaauuacuuuauuua

SEQ ID NO: 2332166 - RNA, 22 nt, Yersinia pestis KIM
aaaaagcugucauaaaaaaagc

SEQ ID NO: 2332167 - RNA, 13 nt, Yersinia pestis KIM
aaaaagccugaau

SEQ ID NO: 2332168 - RNA, 18 nt, Yersinia pestis KIM
aaaaagcgacuaauauca

SEQ ID NO: 2332169 - RNA, 18 nt, Yersinia pestis KIM
aaauucuauccggauuaa

SEQ ID NO: 2332170 - RNA, 22 nt, Yersinia pestis KIM
aaauucucaaugauaaaauccu

SEQ ID NO: 2332171 - RNA, 17 nt, Yersinia pestis KIM
aaauucucaaugauaaa

SEQ ID NO: 2332172 - RNA, 18 nt, Yersinia pestis KIM
aaauucgugcucaucaac

SEQ ID NO: 2332173 - RNA, 23 nt, Yersinia pestis KIM
aaauucgcuuuucgcaucauuaa

SEQ ID NO: 2332174 - RNA, 18 nt, Yersinia pestis KIM
aaauuccuauaaauuuua

SEQ ID NO: 2332175 - RNA, 15 nt, Yersinia pestis KIM
aaauucacguuuacu

SEQ ID NO: 2332176 - RNA, 17 nt, Yersinia pestis KIM
aaauucacaacagugca

SEQ ID NO: 2332177 - RNA, 16 nt, Yersinia pestis KIM
aaauucccguuuuauu

SEQ ID NO: 2332178 - RNA, 16 nt, Yersinia pestis KIM
aaauuacgguuuacca

SEQ ID NO: 2332179 - RNA, 12 nt, Yersinia pestis KIM
aaauuaucuaau

SEQ ID NO: 2332180 - RNA, 15 nt, Yersinia pestis KIM
aaauuauuaaauaag

SEQ ID NO: 2332181 - RNA, 19 nt, Yersinia pestis KIM
aaauuauugccgcagauaa

SEQ ID NO: 2332182 - RNA, 12 nt, Yersinia pestis KIM
aaauaacagcua

SEQ ID NO: 2332183 - RNA, 19 nt, Yersinia pestis KIM
aaauaaccgccaaaauauc

SEQ ID NO: 2332184 - RNA, 14 nt, Yersinia pestis KIM
aaauaaaauaauaa

SEQ ID NO: 2332185 - RNA, 12 nt, Yersinia pestis KIM
aaauaaaauaau

SEQ ID NO: 2332186 - RNA, 12 nt, Yersinia pestis KIM
aaauaaacaaaa

SEQ ID NO: 2332187 - RNA, 22 nt, Yersinia pestis KIM
aaauaaguacuuccaauaagug

SEQ ID NO: 2332188 - RNA, 21 nt, Yersinia pestis KIM
aaauaauaauggugaaccaga

SEQ ID NO: 2332189 - RNA, 22 nt, Yersinia pestis KIM
aaauaaguauuucaaauaagug

SEQ ID NO: 2332190 - RNA, 19 nt, Yersinia pestis KIM
aaauaaguuaauacgccau

SEQ ID NO: 2332191 - RNA, 21 nt, Yersinia pestis KIM
aaauaaccgccaaaauaucgc

SEQ ID NO: 2332192 - RNA, 13 nt, Yersinia pestis KIM
aaauaacgcaaaa

SEQ ID NO: 2332193 - RNA, 15 nt, Yersinia pestis KIM
aaauaacguaguacu

SEQ ID NO: 2332194 - RNA, 16 nt, Yersinia pestis KIM
aaauaacugccagggc

SEQ ID NO: 2332195 - RNA, 15 nt, Yersinia pestis KIM
aaauaauaucaauga

SEQ ID NO: 2332196 - RNA, 23 nt, Yersinia pestis KIM
aaauaauaucaagucuugaagag

SEQ ID NO: 2332197 - RNA, 15 nt, Yersinia pestis KIM
aaauagccuucccug

SEQ ID NO: 2332198 - RNA, 22 nt, Yersinia pestis KIM
aaauagccguuucagauaaaaa

SEQ ID NO: 2332199 - RNA, 13 nt, Yersinia pestis KIM
aaauagccuguaa

SEQ ID NO: 2332200 - RNA, 12 nt, Yersinia pestis KIM
aaauacuuauuu

SEQ ID NO: 2332201 - RNA, 16 nt, Yersinia pestis KIM
aaauacuuauuugaaa

SEQ ID NO: 2332202 - RNA, 17 nt, Yersinia pestis KIM
aaaucacaauuucaccc

SEQ ID NO: 2332203 - RNA, 22 nt, Yersinia pestis KIM
aaaucacccgcaagaauaacug

SEQ ID NO: 2332204 - RNA, 15 nt, Yersinia pestis KIM
aaaucaccuggccag

SEQ ID NO: 2332205 - RNA, 15 nt, Yersinia pestis KIM
aaaucaccgccggau

SEQ ID NO: 2332206 - RNA, 20 nt, Yersinia pestis KIM
aaaucacaugcggauugaac

SEQ ID NO: 2332207 - RNA, 13 nt, Yersinia pestis KIM
aaaucacuucuuc

SEQ ID NO: 2332208 - RNA, 16 nt, Yersinia pestis KIM
aaaucacucacucuuc

SEQ ID NO: 2332209 - RNA, 16 nt, Yersinia pestis KIM
aaaucaguguaucaau

SEQ ID NO: 2332210 - RNA, 22 nt, Yersinia pestis KIM
aaaucagugaaggaugaauaaa

SEQ ID NO: 2332211 - RNA, 23 nt, Yersinia pestis KIM
aaaucagugaaggaugaauaaau

SEQ ID NO: 2332212 - RNA, 16 nt, Yersinia pestis KIM
aaaucaggcuguucuu

SEQ ID NO: 2332213 - RNA, 11 nt, Yersinia pestis KIM
aaaucagggca

SEQ ID NO: 2332214 - RNA, 20 nt, Yersinia pestis KIM
aaaucagcguuuuaaucaca

SEQ ID NO: 2332215 - RNA, 16 nt, Yersinia pestis KIM
aaauagguauaaaacu

SEQ ID NO: 2332216 - RNA, 15 nt, Yersinia pestis KIM
aaauaguggcacaaa

SEQ ID NO: 2332217 - RNA, 20 nt, Yersinia pestis KIM
aaauaggugcgccaguggca

SEQ ID NO: 2332218 - RNA, 18 nt, Yersinia pestis KIM
aaauaggcguuaucggcg

SEQ ID NO: 2332219 - RNA, 18 nt, Yersinia pestis KIM
aaauauuggcaacaacag

SEQ ID NO: 2332220 - RNA, 19 nt, Yersinia pestis KIM
aaauauucgucucaucaau

SEQ ID NO: 2332221 - RNA, 21 nt, Yersinia pestis KIM
aaauauucuaaguaaaacaaa

SEQ ID NO: 2332222 - RNA, 21 nt, Yersinia pestis KIM
aaaucaaaaggaacguggcgu

SEQ ID NO: 2332223 - RNA, 20 nt, Yersinia pestis KIM
aaaucaaacaaaucuuaaau

SEQ ID NO: 2332224 - RNA, 14 nt, Yersinia pestis KIM
aaaucaaagugaga

SEQ ID NO: 2332225 - RNA, 22 nt, Yersinia pestis KIM
aaagucagcaaaucaaacaaau

SEQ ID NO: 2332226 - RNA, 17 nt, Yersinia pestis KIM
aaaguaaucuuugagca

SEQ ID NO: 2332227 - RNA, 13 nt, Yersinia pestis KIM
aaaguaauuuauc

SEQ ID NO: 2332228 - RNA, 16 nt, Yersinia pestis KIM
aaagguuaacugcagu

SEQ ID NO: 2332229 - RNA, 16 nt, Yersinia pestis KIM
aaaggcccgcuaguga

SEQ ID NO: 2332230 - RNA, 15 nt, Yersinia pestis KIM
aaagcccgcuucaaa

SEQ ID NO: 2332231 - RNA, 15 nt, Yersinia pestis KIM
aaagccgccgccuuc

SEQ ID NO: 2332232 - RNA, 15 nt, Yersinia pestis KIM
aaagccgagcaagug

SEQ ID NO: 2332233 - RNA, 17 nt, Yersinia pestis KIM
aaagcccggucacucaa

SEQ ID NO: 2332234 - RNA, 16 nt, Yersinia pestis KIM
aaagcguuaauuauag

SEQ ID NO: 2332235 - RNA, 17 nt, Yersinia pestis KIM
aaaggcaaaagcaucac

SEQ ID NO: 2332236 - RNA, 19 nt, Yersinia pestis KIM
aaaggauuuuauuaaauca

SEQ ID NO: 2332237 - RNA, 16 nt, Yersinia pestis KIM
aaaggcaaaaauugac

SEQ ID NO: 2332238 - RNA, 17 nt, Yersinia pestis KIM
aaaggcaagauuucucu

SEQ ID NO: 2332239 - RNA, 15 nt, Yersinia pestis KIM
aaaggcaaagaagaa

SEQ ID NO: 2332240 - RNA, 21 nt, Yersinia pestis KIM
aaaggcaacgaaggcaacaac

SEQ ID NO: 2332241 - RNA, 20 nt, Yersinia pestis KIM
aaagcugucaguccaaaaua

SEQ ID NO: 2332242 - RNA, 19 nt, Yersinia pestis KIM
aaagcugucauaaaaaaag

SEQ ID NO: 2332243 - RNA, 11 nt, Yersinia pestis KIM
aaaggaaggga

SEQ ID NO: 2332244 - RNA, 11 nt, Yersinia pestis KIM
aaaggaagggg

SEQ ID NO: 2332245 - RNA, 16 nt, Yersinia pestis KIM
aaaggaacaaaagaga

SEQ ID NO: 2332246 - RNA, 21 nt, Yersinia pestis KIM
aaagauuucaucggcaaaaac

SEQ ID NO: 2332247 - RNA, 23 nt, Yersinia pestis KIM
aaagauuuccuuucgcacuuuaa

SEQ ID NO: 2332248 - RNA, 21 nt, Yersinia pestis KIM
aaagauccccacaaaaucaac

SEQ ID NO: 2332249 - RNA, 16 nt, Yersinia pestis KIM
aaagauuucaucauuc

SEQ ID NO: 2332250 - RNA, 22 nt, Yersinia pestis KIM
aaagcaaacgccgcucuucagc

SEQ ID NO: 2332251 - RNA, 17 nt, Yersinia pestis KIM
aaagauagcaaaagaau

SEQ ID NO: 2332252 - RNA, 16 nt, Yersinia pestis KIM
aaagauagcaaaagaa

SEQ ID NO: 2332253 - RNA, 14 nt, Yersinia pestis KIM
aaagauagcaaaag

SEQ ID NO: 2332254 - RNA, 17 nt, Yersinia pestis KIM
aaagcagagaaugagua

SEQ ID NO: 2332255 - RNA, 15 nt, Yersinia pestis KIM
aaagcagacuugaac

SEQ ID NO: 2332256 - RNA, 12 nt, Yersinia pestis KIM
aaagcagcaguu

SEQ ID NO: 2332257 - RNA, 22 nt, Yersinia pestis KIM
aaagcauuuaucauauuaacau

SEQ ID NO: 2332258 - RNA, 13 nt, Yersinia pestis KIM
aaagccaaacccc

SEQ ID NO: 2332259 - RNA, 15 nt, Yersinia pestis KIM
aaagccaggugauaa

SEQ ID NO: 2332260 - RNA, 17 nt, Yersinia pestis KIM
aaagaaggguuagcauu

SEQ ID NO: 2332261 - RNA, 22 nt, Yersinia pestis KIM
aaacuuuucaguuuuaauuuau

SEQ ID NO: 2332262 - RNA, 21 nt, Yersinia pestis KIM
aaacuuuuauugucuuuaaua

SEQ ID NO: 2332263 - RNA, 23 nt, Yersinia pestis KIM
aaagacgccuuccggcaucuuuu

SEQ ID NO: 2332264 - RNA, 18 nt, Yersinia pestis KIM
aaagacgcuaauuaaaga

SEQ ID NO: 2332265 - RNA, 18 nt, Yersinia pestis KIM
aaagacgccguaaauaca

SEQ ID NO: 2332266 - RNA, 18 nt, Yersinia pestis KIM
aaagauaauacauaaaau

SEQ ID NO: 2332267 - RNA, 20 nt, Yersinia pestis KIM
aaagauaauacauaaaauca

SEQ ID NO: 2332268 - RNA, 19 nt, Yersinia pestis KIM
aaagagauccguuuaauca

SEQ ID NO: 2332269 - RNA, 23 nt, Yersinia pestis KIM
aaagacuuuauucacagcagaac

SEQ ID NO: 2332270 - RNA, 22 nt, Yersinia pestis KIM
aaacuguuuuuuaaagaaaaaa

SEQ ID NO: 2332271 - RNA, 14 nt, Yersinia pestis KIM
aaacuuaaaaauca

SEQ ID NO: 2332272 - RNA, 15 nt, Yersinia pestis KIM
aaacuguucuuauug

SEQ ID NO: 2332273 - RNA, 15 nt, Yersinia pestis KIM
aaacugugcaaaugg

SEQ ID NO: 2332274 - RNA, 14 nt, Yersinia pestis KIM
aaacugugcaaaug

SEQ ID NO: 2332275 - RNA, 16 nt, Yersinia pestis KIM
aaacugucagucaaaa

SEQ ID NO: 2332276 - RNA, 20 nt, Yersinia pestis KIM
aaacugccgccaccauauca

SEQ ID NO: 2332277 - RNA, 17 nt, Yersinia pestis KIM
aaacugcucauaaagca

SEQ ID NO: 2332278 - RNA, 19 nt, Yersinia pestis KIM
aaacugauuaauaguguug

SEQ ID NO: 2332279 - RNA, 12 nt, Yersinia pestis KIM
aaacugacauaa

SEQ ID NO: 2332280 - RNA, 16 nt, Yersinia pestis KIM
aaacugauauaaagca

SEQ ID NO: 2332281 - RNA, 14 nt, Yersinia pestis KIM
aaacugaucaucaa

SEQ ID NO: 2332282 - RNA, 15 nt, Yersinia pestis KIM
aaacugaucaucaac

SEQ ID NO: 2332283 - RNA, 16 nt, Yersinia pestis KIM
aaacuucaaaaucaag

SEQ ID NO: 2332284 - RNA, 14 nt, Yersinia pestis KIM
aaacuucaaaauca

SEQ ID NO: 2332285 - RNA, 17 nt, Yersinia pestis KIM
aaacuuaucuaaaaaac

SEQ ID NO: 2332286 - RNA, 15 nt, Yersinia pestis KIM
aaacucaccgagcau

SEQ ID NO: 2332287 - RNA, 20 nt, Yersinia pestis KIM
aaacucaccgagcauauuuu

SEQ ID NO: 2332288 - RNA, 17 nt, Yersinia pestis KIM
aaacucagcgaauaaau

SEQ ID NO: 2332289 - RNA, 18 nt, Yersinia pestis KIM
aaacugaaaaaggcacca

SEQ ID NO: 2332290 - RNA, 20 nt, Yersinia pestis KIM
aaacugaccgauaaacgcca

SEQ ID NO: 2332291 - RNA, 21 nt, Yersinia pestis KIM
aaacugacugccauaauccag

SEQ ID NO: 2332292 - RNA, 23 nt, Yersinia pestis KIM
aaacugaaguuaaaaagccugaa

SEQ ID NO: 2332293 - RNA, 17 nt, Yersinia pestis KIM
aaacugaauaucccccu

SEQ ID NO: 2332294 - RNA, 22 nt, Yersinia pestis KIM
aaacuccuuggaacuuacuccc

SEQ ID NO: 2332295 - RNA, 13 nt, Yersinia pestis KIM
aaacuaauaucuu

SEQ ID NO: 2332296 - RNA, 18 nt, Yersinia pestis KIM
aaacuacgguaauaaaca

SEQ ID NO: 2332297 - RNA, 13 nt, Yersinia pestis KIM
aaaccugauuuac

SEQ ID NO: 2332298 - RNA, 19 nt, Yersinia pestis KIM
aaaccugacugguucacac

SEQ ID NO: 2332299 - RNA, 17 nt, Yersinia pestis KIM
aaacaagcuuauauuau

SEQ ID NO: 2332300 - RNA, 20 nt, Yersinia pestis KIM
aaaccuuauuuuugcauaua

SEQ ID NO: 2332301 - RNA, 23 nt, Yersinia pestis KIM
aaacgaguuuccaguucaagaua

SEQ ID NO: 2332302 - RNA, 22 nt, Yersinia pestis KIM
aaacgccccgauaaaccaacug

SEQ ID NO: 2332303 - RNA, 18 nt, Yersinia pestis KIM
aaacgccagugcaaaaug

SEQ ID NO: 2332304 - RNA, 12 nt, Yersinia pestis KIM
aaacgcccagcu

SEQ ID NO: 2332305 - RNA, 18 nt, Yersinia pestis KIM
aaacgccuccucuuggau

SEQ ID NO: 2332306 - RNA, 14 nt, Yersinia pestis KIM
aaacgccucguuua

SEQ ID NO: 2332307 - RNA, 13 nt, Yersinia pestis KIM
aaacgccugaucc

SEQ ID NO: 2332308 - RNA, 18 nt, Yersinia pestis KIM
aaacgccgcgucaauaac

SEQ ID NO: 2332309 - RNA, 21 nt, Yersinia pestis KIM
aaacgccagauaugaucaaaa

SEQ ID NO: 2332310 - RNA, 13 nt, Yersinia pestis KIM
aaacgccagcaga

SEQ ID NO: 2332311 - RNA, 15 nt, Yersinia pestis KIM
aaacggcuuuuuaaa

SEQ ID NO: 2332312 - RNA, 17 nt, Yersinia pestis KIM
aaacggcgguuaaucgg

SEQ ID NO: 2332313 - RNA, 20 nt, Yersinia pestis KIM
aaacgggccgcgcagauuau

SEQ ID NO: 2332314 - RNA, 20 nt, Yersinia pestis KIM
aaacggguggccacaauaaa

SEQ ID NO: 2332315 - RNA, 19 nt, Yersinia pestis KIM
aaacgcuuuuaacugugca

SEQ ID NO: 2332316 - RNA, 21 nt, Yersinia pestis KIM
aaacggaauggccgauggaac

SEQ ID NO: 2332317 - RNA, 21 nt, Yersinia pestis KIM
aaacggcgcggcaucaccaaa

SEQ ID NO: 2332318 - RNA, 14 nt, Yersinia pestis KIM
aaacgcugggcgau

SEQ ID NO: 2332319 - RNA, 15 nt, Yersinia pestis KIM
aaacgcuggccagca

SEQ ID NO: 2332320 - RNA, 21 nt, Yersinia pestis KIM
aaacgcguuaauuaagacccu

SEQ ID NO: 2332321 - RNA, 18 nt, Yersinia pestis KIM
aaacgcucaguuaaacgg

SEQ ID NO: 2332322 - RNA, 17 nt, Yersinia pestis KIM
aaacgccugggauccau

SEQ ID NO: 2332323 - RNA, 20 nt, Yersinia pestis KIM
aaacgccugggauccauagg

SEQ ID NO: 2332324 - RNA, 22 nt, Yersinia pestis KIM
aaacgguuaagcagguagcugu

SEQ ID NO: 2332325 - RNA, 22 nt, Yersinia pestis KIM
aaacggucauuguagauggcca

SEQ ID NO: 2332326 - RNA, 21 nt, Yersinia pestis KIM
aaacggucuguuaauccuaau

SEQ ID NO: 2332327 - RNA, 16 nt, Yersinia pestis KIM
aaacguauaaaagcau

SEQ ID NO: 2332328 - RNA, 14 nt, Yersinia pestis KIM
aaacguuaacugca

SEQ ID NO: 2332329 - RNA, 16 nt, Yersinia pestis KIM
aaacguuaacugcagu

SEQ ID NO: 2332330 - RNA, 12 nt, Yersinia pestis KIM
auuuauaaggaa

SEQ ID NO: 2332331 - RNA, 16 nt, Yersinia pestis KIM
auuuaucauauuaaca

SEQ ID NO: 2332332 - RNA, 17 nt, Yersinia pestis KIM
aaaaguaucuuucaccc

SEQ ID NO: 2332333 - RNA, 17 nt, Yersinia pestis KIM
aaaagucagcaaaucaa

SEQ ID NO: 2332334 - RNA, 23 nt, Yersinia pestis KIM
auuuaugcaccaaauucagaaug

SEQ ID NO: 2332335 - RNA, 22 nt, Yersinia pestis KIM
auuuaugacggguauauagcca

SEQ ID NO: 2332336 - RNA, 21 nt, Yersinia pestis KIM
auuuauugcggcuuagccacu

SEQ ID NO: 2332337 - RNA, 18 nt, Yersinia pestis KIM
auuuauugccauuuuaau

SEQ ID NO: 2332338 - RNA, 23 nt, Yersinia pestis KIM
auuuauuccucucugaaucacua

SEQ ID NO: 2332339 - RNA, 18 nt, Yersinia pestis KIM
auuuauuuauaaaaccac

SEQ ID NO: 2332340 - RNA, 17 nt, Yersinia pestis KIM
auuuauuuauaaaacca

SEQ ID NO: 2332341 - RNA, 20 nt, Yersinia pestis KIM
auuucaaugccggucaauug

SEQ ID NO: 2332342 - RNA, 20 nt, Yersinia pestis KIM
auuucaauauaugaaugagu

SEQ ID NO: 2332343 - RNA, 22 nt, Yersinia pestis KIM
auuucgccguauuuguauuuac

SEQ ID NO: 2332344 - RNA, 16 nt, Yersinia pestis KIM
auuuccguuaacccaa

SEQ ID NO: 2332345 - RNA, 22 nt, Yersinia pestis KIM
auuuccgccccuugcuucaguu

SEQ ID NO: 2332346 - RNA, 11 nt, Yersinia pestis KIM
auuuccgaaag

SEQ ID NO: 2332347 - RNA, 16 nt, Yersinia pestis KIM
auuucccugcggccau

SEQ ID NO: 2332348 - RNA, 22 nt, Yersinia pestis KIM
auuucccugcggccauccagaa

SEQ ID NO: 2332349 - RNA, 19 nt, Yersinia pestis KIM
auuucaccgguaaucuggu

SEQ ID NO: 2332350 - RNA, 14 nt, Yersinia pestis KIM
auuucacacuguuu

SEQ ID NO: 2332351 - RNA, 20 nt, Yersinia pestis KIM
auuucaccuauaauuaacag

SEQ ID NO: 2332352 - RNA, 18 nt, Yersinia pestis KIM
auuucaccuauaauuaac

SEQ ID NO: 2332353 - RNA, 21 nt, Yersinia pestis KIM
auuucacgcugguuaagcauu

SEQ ID NO: 2332354 - RNA, 19 nt, Yersinia pestis KIM
auuucacggauaucaacau

SEQ ID NO: 2332355 - RNA, 15 nt, Yersinia pestis KIM
auuuccauaucaacc

SEQ ID NO: 2332356 - RNA, 15 nt, Yersinia pestis KIM
auuucagucaauaaa

SEQ ID NO: 2332357 - RNA, 19 nt, Yersinia pestis KIM
auuucagucaauaaacauu

SEQ ID NO: 2332358 - RNA, 18 nt, Yersinia pestis KIM
auuuccaucuagcucaag

SEQ ID NO: 2332359 - RNA, 11 nt, Yersinia pestis KIM
auuucagggcg

SEQ ID NO: 2332360 - RNA, 22 nt, Yersinia pestis KIM
auuucagggcguauaaacagag

SEQ ID NO: 2332361 - RNA, 13 nt, Yersinia pestis KIM
auuucagcuuuua

SEQ ID NO: 2332362 - RNA, 16 nt, Yersinia pestis KIM
auuucuguuaccagaa

SEQ ID NO: 2332363 - RNA, 23 nt, Yersinia pestis KIM
auuucuguuaccagaaaaccuuc

SEQ ID NO: 2332364 - RNA, 22 nt, Yersinia pestis KIM
auuugaaacacuuauuugaaau

SEQ ID NO: 2332365 - RNA, 16 nt, Yersinia pestis KIM
auuugaacuucaaauc

SEQ ID NO: 2332366 - RNA, 19 nt, Yersinia pestis KIM
auuugaacgugcucucauu

SEQ ID NO: 2332367 - RNA, 13 nt, Yersinia pestis KIM
auuucuugauguc

SEQ ID NO: 2332368 - RNA, 16 nt, Yersinia pestis KIM
auuuucaugauccaca

SEQ ID NO: 2332369 - RNA, 18 nt, Yersinia pestis KIM
auuuuaucuguuguauac

SEQ ID NO: 2332370 - RNA, 19 nt, Yersinia pestis KIM
auuuuauauuaucucgauu

SEQ ID NO: 2332371 - RNA, 19 nt, Yersinia pestis KIM
auuuuagcggccucuagcu

SEQ ID NO: 2332372 - RNA, 16 nt, Yersinia pestis KIM
auuuuagcauuuucca

SEQ ID NO: 2332373 - RNA, 13 nt, Yersinia pestis KIM
auuuuagugauga

SEQ ID NO: 2332374 - RNA, 16 nt, Yersinia pestis KIM
auuuuacaggauuaaa

SEQ ID NO: 2332375 - RNA, 14 nt, Yersinia pestis KIM
auuuuaaguuaaug

SEQ ID NO: 2332376 - RNA, 22 nt, Yersinia pestis KIM
auuuuaaguuaauguuuauauu

SEQ ID NO: 2332377 - RNA, 15 nt, Yersinia pestis KIM
auuuuaaucucucca

SEQ ID NO: 2332378 - RNA, 11 nt, Yersinia pestis KIM
auuuuaaugaa

SEQ ID NO: 2332379 - RNA, 22 nt, Yersinia pestis KIM
auuuuacugccacugacugcuu

SEQ ID NO: 2332380 - RNA, 15 nt, Yersinia pestis KIM
auuuuaccuauuuau

SEQ ID NO: 2332381 - RNA, 17 nt, Yersinia pestis KIM
auuugauauuagccaag

SEQ ID NO: 2332382 - RNA, 15 nt, Yersinia pestis KIM
auuugaucaccaauc

SEQ ID NO: 2332383 - RNA, 19 nt, Yersinia pestis KIM
auuugauacagugauaaau

SEQ ID NO: 2332384 - RNA, 15 nt, Yersinia pestis KIM
auuugauaacacagu

SEQ ID NO: 2332385 - RNA, 17 nt, Yersinia pestis KIM
auuuuaacaacccauuu

SEQ ID NO: 2332386 - RNA, 15 nt, Yersinia pestis KIM
auuuuaagaaaacug

SEQ ID NO: 2332387 - RNA, 13 nt, Yersinia pestis KIM
auuuuaaaaaauc

SEQ ID NO: 2332388 - RNA, 12 nt, Yersinia pestis KIM
caaaaaauaagg

SEQ ID NO: 2332389 - RNA, 21 nt, Yersinia pestis KIM
caaaaaauagccguaggccac

SEQ ID NO: 2332390 - RNA, 11 nt, Yersinia pestis KIM
caaaaaauugg

SEQ ID NO: 2332391 - RNA, 21 nt, Yersinia pestis KIM
auuuuuuuuccuauaaaccaa

SEQ ID NO: 2332392 - RNA, 21 nt, Yersinia pestis KIM
auuuuuuaugucagagauaaa

SEQ ID NO: 2332393 - RNA, 20 nt, Yersinia pestis KIM
auuuuucuguucagauuuac

SEQ ID NO: 2332394 - RNA, 15 nt, Yersinia pestis KIM
auuuuucccugcuga

SEQ ID NO: 2332395 - RNA, 22 nt, Yersinia pestis KIM
auuuuucccugcugaucgccaa

SEQ ID NO: 2332396 - RNA, 14 nt, Yersinia pestis KIM
auuuuucgcaguaa

SEQ ID NO: 2332397 - RNA, 17 nt, Yersinia pestis KIM
auuuuuuaucuuguaaa

SEQ ID NO: 2332398 - RNA, 14 nt, Yersinia pestis KIM
auuuuuuauaaaca

SEQ ID NO: 2332399 - RNA, 13 nt, Yersinia pestis KIM
auuuuucuuucuc

SEQ ID NO: 2332400 - RNA, 15 nt, Yersinia pestis KIM
auuuucgaacaacau

SEQ ID NO: 2332401 - RNA, 19 nt, Yersinia pestis KIM
auuuucuauaccaauugau

SEQ ID NO: 2332402 - RNA, 13 nt, Yersinia pestis KIM
auuuucuauacca

SEQ ID NO: 2332403 - RNA, 14 nt, Yersinia pestis KIM
auuuucuauaccaa

SEQ ID NO: 2332404 - RNA, 16 nt, Yersinia pestis KIM
auuuucuaagcugccu

SEQ ID NO: 2332405 - RNA, 19 nt, Yersinia pestis KIM
auuuucggucauacacaug

SEQ ID NO: 2332406 - RNA, 20 nt, Yersinia pestis KIM
auuuuggccgcuuugguugc

SEQ ID NO: 2332407 - RNA, 19 nt, Yersinia pestis KIM
auuuugucaugaaaaucuu

SEQ ID NO: 2332408 - RNA, 17 nt, Yersinia pestis KIM
auuuugggugaacacag

SEQ ID NO: 2332409 - RNA, 15 nt, Yersinia pestis KIM
auuuuguuacccacu

SEQ ID NO: 2332410 - RNA, 18 nt, Yersinia pestis KIM
auuuuuaagucaauuuca

SEQ ID NO: 2332411 - RNA, 16 nt, Yersinia pestis KIM
auuuaaauaacagcua

SEQ ID NO: 2332412 - RNA, 12 nt, Yersinia pestis KIM
auuguugccaau

SEQ ID NO: 2332413 - RNA, 17 nt, Yersinia pestis KIM
auuguugcucaacauau

SEQ ID NO: 2332414 - RNA, 11 nt, Yersinia pestis KIM
auuuaaacucu

SEQ ID NO: 2332415 - RNA, 14 nt, Yersinia pestis KIM
auugugucaauacc

SEQ ID NO: 2332416 - RNA, 17 nt, Yersinia pestis KIM
auuguuaccuaaccaaa

SEQ ID NO: 2332417 - RNA, 16 nt, Yersinia pestis KIM
auuggcugauucaaca

SEQ ID NO: 2332418 - RNA, 13 nt, Yersinia pestis KIM
auuggcugcuugc

SEQ ID NO: 2332419 - RNA, 20 nt, Yersinia pestis KIM
auuggcucauaacacuuaau

SEQ ID NO: 2332420 - RNA, 22 nt, Yersinia pestis KIM
auugcuuaccacuggccuccca

SEQ ID NO: 2332421 - RNA, 18 nt, Yersinia pestis KIM
auugcuggcuaucauccc

SEQ ID NO: 2332422 - RNA, 19 nt, Yersinia pestis KIM
auugguucacugaaccaaa

SEQ ID NO: 2332423 - RNA, 14 nt, Yersinia pestis KIM
auugguuaauuggu

SEQ ID NO: 2332424 - RNA, 17 nt, Yersinia pestis KIM
auugguuacccuaagaa

SEQ ID NO: 2332425 - RNA, 17 nt, Yersinia pestis KIM
aaaagggcaagcguuaa

SEQ ID NO: 2332426 - RNA, 18 nt, Yersinia pestis KIM
aaaagggcacagcgagau

SEQ ID NO: 2332427 - RNA, 17 nt, Yersinia pestis KIM
auugguuuauaacaagg

SEQ ID NO: 2332428 - RNA, 22 nt, Yersinia pestis KIM
auugguuugacauacucuucca

SEQ ID NO: 2332429 - RNA, 14 nt, Yersinia pestis KIM
aaaagguaaacaga

SEQ ID NO: 2332430 - RNA, 19 nt, Yersinia pestis KIM
auuguccugcaauccuccc

SEQ ID NO: 2332431 - RNA, 21 nt, Yersinia pestis KIM
auucuuuuuguuaaaauagug

SEQ ID NO: 2332432 - RNA, 15 nt, Yersinia pestis KIM
auugaaaaaauaaug

SEQ ID NO: 2332433 - RNA, 17 nt, Yersinia pestis KIM
auugaugcuagcccaca

SEQ ID NO: 2332434 - RNA, 14 nt, Yersinia pestis KIM
auugcaaaacauag

SEQ ID NO: 2332435 - RNA, 23 nt, Yersinia pestis KIM
auugcacaugcagcauuucagga

SEQ ID NO: 2332436 - RNA, 15 nt, Yersinia pestis KIM
auugcacaauagcua

SEQ ID NO: 2332437 - RNA, 12 nt, Yersinia pestis KIM
auugcacaccca

SEQ ID NO: 2332438 - RNA, 20 nt, Yersinia pestis KIM
auugcacgguauagcuauca

SEQ ID NO: 2332439 - RNA, 14 nt, Yersinia pestis KIM
auugcaacgcuugc

SEQ ID NO: 2332440 - RNA, 22 nt, Yersinia pestis KIM
auugcauuuuacaggauuaaau

SEQ ID NO: 2332441 - RNA, 19 nt, Yersinia pestis KIM
auugcggccaguauccaga

SEQ ID NO: 2332442 - RNA, 16 nt, Yersinia pestis KIM
auugccuucuccuuuc

SEQ ID NO: 2332443 - RNA, 16 nt, Yersinia pestis KIM
auugccugauuuuuau

SEQ ID NO: 2332444 - RNA, 21 nt, Yersinia pestis KIM
auugccugauuuuuaucauca

SEQ ID NO: 2332445 - RNA, 19 nt, Yersinia pestis KIM
auugcguuauaucuauauu

SEQ ID NO: 2332446 - RNA, 18 nt, Yersinia pestis KIM
auugccggauuccaccug

SEQ ID NO: 2332447 - RNA, 22 nt, Yersinia pestis KIM
auugccgcgucuguuaucugcu

SEQ ID NO: 2332448 - RNA, 23 nt, Yersinia pestis KIM
auugccgcgucuguuaucugcua

SEQ ID NO: 2332449 - RNA, 22 nt, Yersinia pestis KIM
auugccaucuuguucuaauaau

SEQ ID NO: 2332450 - RNA, 14 nt, Yersinia pestis KIM
auugccauuuuaau

SEQ ID NO: 2332451 - RNA, 18 nt, Yersinia pestis KIM
auugccagaacaagacug

SEQ ID NO: 2332452 - RNA, 18 nt, Yersinia pestis KIM
auucugagggacagagag

SEQ ID NO: 2332453 - RNA, 20 nt, Yersinia pestis KIM
auucugagggacagagagau

SEQ ID NO: 2332454 - RNA, 14 nt, Yersinia pestis KIM
auucugauaccugc

SEQ ID NO: 2332455 - RNA, 22 nt, Yersinia pestis KIM
auucugacgggacaaucuguuc

SEQ ID NO: 2332456 - RNA, 22 nt, Yersinia pestis KIM
auucugacggcacucuauuuuc

SEQ ID NO: 2332457 - RNA, 23 nt, Yersinia pestis KIM
auucugauagugauuuuuuucac

SEQ ID NO: 2332458 - RNA, 22 nt, Yersinia pestis KIM
auucugauagugauuuuuuuca

SEQ ID NO: 2332459 - RNA, 18 nt, Yersinia pestis KIM
auucugauaccugcgcua

SEQ ID NO: 2332460 - RNA, 14 nt, Yersinia pestis KIM
auucugauagugau

SEQ ID NO: 2332461 - RNA, 19 nt, Yersinia pestis KIM
auucugauagugauuuuuu

SEQ ID NO: 2332462 - RNA, 21 nt, Yersinia pestis KIM
auucugccgacuaauauuuca

SEQ ID NO: 2332463 - RNA, 15 nt, Yersinia pestis KIM
auucugccuauccuc

SEQ ID NO: 2332464 - RNA, 16 nt, Yersinia pestis KIM
auucugccuauccuca

SEQ ID NO: 2332465 - RNA, 18 nt, Yersinia pestis KIM
auucugccuauccucacc

SEQ ID NO: 2332466 - RNA, 13 nt, Yersinia pestis KIM
auucugcaugcuu

SEQ ID NO: 2332467 - RNA, 21 nt, Yersinia pestis KIM
auucucuacucgcucaccacu

SEQ ID NO: 2332468 - RNA, 15 nt, Yersinia pestis KIM
auucucuucaccuuc

SEQ ID NO: 2332469 - RNA, 12 nt, Yersinia pestis KIM
auucucugucuu

SEQ ID NO: 2332470 - RNA, 20 nt, Yersinia pestis KIM
auucugaagacacacuuauu

SEQ ID NO: 2332471 - RNA, 22 nt, Yersinia pestis KIM
auucuggcggcuuuaauccauu

SEQ ID NO: 2332472 - RNA, 14 nt, Yersinia pestis KIM
auucuggcuuuuca

SEQ ID NO: 2332473 - RNA, 12 nt, Yersinia pestis KIM
auucuugaaauu

SEQ ID NO: 2332474 - RNA, 14 nt, Yersinia pestis KIM
auucuccuuucuuu

SEQ ID NO: 2332475 - RNA, 22 nt, Yersinia pestis KIM
auucucaaaggagacuucgcca

SEQ ID NO: 2332476 - RNA, 23 nt, Yersinia pestis KIM
auucucggcaugcuuccagauaa

SEQ ID NO: 2332477 - RNA, 18 nt, Yersinia pestis KIM
auucucgccccgugcuac

SEQ ID NO: 2332478 - RNA, 18 nt, Yersinia pestis KIM
auucuauccggauuaaau

SEQ ID NO: 2332479 - RNA, 14 nt, Yersinia pestis KIM
auucucaauauuaa

SEQ ID NO: 2332480 - RNA, 19 nt, Yersinia pestis KIM
auucucaauauuaauaaug

SEQ ID NO: 2332481 - RNA, 13 nt, Yersinia pestis KIM
auucucaaaauaa

SEQ ID NO: 2332482 - RNA, 17 nt, Yersinia pestis KIM
auucuauccggauuaaa

SEQ ID NO: 2332483 - RNA, 20 nt, Yersinia pestis KIM
auucgugcucaucaaccuca

SEQ ID NO: 2332484 - RNA, 18 nt, Yersinia pestis KIM
auucguuagcucuucacg

SEQ ID NO: 2332485 - RNA, 19 nt, Yersinia pestis KIM
auucgucugccauugcuca

SEQ ID NO: 2332486 - RNA, 13 nt, Yersinia pestis KIM
auucguagaaaca

SEQ ID NO: 2332487 - RNA, 15 nt, Yersinia pestis KIM
auucgcuuaugacaa

SEQ ID NO: 2332488 - RNA, 16 nt, Yersinia pestis KIM
auucgcgguuacacca

SEQ ID NO: 2332489 - RNA, 13 nt, Yersinia pestis KIM
auucgcgccccaa

SEQ ID NO: 2332490 - RNA, 23 nt, Yersinia pestis KIM
auucccugcgguuauuugcuauc

SEQ ID NO: 2332491 - RNA, 16 nt, Yersinia pestis KIM
auuccgucgauaucua

SEQ ID NO: 2332492 - RNA, 21 nt, Yersinia pestis KIM
auucccaccauaaugugccuc

SEQ ID NO: 2332493 - RNA, 20 nt, Yersinia pestis KIM
auucccaaagcgcagugcuc

SEQ ID NO: 2332494 - RNA, 12 nt, Yersinia pestis KIM
auuccuaagcaa

SEQ ID NO: 2332495 - RNA, 15 nt, Yersinia pestis KIM
auuccguuuaaacuc

SEQ ID NO: 2332496 - RNA, 19 nt, Yersinia pestis KIM
auuccaucagcgcacugca

SEQ ID NO: 2332497 - RNA, 17 nt, Yersinia pestis KIM
auucauaugacaaauaa

SEQ ID NO: 2332498 - RNA, 20 nt, Yersinia pestis KIM
aaaaggauuuuauuaaauca

SEQ ID NO: 2332499 - RNA, 18 nt, Yersinia pestis KIM
auucauauuucacuguua

SEQ ID NO: 2332500 - RNA, 22 nt, Yersinia pestis KIM
auucauauuucacuguuauauu

SEQ ID NO: 2332501 - RNA, 20 nt, Yersinia pestis KIM
auucauauugaauuaaauuu

SEQ ID NO: 2332502 - RNA, 14 nt, Yersinia pestis KIM
auucauaguuaaga

SEQ ID NO: 2332503 - RNA, 16 nt, Yersinia pestis KIM
auucauaguuaagaca

SEQ ID NO: 2332504 - RNA, 17 nt, Yersinia pestis KIM
auucauaucgcuaaaac

SEQ ID NO: 2332505 - RNA, 17 nt, Yersinia pestis KIM
aaaaggauggcccaagc

SEQ ID NO: 2332506 - RNA, 17 nt, Yersinia pestis KIM
auucaugaggcucagac

SEQ ID NO: 2332507 - RNA, 14 nt, Yersinia pestis KIM
auucaucagggcag

SEQ ID NO: 2332508 - RNA, 12 nt, Yersinia pestis KIM
auucaucaccag

SEQ ID NO: 2332509 - RNA, 16 nt, Yersinia pestis KIM
auucauuuuaaaaaaa

SEQ ID NO: 2332510 - RNA, 14 nt, Yersinia pestis KIM
auucauuuuaaaaa

SEQ ID NO: 2332511 - RNA, 13 nt, Yersinia pestis KIM
auucauuuuaaaa

SEQ ID NO: 2332512 - RNA, 15 nt, Yersinia pestis KIM
auucauuucuuuggc

SEQ ID NO: 2332513 - RNA, 21 nt, Yersinia pestis KIM
auucauuuugcuggaaaagua

SEQ ID NO: 2332514 - RNA, 16 nt, Yersinia pestis KIM
auucaugguuucaaaa

SEQ ID NO: 2332515 - RNA, 17 nt, Yersinia pestis KIM
auucaugguuucaaaau

SEQ ID NO: 2332516 - RNA, 17 nt, Yersinia pestis KIM
auucaugugagauaaca

SEQ ID NO: 2332517 - RNA, 19 nt, Yersinia pestis KIM
auucaugugagauaacaca

SEQ ID NO: 2332518 - RNA, 17 nt, Yersinia pestis KIM
auucauuauuacucagc

SEQ ID NO: 2332519 - RNA, 14 nt, Yersinia pestis KIM
auuacuuugaauag

SEQ ID NO: 2332520 - RNA, 15 nt, Yersinia pestis KIM
auuacuuugaauagc

SEQ ID NO: 2332521 - RNA, 17 nt, Yersinia pestis KIM
auuagaccggacauuaa

SEQ ID NO: 2332522 - RNA, 19 nt, Yersinia pestis KIM
auuagaauguguaguugaa

SEQ ID NO: 2332523 - RNA, 15 nt, Yersinia pestis KIM
auuacuucuuuuuaa

SEQ ID NO: 2332524 - RNA, 12 nt, Yersinia pestis KIM
auuacuuauaaa

SEQ ID NO: 2332525 - RNA, 15 nt, Yersinia pestis KIM
auuacuuuauuuaaa

SEQ ID NO: 2332526 - RNA, 18 nt, Yersinia pestis KIM
auuacuuuauuuaaaauu

SEQ ID NO: 2332527 - RNA, 18 nt, Yersinia pestis KIM
auuacuguucaucauauc

SEQ ID NO: 2332528 - RNA, 14 nt, Yersinia pestis KIM
aaaagcgaucagca

SEQ ID NO: 2332529 - RNA, 19 nt, Yersinia pestis KIM
aaaagccugaauucuguag

SEQ ID NO: 2332530 - RNA, 23 nt, Yersinia pestis KIM
aaaagcgccuuuuauucuuuggu

SEQ ID NO: 2332531 - RNA, 17 nt, Yersinia pestis KIM
auuagccagaaauagca

SEQ ID NO: 2332532 - RNA, 18 nt, Yersinia pestis KIM
auuagccccaaaugccag

SEQ ID NO: 2332533 - RNA, 17 nt, Yersinia pestis KIM
auuagccccaaaugcca

SEQ ID NO: 2332534 - RNA, 16 nt, Yersinia pestis KIM
auuagcagggcaguaa

SEQ ID NO: 2332535 - RNA, 13 nt, Yersinia pestis KIM
auuagcaguaacg

SEQ ID NO: 2332536 - RNA, 18 nt, Yersinia pestis KIM
auuagaugugaaauauca

SEQ ID NO: 2332537 - RNA, 19 nt, Yersinia pestis KIM
auuagaugagugguuuaua

SEQ ID NO: 2332538 - RNA, 19 nt, Yersinia pestis KIM
auuacucucuauugaucac

SEQ ID NO: 2332539 - RNA, 23 nt, Yersinia pestis KIM
auuacucuuauaaagauuuuaag

SEQ ID NO: 2332540 - RNA, 17 nt, Yersinia pestis KIM
auuacucguauaaaaaa

SEQ ID NO: 2332541 - RNA, 23 nt, Yersinia pestis KIM
auuacucacacagccagccuuaa

SEQ ID NO: 2332542 - RNA, 13 nt, Yersinia pestis KIM
auuacuccacacg

SEQ ID NO: 2332543 - RNA, 15 nt, Yersinia pestis KIM
auuacucaggaacaa

SEQ ID NO: 2332544 - RNA, 22 nt, Yersinia pestis KIM
auuacucaggaacaagacuuuc

SEQ ID NO: 2332545 - RNA, 19 nt, Yersinia pestis KIM
auuacguucuagcucugag

SEQ ID NO: 2332546 - RNA, 20 nt, Yersinia pestis KIM
auuacggccccagcccagca

SEQ ID NO: 2332547 - RNA, 13 nt, Yersinia pestis KIM
auuaccuuuaaaa

SEQ ID NO: 2332548 - RNA, 15 nt, Yersinia pestis KIM
auuacggucaccaau

SEQ ID NO: 2332549 - RNA, 18 nt, Yersinia pestis KIM
auuacguuaaacgcauac

SEQ ID NO: 2332550 - RNA, 20 nt, Yersinia pestis KIM
auuaccggcguuuuuacagu

SEQ ID NO: 2332551 - RNA, 23 nt, Yersinia pestis KIM
auuaccgucagggacaacaucau

SEQ ID NO: 2332552 - RNA, 17 nt, Yersinia pestis KIM
auuaccgucagggacaa

SEQ ID NO: 2332553 - RNA, 17 nt, Yersinia pestis KIM
auuaccugcauauccuc

SEQ ID NO: 2332554 - RNA, 22 nt, Yersinia pestis KIM
auuaccugccccacaaugaauu

SEQ ID NO: 2332555 - RNA, 15 nt, Yersinia pestis KIM
auuacaucaucuucu

SEQ ID NO: 2332556 - RNA, 18 nt, Yersinia pestis KIM
auuacaguucuuuaucca

SEQ ID NO: 2332557 - RNA, 18 nt, Yersinia pestis KIM
auuacaguugauauuauu

SEQ ID NO: 2332558 - RNA, 18 nt, Yersinia pestis KIM
auuacaggccccaaucca

SEQ ID NO: 2332559 - RNA, 17 nt, Yersinia pestis KIM
auuaauaucaaaacuga

SEQ ID NO: 2332560 - RNA, 22 nt, Yersinia pestis KIM
auuacccuguuuuaaaugccaa

SEQ ID NO: 2332561 - RNA, 17 nt, Yersinia pestis KIM
auuacccucauuuuacc

SEQ ID NO: 2332562 - RNA, 21 nt, Yersinia pestis KIM
auuaauaguguuguaagauuu

SEQ ID NO: 2332563 - RNA, 16 nt, Yersinia pestis KIM
auuaauaucaaaacug

SEQ ID NO: 2332564 - RNA, 22 nt, Yersinia pestis KIM
auuauuuuuggucguuuaaaua

SEQ ID NO: 2332565 - RNA, 23 nt, Yersinia pestis KIM
auucaaaauguauuauuuuguac

SEQ ID NO: 2332566 - RNA, 15 nt, Yersinia pestis KIM
auucaaaauagggaa

SEQ ID NO: 2332567 - RNA, 21 nt, Yersinia pestis KIM
auucaaaaauuucguuaagau

SEQ ID NO: 2332568 - RNA, 18 nt, Yersinia pestis KIM
auucaaacacuuaugauc

SEQ ID NO: 2332569 - RNA, 20 nt, Yersinia pestis KIM
auucaacuugccugaaauug

SEQ ID NO: 2332570 - RNA, 15 nt, Yersinia pestis KIM
auucaagaaaaugau

SEQ ID NO: 2332571 - RNA, 24 nt, Yersinia pestis KIM
auucaacgugacucacuacauucu

SEQ ID NO: 2332572 - RNA, 14 nt, Yersinia pestis KIM
auucaaguugcaga

SEQ ID NO: 2332573 - RNA, 21 nt, Yersinia pestis KIM
auuauuuaaacaaugaaauug

SEQ ID NO: 2332574 - RNA, 14 nt, Yersinia pestis KIM
auuauuuaaacaau

SEQ ID NO: 2332575 - RNA, 22 nt, Yersinia pestis KIM
auuauuggcuucugcuucuugu

SEQ ID NO: 2332576 - RNA, 14 nt, Yersinia pestis KIM
auuauuggcagcaa

SEQ ID NO: 2332577 - RNA, 16 nt, Yersinia pestis KIM
auuauuucucugauga

SEQ ID NO: 2332578 - RNA, 11 nt, Yersinia pestis KIM
auuauuuuuca

SEQ ID NO: 2332579 - RNA, 22 nt, Yersinia pestis KIM
auuauuuuguuuguaaauuuua

SEQ ID NO: 2332580 - RNA, 23 nt, Yersinia pestis KIM
auuauuuuggguauauaguuuau

SEQ ID NO: 2332581 - RNA, 19 nt, Yersinia pestis KIM
auuauuuuccagaugaaua

SEQ ID NO: 2332582 - RNA, 12 nt, Yersinia pestis KIM
auuauuuuaugg

SEQ ID NO: 2332583 - RNA, 18 nt, Yersinia pestis KIM
auuauuuucaaccaguua

SEQ ID NO: 2332584 - RNA, 17 nt, Yersinia pestis KIM
auuauggauaauuuaau

SEQ ID NO: 2332585 - RNA, 15 nt, Yersinia pestis KIM
auuauuaaacugauu

SEQ ID NO: 2332586 - RNA, 18 nt, Yersinia pestis KIM
auuauuaaacugauuuaa

SEQ ID NO: 2332587 - RNA, 22 nt, Yersinia pestis KIM
auuagugagcgguugaaaaguu

SEQ ID NO: 2332588 - RNA, 15 nt, Yersinia pestis KIM
auuagugacagccac

SEQ ID NO: 2332589 - RNA, 23 nt, Yersinia pestis KIM
auuauauaagagaugaaauuuua

SEQ ID NO: 2332590 - RNA, 13 nt, Yersinia pestis KIM
auuauauagauuu

SEQ ID NO: 2332591 - RNA, 14 nt, Yersinia pestis KIM
auuaucgaucacau

SEQ ID NO: 2332592 - RNA, 17 nt, Yersinia pestis KIM
auguuugugugucuuua

SEQ ID NO: 2332593 - RNA, 17 nt, Yersinia pestis KIM
auguuuguugauguaag

SEQ ID NO: 2332594 - RNA, 14 nt, Yersinia pestis KIM
auguucgaacaugc

SEQ ID NO: 2332595 - RNA, 17 nt, Yersinia pestis KIM
auguugaaucaauugcu

SEQ ID NO: 2332596 - RNA, 16 nt, Yersinia pestis KIM
auguucuuccugugcg

SEQ ID NO: 2332597 - RNA, 17 nt, Yersinia pestis KIM
auuaaaacugaaaaguu

SEQ ID NO: 2332598 - RNA, 22 nt, Yersinia pestis KIM
auuaacgcucuacaacguccag

SEQ ID NO: 2332599 - RNA, 13 nt, Yersinia pestis KIM
auuaacgacauuu

SEQ ID NO: 2332600 - RNA, 19 nt, Yersinia pestis KIM
auuaacgacauuucguuua

SEQ ID NO: 2332601 - RNA, 19 nt, Yersinia pestis KIM
auuaaaugguuuauuuaag

SEQ ID NO: 2332602 - RNA, 14 nt, Yersinia pestis KIM
auuaaaugguuuau

SEQ ID NO: 2332603 - RNA, 18 nt, Yersinia pestis KIM
auuaaccgcuccaggcug

SEQ ID NO: 2332604 - RNA, 23 nt, Yersinia pestis KIM
auuaaccgcuccaggcuggccac

SEQ ID NO: 2332605 - RNA, 14 nt, Yersinia pestis KIM
auuaaccuaaaaac

SEQ ID NO: 2332606 - RNA, 19 nt, Yersinia pestis KIM
auuaaccuuaauuugcuuu

SEQ ID NO: 2332607 - RNA, 17 nt, Yersinia pestis KIM
auuaaccuuaucaccaa

SEQ ID NO: 2332608 - RNA, 15 nt, Yersinia pestis KIM
auuaacuucaauuug

SEQ ID NO: 2332609 - RNA, 18 nt, Yersinia pestis KIM
auuaacuucuauuuuucg

SEQ ID NO: 2332610 - RNA, 23 nt, Yersinia pestis KIM
auuaacuuuucuucauugcugcu

SEQ ID NO: 2332611 - RNA, 22 nt, Yersinia pestis KIM
auuaacucuucuguugcccccu

SEQ ID NO: 2332612 - RNA, 17 nt, Yersinia pestis KIM
auuaauacaucaucaaa

SEQ ID NO: 2332613 - RNA, 14 nt, Yersinia pestis KIM
auuaauacaucauc

SEQ ID NO: 2332614 - RNA, 13 nt, Yersinia pestis KIM
auuaauacaucau

SEQ ID NO: 2332615 - RNA, 15 nt, Yersinia pestis KIM
auuaagauuaagcca

SEQ ID NO: 2332616 - RNA, 22 nt, Yersinia pestis KIM
auuaagccaugggucauuaauu

SEQ ID NO: 2332617 - RNA, 21 nt, Yersinia pestis KIM
auuaagauaauagcuaaacau

SEQ ID NO: 2332618 - RNA, 17 nt, Yersinia pestis KIM
auuaagacccucucaca

SEQ ID NO: 2332619 - RNA, 22 nt, Yersinia pestis KIM
augucgaaagauagcaaaagaa

SEQ ID NO: 2332620 - RNA, 21 nt, Yersinia pestis KIM
auguacauuauucaugaugcc

SEQ ID NO: 2332621 - RNA, 17 nt, Yersinia pestis KIM
augugauaagucgucug

SEQ ID NO: 2332622 - RNA, 14 nt, Yersinia pestis KIM
augugacugauuaa

SEQ ID NO: 2332623 - RNA, 14 nt, Yersinia pestis KIM
augugauguggcuu

SEQ ID NO: 2332624 - RNA, 23 nt, Yersinia pestis KIM
augugauguggcuugcaaucaga

SEQ ID NO: 2332625 - RNA, 13 nt, Yersinia pestis KIM
augugaaaagcag

SEQ ID NO: 2332626 - RNA, 21 nt, Yersinia pestis KIM
augucuuuacuaaauuagaaa

SEQ ID NO: 2332627 - RNA, 20 nt, Yersinia pestis KIM
augucucuggcgcgaaaugc

SEQ ID NO: 2332628 - RNA, 22 nt, Yersinia pestis KIM
auguggauaauuucagcagcac

SEQ ID NO: 2332629 - RNA, 22 nt, Yersinia pestis KIM
auguguaguaugcgauuuuuga

SEQ ID NO: 2332630 - RNA, 17 nt, Yersinia pestis KIM
auguuaacucagccaca

SEQ ID NO: 2332631 - RNA, 23 nt, Yersinia pestis KIM
auguuccggacuucauaaauauu

SEQ ID NO: 2332632 - RNA, 19 nt, Yersinia pestis KIM
auguucccccuucagccuu

SEQ ID NO: 2332633 - RNA, 16 nt, Yersinia pestis KIM
auguuaucgccaacac

SEQ ID NO: 2332634 - RNA, 16 nt, Yersinia pestis KIM
auguuauggauuuuua

SEQ ID NO: 2332635 - RNA, 18 nt, Yersinia pestis KIM
auguuaugaggggaggcu

SEQ ID NO: 2332636 - RNA, 14 nt, Yersinia pestis KIM
auguuauuaaugau

SEQ ID NO: 2332637 - RNA, 15 nt, Yersinia pestis KIM
augcgcggguaacaa

SEQ ID NO: 2332638 - RNA, 17 nt, Yersinia pestis KIM
augcucgcucaucauaa

SEQ ID NO: 2332639 - RNA, 14 nt, Yersinia pestis KIM
augcugcacaucaa

SEQ ID NO: 2332640 - RNA, 14 nt, Yersinia pestis KIM
augcugcccgcaca

SEQ ID NO: 2332641 - RNA, 18 nt, Yersinia pestis KIM
augcugcccgcacacuga

SEQ ID NO: 2332642 - RNA, 16 nt, Yersinia pestis KIM
augcucugcugggaua

SEQ ID NO: 2332643 - RNA, 12 nt, Yersinia pestis KIM
augcugugccau

SEQ ID NO: 2332644 - RNA, 21 nt, Yersinia pestis KIM
augcuguuguagcgccaggua

SEQ ID NO: 2332645 - RNA, 11 nt, Yersinia pestis KIM
augcuuauaaa

SEQ ID NO: 2332646 - RNA, 22 nt, Yersinia pestis KIM
auggacgaacagugccaacagc

SEQ ID NO: 2332647 - RNA, 23 nt, Yersinia pestis KIM
auggacuacacagacuggugaac

SEQ ID NO: 2332648 - RNA, 22 nt, Yersinia pestis KIM
auggacgccgcuacaagcaugu

SEQ ID NO: 2332649 - RNA, 13 nt, Yersinia pestis KIM
auggagaggcgcu

SEQ ID NO: 2332650 - RNA, 14 nt, Yersinia pestis KIM
auggagaggcgcua

SEQ ID NO: 2332651 - RNA, 19 nt, Yersinia pestis KIM
auggcacuggaaacaaaac

SEQ ID NO: 2332652 - RNA, 17 nt, Yersinia pestis KIM
auggcagagcuuuucuc

SEQ ID NO: 2332653 - RNA, 18 nt, Yersinia pestis KIM
auggcacgcuuaaucuuu

SEQ ID NO: 2332654 - RNA, 20 nt, Yersinia pestis KIM
auggcaccgugggcaaagaa

SEQ ID NO: 2332655 - RNA, 19 nt, Yersinia pestis KIM
auggaguuguugccacaga

SEQ ID NO: 2332656 - RNA, 13 nt, Yersinia pestis KIM
auggaaguuaaaa

SEQ ID NO: 2332657 - RNA, 13 nt, Yersinia pestis KIM
auggaagaccaga

SEQ ID NO: 2332658 - RNA, 12 nt, Yersinia pestis KIM
auggaacuguaa

SEQ ID NO: 2332659 - RNA, 13 nt, Yersinia pestis KIM
auggaacuguaaa

SEQ ID NO: 2332660 - RNA, 21 nt, Yersinia pestis KIM
auggaauccccauggcuuuca

SEQ ID NO: 2332661 - RNA, 19 nt, Yersinia pestis KIM
auggaaauacgcuuaccug

SEQ ID NO: 2332662 - RNA, 21 nt, Yersinia pestis KIM
auggaaaccggcaauagccau

SEQ ID NO: 2332663 - RNA, 23 nt, Yersinia pestis KIM
auggaacggacauuuuacucccu

SEQ ID NO: 2332664 - RNA, 16 nt, Yersinia pestis KIM
auggaaaaaauacagg

SEQ ID NO: 2332665 - RNA, 22 nt, Yersinia pestis KIM
augcuuuucuuucccgccggca

SEQ ID NO: 2332666 - RNA, 13 nt, Yersinia pestis KIM
auggugcuauuuc

SEQ ID NO: 2332667 - RNA, 14 nt, Yersinia pestis KIM
auggugcuauuucu

SEQ ID NO: 2332668 - RNA, 19 nt, Yersinia pestis KIM
auggugggucgugcgggau

SEQ ID NO: 2332669 - RNA, 18 nt, Yersinia pestis KIM
auggugggucgugcggga

SEQ ID NO: 2332670 - RNA, 18 nt, Yersinia pestis KIM
auggugggccgugcggga

SEQ ID NO: 2332671 - RNA, 19 nt, Yersinia pestis KIM
auggugggccgugcgggau

SEQ ID NO: 2332672 - RNA, 16 nt, Yersinia pestis KIM
augguguuaucuucac

SEQ ID NO: 2332673 - RNA, 16 nt, Yersinia pestis KIM
auggugucuuuacugg

SEQ ID NO: 2332674 - RNA, 17 nt, Yersinia pestis KIM
augguguaaaugcccgu

SEQ ID NO: 2332675 - RNA, 19 nt, Yersinia pestis KIM
auggugagcucaucuuauu

SEQ ID NO: 2332676 - RNA, 18 nt, Yersinia pestis KIM
augguaagaauaaauaau

SEQ ID NO: 2332677 - RNA, 16 nt, Yersinia pestis KIM
augguauagacuguuu

SEQ ID NO: 2332678 - RNA, 13 nt, Yersinia pestis KIM
augguaucagaaa

SEQ ID NO: 2332679 - RNA, 19 nt, Yersinia pestis KIM
augguuaaucuacccgaau

SEQ ID NO: 2332680 - RNA, 22 nt, Yersinia pestis KIM
auggcagcccuuauucaaagaa

SEQ ID NO: 2332681 - RNA, 17 nt, Yersinia pestis KIM
auggcagcccuuauuca

SEQ ID NO: 2332682 - RNA, 18 nt, Yersinia pestis KIM
auggcccaagccauccuu

SEQ ID NO: 2332683 - RNA, 15 nt, Yersinia pestis KIM
auggccgccagcacg

SEQ ID NO: 2332684 - RNA, 16 nt, Yersinia pestis KIM
auggccgauggaacca

SEQ ID NO: 2332685 - RNA, 14 nt, Yersinia pestis KIM
auggccggacucau

SEQ ID NO: 2332686 - RNA, 21 nt, Yersinia pestis KIM
auggccucguauuacccucau

SEQ ID NO: 2332687 - RNA, 14 nt, Yersinia pestis KIM
auggcuaaaucauc

SEQ ID NO: 2332688 - RNA, 21 nt, Yersinia pestis KIM
auggcuacguagcucagcugg

SEQ ID NO: 2332689 - RNA, 14 nt, Yersinia pestis KIM
auggcucagauuga

SEQ ID NO: 2332690 - RNA, 17 nt, Yersinia pestis KIM
auggcuggcaaggcacg

SEQ ID NO: 2332691 - RNA, 20 nt, Yersinia pestis KIM
augggcgccgcuuuaccugu

SEQ ID NO: 2332692 - RNA, 15 nt, Yersinia pestis KIM
auggcugucuauuga

SEQ ID NO: 2332693 - RNA, 17 nt, Yersinia pestis KIM
auggcugccaucaggau

SEQ ID NO: 2332694 - RNA, 16 nt, Yersinia pestis KIM
auggcugaaauaacuu

SEQ ID NO: 2332695 - RNA, 22 nt, Yersinia pestis KIM
augggcugcacuuuuacgggcc

SEQ ID NO: 2332696 - RNA, 22 nt, Yersinia pestis KIM
auggggaucugcauaccuggau

SEQ ID NO: 2332697 - RNA, 15 nt, Yersinia pestis KIM
auggggagcuugccu

SEQ ID NO: 2332698 - RNA, 15 nt, Yersinia pestis KIM
auggggacucuuuau

SEQ ID NO: 2332699 - RNA, 14 nt, Yersinia pestis KIM
augaugaguaacau

SEQ ID NO: 2332700 - RNA, 17 nt, Yersinia pestis KIM
augaugaaaauugcagg

SEQ ID NO: 2332701 - RNA, 17 nt, Yersinia pestis KIM
augaugauaucaccuuu

SEQ ID NO: 2332702 - RNA, 18 nt, Yersinia pestis KIM
augaugcggaagaaggcu

SEQ ID NO: 2332703 - RNA, 15 nt, Yersinia pestis KIM
augaugccgaucauc

SEQ ID NO: 2332704 - RNA, 19 nt, Yersinia pestis KIM
augaugcccgcuuucugau

SEQ ID NO: 2332705 - RNA, 19 nt, Yersinia pestis KIM
augagcagcccagucucuu

SEQ ID NO: 2332706 - RNA, 20 nt, Yersinia pestis KIM
augagcacgaauuuugagga

SEQ ID NO: 2332707 - RNA, 16 nt, Yersinia pestis KIM
augauuaaacgccugg

SEQ ID NO: 2332708 - RNA, 18 nt, Yersinia pestis KIM
augauuaacggauacccu

SEQ ID NO: 2332709 - RNA, 17 nt, Yersinia pestis KIM
augauuacaucacuuuu

SEQ ID NO: 2332710 - RNA, 14 nt, Yersinia pestis KIM
augauuauuuugug

SEQ ID NO: 2332711 - RNA, 13 nt, Yersinia pestis KIM
augauuucucgcu

SEQ ID NO: 2332712 - RNA, 22 nt, Yersinia pestis KIM
augauucguagaaacaucgcca

SEQ ID NO: 2332713 - RNA, 13 nt, Yersinia pestis KIM
augauucucuauu

SEQ ID NO: 2332714 - RNA, 15 nt, Yersinia pestis KIM
augauucucuauucu

SEQ ID NO: 2332715 - RNA, 14 nt, Yersinia pestis KIM
augauugaaaaaca

SEQ ID NO: 2332716 - RNA, 15 nt, Yersinia pestis KIM
augauucauugaguu

SEQ ID NO: 2332717 - RNA, 16 nt, Yersinia pestis KIM
augauuggagcaaaug

SEQ ID NO: 2332718 - RNA, 13 nt, Yersinia pestis KIM
augauugauuauc

SEQ ID NO: 2332719 - RNA, 15 nt, Yersinia pestis KIM
augcaaucuaacuaa

SEQ ID NO: 2332720 - RNA, 13 nt, Yersinia pestis KIM
augcaauuuugga

SEQ ID NO: 2332721 - RNA, 17 nt, Yersinia pestis KIM
augcaacuuggcaccua

SEQ ID NO: 2332722 - RNA, 23 nt, Yersinia pestis KIM
augcaaauaauaacgccugcaau

SEQ ID NO: 2332723 - RNA, 13 nt, Yersinia pestis KIM
augauuuuuuuca

SEQ ID NO: 2332724 - RNA, 14 nt, Yersinia pestis KIM
augauuuuuuucau

SEQ ID NO: 2332725 - RNA, 21 nt, Yersinia pestis KIM
augccuauuugcagaaaguaa

SEQ ID NO: 2332726 - RNA, 22 nt, Yersinia pestis KIM
augccgccugacugcccgccug

SEQ ID NO: 2332727 - RNA, 17 nt, Yersinia pestis KIM
augccgcuaacaaccgu

SEQ ID NO: 2332728 - RNA, 20 nt, Yersinia pestis KIM
augccugcgaauuaucaucc

SEQ ID NO: 2332729 - RNA, 20 nt, Yersinia pestis KIM
augccuguuauaaggcuaac

SEQ ID NO: 2332730 - RNA, 17 nt, Yersinia pestis KIM
augccuuggcaaagaga

SEQ ID NO: 2332731 - RNA, 18 nt, Yersinia pestis KIM
augccuuggcaaagagac

SEQ ID NO: 2332732 - RNA, 21 nt, Yersinia pestis KIM
augccuuggcauguucagggu

SEQ ID NO: 2332733 - RNA, 15 nt, Yersinia pestis KIM
augccuuguuucugg

SEQ ID NO: 2332734 - RNA, 14 nt, Yersinia pestis KIM
augcgaauacuuug

SEQ ID NO: 2332735 - RNA, 16 nt, Yersinia pestis KIM
augcgcgaauagcugg

SEQ ID NO: 2332736 - RNA, 15 nt, Yersinia pestis KIM
augccauagcugcug

SEQ ID NO: 2332737 - RNA, 14 nt, Yersinia pestis KIM
augccaucaagcac

SEQ ID NO: 2332738 - RNA, 14 nt, Yersinia pestis KIM
augccaucccccuu

SEQ ID NO: 2332739 - RNA, 20 nt, Yersinia pestis KIM
augccauggcgaaaauccuu

SEQ ID NO: 2332740 - RNA, 21 nt, Yersinia pestis KIM
augccauuaucuuuaauuuuc

SEQ ID NO: 2332741 - RNA, 17 nt, Yersinia pestis KIM
augcacaguaggcugaa

SEQ ID NO: 2332742 - RNA, 19 nt, Yersinia pestis KIM
augcacaguugucugaggc

SEQ ID NO: 2332743 - RNA, 17 nt, Yersinia pestis KIM
augcaccgacaaagaua

SEQ ID NO: 2332744 - RNA, 17 nt, Yersinia pestis KIM
augcaccaaauucagaa

SEQ ID NO: 2332745 - RNA, 14 nt, Yersinia pestis KIM
augcagagaugcag

SEQ ID NO: 2332746 - RNA, 17 nt, Yersinia pestis KIM
augcagauaaccgugcg

SEQ ID NO: 2332747 - RNA, 22 nt, Yersinia pestis KIM
augcagcguauucaguaaaaac

SEQ ID NO: 2332748 - RNA, 15 nt, Yersinia pestis KIM
augcagcgauuaagg

SEQ ID NO: 2332749 - RNA, 16 nt, Yersinia pestis KIM
augcagcauuucagga

SEQ ID NO: 2332750 - RNA, 22 nt, Yersinia pestis KIM
augccaauugacgccacuuauc

SEQ ID NO: 2332751 - RNA, 14 nt, Yersinia pestis KIM
augccacacucaga

SEQ ID NO: 2332752 - RNA, 21 nt, Yersinia pestis KIM
augccacacucagacaaucau

SEQ ID NO: 2332753 - RNA, 14 nt, Yersinia pestis KIM
cacagauaaauaaa

SEQ ID NO: 2332754 - RNA, 19 nt, Yersinia pestis KIM
cacagaaacgauuacccac

SEQ ID NO: 2332755 - RNA, 15 nt, Yersinia pestis KIM
cacagcauucugcuu

SEQ ID NO: 2332756 - RNA, 17 nt, Yersinia pestis KIM
cacagcagaacaaaaca

SEQ ID NO: 2332757 - RNA, 14 nt, Yersinia pestis KIM
cacagcagacagcg

SEQ ID NO: 2332758 - RNA, 20 nt, Yersinia pestis KIM
cacagcaaaccucuggcgca

SEQ ID NO: 2332759 - RNA, 14 nt, Yersinia pestis KIM
cacagaugcuggcu

SEQ ID NO: 2332760 - RNA, 18 nt, Yersinia pestis KIM
cacagcaaguauuaccaa

SEQ ID NO: 2332761 - RNA, 23 nt, Yersinia pestis KIM
cacacgacugaguuccaaaaugc

SEQ ID NO: 2332762 - RNA, 14 nt, Yersinia pestis KIM
cacaccaacacuga

SEQ ID NO: 2332763 - RNA, 23 nt, Yersinia pestis KIM
cacaaucgcgcuguacaacaaga

SEQ ID NO: 2332764 - RNA, 18 nt, Yersinia pestis KIM
cacacagaaucaccaaca

SEQ ID NO: 2332765 - RNA, 13 nt, Yersinia pestis KIM
cacacagaaucac

SEQ ID NO: 2332766 - RNA, 15 nt, Yersinia pestis KIM
cacacaguauucugc

SEQ ID NO: 2332767 - RNA, 13 nt, Yersinia pestis KIM
caauuuggccaau

SEQ ID NO: 2332768 - RNA, 15 nt, Yersinia pestis KIM
caauuugcccaucuu

SEQ ID NO: 2332769 - RNA, 16 nt, Yersinia pestis KIM
cacaacccgcugaugc

SEQ ID NO: 2332770 - RNA, 13 nt, Yersinia pestis KIM
cacaaccccaccu

SEQ ID NO: 2332771 - RNA, 16 nt, Yersinia pestis KIM
cacaacgcauuacccc

SEQ ID NO: 2332772 - RNA, 17 nt, Yersinia pestis KIM
cacaacugaaugucucu

SEQ ID NO: 2332773 - RNA, 18 nt, Yersinia pestis KIM
cacaauccaggcgaccca

SEQ ID NO: 2332774 - RNA, 15 nt, Yersinia pestis KIM
cacaaucaguaaaua

SEQ ID NO: 2332775 - RNA, 15 nt, Yersinia pestis KIM
cacaauaauuaggaa

SEQ ID NO: 2332776 - RNA, 17 nt, Yersinia pestis KIM
cacaauaauuaggaaua

SEQ ID NO: 2332777 - RNA, 13 nt, Yersinia pestis KIM
cacaagauaaaua

SEQ ID NO: 2332778 - RNA, 14 nt, Yersinia pestis KIM
caauuuccccugcu

SEQ ID NO: 2332779 - RNA, 20 nt, Yersinia pestis KIM
caauuuccccugcuucguag

SEQ ID NO: 2332780 - RNA, 15 nt, Yersinia pestis KIM
caauuucagcuuuua

SEQ ID NO: 2332781 - RNA, 20 nt, Yersinia pestis KIM
caauuucaccccgacauuca

SEQ ID NO: 2332782 - RNA, 10 nt, Yersinia pestis KIM
caauuucagc

SEQ ID NO: 2332783 - RNA, 22 nt, Yersinia pestis KIM
caauuucgaaaacucaaagauu

SEQ ID NO: 2332784 - RNA, 17 nt, Yersinia pestis KIM
caauugcccccuaguga

SEQ ID NO: 2332785 - RNA, 21 nt, Yersinia pestis KIM
caauucuugaaauuauauucu

SEQ ID NO: 2332786 - RNA, 16 nt, Yersinia pestis KIM
caauugccugauuuuu

SEQ ID NO: 2332787 - RNA, 13 nt, Yersinia pestis KIM
caauugccgucgu

SEQ ID NO: 2332788 - RNA, 22 nt, Yersinia pestis KIM
caauugccgucguauagaaaau

SEQ ID NO: 2332789 - RNA, 12 nt, Yersinia pestis KIM
caauugcuggcu

SEQ ID NO: 2332790 - RNA, 16 nt, Yersinia pestis KIM
caauuggucaugauga

SEQ ID NO: 2332791 - RNA, 17 nt, Yersinia pestis KIM
caauuggucaugaugaa

SEQ ID NO: 2332792 - RNA, 13 nt, Yersinia pestis KIM
caauuguauaagg

SEQ ID NO: 2332793 - RNA, 21 nt, Yersinia pestis KIM
caauucguuuuucauuuuucu

SEQ ID NO: 2332794 - RNA, 22 nt, Yersinia pestis KIM
caauucccaaagcgcagugcuc

SEQ ID NO: 2332795 - RNA, 19 nt, Yersinia pestis KIM
caauguuaaacuuugcuau

SEQ ID NO: 2332796 - RNA, 18 nt, Yersinia pestis KIM
caaugugccgcgcaacca

SEQ ID NO: 2332797 - RNA, 22 nt, Yersinia pestis KIM
caauguguugaauauccaaugg

SEQ ID NO: 2332798 - RNA, 22 nt, Yersinia pestis KIM
caaugucuggccguaacuccag

SEQ ID NO: 2332799 - RNA, 14 nt, Yersinia pestis KIM
caauggcgggggcg

SEQ ID NO: 2332800 - RNA, 19 nt, Yersinia pestis KIM
caauggcugcauuggccga

SEQ ID NO: 2332801 - RNA, 22 nt, Yersinia pestis KIM
caauggcuaauuagaugagugg

SEQ ID NO: 2332802 - RNA, 21 nt, Yersinia pestis KIM
caauggccggacucauuaucc

SEQ ID NO: 2332803 - RNA, 17 nt, Yersinia pestis KIM
caauggccuuagcacgu

SEQ ID NO: 2332804 - RNA, 18 nt, Yersinia pestis KIM
caauggauuugugcaaau

SEQ ID NO: 2332805 - RNA, 15 nt, Yersinia pestis KIM
caauggcaaaacaga

SEQ ID NO: 2332806 - RNA, 16 nt, Yersinia pestis KIM
caaugucaugcaauua

SEQ ID NO: 2332807 - RNA, 13 nt, Yersinia pestis KIM
caaugucaccuga

SEQ ID NO: 2332808 - RNA, 18 nt, Yersinia pestis KIM
caaugucaccugaaccug

SEQ ID NO: 2332809 - RNA, 23 nt, Yersinia pestis KIM
caauguaaaacgaguaaauacaa

SEQ ID NO: 2332810 - RNA, 18 nt, Yersinia pestis KIM
caaucuguuccugauucc

SEQ ID NO: 2332811 - RNA, 21 nt, Yersinia pestis KIM
caaugacuccugaaauaaaga

SEQ ID NO: 2332812 - RNA, 14 nt, Yersinia pestis KIM
caaugacugugcgc

SEQ ID NO: 2332813 - RNA, 19 nt, Yersinia pestis KIM
caaugacuuaacugaaagc

SEQ ID NO: 2332814 - RNA, 13 nt, Yersinia pestis KIM
caaugacuuaacu

SEQ ID NO: 2332815 - RNA, 13 nt, Yersinia pestis KIM
caaugcuuauuuc

SEQ ID NO: 2332816 - RNA, 15 nt, Yersinia pestis KIM
caauggaauguucau

SEQ ID NO: 2332817 - RNA, 22 nt, Yersinia pestis KIM
caccagacucugcuaccaggaa

SEQ ID NO: 2332818 - RNA, 21 nt, Yersinia pestis KIM
caccacuacacgcuuuacugu

SEQ ID NO: 2332819 - RNA, 22 nt, Yersinia pestis KIM
caccacgaaaaaauggcagccc

SEQ ID NO: 2332820 - RNA, 13 nt, Yersinia pestis KIM
caccaccacaccg

SEQ ID NO: 2332821 - RNA, 12 nt, Yersinia pestis KIM
caccaccacacc

SEQ ID NO: 2332822 - RNA, 16 nt, Yersinia pestis KIM
aaaauaaacaucaaug

SEQ ID NO: 2332823 - RNA, 12 nt, Yersinia pestis KIM
aaaauaaaaauu

SEQ ID NO: 2332824 - RNA, 15 nt, Yersinia pestis KIM
caccaguaaacgcca

SEQ ID NO: 2332825 - RNA, 20 nt, Yersinia pestis KIM
caccagcaggugauacauca

SEQ ID NO: 2332826 - RNA, 21 nt, Yersinia pestis KIM
aaaagugcuauccucuuaaug

SEQ ID NO: 2332827 - RNA, 19 nt, Yersinia pestis KIM
caccacaaaggcaaaauga

SEQ ID NO: 2332828 - RNA, 22 nt, Yersinia pestis KIM
caccacaccggcugcaauaagc

SEQ ID NO: 2332829 - RNA, 17 nt, Yersinia pestis KIM
caccacacugagcaccg

SEQ ID NO: 2332830 - RNA, 13 nt, Yersinia pestis KIM
caccacaucaucc

SEQ ID NO: 2332831 - RNA, 14 nt, Yersinia pestis KIM
caccaccaacagca

SEQ ID NO: 2332832 - RNA, 18 nt, Yersinia pestis KIM
caccaacagcauuaccaa

SEQ ID NO: 2332833 - RNA, 14 nt, Yersinia pestis KIM
caccaacagcauua

SEQ ID NO: 2332834 - RNA, 13 nt, Yersinia pestis KIM
caccaaaucuucc

SEQ ID NO: 2332835 - RNA, 15 nt, Yersinia pestis KIM
caccaaaucuuccag

SEQ ID NO: 2332836 - RNA, 17 nt, Yersinia pestis KIM
caccaaaucuuccagcg

SEQ ID NO: 2332837 - RNA, 19 nt, Yersinia pestis KIM
cacauuaacacauuaauuu

SEQ ID NO: 2332838 - RNA, 17 nt, Yersinia pestis KIM
cacauuaauuuaucugc

SEQ ID NO: 2332839 - RNA, 17 nt, Yersinia pestis KIM
cacauucaaacacuuau

SEQ ID NO: 2332840 - RNA, 22 nt, Yersinia pestis KIM
cacaucgcgcuuuuuaggaugu

SEQ ID NO: 2332841 - RNA, 15 nt, Yersinia pestis KIM
cacauuuugugugag

SEQ ID NO: 2332842 - RNA, 16 nt, Yersinia pestis KIM
cacauuccaguaaaaa

SEQ ID NO: 2332843 - RNA, 17 nt, Yersinia pestis KIM
cacauucaguacauaaa

SEQ ID NO: 2332844 - RNA, 21 nt, Yersinia pestis KIM
caccaaaaaacggauuuccau

SEQ ID NO: 2332845 - RNA, 15 nt, Yersinia pestis KIM
cacaucauaaucggu

SEQ ID NO: 2332846 - RNA, 21 nt, Yersinia pestis KIM
cacaucaaccugaucaucaaa

SEQ ID NO: 2332847 - RNA, 20 nt, Yersinia pestis KIM
cacaucaacaguugccgacu

SEQ ID NO: 2332848 - RNA, 17 nt, Yersinia pestis KIM
cacaucaccgacagcau

SEQ ID NO: 2332849 - RNA, 11 nt, Yersinia pestis KIM
cacaucacagu

SEQ ID NO: 2332850 - RNA, 22 nt, Yersinia pestis KIM
cacauauuucaggcuguugcgu

SEQ ID NO: 2332851 - RNA, 12 nt, Yersinia pestis KIM
cacauccaaugg

SEQ ID NO: 2332852 - RNA, 15 nt, Yersinia pestis KIM
cacaucauuacccau

SEQ ID NO: 2332853 - RNA, 16 nt, Yersinia pestis KIM
cacauagcuguaaaua

SEQ ID NO: 2332854 - RNA, 17 nt, Yersinia pestis KIM
cacauagcgucagguag

SEQ ID NO: 2332855 - RNA, 16 nt, Yersinia pestis KIM
cacauagccgucaaua

SEQ ID NO: 2332856 - RNA, 18 nt, Yersinia pestis KIM
cacauagccgucaauaaa

SEQ ID NO: 2332857 - RNA, 13 nt, Yersinia pestis KIM
cacgcguucaauc

SEQ ID NO: 2332858 - RNA, 16 nt, Yersinia pestis KIM
cacgcuccacacaaaa

SEQ ID NO: 2332859 - RNA, 20 nt, Yersinia pestis KIM
cacggccuaacaacacgcua

SEQ ID NO: 2332860 - RNA, 17 nt, Yersinia pestis KIM
cacggccuauugaauaa

SEQ ID NO: 2332861 - RNA, 20 nt, Yersinia pestis KIM
cacggauaucaauaaccuga

SEQ ID NO: 2332862 - RNA, 18 nt, Yersinia pestis KIM
cacggaucucauucagac

SEQ ID NO: 2332863 - RNA, 15 nt, Yersinia pestis KIM
cacggcgcuccauca

SEQ ID NO: 2332864 - RNA, 15 nt, Yersinia pestis KIM
cacgggaucaacaug

SEQ ID NO: 2332865 - RNA, 14 nt, Yersinia pestis KIM
cacggcgaucagug

SEQ ID NO: 2332866 - RNA, 13 nt, Yersinia pestis KIM
cacggggaaacag

SEQ ID NO: 2332867 - RNA, 17 nt, Yersinia pestis KIM
cacggguauuugcaaug

SEQ ID NO: 2332868 - RNA, 15 nt, Yersinia pestis KIM
aaaauagcuucccug

SEQ ID NO: 2332869 - RNA, 11 nt, Yersinia pestis KIM
aaaauagggaa

SEQ ID NO: 2332870 - RNA, 21 nt, Yersinia pestis KIM
aaaauagguguuuuucgucau

SEQ ID NO: 2332871 - RNA, 22 nt, Yersinia pestis KIM
aaaauagggaagguguuuaaaa

SEQ ID NO: 2332872 - RNA, 23 nt, Yersinia pestis KIM
aaaauagggaagguguuuaaaau

SEQ ID NO: 2332873 - RNA, 13 nt, Yersinia pestis KIM
cacgcgaagcccu

SEQ ID NO: 2332874 - RNA, 15 nt, Yersinia pestis KIM
cacgcccuacugaga

SEQ ID NO: 2332875 - RNA, 16 nt, Yersinia pestis KIM
cacgcccuucacacug

SEQ ID NO: 2332876 - RNA, 22 nt, Yersinia pestis KIM
cacgaaccgaacgaacccgaua

SEQ ID NO: 2332877 - RNA, 15 nt, Yersinia pestis KIM
aaaauagacucaaca

SEQ ID NO: 2332878 - RNA, 13 nt, Yersinia pestis KIM
aaaauagaaaaca

SEQ ID NO: 2332879 - RNA, 16 nt, Yersinia pestis KIM
aaaauagccuucccug

SEQ ID NO: 2332880 - RNA, 21 nt, Yersinia pestis KIM
cacgacaacaaagccgcugcu

SEQ ID NO: 2332881 - RNA, 15 nt, Yersinia pestis KIM
cacgaauuugcugcu

SEQ ID NO: 2332882 - RNA, 13 nt, Yersinia pestis KIM
cacgauccgcuuu

SEQ ID NO: 2332883 - RNA, 16 nt, Yersinia pestis KIM
cacgaucgaugugaua

SEQ ID NO: 2332884 - RNA, 16 nt, Yersinia pestis KIM
aaaauacauaucaaca

SEQ ID NO: 2332885 - RNA, 13 nt, Yersinia pestis KIM
aaaauacaaccaa

SEQ ID NO: 2332886 - RNA, 21 nt, Yersinia pestis KIM
aaaauacaaccaacaaacaau

SEQ ID NO: 2332887 - RNA, 13 nt, Yersinia pestis KIM
aaaauacaaaaag

SEQ ID NO: 2332888 - RNA, 10 nt, Yersinia pestis KIM
aaaauaauga

SEQ ID NO: 2332889 - RNA, 14 nt, Yersinia pestis KIM
caccuuaaaauaag

SEQ ID NO: 2332890 - RNA, 16 nt, Yersinia pestis KIM
aaaauacggccaguca

SEQ ID NO: 2332891 - RNA, 19 nt, Yersinia pestis KIM
aaaauacccaaagucauug

SEQ ID NO: 2332892 - RNA, 15 nt, Yersinia pestis KIM
caccucagucaucgc

SEQ ID NO: 2332893 - RNA, 15 nt, Yersinia pestis KIM
caccugcuggugcca

SEQ ID NO: 2332894 - RNA, 17 nt, Yersinia pestis KIM
caccuggcccuggaaca

SEQ ID NO: 2332895 - RNA, 17 nt, Yersinia pestis KIM
caccgagguuaucagcc

SEQ ID NO: 2332896 - RNA, 15 nt, Yersinia pestis KIM
caccgauaaaaguga

SEQ ID NO: 2332897 - RNA, 23 nt, Yersinia pestis KIM
caccgcuuagcaauaccagccga

SEQ ID NO: 2332898 - RNA, 20 nt, Yersinia pestis KIM
caccgcuguggaaucggccu

SEQ ID NO: 2332899 - RNA, 14 nt, Yersinia pestis KIM
caccgcuaucacug

SEQ ID NO: 2332900 - RNA, 15 nt, Yersinia pestis KIM
caccgcgucgccgcu

SEQ ID NO: 2332901 - RNA, 14 nt, Yersinia pestis KIM
caccuauaauuaac

SEQ ID NO: 2332902 - RNA, 21 nt, Yersinia pestis KIM
caccuaucgccgccgccagcc

SEQ ID NO: 2332903 - RNA, 16 nt, Yersinia pestis KIM
caccucaccagcaucu

SEQ ID NO: 2332904 - RNA, 17 nt, Yersinia pestis KIM
caccuaaccaaacauug

SEQ ID NO: 2332905 - RNA, 19 nt, Yersinia pestis KIM
caccuaaccaaacauuguu

SEQ ID NO: 2332906 - RNA, 15 nt, Yersinia pestis KIM
caccuaacaugcuga

SEQ ID NO: 2332907 - RNA, 15 nt, Yersinia pestis KIM
caccuaaccaaacau

SEQ ID NO: 2332908 - RNA, 14 nt, Yersinia pestis KIM
caccuaauacagca

SEQ ID NO: 2332909 - RNA, 17 nt, Yersinia pestis KIM
caccuaauacagcacca

SEQ ID NO: 2332910 - RNA, 23 nt, Yersinia pestis KIM
caccuaagccucucucacuuugg

SEQ ID NO: 2332911 - RNA, 16 nt, Yersinia pestis KIM
caccuaauccaaggcg

SEQ ID NO: 2332912 - RNA, 17 nt, Yersinia pestis KIM
caccgucgguuucucuu

SEQ ID NO: 2332913 - RNA, 16 nt, Yersinia pestis KIM
caccguaucaucacca

SEQ ID NO: 2332914 - RNA, 12 nt, Yersinia pestis KIM
caccguaugaga

SEQ ID NO: 2332915 - RNA, 20 nt, Yersinia pestis KIM
cacccagcaaaauagcacag

SEQ ID NO: 2332916 - RNA, 20 nt, Yersinia pestis KIM
cacccaggcugugguggcgg

SEQ ID NO: 2332917 - RNA, 20 nt, Yersinia pestis KIM
cacccacggcgggcaacaga

SEQ ID NO: 2332918 - RNA, 17 nt, Yersinia pestis KIM
caccaguaaacgccaau

SEQ ID NO: 2332919 - RNA, 16 nt, Yersinia pestis KIM
caccaguagcccagcc

SEQ ID NO: 2332920 - RNA, 17 nt, Yersinia pestis KIM
cacccauagcucagcug

SEQ ID NO: 2332921 - RNA, 20 nt, Yersinia pestis KIM
cacccccuccaaacuggcua

SEQ ID NO: 2332922 - RNA, 11 nt, Yersinia pestis KIM
cacccgccauc

SEQ ID NO: 2332923 - RNA, 16 nt, Yersinia pestis KIM
cacccggcuggcacca

SEQ ID NO: 2332924 - RNA, 23 nt, Yersinia pestis KIM
cacccggcuggcaccaagcagcc

SEQ ID NO: 2332925 - RNA, 20 nt, Yersinia pestis KIM
caccgaggcgggucagaaac

SEQ ID NO: 2332926 - RNA, 22 nt, Yersinia pestis KIM
cacccuguguauuuaaccaaca

SEQ ID NO: 2332927 - RNA, 20 nt, Yersinia pestis KIM
cacccugcgugguauacccu

SEQ ID NO: 2332928 - RNA, 24 nt, Yersinia pestis KIM
caaagacuaaccucugcaaugccc

SEQ ID NO: 2332929 - RNA, 15 nt, Yersinia pestis KIM
caaagacauacccca

SEQ ID NO: 2332930 - RNA, 21 nt, Yersinia pestis KIM
caaagaauugagguaaaccaa

SEQ ID NO: 2332931 - RNA, 22 nt, Yersinia pestis KIM
caaagaauugagguaaaccaag

SEQ ID NO: 2332932 - RNA, 22 nt, Yersinia pestis KIM
caaagauuucaucggcaaaaac

SEQ ID NO: 2332933 - RNA, 16 nt, Yersinia pestis KIM
caaagauuggcagcgu

SEQ ID NO: 2332934 - RNA, 22 nt, Yersinia pestis KIM
caaagccuacgagagaucguag

SEQ ID NO: 2332935 - RNA, 16 nt, Yersinia pestis KIM
caaagccgcugcucac

SEQ ID NO: 2332936 - RNA, 16 nt, Yersinia pestis KIM
caaaggaagggguucu

SEQ ID NO: 2332937 - RNA, 19 nt, Yersinia pestis KIM
caaaggcccgcuaucacua

SEQ ID NO: 2332938 - RNA, 15 nt, Yersinia pestis KIM
caaaggcaaaaugau

SEQ ID NO: 2332939 - RNA, 18 nt, Yersinia pestis KIM
caaacuuaaaaaucaaaa

SEQ ID NO: 2332940 - RNA, 14 nt, Yersinia pestis KIM
caaacuuaaaaauc

SEQ ID NO: 2332941 - RNA, 20 nt, Yersinia pestis KIM
caaacuguuuuuuaaagaaa

SEQ ID NO: 2332942 - RNA, 22 nt, Yersinia pestis KIM
caaacuguuuuuuaaagaaaaa

SEQ ID NO: 2332943 - RNA, 13 nt, Yersinia pestis KIM
caaacuuaaaaau

SEQ ID NO: 2332944 - RNA, 17 nt, Yersinia pestis KIM
caaacggugugcaaugc

SEQ ID NO: 2332945 - RNA, 15 nt, Yersinia pestis KIM
caaacuuuguggaua

SEQ ID NO: 2332946 - RNA, 18 nt, Yersinia pestis KIM
caaacuugaucagcgccu

SEQ ID NO: 2332947 - RNA, 21 nt, Yersinia pestis KIM
caaacggucuguuaauccuaa

SEQ ID NO: 2332948 - RNA, 18 nt, Yersinia pestis KIM
caaacggggauacaucuu

SEQ ID NO: 2332949 - RNA, 15 nt, Yersinia pestis KIM
caaacguauugguaa

SEQ ID NO: 2332950 - RNA, 21 nt, Yersinia pestis KIM
caaacggacuccccgcucgac

SEQ ID NO: 2332951 - RNA, 15 nt, Yersinia pestis KIM
caaacaaccuaaaaa

SEQ ID NO: 2332952 - RNA, 13 nt, Yersinia pestis KIM
caaacaauccuau

SEQ ID NO: 2332953 - RNA, 17 nt, Yersinia pestis KIM
caaacauuuucaucuga

SEQ ID NO: 2332954 - RNA, 22 nt, Yersinia pestis KIM
caaaccauuugcggccuaaaua

SEQ ID NO: 2332955 - RNA, 23 nt, Yersinia pestis KIM
caaaccauuugcggccuaaauac

SEQ ID NO: 2332956 - RNA, 14 nt, Yersinia pestis KIM
caaaagcaucacca

SEQ ID NO: 2332957 - RNA, 17 nt, Yersinia pestis KIM
caaaagcaucaccaaag

SEQ ID NO: 2332958 - RNA, 20 nt, Yersinia pestis KIM
caaaagcaucaccaaagaua

SEQ ID NO: 2332959 - RNA, 23 nt, Yersinia pestis KIM
caaaagcauccaauaccaccaau

SEQ ID NO: 2332960 - RNA, 17 nt, Yersinia pestis KIM
caaaagcaaguuaggua

SEQ ID NO: 2332961 - RNA, 15 nt, Yersinia pestis KIM
caaaacugaagcaag

SEQ ID NO: 2332962 - RNA, 16 nt, Yersinia pestis KIM
caaaagaaacugccag

SEQ ID NO: 2332963 - RNA, 13 nt, Yersinia pestis KIM
caaaacgaguaaa

SEQ ID NO: 2332964 - RNA, 19 nt, Yersinia pestis KIM
caaaacgaguaaauagcaa

SEQ ID NO: 2332965 - RNA, 18 nt, Yersinia pestis KIM
caaaaccuuuaaucagau

SEQ ID NO: 2332966 - RNA, 16 nt, Yersinia pestis KIM
caaaacguugaggcac

SEQ ID NO: 2332967 - RNA, 22 nt, Yersinia pestis KIM
caaaacggcaauuaagcaaaaa

SEQ ID NO: 2332968 - RNA, 14 nt, Yersinia pestis KIM
caaaaccgugacua

SEQ ID NO: 2332969 - RNA, 20 nt, Yersinia pestis KIM
caaaaccgugacuaaaacaa

SEQ ID NO: 2332970 - RNA, 20 nt, Yersinia pestis KIM
caaaaccguacugauaucuu

SEQ ID NO: 2332971 - RNA, 18 nt, Yersinia pestis KIM
caaaaggauggcccaagc

SEQ ID NO: 2332972 - RNA, 22 nt, Yersinia pestis KIM
caaaaggauggcccaagccauc

SEQ ID NO: 2332973 - RNA, 18 nt, Yersinia pestis KIM
caaaaggugcaagcagcu

SEQ ID NO: 2332974 - RNA, 16 nt, Yersinia pestis KIM
caaaauacuuaacaau

SEQ ID NO: 2332975 - RNA, 15 nt, Yersinia pestis KIM
caaaauagaaaacag

SEQ ID NO: 2332976 - RNA, 19 nt, Yersinia pestis KIM
caaaaucgcgaccagcaga

SEQ ID NO: 2332977 - RNA, 21 nt, Yersinia pestis KIM
caaaaucgcgaccagcagaau

SEQ ID NO: 2332978 - RNA, 21 nt, Yersinia pestis KIM
caaaauccaccagcgggcggc

SEQ ID NO: 2332979 - RNA, 15 nt, Yersinia pestis KIM
caaaauccaccagcg

SEQ ID NO: 2332980 - RNA, 15 nt, Yersinia pestis KIM
caaaauagggcgccc

SEQ ID NO: 2332981 - RNA, 16 nt, Yersinia pestis KIM
caaaaugugaaaagca

SEQ ID NO: 2332982 - RNA, 20 nt, Yersinia pestis KIM
caacacauucccauuauuau

SEQ ID NO: 2332983 - RNA, 16 nt, Yersinia pestis KIM
caacaaacucugcgua

SEQ ID NO: 2332984 - RNA, 20 nt, Yersinia pestis KIM
caacaaacaguucauaucga

SEQ ID NO: 2332985 - RNA, 17 nt, Yersinia pestis KIM
caacagcaucaucaaau

SEQ ID NO: 2332986 - RNA, 18 nt, Yersinia pestis KIM
caacacccgaccagacaa

SEQ ID NO: 2332987 - RNA, 15 nt, Yersinia pestis KIM
caacacccaacucaa

SEQ ID NO: 2332988 - RNA, 18 nt, Yersinia pestis KIM
caacagcgcucauagcaa

SEQ ID NO: 2332989 - RNA, 22 nt, Yersinia pestis KIM
caacaguuauuuuaauugcuga

SEQ ID NO: 2332990 - RNA, 22 nt, Yersinia pestis KIM
caacaguuacgcgucugcuggc

SEQ ID NO: 2332991 - RNA, 21 nt, Yersinia pestis KIM
caacagugcaacauuaaaaau

SEQ ID NO: 2332992 - RNA, 19 nt, Yersinia pestis KIM
caacagucacaccaacacu

SEQ ID NO: 2332993 - RNA, 21 nt, Yersinia pestis KIM
caacaucgcuugugcuacauc

SEQ ID NO: 2332994 - RNA, 15 nt, Yersinia pestis KIM
caacaucucgccaaa

SEQ ID NO: 2332995 - RNA, 18 nt, Yersinia pestis KIM
caacaucucgccaaagua

SEQ ID NO: 2332996 - RNA, 11 nt, Yersinia pestis KIM
caacaucaucg

SEQ ID NO: 2332997 - RNA, 15 nt, Yersinia pestis KIM
caacauccaguucga

SEQ ID NO: 2332998 - RNA, 15 nt, Yersinia pestis KIM
caacauuaaaaauac

SEQ ID NO: 2332999 - RNA, 14 nt, Yersinia pestis KIM
caacaugguccaca

SEQ ID NO: 2333000 - RNA, 16 nt, Yersinia pestis KIM
caacaugagccacaca

SEQ ID NO: 2333001 - RNA, 12 nt, Yersinia pestis KIM
caacaucuucca

SEQ ID NO: 2333002 - RNA, 23 nt, Yersinia pestis KIM
caacaugggcaagcucugggcug

SEQ ID NO: 2333003 - RNA, 13 nt, Yersinia pestis KIM
caacauugguuac

SEQ ID NO: 2333004 - RNA, 20 nt, Yersinia pestis KIM
caacauuuggggugcaguuc

SEQ ID NO: 2333005 - RNA, 18 nt, Yersinia pestis KIM
caacccaauaauaaucca

SEQ ID NO: 2333006 - RNA, 22 nt, Yersinia pestis KIM
caaccaugcugcccgcacacug

SEQ ID NO: 2333007 - RNA, 18 nt, Yersinia pestis KIM
caacccggcuguuaaauu

SEQ ID NO: 2333008 - RNA, 13 nt, Yersinia pestis KIM
caaccggcgcgcu

SEQ ID NO: 2333009 - RNA, 16 nt, Yersinia pestis KIM
caaccggcgcuccagu

SEQ ID NO: 2333010 - RNA, 17 nt, Yersinia pestis KIM
caaccgaccaaaggcca

SEQ ID NO: 2333011 - RNA, 12 nt, Yersinia pestis KIM
caacccuuuggg

SEQ ID NO: 2333012 - RNA, 12 nt, Yersinia pestis KIM
caaauuccccag

SEQ ID NO: 2333013 - RNA, 13 nt, Yersinia pestis KIM
caaauguuggaua

SEQ ID NO: 2333014 - RNA, 14 nt, Yersinia pestis KIM
caaauuaacacauc

SEQ ID NO: 2333015 - RNA, 14 nt, Yersinia pestis KIM
caaauuaaccugcu

SEQ ID NO: 2333016 - RNA, 18 nt, Yersinia pestis KIM
caaauucucaaugauaaa

SEQ ID NO: 2333017 - RNA, 21 nt, Yersinia pestis KIM
caaauucucaaugauaaaauc

SEQ ID NO: 2333018 - RNA, 17 nt, Yersinia pestis KIM
caaauucucaaugauaa

SEQ ID NO: 2333019 - RNA, 21 nt, Yersinia pestis KIM
caaaugagagcgcagcaguga

SEQ ID NO: 2333020 - RNA, 13 nt, Yersinia pestis KIM
caaaugaaaauau

SEQ ID NO: 2333021 - RNA, 14 nt, Yersinia pestis KIM
caaaucugcucccg

SEQ ID NO: 2333022 - RNA, 21 nt, Yersinia pestis KIM
caaauccucggguuuuauacc

SEQ ID NO: 2333023 - RNA, 17 nt, Yersinia pestis KIM
caaaucacauuucaaau

SEQ ID NO: 2333024 - RNA, 14 nt, Yersinia pestis KIM
caaaucauuuaauu

SEQ ID NO: 2333025 - RNA, 17 nt, Yersinia pestis KIM
caaaucauuuaauuuau

SEQ ID NO: 2333026 - RNA, 18 nt, Yersinia pestis KIM
caaaucaucagacagcca

SEQ ID NO: 2333027 - RNA, 16 nt, Yersinia pestis KIM
caaauagguuuuacuc

SEQ ID NO: 2333028 - RNA, 18 nt, Yersinia pestis KIM
caaauauugaauuaaagu

SEQ ID NO: 2333029 - RNA, 19 nt, Yersinia pestis KIM
caaauauugcacaauagcu

SEQ ID NO: 2333030 - RNA, 15 nt, Yersinia pestis KIM
caaauaucauuauuu

SEQ ID NO: 2333031 - RNA, 16 nt, Yersinia pestis KIM
caaauauaaugcugaa

SEQ ID NO: 2333032 - RNA, 21 nt, Yersinia pestis KIM
caacucuacauugacuaauua

SEQ ID NO: 2333033 - RNA, 18 nt, Yersinia pestis KIM
caacugcucaacugcuca

SEQ ID NO: 2333034 - RNA, 13 nt, Yersinia pestis KIM
caacugcucaacu

SEQ ID NO: 2333035 - RNA, 15 nt, Yersinia pestis KIM
caacugcucaacugc

SEQ ID NO: 2333036 - RNA, 19 nt, Yersinia pestis KIM
caacugcucaacgccccgu

SEQ ID NO: 2333037 - RNA, 22 nt, Yersinia pestis KIM
caacguaacaugcagcccgacc

SEQ ID NO: 2333038 - RNA, 14 nt, Yersinia pestis KIM
caacgucacuucca

SEQ ID NO: 2333039 - RNA, 19 nt, Yersinia pestis KIM
caacgugauaugccugaag

SEQ ID NO: 2333040 - RNA, 21 nt, Yersinia pestis KIM
caacuauugcaucuuuaauua

SEQ ID NO: 2333041 - RNA, 14 nt, Yersinia pestis KIM
caacucaaaacaau

SEQ ID NO: 2333042 - RNA, 15 nt, Yersinia pestis KIM
caacguuaaagauga

SEQ ID NO: 2333043 - RNA, 18 nt, Yersinia pestis KIM
caacuagcccacucagcc

SEQ ID NO: 2333044 - RNA, 18 nt, Yersinia pestis KIM
caacggcacaucccaaua

SEQ ID NO: 2333045 - RNA, 15 nt, Yersinia pestis KIM
caacggcacauccca

SEQ ID NO: 2333046 - RNA, 23 nt, Yersinia pestis KIM
caacgggugacgcuggcacugga

SEQ ID NO: 2333047 - RNA, 21 nt, Yersinia pestis KIM
caacggcuggccgagcagacc

SEQ ID NO: 2333048 - RNA, 21 nt, Yersinia pestis KIM
caacggagcguacacgcagua

SEQ ID NO: 2333049 - RNA, 18 nt, Yersinia pestis KIM
caacgcuaugcagcccag

SEQ ID NO: 2333050 - RNA, 21 nt, Yersinia pestis KIM
caaccuacgccauuaaaaggu

SEQ ID NO: 2333051 - RNA, 16 nt, Yersinia pestis KIM
caaccucagccucauu

SEQ ID NO: 2333052 - RNA, 14 nt, Yersinia pestis KIM
caaccucagccuca

SEQ ID NO: 2333053 - RNA, 21 nt, Yersinia pestis KIM
caagccugugcuaaaucccag

SEQ ID NO: 2333054 - RNA, 17 nt, Yersinia pestis KIM
caagcugagauaagccu

SEQ ID NO: 2333055 - RNA, 20 nt, Yersinia pestis KIM
caagcugagauaagccucgg

SEQ ID NO: 2333056 - RNA, 20 nt, Yersinia pestis KIM
caagcucgccaucgcaccaa

SEQ ID NO: 2333057 - RNA, 19 nt, Yersinia pestis KIM
caagcuacaugugcauuga

SEQ ID NO: 2333058 - RNA, 15 nt, Yersinia pestis KIM
caagcuacggccugu

SEQ ID NO: 2333059 - RNA, 22 nt, Yersinia pestis KIM
caagccgauaaucccugccaga

SEQ ID NO: 2333060 - RNA, 14 nt, Yersinia pestis KIM
caagccaauggcca

SEQ ID NO: 2333061 - RNA, 19 nt, Yersinia pestis KIM
caagccaauauuacggccc

SEQ ID NO: 2333062 - RNA, 16 nt, Yersinia pestis KIM
caagccaaacaaauga

SEQ ID NO: 2333063 - RNA, 24 nt, Yersinia pestis KIM
caagcagugucagggcaauaacaa

SEQ ID NO: 2333064 - RNA, 19 nt, Yersinia pestis KIM
caagcauacguugccagcc

SEQ ID NO: 2333065 - RNA, 18 nt, Yersinia pestis KIM
caagcaugugauguggcu

SEQ ID NO: 2333066 - RNA, 14 nt, Yersinia pestis KIM
caagacagaacuua

SEQ ID NO: 2333067 - RNA, 23 nt, Yersinia pestis KIM
caagaaugucaugguuaaacuga

SEQ ID NO: 2333068 - RNA, 20 nt, Yersinia pestis KIM
caacuuccagugccaauuga

SEQ ID NO: 2333069 - RNA, 18 nt, Yersinia pestis KIM
caacuuccuugauuuuca

SEQ ID NO: 2333070 - RNA, 16 nt, Yersinia pestis KIM
caacuuccacacaaac

SEQ ID NO: 2333071 - RNA, 14 nt, Yersinia pestis KIM
caacuucaagccga

SEQ ID NO: 2333072 - RNA, 13 nt, Yersinia pestis KIM
caacuucacuuug

SEQ ID NO: 2333073 - RNA, 17 nt, Yersinia pestis KIM
caagaucacaugacuga

SEQ ID NO: 2333074 - RNA, 18 nt, Yersinia pestis KIM
caagauaccgaguucuca

SEQ ID NO: 2333075 - RNA, 20 nt, Yersinia pestis KIM
caagauagaaccaugagaau

SEQ ID NO: 2333076 - RNA, 20 nt, Yersinia pestis KIM
caagagaaacccauagcaaa

SEQ ID NO: 2333077 - RNA, 16 nt, Yersinia pestis KIM
caagagaaaugcacuu

SEQ ID NO: 2333078 - RNA, 14 nt, Yersinia pestis KIM
caaucaccaccucc

SEQ ID NO: 2333079 - RNA, 22 nt, Yersinia pestis KIM
caaucacccccuccaaacuggc

SEQ ID NO: 2333080 - RNA, 14 nt, Yersinia pestis KIM
caaucacaucaccg

SEQ ID NO: 2333081 - RNA, 16 nt, Yersinia pestis KIM
caaucacaaccccccc

SEQ ID NO: 2333082 - RNA, 20 nt, Yersinia pestis KIM
caaucaaaagggaucaccag

SEQ ID NO: 2333083 - RNA, 20 nt, Yersinia pestis KIM
caauauuuuagcauuuucca

SEQ ID NO: 2333084 - RNA, 23 nt, Yersinia pestis KIM
caaucaaucaccauaacugcugc

SEQ ID NO: 2333085 - RNA, 22 nt, Yersinia pestis KIM
caaucaaaaugaccuuaucugg

SEQ ID NO: 2333086 - RNA, 13 nt, Yersinia pestis KIM
caauaucaacgcc

SEQ ID NO: 2333087 - RNA, 21 nt, Yersinia pestis KIM
caauauaggcgucaucagcau

SEQ ID NO: 2333088 - RNA, 18 nt, Yersinia pestis KIM
caauauccauauuaaaug

SEQ ID NO: 2333089 - RNA, 19 nt, Yersinia pestis KIM
caauauccgugauuaaccu

SEQ ID NO: 2333090 - RNA, 17 nt, Yersinia pestis KIM
caauaucugccaauuca

SEQ ID NO: 2333091 - RNA, 14 nt, Yersinia pestis KIM
caauacuacggcag

SEQ ID NO: 2333092 - RNA, 19 nt, Yersinia pestis KIM
caaucagccgcaucacuga

SEQ ID NO: 2333093 - RNA, 18 nt, Yersinia pestis KIM
caaucaggaaauuaccac

SEQ ID NO: 2333094 - RNA, 15 nt, Yersinia pestis KIM
caaucaggaaauuac

SEQ ID NO: 2333095 - RNA, 11 nt, Yersinia pestis KIM
caaucacugcg

SEQ ID NO: 2333096 - RNA, 17 nt, Yersinia pestis KIM
caaucagugcaauaaau

SEQ ID NO: 2333097 - RNA, 15 nt, Yersinia pestis KIM
caaucuaacuaauaa

SEQ ID NO: 2333098 - RNA, 14 nt, Yersinia pestis KIM
caaucgauuccugu

SEQ ID NO: 2333099 - RNA, 15 nt, Yersinia pestis KIM
caaucgaugagcugg

SEQ ID NO: 2333100 - RNA, 13 nt, Yersinia pestis KIM
caaucgccaccgg

SEQ ID NO: 2333101 - RNA, 21 nt, Yersinia pestis KIM
caauaaaauuacccagcaucu

SEQ ID NO: 2333102 - RNA, 19 nt, Yersinia pestis KIM
caauaaagcgauaaauacu

SEQ ID NO: 2333103 - RNA, 19 nt, Yersinia pestis KIM
caauaaacagacuaaaaac

SEQ ID NO: 2333104 - RNA, 18 nt, Yersinia pestis KIM
caaguucgccuucagcgu

SEQ ID NO: 2333105 - RNA, 13 nt, Yersinia pestis KIM
caauacaccuugc

SEQ ID NO: 2333106 - RNA, 14 nt, Yersinia pestis KIM
caauacaauuauuu

SEQ ID NO: 2333107 - RNA, 13 nt, Yersinia pestis KIM
caauacaccagac

SEQ ID NO: 2333108 - RNA, 20 nt, Yersinia pestis KIM
caauacaggcaucgguaaua

SEQ ID NO: 2333109 - RNA, 17 nt, Yersinia pestis KIM
caauaaggugccacaca

SEQ ID NO: 2333110 - RNA, 19 nt, Yersinia pestis KIM
caauaauaaaaaaaaauaa

SEQ ID NO: 2333111 - RNA, 17 nt, Yersinia pestis KIM
caauaauaaaaaaaaau

SEQ ID NO: 2333112 - RNA, 14 nt, Yersinia pestis KIM
caauaauaaaaaaa

SEQ ID NO: 2333113 - RNA, 15 nt, Yersinia pestis KIM
caauaauaaaaucug

SEQ ID NO: 2333114 - RNA, 19 nt, Yersinia pestis KIM
caauaauauccaaccaacc

SEQ ID NO: 2333115 - RNA, 20 nt, Yersinia pestis KIM
caagcuguuauucagcuuca

SEQ ID NO: 2333116 - RNA, 22 nt, Yersinia pestis KIM
caagcuuaauauuauucucaac

SEQ ID NO: 2333117 - RNA, 16 nt, Yersinia pestis KIM
caagcuuggccccuua

SEQ ID NO: 2333118 - RNA, 17 nt, Yersinia pestis KIM
caagucagugauucggg

SEQ ID NO: 2333119 - RNA, 16 nt, Yersinia pestis KIM
caagucaauaaauaaa

SEQ ID NO: 2333120 - RNA, 23 nt, Yersinia pestis KIM
caagucaauaaauaaaaacgcag

SEQ ID NO: 2333121 - RNA, 14 nt, Yersinia pestis KIM
caaguaugcagggu

SEQ ID NO: 2333122 - RNA, 21 nt, Yersinia pestis KIM
caaguggguaauguugcaaac

SEQ ID NO: 2333123 - RNA, 12 nt, Yersinia pestis KIM
caagugcuucaa

SEQ ID NO: 2333124 - RNA, 18 nt, Yersinia pestis KIM
caagugcuuuuuucacac

SEQ ID NO: 2333125 - RNA, 15 nt, Yersinia pestis KIM
caagucuugaagagu

SEQ ID NO: 2333126 - RNA, 17 nt, Yersinia pestis KIM
caagucuugaagaguga

SEQ ID NO: 2333127 - RNA, 16 nt, Yersinia pestis KIM
caagucccgccccggg

SEQ ID NO: 2333128 - RNA, 20 nt, Yersinia pestis KIM
aucacaccgcgaucacaaua

SEQ ID NO: 2333129 - RNA, 19 nt, Yersinia pestis KIM
aucacaccgcgaucacaau

SEQ ID NO: 2333130 - RNA, 21 nt, Yersinia pestis KIM
aucacaggggcaauaauugca

SEQ ID NO: 2333131 - RNA, 16 nt, Yersinia pestis KIM
aucacaguaaauucuu

SEQ ID NO: 2333132 - RNA, 13 nt, Yersinia pestis KIM
aucacauaaauaa

SEQ ID NO: 2333133 - RNA, 15 nt, Yersinia pestis KIM
aucacauaauauuua

SEQ ID NO: 2333134 - RNA, 15 nt, Yersinia pestis KIM
aucacauaaauaagu

SEQ ID NO: 2333135 - RNA, 20 nt, Yersinia pestis KIM
aucaccaacaccaccaucac

SEQ ID NO: 2333136 - RNA, 12 nt, Yersinia pestis KIM
aucaccaaacag

SEQ ID NO: 2333137 - RNA, 17 nt, Yersinia pestis KIM
aucaccaaagcaacagc

SEQ ID NO: 2333138 - RNA, 16 nt, Yersinia pestis KIM
aucacaugcggauuga

SEQ ID NO: 2333139 - RNA, 17 nt, Yersinia pestis KIM
aucacaugacugaacau

SEQ ID NO: 2333140 - RNA, 22 nt, Yersinia pestis KIM
aucacaucgcccugcucuucug

SEQ ID NO: 2333141 - RNA, 13 nt, Yersinia pestis KIM
aucacaucuugca

SEQ ID NO: 2333142 - RNA, 13 nt, Yersinia pestis KIM
aucacaacccccc

SEQ ID NO: 2333143 - RNA, 15 nt, Yersinia pestis KIM
aucaauugcuggcua

SEQ ID NO: 2333144 - RNA, 12 nt, Yersinia pestis KIM
aucaauuggccc

SEQ ID NO: 2333145 - RNA, 14 nt, Yersinia pestis KIM
aucaccccccugcc

SEQ ID NO: 2333146 - RNA, 11 nt, Yersinia pestis KIM
aucaccccuuc

SEQ ID NO: 2333147 - RNA, 20 nt, Yersinia pestis KIM
aucacccaugcgagcaguga

SEQ ID NO: 2333148 - RNA, 12 nt, Yersinia pestis KIM
aucacccagcaa

SEQ ID NO: 2333149 - RNA, 15 nt, Yersinia pestis KIM
aucacccgcaaaacu

SEQ ID NO: 2333150 - RNA, 16 nt, Yersinia pestis KIM
aucacccgcagugccu

SEQ ID NO: 2333151 - RNA, 15 nt, Yersinia pestis KIM
aucaccugacaccaa

SEQ ID NO: 2333152 - RNA, 19 nt, Yersinia pestis KIM
aucaccauuaauaauaugc

SEQ ID NO: 2333153 - RNA, 14 nt, Yersinia pestis KIM
aucaccagacaacc

SEQ ID NO: 2333154 - RNA, 17 nt, Yersinia pestis KIM
aucaccagacaaccaau

SEQ ID NO: 2333155 - RNA, 19 nt, Yersinia pestis KIM
aucaccuuauccaauagaa

SEQ ID NO: 2333156 - RNA, 15 nt, Yersinia pestis KIM
aucaccuuccaaacu

SEQ ID NO: 2333157 - RNA, 20 nt, Yersinia pestis KIM
aucacuauaauuauuucucu

SEQ ID NO: 2333158 - RNA, 16 nt, Yersinia pestis KIM
aucacuauuucagaca

SEQ ID NO: 2333159 - RNA, 15 nt, Yersinia pestis KIM
aucacuauuucaggc

SEQ ID NO: 2333160 - RNA, 22 nt, Yersinia pestis KIM
aucacuauuucaggcauaucac

SEQ ID NO: 2333161 - RNA, 22 nt, Yersinia pestis KIM
aucacugaggccaaaugaaaau

SEQ ID NO: 2333162 - RNA, 16 nt, Yersinia pestis KIM
aucacugauucagaaa

SEQ ID NO: 2333163 - RNA, 18 nt, Yersinia pestis KIM
aucacucgggauaugacu

SEQ ID NO: 2333164 - RNA, 16 nt, Yersinia pestis KIM
aucagguuguauuuug

SEQ ID NO: 2333165 - RNA, 18 nt, Yersinia pestis KIM
aucaggucgucaguggau

SEQ ID NO: 2333166 - RNA, 20 nt, Yersinia pestis KIM
aucaggucgucaguggaugg

SEQ ID NO: 2333167 - RNA, 24 nt, Yersinia pestis KIM
aucaggucaguaaugaauucauug

SEQ ID NO: 2333168 - RNA, 14 nt, Yersinia pestis KIM
aucaggcuguucuu

SEQ ID NO: 2333169 - RNA, 15 nt, Yersinia pestis KIM
aucaggcuguugaca

SEQ ID NO: 2333170 - RNA, 22 nt, Yersinia pestis KIM
aucaggcagggagauacccaua

SEQ ID NO: 2333171 - RNA, 23 nt, Yersinia pestis KIM
aucaggcagggagauacccauag

SEQ ID NO: 2333172 - RNA, 16 nt, Yersinia pestis KIM
aucaguucguucccug

SEQ ID NO: 2333173 - RNA, 16 nt, Yersinia pestis KIM
aaaacgaguaaauaca

SEQ ID NO: 2333174 - RNA, 16 nt, Yersinia pestis KIM
aucaguauuauaaaau

SEQ ID NO: 2333175 - RNA, 17 nt, Yersinia pestis KIM
aucagucgcuuuuuaac

SEQ ID NO: 2333176 - RNA, 19 nt, Yersinia pestis KIM
aucagucgcuuuuuaacaa

SEQ ID NO: 2333177 - RNA, 15 nt, Yersinia pestis KIM
aaaacguaaacaucu

SEQ ID NO: 2333178 - RNA, 21 nt, Yersinia pestis KIM
aaaacgggucgucucuugcaa

SEQ ID NO: 2333179 - RNA, 21 nt, Yersinia pestis KIM
aucagcaguggcuuggcaacc

SEQ ID NO: 2333180 - RNA, 14 nt, Yersinia pestis KIM
aucagcagagagcg

SEQ ID NO: 2333181 - RNA, 22 nt, Yersinia pestis KIM
aucacuggaggcguuuuuauug

SEQ ID NO: 2333182 - RNA, 16 nt, Yersinia pestis KIM
aucacuuauuggaagu

SEQ ID NO: 2333183 - RNA, 23 nt, Yersinia pestis KIM
aucacuuauuggaaguacuuauu

SEQ ID NO: 2333184 - RNA, 23 nt, Yersinia pestis KIM
aucacuuauuccuuucguucacu

SEQ ID NO: 2333185 - RNA, 22 nt, Yersinia pestis KIM
aucagaaacaauaaauauccuc

SEQ ID NO: 2333186 - RNA, 16 nt, Yersinia pestis KIM
aucagcccauugcugu

SEQ ID NO: 2333187 - RNA, 20 nt, Yersinia pestis KIM
aucagccgcggcgcuggcau

SEQ ID NO: 2333188 - RNA, 24 nt, Yersinia pestis KIM
aucagcgaccaaauggacgaacag

SEQ ID NO: 2333189 - RNA, 22 nt, Yersinia pestis KIM
aucagcggggcauucauuucuu

SEQ ID NO: 2333190 - RNA, 18 nt, Yersinia pestis KIM
aucagcgguugaaaaguu

SEQ ID NO: 2333191 - RNA, 19 nt, Yersinia pestis KIM
aucagcguuuuaaucacau

SEQ ID NO: 2333192 - RNA, 16 nt, Yersinia pestis KIM
aucagcguuacccaga

SEQ ID NO: 2333193 - RNA, 20 nt, Yersinia pestis KIM
aucagcguauagcgccgcca

SEQ ID NO: 2333194 - RNA, 12 nt, Yersinia pestis KIM
aucaggauaucu

SEQ ID NO: 2333195 - RNA, 13 nt, Yersinia pestis KIM
auauuauuuugca

SEQ ID NO: 2333196 - RNA, 14 nt, Yersinia pestis KIM
auauucgcagccaa

SEQ ID NO: 2333197 - RNA, 24 nt, Yersinia pestis KIM
auauucgguaaguuggcaucagcu

SEQ ID NO: 2333198 - RNA, 17 nt, Yersinia pestis KIM
auauuaucauucaagaa

SEQ ID NO: 2333199 - RNA, 16 nt, Yersinia pestis KIM
auauuauaaugaaaua

SEQ ID NO: 2333200 - RNA, 18 nt, Yersinia pestis KIM
auauuaguuaacccuauu

SEQ ID NO: 2333201 - RNA, 16 nt, Yersinia pestis KIM
auauuacgcagccaua

SEQ ID NO: 2333202 - RNA, 18 nt, Yersinia pestis KIM
auauuaccgcugaaaaau

SEQ ID NO: 2333203 - RNA, 18 nt, Yersinia pestis KIM
auauuacggcccuccuga

SEQ ID NO: 2333204 - RNA, 22 nt, Yersinia pestis KIM
auauuacgcagccauacccaaa

SEQ ID NO: 2333205 - RNA, 14 nt, Yersinia pestis KIM
auauuacucacaca

SEQ ID NO: 2333206 - RNA, 15 nt, Yersinia pestis KIM
auauuacucucuauu

SEQ ID NO: 2333207 - RNA, 12 nt, Yersinia pestis KIM
auauuaacauau

SEQ ID NO: 2333208 - RNA, 15 nt, Yersinia pestis KIM
auauuaaaugcauua

SEQ ID NO: 2333209 - RNA, 12 nt, Yersinia pestis KIM
auauuaaaugca

SEQ ID NO: 2333210 - RNA, 11 nt, Yersinia pestis KIM
auauuaacccg

SEQ ID NO: 2333211 - RNA, 19 nt, Yersinia pestis KIM
auauuaacugcagugaaaa

SEQ ID NO: 2333212 - RNA, 23 nt, Yersinia pestis KIM
auaugcucugcugggauacuggu

SEQ ID NO: 2333213 - RNA, 15 nt, Yersinia pestis KIM
auauggaugaugcac

SEQ ID NO: 2333214 - RNA, 14 nt, Yersinia pestis KIM
auaugccaggcauc

SEQ ID NO: 2333215 - RNA, 19 nt, Yersinia pestis KIM
auaugcaguuuuccucccu

SEQ ID NO: 2333216 - RNA, 22 nt, Yersinia pestis KIM
auauccuggaagcagaauacug

SEQ ID NO: 2333217 - RNA, 16 nt, Yersinia pestis KIM
auauguucuuccugug

SEQ ID NO: 2333218 - RNA, 23 nt, Yersinia pestis KIM
auauguugauuccguauuauuua

SEQ ID NO: 2333219 - RNA, 20 nt, Yersinia pestis KIM
auauguucgaucaaaacaau

SEQ ID NO: 2333220 - RNA, 19 nt, Yersinia pestis KIM
auauggcggcaucagcaaa

SEQ ID NO: 2333221 - RNA, 20 nt, Yersinia pestis KIM
auauguagggguacagcagg

SEQ ID NO: 2333222 - RNA, 14 nt, Yersinia pestis KIM
auaugucaccucca

SEQ ID NO: 2333223 - RNA, 14 nt, Yersinia pestis KIM
aucaacauuuuuag

SEQ ID NO: 2333224 - RNA, 18 nt, Yersinia pestis KIM
aucaacauuuuuagcuuc

SEQ ID NO: 2333225 - RNA, 20 nt, Yersinia pestis KIM
aucaacaugguccacaguca

SEQ ID NO: 2333226 - RNA, 22 nt, Yersinia pestis KIM
aucaacgggcugauuacccaaa

SEQ ID NO: 2333227 - RNA, 13 nt, Yersinia pestis KIM
aucaacugguuga

SEQ ID NO: 2333228 - RNA, 17 nt, Yersinia pestis KIM
aucaacuucugcaaaau

SEQ ID NO: 2333229 - RNA, 22 nt, Yersinia pestis KIM
aucaaagugcuuaacccaccaa

SEQ ID NO: 2333230 - RNA, 14 nt, Yersinia pestis KIM
auauucuuguugua

SEQ ID NO: 2333231 - RNA, 21 nt, Yersinia pestis KIM
auauuuaauugagaauuauaa

SEQ ID NO: 2333232 - RNA, 13 nt, Yersinia pestis KIM
auauucucaauau

SEQ ID NO: 2333233 - RNA, 15 nt, Yersinia pestis KIM
auauucucauugccc

SEQ ID NO: 2333234 - RNA, 14 nt, Yersinia pestis KIM
auauuuauaaaaaa

SEQ ID NO: 2333235 - RNA, 14 nt, Yersinia pestis KIM
auauuuaucgauuu

SEQ ID NO: 2333236 - RNA, 22 nt, Yersinia pestis KIM
auauuuacggugagaauaaaua

SEQ ID NO: 2333237 - RNA, 15 nt, Yersinia pestis KIM
auauuucuccccacu

SEQ ID NO: 2333238 - RNA, 21 nt, Yersinia pestis KIM
auauuucuccccacuucauca

SEQ ID NO: 2333239 - RNA, 23 nt, Yersinia pestis KIM
auauuucuccccacuucaucauc

SEQ ID NO: 2333240 - RNA, 17 nt, Yersinia pestis KIM
auauuuuuauuaauaua

SEQ ID NO: 2333241 - RNA, 22 nt, Yersinia pestis KIM
auauuuuuauuaauauauuuaa

SEQ ID NO: 2333242 - RNA, 14 nt, Yersinia pestis KIM
aucaaaaaauaaau

SEQ ID NO: 2333243 - RNA, 18 nt, Yersinia pestis KIM
auauagggaaauaacauc

SEQ ID NO: 2333244 - RNA, 22 nt, Yersinia pestis KIM
auauaggccccaacccguggcc

SEQ ID NO: 2333245 - RNA, 22 nt, Yersinia pestis KIM
auauagcggcguucagcaauau

SEQ ID NO: 2333246 - RNA, 23 nt, Yersinia pestis KIM
auauagcgugcuacauagaaaau

SEQ ID NO: 2333247 - RNA, 17 nt, Yersinia pestis KIM
auauacagucaauugag

SEQ ID NO: 2333248 - RNA, 14 nt, Yersinia pestis KIM
auauacaaggcaca

SEQ ID NO: 2333249 - RNA, 17 nt, Yersinia pestis KIM
auauacaaggcacaucu

SEQ ID NO: 2333250 - RNA, 14 nt, Yersinia pestis KIM
auauacauauucac

SEQ ID NO: 2333251 - RNA, 23 nt, Yersinia pestis KIM
auauacauauucacuauagacuc

SEQ ID NO: 2333252 - RNA, 19 nt, Yersinia pestis KIM
auagugggucguggaguag

SEQ ID NO: 2333253 - RNA, 16 nt, Yersinia pestis KIM
auaguguaaaaaccau

SEQ ID NO: 2333254 - RNA, 14 nt, Yersinia pestis KIM
auaguguugcuaag

SEQ ID NO: 2333255 - RNA, 21 nt, Yersinia pestis KIM
auaguguuguucugauagaga

SEQ ID NO: 2333256 - RNA, 18 nt, Yersinia pestis KIM
auagucuccaaauucauu

SEQ ID NO: 2333257 - RNA, 16 nt, Yersinia pestis KIM
auagucggugucuucg

SEQ ID NO: 2333258 - RNA, 14 nt, Yersinia pestis KIM
auauaaccaucaaa

SEQ ID NO: 2333259 - RNA, 24 nt, Yersinia pestis KIM
auauaaccaucaaauacacauaac

SEQ ID NO: 2333260 - RNA, 22 nt, Yersinia pestis KIM
auauaacgaauauucaagagau

SEQ ID NO: 2333261 - RNA, 20 nt, Yersinia pestis KIM
auauaacaaguuacauuuuu

SEQ ID NO: 2333262 - RNA, 17 nt, Yersinia pestis KIM
auaguuacccacauuca

SEQ ID NO: 2333263 - RNA, 13 nt, Yersinia pestis KIM
auauaaauccagc

SEQ ID NO: 2333264 - RNA, 13 nt, Yersinia pestis KIM
auauaaauaaaau

SEQ ID NO: 2333265 - RNA, 22 nt, Yersinia pestis KIM
auauauacaauccaaccuauau

SEQ ID NO: 2333266 - RNA, 16 nt, Yersinia pestis KIM
auaucaacacugccug

SEQ ID NO: 2333267 - RNA, 14 nt, Yersinia pestis KIM
auaucaauaaccug

SEQ ID NO: 2333268 - RNA, 18 nt, Yersinia pestis KIM
auaucauuugcucgaaau

SEQ ID NO: 2333269 - RNA, 17 nt, Yersinia pestis KIM
auauccgccaaagauua

SEQ ID NO: 2333270 - RNA, 10 nt, Yersinia pestis KIM
auauccuccg

SEQ ID NO: 2333271 - RNA, 19 nt, Yersinia pestis KIM
auauccucaagaccgauuu

SEQ ID NO: 2333272 - RNA, 13 nt, Yersinia pestis KIM
auaucauuauuuu

SEQ ID NO: 2333273 - RNA, 14 nt, Yersinia pestis KIM
auaucagccagcuc

SEQ ID NO: 2333274 - RNA, 20 nt, Yersinia pestis KIM
auaucagccagcuccugcca

SEQ ID NO: 2333275 - RNA, 13 nt, Yersinia pestis KIM
auaucacuucugc

SEQ ID NO: 2333276 - RNA, 17 nt, Yersinia pestis KIM
auaucagaaacaauaaa

SEQ ID NO: 2333277 - RNA, 12 nt, Yersinia pestis KIM
auaucacuauuu

SEQ ID NO: 2333278 - RNA, 13 nt, Yersinia pestis KIM
auaucaccagguu

SEQ ID NO: 2333279 - RNA, 15 nt, Yersinia pestis KIM
auagcgcauccaacc

SEQ ID NO: 2333280 - RNA, 14 nt, Yersinia pestis KIM
auagcgccugcccu

SEQ ID NO: 2333281 - RNA, 15 nt, Yersinia pestis KIM
auagccgaagaaugu

SEQ ID NO: 2333282 - RNA, 13 nt, Yersinia pestis KIM
auagagcaccaaa

SEQ ID NO: 2333283 - RNA, 22 nt, Yersinia pestis KIM
auagagcuucgcgaucagacau

SEQ ID NO: 2333284 - RNA, 23 nt, Yersinia pestis KIM
auagccccauauaaaaaacuaau

SEQ ID NO: 2333285 - RNA, 20 nt, Yersinia pestis KIM
auagccccugacgcugacau

SEQ ID NO: 2333286 - RNA, 17 nt, Yersinia pestis KIM
auagaggaaauaaauga

SEQ ID NO: 2333287 - RNA, 13 nt, Yersinia pestis KIM
auaggauuuucau

SEQ ID NO: 2333288 - RNA, 13 nt, Yersinia pestis KIM
auaggcagaggag

SEQ ID NO: 2333289 - RNA, 17 nt, Yersinia pestis KIM
auaggcagaauagucac

SEQ ID NO: 2333290 - RNA, 20 nt, Yersinia pestis KIM
auagcggcguucagcaauau

SEQ ID NO: 2333291 - RNA, 20 nt, Yersinia pestis KIM
auagcugcugcuuucagugu

SEQ ID NO: 2333292 - RNA, 15 nt, Yersinia pestis KIM
auagcuggcuuucgc

SEQ ID NO: 2333293 - RNA, 20 nt, Yersinia pestis KIM
auagcuggcuucaaaaucac

SEQ ID NO: 2333294 - RNA, 18 nt, Yersinia pestis KIM
auagcuguaaaauaccaa

SEQ ID NO: 2333295 - RNA, 12 nt, Yersinia pestis KIM
auagcuucagga

SEQ ID NO: 2333296 - RNA, 13 nt, Yersinia pestis KIM
auagcuucccugg

SEQ ID NO: 2333297 - RNA, 17 nt, Yersinia pestis KIM
auaguacuuagcaauaa

SEQ ID NO: 2333298 - RNA, 20 nt, Yersinia pestis KIM
auaguacuugccacaacuga

SEQ ID NO: 2333299 - RNA, 13 nt, Yersinia pestis KIM
auaguaaaacagg

SEQ ID NO: 2333300 - RNA, 20 nt, Yersinia pestis KIM
auaguaauuuuuagccgcaa

SEQ ID NO: 2333301 - RNA, 18 nt, Yersinia pestis KIM
auagucacgucuucacca

SEQ ID NO: 2333302 - RNA, 14 nt, Yersinia pestis KIM
auaggcaggggagu

SEQ ID NO: 2333303 - RNA, 16 nt, Yersinia pestis KIM
auaggcucuguuuuac

SEQ ID NO: 2333304 - RNA, 20 nt, Yersinia pestis KIM
auagggcugaagacccaagg

SEQ ID NO: 2333305 - RNA, 15 nt, Yersinia pestis KIM
auagggaagguguuu

SEQ ID NO: 2333306 - RNA, 16 nt, Yersinia pestis KIM
auagggauuguuuuca

SEQ ID NO: 2333307 - RNA, 14 nt, Yersinia pestis KIM
auaggucauauaca

SEQ ID NO: 2333308 - RNA, 21 nt, Yersinia pestis KIM
auaccacccguugcauuuuuc

SEQ ID NO: 2333309 - RNA, 20 nt, Yersinia pestis KIM
auaccacaucaaaccggcua

SEQ ID NO: 2333310 - RNA, 13 nt, Yersinia pestis KIM
auaccacaucaaa

SEQ ID NO: 2333311 - RNA, 16 nt, Yersinia pestis KIM
auaccagaugcauaua

SEQ ID NO: 2333312 - RNA, 22 nt, Yersinia pestis KIM
auaccagagacgugcguuuuug

SEQ ID NO: 2333313 - RNA, 20 nt, Yersinia pestis KIM
auaccagcaagaaucccauc

SEQ ID NO: 2333314 - RNA, 21 nt, Yersinia pestis KIM
auaccagcguagguacuucuc

SEQ ID NO: 2333315 - RNA, 12 nt, Yersinia pestis KIM
auaccaaauuua

SEQ ID NO: 2333316 - RNA, 17 nt, Yersinia pestis KIM
auaccaaauuuaccgac

SEQ ID NO: 2333317 - RNA, 15 nt, Yersinia pestis KIM
auaccaaaaaucucu

SEQ ID NO: 2333318 - RNA, 14 nt, Yersinia pestis KIM
auacccaaaccaac

SEQ ID NO: 2333319 - RNA, 16 nt, Yersinia pestis KIM
auacccaacagguugg

SEQ ID NO: 2333320 - RNA, 13 nt, Yersinia pestis KIM
auaccauuuugcc

SEQ ID NO: 2333321 - RNA, 13 nt, Yersinia pestis KIM
auacccaaaauaa

SEQ ID NO: 2333322 - RNA, 14 nt, Yersinia pestis KIM
auacccaaaauaau

SEQ ID NO: 2333323 - RNA, 21 nt, Yersinia pestis KIM
auaccauguugaaucaauugc

SEQ ID NO: 2333324 - RNA, 20 nt, Yersinia pestis KIM
auaccaugccaucaauguuc

SEQ ID NO: 2333325 - RNA, 15 nt, Yersinia pestis KIM
auaccauaacgcugc

SEQ ID NO: 2333326 - RNA, 13 nt, Yersinia pestis KIM
auacaucacguua

SEQ ID NO: 2333327 - RNA, 20 nt, Yersinia pestis KIM
auacaucaagcuacaugugc

SEQ ID NO: 2333328 - RNA, 23 nt, Yersinia pestis KIM
auacaucaauggguuugcgggca

SEQ ID NO: 2333329 - RNA, 20 nt, Yersinia pestis KIM
auacaucaaaucagaggcuu

SEQ ID NO: 2333330 - RNA, 18 nt, Yersinia pestis KIM
auacaucuuacugauauc

SEQ ID NO: 2333331 - RNA, 19 nt, Yersinia pestis KIM
auacaucuuacugauaucu

SEQ ID NO: 2333332 - RNA, 16 nt, Yersinia pestis KIM
auacauccuaaauaau

SEQ ID NO: 2333333 - RNA, 17 nt, Yersinia pestis KIM
auacauccuaaauaauu

SEQ ID NO: 2333334 - RNA, 15 nt, Yersinia pestis KIM
auacauaauaaugau

SEQ ID NO: 2333335 - RNA, 15 nt, Yersinia pestis KIM
auacaguuccuguuu

SEQ ID NO: 2333336 - RNA, 23 nt, Yersinia pestis KIM
auacaguggcgagcgcaggguca

SEQ ID NO: 2333337 - RNA, 20 nt, Yersinia pestis KIM
auacagucaauugagaauaa

SEQ ID NO: 2333338 - RNA, 17 nt, Yersinia pestis KIM
auacagucaauugagaa

SEQ ID NO: 2333339 - RNA, 20 nt, Yersinia pestis KIM
auacaguuuuuucucaauga

SEQ ID NO: 2333340 - RNA, 13 nt, Yersinia pestis KIM
auaauucagcauc

SEQ ID NO: 2333341 - RNA, 19 nt, Yersinia pestis KIM
auaauucacgucgccggug

SEQ ID NO: 2333342 - RNA, 15 nt, Yersinia pestis KIM
auaauuauuucucug

SEQ ID NO: 2333343 - RNA, 15 nt, Yersinia pestis KIM
auaauucauaugaca

SEQ ID NO: 2333344 - RNA, 21 nt, Yersinia pestis KIM
auaauucauuuuuugggauga

SEQ ID NO: 2333345 - RNA, 14 nt, Yersinia pestis KIM
auaauuccacauaa

SEQ ID NO: 2333346 - RNA, 16 nt, Yersinia pestis KIM
auacagguacuucaaa

SEQ ID NO: 2333347 - RNA, 23 nt, Yersinia pestis KIM
auacuuaacaaucagugcaauaa

SEQ ID NO: 2333348 - RNA, 15 nt, Yersinia pestis KIM
auacuuaacaaucag

SEQ ID NO: 2333349 - RNA, 15 nt, Yersinia pestis KIM
auagaagcucauaug

SEQ ID NO: 2333350 - RNA, 16 nt, Yersinia pestis KIM
auagaacggcagugau

SEQ ID NO: 2333351 - RNA, 16 nt, Yersinia pestis KIM
auagacgaauggccgc

SEQ ID NO: 2333352 - RNA, 17 nt, Yersinia pestis KIM
auagacauauuguccaa

SEQ ID NO: 2333353 - RNA, 18 nt, Yersinia pestis KIM
auagacaccuucccuauu

SEQ ID NO: 2333354 - RNA, 18 nt, Yersinia pestis KIM
auagaaggcggagaaugu

SEQ ID NO: 2333355 - RNA, 16 nt, Yersinia pestis KIM
auagaauucauucaga

SEQ ID NO: 2333356 - RNA, 21 nt, Yersinia pestis KIM
auacgugccaaaaugccuacc

SEQ ID NO: 2333357 - RNA, 20 nt, Yersinia pestis KIM
auacgguccagcaucgcuga

SEQ ID NO: 2333358 - RNA, 18 nt, Yersinia pestis KIM
auacgguucaaaucaguu

SEQ ID NO: 2333359 - RNA, 21 nt, Yersinia pestis KIM
auacggcaccaauggcuaaau

SEQ ID NO: 2333360 - RNA, 13 nt, Yersinia pestis KIM
auaccuacccuuu

SEQ ID NO: 2333361 - RNA, 15 nt, Yersinia pestis KIM
auaccgacaucaaca

SEQ ID NO: 2333362 - RNA, 16 nt, Yersinia pestis KIM
auaccggucauauuua

SEQ ID NO: 2333363 - RNA, 12 nt, Yersinia pestis KIM
auacuaaagaaa

SEQ ID NO: 2333364 - RNA, 15 nt, Yersinia pestis KIM
auacuaaagaaauaa

SEQ ID NO: 2333365 - RNA, 19 nt, Yersinia pestis KIM
auacuaaagaaauaaucau

SEQ ID NO: 2333366 - RNA, 21 nt, Yersinia pestis KIM
auacuaauagaagagaggcaa

SEQ ID NO: 2333367 - RNA, 13 nt, Yersinia pestis KIM
auacguugcaggu

SEQ ID NO: 2333368 - RNA, 14 nt, Yersinia pestis KIM
auacguuaccccuc

SEQ ID NO: 2333369 - RNA, 13 nt, Yersinia pestis KIM
auacuaaaacagc

SEQ ID NO: 2333370 - RNA, 22 nt, Yersinia pestis KIM
auacucuuccaacgcuucacca

SEQ ID NO: 2333371 - RNA, 23 nt, Yersinia pestis KIM
auacugacauucuggcuuuucau

SEQ ID NO: 2333372 - RNA, 19 nt, Yersinia pestis KIM
aucuugaaccaauuuuucu

SEQ ID NO: 2333373 - RNA, 17 nt, Yersinia pestis KIM
aucuugaaccaauuuuu

SEQ ID NO: 2333374 - RNA, 19 nt, Yersinia pestis KIM
aucuugaacggugaggaua

SEQ ID NO: 2333375 - RNA, 18 nt, Yersinia pestis KIM
aucuugauuagcuggcug

SEQ ID NO: 2333376 - RNA, 19 nt, Yersinia pestis KIM
aucuugauuagcuggcugu

SEQ ID NO: 2333377 - RNA, 20 nt, Yersinia pestis KIM
aucuugcagcgaucacagau

SEQ ID NO: 2333378 - RNA, 22 nt, Yersinia pestis KIM
aucuugauaaacaugccacuuc

SEQ ID NO: 2333379 - RNA, 19 nt, Yersinia pestis KIM
aucuugcugaaaacaauau

SEQ ID NO: 2333380 - RNA, 18 nt, Yersinia pestis KIM
aucuucucguaauuauug

SEQ ID NO: 2333381 - RNA, 14 nt, Yersinia pestis KIM
aucuucugccagcc

SEQ ID NO: 2333382 - RNA, 21 nt, Yersinia pestis KIM
aucugugucaguaccugaugu

SEQ ID NO: 2333383 - RNA, 14 nt, Yersinia pestis KIM
aucuuguaguaacc

SEQ ID NO: 2333384 - RNA, 23 nt, Yersinia pestis KIM
aucuuguaaauagucauauauuu

SEQ ID NO: 2333385 - RNA, 23 nt, Yersinia pestis KIM
aucuugucauuaccaaugguuuc

SEQ ID NO: 2333386 - RNA, 16 nt, Yersinia pestis KIM
aucuuguucuaauaau

SEQ ID NO: 2333387 - RNA, 22 nt, Yersinia pestis KIM
aucuuuaacaacaaccaagcuu

SEQ ID NO: 2333388 - RNA, 19 nt, Yersinia pestis KIM
aucuuuaauaaauuuucua

SEQ ID NO: 2333389 - RNA, 16 nt, Yersinia pestis KIM
aucuuuaauaauagau

SEQ ID NO: 2333390 - RNA, 20 nt, Yersinia pestis KIM
aucuuuaauauugcauuuua

SEQ ID NO: 2333391 - RNA, 17 nt, Yersinia pestis KIM
aucuuuaauuuucugac

SEQ ID NO: 2333392 - RNA, 13 nt, Yersinia pestis KIM
aucuuuuuguaau

SEQ ID NO: 2333393 - RNA, 16 nt, Yersinia pestis KIM
aucuuuucugauuuuu

SEQ ID NO: 2333394 - RNA, 18 nt, Yersinia pestis KIM
aucuuuucugauuuuuua

SEQ ID NO: 2333395 - RNA, 20 nt, Yersinia pestis KIM
aucuuuucugauuuuuuacu

SEQ ID NO: 2333396 - RNA, 22 nt, Yersinia pestis KIM
aucuuucuccaguaaaagaaua

SEQ ID NO: 2333397 - RNA, 19 nt, Yersinia pestis KIM
augaagcacaaaaagaguc

SEQ ID NO: 2333398 - RNA, 15 nt, Yersinia pestis KIM
augaauauuauucag

SEQ ID NO: 2333399 - RNA, 16 nt, Yersinia pestis KIM
augaauauuuucauuu

SEQ ID NO: 2333400 - RNA, 17 nt, Yersinia pestis KIM
augaauggaaguuaaaa

SEQ ID NO: 2333401 - RNA, 21 nt, Yersinia pestis KIM
augaauggaaguuaaaaaaau

SEQ ID NO: 2333402 - RNA, 13 nt, Yersinia pestis KIM
augaauuaaagau

SEQ ID NO: 2333403 - RNA, 23 nt, Yersinia pestis KIM
aucuuuuuuuuuauuaucaucuu

SEQ ID NO: 2333404 - RNA, 23 nt, Yersinia pestis KIM
augaaaaacugugcaaauggcuu

SEQ ID NO: 2333405 - RNA, 12 nt, Yersinia pestis KIM
augaaaaacaga

SEQ ID NO: 2333406 - RNA, 16 nt, Yersinia pestis KIM
augaccgauuauauga

SEQ ID NO: 2333407 - RNA, 17 nt, Yersinia pestis KIM
augaccauuuauuucca

SEQ ID NO: 2333408 - RNA, 18 nt, Yersinia pestis KIM
augaccgugacauuuuca

SEQ ID NO: 2333409 - RNA, 14 nt, Yersinia pestis KIM
augaccuggaagaa

SEQ ID NO: 2333410 - RNA, 15 nt, Yersinia pestis KIM
augaccaauagucac

SEQ ID NO: 2333411 - RNA, 14 nt, Yersinia pestis KIM
augaccaaaggcua

SEQ ID NO: 2333412 - RNA, 17 nt, Yersinia pestis KIM
augaccaagguuauaca

SEQ ID NO: 2333413 - RNA, 19 nt, Yersinia pestis KIM
augacaaguugucuguaau

SEQ ID NO: 2333414 - RNA, 13 nt, Yersinia pestis KIM
augacaauauccg

SEQ ID NO: 2333415 - RNA, 15 nt, Yersinia pestis KIM
augacaagucaugau

SEQ ID NO: 2333416 - RNA, 22 nt, Yersinia pestis KIM
augacacauauuucaggcuguu

SEQ ID NO: 2333417 - RNA, 16 nt, Yersinia pestis KIM
augacaccuuucaaaa

SEQ ID NO: 2333418 - RNA, 17 nt, Yersinia pestis KIM
augacgcgaucuugaac

SEQ ID NO: 2333419 - RNA, 20 nt, Yersinia pestis KIM
augacgggugccgcgucuga

SEQ ID NO: 2333420 - RNA, 15 nt, Yersinia pestis KIM
augacggugcccaca

SEQ ID NO: 2333421 - RNA, 18 nt, Yersinia pestis KIM
augacgguugcugggauc

SEQ ID NO: 2333422 - RNA, 16 nt, Yersinia pestis KIM
augacuuuuuuuaugg

SEQ ID NO: 2333423 - RNA, 19 nt, Yersinia pestis KIM
augacgcgaucugaaacgg

SEQ ID NO: 2333424 - RNA, 19 nt, Yersinia pestis KIM
augacgccaacuucaagcc

SEQ ID NO: 2333425 - RNA, 13 nt, Yersinia pestis KIM
augacgagaucau

SEQ ID NO: 2333426 - RNA, 13 nt, Yersinia pestis KIM
augagaaguaaaa

SEQ ID NO: 2333427 - RNA, 22 nt, Yersinia pestis KIM
augagauccugaaaauagagca

SEQ ID NO: 2333428 - RNA, 15 nt, Yersinia pestis KIM
aucugcauugauuaa

SEQ ID NO: 2333429 - RNA, 20 nt, Yersinia pestis KIM
aucugccaacuggccgccau

SEQ ID NO: 2333430 - RNA, 18 nt, Yersinia pestis KIM
aucugccaccgcacaguu

SEQ ID NO: 2333431 - RNA, 14 nt, Yersinia pestis KIM
aucugccaccgcuc

SEQ ID NO: 2333432 - RNA, 19 nt, Yersinia pestis KIM
aucugccaccgcuccuuuc

SEQ ID NO: 2333433 - RNA, 22 nt, Yersinia pestis KIM
aucugcccagccugguuuuuua

SEQ ID NO: 2333434 - RNA, 22 nt, Yersinia pestis KIM
aucugccccaaccgaccacaaa

SEQ ID NO: 2333435 - RNA, 23 nt, Yersinia pestis KIM
aucugcuucuccuguaaugcauu

SEQ ID NO: 2333436 - RNA, 13 nt, Yersinia pestis KIM
aucuggaauuuau

SEQ ID NO: 2333437 - RNA, 22 nt, Yersinia pestis KIM
aucugcauaccuggaucacgau

SEQ ID NO: 2333438 - RNA, 21 nt, Yersinia pestis KIM
aucugauuugggaacaacagc

SEQ ID NO: 2333439 - RNA, 13 nt, Yersinia pestis KIM
aucugcaauggcu

SEQ ID NO: 2333440 - RNA, 18 nt, Yersinia pestis KIM
aucugcaacuucagccac

SEQ ID NO: 2333441 - RNA, 21 nt, Yersinia pestis KIM
aucugcaacuucagccaccag

SEQ ID NO: 2333442 - RNA, 14 nt, Yersinia pestis KIM
aucugaucaaucuc

SEQ ID NO: 2333443 - RNA, 15 nt, Yersinia pestis KIM
aucugauacugaacg

SEQ ID NO: 2333444 - RNA, 18 nt, Yersinia pestis KIM
aucugauaucucuuuauc

SEQ ID NO: 2333445 - RNA, 16 nt, Yersinia pestis KIM
aucugauaucucuuua

SEQ ID NO: 2333446 - RNA, 19 nt, Yersinia pestis KIM
aucuccaguugcacaccau

SEQ ID NO: 2333447 - RNA, 18 nt, Yersinia pestis KIM
aucuccgcucuccuuuuc

SEQ ID NO: 2333448 - RNA, 13 nt, Yersinia pestis KIM
aucuccggacagg

SEQ ID NO: 2333449 - RNA, 19 nt, Yersinia pestis KIM
aucuauuuuuuugaaauuc

SEQ ID NO: 2333450 - RNA, 15 nt, Yersinia pestis KIM
aucuauuuuuuugaa

SEQ ID NO: 2333451 - RNA, 17 nt, Yersinia pestis KIM
aucuauuuccaucaaag

SEQ ID NO: 2333452 - RNA, 16 nt, Yersinia pestis KIM
aucuauuuccaucaaa

SEQ ID NO: 2333453 - RNA, 17 nt, Yersinia pestis KIM
aucuauugugucaauac

SEQ ID NO: 2333454 - RNA, 15 nt, Yersinia pestis KIM
aucucuccagccugc

SEQ ID NO: 2333455 - RNA, 20 nt, Yersinia pestis KIM
aucucuccagugcaaauuua

SEQ ID NO: 2333456 - RNA, 17 nt, Yersinia pestis KIM
aucucuuccgacaggcu

SEQ ID NO: 2333457 - RNA, 14 nt, Yersinia pestis KIM
aucucguugcccug

SEQ ID NO: 2333458 - RNA, 16 nt, Yersinia pestis KIM
aucucggcuuucaggu

SEQ ID NO: 2333459 - RNA, 19 nt, Yersinia pestis KIM
aucggcaaaccgaauacca

SEQ ID NO: 2333460 - RNA, 15 nt, Yersinia pestis KIM
aucggcaaaaacagu

SEQ ID NO: 2333461 - RNA, 17 nt, Yersinia pestis KIM
aucgucgaacauuuucu

SEQ ID NO: 2333462 - RNA, 19 nt, Yersinia pestis KIM
aucguguggagaacucauu

SEQ ID NO: 2333463 - RNA, 17 nt, Yersinia pestis KIM
aucgugcuccgcuucca

SEQ ID NO: 2333464 - RNA, 19 nt, Yersinia pestis KIM
aucgugcaguaauggaaau

SEQ ID NO: 2333465 - RNA, 19 nt, Yersinia pestis KIM
aucguggcgcgcaucuaac

SEQ ID NO: 2333466 - RNA, 15 nt, Yersinia pestis KIM
aucgugggcgcagaa

SEQ ID NO: 2333467 - RNA, 19 nt, Yersinia pestis KIM
aucuaaacaauugccuuug

SEQ ID NO: 2333468 - RNA, 17 nt, Yersinia pestis KIM
aucuaaacaauugccuu

SEQ ID NO: 2333469 - RNA, 19 nt, Yersinia pestis KIM
aucguugcggguuaacucu

SEQ ID NO: 2333470 - RNA, 21 nt, Yersinia pestis KIM
aucguugugggguuuuuuaau

SEQ ID NO: 2333471 - RNA, 15 nt, Yersinia pestis KIM
aucguugcaggauaa

SEQ ID NO: 2333472 - RNA, 17 nt, Yersinia pestis KIM
aucuauuagaugugaaa

SEQ ID NO: 2333473 - RNA, 13 nt, Yersinia pestis KIM
aucuauuaauauc

SEQ ID NO: 2333474 - RNA, 14 nt, Yersinia pestis KIM
aucuaugcuaucca

SEQ ID NO: 2333475 - RNA, 16 nt, Yersinia pestis KIM
aucuaugcuauccaga

SEQ ID NO: 2333476 - RNA, 21 nt, Yersinia pestis KIM
aucuauugauugcuuaccacu

SEQ ID NO: 2333477 - RNA, 18 nt, Yersinia pestis KIM
aucuacuuuauucaauac

SEQ ID NO: 2333478 - RNA, 12 nt, Yersinia pestis KIM
aucuacugggcc

SEQ ID NO: 2333479 - RNA, 16 nt, Yersinia pestis KIM
aucuaauuuauaaccu

SEQ ID NO: 2333480 - RNA, 21 nt, Yersinia pestis KIM
aucuaauagaauagaucccau

SEQ ID NO: 2333481 - RNA, 22 nt, Yersinia pestis KIM
aucuaaugacuacuaaucaauc

SEQ ID NO: 2333482 - RNA, 17 nt, Yersinia pestis KIM
auccgggaaaaaauacg

SEQ ID NO: 2333483 - RNA, 13 nt, Yersinia pestis KIM
aucccgagacacu

SEQ ID NO: 2333484 - RNA, 20 nt, Yersinia pestis KIM
auccccuuugacagcaucug

SEQ ID NO: 2333485 - RNA, 22 nt, Yersinia pestis KIM
auccuaucguuuauuacuacaa

SEQ ID NO: 2333486 - RNA, 14 nt, Yersinia pestis KIM
auccuacaauaucu

SEQ ID NO: 2333487 - RNA, 13 nt, Yersinia pestis KIM
auccuaagaauua

SEQ ID NO: 2333488 - RNA, 15 nt, Yersinia pestis KIM
auccguuugcaacau

SEQ ID NO: 2333489 - RNA, 18 nt, Yersinia pestis KIM
auccguuaacccaaagcc

SEQ ID NO: 2333490 - RNA, 15 nt, Yersinia pestis KIM
auccguaaaaaaccu

SEQ ID NO: 2333491 - RNA, 17 nt, Yersinia pestis KIM
auccgucguucucuauu

SEQ ID NO: 2333492 - RNA, 21 nt, Yersinia pestis KIM
auccguacuuuucgccgcuuc

SEQ ID NO: 2333493 - RNA, 19 nt, Yersinia pestis KIM
auccucggguuuuauaccg

SEQ ID NO: 2333494 - RNA, 18 nt, Yersinia pestis KIM
auccucgucguaauauuu

SEQ ID NO: 2333495 - RNA, 21 nt, Yersinia pestis KIM
auccugaauaauacugucaaa

SEQ ID NO: 2333496 - RNA, 13 nt, Yersinia pestis KIM
auccuauuuuuac

SEQ ID NO: 2333497 - RNA, 15 nt, Yersinia pestis KIM
auccucgagauguau

SEQ ID NO: 2333498 - RNA, 16 nt, Yersinia pestis KIM
auccuuacuuugcgau

SEQ ID NO: 2333499 - RNA, 21 nt, Yersinia pestis KIM
auccuuaaagaaauaaauauc

SEQ ID NO: 2333500 - RNA, 16 nt, Yersinia pestis KIM
auccugaugagucuau

SEQ ID NO: 2333501 - RNA, 19 nt, Yersinia pestis KIM
auccuuuuuauuuaagcag

SEQ ID NO: 2333502 - RNA, 16 nt, Yersinia pestis KIM
auccuuuggauuuaau

SEQ ID NO: 2333503 - RNA, 17 nt, Yersinia pestis KIM
auccuuuagcgcugcau

SEQ ID NO: 2333504 - RNA, 17 nt, Yersinia pestis KIM
aucgccgccgccagccc

SEQ ID NO: 2333505 - RNA, 18 nt, Yersinia pestis KIM
aucgccguacuuggucac

SEQ ID NO: 2333506 - RNA, 19 nt, Yersinia pestis KIM
aucgccuaccaucaaaaua

SEQ ID NO: 2333507 - RNA, 20 nt, Yersinia pestis KIM
aucgccuaccaucaaaauau

SEQ ID NO: 2333508 - RNA, 15 nt, Yersinia pestis KIM
aucgcugacaauuua

SEQ ID NO: 2333509 - RNA, 15 nt, Yersinia pestis KIM
aucgcugccgcaaga

SEQ ID NO: 2333510 - RNA, 14 nt, Yersinia pestis KIM
aucgcgucuuuacg

SEQ ID NO: 2333511 - RNA, 14 nt, Yersinia pestis KIM
aucgcgguaaacac

SEQ ID NO: 2333512 - RNA, 22 nt, Yersinia pestis KIM
aucgcgaccagcagaauaauca

SEQ ID NO: 2333513 - RNA, 16 nt, Yersinia pestis KIM
aucgcaguaauagaaa

SEQ ID NO: 2333514 - RNA, 16 nt, Yersinia pestis KIM
aucgcagcgacauaaa

SEQ ID NO: 2333515 - RNA, 19 nt, Yersinia pestis KIM
aucgcaggcuuugguuuug

SEQ ID NO: 2333516 - RNA, 16 nt, Yersinia pestis KIM
aucgccaguguugcca

SEQ ID NO: 2333517 - RNA, 19 nt, Yersinia pestis KIM
aucgccauagccgaucacc

SEQ ID NO: 2333518 - RNA, 22 nt, Yersinia pestis KIM
aucgccauagccgaucaccgca

SEQ ID NO: 2333519 - RNA, 20 nt, Yersinia pestis KIM
aucgccagugaguccuuuac

SEQ ID NO: 2333520 - RNA, 17 nt, Yersinia pestis KIM
aucgcacguugcagaug

SEQ ID NO: 2333521 - RNA, 21 nt, Yersinia pestis KIM
aucgaucucuuuauauucaau

SEQ ID NO: 2333522 - RNA, 14 nt, Yersinia pestis KIM
aucgauugauauau

SEQ ID NO: 2333523 - RNA, 23 nt, Yersinia pestis KIM
aucgauugauauauagaaauaag

SEQ ID NO: 2333524 - RNA, 23 nt, Yersinia pestis KIM
aucgauuccgcgagcaauaccaa

SEQ ID NO: 2333525 - RNA, 18 nt, Yersinia pestis KIM
aucgagaguugcucaccc

SEQ ID NO: 2333526 - RNA, 11 nt, Yersinia pestis KIM
aucgaaacacc

SEQ ID NO: 2333527 - RNA, 15 nt, Yersinia pestis KIM
auccaaaugacacuu

SEQ ID NO: 2333528 - RNA, 21 nt, Yersinia pestis KIM
auccaacguaaacauuggcuu

SEQ ID NO: 2333529 - RNA, 21 nt, Yersinia pestis KIM
aucauuggcaacuuaagcauu

SEQ ID NO: 2333530 - RNA, 14 nt, Yersinia pestis KIM
auccacauaaaaag

SEQ ID NO: 2333531 - RNA, 22 nt, Yersinia pestis KIM
auccacgcaggcaaucagaaug

SEQ ID NO: 2333532 - RNA, 17 nt, Yersinia pestis KIM
auccacaaugaucaaac

SEQ ID NO: 2333533 - RNA, 19 nt, Yersinia pestis KIM
auccacacagcauucugcu

SEQ ID NO: 2333534 - RNA, 23 nt, Yersinia pestis KIM
auccaacuuaccuugauccgcca

SEQ ID NO: 2333535 - RNA, 15 nt, Yersinia pestis KIM
auccagauauuuuac

SEQ ID NO: 2333536 - RNA, 13 nt, Yersinia pestis KIM
auccagauucaga

SEQ ID NO: 2333537 - RNA, 18 nt, Yersinia pestis KIM
auccagauccucaucacu

SEQ ID NO: 2333538 - RNA, 20 nt, Yersinia pestis KIM
auccagcaccacaauggcag

SEQ ID NO: 2333539 - RNA, 12 nt, Yersinia pestis KIM
auccauauuaaa

SEQ ID NO: 2333540 - RNA, 21 nt, Yersinia pestis KIM
auccauagugauuauuuaaac

SEQ ID NO: 2333541 - RNA, 18 nt, Yersinia pestis KIM
auccauacgaauuuuucc

SEQ ID NO: 2333542 - RNA, 23 nt, Yersinia pestis KIM
auccaguugcccggaguuugaga

SEQ ID NO: 2333543 - RNA, 20 nt, Yersinia pestis KIM
auccaguucgaccaauucac

SEQ ID NO: 2333544 - RNA, 20 nt, Yersinia pestis KIM
auccagugucaugcgcagaa

SEQ ID NO: 2333545 - RNA, 17 nt, Yersinia pestis KIM
auccaguauuucaguaa

SEQ ID NO: 2333546 - RNA, 21 nt, Yersinia pestis KIM
auccauccccgccucaaugca

SEQ ID NO: 2333547 - RNA, 16 nt, Yersinia pestis KIM
auccaucugauaaguu

SEQ ID NO: 2333548 - RNA, 12 nt, Yersinia pestis KIM
aucccaauauug

SEQ ID NO: 2333549 - RNA, 13 nt, Yersinia pestis KIM
auccauguauauu

SEQ ID NO: 2333550 - RNA, 15 nt, Yersinia pestis KIM
auccaugggccucgc

SEQ ID NO: 2333551 - RNA, 15 nt, Yersinia pestis KIM
auccccaccaacaca

SEQ ID NO: 2333552 - RNA, 16 nt, Yersinia pestis KIM
aucccacgcagauacu

SEQ ID NO: 2333553 - RNA, 14 nt, Yersinia pestis KIM
aucccaaucaucau

SEQ ID NO: 2333554 - RNA, 23 nt, Yersinia pestis KIM
aucauugacgugcaggcccagca

SEQ ID NO: 2333555 - RNA, 23 nt, Yersinia pestis KIM
aucauugccacgacgcagcucca

SEQ ID NO: 2333556 - RNA, 18 nt, Yersinia pestis KIM
aucauucgguuauuuaga

SEQ ID NO: 2333557 - RNA, 18 nt, Yersinia pestis KIM
aaaacugugcaaauggcu

SEQ ID NO: 2333558 - RNA, 16 nt, Yersinia pestis KIM
aaaacugugccugaau

SEQ ID NO: 2333559 - RNA, 23 nt, Yersinia pestis KIM
aaaacugugcgaauggaaaaacg

SEQ ID NO: 2333560 - RNA, 14 nt, Yersinia pestis KIM
aaaacuggucagcc

SEQ ID NO: 2333561 - RNA, 16 nt, Yersinia pestis KIM
aaaacugauuaauagu

SEQ ID NO: 2333562 - RNA, 15 nt, Yersinia pestis KIM
aucaugcucugcuaa

SEQ ID NO: 2333563 - RNA, 19 nt, Yersinia pestis KIM
aucaugcucaaucugcaau

SEQ ID NO: 2333564 - RNA, 17 nt, Yersinia pestis KIM
aucaugcgggauuacuc

SEQ ID NO: 2333565 - RNA, 18 nt, Yersinia pestis KIM
aucauggaagaccagaua

SEQ ID NO: 2333566 - RNA, 14 nt, Yersinia pestis KIM
aucaugggccaauc

SEQ ID NO: 2333567 - RNA, 21 nt, Yersinia pestis KIM
aucauggcuugugcagcaaua

SEQ ID NO: 2333568 - RNA, 17 nt, Yersinia pestis KIM
aucaugggccaauccaa

SEQ ID NO: 2333569 - RNA, 20 nt, Yersinia pestis KIM
aaaacugauauaaagcauuu

SEQ ID NO: 2333570 - RNA, 17 nt, Yersinia pestis KIM
aaaacugaagcaucaau

SEQ ID NO: 2333571 - RNA, 23 nt, Yersinia pestis KIM
aaaacucgcgccugaaaucauuu

SEQ ID NO: 2333572 - RNA, 23 nt, Yersinia pestis KIM
aucauguaaggcaauaccaauau

SEQ ID NO: 2333573 - RNA, 18 nt, Yersinia pestis KIM
aucauguaacacacagca

SEQ ID NO: 2333574 - RNA, 17 nt, Yersinia pestis KIM
aucaugguucugcucaa

SEQ ID NO: 2333575 - RNA, 18 nt, Yersinia pestis KIM
aaaacucgcgccugaaau

SEQ ID NO: 2333576 - RNA, 20 nt, Yersinia pestis KIM
aucaucugcgguaaccaaua

SEQ ID NO: 2333577 - RNA, 14 nt, Yersinia pestis KIM
aucaucuacaacau

SEQ ID NO: 2333578 - RNA, 21 nt, Yersinia pestis KIM
aucaucugguuuuuuuauaaa

SEQ ID NO: 2333579 - RNA, 22 nt, Yersinia pestis KIM
aucaugaacggauacccagcac

SEQ ID NO: 2333580 - RNA, 21 nt, Yersinia pestis KIM
aucaugaacggauacccagca

SEQ ID NO: 2333581 - RNA, 16 nt, Yersinia pestis KIM
aucaugagauaaauau

SEQ ID NO: 2333582 - RNA, 20 nt, Yersinia pestis KIM
aucauaaugguaccggcacc

SEQ ID NO: 2333583 - RNA, 16 nt, Yersinia pestis KIM
aaaacgugaauauccu

SEQ ID NO: 2333584 - RNA, 17 nt, Yersinia pestis KIM
aaaacgugaauauccug

SEQ ID NO: 2333585 - RNA, 15 nt, Yersinia pestis KIM
aaaacucaaauagau

SEQ ID NO: 2333586 - RNA, 15 nt, Yersinia pestis KIM
aaaacucaaagauuu

SEQ ID NO: 2333587 - RNA, 17 nt, Yersinia pestis KIM
aucaucgggcauucacu

SEQ ID NO: 2333588 - RNA, 19 nt, Yersinia pestis KIM
aucaucgggcauucacugc

SEQ ID NO: 2333589 - RNA, 18 nt, Yersinia pestis KIM
aucaucgcucaucgccaa

SEQ ID NO: 2333590 - RNA, 19 nt, Yersinia pestis KIM
aucaucgcugacaauuuac

SEQ ID NO: 2333591 - RNA, 15 nt, Yersinia pestis KIM
aaaacuauucugcuu

SEQ ID NO: 2333592 - RNA, 16 nt, Yersinia pestis KIM
auaaaugucgcuaaua

SEQ ID NO: 2333593 - RNA, 21 nt, Yersinia pestis KIM
auaaaugucgcuaauaggccu

SEQ ID NO: 2333594 - RNA, 18 nt, Yersinia pestis KIM
auaaauggucaguuuaau

SEQ ID NO: 2333595 - RNA, 14 nt, Yersinia pestis KIM
auaaauuaaaaaga

SEQ ID NO: 2333596 - RNA, 12 nt, Yersinia pestis KIM
auaaauuaaaac

SEQ ID NO: 2333597 - RNA, 15 nt, Yersinia pestis KIM
auaaauuaaaacuga

SEQ ID NO: 2333598 - RNA, 21 nt, Yersinia pestis KIM
auaaaugacuaucccuucaau

SEQ ID NO: 2333599 - RNA, 14 nt, Yersinia pestis KIM
auaaaugcaauauu

SEQ ID NO: 2333600 - RNA, 23 nt, Yersinia pestis KIM
auaaauuaucugaauagcgcugc

SEQ ID NO: 2333601 - RNA, 22 nt, Yersinia pestis KIM
auaaauuacucguauaaaaaau

SEQ ID NO: 2333602 - RNA, 15 nt, Yersinia pestis KIM
auaaauuauaaugau

SEQ ID NO: 2333603 - RNA, 16 nt, Yersinia pestis KIM
auaaauuauaaugaug

SEQ ID NO: 2333604 - RNA, 18 nt, Yersinia pestis KIM
auaaauugcacacccaua

SEQ ID NO: 2333605 - RNA, 20 nt, Yersinia pestis KIM
auaaauugcacacccauaca

SEQ ID NO: 2333606 - RNA, 21 nt, Yersinia pestis KIM
auaaauucgauaaaaggcuau

SEQ ID NO: 2333607 - RNA, 16 nt, Yersinia pestis KIM
auaaauaaaauaauaa

SEQ ID NO: 2333608 - RNA, 14 nt, Yersinia pestis KIM
auaaauaaaauaau

SEQ ID NO: 2333609 - RNA, 15 nt, Yersinia pestis KIM
auaaaguuuuuccuc

SEQ ID NO: 2333610 - RNA, 18 nt, Yersinia pestis KIM
auaaaggcuguaaugacu

SEQ ID NO: 2333611 - RNA, 20 nt, Yersinia pestis KIM
auaaauauucauuaaaaaau

SEQ ID NO: 2333612 - RNA, 20 nt, Yersinia pestis KIM
auaaaugaccaacuguaaaa

SEQ ID NO: 2333613 - RNA, 23 nt, Yersinia pestis KIM
auaaacauuuacuuauaaacacu

SEQ ID NO: 2333614 - RNA, 18 nt, Yersinia pestis KIM
auaaacgcgaguuaggaa

SEQ ID NO: 2333615 - RNA, 19 nt, Yersinia pestis KIM
auaaacgcuuuugcugcaa

SEQ ID NO: 2333616 - RNA, 15 nt, Yersinia pestis KIM
auaaacagacuaaaa

SEQ ID NO: 2333617 - RNA, 21 nt, Yersinia pestis KIM
auaaacaucaugagauaaaua

SEQ ID NO: 2333618 - RNA, 16 nt, Yersinia pestis KIM
auaaaggcaaaagcau

SEQ ID NO: 2333619 - RNA, 17 nt, Yersinia pestis KIM
auaaaggcaaaagcauc

SEQ ID NO: 2333620 - RNA, 15 nt, Yersinia pestis KIM
auaaagauaauguga

SEQ ID NO: 2333621 - RNA, 16 nt, Yersinia pestis KIM
auaaacuucacaaugc

SEQ ID NO: 2333622 - RNA, 13 nt, Yersinia pestis KIM
auaaacuucgaua

SEQ ID NO: 2333623 - RNA, 17 nt, Yersinia pestis KIM
auaaacugugcccuuga

SEQ ID NO: 2333624 - RNA, 21 nt, Yersinia pestis KIM
auaaacugugcccuugagcua

SEQ ID NO: 2333625 - RNA, 19 nt, Yersinia pestis KIM
auaaacugacucacgucag

SEQ ID NO: 2333626 - RNA, 16 nt, Yersinia pestis KIM
auaaacugaaguuaaa

SEQ ID NO: 2333627 - RNA, 18 nt, Yersinia pestis KIM
auaaacugaaguuaaaaa

SEQ ID NO: 2333628 - RNA, 12 nt, Yersinia pestis KIM
auaaagaaugcg

SEQ ID NO: 2333629 - RNA, 12 nt, Yersinia pestis KIM
auaaagaaaaga

SEQ ID NO: 2333630 - RNA, 22 nt, Yersinia pestis KIM
aguuuucccugcgccagcagca

SEQ ID NO: 2333631 - RNA, 17 nt, Yersinia pestis KIM
aguuggugcuuuggaac

SEQ ID NO: 2333632 - RNA, 17 nt, Yersinia pestis KIM
aguugguaaaauauuuu

SEQ ID NO: 2333633 - RNA, 22 nt, Yersinia pestis KIM
aguugggaaucgguuucagcuu

SEQ ID NO: 2333634 - RNA, 14 nt, Yersinia pestis KIM
aguugggcauugga

SEQ ID NO: 2333635 - RNA, 17 nt, Yersinia pestis KIM
aguuggggauaauugac

SEQ ID NO: 2333636 - RNA, 23 nt, Yersinia pestis KIM
auaaaaaagcaugcagaauaucu

SEQ ID NO: 2333637 - RNA, 14 nt, Yersinia pestis KIM
auaaaaaacugacu

SEQ ID NO: 2333638 - RNA, 12 nt, Yersinia pestis KIM
auaaaaaauaau

SEQ ID NO: 2333639 - RNA, 23 nt, Yersinia pestis KIM
aguuuuuuguuuuucugacaaaa

SEQ ID NO: 2333640 - RNA, 21 nt, Yersinia pestis KIM
auaaaacuauucugcuuggac

SEQ ID NO: 2333641 - RNA, 18 nt, Yersinia pestis KIM
auaaaagagauguuauuu

SEQ ID NO: 2333642 - RNA, 15 nt, Yersinia pestis KIM
auaaaagaaagggca

SEQ ID NO: 2333643 - RNA, 13 nt, Yersinia pestis KIM
auaaaagaaugaa

SEQ ID NO: 2333644 - RNA, 15 nt, Yersinia pestis KIM
auaaaagaaugaauu

SEQ ID NO: 2333645 - RNA, 22 nt, Yersinia pestis KIM
auaaaaccuuuauguaacacau

SEQ ID NO: 2333646 - RNA, 23 nt, Yersinia pestis KIM
auaaaacggcauaucgagcaucu

SEQ ID NO: 2333647 - RNA, 13 nt, Yersinia pestis KIM
auaaaaguaauuu

SEQ ID NO: 2333648 - RNA, 21 nt, Yersinia pestis KIM
auaaaaguaauuuaucaguag

SEQ ID NO: 2333649 - RNA, 16 nt, Yersinia pestis KIM
auaaaaggauggccca

SEQ ID NO: 2333650 - RNA, 21 nt, Yersinia pestis KIM
auaaaagcacagacaaacaac

SEQ ID NO: 2333651 - RNA, 20 nt, Yersinia pestis KIM
auaaaagcaucucgauacau

SEQ ID NO: 2333652 - RNA, 11 nt, Yersinia pestis KIM
auaaaaacccc

SEQ ID NO: 2333653 - RNA, 22 nt, Yersinia pestis KIM
auaaaaaccccugucuuauuuu

SEQ ID NO: 2333654 - RNA, 12 nt, Yersinia pestis KIM
auaaaaaccauu

SEQ ID NO: 2333655 - RNA, 12 nt, Yersinia pestis KIM
auaaaaacauug

SEQ ID NO: 2333656 - RNA, 12 nt, Yersinia pestis KIM
auaaaaauagcu

SEQ ID NO: 2333657 - RNA, 18 nt, Yersinia pestis KIM
auaaaaauagccuuccuu

SEQ ID NO: 2333658 - RNA, 18 nt, Yersinia pestis KIM
auaaaacagaacccccgc

SEQ ID NO: 2333659 - RNA, 21 nt, Yersinia pestis KIM
auaaaacagcuugauagggcu

SEQ ID NO: 2333660 - RNA, 12 nt, Yersinia pestis KIM
auaaaacaauag

SEQ ID NO: 2333661 - RNA, 16 nt, Yersinia pestis KIM
auaaaaccacugaccu

SEQ ID NO: 2333662 - RNA, 23 nt, Yersinia pestis KIM
auaauccaccugacgaaaugccg

SEQ ID NO: 2333663 - RNA, 15 nt, Yersinia pestis KIM
auaaucaauccuaca

SEQ ID NO: 2333664 - RNA, 14 nt, Yersinia pestis KIM
auaaucaaugccac

SEQ ID NO: 2333665 - RNA, 12 nt, Yersinia pestis KIM
auaaucaaugac

SEQ ID NO: 2333666 - RNA, 13 nt, Yersinia pestis KIM
auaauauuggccg

SEQ ID NO: 2333667 - RNA, 18 nt, Yersinia pestis KIM
auaaucaacggcaccaca

SEQ ID NO: 2333668 - RNA, 23 nt, Yersinia pestis KIM
auaauaucaagucuugaagagug

SEQ ID NO: 2333669 - RNA, 18 nt, Yersinia pestis KIM
auaauaucggcaaauuaa

SEQ ID NO: 2333670 - RNA, 21 nt, Yersinia pestis KIM
auaauagcuggcggauaaaaa

SEQ ID NO: 2333671 - RNA, 15 nt, Yersinia pestis KIM
auaauagauaguacu

SEQ ID NO: 2333672 - RNA, 14 nt, Yersinia pestis KIM
auaauagauaguac

SEQ ID NO: 2333673 - RNA, 20 nt, Yersinia pestis KIM
auaauagauaacaaacuacu

SEQ ID NO: 2333674 - RNA, 14 nt, Yersinia pestis KIM
auaaguaagugauu

SEQ ID NO: 2333675 - RNA, 20 nt, Yersinia pestis KIM
auaaguaaucgccaaugguc

SEQ ID NO: 2333676 - RNA, 13 nt, Yersinia pestis KIM
auaauuaacuauu

SEQ ID NO: 2333677 - RNA, 14 nt, Yersinia pestis KIM
auaauuaacuauuu

SEQ ID NO: 2333678 - RNA, 16 nt, Yersinia pestis KIM
auaauuaacagcauca

SEQ ID NO: 2333679 - RNA, 22 nt, Yersinia pestis KIM
auaauguucguuuuuuggguuu

SEQ ID NO: 2333680 - RNA, 22 nt, Yersinia pestis KIM
auaauguggcauguucagcauu

SEQ ID NO: 2333681 - RNA, 17 nt, Yersinia pestis KIM
auaauuaaggugguuuu

SEQ ID NO: 2333682 - RNA, 13 nt, Yersinia pestis KIM
auaauuaauuauu

SEQ ID NO: 2333683 - RNA, 15 nt, Yersinia pestis KIM
auaauuaauuugugu

SEQ ID NO: 2333684 - RNA, 12 nt, Yersinia pestis KIM
auaauuacuuau

SEQ ID NO: 2333685 - RNA, 13 nt, Yersinia pestis KIM
auaauuacuuaua

SEQ ID NO: 2333686 - RNA, 13 nt, Yersinia pestis KIM
auaauuaugaaag

SEQ ID NO: 2333687 - RNA, 17 nt, Yersinia pestis KIM
auaauuauaccuacccu

SEQ ID NO: 2333688 - RNA, 22 nt, Yersinia pestis KIM
auaaugucaccacggcuuucaa

SEQ ID NO: 2333689 - RNA, 17 nt, Yersinia pestis KIM
auaauguccuauuuaau

SEQ ID NO: 2333690 - RNA, 19 nt, Yersinia pestis KIM
auaauccgccaauagcugg

SEQ ID NO: 2333691 - RNA, 13 nt, Yersinia pestis KIM
auaaucccugcca

SEQ ID NO: 2333692 - RNA, 16 nt, Yersinia pestis KIM
auaaucccuugagcau

SEQ ID NO: 2333693 - RNA, 13 nt, Yersinia pestis KIM
auaaucucagcau

SEQ ID NO: 2333694 - RNA, 20 nt, Yersinia pestis KIM
auaacuauauucucauugcc

SEQ ID NO: 2333695 - RNA, 19 nt, Yersinia pestis KIM
auaacuauuaucuuuuaaa

SEQ ID NO: 2333696 - RNA, 20 nt, Yersinia pestis KIM
auaacuauuaucuuuuaaaa

SEQ ID NO: 2333697 - RNA, 22 nt, Yersinia pestis KIM
auaacgauuaauuaguuuuaau

SEQ ID NO: 2333698 - RNA, 19 nt, Yersinia pestis KIM
auaacgcaucaugguccag

SEQ ID NO: 2333699 - RNA, 20 nt, Yersinia pestis KIM
auaacgccccuguaaauaaa

SEQ ID NO: 2333700 - RNA, 14 nt, Yersinia pestis KIM
auaacgccacaaua

SEQ ID NO: 2333701 - RNA, 16 nt, Yersinia pestis KIM
auaaauuuaucgauaa

SEQ ID NO: 2333702 - RNA, 14 nt, Yersinia pestis KIM
auaagacagggguu

SEQ ID NO: 2333703 - RNA, 16 nt, Yersinia pestis KIM
auaagacaccacauca

SEQ ID NO: 2333704 - RNA, 21 nt, Yersinia pestis KIM
auaagagcgacucaauaauau

SEQ ID NO: 2333705 - RNA, 13 nt, Yersinia pestis KIM
auaacucaucagu

SEQ ID NO: 2333706 - RNA, 20 nt, Yersinia pestis KIM
auaagcacgaauuuuauuca

SEQ ID NO: 2333707 - RNA, 20 nt, Yersinia pestis KIM
auaagcaggcaguaaaauau

SEQ ID NO: 2333708 - RNA, 21 nt, Yersinia pestis KIM
auaagcaggcaguaaaauauu

SEQ ID NO: 2333709 - RNA, 21 nt, Yersinia pestis KIM
auaagcgggguuaaucccccg

SEQ ID NO: 2333710 - RNA, 23 nt, Yersinia pestis KIM
auaagccauuuuuuauaaacacu

SEQ ID NO: 2333711 - RNA, 14 nt, Yersinia pestis KIM
auaagaugggcuua

SEQ ID NO: 2333712 - RNA, 23 nt, Yersinia pestis KIM
auaagauugagggcgucucuacg

SEQ ID NO: 2333713 - RNA, 20 nt, Yersinia pestis KIM
auaagauucagcugcccuug

SEQ ID NO: 2333714 - RNA, 17 nt, Yersinia pestis KIM
auaaggauaaccgccug

SEQ ID NO: 2333715 - RNA, 17 nt, Yersinia pestis KIM
auaaggagagauuagag

SEQ ID NO: 2333716 - RNA, 13 nt, Yersinia pestis KIM
auaaggaauaacu

SEQ ID NO: 2333717 - RNA, 18 nt, Yersinia pestis KIM
auaagcgguuuuaucaau

SEQ ID NO: 2333718 - RNA, 13 nt, Yersinia pestis KIM
auaagggccaccc

SEQ ID NO: 2333719 - RNA, 21 nt, Yersinia pestis KIM
auaaggggauugcugccaacg

SEQ ID NO: 2333720 - RNA, 16 nt, Yersinia pestis KIM
auaaggcuaacaccuu

SEQ ID NO: 2333721 - RNA, 13 nt, Yersinia pestis KIM
auaagggccacca

SEQ ID NO: 2333722 - RNA, 13 nt, Yersinia pestis KIM
auaaggccaggca

SEQ ID NO: 2333723 - RNA, 18 nt, Yersinia pestis KIM
auaaggccaggcaauaag

SEQ ID NO: 2333724 - RNA, 19 nt, Yersinia pestis KIM
aguuagcuacgcugcugaa

SEQ ID NO: 2333725 - RNA, 16 nt, Yersinia pestis KIM
aguuaaguaauaacuc

SEQ ID NO: 2333726 - RNA, 17 nt, Yersinia pestis KIM
aguuaauagggcuucca

SEQ ID NO: 2333727 - RNA, 23 nt, Yersinia pestis KIM
aguuaauaccagaugcauauacu

SEQ ID NO: 2333728 - RNA, 16 nt, Yersinia pestis KIM
aguuaguggcuuuaag

SEQ ID NO: 2333729 - RNA, 13 nt, Yersinia pestis KIM
aguuauaaaaacc

SEQ ID NO: 2333730 - RNA, 23 nt, Yersinia pestis KIM
aguuauaacguuaugugccauaa

SEQ ID NO: 2333731 - RNA, 11 nt, Yersinia pestis KIM
aguucaucaaa

SEQ ID NO: 2333732 - RNA, 14 nt, Yersinia pestis KIM
aguugaaccauaaa

SEQ ID NO: 2333733 - RNA, 20 nt, Yersinia pestis KIM
aguucuuuauccacuuggcu

SEQ ID NO: 2333734 - RNA, 14 nt, Yersinia pestis KIM
aguucuuuauccac

SEQ ID NO: 2333735 - RNA, 16 nt, Yersinia pestis KIM
aguucgacaccuucaa

SEQ ID NO: 2333736 - RNA, 21 nt, Yersinia pestis KIM
aguucgacaccuucaaucauu

SEQ ID NO: 2333737 - RNA, 20 nt, Yersinia pestis KIM
aguugaauuuuuauaauuaa

SEQ ID NO: 2333738 - RNA, 17 nt, Yersinia pestis KIM
aguugagagacaaaaau

SEQ ID NO: 2333739 - RNA, 17 nt, Yersinia pestis KIM
aguugcuaucaauaaac

SEQ ID NO: 2333740 - RNA, 17 nt, Yersinia pestis KIM
aguugcgggaauucuuu

SEQ ID NO: 2333741 - RNA, 19 nt, Yersinia pestis KIM
aguugcgggaauucuuugg

SEQ ID NO: 2333742 - RNA, 16 nt, Yersinia pestis KIM
aguuggcauucuaguu

SEQ ID NO: 2333743 - RNA, 17 nt, Yersinia pestis KIM
agugagcgcggguaaug

SEQ ID NO: 2333744 - RNA, 16 nt, Yersinia pestis KIM
agugagcugaacugag

SEQ ID NO: 2333745 - RNA, 15 nt, Yersinia pestis KIM
agugagucaguaacu

SEQ ID NO: 2333746 - RNA, 15 nt, Yersinia pestis KIM
agugauaacaacccu

SEQ ID NO: 2333747 - RNA, 18 nt, Yersinia pestis KIM
agugauaaauuugauaca

SEQ ID NO: 2333748 - RNA, 15 nt, Yersinia pestis KIM
agugcguuuuauuca

SEQ ID NO: 2333749 - RNA, 17 nt, Yersinia pestis KIM
agugcguuuuauucaag

SEQ ID NO: 2333750 - RNA, 16 nt, Yersinia pestis KIM
agugcuacagcagcag

SEQ ID NO: 2333751 - RNA, 20 nt, Yersinia pestis KIM
agugcucaccuaggcuuuca

SEQ ID NO: 2333752 - RNA, 19 nt, Yersinia pestis KIM
aguggacgauaaauucaaa

SEQ ID NO: 2333753 - RNA, 15 nt, Yersinia pestis KIM
aguggaaaaacugaa

SEQ ID NO: 2333754 - RNA, 16 nt, Yersinia pestis KIM
aguggcgguaucacuu

SEQ ID NO: 2333755 - RNA, 14 nt, Yersinia pestis KIM
aguguaaaaagcag

SEQ ID NO: 2333756 - RNA, 21 nt, Yersinia pestis KIM
aguguaaaaagcagugcugaa

SEQ ID NO: 2333757 - RNA, 22 nt, Yersinia pestis KIM
aguguaaaaaccaucugaugca

SEQ ID NO: 2333758 - RNA, 12 nt, Yersinia pestis KIM
aguguaaaaccu

SEQ ID NO: 2333759 - RNA, 19 nt, Yersinia pestis KIM
aguuaaaucccugugcuga

SEQ ID NO: 2333760 - RNA, 14 nt, Yersinia pestis KIM
aguuaaaugaagga

SEQ ID NO: 2333761 - RNA, 12 nt, Yersinia pestis KIM
aguuaaauaaug

SEQ ID NO: 2333762 - RNA, 11 nt, Yersinia pestis KIM
aguuaaauaau

SEQ ID NO: 2333763 - RNA, 22 nt, Yersinia pestis KIM
aguuaaagguaaaaggcccgcu

SEQ ID NO: 2333764 - RNA, 22 nt, Yersinia pestis KIM
aguuaaacgguaaccauccaua

SEQ ID NO: 2333765 - RNA, 20 nt, Yersinia pestis KIM
aguuaacacgggcaugaacg

SEQ ID NO: 2333766 - RNA, 22 nt, Yersinia pestis KIM
aguuaaaaagaaaaagacauaa

SEQ ID NO: 2333767 - RNA, 18 nt, Yersinia pestis KIM
aguuaaacaacgcugaaa

SEQ ID NO: 2333768 - RNA, 15 nt, Yersinia pestis KIM
agugugcaaauaaac

SEQ ID NO: 2333769 - RNA, 14 nt, Yersinia pestis KIM
agugugcaaauaaa

SEQ ID NO: 2333770 - RNA, 17 nt, Yersinia pestis KIM
aguguacuguuaacuca

SEQ ID NO: 2333771 - RNA, 19 nt, Yersinia pestis KIM
aguguacuguuaacucaug

SEQ ID NO: 2333772 - RNA, 23 nt, Yersinia pestis KIM
agugugccuuggucucagaacaa

SEQ ID NO: 2333773 - RNA, 22 nt, Yersinia pestis KIM
agugugccuuggucucagaaca

SEQ ID NO: 2333774 - RNA, 22 nt, Yersinia pestis KIM
agugugcugcgaagaucacuca

SEQ ID NO: 2333775 - RNA, 22 nt, Yersinia pestis KIM
aguguucggggguugucagcag

SEQ ID NO: 2333776 - RNA, 15 nt, Yersinia pestis KIM
aguguucauaaauua

SEQ ID NO: 2333777 - RNA, 18 nt, Yersinia pestis KIM
aguguucauaaauuaaaa

SEQ ID NO: 2333778 - RNA, 17 nt, Yersinia pestis KIM
agucccuaaagagcgau

SEQ ID NO: 2333779 - RNA, 17 nt, Yersinia pestis KIM
agucgccuuaaaugcgu

SEQ ID NO: 2333780 - RNA, 22 nt, Yersinia pestis KIM
agucuaaacgccgcgucaauaa

SEQ ID NO: 2333781 - RNA, 20 nt, Yersinia pestis KIM
agucucacuaaaucaaaagg

SEQ ID NO: 2333782 - RNA, 13 nt, Yersinia pestis KIM
agucuauuauauu

SEQ ID NO: 2333783 - RNA, 14 nt, Yersinia pestis KIM
agugaccaaagcag

SEQ ID NO: 2333784 - RNA, 23 nt, Yersinia pestis KIM
agugacaugcuuaauuauugcag

SEQ ID NO: 2333785 - RNA, 23 nt, Yersinia pestis KIM
agugacguaaaaaggcagugaca

SEQ ID NO: 2333786 - RNA, 20 nt, Yersinia pestis KIM
agugacuaauuguuugcuuu

SEQ ID NO: 2333787 - RNA, 18 nt, Yersinia pestis KIM
agugacucaucaaaacaa

SEQ ID NO: 2333788 - RNA, 18 nt, Yersinia pestis KIM
agugaaccgcgcucugcu

SEQ ID NO: 2333789 - RNA, 14 nt, Yersinia pestis KIM
agugaacguagcua

SEQ ID NO: 2333790 - RNA, 18 nt, Yersinia pestis KIM
agugaacguagcuaacac

SEQ ID NO: 2333791 - RNA, 17 nt, Yersinia pestis KIM
agugaacauagcuaaca

SEQ ID NO: 2333792 - RNA, 18 nt, Yersinia pestis KIM
agugaacauagcuaacac

SEQ ID NO: 2333793 - RNA, 21 nt, Yersinia pestis KIM
agugaaaccauugguaauaau

SEQ ID NO: 2333794 - RNA, 21 nt, Yersinia pestis KIM
agugaaacccgcgcagccuaa

SEQ ID NO: 2333795 - RNA, 13 nt, Yersinia pestis KIM
agugacagccaca

SEQ ID NO: 2333796 - RNA, 13 nt, Yersinia pestis KIM
agugaaagggaag

SEQ ID NO: 2333797 - RNA, 20 nt, Yersinia pestis KIM
agugaaaagguuaacugcag

SEQ ID NO: 2333798 - RNA, 20 nt, Yersinia pestis KIM
agucuuccaugacaaaauac

SEQ ID NO: 2333799 - RNA, 23 nt, Yersinia pestis KIM
agucugucguacuuuccuuccuc

SEQ ID NO: 2333800 - RNA, 19 nt, Yersinia pestis KIM
agucugucguacuuuccuu

SEQ ID NO: 2333801 - RNA, 16 nt, Yersinia pestis KIM
agucugggcaggugcg

SEQ ID NO: 2333802 - RNA, 20 nt, Yersinia pestis KIM
agucaucgcggguuuuuaac

SEQ ID NO: 2333803 - RNA, 18 nt, Yersinia pestis KIM
agucaucgcggguuuuua

SEQ ID NO: 2333804 - RNA, 13 nt, Yersinia pestis KIM
agucauauauuuu

SEQ ID NO: 2333805 - RNA, 18 nt, Yersinia pestis KIM
agucauauauuuuucuuu

SEQ ID NO: 2333806 - RNA, 20 nt, Yersinia pestis KIM
agucaguaauucacccuuua

SEQ ID NO: 2333807 - RNA, 16 nt, Yersinia pestis KIM
agucagggaucaccuc

SEQ ID NO: 2333808 - RNA, 13 nt, Yersinia pestis KIM
agucagucagggu

SEQ ID NO: 2333809 - RNA, 15 nt, Yersinia pestis KIM
agucauacaaaauga

SEQ ID NO: 2333810 - RNA, 19 nt, Yersinia pestis KIM
agucauugguguuacagca

SEQ ID NO: 2333811 - RNA, 22 nt, Yersinia pestis KIM
agucauuggcguuacagcaagg

SEQ ID NO: 2333812 - RNA, 15 nt, Yersinia pestis KIM
agucauucaccugcc

SEQ ID NO: 2333813 - RNA, 21 nt, Yersinia pestis KIM
agucauugguguuacagcaag

SEQ ID NO: 2333814 - RNA, 16 nt, Yersinia pestis KIM
agucauuuacugauga

SEQ ID NO: 2333815 - RNA, 15 nt, Yersinia pestis KIM
aguccaaaauacggc

SEQ ID NO: 2333816 - RNA, 17 nt, Yersinia pestis KIM
aguccaagaagauaacu

SEQ ID NO: 2333817 - RNA, 15 nt, Yersinia pestis KIM
agucacuaaaccauu

SEQ ID NO: 2333818 - RNA, 20 nt, Yersinia pestis KIM
agucacgucuucaccaauga

SEQ ID NO: 2333819 - RNA, 20 nt, Yersinia pestis KIM
agucacuaaaccauucagcc

SEQ ID NO: 2333820 - RNA, 16 nt, Yersinia pestis KIM
agucacuuugggcuga

SEQ ID NO: 2333821 - RNA, 17 nt, Yersinia pestis KIM
agucagcuagccugccc

SEQ ID NO: 2333822 - RNA, 14 nt, Yersinia pestis KIM
agucagcaaaucaa

SEQ ID NO: 2333823 - RNA, 15 nt, Yersinia pestis KIM
agucagcaaaucaaa

SEQ ID NO: 2333824 - RNA, 19 nt, Yersinia pestis KIM
agucagcaaaucaaacaaa

SEQ ID NO: 2333825 - RNA, 19 nt, Yersinia pestis KIM
agucacgucuucaccaaug

SEQ ID NO: 2333826 - RNA, 17 nt, Yersinia pestis KIM
agucacgucuucaccaa

SEQ ID NO: 2333827 - RNA, 21 nt, Yersinia pestis KIM
agucacgucguacugccugaa

SEQ ID NO: 2333828 - RNA, 22 nt, Yersinia pestis KIM
agucacgaaggcaaccagcaca

SEQ ID NO: 2333829 - RNA, 14 nt, Yersinia pestis KIM
agucacauuuuuaa

SEQ ID NO: 2333830 - RNA, 15 nt, Yersinia pestis KIM
agucaauuucagcuu

SEQ ID NO: 2333831 - RNA, 19 nt, Yersinia pestis KIM
aguacuuauuugaaacacu

SEQ ID NO: 2333832 - RNA, 18 nt, Yersinia pestis KIM
aguacuuauuugaaacac

SEQ ID NO: 2333833 - RNA, 15 nt, Yersinia pestis KIM
aguacuucagguaau

SEQ ID NO: 2333834 - RNA, 13 nt, Yersinia pestis KIM
aguacuuccaaua

SEQ ID NO: 2333835 - RNA, 16 nt, Yersinia pestis KIM
aguacuuagcaauaau

SEQ ID NO: 2333836 - RNA, 23 nt, Yersinia pestis KIM
aguacugcgcuagaccaguuaau

SEQ ID NO: 2333837 - RNA, 18 nt, Yersinia pestis KIM
aguagaauaccucacugg

SEQ ID NO: 2333838 - RNA, 20 nt, Yersinia pestis KIM
aguagacgacacaaaugcug

SEQ ID NO: 2333839 - RNA, 19 nt, Yersinia pestis KIM
agucaauguucucugggua

SEQ ID NO: 2333840 - RNA, 21 nt, Yersinia pestis KIM
agucaauacaccuugcagcac

SEQ ID NO: 2333841 - RNA, 23 nt, Yersinia pestis KIM
agucaauaaauccguggcccccu

SEQ ID NO: 2333842 - RNA, 19 nt, Yersinia pestis KIM
aggucagugguuuuaucaa

SEQ ID NO: 2333843 - RNA, 16 nt, Yersinia pestis KIM
aggugacaggcaaaga

SEQ ID NO: 2333844 - RNA, 11 nt, Yersinia pestis KIM
aggucaggaag

SEQ ID NO: 2333845 - RNA, 21 nt, Yersinia pestis KIM
aggucaauugcggccagccuu

SEQ ID NO: 2333846 - RNA, 16 nt, Yersinia pestis KIM
aggucaaucuuauuga

SEQ ID NO: 2333847 - RNA, 18 nt, Yersinia pestis KIM
aggucacuguuucgccuu

SEQ ID NO: 2333848 - RNA, 17 nt, Yersinia pestis KIM
agguaaauaagauagcc

SEQ ID NO: 2333849 - RNA, 11 nt, Yersinia pestis KIM
agguauucagc

SEQ ID NO: 2333850 - RNA, 23 nt, Yersinia pestis KIM
aggugucaucaaggcaaccauca

SEQ ID NO: 2333851 - RNA, 21 nt, Yersinia pestis KIM
aggugcgggaugcaguuacug

SEQ ID NO: 2333852 - RNA, 22 nt, Yersinia pestis KIM
aggugccuuuuaacguuagagc

SEQ ID NO: 2333853 - RNA, 20 nt, Yersinia pestis KIM
aggugauacaucaaaucaga

SEQ ID NO: 2333854 - RNA, 22 nt, Yersinia pestis KIM
aggugagcacuucguagugacu

SEQ ID NO: 2333855 - RNA, 21 nt, Yersinia pestis KIM
agguuauugacaaagugccug

SEQ ID NO: 2333856 - RNA, 16 nt, Yersinia pestis KIM
agguuauugacaaaga

SEQ ID NO: 2333857 - RNA, 14 nt, Yersinia pestis KIM
agguuacugcccug

SEQ ID NO: 2333858 - RNA, 18 nt, Yersinia pestis KIM
aggugugcggauggcugc

SEQ ID NO: 2333859 - RNA, 22 nt, Yersinia pestis KIM
agguguuaacgcgccggaauua

SEQ ID NO: 2333860 - RNA, 20 nt, Yersinia pestis KIM
agguguuacaacaugaaagg

SEQ ID NO: 2333861 - RNA, 19 nt, Yersinia pestis KIM
agguguucuacagggaaaa

SEQ ID NO: 2333862 - RNA, 21 nt, Yersinia pestis KIM
agguguucuacagggaaaaac

SEQ ID NO: 2333863 - RNA, 15 nt, Yersinia pestis KIM
agguuaacagccccg

SEQ ID NO: 2333864 - RNA, 13 nt, Yersinia pestis KIM
agguuaacugcag

SEQ ID NO: 2333865 - RNA, 15 nt, Yersinia pestis KIM
agguuaacugcagug

SEQ ID NO: 2333866 - RNA, 18 nt, Yersinia pestis KIM
aguacggugccagcagca

SEQ ID NO: 2333867 - RNA, 20 nt, Yersinia pestis KIM
aguacggugccagcagcaag

SEQ ID NO: 2333868 - RNA, 21 nt, Yersinia pestis KIM
aguacggugccagcagcaagu

SEQ ID NO: 2333869 - RNA, 15 nt, Yersinia pestis KIM
aguacguaaauuuau

SEQ ID NO: 2333870 - RNA, 20 nt, Yersinia pestis KIM
aguacucaccgccguauuca

SEQ ID NO: 2333871 - RNA, 20 nt, Yersinia pestis KIM
aguacuaacgucaacagaac

SEQ ID NO: 2333872 - RNA, 19 nt, Yersinia pestis KIM
aguaaugaggcuaccugca

SEQ ID NO: 2333873 - RNA, 18 nt, Yersinia pestis KIM
aguaaggccaauuggcuu

SEQ ID NO: 2333874 - RNA, 18 nt, Yersinia pestis KIM
aguaaggcagcaagugaa

SEQ ID NO: 2333875 - RNA, 18 nt, Yersinia pestis KIM
aguaauuaauuaugauaa

SEQ ID NO: 2333876 - RNA, 14 nt, Yersinia pestis KIM
agguugaaauaaau

SEQ ID NO: 2333877 - RNA, 15 nt, Yersinia pestis KIM
agguugaaauaaaua

SEQ ID NO: 2333878 - RNA, 22 nt, Yersinia pestis KIM
agguucuaaaccuauugauguu

SEQ ID NO: 2333879 - RNA, 18 nt, Yersinia pestis KIM
agguucuccaggguuucu

SEQ ID NO: 2333880 - RNA, 18 nt, Yersinia pestis KIM
agguuuuuucaccaacca

SEQ ID NO: 2333881 - RNA, 11 nt, Yersinia pestis KIM
aguaaaaaaaa

SEQ ID NO: 2333882 - RNA, 19 nt, Yersinia pestis KIM
agguuuucccuuagggcaa

SEQ ID NO: 2333883 - RNA, 23 nt, Yersinia pestis KIM
agguuuuucauaugcgccuauaa

SEQ ID NO: 2333884 - RNA, 14 nt, Yersinia pestis KIM
aguaaauagcaaaa

SEQ ID NO: 2333885 - RNA, 21 nt, Yersinia pestis KIM
aguaaauaccuucagacugac

SEQ ID NO: 2333886 - RNA, 12 nt, Yersinia pestis KIM
aguaaauauauc

SEQ ID NO: 2333887 - RNA, 21 nt, Yersinia pestis KIM
aguaaccgggcuugauuaaau

SEQ ID NO: 2333888 - RNA, 19 nt, Yersinia pestis KIM
aguaaaucuacuuuauuca

SEQ ID NO: 2333889 - RNA, 17 nt, Yersinia pestis KIM
aguaacucgacaaccuu

SEQ ID NO: 2333890 - RNA, 15 nt, Yersinia pestis KIM
aguaacugaucaaua

SEQ ID NO: 2333891 - RNA, 16 nt, Yersinia pestis KIM
aguaacggaauucaga

SEQ ID NO: 2333892 - RNA, 16 nt, Yersinia pestis KIM
aguaacuguaaggcca

SEQ ID NO: 2333893 - RNA, 15 nt, Yersinia pestis KIM
aggguauugaagaua

SEQ ID NO: 2333894 - RNA, 17 nt, Yersinia pestis KIM
aggguauugaagauacc

SEQ ID NO: 2333895 - RNA, 21 nt, Yersinia pestis KIM
agggugggauauuaauuccac

SEQ ID NO: 2333896 - RNA, 17 nt, Yersinia pestis KIM
aggguuucuccacagug

SEQ ID NO: 2333897 - RNA, 18 nt, Yersinia pestis KIM
aggguuuugugggagagg

SEQ ID NO: 2333898 - RNA, 22 nt, Yersinia pestis KIM
agguaaaccgguuaaaacagau

SEQ ID NO: 2333899 - RNA, 21 nt, Yersinia pestis KIM
aggguugcgggccucuucuuu

SEQ ID NO: 2333900 - RNA, 17 nt, Yersinia pestis KIM
aggguucaguaaaacca

SEQ ID NO: 2333901 - RNA, 20 nt, Yersinia pestis KIM
aggggaugacaccuuucaaa

SEQ ID NO: 2333902 - RNA, 22 nt, Yersinia pestis KIM
aggggcuuguguucuucaucua

SEQ ID NO: 2333903 - RNA, 18 nt, Yersinia pestis KIM
agggggaaacgaacaggg

SEQ ID NO: 2333904 - RNA, 19 nt, Yersinia pestis KIM
agggggaaacgaacaggga

SEQ ID NO: 2333905 - RNA, 16 nt, Yersinia pestis KIM
agggggcuuauucuaa

SEQ ID NO: 2333906 - RNA, 19 nt, Yersinia pestis KIM
agggggcaauugaaaaugg

SEQ ID NO: 2333907 - RNA, 16 nt, Yersinia pestis KIM
agggcgcuuucugggu

SEQ ID NO: 2333908 - RNA, 11 nt, Yersinia pestis KIM
agggcgccccg

SEQ ID NO: 2333909 - RNA, 20 nt, Yersinia pestis KIM
agggcgcauguaaauuaaua

SEQ ID NO: 2333910 - RNA, 14 nt, Yersinia pestis KIM
agggcgaucaggaa

SEQ ID NO: 2333911 - RNA, 16 nt, Yersinia pestis KIM
agggccuacguucagg

SEQ ID NO: 2333912 - RNA, 15 nt, Yersinia pestis KIM
agggcagccaauuac

SEQ ID NO: 2333913 - RNA, 22 nt, Yersinia pestis KIM
agggauaucucaccgccaauau

SEQ ID NO: 2333914 - RNA, 20 nt, Yersinia pestis KIM
aggcuugagguuauugacaa

SEQ ID NO: 2333915 - RNA, 17 nt, Yersinia pestis KIM
aggcugugguggcgguc

SEQ ID NO: 2333916 - RNA, 22 nt, Yersinia pestis KIM
aggcuguugcguaccauaugga

SEQ ID NO: 2333917 - RNA, 21 nt, Yersinia pestis KIM
aggcuuauauuuaugcuugau

SEQ ID NO: 2333918 - RNA, 14 nt, Yersinia pestis KIM
aggcuuagcgacac

SEQ ID NO: 2333919 - RNA, 19 nt, Yersinia pestis KIM
aggcggcccgcagauaauc

SEQ ID NO: 2333920 - RNA, 23 nt, Yersinia pestis KIM
aggcggcccgcagauaauccccu

SEQ ID NO: 2333921 - RNA, 18 nt, Yersinia pestis KIM
aggcuaaagacuucagcc

SEQ ID NO: 2333922 - RNA, 23 nt, Yersinia pestis KIM
aggcuaaagacuucagcccaugg

SEQ ID NO: 2333923 - RNA, 15 nt, Yersinia pestis KIM
aggcguuuuuuugcc

SEQ ID NO: 2333924 - RNA, 13 nt, Yersinia pestis KIM
aggcgugggcuaa

SEQ ID NO: 2333925 - RNA, 18 nt, Yersinia pestis KIM
aggcugacuugcagguuc

SEQ ID NO: 2333926 - RNA, 12 nt, Yersinia pestis KIM
aggcugcaccuu

SEQ ID NO: 2333927 - RNA, 19 nt, Yersinia pestis KIM
aggcuggggguucaguaaa

SEQ ID NO: 2333928 - RNA, 17 nt, Yersinia pestis KIM
aggcuggccacuuccac

SEQ ID NO: 2333929 - RNA, 19 nt, Yersinia pestis KIM
aggcuccuccuuggggccu

SEQ ID NO: 2333930 - RNA, 13 nt, Yersinia pestis KIM
aggcucuguuacc

SEQ ID NO: 2333931 - RNA, 17 nt, Yersinia pestis KIM
aggcucagcacaaacau

SEQ ID NO: 2333932 - RNA, 21 nt, Yersinia pestis KIM
aggcuaccgucauccagcacu

SEQ ID NO: 2333933 - RNA, 17 nt, Yersinia pestis KIM
aggcuaccugcaccaau

SEQ ID NO: 2333934 - RNA, 20 nt, Yersinia pestis KIM
aggcuaucacgauaaucaau

SEQ ID NO: 2333935 - RNA, 18 nt, Yersinia pestis KIM
aggcucccaaggguauaa

SEQ ID NO: 2333936 - RNA, 24 nt, Yersinia pestis KIM
aggcucagcgguacuuuuugugau

SEQ ID NO: 2333937 - RNA, 19 nt, Yersinia pestis KIM
aggcucaucaccuuccaaa

SEQ ID NO: 2333938 - RNA, 20 nt, Yersinia pestis KIM
aggcccugagauucaaccca

SEQ ID NO: 2333939 - RNA, 11 nt, Yersinia pestis KIM
aggccgcgaau

SEQ ID NO: 2333940 - RNA, 14 nt, Yersinia pestis KIM
aggccgcugcaagc

SEQ ID NO: 2333941 - RNA, 19 nt, Yersinia pestis KIM
aggcccgcuaucacuagcg

SEQ ID NO: 2333942 - RNA, 16 nt, Yersinia pestis KIM
aggcccgcuucccuac

SEQ ID NO: 2333943 - RNA, 23 nt, Yersinia pestis KIM
aggcaucgguaauacucuggcca

SEQ ID NO: 2333944 - RNA, 14 nt, Yersinia pestis KIM
aggccaggcaauaa

SEQ ID NO: 2333945 - RNA, 19 nt, Yersinia pestis KIM
aggcauccacaucuugcgc

SEQ ID NO: 2333946 - RNA, 15 nt, Yersinia pestis KIM
aggcauauacaaccu

SEQ ID NO: 2333947 - RNA, 16 nt, Yersinia pestis KIM
aggcauauacaaccuc

SEQ ID NO: 2333948 - RNA, 17 nt, Yersinia pestis KIM
aggcauauacaaccuca

SEQ ID NO: 2333949 - RNA, 14 nt, Yersinia pestis KIM
aggcagaggaagua

SEQ ID NO: 2333950 - RNA, 15 nt, Yersinia pestis KIM
aggcagauaaaucca

SEQ ID NO: 2333951 - RNA, 18 nt, Yersinia pestis KIM
aggcaggcccgcuucccu

SEQ ID NO: 2333952 - RNA, 22 nt, Yersinia pestis KIM
aggcaggggaguaaaggauggc

SEQ ID NO: 2333953 - RNA, 15 nt, Yersinia pestis KIM
aggcaguauuccaau

SEQ ID NO: 2333954 - RNA, 15 nt, Yersinia pestis KIM
aggcaauaccaauau

SEQ ID NO: 2333955 - RNA, 15 nt, Yersinia pestis KIM
aggcaaauucucaau

SEQ ID NO: 2333956 - RNA, 13 nt, Yersinia pestis KIM
aggcaaagaagaa

SEQ ID NO: 2333957 - RNA, 15 nt, Yersinia pestis KIM
aggcaaagaagaaua

SEQ ID NO: 2333958 - RNA, 16 nt, Yersinia pestis KIM
aggauuaaauaaagau

SEQ ID NO: 2333959 - RNA, 14 nt, Yersinia pestis KIM
aggauggcccaagc

SEQ ID NO: 2333960 - RNA, 23 nt, Yersinia pestis KIM
aggaucugaagaauuacgcacua

SEQ ID NO: 2333961 - RNA, 21 nt, Yersinia pestis KIM
aggauaggcagaggaguaaag

SEQ ID NO: 2333962 - RNA, 14 nt, Yersinia pestis KIM
aggauagggagcca

SEQ ID NO: 2333963 - RNA, 15 nt, Yersinia pestis KIM
aggauagggagccaa

SEQ ID NO: 2333964 - RNA, 14 nt, Yersinia pestis KIM
aggauaggcagagg

SEQ ID NO: 2333965 - RNA, 15 nt, Yersinia pestis KIM
aggauauuagggcug

SEQ ID NO: 2333966 - RNA, 15 nt, Yersinia pestis KIM
aggauaggcagaaua

SEQ ID NO: 2333967 - RNA, 14 nt, Yersinia pestis KIM
aggauaaucaucag

SEQ ID NO: 2333968 - RNA, 22 nt, Yersinia pestis KIM
aggacuauucaaugacuccuga

SEQ ID NO: 2333969 - RNA, 23 nt, Yersinia pestis KIM
aggaaugcgcccuuuuccgucag

SEQ ID NO: 2333970 - RNA, 17 nt, Yersinia pestis KIM
aggacgacggguauauu

SEQ ID NO: 2333971 - RNA, 14 nt, Yersinia pestis KIM
aggacggugccaug

SEQ ID NO: 2333972 - RNA, 12 nt, Yersinia pestis KIM
aggaaacucaug

SEQ ID NO: 2333973 - RNA, 16 nt, Yersinia pestis KIM
aggaaaacgccagcag

SEQ ID NO: 2333974 - RNA, 20 nt, Yersinia pestis KIM
aggaaaacgcccccuaguga

SEQ ID NO: 2333975 - RNA, 16 nt, Yersinia pestis KIM
aggaaaacguaaacau

SEQ ID NO: 2333976 - RNA, 15 nt, Yersinia pestis KIM
aggaauaagguuuuu

SEQ ID NO: 2333977 - RNA, 15 nt, Yersinia pestis KIM
aggaaacuccaguca

SEQ ID NO: 2333978 - RNA, 15 nt, Yersinia pestis KIM
aggaauaucugugau

SEQ ID NO: 2333979 - RNA, 19 nt, Yersinia pestis KIM
aggaauaucugugauaacc

SEQ ID NO: 2333980 - RNA, 17 nt, Yersinia pestis KIM
agcuggcgcacucaucc

SEQ ID NO: 2333981 - RNA, 17 nt, Yersinia pestis KIM
agcugaugauuggcuuc

SEQ ID NO: 2333982 - RNA, 18 nt, Yersinia pestis KIM
agcugauggcgaucaaaa

SEQ ID NO: 2333983 - RNA, 21 nt, Yersinia pestis KIM
agcugauaugaaaaaucugac

SEQ ID NO: 2333984 - RNA, 14 nt, Yersinia pestis KIM
agcugauaugaaaa

SEQ ID NO: 2333985 - RNA, 16 nt, Yersinia pestis KIM
agcugauaugaaaaau

SEQ ID NO: 2333986 - RNA, 14 nt, Yersinia pestis KIM
agcugcaauugccg

SEQ ID NO: 2333987 - RNA, 15 nt, Yersinia pestis KIM
agcugcgauaauccg

SEQ ID NO: 2333988 - RNA, 16 nt, Yersinia pestis KIM
agcugcgcugaccuaa

SEQ ID NO: 2333989 - RNA, 21 nt, Yersinia pestis KIM
agcuuaacauccgaauuuuua

SEQ ID NO: 2333990 - RNA, 23 nt, Yersinia pestis KIM
agcuucaagguacugauaaugga

SEQ ID NO: 2333991 - RNA, 16 nt, Yersinia pestis KIM
agcuucuucaaaagca

SEQ ID NO: 2333992 - RNA, 15 nt, Yersinia pestis KIM
agcuucuucaaaagc

SEQ ID NO: 2333993 - RNA, 13 nt, Yersinia pestis KIM
agcuucuuuuaaa

SEQ ID NO: 2333994 - RNA, 20 nt, Yersinia pestis KIM
agcuuucuccuuugauuuga

SEQ ID NO: 2333995 - RNA, 18 nt, Yersinia pestis KIM
agcuuuuuacgcaacaag

SEQ ID NO: 2333996 - RNA, 12 nt, Yersinia pestis KIM
agcuugcugcug

SEQ ID NO: 2333997 - RNA, 14 nt, Yersinia pestis KIM
agcuugcuggcggc

SEQ ID NO: 2333998 - RNA, 17 nt, Yersinia pestis KIM
agcuuuagcauugcaga

SEQ ID NO: 2333999 - RNA, 20 nt, Yersinia pestis KIM
agcuuuagcggcgauuucau

SEQ ID NO: 2334000 - RNA, 17 nt, Yersinia pestis KIM
agcucgccaucgcacca

SEQ ID NO: 2334001 - RNA, 20 nt, Yersinia pestis KIM
agcucccccacucgccccac

SEQ ID NO: 2334002 - RNA, 19 nt, Yersinia pestis KIM
agcucccccacucgcccca

SEQ ID NO: 2334003 - RNA, 14 nt, Yersinia pestis KIM
agcucuucugccag

SEQ ID NO: 2334004 - RNA, 19 nt, Yersinia pestis KIM
accugcgaccaauugauua

SEQ ID NO: 2334005 - RNA, 18 nt, Yersinia pestis KIM
accugcuaucaugauaaa

SEQ ID NO: 2334006 - RNA, 10 nt, Yersinia pestis KIM
accugcucaa

SEQ ID NO: 2334007 - RNA, 15 nt, Yersinia pestis KIM
accugcuuaguuaca

SEQ ID NO: 2334008 - RNA, 18 nt, Yersinia pestis KIM
accugcauccccggcauc

SEQ ID NO: 2334009 - RNA, 14 nt, Yersinia pestis KIM
accugcaucaagcc

SEQ ID NO: 2334010 - RNA, 14 nt, Yersinia pestis KIM
accugcauauccuc

SEQ ID NO: 2334011 - RNA, 19 nt, Yersinia pestis KIM
accugcaccaaucauuaca

SEQ ID NO: 2334012 - RNA, 18 nt, Yersinia pestis KIM
accugauguaacucagga

SEQ ID NO: 2334013 - RNA, 20 nt, Yersinia pestis KIM
accugauuuaccgucuuuuu

SEQ ID NO: 2334014 - RNA, 18 nt, Yersinia pestis KIM
accugauuugccagcacc

SEQ ID NO: 2334015 - RNA, 22 nt, Yersinia pestis KIM
accugcaacguuaaagaugaag

SEQ ID NO: 2334016 - RNA, 19 nt, Yersinia pestis KIM
accugcaauaaccagaaua

SEQ ID NO: 2334017 - RNA, 21 nt, Yersinia pestis KIM
accugcaauaaccagaauaau

SEQ ID NO: 2334018 - RNA, 19 nt, Yersinia pestis KIM
accugaugacccgguaaaa

SEQ ID NO: 2334019 - RNA, 15 nt, Yersinia pestis KIM
accuccauauccugg

SEQ ID NO: 2334020 - RNA, 23 nt, Yersinia pestis KIM
accuugguaucuguuuuugccac

SEQ ID NO: 2334021 - RNA, 23 nt, Yersinia pestis KIM
accuugguuugauagcaaaacac

SEQ ID NO: 2334022 - RNA, 19 nt, Yersinia pestis KIM
accuuucgguugcaucaga

SEQ ID NO: 2334023 - RNA, 16 nt, Yersinia pestis KIM
accuuucuaauuauua

SEQ ID NO: 2334024 - RNA, 18 nt, Yersinia pestis KIM
accuuugaucauggcuug

SEQ ID NO: 2334025 - RNA, 19 nt, Yersinia pestis KIM
accuuccauaacucaccuu

SEQ ID NO: 2334026 - RNA, 20 nt, Yersinia pestis KIM
accuuggauggcgaaacaau

SEQ ID NO: 2334027 - RNA, 14 nt, Yersinia pestis KIM
accuuggaacagcu

SEQ ID NO: 2334028 - RNA, 17 nt, Yersinia pestis KIM
accuguagcuuuuuaaa

SEQ ID NO: 2334029 - RNA, 15 nt, Yersinia pestis KIM
accuucacauuuucu

SEQ ID NO: 2334030 - RNA, 16 nt, Yersinia pestis KIM
accugugcaccacaca

SEQ ID NO: 2334031 - RNA, 21 nt, Yersinia pestis KIM
accuucacuggggagaucagu

SEQ ID NO: 2334032 - RNA, 15 nt, Yersinia pestis KIM
accuucagcaaagag

SEQ ID NO: 2334033 - RNA, 20 nt, Yersinia pestis KIM
accuucaggaauaaacagca

SEQ ID NO: 2334034 - RNA, 16 nt, Yersinia pestis KIM
acgauaucaauaaaga

SEQ ID NO: 2334035 - RNA, 19 nt, Yersinia pestis KIM
acgauauagagcucagcuu

SEQ ID NO: 2334036 - RNA, 19 nt, Yersinia pestis KIM
acgaguuguacgugaagau

SEQ ID NO: 2334037 - RNA, 20 nt, Yersinia pestis KIM
acgaguuaacacgggcauga

SEQ ID NO: 2334038 - RNA, 14 nt, Yersinia pestis KIM
acgacgauaagaau

SEQ ID NO: 2334039 - RNA, 16 nt, Yersinia pestis KIM
acgacgcccccgccag

SEQ ID NO: 2334040 - RNA, 18 nt, Yersinia pestis KIM
acgacgcccgcagacugc

SEQ ID NO: 2334041 - RNA, 14 nt, Yersinia pestis KIM
acgaccuucaucuc

SEQ ID NO: 2334042 - RNA, 14 nt, Yersinia pestis KIM
acgaccuugccaag

SEQ ID NO: 2334043 - RNA, 16 nt, Yersinia pestis KIM
acgacaaugaucguca

SEQ ID NO: 2334044 - RNA, 19 nt, Yersinia pestis KIM
acgacacaaaugcugugcc

SEQ ID NO: 2334045 - RNA, 22 nt, Yersinia pestis KIM
acgacacaaaugcugugccaug

SEQ ID NO: 2334046 - RNA, 21 nt, Yersinia pestis KIM
acgacaauccuaucguuuauu

SEQ ID NO: 2334047 - RNA, 19 nt, Yersinia pestis KIM
acgaaugaguuuuguccug

SEQ ID NO: 2334048 - RNA, 22 nt, Yersinia pestis KIM
acgaaugagcaguaauagcaaa

SEQ ID NO: 2334049 - RNA, 20 nt, Yersinia pestis KIM
acgaauggucugcaacucag

SEQ ID NO: 2334050 - RNA, 20 nt, Yersinia pestis KIM
acgaaagauaauuuagcaaa

SEQ ID NO: 2334051 - RNA, 18 nt, Yersinia pestis KIM
acgaauaucuagcaacac

SEQ ID NO: 2334052 - RNA, 15 nt, Yersinia pestis KIM
acgaaacgcauaaga

SEQ ID NO: 2334053 - RNA, 15 nt, Yersinia pestis KIM
accgggaugaaucga

SEQ ID NO: 2334054 - RNA, 16 nt, Yersinia pestis KIM
accgguacugaggcau

SEQ ID NO: 2334055 - RNA, 23 nt, Yersinia pestis KIM
accgguacggcccaaugucccca

SEQ ID NO: 2334056 - RNA, 20 nt, Yersinia pestis KIM
accggcaguucauuccccau

SEQ ID NO: 2334057 - RNA, 22 nt, Yersinia pestis KIM
accguacauuaaaugaauaccu

SEQ ID NO: 2334058 - RNA, 14 nt, Yersinia pestis KIM
accguaaccacauu

SEQ ID NO: 2334059 - RNA, 17 nt, Yersinia pestis KIM
accgguuuacccugcgc

SEQ ID NO: 2334060 - RNA, 20 nt, Yersinia pestis KIM
accgguuuacccugcgccug

SEQ ID NO: 2334061 - RNA, 16 nt, Yersinia pestis KIM
accgucaccuuuauga

SEQ ID NO: 2334062 - RNA, 22 nt, Yersinia pestis KIM
accgucaagacaacaaacagua

SEQ ID NO: 2334063 - RNA, 17 nt, Yersinia pestis KIM
accgucaagacaacaaa

SEQ ID NO: 2334064 - RNA, 14 nt, Yersinia pestis KIM
accguaucacccgc

SEQ ID NO: 2334065 - RNA, 13 nt, Yersinia pestis KIM
accguaucagccc

SEQ ID NO: 2334066 - RNA, 20 nt, Yersinia pestis KIM
accguaucaucaccaaacag

SEQ ID NO: 2334067 - RNA, 13 nt, Yersinia pestis KIM
accguauccacuu

SEQ ID NO: 2334068 - RNA, 18 nt, Yersinia pestis KIM
accguaugcuuucaucuu

SEQ ID NO: 2334069 - RNA, 22 nt, Yersinia pestis KIM
accggaaaaugcgccagccaau

SEQ ID NO: 2334070 - RNA, 14 nt, Yersinia pestis KIM
accggacaaaccag

SEQ ID NO: 2334071 - RNA, 17 nt, Yersinia pestis KIM
accgcugaaguggcuga

SEQ ID NO: 2334072 - RNA, 18 nt, Yersinia pestis KIM
accgcuucagcaggggca

SEQ ID NO: 2334073 - RNA, 20 nt, Yersinia pestis KIM
accgcuuaaggcaucaacca

SEQ ID NO: 2334074 - RNA, 21 nt, Yersinia pestis KIM
accgcuuugaugccuaauaau

SEQ ID NO: 2334075 - RNA, 22 nt, Yersinia pestis KIM
accgcgucgccgcuuuuuguaa

SEQ ID NO: 2334076 - RNA, 20 nt, Yersinia pestis KIM
accgcguaaaauuagagcaa

SEQ ID NO: 2334077 - RNA, 23 nt, Yersinia pestis KIM
accgcuaugcuaaaaaacagccu

SEQ ID NO: 2334078 - RNA, 21 nt, Yersinia pestis KIM
accgcuaugcuaaaaaacagc

SEQ ID NO: 2334079 - RNA, 14 nt, Yersinia pestis KIM
accgcucaguauuc

SEQ ID NO: 2334080 - RNA, 22 nt, Yersinia pestis KIM
accgcucucaccuaagccucuc

SEQ ID NO: 2334081 - RNA, 16 nt, Yersinia pestis KIM
accgcguuuguggcua

SEQ ID NO: 2334082 - RNA, 14 nt, Yersinia pestis KIM
accgcuaaggccaa

SEQ ID NO: 2334083 - RNA, 18 nt, Yersinia pestis KIM
accgcguuauggagaggc

SEQ ID NO: 2334084 - RNA, 16 nt, Yersinia pestis KIM
accgugacauuuucac

SEQ ID NO: 2334085 - RNA, 15 nt, Yersinia pestis KIM
accgugcagggcgau

SEQ ID NO: 2334086 - RNA, 18 nt, Yersinia pestis KIM
accguuguauguggcugu

SEQ ID NO: 2334087 - RNA, 17 nt, Yersinia pestis KIM
accguuguauguggcug

SEQ ID NO: 2334088 - RNA, 20 nt, Yersinia pestis KIM
accguucaagaucgcgucau

SEQ ID NO: 2334089 - RNA, 16 nt, Yersinia pestis KIM
accuaaaaaaaacaac

SEQ ID NO: 2334090 - RNA, 21 nt, Yersinia pestis KIM
accuaaaaugacgaucacugc

SEQ ID NO: 2334091 - RNA, 14 nt, Yersinia pestis KIM
accuaacaugcuga

SEQ ID NO: 2334092 - RNA, 15 nt, Yersinia pestis KIM
accuaaccaaacauu

SEQ ID NO: 2334093 - RNA, 20 nt, Yersinia pestis KIM
accuaauaacgcucaucacg

SEQ ID NO: 2334094 - RNA, 16 nt, Yersinia pestis KIM
accuaauacagcacca

SEQ ID NO: 2334095 - RNA, 12 nt, Yersinia pestis KIM
accucaucauua

SEQ ID NO: 2334096 - RNA, 14 nt, Yersinia pestis KIM
accuccaaauguca

SEQ ID NO: 2334097 - RNA, 17 nt, Yersinia pestis KIM
accuauugauaaaacca

SEQ ID NO: 2334098 - RNA, 20 nt, Yersinia pestis KIM
accuauugauaaaaccgcuu

SEQ ID NO: 2334099 - RNA, 13 nt, Yersinia pestis KIM
accuauugauguu

SEQ ID NO: 2334100 - RNA, 14 nt, Yersinia pestis KIM
accucaaaaggaug

SEQ ID NO: 2334101 - RNA, 14 nt, Yersinia pestis KIM
accuacccuuuaga

SEQ ID NO: 2334102 - RNA, 13 nt, Yersinia pestis KIM
accuaccggauaa

SEQ ID NO: 2334103 - RNA, 18 nt, Yersinia pestis KIM
accuacgccauuaaaagg

SEQ ID NO: 2334104 - RNA, 15 nt, Yersinia pestis KIM
accuauugauaaaac

SEQ ID NO: 2334105 - RNA, 21 nt, Yersinia pestis KIM
accaucgacuggccgauauca

SEQ ID NO: 2334106 - RNA, 17 nt, Yersinia pestis KIM
accauauucccagccaa

SEQ ID NO: 2334107 - RNA, 20 nt, Yersinia pestis KIM
accauaaaguuacugcgcuc

SEQ ID NO: 2334108 - RNA, 18 nt, Yersinia pestis KIM
accauaaacaaguugaac

SEQ ID NO: 2334109 - RNA, 12 nt, Yersinia pestis KIM
accauagccacg

SEQ ID NO: 2334110 - RNA, 18 nt, Yersinia pestis KIM
accauagauuaagaaaac

SEQ ID NO: 2334111 - RNA, 17 nt, Yersinia pestis KIM
accagugccaaucccca

SEQ ID NO: 2334112 - RNA, 21 nt, Yersinia pestis KIM
accagugauucgggcaaaugg

SEQ ID NO: 2334113 - RNA, 23 nt, Yersinia pestis KIM
accagugaauaaguucugcgacu

SEQ ID NO: 2334114 - RNA, 14 nt, Yersinia pestis KIM
accaguagcccagc

SEQ ID NO: 2334115 - RNA, 22 nt, Yersinia pestis KIM
accaguuaaagaauacagccag

SEQ ID NO: 2334116 - RNA, 18 nt, Yersinia pestis KIM
accaguuaauaucaauga

SEQ ID NO: 2334117 - RNA, 22 nt, Yersinia pestis KIM
accaguggugcucccgcacucu

SEQ ID NO: 2334118 - RNA, 18 nt, Yersinia pestis KIM
accaguuuauuuucccuu

SEQ ID NO: 2334119 - RNA, 20 nt, Yersinia pestis KIM
accaguuuauuuucccuuuc

SEQ ID NO: 2334120 - RNA, 22 nt, Yersinia pestis KIM
accaguugaugaaucaaugaaa

SEQ ID NO: 2334121 - RNA, 19 nt, Yersinia pestis KIM
accauaaaaggauggccca

SEQ ID NO: 2334122 - RNA, 23 nt, Yersinia pestis KIM
accauaaaauaaauaauuuguaa

SEQ ID NO: 2334123 - RNA, 21 nt, Yersinia pestis KIM
accagcuugggugaagacacu

SEQ ID NO: 2334124 - RNA, 12 nt, Yersinia pestis KIM
accaggccgcca

SEQ ID NO: 2334125 - RNA, 14 nt, Yersinia pestis KIM
accaguaaacgcca

SEQ ID NO: 2334126 - RNA, 23 nt, Yersinia pestis KIM
accagcaguugcugcucugucaa

SEQ ID NO: 2334127 - RNA, 16 nt, Yersinia pestis KIM
accagcauacgugcca

SEQ ID NO: 2334128 - RNA, 20 nt, Yersinia pestis KIM
accagccgauaauccaccug

SEQ ID NO: 2334129 - RNA, 19 nt, Yersinia pestis KIM
accagaauaauccaagcca

SEQ ID NO: 2334130 - RNA, 20 nt, Yersinia pestis KIM
accaagcccaguaaagcaaa

SEQ ID NO: 2334131 - RNA, 12 nt, Yersinia pestis KIM
accagacaacag

SEQ ID NO: 2334132 - RNA, 16 nt, Yersinia pestis KIM
accagacaacagucac

SEQ ID NO: 2334133 - RNA, 17 nt, Yersinia pestis KIM
accagacaaccaauaca

SEQ ID NO: 2334134 - RNA, 19 nt, Yersinia pestis KIM
accaagaacccuuuaucuu

SEQ ID NO: 2334135 - RNA, 23 nt, Yersinia pestis KIM
accaagaccaguucagguauuug

SEQ ID NO: 2334136 - RNA, 19 nt, Yersinia pestis KIM
accaagacuucaugacuac

SEQ ID NO: 2334137 - RNA, 11 nt, Yersinia pestis KIM
accaaccccac

SEQ ID NO: 2334138 - RNA, 16 nt, Yersinia pestis KIM
accagcaaaggccacc

SEQ ID NO: 2334139 - RNA, 17 nt, Yersinia pestis KIM
accagcaaaggccacca

SEQ ID NO: 2334140 - RNA, 17 nt, Yersinia pestis KIM
accagauuaaucaccuc

SEQ ID NO: 2334141 - RNA, 15 nt, Yersinia pestis KIM
accagauaacaacaa

SEQ ID NO: 2334142 - RNA, 16 nt, Yersinia pestis KIM
accagauaacaacaaa

SEQ ID NO: 2334143 - RNA, 23 nt, Yersinia pestis KIM
accagacucugcuaccaggaagc

SEQ ID NO: 2334144 - RNA, 17 nt, Yersinia pestis KIM
acccguacgaauuuuuc

SEQ ID NO: 2334145 - RNA, 15 nt, Yersinia pestis KIM
acccguaaacacaaa

SEQ ID NO: 2334146 - RNA, 17 nt, Yersinia pestis KIM
acccucaacucaaaaca

SEQ ID NO: 2334147 - RNA, 18 nt, Yersinia pestis KIM
acccucaacucaaaacaa

SEQ ID NO: 2334148 - RNA, 19 nt, Yersinia pestis KIM
acccucaacucaaaacaau

SEQ ID NO: 2334149 - RNA, 22 nt, Yersinia pestis KIM
acccucaggcucuggugucucu

SEQ ID NO: 2334150 - RNA, 19 nt, Yersinia pestis KIM
acccugacgaaauuuaaga

SEQ ID NO: 2334151 - RNA, 16 nt, Yersinia pestis KIM
acccugcguacaacau

SEQ ID NO: 2334152 - RNA, 16 nt, Yersinia pestis KIM
acccuucucuuuauca

SEQ ID NO: 2334153 - RNA, 15 nt, Yersinia pestis KIM
acccuucucuuuauc

SEQ ID NO: 2334154 - RNA, 14 nt, Yersinia pestis KIM
accgacgauaauca

SEQ ID NO: 2334155 - RNA, 21 nt, Yersinia pestis KIM
accgacgguucccaugacgau

SEQ ID NO: 2334156 - RNA, 16 nt, Yersinia pestis KIM
accgaguguaaaaagc

SEQ ID NO: 2334157 - RNA, 22 nt, Yersinia pestis KIM
accgaggcucgacgggaacgac

SEQ ID NO: 2334158 - RNA, 17 nt, Yersinia pestis KIM
accgagguuaucagccu

SEQ ID NO: 2334159 - RNA, 18 nt, Yersinia pestis KIM
accgaggaugacgacaaa

SEQ ID NO: 2334160 - RNA, 24 nt, Yersinia pestis KIM
acccuuugagaaaggauuugaaga

SEQ ID NO: 2334161 - RNA, 20 nt, Yersinia pestis KIM
acccuuuugaauucaccaaa

SEQ ID NO: 2334162 - RNA, 21 nt, Yersinia pestis KIM
acccuuuuugaguaaauucgg

SEQ ID NO: 2334163 - RNA, 15 nt, Yersinia pestis KIM
accgaacgaacccga

SEQ ID NO: 2334164 - RNA, 16 nt, Yersinia pestis KIM
accgacaccaaccggu

SEQ ID NO: 2334165 - RNA, 14 nt, Yersinia pestis KIM
accgaauaaaaccu

SEQ ID NO: 2334166 - RNA, 16 nt, Yersinia pestis KIM
accaucugaugcaggu

SEQ ID NO: 2334167 - RNA, 19 nt, Yersinia pestis KIM
accaucuugucauuaccaa

SEQ ID NO: 2334168 - RNA, 20 nt, Yersinia pestis KIM
accaucuccggcugacugga

SEQ ID NO: 2334169 - RNA, 21 nt, Yersinia pestis KIM
acccacuugccauaagugaac

SEQ ID NO: 2334170 - RNA, 22 nt, Yersinia pestis KIM
acccacuugccauaagugaaca

SEQ ID NO: 2334171 - RNA, 14 nt, Yersinia pestis KIM
acccacuuuauuuu

SEQ ID NO: 2334172 - RNA, 17 nt, Yersinia pestis KIM
acccacgccgaaaacaa

SEQ ID NO: 2334173 - RNA, 22 nt, Yersinia pestis KIM
acccacggcgggcaacagagaa

SEQ ID NO: 2334174 - RNA, 22 nt, Yersinia pestis KIM
acccagcuucuuuuaaagaaga

SEQ ID NO: 2334175 - RNA, 15 nt, Yersinia pestis KIM
acccauaccaaccau

SEQ ID NO: 2334176 - RNA, 20 nt, Yersinia pestis KIM
acccauauuacucacacagc

SEQ ID NO: 2334177 - RNA, 19 nt, Yersinia pestis KIM
acccauaacuugagcacau

SEQ ID NO: 2334178 - RNA, 17 nt, Yersinia pestis KIM
acccgauacaggcucug

SEQ ID NO: 2334179 - RNA, 21 nt, Yersinia pestis KIM
acccgcaauacgggugaacau

SEQ ID NO: 2334180 - RNA, 19 nt, Yersinia pestis KIM
acccgaauuaauaaaaccu

SEQ ID NO: 2334181 - RNA, 14 nt, Yersinia pestis KIM
acccgacaucaaga

SEQ ID NO: 2334182 - RNA, 15 nt, Yersinia pestis KIM
acccgaccagacaac

SEQ ID NO: 2334183 - RNA, 15 nt, Yersinia pestis KIM
acccgagccgcacca

SEQ ID NO: 2334184 - RNA, 13 nt, Yersinia pestis KIM
acccgaaagccau

SEQ ID NO: 2334185 - RNA, 16 nt, Yersinia pestis KIM
accccuauuagggaac

SEQ ID NO: 2334186 - RNA, 15 nt, Yersinia pestis KIM
accccguugcucuac

SEQ ID NO: 2334187 - RNA, 18 nt, Yersinia pestis KIM
accccguagcacacacag

SEQ ID NO: 2334188 - RNA, 14 nt, Yersinia pestis KIM
accccgaugacgcg

SEQ ID NO: 2334189 - RNA, 14 nt, Yersinia pestis KIM
acccccuucaccaa

SEQ ID NO: 2334190 - RNA, 20 nt, Yersinia pestis KIM
acccauuuuauccucuucca

SEQ ID NO: 2334191 - RNA, 16 nt, Yersinia pestis KIM
acccauuaaaaacaaa

SEQ ID NO: 2334192 - RNA, 20 nt, Yersinia pestis KIM
acccauuugcacagcauuua

SEQ ID NO: 2334193 - RNA, 22 nt, Yersinia pestis KIM
acccauuauauagauuuauuca

SEQ ID NO: 2334194 - RNA, 20 nt, Yersinia pestis KIM
acccauuuccccuuucuggu

SEQ ID NO: 2334195 - RNA, 13 nt, Yersinia pestis KIM
acccauuugcaca

SEQ ID NO: 2334196 - RNA, 13 nt, Yersinia pestis KIM
acgcguagagccu

SEQ ID NO: 2334197 - RNA, 19 nt, Yersinia pestis KIM
acgcgguugggcuucgguc

SEQ ID NO: 2334198 - RNA, 15 nt, Yersinia pestis KIM
acgcuaaccaccguc

SEQ ID NO: 2334199 - RNA, 15 nt, Yersinia pestis KIM
acgcuaaccaucacc

SEQ ID NO: 2334200 - RNA, 14 nt, Yersinia pestis KIM
acgcguuaauuaag

SEQ ID NO: 2334201 - RNA, 20 nt, Yersinia pestis KIM
acgcugguguaacggcugcu

SEQ ID NO: 2334202 - RNA, 17 nt, Yersinia pestis KIM
acgcugguuaucacagc

SEQ ID NO: 2334203 - RNA, 15 nt, Yersinia pestis KIM
acgcugggcgaucau

SEQ ID NO: 2334204 - RNA, 13 nt, Yersinia pestis KIM
acgcuggcacugg

SEQ ID NO: 2334205 - RNA, 17 nt, Yersinia pestis KIM
acgcuggcacuggaugu

SEQ ID NO: 2334206 - RNA, 17 nt, Yersinia pestis KIM
acgcgccgcagcagugc

SEQ ID NO: 2334207 - RNA, 15 nt, Yersinia pestis KIM
acgccgaucauaaau

SEQ ID NO: 2334208 - RNA, 22 nt, Yersinia pestis KIM
acgccgaggugaagacacccgu

SEQ ID NO: 2334209 - RNA, 19 nt, Yersinia pestis KIM
acgaucaacccccugugga

SEQ ID NO: 2334210 - RNA, 19 nt, Yersinia pestis KIM
acgauauuuucgacaaaau

SEQ ID NO: 2334211 - RNA, 14 nt, Yersinia pestis KIM
acgauauuaccgag

SEQ ID NO: 2334212 - RNA, 21 nt, Yersinia pestis KIM
acgcccagcuuuagcauugca

SEQ ID NO: 2334213 - RNA, 15 nt, Yersinia pestis KIM
acgccccaugcaccu

SEQ ID NO: 2334214 - RNA, 17 nt, Yersinia pestis KIM
acgccggcgccauugcg

SEQ ID NO: 2334215 - RNA, 19 nt, Yersinia pestis KIM
acgccguaaauacauccau

SEQ ID NO: 2334216 - RNA, 16 nt, Yersinia pestis KIM
acgccguaaauacauc

SEQ ID NO: 2334217 - RNA, 18 nt, Yersinia pestis KIM
acgccuuggcguuucuga

SEQ ID NO: 2334218 - RNA, 19 nt, Yersinia pestis KIM
acgccuucauguugcaaca

SEQ ID NO: 2334219 - RNA, 14 nt, Yersinia pestis KIM
acgccuucauguug

SEQ ID NO: 2334220 - RNA, 17 nt, Yersinia pestis KIM
acgccuauccucaugau

SEQ ID NO: 2334221 - RNA, 17 nt, Yersinia pestis KIM
acgccguggugaaaaau

SEQ ID NO: 2334222 - RNA, 17 nt, Yersinia pestis KIM
acgccucaucuucacga

SEQ ID NO: 2334223 - RNA, 22 nt, Yersinia pestis KIM
acgccucguuuaacucaaauaa

SEQ ID NO: 2334224 - RNA, 17 nt, Yersinia pestis KIM
acggccuguaccaccac

SEQ ID NO: 2334225 - RNA, 14 nt, Yersinia pestis KIM
acggccaauuucag

SEQ ID NO: 2334226 - RNA, 14 nt, Yersinia pestis KIM
acggccagcaaccu

SEQ ID NO: 2334227 - RNA, 20 nt, Yersinia pestis KIM
acggccagagccaccagaau

SEQ ID NO: 2334228 - RNA, 21 nt, Yersinia pestis KIM
acggccaucaauaaagcuggc

SEQ ID NO: 2334229 - RNA, 22 nt, Yersinia pestis KIM
acggcaccggguauugaccacu

SEQ ID NO: 2334230 - RNA, 20 nt, Yersinia pestis KIM
acggcagacauuccgucagc

SEQ ID NO: 2334231 - RNA, 19 nt, Yersinia pestis KIM
acggcagcgagcacugccc

SEQ ID NO: 2334232 - RNA, 16 nt, Yersinia pestis KIM
acggcaccuuuuuugu

SEQ ID NO: 2334233 - RNA, 17 nt, Yersinia pestis KIM
acggcacguuuccccuu

SEQ ID NO: 2334234 - RNA, 23 nt, Yersinia pestis KIM
acggcagugaucgcacuucaacc

SEQ ID NO: 2334235 - RNA, 16 nt, Yersinia pestis KIM
acggcagugaucgcac

SEQ ID NO: 2334236 - RNA, 17 nt, Yersinia pestis KIM
acggcaucgcugcaaua

SEQ ID NO: 2334237 - RNA, 17 nt, Yersinia pestis KIM
acggucagagauauaaa

SEQ ID NO: 2334238 - RNA, 23 nt, Yersinia pestis KIM
acggucauucacuguggcggcca

SEQ ID NO: 2334239 - RNA, 15 nt, Yersinia pestis KIM
acggugaauaaaccc

SEQ ID NO: 2334240 - RNA, 22 nt, Yersinia pestis KIM
acggcggcuacugguagcagcc

SEQ ID NO: 2334241 - RNA, 23 nt, Yersinia pestis KIM
acggcggguugaacaugggugcc

SEQ ID NO: 2334242 - RNA, 19 nt, Yersinia pestis KIM
acgggcuuuaaugaguaaa

SEQ ID NO: 2334243 - RNA, 21 nt, Yersinia pestis KIM
acgggcuuccaucaggaaguc

SEQ ID NO: 2334244 - RNA, 19 nt, Yersinia pestis KIM
acgggcuuccaucaggaag

SEQ ID NO: 2334245 - RNA, 18 nt, Yersinia pestis KIM
acgggcuuccaucaggaa

SEQ ID NO: 2334246 - RNA, 14 nt, Yersinia pestis KIM
acgggcaaccugua

SEQ ID NO: 2334247 - RNA, 16 nt, Yersinia pestis KIM
acgucauuuuuuuuau

SEQ ID NO: 2334248 - RNA, 20 nt, Yersinia pestis KIM
acgucauuuuuuuuauuuuc

SEQ ID NO: 2334249 - RNA, 20 nt, Yersinia pestis KIM
acgucaucgccacacgcauu

SEQ ID NO: 2334250 - RNA, 14 nt, Yersinia pestis KIM
acguccccugagcg

SEQ ID NO: 2334251 - RNA, 17 nt, Yersinia pestis KIM
acgguguguugaaauuu

SEQ ID NO: 2334252 - RNA, 18 nt, Yersinia pestis KIM
acgguguguugaaauuug

SEQ ID NO: 2334253 - RNA, 15 nt, Yersinia pestis KIM
acggugugcaaugca

SEQ ID NO: 2334254 - RNA, 11 nt, Yersinia pestis KIM
acggugagaau

SEQ ID NO: 2334255 - RNA, 16 nt, Yersinia pestis KIM
acggugagaauaaaua

SEQ ID NO: 2334256 - RNA, 21 nt, Yersinia pestis KIM
acguauugguaacgcagaaau

SEQ ID NO: 2334257 - RNA, 21 nt, Yersinia pestis KIM
acguauucgucaccaucaaua

SEQ ID NO: 2334258 - RNA, 14 nt, Yersinia pestis KIM
acguauauuggccu

SEQ ID NO: 2334259 - RNA, 15 nt, Yersinia pestis KIM
acgucaccacgcagu

SEQ ID NO: 2334260 - RNA, 20 nt, Yersinia pestis KIM
acgucacccaaccgaccaaa

SEQ ID NO: 2334261 - RNA, 16 nt, Yersinia pestis KIM
acgucaacagaacuaa

SEQ ID NO: 2334262 - RNA, 19 nt, Yersinia pestis KIM
acgucaauaccgugagaac

SEQ ID NO: 2334263 - RNA, 20 nt, Yersinia pestis KIM
acguuacaacgagggcucaa

SEQ ID NO: 2334264 - RNA, 12 nt, Yersinia pestis KIM
acguuaacugca

SEQ ID NO: 2334265 - RNA, 21 nt, Yersinia pestis KIM
acgugagcguucaaaaucaaa

SEQ ID NO: 2334266 - RNA, 17 nt, Yersinia pestis KIM
acgugaguuuuuggccu

SEQ ID NO: 2334267 - RNA, 19 nt, Yersinia pestis KIM
acgugaguuuuuggccucc

SEQ ID NO: 2334268 - RNA, 13 nt, Yersinia pestis KIM
acgugaucaucuu

SEQ ID NO: 2334269 - RNA, 14 nt, Yersinia pestis KIM
acgugaucaucuuu

SEQ ID NO: 2334270 - RNA, 16 nt, Yersinia pestis KIM
acgucugcaauagcuc

SEQ ID NO: 2334271 - RNA, 17 nt, Yersinia pestis KIM
acgucuaauugcugccc

SEQ ID NO: 2334272 - RNA, 17 nt, Yersinia pestis KIM
acgucgccgguggcuga

SEQ ID NO: 2334273 - RNA, 22 nt, Yersinia pestis KIM
acuguuaacucgccaacagagu

SEQ ID NO: 2334274 - RNA, 19 nt, Yersinia pestis KIM
acuguuaauccguauguca

SEQ ID NO: 2334275 - RNA, 14 nt, Yersinia pestis KIM
acuguguuaaucag

SEQ ID NO: 2334276 - RNA, 19 nt, Yersinia pestis KIM
acuguggcugcucugcucc

SEQ ID NO: 2334277 - RNA, 19 nt, Yersinia pestis KIM
acugugcgcggcuagccac

SEQ ID NO: 2334278 - RNA, 20 nt, Yersinia pestis KIM
acugucaaucgaugagcugg

SEQ ID NO: 2334279 - RNA, 14 nt, Yersinia pestis KIM
acugucaaaaagca

SEQ ID NO: 2334280 - RNA, 15 nt, Yersinia pestis KIM
acuguaguaaagcag

SEQ ID NO: 2334281 - RNA, 23 nt, Yersinia pestis KIM
acuuaaguugaguugaauuuuua

SEQ ID NO: 2334282 - RNA, 21 nt, Yersinia pestis KIM
acuuaagcauuggcaaaucau

SEQ ID NO: 2334283 - RNA, 18 nt, Yersinia pestis KIM
acuuaaucgauagugcuu

SEQ ID NO: 2334284 - RNA, 17 nt, Yersinia pestis KIM
acuuaauggucuucuuu

SEQ ID NO: 2334285 - RNA, 22 nt, Yersinia pestis KIM
acuuagguucaaucggcagugc

SEQ ID NO: 2334286 - RNA, 14 nt, Yersinia pestis KIM
acuguuuuauuaua

SEQ ID NO: 2334287 - RNA, 16 nt, Yersinia pestis KIM
acuguuuuauuauaua

SEQ ID NO: 2334288 - RNA, 17 nt, Yersinia pestis KIM
acuuaacgauaaaauca

SEQ ID NO: 2334289 - RNA, 16 nt, Yersinia pestis KIM
acuguuuuuccagccc

SEQ ID NO: 2334290 - RNA, 21 nt, Yersinia pestis KIM
acuguuuuuuaaagaaaaaac

SEQ ID NO: 2334291 - RNA, 12 nt, Yersinia pestis KIM
acuguuaucacu

SEQ ID NO: 2334292 - RNA, 13 nt, Yersinia pestis KIM
acuggcugaaguu

SEQ ID NO: 2334293 - RNA, 21 nt, Yersinia pestis KIM
acuggcggggcaaauaggccg

SEQ ID NO: 2334294 - RNA, 16 nt, Yersinia pestis KIM
acuggcggacaucuua

SEQ ID NO: 2334295 - RNA, 20 nt, Yersinia pestis KIM
acuggcucaucgccgccauc

SEQ ID NO: 2334296 - RNA, 19 nt, Yersinia pestis KIM
acuggccuauuaagauaau

SEQ ID NO: 2334297 - RNA, 14 nt, Yersinia pestis KIM
acugguugaaaccu

SEQ ID NO: 2334298 - RNA, 20 nt, Yersinia pestis KIM
acugguugaaaccucaucau

SEQ ID NO: 2334299 - RNA, 13 nt, Yersinia pestis KIM
acugguugaaacc

SEQ ID NO: 2334300 - RNA, 15 nt, Yersinia pestis KIM
acuggucccgacaaa

SEQ ID NO: 2334301 - RNA, 14 nt, Yersinia pestis KIM
acuggggugaauca

SEQ ID NO: 2334302 - RNA, 22 nt, Yersinia pestis KIM
acugggaugaagaaauaccuga

SEQ ID NO: 2334303 - RNA, 18 nt, Yersinia pestis KIM
acuggguggccaguaacg

SEQ ID NO: 2334304 - RNA, 16 nt, Yersinia pestis KIM
acugguaauaaugcug

SEQ ID NO: 2334305 - RNA, 19 nt, Yersinia pestis KIM
acugguaccaaauaacaac

SEQ ID NO: 2334306 - RNA, 13 nt, Yersinia pestis KIM
acugaaugugaag

SEQ ID NO: 2334307 - RNA, 17 nt, Yersinia pestis KIM
acugaaugugaagagcg

SEQ ID NO: 2334308 - RNA, 20 nt, Yersinia pestis KIM
acugacgauuguccaggcua

SEQ ID NO: 2334309 - RNA, 13 nt, Yersinia pestis KIM
acugaccugcgcu

SEQ ID NO: 2334310 - RNA, 14 nt, Yersinia pestis KIM
acugacaucaucac

SEQ ID NO: 2334311 - RNA, 14 nt, Yersinia pestis KIM
acugacauuuaugc

SEQ ID NO: 2334312 - RNA, 17 nt, Yersinia pestis KIM
acugaccauaaaaggau

SEQ ID NO: 2334313 - RNA, 22 nt, Yersinia pestis KIM
acugaugacgccguacaaauau

SEQ ID NO: 2334314 - RNA, 16 nt, Yersinia pestis KIM
acugaugagcuggcaa

SEQ ID NO: 2334315 - RNA, 12 nt, Yersinia pestis KIM
acugacugccau

SEQ ID NO: 2334316 - RNA, 16 nt, Yersinia pestis KIM
acugacucacgucagu

SEQ ID NO: 2334317 - RNA, 17 nt, Yersinia pestis KIM
acugaaccgccauugca

SEQ ID NO: 2334318 - RNA, 18 nt, Yersinia pestis KIM
acugaacgauaaauugcu

SEQ ID NO: 2334319 - RNA, 22 nt, Yersinia pestis KIM
acugaauaaacaccauagccac

SEQ ID NO: 2334320 - RNA, 13 nt, Yersinia pestis KIM
acugaacugaacu

SEQ ID NO: 2334321 - RNA, 15 nt, Yersinia pestis KIM
acugaacugaacuga

SEQ ID NO: 2334322 - RNA, 15 nt, Yersinia pestis KIM
acugaagcaucaaua

SEQ ID NO: 2334323 - RNA, 18 nt, Yersinia pestis KIM
acucuagcgccagcaauu

SEQ ID NO: 2334324 - RNA, 13 nt, Yersinia pestis KIM
acucucaagccca

SEQ ID NO: 2334325 - RNA, 15 nt, Yersinia pestis KIM
acugcugugccagag

SEQ ID NO: 2334326 - RNA, 21 nt, Yersinia pestis KIM
acugcugugugggcgggggaa

SEQ ID NO: 2334327 - RNA, 14 nt, Yersinia pestis KIM
acugcucaacugcu

SEQ ID NO: 2334328 - RNA, 14 nt, Yersinia pestis KIM
acugcguccuuugc

SEQ ID NO: 2334329 - RNA, 18 nt, Yersinia pestis KIM
acugcguccuuugcccau

SEQ ID NO: 2334330 - RNA, 20 nt, Yersinia pestis KIM
acugaugcgguagugaugca

SEQ ID NO: 2334331 - RNA, 15 nt, Yersinia pestis KIM
acugaugcuuggccc

SEQ ID NO: 2334332 - RNA, 13 nt, Yersinia pestis KIM
acugauucagaaa

SEQ ID NO: 2334333 - RNA, 16 nt, Yersinia pestis KIM
acugauucagaaaggu

SEQ ID NO: 2334334 - RNA, 20 nt, Yersinia pestis KIM
acugauuauuuggugaguaa

SEQ ID NO: 2334335 - RNA, 18 nt, Yersinia pestis KIM
acugcaguaaaaauauua

SEQ ID NO: 2334336 - RNA, 19 nt, Yersinia pestis KIM
acugccacugacugcuuuu

SEQ ID NO: 2334337 - RNA, 15 nt, Yersinia pestis KIM
acugccccgaagcuc

SEQ ID NO: 2334338 - RNA, 18 nt, Yersinia pestis KIM
acugccccgaagcucaag

SEQ ID NO: 2334339 - RNA, 20 nt, Yersinia pestis KIM
acugccccgaagcucaagcu

SEQ ID NO: 2334340 - RNA, 13 nt, Yersinia pestis KIM
acugcccaaaaua

SEQ ID NO: 2334341 - RNA, 18 nt, Yersinia pestis KIM
acucccuuguugccuuuc

SEQ ID NO: 2334342 - RNA, 16 nt, Yersinia pestis KIM
acuccauuuuuuugau

SEQ ID NO: 2334343 - RNA, 15 nt, Yersinia pestis KIM
acuccauuaauuuau

SEQ ID NO: 2334344 - RNA, 17 nt, Yersinia pestis KIM
acuccaucgccacuucu

SEQ ID NO: 2334345 - RNA, 23 nt, Yersinia pestis KIM
acucccugacucccugacucccu

SEQ ID NO: 2334346 - RNA, 22 nt, Yersinia pestis KIM
acuccaguaagccugaugccuu

SEQ ID NO: 2334347 - RNA, 21 nt, Yersinia pestis KIM
acuccagcgccguugggcgga

SEQ ID NO: 2334348 - RNA, 20 nt, Yersinia pestis KIM
acucgaugacguaauuuuaa

SEQ ID NO: 2334349 - RNA, 18 nt, Yersinia pestis KIM
acucgguacaaucucugg

SEQ ID NO: 2334350 - RNA, 18 nt, Yersinia pestis KIM
acucgcgugccguucagg

SEQ ID NO: 2334351 - RNA, 21 nt, Yersinia pestis KIM
acuccuuaccacugcucacuu

SEQ ID NO: 2334352 - RNA, 15 nt, Yersinia pestis KIM
acuccuuagucggca

SEQ ID NO: 2334353 - RNA, 23 nt, Yersinia pestis KIM
acuccuucucgaugccuucuuuc

SEQ ID NO: 2334354 - RNA, 16 nt, Yersinia pestis KIM
acucgaucuugaacgg

SEQ ID NO: 2334355 - RNA, 22 nt, Yersinia pestis KIM
acuccuuggaacuuacucccuu

SEQ ID NO: 2334356 - RNA, 15 nt, Yersinia pestis KIM
acucagcauccuccu

SEQ ID NO: 2334357 - RNA, 17 nt, Yersinia pestis KIM
acucagcacauuuuuau

SEQ ID NO: 2334358 - RNA, 16 nt, Yersinia pestis KIM
acucagaugaaaaacu

SEQ ID NO: 2334359 - RNA, 14 nt, Yersinia pestis KIM
acucagaaaacagc

SEQ ID NO: 2334360 - RNA, 14 nt, Yersinia pestis KIM
acucagucaucgcu

SEQ ID NO: 2334361 - RNA, 15 nt, Yersinia pestis KIM
acucaucaaaacaau

SEQ ID NO: 2334362 - RNA, 15 nt, Yersinia pestis KIM
acucauauuguccaa

SEQ ID NO: 2334363 - RNA, 17 nt, Yersinia pestis KIM
acucauuuuuugcguau

SEQ ID NO: 2334364 - RNA, 16 nt, Yersinia pestis KIM
acucaugacaucccag

SEQ ID NO: 2334365 - RNA, 19 nt, Yersinia pestis KIM
acuacgguguuuggugaag

SEQ ID NO: 2334366 - RNA, 16 nt, Yersinia pestis KIM
acguuccacugcuuua

SEQ ID NO: 2334367 - RNA, 12 nt, Yersinia pestis KIM
acuauccuuuga

SEQ ID NO: 2334368 - RNA, 18 nt, Yersinia pestis KIM
acuauccuuugauagaaa

SEQ ID NO: 2334369 - RNA, 16 nt, Yersinia pestis KIM
acuaucccuucaauca

SEQ ID NO: 2334370 - RNA, 14 nt, Yersinia pestis KIM
acuacuugguuuaa

SEQ ID NO: 2334371 - RNA, 14 nt, Yersinia pestis KIM
acuaguuaaaacca

SEQ ID NO: 2334372 - RNA, 20 nt, Yersinia pestis KIM
acucacuuaagccacaaacc

SEQ ID NO: 2334373 - RNA, 16 nt, Yersinia pestis KIM
acucacucuucgcaaa

SEQ ID NO: 2334374 - RNA, 18 nt, Yersinia pestis KIM
acucacucuucgcaaaau

SEQ ID NO: 2334375 - RNA, 16 nt, Yersinia pestis KIM
acucacguauuuucau

SEQ ID NO: 2334376 - RNA, 16 nt, Yersinia pestis KIM
acucacuacauucuga

SEQ ID NO: 2334377 - RNA, 16 nt, Yersinia pestis KIM
acucaccuaaaucaua

SEQ ID NO: 2334378 - RNA, 18 nt, Yersinia pestis KIM
acucaaugcuuaacagcc

SEQ ID NO: 2334379 - RNA, 12 nt, Yersinia pestis KIM
acucacacagcc

SEQ ID NO: 2334380 - RNA, 14 nt, Yersinia pestis KIM
acucacaacccgcu

SEQ ID NO: 2334381 - RNA, 18 nt, Yersinia pestis KIM
acucaaauaaaccaauau

SEQ ID NO: 2334382 - RNA, 13 nt, Yersinia pestis KIM
acucaagccucua

SEQ ID NO: 2334383 - RNA, 18 nt, Yersinia pestis KIM
acucaacugauguuuuag

SEQ ID NO: 2334384 - RNA, 19 nt, Yersinia pestis KIM
acucaaguaugcaggguua

SEQ ID NO: 2334385 - RNA, 22 nt, Yersinia pestis KIM
acucaaucuuugccuauuucag

SEQ ID NO: 2334386 - RNA, 17 nt, Yersinia pestis KIM
acuaucuuuauugcucc

SEQ ID NO: 2334387 - RNA, 19 nt, Yersinia pestis KIM
agcaauauaauaaucuaua

SEQ ID NO: 2334388 - RNA, 22 nt, Yersinia pestis KIM
agcaaucaaaagggaucaccag

SEQ ID NO: 2334389 - RNA, 22 nt, Yersinia pestis KIM
agcaaucgggggaggaagcuga

SEQ ID NO: 2334390 - RNA, 20 nt, Yersinia pestis KIM
agcaaugcaccgacaaagau

SEQ ID NO: 2334391 - RNA, 22 nt, Yersinia pestis KIM
agcacaaugacuuaacugaaag

SEQ ID NO: 2334392 - RNA, 15 nt, Yersinia pestis KIM
agcacaauuguuaug

SEQ ID NO: 2334393 - RNA, 11 nt, Yersinia pestis KIM
agcacacacag

SEQ ID NO: 2334394 - RNA, 15 nt, Yersinia pestis KIM
agcacacacagccua

SEQ ID NO: 2334395 - RNA, 12 nt, Yersinia pestis KIM
agcacaaaaaga

SEQ ID NO: 2334396 - RNA, 16 nt, Yersinia pestis KIM
agauuauuucagcuuc

SEQ ID NO: 2334397 - RNA, 23 nt, Yersinia pestis KIM
agauuauuggcgauuuaauguau

SEQ ID NO: 2334398 - RNA, 17 nt, Yersinia pestis KIM
agcaacucgguuuuaau

SEQ ID NO: 2334399 - RNA, 16 nt, Yersinia pestis KIM
agcaaguuagcgauau

SEQ ID NO: 2334400 - RNA, 16 nt, Yersinia pestis KIM
agcaaggcagcaagca

SEQ ID NO: 2334401 - RNA, 11 nt, Yersinia pestis KIM
agcaaggcaga

SEQ ID NO: 2334402 - RNA, 12 nt, Yersinia pestis KIM
agcaagaaacug

SEQ ID NO: 2334403 - RNA, 19 nt, Yersinia pestis KIM
agcaagccgauaaucaauu

SEQ ID NO: 2334404 - RNA, 21 nt, Yersinia pestis KIM
agcaagcggcagcgcuggugc

SEQ ID NO: 2334405 - RNA, 23 nt, Yersinia pestis KIM
agcaagauuuuguagcccacuga

SEQ ID NO: 2334406 - RNA, 16 nt, Yersinia pestis KIM
agcacccacaccgcag

SEQ ID NO: 2334407 - RNA, 22 nt, Yersinia pestis KIM
agcaccauuaucuuccauagau

SEQ ID NO: 2334408 - RNA, 14 nt, Yersinia pestis KIM
agcaccauuaucuu

SEQ ID NO: 2334409 - RNA, 22 nt, Yersinia pestis KIM
agcaccauucaauguaaaacga

SEQ ID NO: 2334410 - RNA, 15 nt, Yersinia pestis KIM
agcacagacaaacaa

SEQ ID NO: 2334411 - RNA, 15 nt, Yersinia pestis KIM
agcacaccggccaaa

SEQ ID NO: 2334412 - RNA, 21 nt, Yersinia pestis KIM
agcacacucagaugaaaaacu

SEQ ID NO: 2334413 - RNA, 14 nt, Yersinia pestis KIM
agcaccaauauugc

SEQ ID NO: 2334414 - RNA, 13 nt, Yersinia pestis KIM
agcaccaaaucuu

SEQ ID NO: 2334415 - RNA, 19 nt, Yersinia pestis KIM
agcaccaaaucuuccagcg

SEQ ID NO: 2334416 - RNA, 21 nt, Yersinia pestis KIM
agcaccaaaucuuccagcggc

SEQ ID NO: 2334417 - RNA, 19 nt, Yersinia pestis KIM
agcacgaccuugccaaggu

SEQ ID NO: 2334418 - RNA, 15 nt, Yersinia pestis KIM
aaaaccgguuuuggu

SEQ ID NO: 2334419 - RNA, 18 nt, Yersinia pestis KIM
aaaaccgugacuaaaaca

SEQ ID NO: 2334420 - RNA, 13 nt, Yersinia pestis KIM
agcagacagcgag

SEQ ID NO: 2334421 - RNA, 16 nt, Yersinia pestis KIM
agcagacaacugacaa

SEQ ID NO: 2334422 - RNA, 11 nt, Yersinia pestis KIM
agcacugcccc

SEQ ID NO: 2334423 - RNA, 19 nt, Yersinia pestis KIM
agcacggcugaacgguagc

SEQ ID NO: 2334424 - RNA, 21 nt, Yersinia pestis KIM
agcacuguacugggaugaaga

SEQ ID NO: 2334425 - RNA, 21 nt, Yersinia pestis KIM
agcacuguuacccggaaugga

SEQ ID NO: 2334426 - RNA, 18 nt, Yersinia pestis KIM
agccaccaccacggccag

SEQ ID NO: 2334427 - RNA, 14 nt, Yersinia pestis KIM
agccaccagaauca

SEQ ID NO: 2334428 - RNA, 18 nt, Yersinia pestis KIM
agccaccaguuuauuuuc

SEQ ID NO: 2334429 - RNA, 17 nt, Yersinia pestis KIM
agccaccaguuuauuuu

SEQ ID NO: 2334430 - RNA, 13 nt, Yersinia pestis KIM
agccacucaacug

SEQ ID NO: 2334431 - RNA, 22 nt, Yersinia pestis KIM
agccacucaacugauguuuuag

SEQ ID NO: 2334432 - RNA, 13 nt, Yersinia pestis KIM
agccacucacaua

SEQ ID NO: 2334433 - RNA, 17 nt, Yersinia pestis KIM
agccacucacauaagaa

SEQ ID NO: 2334434 - RNA, 20 nt, Yersinia pestis KIM
agccagccaccgcacacuga

SEQ ID NO: 2334435 - RNA, 15 nt, Yersinia pestis KIM
agccacugggcuacc

SEQ ID NO: 2334436 - RNA, 16 nt, Yersinia pestis KIM
agccaauaauauaauc

SEQ ID NO: 2334437 - RNA, 17 nt, Yersinia pestis KIM
agccaauaauauaauca

SEQ ID NO: 2334438 - RNA, 22 nt, Yersinia pestis KIM
agccaaauacccuaauucagau

SEQ ID NO: 2334439 - RNA, 18 nt, Yersinia pestis KIM
agccacagucauuugaac

SEQ ID NO: 2334440 - RNA, 13 nt, Yersinia pestis KIM
agccaaucucuug

SEQ ID NO: 2334441 - RNA, 16 nt, Yersinia pestis KIM
agccaaucggccuuaa

SEQ ID NO: 2334442 - RNA, 19 nt, Yersinia pestis KIM
agccaaucccgauaaaaac

SEQ ID NO: 2334443 - RNA, 16 nt, Yersinia pestis KIM
agccaauggccacugc

SEQ ID NO: 2334444 - RNA, 21 nt, Yersinia pestis KIM
agcauucgcgguuacaccaau

SEQ ID NO: 2334445 - RNA, 24 nt, Yersinia pestis KIM
agcauugaguacgcuaagacauua

SEQ ID NO: 2334446 - RNA, 15 nt, Yersinia pestis KIM
agcauuuaucauauu

SEQ ID NO: 2334447 - RNA, 13 nt, Yersinia pestis KIM
agcauuucaggau

SEQ ID NO: 2334448 - RNA, 14 nt, Yersinia pestis KIM
agccaaaauaauua

SEQ ID NO: 2334449 - RNA, 19 nt, Yersinia pestis KIM
agccaaacaaaugaacccu

SEQ ID NO: 2334450 - RNA, 20 nt, Yersinia pestis KIM
agcauuuugcggaucacaua

SEQ ID NO: 2334451 - RNA, 12 nt, Yersinia pestis KIM
agcauuuuguca

SEQ ID NO: 2334452 - RNA, 17 nt, Yersinia pestis KIM
agcauuuuguuacccac

SEQ ID NO: 2334453 - RNA, 14 nt, Yersinia pestis KIM
agccaaaacagccu

SEQ ID NO: 2334454 - RNA, 16 nt, Yersinia pestis KIM
agcaucuagcagugau

SEQ ID NO: 2334455 - RNA, 22 nt, Yersinia pestis KIM
agcauggcuuuaugaccaauag

SEQ ID NO: 2334456 - RNA, 16 nt, Yersinia pestis KIM
agcaugugguuaccau

SEQ ID NO: 2334457 - RNA, 17 nt, Yersinia pestis KIM
agcaugugguuaccauc

SEQ ID NO: 2334458 - RNA, 16 nt, Yersinia pestis KIM
agcaggggcaaccucu

SEQ ID NO: 2334459 - RNA, 23 nt, Yersinia pestis KIM
agcagggcuuucacaucuggguc

SEQ ID NO: 2334460 - RNA, 22 nt, Yersinia pestis KIM
agcagggccgcccagauaaaga

SEQ ID NO: 2334461 - RNA, 16 nt, Yersinia pestis KIM
agcagggccgcccaga

SEQ ID NO: 2334462 - RNA, 22 nt, Yersinia pestis KIM
agcagguagcuguuugcaccuu

SEQ ID NO: 2334463 - RNA, 13 nt, Yersinia pestis KIM
agcagcgcacugg

SEQ ID NO: 2334464 - RNA, 17 nt, Yersinia pestis KIM
agcaggaaacaugcuga

SEQ ID NO: 2334465 - RNA, 21 nt, Yersinia pestis KIM
aaaaccuccgcgauaccaaua

SEQ ID NO: 2334466 - RNA, 19 nt, Yersinia pestis KIM
aaaaccgugacuaaaacaa

SEQ ID NO: 2334467 - RNA, 15 nt, Yersinia pestis KIM
aaaaccuaacgccaa

SEQ ID NO: 2334468 - RNA, 21 nt, Yersinia pestis KIM
aaaaccuuuacaauuacacac

SEQ ID NO: 2334469 - RNA, 19 nt, Yersinia pestis KIM
agcauccaguucauggcca

SEQ ID NO: 2334470 - RNA, 15 nt, Yersinia pestis KIM
agcauccagcucaua

SEQ ID NO: 2334471 - RNA, 20 nt, Yersinia pestis KIM
agcaucaacauuguccugca

SEQ ID NO: 2334472 - RNA, 23 nt, Yersinia pestis KIM
agcaucgaggauuuuccgcagcu

SEQ ID NO: 2334473 - RNA, 17 nt, Yersinia pestis KIM
agcauauccaacgcuuu

SEQ ID NO: 2334474 - RNA, 17 nt, Yersinia pestis KIM
agcauaucccuguuuuc

SEQ ID NO: 2334475 - RNA, 18 nt, Yersinia pestis KIM
agcauaaguaucagcggc

SEQ ID NO: 2334476 - RNA, 13 nt, Yersinia pestis KIM
agcauauuaccca

SEQ ID NO: 2334477 - RNA, 18 nt, Yersinia pestis KIM
agcauauucaguaacaac

SEQ ID NO: 2334478 - RNA, 15 nt, Yersinia pestis KIM
agcaucaaauuauuu

SEQ ID NO: 2334479 - RNA, 19 nt, Yersinia pestis KIM
agcaucaaauuauuuuucc

SEQ ID NO: 2334480 - RNA, 21 nt, Yersinia pestis KIM
agcagguucggcgcaaucaua

SEQ ID NO: 2334481 - RNA, 13 nt, Yersinia pestis KIM
agcagguggcuga

SEQ ID NO: 2334482 - RNA, 14 nt, Yersinia pestis KIM
agcauaaccagugc

SEQ ID NO: 2334483 - RNA, 19 nt, Yersinia pestis KIM
agcauaaauaucagugaca

SEQ ID NO: 2334484 - RNA, 16 nt, Yersinia pestis KIM
agcaguugcugcucug

SEQ ID NO: 2334485 - RNA, 17 nt, Yersinia pestis KIM
agcggcaaauagagcac

SEQ ID NO: 2334486 - RNA, 20 nt, Yersinia pestis KIM
agcggaucccaaaagaaaau

SEQ ID NO: 2334487 - RNA, 19 nt, Yersinia pestis KIM
agcgcuugcugguauucau

SEQ ID NO: 2334488 - RNA, 15 nt, Yersinia pestis KIM
agcgcuuggcucugg

SEQ ID NO: 2334489 - RNA, 14 nt, Yersinia pestis KIM
agcgcuguucaaaa

SEQ ID NO: 2334490 - RNA, 15 nt, Yersinia pestis KIM
agcgcugcaucagca

SEQ ID NO: 2334491 - RNA, 14 nt, Yersinia pestis KIM
agcggcgauuaucg

SEQ ID NO: 2334492 - RNA, 15 nt, Yersinia pestis KIM
agcggcgaccgggga

SEQ ID NO: 2334493 - RNA, 16 nt, Yersinia pestis KIM
agcggccaacauaauc

SEQ ID NO: 2334494 - RNA, 14 nt, Yersinia pestis KIM
agcggcaggggcgc

SEQ ID NO: 2334495 - RNA, 17 nt, Yersinia pestis KIM
agcgguaucccacugga

SEQ ID NO: 2334496 - RNA, 19 nt, Yersinia pestis KIM
agcggguuggcaucaaauu

SEQ ID NO: 2334497 - RNA, 16 nt, Yersinia pestis KIM
agcguacaucagggug

SEQ ID NO: 2334498 - RNA, 13 nt, Yersinia pestis KIM
agcguaauucagc

SEQ ID NO: 2334499 - RNA, 14 nt, Yersinia pestis KIM
agcggugccuugcc

SEQ ID NO: 2334500 - RNA, 20 nt, Yersinia pestis KIM
agcguauucaguaaaaacug

SEQ ID NO: 2334501 - RNA, 18 nt, Yersinia pestis KIM
agcguauugccuucuccu

SEQ ID NO: 2334502 - RNA, 12 nt, Yersinia pestis KIM
agcgucaaccca

SEQ ID NO: 2334503 - RNA, 16 nt, Yersinia pestis KIM
agcgucaacccagaca

SEQ ID NO: 2334504 - RNA, 18 nt, Yersinia pestis KIM
agcguagccguuaaauau

SEQ ID NO: 2334505 - RNA, 21 nt, Yersinia pestis KIM
agcguagcaggaggcccaucu

SEQ ID NO: 2334506 - RNA, 18 nt, Yersinia pestis KIM
agcguagguaacuaagcu

SEQ ID NO: 2334507 - RNA, 22 nt, Yersinia pestis KIM
agcguagguaacuaagcugccu

SEQ ID NO: 2334508 - RNA, 18 nt, Yersinia pestis KIM
agcguaggcaacuaagcu

SEQ ID NO: 2334509 - RNA, 22 nt, Yersinia pestis KIM
agcgccgugcauaauggacgaa

SEQ ID NO: 2334510 - RNA, 14 nt, Yersinia pestis KIM
agcgcgcuccagau

SEQ ID NO: 2334511 - RNA, 17 nt, Yersinia pestis KIM
agcgcucauagcaaaac

SEQ ID NO: 2334512 - RNA, 14 nt, Yersinia pestis KIM
agcgcgguaacgaa

SEQ ID NO: 2334513 - RNA, 12 nt, Yersinia pestis KIM
agcgcagguaac

SEQ ID NO: 2334514 - RNA, 15 nt, Yersinia pestis KIM
agcgcaggauaaagc

SEQ ID NO: 2334515 - RNA, 22 nt, Yersinia pestis KIM
agcgaccaaauggacgaacagc

SEQ ID NO: 2334516 - RNA, 18 nt, Yersinia pestis KIM
agcgacauuucggccacc

SEQ ID NO: 2334517 - RNA, 20 nt, Yersinia pestis KIM
agcgaccaggcauuggcgcu

SEQ ID NO: 2334518 - RNA, 21 nt, Yersinia pestis KIM
agccguuucagauaaaaagcc

SEQ ID NO: 2334519 - RNA, 23 nt, Yersinia pestis KIM
agccguuucagauaaaaagccag

SEQ ID NO: 2334520 - RNA, 12 nt, Yersinia pestis KIM
agccuacaugga

SEQ ID NO: 2334521 - RNA, 15 nt, Yersinia pestis KIM
agccuacauggaugu

SEQ ID NO: 2334522 - RNA, 14 nt, Yersinia pestis KIM
agccuacgagagau

SEQ ID NO: 2334523 - RNA, 15 nt, Yersinia pestis KIM
agccuacgagagauc

SEQ ID NO: 2334524 - RNA, 21 nt, Yersinia pestis KIM
agccgugaccgcagauauccu

SEQ ID NO: 2334525 - RNA, 13 nt, Yersinia pestis KIM
agccguuaaaaag

SEQ ID NO: 2334526 - RNA, 23 nt, Yersinia pestis KIM
agccguguaaauguacagucauu

SEQ ID NO: 2334527 - RNA, 21 nt, Yersinia pestis KIM
agccguaacugaccgcagccu

SEQ ID NO: 2334528 - RNA, 23 nt, Yersinia pestis KIM
agccuuguaacccgcuggcgacc

SEQ ID NO: 2334529 - RNA, 13 nt, Yersinia pestis KIM
agcgaacguaaaa

SEQ ID NO: 2334530 - RNA, 21 nt, Yersinia pestis KIM
agccucaucagaggcucaucc

SEQ ID NO: 2334531 - RNA, 15 nt, Yersinia pestis KIM
agccucauucaugag

SEQ ID NO: 2334532 - RNA, 20 nt, Yersinia pestis KIM
agccucauucaugaggcuca

SEQ ID NO: 2334533 - RNA, 21 nt, Yersinia pestis KIM
agccucuaccaaugccccgga

SEQ ID NO: 2334534 - RNA, 15 nt, Yersinia pestis KIM
agccucugaucauuc

SEQ ID NO: 2334535 - RNA, 14 nt, Yersinia pestis KIM
agccuuaauguuuu

SEQ ID NO: 2334536 - RNA, 12 nt, Yersinia pestis KIM
agccagguuuuu

SEQ ID NO: 2334537 - RNA, 16 nt, Yersinia pestis KIM
agcccggaaacgucca

SEQ ID NO: 2334538 - RNA, 17 nt, Yersinia pestis KIM
agcccuacuggcugaag

SEQ ID NO: 2334539 - RNA, 19 nt, Yersinia pestis KIM
agccgaagaacaaauucau

SEQ ID NO: 2334540 - RNA, 14 nt, Yersinia pestis KIM
agcccugaucgcug

SEQ ID NO: 2334541 - RNA, 19 nt, Yersinia pestis KIM
agccgcccccuuucuuauc

SEQ ID NO: 2334542 - RNA, 14 nt, Yersinia pestis KIM
agccgcgcccuccc

SEQ ID NO: 2334543 - RNA, 18 nt, Yersinia pestis KIM
agccgcgccauccuuggc

SEQ ID NO: 2334544 - RNA, 19 nt, Yersinia pestis KIM
agccgcgccauccuuggcg

SEQ ID NO: 2334545 - RNA, 17 nt, Yersinia pestis KIM
agccggacucaaaauac

SEQ ID NO: 2334546 - RNA, 16 nt, Yersinia pestis KIM
acuugguuuaaauucu

SEQ ID NO: 2334547 - RNA, 22 nt, Yersinia pestis KIM
acuuggauacguucaacgaccu

SEQ ID NO: 2334548 - RNA, 13 nt, Yersinia pestis KIM
acuuguucagaga

SEQ ID NO: 2334549 - RNA, 17 nt, Yersinia pestis KIM
acuuguucagagauaau

SEQ ID NO: 2334550 - RNA, 14 nt, Yersinia pestis KIM
acuuguucauccug

SEQ ID NO: 2334551 - RNA, 18 nt, Yersinia pestis KIM
acuuguucauccuguacc

SEQ ID NO: 2334552 - RNA, 19 nt, Yersinia pestis KIM
acuuauaccgacuaucauc

SEQ ID NO: 2334553 - RNA, 19 nt, Yersinia pestis KIM
acuuagugcuggccuaggc

SEQ ID NO: 2334554 - RNA, 13 nt, Yersinia pestis KIM
acuuauaaacacu

SEQ ID NO: 2334555 - RNA, 21 nt, Yersinia pestis KIM
acuuauaaacacugauuuaua

SEQ ID NO: 2334556 - RNA, 20 nt, Yersinia pestis KIM
acuugcaguggccucgaaga

SEQ ID NO: 2334557 - RNA, 22 nt, Yersinia pestis KIM
acuugcaauucauguugccaau

SEQ ID NO: 2334558 - RNA, 13 nt, Yersinia pestis KIM
acuugccguggcu

SEQ ID NO: 2334559 - RNA, 15 nt, Yersinia pestis KIM
acuugcugaugccca

SEQ ID NO: 2334560 - RNA, 16 nt, Yersinia pestis KIM
acuugcucuugagugu

SEQ ID NO: 2334561 - RNA, 16 nt, Yersinia pestis KIM
acuuuacauauaggaa

SEQ ID NO: 2334562 - RNA, 16 nt, Yersinia pestis KIM
acuuuaccgauuucag

SEQ ID NO: 2334563 - RNA, 12 nt, Yersinia pestis KIM
acuuuaaauacc

SEQ ID NO: 2334564 - RNA, 18 nt, Yersinia pestis KIM
acuuuauucacagcagaa

SEQ ID NO: 2334565 - RNA, 15 nt, Yersinia pestis KIM
acuuuaucugccaaa

SEQ ID NO: 2334566 - RNA, 22 nt, Yersinia pestis KIM
acuuuaucugccaaauauugca

SEQ ID NO: 2334567 - RNA, 13 nt, Yersinia pestis KIM
acuuuacucuuca

SEQ ID NO: 2334568 - RNA, 21 nt, Yersinia pestis KIM
acuuuauuuuuuuccagguca

SEQ ID NO: 2334569 - RNA, 19 nt, Yersinia pestis KIM
acuuuauugacuguaaaua

SEQ ID NO: 2334570 - RNA, 15 nt, Yersinia pestis KIM
acuuuggguauauga

SEQ ID NO: 2334571 - RNA, 21 nt, Yersinia pestis KIM
acuuugcuaaccuauagcaau

SEQ ID NO: 2334572 - RNA, 17 nt, Yersinia pestis KIM
acuuugcgcuuuuuaau

SEQ ID NO: 2334573 - RNA, 23 nt, Yersinia pestis KIM
acuuugcauuuucuggugagcau

SEQ ID NO: 2334574 - RNA, 18 nt, Yersinia pestis KIM
acuuugaugccaaggccg

SEQ ID NO: 2334575 - RNA, 20 nt, Yersinia pestis KIM
acuuuuacgggccuuuuaau

SEQ ID NO: 2334576 - RNA, 21 nt, Yersinia pestis KIM
acuuucccauagcuggcuuca

SEQ ID NO: 2334577 - RNA, 13 nt, Yersinia pestis KIM
acuuucuaagcug

SEQ ID NO: 2334578 - RNA, 22 nt, Yersinia pestis KIM
acuuucgauagucagcuucacu

SEQ ID NO: 2334579 - RNA, 20 nt, Yersinia pestis KIM
acuuugacuuaaauaguucu

SEQ ID NO: 2334580 - RNA, 15 nt, Yersinia pestis KIM
acuuuuucucuccua

SEQ ID NO: 2334581 - RNA, 16 nt, Yersinia pestis KIM
acuuuucaguuuuaau

SEQ ID NO: 2334582 - RNA, 15 nt, Yersinia pestis KIM
acuuuuauuuuuuau

SEQ ID NO: 2334583 - RNA, 23 nt, Yersinia pestis KIM
acuuuucaucgcauaggccaaua

SEQ ID NO: 2334584 - RNA, 15 nt, Yersinia pestis KIM
acuuuucauuuccuc

SEQ ID NO: 2334585 - RNA, 18 nt, Yersinia pestis KIM
acuuuucuucauugcugc

SEQ ID NO: 2334586 - RNA, 15 nt, Yersinia pestis KIM
agaaaaacacuggca

SEQ ID NO: 2334587 - RNA, 17 nt, Yersinia pestis KIM
agaaaaacacuggcagc

SEQ ID NO: 2334588 - RNA, 12 nt, Yersinia pestis KIM
agaaaauacugu

SEQ ID NO: 2334589 - RNA, 22 nt, Yersinia pestis KIM
agaaaauacugucgauuugugg

SEQ ID NO: 2334590 - RNA, 12 nt, Yersinia pestis KIM
agaaacaaaacc

SEQ ID NO: 2334591 - RNA, 23 nt, Yersinia pestis KIM
agaauaaggguagguucaauaau

SEQ ID NO: 2334592 - RNA, 21 nt, Yersinia pestis KIM
agaauaaauaauaucaaugau

SEQ ID NO: 2334593 - RNA, 15 nt, Yersinia pestis KIM
agaauaaacgagaau

SEQ ID NO: 2334594 - RNA, 13 nt, Yersinia pestis KIM
agaauacagccag

SEQ ID NO: 2334595 - RNA, 15 nt, Yersinia pestis KIM
agaauaggcagggga

SEQ ID NO: 2334596 - RNA, 14 nt, Yersinia pestis KIM
agaaguccugauuc

SEQ ID NO: 2334597 - RNA, 18 nt, Yersinia pestis KIM
agaaguucuaaauaaaau

SEQ ID NO: 2334598 - RNA, 17 nt, Yersinia pestis KIM
agaagccucaugaauga

SEQ ID NO: 2334599 - RNA, 15 nt, Yersinia pestis KIM
agaagccugaauauu

SEQ ID NO: 2334600 - RNA, 15 nt, Yersinia pestis KIM
agaaugcgacauguu

SEQ ID NO: 2334601 - RNA, 23 nt, Yersinia pestis KIM
agaaucucuccagugcaaauuua

SEQ ID NO: 2334602 - RNA, 15 nt, Yersinia pestis KIM
agaaucucuccagug

SEQ ID NO: 2334603 - RNA, 14 nt, Yersinia pestis KIM
agaauuagcggcaa

SEQ ID NO: 2334604 - RNA, 19 nt, Yersinia pestis KIM
agaauuaaggaaacucaug

SEQ ID NO: 2334605 - RNA, 17 nt, Yersinia pestis KIM
agaaucaaccacgguaa

SEQ ID NO: 2334606 - RNA, 23 nt, Yersinia pestis KIM
agaauauaaaagcacagacaaac

SEQ ID NO: 2334607 - RNA, 14 nt, Yersinia pestis KIM
agaaucaaucaauu

SEQ ID NO: 2334608 - RNA, 13 nt, Yersinia pestis KIM
agaacaaauucau

SEQ ID NO: 2334609 - RNA, 17 nt, Yersinia pestis KIM
agaaccuguuacaucag

SEQ ID NO: 2334610 - RNA, 21 nt, Yersinia pestis KIM
agaaccuguuacaucagagcu

SEQ ID NO: 2334611 - RNA, 15 nt, Yersinia pestis KIM
agaaccuuguuuuac

SEQ ID NO: 2334612 - RNA, 16 nt, Yersinia pestis KIM
agaacggccugccaga

SEQ ID NO: 2334613 - RNA, 23 nt, Yersinia pestis KIM
agaacggccugccagaacagcag

SEQ ID NO: 2334614 - RNA, 22 nt, Yersinia pestis KIM
agaacgucaccgccaaaauaaa

SEQ ID NO: 2334615 - RNA, 18 nt, Yersinia pestis KIM
agaagaaaucauuuaggc

SEQ ID NO: 2334616 - RNA, 21 nt, Yersinia pestis KIM
agaagaauugcagauaccaca

SEQ ID NO: 2334617 - RNA, 22 nt, Yersinia pestis KIM
agaagaauaucugccgggagga

SEQ ID NO: 2334618 - RNA, 18 nt, Yersinia pestis KIM
agaagacauaucuugaac

SEQ ID NO: 2334619 - RNA, 21 nt, Yersinia pestis KIM
agaagaauccacauaaaaaga

SEQ ID NO: 2334620 - RNA, 21 nt, Yersinia pestis KIM
agaaaucgccccuuuuuuguu

SEQ ID NO: 2334621 - RNA, 13 nt, Yersinia pestis KIM
agaaaucugcagu

SEQ ID NO: 2334622 - RNA, 16 nt, Yersinia pestis KIM
agaaacgccccgauaa

SEQ ID NO: 2334623 - RNA, 15 nt, Yersinia pestis KIM
agaaacggcuauuuu

SEQ ID NO: 2334624 - RNA, 19 nt, Yersinia pestis KIM
agaaaccuaaugccagaca

SEQ ID NO: 2334625 - RNA, 14 nt, Yersinia pestis KIM
aaaacacgcaacac

SEQ ID NO: 2334626 - RNA, 21 nt, Yersinia pestis KIM
agaaacgugaauugcuacugg

SEQ ID NO: 2334627 - RNA, 15 nt, Yersinia pestis KIM
aaaacagacuaaaaa

SEQ ID NO: 2334628 - RNA, 15 nt, Yersinia pestis KIM
aaaacagauaaaaaa

SEQ ID NO: 2334629 - RNA, 14 nt, Yersinia pestis KIM
aaaacagacuaaaa

SEQ ID NO: 2334630 - RNA, 14 nt, Yersinia pestis KIM
aaaacacucuuuuu

SEQ ID NO: 2334631 - RNA, 19 nt, Yersinia pestis KIM
aaaacacucuuuuugguuu

SEQ ID NO: 2334632 - RNA, 15 nt, Yersinia pestis KIM
agauaauuuagcaaa

SEQ ID NO: 2334633 - RNA, 17 nt, Yersinia pestis KIM
agauaauuuagcaaagc

SEQ ID NO: 2334634 - RNA, 14 nt, Yersinia pestis KIM
agauaauuauccau

SEQ ID NO: 2334635 - RNA, 15 nt, Yersinia pestis KIM
agauaauuauccauu

SEQ ID NO: 2334636 - RNA, 19 nt, Yersinia pestis KIM
agauaauuauccauuuucu

SEQ ID NO: 2334637 - RNA, 15 nt, Yersinia pestis KIM
agauaauguugaucu

SEQ ID NO: 2334638 - RNA, 18 nt, Yersinia pestis KIM
agauaaucacugaggcca

SEQ ID NO: 2334639 - RNA, 23 nt, Yersinia pestis KIM
agauaauccccuuguggauaggg

SEQ ID NO: 2334640 - RNA, 16 nt, Yersinia pestis KIM
agauaccgcaaccauu

SEQ ID NO: 2334641 - RNA, 19 nt, Yersinia pestis KIM
agauaccgaguucucacca

SEQ ID NO: 2334642 - RNA, 17 nt, Yersinia pestis KIM
agauaccgaguucucac

SEQ ID NO: 2334643 - RNA, 13 nt, Yersinia pestis KIM
agauaccgccaau

SEQ ID NO: 2334644 - RNA, 15 nt, Yersinia pestis KIM
agauaccacaucaaa

SEQ ID NO: 2334645 - RNA, 16 nt, Yersinia pestis KIM
agauaccacaucaaac

SEQ ID NO: 2334646 - RNA, 17 nt, Yersinia pestis KIM
agauacccuucucuuua

SEQ ID NO: 2334647 - RNA, 20 nt, Yersinia pestis KIM
agaucaaaagcagagaauga

SEQ ID NO: 2334648 - RNA, 18 nt, Yersinia pestis KIM
agaucaaaagcagagaau

SEQ ID NO: 2334649 - RNA, 14 nt, Yersinia pestis KIM
agauauuugcugcc

SEQ ID NO: 2334650 - RNA, 12 nt, Yersinia pestis KIM
agauauaauggu

SEQ ID NO: 2334651 - RNA, 13 nt, Yersinia pestis KIM
agauaguuaccca

SEQ ID NO: 2334652 - RNA, 15 nt, Yersinia pestis KIM
agauagucauuuuau

SEQ ID NO: 2334653 - RNA, 18 nt, Yersinia pestis KIM
agauaggcgaaauugacu

SEQ ID NO: 2334654 - RNA, 15 nt, Yersinia pestis KIM
agauaguacuuagca

SEQ ID NO: 2334655 - RNA, 11 nt, Yersinia pestis KIM
aaaaccacuga

SEQ ID NO: 2334656 - RNA, 12 nt, Yersinia pestis KIM
aaaaccacugac

SEQ ID NO: 2334657 - RNA, 22 nt, Yersinia pestis KIM
aaaaccacugaccuauugauaa

SEQ ID NO: 2334658 - RNA, 13 nt, Yersinia pestis KIM
aaaaccaccaaaa

SEQ ID NO: 2334659 - RNA, 12 nt, Yersinia pestis KIM
agagucacagca

SEQ ID NO: 2334660 - RNA, 12 nt, Yersinia pestis KIM
aaaaccagcagc

SEQ ID NO: 2334661 - RNA, 16 nt, Yersinia pestis KIM
agagugaccaaagcag

SEQ ID NO: 2334662 - RNA, 18 nt, Yersinia pestis KIM
agagugaaugugaguguu

SEQ ID NO: 2334663 - RNA, 18 nt, Yersinia pestis KIM
agagucacagcauucaga

SEQ ID NO: 2334664 - RNA, 13 nt, Yersinia pestis KIM
agagucacagcau

SEQ ID NO: 2334665 - RNA, 20 nt, Yersinia pestis KIM
agagucgagcggggcaaaaa

SEQ ID NO: 2334666 - RNA, 21 nt, Yersinia pestis KIM
agagucgagcggggcaaaaau

SEQ ID NO: 2334667 - RNA, 15 nt, Yersinia pestis KIM
agauaacaacaaaga

SEQ ID NO: 2334668 - RNA, 14 nt, Yersinia pestis KIM
agauaaaaauaauc

SEQ ID NO: 2334669 - RNA, 16 nt, Yersinia pestis KIM
agauaaaaauuacccg

SEQ ID NO: 2334670 - RNA, 23 nt, Yersinia pestis KIM
agauaaaaacauuuaaauaugaa

SEQ ID NO: 2334671 - RNA, 22 nt, Yersinia pestis KIM
agauccguuuuuuuuaucagcc

SEQ ID NO: 2334672 - RNA, 13 nt, Yersinia pestis KIM
agaucguaggcuu

SEQ ID NO: 2334673 - RNA, 16 nt, Yersinia pestis KIM
agaucggcauuauuau

SEQ ID NO: 2334674 - RNA, 19 nt, Yersinia pestis KIM
agaucggggcgcuuaauuc

SEQ ID NO: 2334675 - RNA, 19 nt, Yersinia pestis KIM
agaucucugcgacaucagc

SEQ ID NO: 2334676 - RNA, 23 nt, Yersinia pestis KIM
agaucucuguuuuccaucaccca

SEQ ID NO: 2334677 - RNA, 23 nt, Yersinia pestis KIM
agauuaguuuuagacgucagauu

SEQ ID NO: 2334678 - RNA, 22 nt, Yersinia pestis KIM
agauuaguuuuagaugucagau

SEQ ID NO: 2334679 - RNA, 20 nt, Yersinia pestis KIM
agauuaagaaaacauuaagg

SEQ ID NO: 2334680 - RNA, 13 nt, Yersinia pestis KIM
agauuaagacuuu

SEQ ID NO: 2334681 - RNA, 23 nt, Yersinia pestis KIM
agauggucauaaauaggugcgcc

SEQ ID NO: 2334682 - RNA, 18 nt, Yersinia pestis KIM
agauggcuuuggugauca

SEQ ID NO: 2334683 - RNA, 19 nt, Yersinia pestis KIM
agaugcugaggauaggccg

SEQ ID NO: 2334684 - RNA, 18 nt, Yersinia pestis KIM
agaugcagagaugcagag

SEQ ID NO: 2334685 - RNA, 13 nt, Yersinia pestis KIM
agaugauugaggc

SEQ ID NO: 2334686 - RNA, 12 nt, Yersinia pestis KIM
agaugaacacag

SEQ ID NO: 2334687 - RNA, 16 nt, Yersinia pestis KIM
agaugaacacagaaac

SEQ ID NO: 2334688 - RNA, 20 nt, Yersinia pestis KIM
agaugaucaacgccaaaaua

SEQ ID NO: 2334689 - RNA, 14 nt, Yersinia pestis KIM
agaucuuuuucauu

SEQ ID NO: 2334690 - RNA, 16 nt, Yersinia pestis KIM
agaucuuuuucauucu

SEQ ID NO: 2334691 - RNA, 23 nt, Yersinia pestis KIM
agagauucguuuuuuuaucaaug

SEQ ID NO: 2334692 - RNA, 17 nt, Yersinia pestis KIM
agagauagccaauucua

SEQ ID NO: 2334693 - RNA, 14 nt, Yersinia pestis KIM
agagagacuuugua

SEQ ID NO: 2334694 - RNA, 13 nt, Yersinia pestis KIM
agagauaaacccu

SEQ ID NO: 2334695 - RNA, 15 nt, Yersinia pestis KIM
agagauaaacccuaa

SEQ ID NO: 2334696 - RNA, 22 nt, Yersinia pestis KIM
agagcggucgacaaaaugugaa

SEQ ID NO: 2334697 - RNA, 22 nt, Yersinia pestis KIM
agagcgucccugauggggcaau

SEQ ID NO: 2334698 - RNA, 12 nt, Yersinia pestis KIM
aaaaccaauuca

SEQ ID NO: 2334699 - RNA, 15 nt, Yersinia pestis KIM
agagcucuucugcca

SEQ ID NO: 2334700 - RNA, 13 nt, Yersinia pestis KIM
agagcauuaccac

SEQ ID NO: 2334701 - RNA, 12 nt, Yersinia pestis KIM
agagacggaaag

SEQ ID NO: 2334702 - RNA, 12 nt, Yersinia pestis KIM
agagacuuugua

SEQ ID NO: 2334703 - RNA, 19 nt, Yersinia pestis KIM
agagacggaaagagccagc

SEQ ID NO: 2334704 - RNA, 18 nt, Yersinia pestis KIM
agagaacgggcaaccugu

SEQ ID NO: 2334705 - RNA, 22 nt, Yersinia pestis KIM
agagaacaggcagaucguaaag

SEQ ID NO: 2334706 - RNA, 15 nt, Yersinia pestis KIM
agagaacaggcagau

SEQ ID NO: 2334707 - RNA, 21 nt, Yersinia pestis KIM
agagaacaggcagcaaauaaa

SEQ ID NO: 2334708 - RNA, 12 nt, Yersinia pestis KIM
agagaaaucaaa

SEQ ID NO: 2334709 - RNA, 13 nt, Yersinia pestis KIM
agagaaauaaccc

SEQ ID NO: 2334710 - RNA, 14 nt, Yersinia pestis KIM
agagaaauaaccca

SEQ ID NO: 2334711 - RNA, 18 nt, Yersinia pestis KIM
agagaaaacagauauuuu

SEQ ID NO: 2334712 - RNA, 18 nt, Yersinia pestis KIM
agagaaaagcagacuuga

SEQ ID NO: 2334713 - RNA, 20 nt, Yersinia pestis KIM
agacgccguaaauacaucca

SEQ ID NO: 2334714 - RNA, 16 nt, Yersinia pestis KIM
agacgccguaaauaca

SEQ ID NO: 2334715 - RNA, 13 nt, Yersinia pestis KIM
agacgaaggcacg

SEQ ID NO: 2334716 - RNA, 20 nt, Yersinia pestis KIM
agacgacgugcagcgcgcag

SEQ ID NO: 2334717 - RNA, 16 nt, Yersinia pestis KIM
agacgagcguaauucc

SEQ ID NO: 2334718 - RNA, 23 nt, Yersinia pestis KIM
agacccauuucugcuucuacccu

SEQ ID NO: 2334719 - RNA, 10 nt, Yersinia pestis KIM
agacccccaa

SEQ ID NO: 2334720 - RNA, 23 nt, Yersinia pestis KIM
agaccccugcgauaaucuccauc

SEQ ID NO: 2334721 - RNA, 21 nt, Yersinia pestis KIM
agaccgguggcuuuuucaccc

SEQ ID NO: 2334722 - RNA, 17 nt, Yersinia pestis KIM
agacggcagcaacgaaa

SEQ ID NO: 2334723 - RNA, 18 nt, Yersinia pestis KIM
agacuacacacagcaaua

SEQ ID NO: 2334724 - RNA, 16 nt, Yersinia pestis KIM
agacggcguaagccuu

SEQ ID NO: 2334725 - RNA, 16 nt, Yersinia pestis KIM
agacucaucuaauuuu

SEQ ID NO: 2334726 - RNA, 19 nt, Yersinia pestis KIM
agacucaucuaauuuucuc

SEQ ID NO: 2334727 - RNA, 21 nt, Yersinia pestis KIM
agacucaucuaauuuucucag

SEQ ID NO: 2334728 - RNA, 16 nt, Yersinia pestis KIM
agacugcugacaaacc

SEQ ID NO: 2334729 - RNA, 15 nt, Yersinia pestis KIM
agacucugcuaccag

SEQ ID NO: 2334730 - RNA, 16 nt, Yersinia pestis KIM
agacuguuuuauuaua

SEQ ID NO: 2334731 - RNA, 21 nt, Yersinia pestis KIM
agacuggcgauauggcacagg

SEQ ID NO: 2334732 - RNA, 21 nt, Yersinia pestis KIM
agacuuacgcgaugccaacaa

SEQ ID NO: 2334733 - RNA, 23 nt, Yersinia pestis KIM
agacuucuaaaucacgcagcagg

SEQ ID NO: 2334734 - RNA, 20 nt, Yersinia pestis KIM
acagguacuucaaauaagca

SEQ ID NO: 2334735 - RNA, 23 nt, Yersinia pestis KIM
acagguagaucaaacauaaccug

SEQ ID NO: 2334736 - RNA, 19 nt, Yersinia pestis KIM
acaggggcguuauugagaa

SEQ ID NO: 2334737 - RNA, 21 nt, Yersinia pestis KIM
acaguagugaguuaacgagug

SEQ ID NO: 2334738 - RNA, 15 nt, Yersinia pestis KIM
acaguagaagcuacc

SEQ ID NO: 2334739 - RNA, 20 nt, Yersinia pestis KIM
acaguagaagcuaccagcac

SEQ ID NO: 2334740 - RNA, 21 nt, Yersinia pestis KIM
acaguacaaaaaacaaaccgg

SEQ ID NO: 2334741 - RNA, 22 nt, Yersinia pestis KIM
acagucccugugcgcccacgcc

SEQ ID NO: 2334742 - RNA, 14 nt, Yersinia pestis KIM
acagucccugugcg

SEQ ID NO: 2334743 - RNA, 13 nt, Yersinia pestis KIM
acagucauuaaca

SEQ ID NO: 2334744 - RNA, 20 nt, Yersinia pestis KIM
acagucuagugcgcugugcc

SEQ ID NO: 2334745 - RNA, 16 nt, Yersinia pestis KIM
acagucacaccaacac

SEQ ID NO: 2334746 - RNA, 17 nt, Yersinia pestis KIM
acagucaguucauuaca

SEQ ID NO: 2334747 - RNA, 16 nt, Yersinia pestis KIM
acaguauucugcuucc

SEQ ID NO: 2334748 - RNA, 18 nt, Yersinia pestis KIM
acaguaggcugaaggccu

SEQ ID NO: 2334749 - RNA, 19 nt, Yersinia pestis KIM
acauaaauaaguucagguu

SEQ ID NO: 2334750 - RNA, 20 nt, Yersinia pestis KIM
acauaaagcaaacgccgcuc

SEQ ID NO: 2334751 - RNA, 16 nt, Yersinia pestis KIM
acauaaccaucaaaca

SEQ ID NO: 2334752 - RNA, 13 nt, Yersinia pestis KIM
acauaaccaucaa

SEQ ID NO: 2334753 - RNA, 15 nt, Yersinia pestis KIM
acauaaaaagaaaaa

SEQ ID NO: 2334754 - RNA, 21 nt, Yersinia pestis KIM
acauaaaaagaaaaaaacaga

SEQ ID NO: 2334755 - RNA, 16 nt, Yersinia pestis KIM
acauaaaaucaauauc

SEQ ID NO: 2334756 - RNA, 22 nt, Yersinia pestis KIM
acaguugugucagaccaaauag

SEQ ID NO: 2334757 - RNA, 20 nt, Yersinia pestis KIM
acaguuccuguuuuugaaua

SEQ ID NO: 2334758 - RNA, 20 nt, Yersinia pestis KIM
acaguuaaacaacgcugaaa

SEQ ID NO: 2334759 - RNA, 15 nt, Yersinia pestis KIM
acaguuaauuuucac

SEQ ID NO: 2334760 - RNA, 18 nt, Yersinia pestis KIM
acagugcaacauuaaaaa

SEQ ID NO: 2334761 - RNA, 22 nt, Yersinia pestis KIM
acagucugucguacuuuccuuc

SEQ ID NO: 2334762 - RNA, 16 nt, Yersinia pestis KIM
acagucuuuuucccaa

SEQ ID NO: 2334763 - RNA, 20 nt, Yersinia pestis KIM
acagugucaguaugaaauuu

SEQ ID NO: 2334764 - RNA, 19 nt, Yersinia pestis KIM
acaggccgugggcaauaac

SEQ ID NO: 2334765 - RNA, 18 nt, Yersinia pestis KIM
acaggcgauagcuucagc

SEQ ID NO: 2334766 - RNA, 12 nt, Yersinia pestis KIM
acaggaaacucc

SEQ ID NO: 2334767 - RNA, 22 nt, Yersinia pestis KIM
acaggcucuaucucuucagggc

SEQ ID NO: 2334768 - RNA, 14 nt, Yersinia pestis KIM
acaggcugccugcc

SEQ ID NO: 2334769 - RNA, 15 nt, Yersinia pestis KIM
acagggcagaaaaua

SEQ ID NO: 2334770 - RNA, 22 nt, Yersinia pestis KIM
acaggcuugaugaaagcuauuu

SEQ ID NO: 2334771 - RNA, 20 nt, Yersinia pestis KIM
acagcgagauaaacugugcc

SEQ ID NO: 2334772 - RNA, 19 nt, Yersinia pestis KIM
acagcgagauaaacugugc

SEQ ID NO: 2334773 - RNA, 21 nt, Yersinia pestis KIM
acagcguuggcagcaaaucuu

SEQ ID NO: 2334774 - RNA, 20 nt, Yersinia pestis KIM
acagcgccucaguaucuuuc

SEQ ID NO: 2334775 - RNA, 15 nt, Yersinia pestis KIM
acagcucaucaccaa

SEQ ID NO: 2334776 - RNA, 17 nt, Yersinia pestis KIM
acagcuaucuugaaaca

SEQ ID NO: 2334777 - RNA, 19 nt, Yersinia pestis KIM
acagcuaauuuucauugau

SEQ ID NO: 2334778 - RNA, 13 nt, Yersinia pestis KIM
acagcaacaccau

SEQ ID NO: 2334779 - RNA, 19 nt, Yersinia pestis KIM
acacguggguauccagugu

SEQ ID NO: 2334780 - RNA, 18 nt, Yersinia pestis KIM
acacguggguauccagug

SEQ ID NO: 2334781 - RNA, 19 nt, Yersinia pestis KIM
acacgucuaauuccgccag

SEQ ID NO: 2334782 - RNA, 14 nt, Yersinia pestis KIM
acacgguugaaaag

SEQ ID NO: 2334783 - RNA, 16 nt, Yersinia pestis KIM
acacguaaaacaggga

SEQ ID NO: 2334784 - RNA, 19 nt, Yersinia pestis KIM
acacguaucgaugcccgca

SEQ ID NO: 2334785 - RNA, 12 nt, Yersinia pestis KIM
acagcaccaccg

SEQ ID NO: 2334786 - RNA, 19 nt, Yersinia pestis KIM
acagcaccaccgauggcac

SEQ ID NO: 2334787 - RNA, 13 nt, Yersinia pestis KIM
acagcaaggcagc

SEQ ID NO: 2334788 - RNA, 22 nt, Yersinia pestis KIM
acagcaauauccgugauuaacc

SEQ ID NO: 2334789 - RNA, 19 nt, Yersinia pestis KIM
acagcaguucaucuucgau

SEQ ID NO: 2334790 - RNA, 21 nt, Yersinia pestis KIM
acagccgcccccuuucuuauc

SEQ ID NO: 2334791 - RNA, 16 nt, Yersinia pestis KIM
acagccauauuuuuca

SEQ ID NO: 2334792 - RNA, 16 nt, Yersinia pestis KIM
acagccuaaccgcugu

SEQ ID NO: 2334793 - RNA, 14 nt, Yersinia pestis KIM
acagccuaaccgcu

SEQ ID NO: 2334794 - RNA, 12 nt, Yersinia pestis KIM
acagccugugcc

SEQ ID NO: 2334795 - RNA, 14 nt, Yersinia pestis KIM
acagccugugccca

SEQ ID NO: 2334796 - RNA, 19 nt, Yersinia pestis KIM
accaacaccacacugagca

SEQ ID NO: 2334797 - RNA, 22 nt, Yersinia pestis KIM
accaacaccacacugagcaccg

SEQ ID NO: 2334798 - RNA, 12 nt, Yersinia pestis KIM
accaaaucuucc

SEQ ID NO: 2334799 - RNA, 13 nt, Yersinia pestis KIM
accaaaucuucca

SEQ ID NO: 2334800 - RNA, 17 nt, Yersinia pestis KIM
accaaaucuuccagcgg

SEQ ID NO: 2334801 - RNA, 17 nt, Yersinia pestis KIM
accaacaaacaauccua

SEQ ID NO: 2334802 - RNA, 12 nt, Yersinia pestis KIM
accaacaaacaa

SEQ ID NO: 2334803 - RNA, 13 nt, Yersinia pestis KIM
accaaauaaaaca

SEQ ID NO: 2334804 - RNA, 15 nt, Yersinia pestis KIM
accaaauaaaacaag

SEQ ID NO: 2334805 - RNA, 18 nt, Yersinia pestis KIM
accaaauaaaccagaugu

SEQ ID NO: 2334806 - RNA, 18 nt, Yersinia pestis KIM
accaaaggccaaccucuu

SEQ ID NO: 2334807 - RNA, 20 nt, Yersinia pestis KIM
accaaaucugacgguuauuu

SEQ ID NO: 2334808 - RNA, 17 nt, Yersinia pestis KIM
accaaauagccggcucu

SEQ ID NO: 2334809 - RNA, 11 nt, Yersinia pestis KIM
accaaacagaa

SEQ ID NO: 2334810 - RNA, 19 nt, Yersinia pestis KIM
accaaaauucacaacuugu

SEQ ID NO: 2334811 - RNA, 23 nt, Yersinia pestis KIM
accaaaauagcggccaacauaau

SEQ ID NO: 2334812 - RNA, 12 nt, Yersinia pestis KIM
accaaaauagcg

SEQ ID NO: 2334813 - RNA, 17 nt, Yersinia pestis KIM
accaaacauugucaccu

SEQ ID NO: 2334814 - RNA, 21 nt, Yersinia pestis KIM
accaaaccggaugauuucaaa

SEQ ID NO: 2334815 - RNA, 22 nt, Yersinia pestis KIM
accaaacggaaugguuuggcca

SEQ ID NO: 2334816 - RNA, 14 nt, Yersinia pestis KIM
accaaagauauguu

SEQ ID NO: 2334817 - RNA, 23 nt, Yersinia pestis KIM
accaaaacccaucagacggaaug

SEQ ID NO: 2334818 - RNA, 17 nt, Yersinia pestis KIM
acauuuuucuauuucug

SEQ ID NO: 2334819 - RNA, 21 nt, Yersinia pestis KIM
acauuguuaccuaaccaaaca

SEQ ID NO: 2334820 - RNA, 22 nt, Yersinia pestis KIM
acauuguuaccuaaccaaacau

SEQ ID NO: 2334821 - RNA, 21 nt, Yersinia pestis KIM
acauugaccagauuaaucacc

SEQ ID NO: 2334822 - RNA, 17 nt, Yersinia pestis KIM
acauugacgauggaauc

SEQ ID NO: 2334823 - RNA, 19 nt, Yersinia pestis KIM
acauuaauuuaucugcuaa

SEQ ID NO: 2334824 - RNA, 17 nt, Yersinia pestis KIM
acauuaauuauuuauaa

SEQ ID NO: 2334825 - RNA, 19 nt, Yersinia pestis KIM
acauuaccgcucuuuaaca

SEQ ID NO: 2334826 - RNA, 12 nt, Yersinia pestis KIM
acauuacccacu

SEQ ID NO: 2334827 - RNA, 12 nt, Yersinia pestis KIM
acauuaggcaua

SEQ ID NO: 2334828 - RNA, 19 nt, Yersinia pestis KIM
acauuaggcauauauccca

SEQ ID NO: 2334829 - RNA, 20 nt, Yersinia pestis KIM
acauuaggcauauaucccaa

SEQ ID NO: 2334830 - RNA, 22 nt, Yersinia pestis KIM
acauuacuggcgcugacacugg

SEQ ID NO: 2334831 - RNA, 21 nt, Yersinia pestis KIM
acauuuuuaauaauguguuug

SEQ ID NO: 2334832 - RNA, 15 nt, Yersinia pestis KIM
acauuuugugugagu

SEQ ID NO: 2334833 - RNA, 11 nt, Yersinia pestis KIM
acauuuugugc

SEQ ID NO: 2334834 - RNA, 11 nt, Yersinia pestis KIM
acauuuugguu

SEQ ID NO: 2334835 - RNA, 21 nt, Yersinia pestis KIM
acauuuugguuucuccaagca

SEQ ID NO: 2334836 - RNA, 13 nt, Yersinia pestis KIM
acauuuucuaagc

SEQ ID NO: 2334837 - RNA, 14 nt, Yersinia pestis KIM
acauuuucuaucuc

SEQ ID NO: 2334838 - RNA, 15 nt, Yersinia pestis KIM
acauuuguugcaaua

SEQ ID NO: 2334839 - RNA, 14 nt, Yersinia pestis KIM
acauuuuaaagaau

SEQ ID NO: 2334840 - RNA, 17 nt, Yersinia pestis KIM
acauuuuaaagaaugca

SEQ ID NO: 2334841 - RNA, 22 nt, Yersinia pestis KIM
acauuuucaucugaccaaacau

SEQ ID NO: 2334842 - RNA, 16 nt, Yersinia pestis KIM
acauuuuacucccuga

SEQ ID NO: 2334843 - RNA, 17 nt, Yersinia pestis KIM
acauuugcaucuaugga

SEQ ID NO: 2334844 - RNA, 13 nt, Yersinia pestis KIM
acauuuacuuaua

SEQ ID NO: 2334845 - RNA, 15 nt, Yersinia pestis KIM
acauuuacuuauaaa

SEQ ID NO: 2334846 - RNA, 19 nt, Yersinia pestis KIM
acaucugggucauguggaa

SEQ ID NO: 2334847 - RNA, 16 nt, Yersinia pestis KIM
acaucucggcuuucag

SEQ ID NO: 2334848 - RNA, 14 nt, Yersinia pestis KIM
acaugagccacaca

SEQ ID NO: 2334849 - RNA, 21 nt, Yersinia pestis KIM
acaugccgucaccucaucagu

SEQ ID NO: 2334850 - RNA, 15 nt, Yersinia pestis KIM
acaugcggauugaac

SEQ ID NO: 2334851 - RNA, 17 nt, Yersinia pestis KIM
acaugcugaagccagca

SEQ ID NO: 2334852 - RNA, 13 nt, Yersinia pestis KIM
acauguacauuau

SEQ ID NO: 2334853 - RNA, 18 nt, Yersinia pestis KIM
acaugucccucugucccc

SEQ ID NO: 2334854 - RNA, 13 nt, Yersinia pestis KIM
acauccuuauuuu

SEQ ID NO: 2334855 - RNA, 22 nt, Yersinia pestis KIM
acaucgguaucggccaauucag

SEQ ID NO: 2334856 - RNA, 22 nt, Yersinia pestis KIM
acaucggauaauguuaauauuu

SEQ ID NO: 2334857 - RNA, 19 nt, Yersinia pestis KIM
acauccaauucaguacgac

SEQ ID NO: 2334858 - RNA, 20 nt, Yersinia pestis KIM
acauccaauuuuuucaucau

SEQ ID NO: 2334859 - RNA, 12 nt, Yersinia pestis KIM
acauccaauuca

SEQ ID NO: 2334860 - RNA, 17 nt, Yersinia pestis KIM
acauccaacaacugcca

SEQ ID NO: 2334861 - RNA, 17 nt, Yersinia pestis KIM
acauaacguuauaacuc

SEQ ID NO: 2334862 - RNA, 13 nt, Yersinia pestis KIM
acauaagaugacc

SEQ ID NO: 2334863 - RNA, 12 nt, Yersinia pestis KIM
acauaauauuua

SEQ ID NO: 2334864 - RNA, 17 nt, Yersinia pestis KIM
acauaaguaagugauuc

SEQ ID NO: 2334865 - RNA, 16 nt, Yersinia pestis KIM
acauaauaaauuaaua

SEQ ID NO: 2334866 - RNA, 21 nt, Yersinia pestis KIM
acauaaucuuuacugcauuga

SEQ ID NO: 2334867 - RNA, 16 nt, Yersinia pestis KIM
acaucaaucaccccag

SEQ ID NO: 2334868 - RNA, 15 nt, Yersinia pestis KIM
acaucaauccgcauc

SEQ ID NO: 2334869 - RNA, 22 nt, Yersinia pestis KIM
acaucaauccgcaucguaaccc

SEQ ID NO: 2334870 - RNA, 19 nt, Yersinia pestis KIM
acaucacaccugggcgcuc

SEQ ID NO: 2334871 - RNA, 18 nt, Yersinia pestis KIM
acaucaucuucuauuauu

SEQ ID NO: 2334872 - RNA, 13 nt, Yersinia pestis KIM
acaucaugaguaa

SEQ ID NO: 2334873 - RNA, 19 nt, Yersinia pestis KIM
acaaccuaaaaaaaacaac

SEQ ID NO: 2334874 - RNA, 14 nt, Yersinia pestis KIM
acaaccgugcacca

SEQ ID NO: 2334875 - RNA, 14 nt, Yersinia pestis KIM
acaacccaauaaua

SEQ ID NO: 2334876 - RNA, 23 nt, Yersinia pestis KIM
acaaccauuguggcuaaacccaa

SEQ ID NO: 2334877 - RNA, 13 nt, Yersinia pestis KIM
acaacccauuucc

SEQ ID NO: 2334878 - RNA, 19 nt, Yersinia pestis KIM
acaaccaacaaacaauccu

SEQ ID NO: 2334879 - RNA, 14 nt, Yersinia pestis KIM
acaaccaacaaaca

SEQ ID NO: 2334880 - RNA, 12 nt, Yersinia pestis KIM
acaaccaauaca

SEQ ID NO: 2334881 - RNA, 18 nt, Yersinia pestis KIM
acaacaucaaaugaaggg

SEQ ID NO: 2334882 - RNA, 19 nt, Yersinia pestis KIM
acaacauagguuuuuucac

SEQ ID NO: 2334883 - RNA, 14 nt, Yersinia pestis KIM
acaacaucauauau

SEQ ID NO: 2334884 - RNA, 12 nt, Yersinia pestis KIM
acaacaauaaua

SEQ ID NO: 2334885 - RNA, 22 nt, Yersinia pestis KIM
acaacagucacaccaacacuga

SEQ ID NO: 2334886 - RNA, 12 nt, Yersinia pestis KIM
acaacaaaggcg

SEQ ID NO: 2334887 - RNA, 17 nt, Yersinia pestis KIM
acaaauuugacauuucc

SEQ ID NO: 2334888 - RNA, 17 nt, Yersinia pestis KIM
acaaauucaccagcaau

SEQ ID NO: 2334889 - RNA, 18 nt, Yersinia pestis KIM
acaaauucaccagcaaua

SEQ ID NO: 2334890 - RNA, 18 nt, Yersinia pestis KIM
acaaaugcugugccaugu

SEQ ID NO: 2334891 - RNA, 21 nt, Yersinia pestis KIM
acaaaucuuaaauugaagagu

SEQ ID NO: 2334892 - RNA, 14 nt, Yersinia pestis KIM
acaaauccuuuuaa

SEQ ID NO: 2334893 - RNA, 16 nt, Yersinia pestis KIM
acaaauccuuuuaaaa

SEQ ID NO: 2334894 - RNA, 18 nt, Yersinia pestis KIM
acaaaguuaaaugaagga

SEQ ID NO: 2334895 - RNA, 14 nt, Yersinia pestis KIM
acaaagugagggau

SEQ ID NO: 2334896 - RNA, 14 nt, Yersinia pestis KIM
acaaauaaaaccaa

SEQ ID NO: 2334897 - RNA, 16 nt, Yersinia pestis KIM
acaaaguaccuauggc

SEQ ID NO: 2334898 - RNA, 12 nt, Yersinia pestis KIM
acaaaggucagc

SEQ ID NO: 2334899 - RNA, 14 nt, Yersinia pestis KIM
acaaauagcgcugc

SEQ ID NO: 2334900 - RNA, 13 nt, Yersinia pestis KIM
acaaauaucggcc

SEQ ID NO: 2334901 - RNA, 23 nt, Yersinia pestis KIM
acaaauaugacgcagcgaaaugu

SEQ ID NO: 2334902 - RNA, 16 nt, Yersinia pestis KIM
acaaauagauuuaacu

SEQ ID NO: 2334903 - RNA, 18 nt, Yersinia pestis KIM
acaaauaaggcguuuaau

SEQ ID NO: 2334904 - RNA, 23 nt, Yersinia pestis KIM
acaaauaacccgccuagcaucau

SEQ ID NO: 2334905 - RNA, 15 nt, Yersinia pestis KIM
acaaaaucccccacc

SEQ ID NO: 2334906 - RNA, 16 nt, Yersinia pestis KIM
acaaaauagaaaacag

SEQ ID NO: 2334907 - RNA, 12 nt, Yersinia pestis KIM
acaaaaugugaa

SEQ ID NO: 2334908 - RNA, 17 nt, Yersinia pestis KIM
acaaaaugugaaaagca

SEQ ID NO: 2334909 - RNA, 22 nt, Yersinia pestis KIM
acaaaaugugaaaagcagucga

SEQ ID NO: 2334910 - RNA, 22 nt, Yersinia pestis KIM
acaaaagagauccguuuaauca

SEQ ID NO: 2334911 - RNA, 18 nt, Yersinia pestis KIM
acaaaaauaaacgggcuu

SEQ ID NO: 2334912 - RNA, 13 nt, Yersinia pestis KIM
acaaaaccaaccc

SEQ ID NO: 2334913 - RNA, 13 nt, Yersinia pestis KIM
acaaacagauaca

SEQ ID NO: 2334914 - RNA, 22 nt, Yersinia pestis KIM
acaaacgcguuaauuaagaccc

SEQ ID NO: 2334915 - RNA, 15 nt, Yersinia pestis KIM
acaaaccuaaaccuu

SEQ ID NO: 2334916 - RNA, 24 nt, Yersinia pestis KIM
acaaagauacagcccaagagaaau

SEQ ID NO: 2334917 - RNA, 15 nt, Yersinia pestis KIM
acaaaggcaaaauga

SEQ ID NO: 2334918 - RNA, 22 nt, Yersinia pestis KIM
acaccgccuaucgugaacaggc

SEQ ID NO: 2334919 - RNA, 12 nt, Yersinia pestis KIM
acacccagccag

SEQ ID NO: 2334920 - RNA, 12 nt, Yersinia pestis KIM
acacccaagaau

SEQ ID NO: 2334921 - RNA, 16 nt, Yersinia pestis KIM
acacccaagaauauaa

SEQ ID NO: 2334922 - RNA, 12 nt, Yersinia pestis KIM
acaccacaacau

SEQ ID NO: 2334923 - RNA, 14 nt, Yersinia pestis KIM
acacaaaagacgcc

SEQ ID NO: 2334924 - RNA, 13 nt, Yersinia pestis KIM
acacaaaaaaggg

SEQ ID NO: 2334925 - RNA, 17 nt, Yersinia pestis KIM
acacaaaaaagggcaag

SEQ ID NO: 2334926 - RNA, 20 nt, Yersinia pestis KIM
acacaaaauagaaaacagca

SEQ ID NO: 2334927 - RNA, 20 nt, Yersinia pestis KIM
acacauuccaguaaaaaaau

SEQ ID NO: 2334928 - RNA, 17 nt, Yersinia pestis KIM
acacauucccauuauua

SEQ ID NO: 2334929 - RNA, 18 nt, Yersinia pestis KIM
acacauuccaguaaaaaa

SEQ ID NO: 2334930 - RNA, 19 nt, Yersinia pestis KIM
acaccaacacugaauaacu

SEQ ID NO: 2334931 - RNA, 18 nt, Yersinia pestis KIM
acaccaacaccacacuga

SEQ ID NO: 2334932 - RNA, 21 nt, Yersinia pestis KIM
acacgccguuuugagauuaau

SEQ ID NO: 2334933 - RNA, 14 nt, Yersinia pestis KIM
acacgguaggcuuc

SEQ ID NO: 2334934 - RNA, 22 nt, Yersinia pestis KIM
acacgccuucauguugcaacau

SEQ ID NO: 2334935 - RNA, 21 nt, Yersinia pestis KIM
acaccuucgagagcuaaugcu

SEQ ID NO: 2334936 - RNA, 15 nt, Yersinia pestis KIM
acaccuugcagcaca

SEQ ID NO: 2334937 - RNA, 16 nt, Yersinia pestis KIM
acacgaaaagcagcag

SEQ ID NO: 2334938 - RNA, 13 nt, Yersinia pestis KIM
acaccuuaaaaca

SEQ ID NO: 2334939 - RNA, 20 nt, Yersinia pestis KIM
acaccggggauccauaggau

SEQ ID NO: 2334940 - RNA, 17 nt, Yersinia pestis KIM
acaccggggauccauag

SEQ ID NO: 2334941 - RNA, 23 nt, Yersinia pestis KIM
acaccggguaagguaaagaaaua

SEQ ID NO: 2334942 - RNA, 15 nt, Yersinia pestis KIM
acaccggccaaaauc

SEQ ID NO: 2334943 - RNA, 22 nt, Yersinia pestis KIM
acaccucaacgugauaugccug

SEQ ID NO: 2334944 - RNA, 22 nt, Yersinia pestis KIM
acaccgugguuugcucuucccu

SEQ ID NO: 2334945 - RNA, 14 nt, Yersinia pestis KIM
acaacgagggcuca

SEQ ID NO: 2334946 - RNA, 15 nt, Yersinia pestis KIM
acaacgagggcucaa

SEQ ID NO: 2334947 - RNA, 17 nt, Yersinia pestis KIM
acaaccuguagcucaua

SEQ ID NO: 2334948 - RNA, 20 nt, Yersinia pestis KIM
acaagcgaccaucaugaaua

SEQ ID NO: 2334949 - RNA, 18 nt, Yersinia pestis KIM
acaauauucgcagccaaa

SEQ ID NO: 2334950 - RNA, 23 nt, Yersinia pestis KIM
acaauauucauuuugcuggaaaa

SEQ ID NO: 2334951 - RNA, 21 nt, Yersinia pestis KIM
acaauaccgccacacaauaca

SEQ ID NO: 2334952 - RNA, 17 nt, Yersinia pestis KIM
acaauaauuaggaauau

SEQ ID NO: 2334953 - RNA, 22 nt, Yersinia pestis KIM
acaaguugucuguaauaauaau

SEQ ID NO: 2334954 - RNA, 21 nt, Yersinia pestis KIM
acaaguugucuguaauaauaa

SEQ ID NO: 2334955 - RNA, 20 nt, Yersinia pestis KIM
acaaguuggugcaguugguc

SEQ ID NO: 2334956 - RNA, 18 nt, Yersinia pestis KIM
acaaguuacauuuuuaac

SEQ ID NO: 2334957 - RNA, 22 nt, Yersinia pestis KIM
acaaucagugcaauaaauucaa

SEQ ID NO: 2334958 - RNA, 19 nt, Yersinia pestis KIM
acaaucauuuaacggccag

SEQ ID NO: 2334959 - RNA, 21 nt, Yersinia pestis KIM
acaauuuuauuguuuucguuu

SEQ ID NO: 2334960 - RNA, 10 nt, Yersinia pestis KIM
acaauuuuau

SEQ ID NO: 2334961 - RNA, 15 nt, Yersinia pestis KIM
acaauugcuccaguu

SEQ ID NO: 2334962 - RNA, 19 nt, Yersinia pestis KIM
acaauugccugauuuuuau

SEQ ID NO: 2334963 - RNA, 17 nt, Yersinia pestis KIM
acaauucuugaaauuau

SEQ ID NO: 2334964 - RNA, 18 nt, Yersinia pestis KIM
acaauucuugaaauuaua

SEQ ID NO: 2334965 - RNA, 15 nt, Yersinia pestis KIM
acaaugccuaaaaug

SEQ ID NO: 2334966 - RNA, 14 nt, Yersinia pestis KIM
acaaugcacagugc

SEQ ID NO: 2334967 - RNA, 14 nt, Yersinia pestis KIM
aaucagaucaacag

SEQ ID NO: 2334968 - RNA, 20 nt, Yersinia pestis KIM
aaucagaucaacagauuuuc

SEQ ID NO: 2334969 - RNA, 20 nt, Yersinia pestis KIM
aaucagauggucgccuuucc

SEQ ID NO: 2334970 - RNA, 21 nt, Yersinia pestis KIM
aaucaucugcuguacacuaac

SEQ ID NO: 2334971 - RNA, 21 nt, Yersinia pestis KIM
aaucauuuguuucucaccgac

SEQ ID NO: 2334972 - RNA, 14 nt, Yersinia pestis KIM
aaucauggcauaaa

SEQ ID NO: 2334973 - RNA, 16 nt, Yersinia pestis KIM
aaucauggcauaaacc

SEQ ID NO: 2334974 - RNA, 19 nt, Yersinia pestis KIM
aaucaugcauugcaugaug

SEQ ID NO: 2334975 - RNA, 15 nt, Yersinia pestis KIM
aauccaaacauacau

SEQ ID NO: 2334976 - RNA, 15 nt, Yersinia pestis KIM
aauccagaagccauu

SEQ ID NO: 2334977 - RNA, 19 nt, Yersinia pestis KIM
aauccuugcuaguuauaua

SEQ ID NO: 2334978 - RNA, 14 nt, Yersinia pestis KIM
aauccuucuggcuu

SEQ ID NO: 2334979 - RNA, 14 nt, Yersinia pestis KIM
aauccuacauucag

SEQ ID NO: 2334980 - RNA, 15 nt, Yersinia pestis KIM
aauccuaaugaacac

SEQ ID NO: 2334981 - RNA, 15 nt, Yersinia pestis KIM
aaucgauacaguggc

SEQ ID NO: 2334982 - RNA, 18 nt, Yersinia pestis KIM
aauccguaugucacuggu

SEQ ID NO: 2334983 - RNA, 19 nt, Yersinia pestis KIM
aauccgcuaguuaacccua

SEQ ID NO: 2334984 - RNA, 17 nt, Yersinia pestis KIM
aauccgcgccaaaauua

SEQ ID NO: 2334985 - RNA, 15 nt, Yersinia pestis KIM
aaucccucggcuuau

SEQ ID NO: 2334986 - RNA, 13 nt, Yersinia pestis KIM
aaucccuacggca

SEQ ID NO: 2334987 - RNA, 17 nt, Yersinia pestis KIM
aaucgcaucgucgcugu

SEQ ID NO: 2334988 - RNA, 15 nt, Yersinia pestis KIM
aaucgauuacuggcu

SEQ ID NO: 2334989 - RNA, 17 nt, Yersinia pestis KIM
aaucgccaaacugcuca

SEQ ID NO: 2334990 - RNA, 15 nt, Yersinia pestis KIM
aaucgccaaacugcu

SEQ ID NO: 2334991 - RNA, 18 nt, Yersinia pestis KIM
aaucucuccuagaggcuu

SEQ ID NO: 2334992 - RNA, 22 nt, Yersinia pestis KIM
aaucucuggcaacggcacaucc

SEQ ID NO: 2334993 - RNA, 17 nt, Yersinia pestis KIM
aaucucugggugcugcu

SEQ ID NO: 2334994 - RNA, 12 nt, Yersinia pestis KIM
aaucucaucaau

SEQ ID NO: 2334995 - RNA, 12 nt, Yersinia pestis KIM
aaucuagaacua

SEQ ID NO: 2334996 - RNA, 21 nt, Yersinia pestis KIM
aaucugacgguuauuuucuga

SEQ ID NO: 2334997 - RNA, 17 nt, Yersinia pestis KIM
aaucugagcgaacugaa

SEQ ID NO: 2334998 - RNA, 13 nt, Yersinia pestis KIM
aaucugauacuga

SEQ ID NO: 2334999 - RNA, 22 nt, Yersinia pestis KIM
aaucugaugaauuaaagauuaa

SEQ ID NO: 2335000 - RNA, 19 nt, Yersinia pestis KIM
aaucugcggcauaaauucu

SEQ ID NO: 2335001 - RNA, 19 nt, Yersinia pestis KIM
aaucugguacuccugcuca

SEQ ID NO: 2335002 - RNA, 18 nt, Yersinia pestis KIM
aaucuguuccugauucca

SEQ ID NO: 2335003 - RNA, 14 nt, Yersinia pestis KIM
aaucugucgcugug

SEQ ID NO: 2335004 - RNA, 16 nt, Yersinia pestis KIM
aaucugucgcugugaa

SEQ ID NO: 2335005 - RNA, 18 nt, Yersinia pestis KIM
aaucuguaagucauucuu

SEQ ID NO: 2335006 - RNA, 20 nt, Yersinia pestis KIM
aaucuguggucaacagugaa

SEQ ID NO: 2335007 - RNA, 11 nt, Yersinia pestis KIM
aaucuuccuuu

SEQ ID NO: 2335008 - RNA, 12 nt, Yersinia pestis KIM
aaucuuccagcg

SEQ ID NO: 2335009 - RNA, 21 nt, Yersinia pestis KIM
aaucuuccagcggcaaauaga

SEQ ID NO: 2335010 - RNA, 17 nt, Yersinia pestis KIM
aauauucaguaagguuu

SEQ ID NO: 2335011 - RNA, 20 nt, Yersinia pestis KIM
aauauucaguaagguuuuac

SEQ ID NO: 2335012 - RNA, 19 nt, Yersinia pestis KIM
aauauuccggccagcuuuu

SEQ ID NO: 2335013 - RNA, 18 nt, Yersinia pestis KIM
aauauuccugagcuggcu

SEQ ID NO: 2335014 - RNA, 19 nt, Yersinia pestis KIM
aauauucucaauauuaaua

SEQ ID NO: 2335015 - RNA, 16 nt, Yersinia pestis KIM
aauauucauucuuauc

SEQ ID NO: 2335016 - RNA, 16 nt, Yersinia pestis KIM
aauauucgcagccaaa

SEQ ID NO: 2335017 - RNA, 14 nt, Yersinia pestis KIM
aauauuggauaaua

SEQ ID NO: 2335018 - RNA, 21 nt, Yersinia pestis KIM
aauauuggauaauaaccugau

SEQ ID NO: 2335019 - RNA, 12 nt, Yersinia pestis KIM
aauauugcacaa

SEQ ID NO: 2335020 - RNA, 16 nt, Yersinia pestis KIM
aauauugcauuuuaca

SEQ ID NO: 2335021 - RNA, 14 nt, Yersinia pestis KIM
aauauugacaggau

SEQ ID NO: 2335022 - RNA, 22 nt, Yersinia pestis KIM
aauauugacaggaucaggccag

SEQ ID NO: 2335023 - RNA, 16 nt, Yersinia pestis KIM
aauauuuauaaaaaau

SEQ ID NO: 2335024 - RNA, 12 nt, Yersinia pestis KIM
aauauuuaucca

SEQ ID NO: 2335025 - RNA, 12 nt, Yersinia pestis KIM
aauauuucaggc

SEQ ID NO: 2335026 - RNA, 15 nt, Yersinia pestis KIM
aaucaaaaaauaaau

SEQ ID NO: 2335027 - RNA, 13 nt, Yersinia pestis KIM
aaucaaaaaauaa

SEQ ID NO: 2335028 - RNA, 23 nt, Yersinia pestis KIM
aaucaaaaaacagaauagugggu

SEQ ID NO: 2335029 - RNA, 15 nt, Yersinia pestis KIM
aauauuuucauuugg

SEQ ID NO: 2335030 - RNA, 20 nt, Yersinia pestis KIM
aauauuuguuugaauuuuag

SEQ ID NO: 2335031 - RNA, 14 nt, Yersinia pestis KIM
aauagauaacaaac

SEQ ID NO: 2335032 - RNA, 15 nt, Yersinia pestis KIM
aauagauaaaaacau

SEQ ID NO: 2335033 - RNA, 13 nt, Yersinia pestis KIM
aauagcauaaaua

SEQ ID NO: 2335034 - RNA, 15 nt, Yersinia pestis KIM
aauagcauaaauauc

SEQ ID NO: 2335035 - RNA, 15 nt, Yersinia pestis KIM
aauagcaucuggcca

SEQ ID NO: 2335036 - RNA, 16 nt, Yersinia pestis KIM
aauagcaguggccauu

SEQ ID NO: 2335037 - RNA, 21 nt, Yersinia pestis KIM
aauaugauaguguaaaaacca

SEQ ID NO: 2335038 - RNA, 18 nt, Yersinia pestis KIM
aauagcccgacacguggc

SEQ ID NO: 2335039 - RNA, 15 nt, Yersinia pestis KIM
aauaugcaaaaaaag

SEQ ID NO: 2335040 - RNA, 22 nt, Yersinia pestis KIM
aauaugcggcauaacugaauac

SEQ ID NO: 2335041 - RNA, 17 nt, Yersinia pestis KIM
aauauggguuaaaaacu

SEQ ID NO: 2335042 - RNA, 22 nt, Yersinia pestis KIM
aauauguaguuguaccccugaa

SEQ ID NO: 2335043 - RNA, 20 nt, Yersinia pestis KIM
aauaugugacaauaguguug

SEQ ID NO: 2335044 - RNA, 17 nt, Yersinia pestis KIM
aauauuaaaauagcaac

SEQ ID NO: 2335045 - RNA, 17 nt, Yersinia pestis KIM
aauauuaacugcaguga

SEQ ID NO: 2335046 - RNA, 13 nt, Yersinia pestis KIM
aauauuauucagu

SEQ ID NO: 2335047 - RNA, 14 nt, Yersinia pestis KIM
aaucaagcgccauu

SEQ ID NO: 2335048 - RNA, 23 nt, Yersinia pestis KIM
aaucaagugcgaaaauuuaacua

SEQ ID NO: 2335049 - RNA, 19 nt, Yersinia pestis KIM
aaucaagggcgauaccaua

SEQ ID NO: 2335050 - RNA, 18 nt, Yersinia pestis KIM
aaucaagauauuacuucu

SEQ ID NO: 2335051 - RNA, 13 nt, Yersinia pestis KIM
aaucaauuuuugc

SEQ ID NO: 2335052 - RNA, 15 nt, Yersinia pestis KIM
aaucaauguauugcu

SEQ ID NO: 2335053 - RNA, 17 nt, Yersinia pestis KIM
aaucaauguauugcucc

SEQ ID NO: 2335054 - RNA, 14 nt, Yersinia pestis KIM
aaucaauaagcuac

SEQ ID NO: 2335055 - RNA, 13 nt, Yersinia pestis KIM
aaucaacagauau

SEQ ID NO: 2335056 - RNA, 16 nt, Yersinia pestis KIM
aaucaacgcucaauca

SEQ ID NO: 2335057 - RNA, 21 nt, Yersinia pestis KIM
aaucaacgaaacgcauaagaa

SEQ ID NO: 2335058 - RNA, 19 nt, Yersinia pestis KIM
aaucaaaauacccauugag

SEQ ID NO: 2335059 - RNA, 14 nt, Yersinia pestis KIM
aaucaaaauaccca

SEQ ID NO: 2335060 - RNA, 23 nt, Yersinia pestis KIM
aaucaaaaguuaggguucaguaa

SEQ ID NO: 2335061 - RNA, 17 nt, Yersinia pestis KIM
aaucaaaaauugcccca

SEQ ID NO: 2335062 - RNA, 14 nt, Yersinia pestis KIM
aaucacauacuggc

SEQ ID NO: 2335063 - RNA, 11 nt, Yersinia pestis KIM
aaucaccaaca

SEQ ID NO: 2335064 - RNA, 22 nt, Yersinia pestis KIM
aaucacauuucaaauuaucgau

SEQ ID NO: 2335065 - RNA, 23 nt, Yersinia pestis KIM
aaucaccuuggauggcgaaacaa

SEQ ID NO: 2335066 - RNA, 17 nt, Yersinia pestis KIM
aaucaccuggccaggaa

SEQ ID NO: 2335067 - RNA, 16 nt, Yersinia pestis KIM
aaucaccauaacugcu

SEQ ID NO: 2335068 - RNA, 14 nt, Yersinia pestis KIM
aaucacccgcaaga

SEQ ID NO: 2335069 - RNA, 18 nt, Yersinia pestis KIM
aaucacugauucagaaag

SEQ ID NO: 2335070 - RNA, 19 nt, Yersinia pestis KIM
aaucacugauucagaaagg

SEQ ID NO: 2335071 - RNA, 16 nt, Yersinia pestis KIM
aaucacuggcaauaau

SEQ ID NO: 2335072 - RNA, 19 nt, Yersinia pestis KIM
aaucacuggcaauaauuca

SEQ ID NO: 2335073 - RNA, 13 nt, Yersinia pestis KIM
aaucacuuauucc

SEQ ID NO: 2335074 - RNA, 18 nt, Yersinia pestis KIM
aaucagaggugaaaaaau

SEQ ID NO: 2335075 - RNA, 16 nt, Yersinia pestis KIM
aaucacuuuauuugcc

SEQ ID NO: 2335076 - RNA, 20 nt, Yersinia pestis KIM
aauugcuguuggaucucucc

SEQ ID NO: 2335077 - RNA, 22 nt, Yersinia pestis KIM
aauugcuuaaaaaaagcaugug

SEQ ID NO: 2335078 - RNA, 20 nt, Yersinia pestis KIM
aauugcuggcuaucaucccu

SEQ ID NO: 2335079 - RNA, 19 nt, Yersinia pestis KIM
aauugcugcuugcgcgccu

SEQ ID NO: 2335080 - RNA, 17 nt, Yersinia pestis KIM
aauugccugauuuuuau

SEQ ID NO: 2335081 - RNA, 18 nt, Yersinia pestis KIM
aauuggcaaguuaaucau

SEQ ID NO: 2335082 - RNA, 19 nt, Yersinia pestis KIM
aauuggugcuuuauguauu

SEQ ID NO: 2335083 - RNA, 17 nt, Yersinia pestis KIM
aauugaagauuuaaaua

SEQ ID NO: 2335084 - RNA, 21 nt, Yersinia pestis KIM
aauucuggguacaacacaaaa

SEQ ID NO: 2335085 - RNA, 12 nt, Yersinia pestis KIM
aaaacaagcuac

SEQ ID NO: 2335086 - RNA, 17 nt, Yersinia pestis KIM
aaaacaacccgaauuaa

SEQ ID NO: 2335087 - RNA, 23 nt, Yersinia pestis KIM
aaaacaacccgaauuaauaaaac

SEQ ID NO: 2335088 - RNA, 13 nt, Yersinia pestis KIM
aaaacaaaguagu

SEQ ID NO: 2335089 - RNA, 18 nt, Yersinia pestis KIM
aaaacaauaaaaagaucu

SEQ ID NO: 2335090 - RNA, 23 nt, Yersinia pestis KIM
aauugguuagcgccuuuuuuaua

SEQ ID NO: 2335091 - RNA, 20 nt, Yersinia pestis KIM
aauugguuuuaauaaccauu

SEQ ID NO: 2335092 - RNA, 23 nt, Yersinia pestis KIM
aauuguuugcuaucaauugcugg

SEQ ID NO: 2335093 - RNA, 14 nt, Yersinia pestis KIM
aauuguuugcuauc

SEQ ID NO: 2335094 - RNA, 15 nt, Yersinia pestis KIM
aauuguuucuucccc

SEQ ID NO: 2335095 - RNA, 14 nt, Yersinia pestis KIM
aauuuaagaaaucu

SEQ ID NO: 2335096 - RNA, 14 nt, Yersinia pestis KIM
aauuauauucuugg

SEQ ID NO: 2335097 - RNA, 15 nt, Yersinia pestis KIM
aauuauauaagagau

SEQ ID NO: 2335098 - RNA, 13 nt, Yersinia pestis KIM
aauuauccguaaa

SEQ ID NO: 2335099 - RNA, 22 nt, Yersinia pestis KIM
aauuaucgaucacaugcucagu

SEQ ID NO: 2335100 - RNA, 14 nt, Yersinia pestis KIM
aauuaagcaaaaag

SEQ ID NO: 2335101 - RNA, 19 nt, Yersinia pestis KIM
aauuaagcaaaaaggcugc

SEQ ID NO: 2335102 - RNA, 15 nt, Yersinia pestis KIM
aauuauaaugaugua

SEQ ID NO: 2335103 - RNA, 22 nt, Yersinia pestis KIM
aauuauagccaaaucuggauaa

SEQ ID NO: 2335104 - RNA, 15 nt, Yersinia pestis KIM
aauucacgccuaucu

SEQ ID NO: 2335105 - RNA, 19 nt, Yersinia pestis KIM
aauucacgcaaggccaggu

SEQ ID NO: 2335106 - RNA, 20 nt, Yersinia pestis KIM
aauucagguugaucaguaaa

SEQ ID NO: 2335107 - RNA, 15 nt, Yersinia pestis KIM
aauucaccagcaaua

SEQ ID NO: 2335108 - RNA, 17 nt, Yersinia pestis KIM
aauuauuguucaaaaac

SEQ ID NO: 2335109 - RNA, 14 nt, Yersinia pestis KIM
aauucucccauuua

SEQ ID NO: 2335110 - RNA, 18 nt, Yersinia pestis KIM
aauucuccuuucuuuucg

SEQ ID NO: 2335111 - RNA, 18 nt, Yersinia pestis KIM
aauucuauccggauuaaa

SEQ ID NO: 2335112 - RNA, 20 nt, Yersinia pestis KIM
aauucuauccggauuaaauu

SEQ ID NO: 2335113 - RNA, 19 nt, Yersinia pestis KIM
aauucaucuuuaacaacaa

SEQ ID NO: 2335114 - RNA, 15 nt, Yersinia pestis KIM
aauucauaugacaaa

SEQ ID NO: 2335115 - RNA, 20 nt, Yersinia pestis KIM
aauucaucagauuguuuaua

SEQ ID NO: 2335116 - RNA, 18 nt, Yersinia pestis KIM
aauucaucagcgcuggcu

SEQ ID NO: 2335117 - RNA, 22 nt, Yersinia pestis KIM
aauucauuauuacucagcacau

SEQ ID NO: 2335118 - RNA, 15 nt, Yersinia pestis KIM
aauucauuauuacuc

SEQ ID NO: 2335119 - RNA, 16 nt, Yersinia pestis KIM
aauucauuauuacuca

SEQ ID NO: 2335120 - RNA, 23 nt, Yersinia pestis KIM
aauuccacgcugaaacuuuucag

SEQ ID NO: 2335121 - RNA, 22 nt, Yersinia pestis KIM
aauuccaccauucucaaaauaa

SEQ ID NO: 2335122 - RNA, 21 nt, Yersinia pestis KIM
aauuccccagcccaacaacuu

SEQ ID NO: 2335123 - RNA, 19 nt, Yersinia pestis KIM
aauguuggggcacaauaag

SEQ ID NO: 2335124 - RNA, 24 nt, Yersinia pestis KIM
aauguugauacuccauuugaacug

SEQ ID NO: 2335125 - RNA, 12 nt, Yersinia pestis KIM
aauguugcaaac

SEQ ID NO: 2335126 - RNA, 15 nt, Yersinia pestis KIM
aauguugcaaacgga

SEQ ID NO: 2335127 - RNA, 23 nt, Yersinia pestis KIM
aauuaaccugcuggcgcaacugu

SEQ ID NO: 2335128 - RNA, 15 nt, Yersinia pestis KIM
aauuaaauuuuauau

SEQ ID NO: 2335129 - RNA, 14 nt, Yersinia pestis KIM
aauuaaaauaauga

SEQ ID NO: 2335130 - RNA, 18 nt, Yersinia pestis KIM
aauuaaacgcucaucaac

SEQ ID NO: 2335131 - RNA, 19 nt, Yersinia pestis KIM
aauuaaacgcucaucaacc

SEQ ID NO: 2335132 - RNA, 13 nt, Yersinia pestis KIM
aauuaaaccucag

SEQ ID NO: 2335133 - RNA, 15 nt, Yersinia pestis KIM
aauguguugaauauc

SEQ ID NO: 2335134 - RNA, 14 nt, Yersinia pestis KIM
aauguuaucgccaa

SEQ ID NO: 2335135 - RNA, 17 nt, Yersinia pestis KIM
aauguucccccuucagc

SEQ ID NO: 2335136 - RNA, 19 nt, Yersinia pestis KIM
aauguuaauauuuuacugc

SEQ ID NO: 2335137 - RNA, 20 nt, Yersinia pestis KIM
aauguuaauauuuuacugcc

SEQ ID NO: 2335138 - RNA, 16 nt, Yersinia pestis KIM
aaugucacgcuuuaaa

SEQ ID NO: 2335139 - RNA, 15 nt, Yersinia pestis KIM
aaugucaccacggcu

SEQ ID NO: 2335140 - RNA, 14 nt, Yersinia pestis KIM
aauguauuuauuca

SEQ ID NO: 2335141 - RNA, 23 nt, Yersinia pestis KIM
aauguccccuugaguauccaaua

SEQ ID NO: 2335142 - RNA, 16 nt, Yersinia pestis KIM
aaugugaaaagcaguc

SEQ ID NO: 2335143 - RNA, 15 nt, Yersinia pestis KIM
aaugcagauaaccgu

SEQ ID NO: 2335144 - RNA, 18 nt, Yersinia pestis KIM
aaugcagacucuuauaua

SEQ ID NO: 2335145 - RNA, 16 nt, Yersinia pestis KIM
aaugcacguaaagagu

SEQ ID NO: 2335146 - RNA, 12 nt, Yersinia pestis KIM
aaugcacccaau

SEQ ID NO: 2335147 - RNA, 17 nt, Yersinia pestis KIM
aaugcacccaauggcaa

SEQ ID NO: 2335148 - RNA, 16 nt, Yersinia pestis KIM
aaugcaccgacaaaga

SEQ ID NO: 2335149 - RNA, 17 nt, Yersinia pestis KIM
aaugcaccgacaaagau

SEQ ID NO: 2335150 - RNA, 17 nt, Yersinia pestis KIM
aaugcaauuuuggaaua

SEQ ID NO: 2335151 - RNA, 17 nt, Yersinia pestis KIM
aaucuugauccugcaau

SEQ ID NO: 2335152 - RNA, 18 nt, Yersinia pestis KIM
aaucuugcagcgaucaca

SEQ ID NO: 2335153 - RNA, 23 nt, Yersinia pestis KIM
aaucuugagcuauuucuugcagu

SEQ ID NO: 2335154 - RNA, 14 nt, Yersinia pestis KIM
aaugccagcgaaaa

SEQ ID NO: 2335155 - RNA, 21 nt, Yersinia pestis KIM
aaugccagacacaagauaaau

SEQ ID NO: 2335156 - RNA, 22 nt, Yersinia pestis KIM
aauggccgccauuuuuauguuu

SEQ ID NO: 2335157 - RNA, 20 nt, Yersinia pestis KIM
aauggccgccauuuuuaugu

SEQ ID NO: 2335158 - RNA, 20 nt, Yersinia pestis KIM
aauggccgauggaaccacau

SEQ ID NO: 2335159 - RNA, 19 nt, Yersinia pestis KIM
aauggccagcgggaaucaa

SEQ ID NO: 2335160 - RNA, 22 nt, Yersinia pestis KIM
aauggcgaaaggaacaaaagag

SEQ ID NO: 2335161 - RNA, 16 nt, Yersinia pestis KIM
aauggccggacucauu

SEQ ID NO: 2335162 - RNA, 11 nt, Yersinia pestis KIM
aauggcauuaa

SEQ ID NO: 2335163 - RNA, 11 nt, Yersinia pestis KIM
aauggaagaau

SEQ ID NO: 2335164 - RNA, 17 nt, Yersinia pestis KIM
aaugguuugcuguucuu

SEQ ID NO: 2335165 - RNA, 20 nt, Yersinia pestis KIM
aaugguuugcuguucuugca

SEQ ID NO: 2335166 - RNA, 14 nt, Yersinia pestis KIM
aaugguuuggccau

SEQ ID NO: 2335167 - RNA, 21 nt, Yersinia pestis KIM
aauguaaaacgaguaaauaca

SEQ ID NO: 2335168 - RNA, 23 nt, Yersinia pestis KIM
aauguaaaacgaguaaauacaaa

SEQ ID NO: 2335169 - RNA, 23 nt, Yersinia pestis KIM
aaugguuuccuucaccaaaaaaa

SEQ ID NO: 2335170 - RNA, 16 nt, Yersinia pestis KIM
aaugcgcucaccaaga

SEQ ID NO: 2335171 - RNA, 19 nt, Yersinia pestis KIM
aaugcuuauuucacacugu

SEQ ID NO: 2335172 - RNA, 13 nt, Yersinia pestis KIM
aaugcggcggcug

SEQ ID NO: 2335173 - RNA, 15 nt, Yersinia pestis KIM
aauggaaaaacguga

SEQ ID NO: 2335174 - RNA, 20 nt, Yersinia pestis KIM
aauggaaaaacgugaauauc

SEQ ID NO: 2335175 - RNA, 16 nt, Yersinia pestis KIM
aacacgaaaagcagca

SEQ ID NO: 2335176 - RNA, 17 nt, Yersinia pestis KIM
aacaccuuuaccuuuac

SEQ ID NO: 2335177 - RNA, 14 nt, Yersinia pestis KIM
aacacgaaaagcag

SEQ ID NO: 2335178 - RNA, 14 nt, Yersinia pestis KIM
aacacgaccuucau

SEQ ID NO: 2335179 - RNA, 22 nt, Yersinia pestis KIM
aacacgacgccauaaaagaaug

SEQ ID NO: 2335180 - RNA, 23 nt, Yersinia pestis KIM
aacacgacgccauaaaagaaugu

SEQ ID NO: 2335181 - RNA, 24 nt, Yersinia pestis KIM
aacacgacgccauaaaagaaugua

SEQ ID NO: 2335182 - RNA, 15 nt, Yersinia pestis KIM
aacaccuaguuauuc

SEQ ID NO: 2335183 - RNA, 19 nt, Yersinia pestis KIM
aacacccaacucaacggca

SEQ ID NO: 2335184 - RNA, 20 nt, Yersinia pestis KIM
aacaccguaacgcccuccug

SEQ ID NO: 2335185 - RNA, 14 nt, Yersinia pestis KIM
aacaccggcaauau

SEQ ID NO: 2335186 - RNA, 22 nt, Yersinia pestis KIM
aacaccgugcuggguaauucau

SEQ ID NO: 2335187 - RNA, 23 nt, Yersinia pestis KIM
aacacguucggcgucgccacccc

SEQ ID NO: 2335188 - RNA, 20 nt, Yersinia pestis KIM
aacacguuuaacucauccua

SEQ ID NO: 2335189 - RNA, 22 nt, Yersinia pestis KIM
aacacugauuuauaaauaauua

SEQ ID NO: 2335190 - RNA, 18 nt, Yersinia pestis KIM
aacacuucagacugaaag

SEQ ID NO: 2335191 - RNA, 14 nt, Yersinia pestis KIM
aacacuuaauucca

SEQ ID NO: 2335192 - RNA, 18 nt, Yersinia pestis KIM
aacacuuaccuauaaaca

SEQ ID NO: 2335193 - RNA, 22 nt, Yersinia pestis KIM
aacagacgccccgaaccauuua

SEQ ID NO: 2335194 - RNA, 17 nt, Yersinia pestis KIM
aacagaccccagaagau

SEQ ID NO: 2335195 - RNA, 16 nt, Yersinia pestis KIM
aacagacacagcaaca

SEQ ID NO: 2335196 - RNA, 17 nt, Yersinia pestis KIM
aacagagcagaaagcag

SEQ ID NO: 2335197 - RNA, 19 nt, Yersinia pestis KIM
aacagauaugcauuauuga

SEQ ID NO: 2335198 - RNA, 20 nt, Yersinia pestis KIM
aacagauagauaaauguuca

SEQ ID NO: 2335199 - RNA, 14 nt, Yersinia pestis KIM
aacagauaaaaaau

SEQ ID NO: 2335200 - RNA, 21 nt, Yersinia pestis KIM
aacagauaaaaaauaauuaaa

SEQ ID NO: 2335201 - RNA, 18 nt, Yersinia pestis KIM
aacagaacuaaacgccaa

SEQ ID NO: 2335202 - RNA, 19 nt, Yersinia pestis KIM
aacagaacuaaacgccaac

SEQ ID NO: 2335203 - RNA, 19 nt, Yersinia pestis KIM
aacagaacuaauaucaaca

SEQ ID NO: 2335204 - RNA, 20 nt, Yersinia pestis KIM
aacagaacuaauaucaacag

SEQ ID NO: 2335205 - RNA, 20 nt, Yersinia pestis KIM
aacagaacccccgcgaacag

SEQ ID NO: 2335206 - RNA, 22 nt, Yersinia pestis KIM
aacagaauguuggugaucagca

SEQ ID NO: 2335207 - RNA, 21 nt, Yersinia pestis KIM
aacacuuuaucgaccacuuuu

SEQ ID NO: 2335208 - RNA, 15 nt, Yersinia pestis KIM
aacagauuuuccauc

SEQ ID NO: 2335209 - RNA, 14 nt, Yersinia pestis KIM
aacagauuguuggu

SEQ ID NO: 2335210 - RNA, 22 nt, Yersinia pestis KIM
aacagauguuauuugaauaaaa

SEQ ID NO: 2335211 - RNA, 23 nt, Yersinia pestis KIM
aacagauguuauuugaauaaaag

SEQ ID NO: 2335212 - RNA, 12 nt, Yersinia pestis KIM
aacagauucaau

SEQ ID NO: 2335213 - RNA, 16 nt, Yersinia pestis KIM
aacagcaucacugucu

SEQ ID NO: 2335214 - RNA, 22 nt, Yersinia pestis KIM
aacagcaucacugucuauuuuu

SEQ ID NO: 2335215 - RNA, 21 nt, Yersinia pestis KIM
aacagcaggauuaagcggagg

SEQ ID NO: 2335216 - RNA, 15 nt, Yersinia pestis KIM
aacagccagcaucac

SEQ ID NO: 2335217 - RNA, 17 nt, Yersinia pestis KIM
aacagccagcaucacga

SEQ ID NO: 2335218 - RNA, 13 nt, Yersinia pestis KIM
aacaccaacacca

SEQ ID NO: 2335219 - RNA, 16 nt, Yersinia pestis KIM
aacaccaacaccacac

SEQ ID NO: 2335220 - RNA, 11 nt, Yersinia pestis KIM
aacaccaaccg

SEQ ID NO: 2335221 - RNA, 22 nt, Yersinia pestis KIM
aacacauuccaguaaaaaaaua

SEQ ID NO: 2335222 - RNA, 20 nt, Yersinia pestis KIM
aacacauuccaguaaaaaaa

SEQ ID NO: 2335223 - RNA, 21 nt, Yersinia pestis KIM
aaaaagucauuaacuguuaaa

SEQ ID NO: 2335224 - RNA, 19 nt, Yersinia pestis KIM
aacacacuucgccagguca

SEQ ID NO: 2335225 - RNA, 14 nt, Yersinia pestis KIM
aacacacagcagac

SEQ ID NO: 2335226 - RNA, 22 nt, Yersinia pestis KIM
aacacaccugcaacguuaaaga

SEQ ID NO: 2335227 - RNA, 20 nt, Yersinia pestis KIM
aacaauuuuauuguuuucgu

SEQ ID NO: 2335228 - RNA, 12 nt, Yersinia pestis KIM
aacacaaaauag

SEQ ID NO: 2335229 - RNA, 20 nt, Yersinia pestis KIM
aacacaaaauagaaaacagc

SEQ ID NO: 2335230 - RNA, 12 nt, Yersinia pestis KIM
aacacaauugau

SEQ ID NO: 2335231 - RNA, 17 nt, Yersinia pestis KIM
aacacauauauuaucua

SEQ ID NO: 2335232 - RNA, 17 nt, Yersinia pestis KIM
aacacauaaaaucagca

SEQ ID NO: 2335233 - RNA, 14 nt, Yersinia pestis KIM
aacacauauuucau

SEQ ID NO: 2335234 - RNA, 20 nt, Yersinia pestis KIM
aacacaucuauuuuuuugaa

SEQ ID NO: 2335235 - RNA, 18 nt, Yersinia pestis KIM
aacaaugguucaucauuu

SEQ ID NO: 2335236 - RNA, 18 nt, Yersinia pestis KIM
aacaauuuuauuguuuuc

SEQ ID NO: 2335237 - RNA, 17 nt, Yersinia pestis KIM
aacaauuuaucagacaa

SEQ ID NO: 2335238 - RNA, 20 nt, Yersinia pestis KIM
aacaauuuaucagacaaucu

SEQ ID NO: 2335239 - RNA, 23 nt, Yersinia pestis KIM
aaauucuuuauacccaaaauaau

SEQ ID NO: 2335240 - RNA, 21 nt, Yersinia pestis KIM
aacaauaaaaagaucugcauu

SEQ ID NO: 2335241 - RNA, 17 nt, Yersinia pestis KIM
aacaaguugaaccauaa

SEQ ID NO: 2335242 - RNA, 15 nt, Yersinia pestis KIM
aacaauaaucucagc

SEQ ID NO: 2335243 - RNA, 21 nt, Yersinia pestis KIM
aacaauauucauuuugcugga

SEQ ID NO: 2335244 - RNA, 13 nt, Yersinia pestis KIM
aaccgagaagucg

SEQ ID NO: 2335245 - RNA, 20 nt, Yersinia pestis KIM
aaccgaguaacaaaugguca

SEQ ID NO: 2335246 - RNA, 14 nt, Yersinia pestis KIM
aaccgaagauaacc

SEQ ID NO: 2335247 - RNA, 12 nt, Yersinia pestis KIM
aacccugacggc

SEQ ID NO: 2335248 - RNA, 16 nt, Yersinia pestis KIM
aaccgcagacauaucu

SEQ ID NO: 2335249 - RNA, 15 nt, Yersinia pestis KIM
aaccgcagcaggcag

SEQ ID NO: 2335250 - RNA, 18 nt, Yersinia pestis KIM
aaccgcagcaggcagagc

SEQ ID NO: 2335251 - RNA, 15 nt, Yersinia pestis KIM
aaccgcauucccugc

SEQ ID NO: 2335252 - RNA, 23 nt, Yersinia pestis KIM
aaccgcaucauuguuuacuauuu

SEQ ID NO: 2335253 - RNA, 22 nt, Yersinia pestis KIM
aaccgcaccacaaaggcaaaau

SEQ ID NO: 2335254 - RNA, 15 nt, Yersinia pestis KIM
aaccgaugcaauaaa

SEQ ID NO: 2335255 - RNA, 18 nt, Yersinia pestis KIM
aaccgcccucuugaacgg

SEQ ID NO: 2335256 - RNA, 15 nt, Yersinia pestis KIM
aaccgccccccaucc

SEQ ID NO: 2335257 - RNA, 20 nt, Yersinia pestis KIM
aaccgcgaagaggguuuuuu

SEQ ID NO: 2335258 - RNA, 21 nt, Yersinia pestis KIM
aaccgcuauaucaucagcaga

SEQ ID NO: 2335259 - RNA, 20 nt, Yersinia pestis KIM
aaccauccccagaacagcua

SEQ ID NO: 2335260 - RNA, 15 nt, Yersinia pestis KIM
aaccauggcacucuc

SEQ ID NO: 2335261 - RNA, 15 nt, Yersinia pestis KIM
aaccacucucccuca

SEQ ID NO: 2335262 - RNA, 14 nt, Yersinia pestis KIM
aaccacugaccuau

SEQ ID NO: 2335263 - RNA, 13 nt, Yersinia pestis KIM
aaccacugaccua

SEQ ID NO: 2335264 - RNA, 18 nt, Yersinia pestis KIM
aaccacugaccuauugau

SEQ ID NO: 2335265 - RNA, 21 nt, Yersinia pestis KIM
aaccacugaccuauugauaaa

SEQ ID NO: 2335266 - RNA, 16 nt, Yersinia pestis KIM
aaccaccuuuaccaug

SEQ ID NO: 2335267 - RNA, 15 nt, Yersinia pestis KIM
aacccggcaucaacc

SEQ ID NO: 2335268 - RNA, 12 nt, Yersinia pestis KIM
aacccauucauc

SEQ ID NO: 2335269 - RNA, 17 nt, Yersinia pestis KIM
aacccgcuaacaugcca

SEQ ID NO: 2335270 - RNA, 17 nt, Yersinia pestis KIM
aacccauauuacucaca

SEQ ID NO: 2335271 - RNA, 13 nt, Yersinia pestis KIM
aacccauagcaaa

SEQ ID NO: 2335272 - RNA, 16 nt, Yersinia pestis KIM
aacccacaucccggca

SEQ ID NO: 2335273 - RNA, 20 nt, Yersinia pestis KIM
aacccacaucccggcagcag

SEQ ID NO: 2335274 - RNA, 18 nt, Yersinia pestis KIM
aaccauuuucaauugccc

SEQ ID NO: 2335275 - RNA, 15 nt, Yersinia pestis KIM
aacccaaaggggagc

SEQ ID NO: 2335276 - RNA, 18 nt, Yersinia pestis KIM
aacccaaaggggagccaa

SEQ ID NO: 2335277 - RNA, 15 nt, Yersinia pestis KIM
aacccaaagcccuua

SEQ ID NO: 2335278 - RNA, 21 nt, Yersinia pestis KIM
aacccagccccuaacagcagu

SEQ ID NO: 2335279 - RNA, 16 nt, Yersinia pestis KIM
aacaucauauauuaaa

SEQ ID NO: 2335280 - RNA, 14 nt, Yersinia pestis KIM
aacaucauccccaa

SEQ ID NO: 2335281 - RNA, 13 nt, Yersinia pestis KIM
aacaucaugacaa

SEQ ID NO: 2335282 - RNA, 17 nt, Yersinia pestis KIM
aacauccagaccuucac

SEQ ID NO: 2335283 - RNA, 15 nt, Yersinia pestis KIM
aacaugagccacaca

SEQ ID NO: 2335284 - RNA, 19 nt, Yersinia pestis KIM
aacaugagccacacauuca

SEQ ID NO: 2335285 - RNA, 22 nt, Yersinia pestis KIM
aacaugagccacacauucaguc

SEQ ID NO: 2335286 - RNA, 16 nt, Yersinia pestis KIM
aacaugacgggugccg

SEQ ID NO: 2335287 - RNA, 21 nt, Yersinia pestis KIM
aacagccuaaggccaucaaua

SEQ ID NO: 2335288 - RNA, 17 nt, Yersinia pestis KIM
aacagccguauaucuua

SEQ ID NO: 2335289 - RNA, 14 nt, Yersinia pestis KIM
aacagccauauuuu

SEQ ID NO: 2335290 - RNA, 17 nt, Yersinia pestis KIM
aacauacaaccacugaa

SEQ ID NO: 2335291 - RNA, 12 nt, Yersinia pestis KIM
aacauuaaaaau

SEQ ID NO: 2335292 - RNA, 13 nt, Yersinia pestis KIM
aacauuaaaaaua

SEQ ID NO: 2335293 - RNA, 22 nt, Yersinia pestis KIM
aacauuaaggcgauauuauuag

SEQ ID NO: 2335294 - RNA, 12 nt, Yersinia pestis KIM
aacauguagcac

SEQ ID NO: 2335295 - RNA, 14 nt, Yersinia pestis KIM
aacauucaucuuuu

SEQ ID NO: 2335296 - RNA, 14 nt, Yersinia pestis KIM
aacauuauccguuu

SEQ ID NO: 2335297 - RNA, 18 nt, Yersinia pestis KIM
aacauuauccguuugcaa

SEQ ID NO: 2335298 - RNA, 14 nt, Yersinia pestis KIM
aacauuauuuuuca

SEQ ID NO: 2335299 - RNA, 19 nt, Yersinia pestis KIM
aacauuauuuuucacgagg

SEQ ID NO: 2335300 - RNA, 20 nt, Yersinia pestis KIM
aacauugguuacccuaagaa

SEQ ID NO: 2335301 - RNA, 21 nt, Yersinia pestis KIM
aacauugguuacccuaagaau

SEQ ID NO: 2335302 - RNA, 19 nt, Yersinia pestis KIM
aacauuguccugcaauccu

SEQ ID NO: 2335303 - RNA, 14 nt, Yersinia pestis KIM
aaccaacaugagcc

SEQ ID NO: 2335304 - RNA, 20 nt, Yersinia pestis KIM
aaccaacaauauucgcagcc

SEQ ID NO: 2335305 - RNA, 14 nt, Yersinia pestis KIM
aaccaacaaacaau

SEQ ID NO: 2335306 - RNA, 15 nt, Yersinia pestis KIM
aaccaauccaugcca

SEQ ID NO: 2335307 - RNA, 13 nt, Yersinia pestis KIM
aaccaaucaagca

SEQ ID NO: 2335308 - RNA, 16 nt, Yersinia pestis KIM
aaccaaggugguaucu

SEQ ID NO: 2335309 - RNA, 12 nt, Yersinia pestis KIM
aagaagccucau

SEQ ID NO: 2335310 - RNA, 14 nt, Yersinia pestis KIM
aagaagccucauga

SEQ ID NO: 2335311 - RNA, 16 nt, Yersinia pestis KIM
aagaagccucaugaau

SEQ ID NO: 2335312 - RNA, 17 nt, Yersinia pestis KIM
aagaagccucaugaaug

SEQ ID NO: 2335313 - RNA, 21 nt, Yersinia pestis KIM
aagaagcgggcggccucugcu

SEQ ID NO: 2335314 - RNA, 23 nt, Yersinia pestis KIM
aagaacuggcuggaucagcagac

SEQ ID NO: 2335315 - RNA, 20 nt, Yersinia pestis KIM
aagaacuggcuggaucagca

SEQ ID NO: 2335316 - RNA, 17 nt, Yersinia pestis KIM
aagaacggccugccaga

SEQ ID NO: 2335317 - RNA, 21 nt, Yersinia pestis KIM
aagaacggccugccagaacag

SEQ ID NO: 2335318 - RNA, 19 nt, Yersinia pestis KIM
aagaagaauccacauaaaa

SEQ ID NO: 2335319 - RNA, 14 nt, Yersinia pestis KIM
aagaaucccaucaa

SEQ ID NO: 2335320 - RNA, 15 nt, Yersinia pestis KIM
aagaaucccaucaaa

SEQ ID NO: 2335321 - RNA, 14 nt, Yersinia pestis KIM
aagaauaaauaaua

SEQ ID NO: 2335322 - RNA, 15 nt, Yersinia pestis KIM
aagaauaaauaauau

SEQ ID NO: 2335323 - RNA, 13 nt, Yersinia pestis KIM
aagaauaaauaau

SEQ ID NO: 2335324 - RNA, 12 nt, Yersinia pestis KIM
aagaauaaauaa

SEQ ID NO: 2335325 - RNA, 22 nt, Yersinia pestis KIM
aagaacgcgccaaccaucggaa

SEQ ID NO: 2335326 - RNA, 15 nt, Yersinia pestis KIM
aagaaccgaaauauc

SEQ ID NO: 2335327 - RNA, 23 nt, Yersinia pestis KIM
aacuugcuuugcgaaauaaguua

SEQ ID NO: 2335328 - RNA, 12 nt, Yersinia pestis KIM
aagaaaagcacc

SEQ ID NO: 2335329 - RNA, 13 nt, Yersinia pestis KIM
aagaaaagcaccg

SEQ ID NO: 2335330 - RNA, 23 nt, Yersinia pestis KIM
aagaaacuucauuucagguaaaa

SEQ ID NO: 2335331 - RNA, 24 nt, Yersinia pestis KIM
aacuuaucgaccaacuggcaauca

SEQ ID NO: 2335332 - RNA, 12 nt, Yersinia pestis KIM
aacuuaucacug

SEQ ID NO: 2335333 - RNA, 15 nt, Yersinia pestis KIM
aacuuaucgaccaac

SEQ ID NO: 2335334 - RNA, 20 nt, Yersinia pestis KIM
aacuucaaaaucaaguugau

SEQ ID NO: 2335335 - RNA, 15 nt, Yersinia pestis KIM
aacuucaagccgaua

SEQ ID NO: 2335336 - RNA, 22 nt, Yersinia pestis KIM
aacuucaagccgauaaucccug

SEQ ID NO: 2335337 - RNA, 18 nt, Yersinia pestis KIM
aacuucaauaccaaauuu

SEQ ID NO: 2335338 - RNA, 19 nt, Yersinia pestis KIM
aacuucaccacugugauaa

SEQ ID NO: 2335339 - RNA, 15 nt, Yersinia pestis KIM
aacuuacucccuugu

SEQ ID NO: 2335340 - RNA, 13 nt, Yersinia pestis KIM
aacuuacucccuu

SEQ ID NO: 2335341 - RNA, 20 nt, Yersinia pestis KIM
aacuuaagauagccggauua

SEQ ID NO: 2335342 - RNA, 12 nt, Yersinia pestis KIM
aacuuacaggcu

SEQ ID NO: 2335343 - RNA, 16 nt, Yersinia pestis KIM
aacuuacaugaguaag

SEQ ID NO: 2335344 - RNA, 20 nt, Yersinia pestis KIM
aacuguuuuuuaaagaaaaa

SEQ ID NO: 2335345 - RNA, 15 nt, Yersinia pestis KIM
aacuuaaaaaucaaa

SEQ ID NO: 2335346 - RNA, 15 nt, Yersinia pestis KIM
aacugguugagauaa

SEQ ID NO: 2335347 - RNA, 20 nt, Yersinia pestis KIM
aacugggcgacaaucaaugg

SEQ ID NO: 2335348 - RNA, 15 nt, Yersinia pestis KIM
aacugcaaauguuca

SEQ ID NO: 2335349 - RNA, 17 nt, Yersinia pestis KIM
aacugauguauucccuc

SEQ ID NO: 2335350 - RNA, 18 nt, Yersinia pestis KIM
aacugauuuaaccgaugc

SEQ ID NO: 2335351 - RNA, 21 nt, Yersinia pestis KIM
aacugaaccgccauugcauau

SEQ ID NO: 2335352 - RNA, 13 nt, Yersinia pestis KIM
aacucaaagauuu

SEQ ID NO: 2335353 - RNA, 23 nt, Yersinia pestis KIM
aacuggcgcuggaccuuaucauc

SEQ ID NO: 2335354 - RNA, 15 nt, Yersinia pestis KIM
aacuggcggggcaaa

SEQ ID NO: 2335355 - RNA, 15 nt, Yersinia pestis KIM
aacugcucaacugcu

SEQ ID NO: 2335356 - RNA, 14 nt, Yersinia pestis KIM
aacugcucaacugc

SEQ ID NO: 2335357 - RNA, 14 nt, Yersinia pestis KIM
aacugcggcauuaa

SEQ ID NO: 2335358 - RNA, 22 nt, Yersinia pestis KIM
aacugcggcauuaaugcagguu

SEQ ID NO: 2335359 - RNA, 21 nt, Yersinia pestis KIM
aacugcggcaauaagcauuau

SEQ ID NO: 2335360 - RNA, 19 nt, Yersinia pestis KIM
aacugcauagcuaaccuua

SEQ ID NO: 2335361 - RNA, 20 nt, Yersinia pestis KIM
aacugcauagcuaaccuuaa

SEQ ID NO: 2335362 - RNA, 15 nt, Yersinia pestis KIM
aacugcaguaaaaau

SEQ ID NO: 2335363 - RNA, 22 nt, Yersinia pestis KIM
aacuaauguuuguuucucugcc

SEQ ID NO: 2335364 - RNA, 18 nt, Yersinia pestis KIM
aacuaauaucaacagaac

SEQ ID NO: 2335365 - RNA, 22 nt, Yersinia pestis KIM
aacuaauaucaacagaacuaaa

SEQ ID NO: 2335366 - RNA, 21 nt, Yersinia pestis KIM
aacuaacguuuuguaaucaac

SEQ ID NO: 2335367 - RNA, 22 nt, Yersinia pestis KIM
aacuaacgauugacggaaaauu

SEQ ID NO: 2335368 - RNA, 14 nt, Yersinia pestis KIM
aacuaacaucagcg

SEQ ID NO: 2335369 - RNA, 15 nt, Yersinia pestis KIM
aacuaacaucagcga

SEQ ID NO: 2335370 - RNA, 13 nt, Yersinia pestis KIM
aacuaaggggcca

SEQ ID NO: 2335371 - RNA, 20 nt, Yersinia pestis KIM
aacuaaacagggcagaaaau

SEQ ID NO: 2335372 - RNA, 21 nt, Yersinia pestis KIM
aacuaaacagggcagaaaaua

SEQ ID NO: 2335373 - RNA, 15 nt, Yersinia pestis KIM
aacuaaacgccaaca

SEQ ID NO: 2335374 - RNA, 23 nt, Yersinia pestis KIM
aacuacgccucgcagauccagaa

SEQ ID NO: 2335375 - RNA, 13 nt, Yersinia pestis KIM
aacuacuccaucc

SEQ ID NO: 2335376 - RNA, 20 nt, Yersinia pestis KIM
aacuacaccgcuaaccuuaa

SEQ ID NO: 2335377 - RNA, 15 nt, Yersinia pestis KIM
aacgucacuuccauc

SEQ ID NO: 2335378 - RNA, 20 nt, Yersinia pestis KIM
aacgucagauaaaaaagggu

SEQ ID NO: 2335379 - RNA, 19 nt, Yersinia pestis KIM
aacgucaucgccacacgca

SEQ ID NO: 2335380 - RNA, 16 nt, Yersinia pestis KIM
aacgugacucuuuguu

SEQ ID NO: 2335381 - RNA, 19 nt, Yersinia pestis KIM
aacgugacucuuuguuacu

SEQ ID NO: 2335382 - RNA, 18 nt, Yersinia pestis KIM
aacgugaacauugcagua

SEQ ID NO: 2335383 - RNA, 15 nt, Yersinia pestis KIM
aacguagcugaauug

SEQ ID NO: 2335384 - RNA, 12 nt, Yersinia pestis KIM
aacguagcuaac

SEQ ID NO: 2335385 - RNA, 15 nt, Yersinia pestis KIM
aacguagcuaacacc

SEQ ID NO: 2335386 - RNA, 17 nt, Yersinia pestis KIM
aacgucaacagaacuaa

SEQ ID NO: 2335387 - RNA, 21 nt, Yersinia pestis KIM
aacguauucccgcuaccgagu

SEQ ID NO: 2335388 - RNA, 17 nt, Yersinia pestis KIM
aacguaauaucugccac

SEQ ID NO: 2335389 - RNA, 22 nt, Yersinia pestis KIM
aacguuucuggaaugagaugaa

SEQ ID NO: 2335390 - RNA, 15 nt, Yersinia pestis KIM
aacguuuuaacgcuu

SEQ ID NO: 2335391 - RNA, 14 nt, Yersinia pestis KIM
aacguucugccaau

SEQ ID NO: 2335392 - RNA, 16 nt, Yersinia pestis KIM
aacguucguagauaau

SEQ ID NO: 2335393 - RNA, 21 nt, Yersinia pestis KIM
aacguucguagauaauuucua

SEQ ID NO: 2335394 - RNA, 13 nt, Yersinia pestis KIM
aacguuagagcac

SEQ ID NO: 2335395 - RNA, 20 nt, Yersinia pestis KIM
aacguguuagguaauaccaa

SEQ ID NO: 2335396 - RNA, 14 nt, Yersinia pestis KIM
aacguuaacugcag

SEQ ID NO: 2335397 - RNA, 13 nt, Yersinia pestis KIM
aacguuaacugca

SEQ ID NO: 2335398 - RNA, 23 nt, Yersinia pestis KIM
aacgcuuuacuccucugccuauc

SEQ ID NO: 2335399 - RNA, 19 nt, Yersinia pestis KIM
aacgcuuuuaacugugcag

SEQ ID NO: 2335400 - RNA, 15 nt, Yersinia pestis KIM
aacgcuucaucaugg

SEQ ID NO: 2335401 - RNA, 20 nt, Yersinia pestis KIM
aacgccuccucuuggauuau

SEQ ID NO: 2335402 - RNA, 22 nt, Yersinia pestis KIM
aacgcugcaauuauaagcacaa

SEQ ID NO: 2335403 - RNA, 15 nt, Yersinia pestis KIM
aacgccgcuaaauca

SEQ ID NO: 2335404 - RNA, 16 nt, Yersinia pestis KIM
aacgguaacccgauaa

SEQ ID NO: 2335405 - RNA, 17 nt, Yersinia pestis KIM
aacgggucgucucuugc

SEQ ID NO: 2335406 - RNA, 23 nt, Yersinia pestis KIM
aacggguggccacaauaaaauaa

SEQ ID NO: 2335407 - RNA, 18 nt, Yersinia pestis KIM
aacggguggccgccgcgg

SEQ ID NO: 2335408 - RNA, 13 nt, Yersinia pestis KIM
aacggagaugauu

SEQ ID NO: 2335409 - RNA, 18 nt, Yersinia pestis KIM
aacggacggaauccaaca

SEQ ID NO: 2335410 - RNA, 13 nt, Yersinia pestis KIM
aacggacauuuua

SEQ ID NO: 2335411 - RNA, 16 nt, Yersinia pestis KIM
aacgguuaagcaggua

SEQ ID NO: 2335412 - RNA, 17 nt, Yersinia pestis KIM
aacggugaggauaggca

SEQ ID NO: 2335413 - RNA, 22 nt, Yersinia pestis KIM
aacggucucuuucgggcaaaaa

SEQ ID NO: 2335414 - RNA, 21 nt, Yersinia pestis KIM
aacggucagauccacauucug

SEQ ID NO: 2335415 - RNA, 15 nt, Yersinia pestis KIM
aacgccagauaacga

SEQ ID NO: 2335416 - RNA, 15 nt, Yersinia pestis KIM
aacgcaauuuuaugg

SEQ ID NO: 2335417 - RNA, 14 nt, Yersinia pestis KIM
aacgcacgaaaaca

SEQ ID NO: 2335418 - RNA, 19 nt, Yersinia pestis KIM
aacgccgaucauaaaucac

SEQ ID NO: 2335419 - RNA, 14 nt, Yersinia pestis KIM
aacgccgaugaagg

SEQ ID NO: 2335420 - RNA, 15 nt, Yersinia pestis KIM
aacgcccagcuaauu

SEQ ID NO: 2335421 - RNA, 17 nt, Yersinia pestis KIM
aaccggaugauuucaaa

SEQ ID NO: 2335422 - RNA, 22 nt, Yersinia pestis KIM
aaccggaugauuucaaacgugu

SEQ ID NO: 2335423 - RNA, 14 nt, Yersinia pestis KIM
aaccgcuuacgcug

SEQ ID NO: 2335424 - RNA, 18 nt, Yersinia pestis KIM
aaccggcuggaaauucau

SEQ ID NO: 2335425 - RNA, 13 nt, Yersinia pestis KIM
aaccggcgcaaau

SEQ ID NO: 2335426 - RNA, 14 nt, Yersinia pestis KIM
aacgauauuuuuau

SEQ ID NO: 2335427 - RNA, 19 nt, Yersinia pestis KIM
aacgauaugcuccagauca

SEQ ID NO: 2335428 - RNA, 21 nt, Yersinia pestis KIM
aacgaucagaacuaacacuau

SEQ ID NO: 2335429 - RNA, 16 nt, Yersinia pestis KIM
aagcugcgcugaccua

SEQ ID NO: 2335430 - RNA, 14 nt, Yersinia pestis KIM
aagcuuaauauuau

SEQ ID NO: 2335431 - RNA, 22 nt, Yersinia pestis KIM
aagcugccugugcggcagugaa

SEQ ID NO: 2335432 - RNA, 22 nt, Yersinia pestis KIM
aagcuuuugccacauuucccuu

SEQ ID NO: 2335433 - RNA, 18 nt, Yersinia pestis KIM
aaggauagggagccaaua

SEQ ID NO: 2335434 - RNA, 17 nt, Yersinia pestis KIM
aaggauaaacgaaagag

SEQ ID NO: 2335435 - RNA, 13 nt, Yersinia pestis KIM
aaggacuuggcgu

SEQ ID NO: 2335436 - RNA, 23 nt, Yersinia pestis KIM
aaggacuuggcguaacugcauuu

SEQ ID NO: 2335437 - RNA, 15 nt, Yersinia pestis KIM
aagcucuacuaauau

SEQ ID NO: 2335438 - RNA, 14 nt, Yersinia pestis KIM
aagcucuuccaaua

SEQ ID NO: 2335439 - RNA, 17 nt, Yersinia pestis KIM
aagcucugacaaaaugc

SEQ ID NO: 2335440 - RNA, 21 nt, Yersinia pestis KIM
aagcucugacaaaaugccaga

SEQ ID NO: 2335441 - RNA, 20 nt, Yersinia pestis KIM
aagcuaaaaaucucaacaag

SEQ ID NO: 2335442 - RNA, 22 nt, Yersinia pestis KIM
aagcguuaauuauagugaaaac

SEQ ID NO: 2335443 - RNA, 17 nt, Yersinia pestis KIM
aagccgacgaucuugcc

SEQ ID NO: 2335444 - RNA, 13 nt, Yersinia pestis KIM
aagccgcugcuca

SEQ ID NO: 2335445 - RNA, 22 nt, Yersinia pestis KIM
aagcgucuacgggcgcuuuucu

SEQ ID NO: 2335446 - RNA, 15 nt, Yersinia pestis KIM
aagcguaaagcaccc

SEQ ID NO: 2335447 - RNA, 15 nt, Yersinia pestis KIM
aagcgcucaaauacg

SEQ ID NO: 2335448 - RNA, 23 nt, Yersinia pestis KIM
aaggcggagaauguuaaaccccc

SEQ ID NO: 2335449 - RNA, 15 nt, Yersinia pestis KIM
aaggcggaugugggu

SEQ ID NO: 2335450 - RNA, 13 nt, Yersinia pestis KIM
aaggcaauaccaa

SEQ ID NO: 2335451 - RNA, 20 nt, Yersinia pestis KIM
aaggcaacgaaggcaacaac

SEQ ID NO: 2335452 - RNA, 23 nt, Yersinia pestis KIM
aaggcaaaaugaucaucagcagc

SEQ ID NO: 2335453 - RNA, 14 nt, Yersinia pestis KIM
aaggcggugaacag

SEQ ID NO: 2335454 - RNA, 15 nt, Yersinia pestis KIM
aaggcggugaacagu

SEQ ID NO: 2335455 - RNA, 16 nt, Yersinia pestis KIM
aaggcggugaacagua

SEQ ID NO: 2335456 - RNA, 16 nt, Yersinia pestis KIM
aagggcaagcgcuguu

SEQ ID NO: 2335457 - RNA, 17 nt, Yersinia pestis KIM
aagggcaagcguuaaca

SEQ ID NO: 2335458 - RNA, 17 nt, Yersinia pestis KIM
aagguaaacagacacag

SEQ ID NO: 2335459 - RNA, 13 nt, Yersinia pestis KIM
aagguaaagaaau

SEQ ID NO: 2335460 - RNA, 16 nt, Yersinia pestis KIM
aaggguauaacucauc

SEQ ID NO: 2335461 - RNA, 13 nt, Yersinia pestis KIM
aaggguauugaag

SEQ ID NO: 2335462 - RNA, 15 nt, Yersinia pestis KIM
aaggguauugaagau

SEQ ID NO: 2335463 - RNA, 18 nt, Yersinia pestis KIM
aaggguaauagaagauaa

SEQ ID NO: 2335464 - RNA, 20 nt, Yersinia pestis KIM
aagggccaccacgaaaaaau

SEQ ID NO: 2335465 - RNA, 13 nt, Yersinia pestis KIM
aagguuaacugca

SEQ ID NO: 2335466 - RNA, 16 nt, Yersinia pestis KIM
aagguuaaauuuaaua

SEQ ID NO: 2335467 - RNA, 12 nt, Yersinia pestis KIM
aagguguuuaaa

SEQ ID NO: 2335468 - RNA, 18 nt, Yersinia pestis KIM
aaggugugauugaagcgu

SEQ ID NO: 2335469 - RNA, 16 nt, Yersinia pestis KIM
aagguauauuuucccg

SEQ ID NO: 2335470 - RNA, 22 nt, Yersinia pestis KIM
aaggucaacgacaagucaguga

SEQ ID NO: 2335471 - RNA, 18 nt, Yersinia pestis KIM
aagguaaugcgaaaaaag

SEQ ID NO: 2335472 - RNA, 22 nt, Yersinia pestis KIM
aagguagaucggggacaggcug

SEQ ID NO: 2335473 - RNA, 20 nt, Yersinia pestis KIM
aagguauagcgauagaguug

SEQ ID NO: 2335474 - RNA, 18 nt, Yersinia pestis KIM
aaggugaugaaugacugg

SEQ ID NO: 2335475 - RNA, 13 nt, Yersinia pestis KIM
aaggucaguucac

SEQ ID NO: 2335476 - RNA, 18 nt, Yersinia pestis KIM
aagccauuuuuuauaaac

SEQ ID NO: 2335477 - RNA, 14 nt, Yersinia pestis KIM
aagccagucagggc

SEQ ID NO: 2335478 - RNA, 13 nt, Yersinia pestis KIM
aagccccacagua

SEQ ID NO: 2335479 - RNA, 16 nt, Yersinia pestis KIM
aagcccuguuucauuu

SEQ ID NO: 2335480 - RNA, 15 nt, Yersinia pestis KIM
aagcccucauuuucg

SEQ ID NO: 2335481 - RNA, 18 nt, Yersinia pestis KIM
aagcccggaaacguccag

SEQ ID NO: 2335482 - RNA, 15 nt, Yersinia pestis KIM
aagccaauaauauaa

SEQ ID NO: 2335483 - RNA, 20 nt, Yersinia pestis KIM
aagccacgaguuuucccugc

SEQ ID NO: 2335484 - RNA, 21 nt, Yersinia pestis KIM
aagccaccaccacggccagaa

SEQ ID NO: 2335485 - RNA, 22 nt, Yersinia pestis KIM
aagcaugugauguggcuugcaa

SEQ ID NO: 2335486 - RNA, 22 nt, Yersinia pestis KIM
aagcaugcccagccucuggaua

SEQ ID NO: 2335487 - RNA, 22 nt, Yersinia pestis KIM
aagcauggcagguaucaauaca

SEQ ID NO: 2335488 - RNA, 14 nt, Yersinia pestis KIM
aagccaacccccau

SEQ ID NO: 2335489 - RNA, 17 nt, Yersinia pestis KIM
aagccaaacaaaugaac

SEQ ID NO: 2335490 - RNA, 17 nt, Yersinia pestis KIM
aagccaaaacagccuaa

SEQ ID NO: 2335491 - RNA, 17 nt, Yersinia pestis KIM
aagcagcgucucgugua

SEQ ID NO: 2335492 - RNA, 16 nt, Yersinia pestis KIM
aagcagauaaagaaaa

SEQ ID NO: 2335493 - RNA, 13 nt, Yersinia pestis KIM
aagcagauaaaga

SEQ ID NO: 2335494 - RNA, 17 nt, Yersinia pestis KIM
aagcagagaauuucaag

SEQ ID NO: 2335495 - RNA, 14 nt, Yersinia pestis KIM
aagcacggcaggcg

SEQ ID NO: 2335496 - RNA, 17 nt, Yersinia pestis KIM
aagcaucaccaaagaua

SEQ ID NO: 2335497 - RNA, 15 nt, Yersinia pestis KIM
aagcaucggaaucca

SEQ ID NO: 2335498 - RNA, 14 nt, Yersinia pestis KIM
aagcagcuuuucac

SEQ ID NO: 2335499 - RNA, 23 nt, Yersinia pestis KIM
aagcagcuuuucacgagagagca

SEQ ID NO: 2335500 - RNA, 14 nt, Yersinia pestis KIM
aagcagucagcaug

SEQ ID NO: 2335501 - RNA, 15 nt, Yersinia pestis KIM
aagcaguaaacauuu

SEQ ID NO: 2335502 - RNA, 17 nt, Yersinia pestis KIM
aagcagguaguuacagc

SEQ ID NO: 2335503 - RNA, 22 nt, Yersinia pestis KIM
aagcaguucacucuguuuuaaa

SEQ ID NO: 2335504 - RNA, 16 nt, Yersinia pestis KIM
aagcaguucacugagu

SEQ ID NO: 2335505 - RNA, 21 nt, Yersinia pestis KIM
aagcagugucagggcaauaac

SEQ ID NO: 2335506 - RNA, 23 nt, Yersinia pestis KIM
aagcaacagccauauuuuucaau

SEQ ID NO: 2335507 - RNA, 12 nt, Yersinia pestis KIM
aagcaaacugau

SEQ ID NO: 2335508 - RNA, 22 nt, Yersinia pestis KIM
aagauuuuuagcgugccgcagu

SEQ ID NO: 2335509 - RNA, 19 nt, Yersinia pestis KIM
aagauuugugcauauucau

SEQ ID NO: 2335510 - RNA, 20 nt, Yersinia pestis KIM
aagauuucucuuaggcaacc

SEQ ID NO: 2335511 - RNA, 15 nt, Yersinia pestis KIM
aagauuuaaauaaca

SEQ ID NO: 2335512 - RNA, 21 nt, Yersinia pestis KIM
aagcaauuugaucaccaaucg

SEQ ID NO: 2335513 - RNA, 19 nt, Yersinia pestis KIM
aagcaagaccgguggcuuu

SEQ ID NO: 2335514 - RNA, 13 nt, Yersinia pestis KIM
aagcaagaaacug

SEQ ID NO: 2335515 - RNA, 17 nt, Yersinia pestis KIM
aagaucugcauugauua

SEQ ID NO: 2335516 - RNA, 12 nt, Yersinia pestis KIM
aagaugcagggc

SEQ ID NO: 2335517 - RNA, 15 nt, Yersinia pestis KIM
aagaugaccaccaau

SEQ ID NO: 2335518 - RNA, 14 nt, Yersinia pestis KIM
aagaugacuacugu

SEQ ID NO: 2335519 - RNA, 19 nt, Yersinia pestis KIM
aagaugacuacugucuuuu

SEQ ID NO: 2335520 - RNA, 22 nt, Yersinia pestis KIM
aagaaugucaugguuaaacuga

SEQ ID NO: 2335521 - RNA, 14 nt, Yersinia pestis KIM
aagaauguagacgu

SEQ ID NO: 2335522 - RNA, 14 nt, Yersinia pestis KIM
aagaaucaguaggu

SEQ ID NO: 2335523 - RNA, 16 nt, Yersinia pestis KIM
aagaauuccggcgcau

SEQ ID NO: 2335524 - RNA, 18 nt, Yersinia pestis KIM
aagaugccuauuugcaga

SEQ ID NO: 2335525 - RNA, 12 nt, Yersinia pestis KIM
aagauucaacca

SEQ ID NO: 2335526 - RNA, 17 nt, Yersinia pestis KIM
aagauucucggcaugcu

SEQ ID NO: 2335527 - RNA, 15 nt, Yersinia pestis KIM
aauacugucaaaauc

SEQ ID NO: 2335528 - RNA, 20 nt, Yersinia pestis KIM
aauacuguugguaaauaacg

SEQ ID NO: 2335529 - RNA, 14 nt, Yersinia pestis KIM
aauacuguuaucac

SEQ ID NO: 2335530 - RNA, 13 nt, Yersinia pestis KIM
aauacucauuuuu

SEQ ID NO: 2335531 - RNA, 15 nt, Yersinia pestis KIM
aauacucauuuuuaa

SEQ ID NO: 2335532 - RNA, 12 nt, Yersinia pestis KIM
aauagagcacca

SEQ ID NO: 2335533 - RNA, 21 nt, Yersinia pestis KIM
aauagagcaccaaaucuucca

SEQ ID NO: 2335534 - RNA, 21 nt, Yersinia pestis KIM
aauagagugaaguaucaccac

SEQ ID NO: 2335535 - RNA, 17 nt, Yersinia pestis KIM
aauagaaccggaauaaa

SEQ ID NO: 2335536 - RNA, 16 nt, Yersinia pestis KIM
aauagaaaggcuauca

SEQ ID NO: 2335537 - RNA, 17 nt, Yersinia pestis KIM
aauacgugguuugauaa

SEQ ID NO: 2335538 - RNA, 16 nt, Yersinia pestis KIM
aauacggcacucaaau

SEQ ID NO: 2335539 - RNA, 15 nt, Yersinia pestis KIM
aauacgauaaagaag

SEQ ID NO: 2335540 - RNA, 17 nt, Yersinia pestis KIM
aauacgccccugaucau

SEQ ID NO: 2335541 - RNA, 23 nt, Yersinia pestis KIM
aauacgcuaucgcgaaacucuuc

SEQ ID NO: 2335542 - RNA, 18 nt, Yersinia pestis KIM
aauacgcugucugaauag

SEQ ID NO: 2335543 - RNA, 18 nt, Yersinia pestis KIM
aauacauauaaccaucaa

SEQ ID NO: 2335544 - RNA, 17 nt, Yersinia pestis KIM
aauacauaucaacacug

SEQ ID NO: 2335545 - RNA, 14 nt, Yersinia pestis KIM
aauacauagaagcu

SEQ ID NO: 2335546 - RNA, 14 nt, Yersinia pestis KIM
aauacauccaugua

SEQ ID NO: 2335547 - RNA, 23 nt, Yersinia pestis KIM
aauacauccauguaggcucgagc

SEQ ID NO: 2335548 - RNA, 16 nt, Yersinia pestis KIM
aauacaucaucaaaac

SEQ ID NO: 2335549 - RNA, 16 nt, Yersinia pestis KIM
aauacccgguuuccag

SEQ ID NO: 2335550 - RNA, 23 nt, Yersinia pestis KIM
aauaccgaugagcugaauagccu

SEQ ID NO: 2335551 - RNA, 18 nt, Yersinia pestis KIM
aauaccgccgguuuuugc

SEQ ID NO: 2335552 - RNA, 14 nt, Yersinia pestis KIM
aauaccgguggcau

SEQ ID NO: 2335553 - RNA, 19 nt, Yersinia pestis KIM
aauaccgcugcuaccagca

SEQ ID NO: 2335554 - RNA, 23 nt, Yersinia pestis KIM
aauaacgauuaauuaguuuuaau

SEQ ID NO: 2335555 - RNA, 23 nt, Yersinia pestis KIM
aauaacgccccuguaaauaaaua

SEQ ID NO: 2335556 - RNA, 19 nt, Yersinia pestis KIM
aauaacgcuggauaaguga

SEQ ID NO: 2335557 - RNA, 15 nt, Yersinia pestis KIM
aauaacuaaaaaagu

SEQ ID NO: 2335558 - RNA, 14 nt, Yersinia pestis KIM
aauaacucagggcu

SEQ ID NO: 2335559 - RNA, 20 nt, Yersinia pestis KIM
aauaacucagccauugcuuu

SEQ ID NO: 2335560 - RNA, 13 nt, Yersinia pestis KIM
aaaaauaaucaau

SEQ ID NO: 2335561 - RNA, 13 nt, Yersinia pestis KIM
aaaaauacaacca

SEQ ID NO: 2335562 - RNA, 13 nt, Yersinia pestis KIM
aaaaauaauuaaa

SEQ ID NO: 2335563 - RNA, 14 nt, Yersinia pestis KIM
aaaaauacauauca

SEQ ID NO: 2335564 - RNA, 14 nt, Yersinia pestis KIM
aauaauaucaauga

SEQ ID NO: 2335565 - RNA, 20 nt, Yersinia pestis KIM
aauaauaucggcaaauuaaa

SEQ ID NO: 2335566 - RNA, 23 nt, Yersinia pestis KIM
aauaauaucggcggcaaagacau

SEQ ID NO: 2335567 - RNA, 14 nt, Yersinia pestis KIM
aauaauauaauuca

SEQ ID NO: 2335568 - RNA, 23 nt, Yersinia pestis KIM
aauaauaggcugaucaacgggcu

SEQ ID NO: 2335569 - RNA, 12 nt, Yersinia pestis KIM
aaaaauauuaau

SEQ ID NO: 2335570 - RNA, 14 nt, Yersinia pestis KIM
aaaaauaucuauuu

SEQ ID NO: 2335571 - RNA, 15 nt, Yersinia pestis KIM
aaaaauaucuauuuc

SEQ ID NO: 2335572 - RNA, 15 nt, Yersinia pestis KIM
aaaaauaucuuuaaa

SEQ ID NO: 2335573 - RNA, 14 nt, Yersinia pestis KIM
aauaauuaaaccuc

SEQ ID NO: 2335574 - RNA, 22 nt, Yersinia pestis KIM
aauaauuaaaccucagaaaaau

SEQ ID NO: 2335575 - RNA, 20 nt, Yersinia pestis KIM
aauaauguggcauguucagc

SEQ ID NO: 2335576 - RNA, 18 nt, Yersinia pestis KIM
aauaaucuuaaguaaauu

SEQ ID NO: 2335577 - RNA, 22 nt, Yersinia pestis KIM
aauaauucauaugacaaauaag

SEQ ID NO: 2335578 - RNA, 16 nt, Yersinia pestis KIM
aauaauuacuuauaaa

SEQ ID NO: 2335579 - RNA, 17 nt, Yersinia pestis KIM
aauaauuacuuauaaac

SEQ ID NO: 2335580 - RNA, 20 nt, Yersinia pestis KIM
aauaaucacaggggcaauaa

SEQ ID NO: 2335581 - RNA, 14 nt, Yersinia pestis KIM
aauaaucauaucaa

SEQ ID NO: 2335582 - RNA, 19 nt, Yersinia pestis KIM
aauaauccgguuagcaaaa

SEQ ID NO: 2335583 - RNA, 17 nt, Yersinia pestis KIM
aauaaucuggaugagua

SEQ ID NO: 2335584 - RNA, 13 nt, Yersinia pestis KIM
aauaauuuauaca

SEQ ID NO: 2335585 - RNA, 23 nt, Yersinia pestis KIM
aauaauucauaugacaaauaagg

SEQ ID NO: 2335586 - RNA, 18 nt, Yersinia pestis KIM
aauacaaccaacaaacaa

SEQ ID NO: 2335587 - RNA, 15 nt, Yersinia pestis KIM
aauacaaccaacaaa

SEQ ID NO: 2335588 - RNA, 17 nt, Yersinia pestis KIM
aauacaaccaacaaaca

SEQ ID NO: 2335589 - RNA, 18 nt, Yersinia pestis KIM
aauacaaauauaaugcug

SEQ ID NO: 2335590 - RNA, 20 nt, Yersinia pestis KIM
aauacaaccaacaaacaauc

SEQ ID NO: 2335591 - RNA, 22 nt, Yersinia pestis KIM
aauacaacgguuuaugcccaga

SEQ ID NO: 2335592 - RNA, 12 nt, Yersinia pestis KIM
aauacagccagc

SEQ ID NO: 2335593 - RNA, 19 nt, Yersinia pestis KIM
aagugugauagaacccugc

SEQ ID NO: 2335594 - RNA, 23 nt, Yersinia pestis KIM
aaguuagcuacgcugcugaauuc

SEQ ID NO: 2335595 - RNA, 22 nt, Yersinia pestis KIM
aaguuagugguguuauccacuu

SEQ ID NO: 2335596 - RNA, 17 nt, Yersinia pestis KIM
aaguuagucgcaaagcg

SEQ ID NO: 2335597 - RNA, 14 nt, Yersinia pestis KIM
aaguuagugguguu

SEQ ID NO: 2335598 - RNA, 23 nt, Yersinia pestis KIM
aaguuaggguucaguaaaaccaa

SEQ ID NO: 2335599 - RNA, 14 nt, Yersinia pestis KIM
aaguucuaaggaaa

SEQ ID NO: 2335600 - RNA, 17 nt, Yersinia pestis KIM
aaguucuaaggaaaaua

SEQ ID NO: 2335601 - RNA, 15 nt, Yersinia pestis KIM
aaguucuaagggaaa

SEQ ID NO: 2335602 - RNA, 19 nt, Yersinia pestis KIM
aaguugccggacgccccac

SEQ ID NO: 2335603 - RNA, 15 nt, Yersinia pestis KIM
aaguuggcuuuugcc

SEQ ID NO: 2335604 - RNA, 19 nt, Yersinia pestis KIM
aaguuucagcguggaauua

SEQ ID NO: 2335605 - RNA, 20 nt, Yersinia pestis KIM
aaguaaggaucguucagugc

SEQ ID NO: 2335606 - RNA, 12 nt, Yersinia pestis KIM
aaguaauaaaaa

SEQ ID NO: 2335607 - RNA, 18 nt, Yersinia pestis KIM
aagucuugaagagugacc

SEQ ID NO: 2335608 - RNA, 17 nt, Yersinia pestis KIM
aagucuuaaucuuuaau

SEQ ID NO: 2335609 - RNA, 14 nt, Yersinia pestis KIM
aaguaaucaggcau

SEQ ID NO: 2335610 - RNA, 23 nt, Yersinia pestis KIM
aaguggccacucaccucagucau

SEQ ID NO: 2335611 - RNA, 19 nt, Yersinia pestis KIM
aaguggccacucaccucag

SEQ ID NO: 2335612 - RNA, 23 nt, Yersinia pestis KIM
aagugguagccggacucaaaaua

SEQ ID NO: 2335613 - RNA, 23 nt, Yersinia pestis KIM
aagugggggugauauaugccaua

SEQ ID NO: 2335614 - RNA, 19 nt, Yersinia pestis KIM
aagugcugcaaggcauuaa

SEQ ID NO: 2335615 - RNA, 22 nt, Yersinia pestis KIM
aagugaucagcuaacaaaaccg

SEQ ID NO: 2335616 - RNA, 21 nt, Yersinia pestis KIM
aagugauucgggugagugaac

SEQ ID NO: 2335617 - RNA, 20 nt, Yersinia pestis KIM
aagugcaaacuuaaaaauca

SEQ ID NO: 2335618 - RNA, 21 nt, Yersinia pestis KIM
aagugcaaacuuaaaaaucaa

SEQ ID NO: 2335619 - RNA, 17 nt, Yersinia pestis KIM
aagugcaaacuuaaaaa

SEQ ID NO: 2335620 - RNA, 21 nt, Yersinia pestis KIM
aagucuugaagagugaccaaa

SEQ ID NO: 2335621 - RNA, 15 nt, Yersinia pestis KIM
aagugagcugaacug

SEQ ID NO: 2335622 - RNA, 15 nt, Yersinia pestis KIM
aauaaauucaaaaua

SEQ ID NO: 2335623 - RNA, 11 nt, Yersinia pestis KIM
aauaacaaaca

SEQ ID NO: 2335624 - RNA, 11 nt, Yersinia pestis KIM
aauaacaauau

SEQ ID NO: 2335625 - RNA, 18 nt, Yersinia pestis KIM
aauaacaauauucauuuu

SEQ ID NO: 2335626 - RNA, 15 nt, Yersinia pestis KIM
aauaacagcuaauca

SEQ ID NO: 2335627 - RNA, 21 nt, Yersinia pestis KIM
aauaaccucacgcagcguagg

SEQ ID NO: 2335628 - RNA, 22 nt, Yersinia pestis KIM
aauaaccucacgggcuuccauc

SEQ ID NO: 2335629 - RNA, 22 nt, Yersinia pestis KIM
aauaaccucaggcccgcuauca

SEQ ID NO: 2335630 - RNA, 19 nt, Yersinia pestis KIM
aauaaccucagggagccaa

SEQ ID NO: 2335631 - RNA, 21 nt, Yersinia pestis KIM
aauaaccuacuccaacaacca

SEQ ID NO: 2335632 - RNA, 13 nt, Yersinia pestis KIM
aauaaccggguaa

SEQ ID NO: 2335633 - RNA, 21 nt, Yersinia pestis KIM
aauaaauaccggcaggaaagc

SEQ ID NO: 2335634 - RNA, 12 nt, Yersinia pestis KIM
aauaaauacccu

SEQ ID NO: 2335635 - RNA, 20 nt, Yersinia pestis KIM
aauaaauagagugaaguauc

SEQ ID NO: 2335636 - RNA, 13 nt, Yersinia pestis KIM
aauaaauaauugg

SEQ ID NO: 2335637 - RNA, 12 nt, Yersinia pestis KIM
aauaaauaaaaa

SEQ ID NO: 2335638 - RNA, 19 nt, Yersinia pestis KIM
aauaaagcgauaaauacuc

SEQ ID NO: 2335639 - RNA, 22 nt, Yersinia pestis KIM
aauaaaguccaccucgaaauca

SEQ ID NO: 2335640 - RNA, 19 nt, Yersinia pestis KIM
aauaaacgggcuuccauca

SEQ ID NO: 2335641 - RNA, 23 nt, Yersinia pestis KIM
aauaaacuaccgaucaucaggca

SEQ ID NO: 2335642 - RNA, 23 nt, Yersinia pestis KIM
aauaaagauacccgccauaaaua

SEQ ID NO: 2335643 - RNA, 17 nt, Yersinia pestis KIM
aauaaagcucugacaaa

SEQ ID NO: 2335644 - RNA, 16 nt, Yersinia pestis KIM
aauaaaaccuuuacaa

SEQ ID NO: 2335645 - RNA, 22 nt, Yersinia pestis KIM
aauaaaagagauguuauuugaa

SEQ ID NO: 2335646 - RNA, 14 nt, Yersinia pestis KIM
aauaaacaaaauag

SEQ ID NO: 2335647 - RNA, 19 nt, Yersinia pestis KIM
aauaaacagacaaaaaaua

SEQ ID NO: 2335648 - RNA, 13 nt, Yersinia pestis KIM
aauaaaaucugcu

SEQ ID NO: 2335649 - RNA, 16 nt, Yersinia pestis KIM
aauaaaaucguaauca

SEQ ID NO: 2335650 - RNA, 15 nt, Yersinia pestis KIM
aauaaaaaaccccga

SEQ ID NO: 2335651 - RNA, 16 nt, Yersinia pestis KIM
aaguuuucuggcaauu

SEQ ID NO: 2335652 - RNA, 21 nt, Yersinia pestis KIM
aaguuuucuggcaauuucugu

SEQ ID NO: 2335653 - RNA, 22 nt, Yersinia pestis KIM
aaguuuucuggcaauuucuguu

SEQ ID NO: 2335654 - RNA, 20 nt, Yersinia pestis KIM
cggcccacuuuuugaauaau

SEQ ID NO: 2335655 - RNA, 23 nt, Yersinia pestis KIM
cggccagcaaccuggcggcccga

SEQ ID NO: 2335656 - RNA, 20 nt, Yersinia pestis KIM
cggcgaagggcgcagccccc

SEQ ID NO: 2335657 - RNA, 20 nt, Yersinia pestis KIM
cggccuuucguuucugucug

SEQ ID NO: 2335658 - RNA, 13 nt, Yersinia pestis KIM
cggagaacuugaa

SEQ ID NO: 2335659 - RNA, 14 nt, Yersinia pestis KIM
cggacgcuccucac

SEQ ID NO: 2335660 - RNA, 22 nt, Yersinia pestis KIM
cggacgcuuuacuccccugccu

SEQ ID NO: 2335661 - RNA, 18 nt, Yersinia pestis KIM
cggacgcuuuacuccucu

SEQ ID NO: 2335662 - RNA, 19 nt, Yersinia pestis KIM
cggacgcuuuacuccucug

SEQ ID NO: 2335663 - RNA, 22 nt, Yersinia pestis KIM
cggacgcuuuacuccucugccu

SEQ ID NO: 2335664 - RNA, 13 nt, Yersinia pestis KIM
cggagccugauac

SEQ ID NO: 2335665 - RNA, 16 nt, Yersinia pestis KIM
cggagagaacaggcag

SEQ ID NO: 2335666 - RNA, 15 nt, Yersinia pestis KIM
cggacagcgcgcagc

SEQ ID NO: 2335667 - RNA, 14 nt, Yersinia pestis KIM
cggacagcaaccac

SEQ ID NO: 2335668 - RNA, 20 nt, Yersinia pestis KIM
cggaaucaccuuucuccaug

SEQ ID NO: 2335669 - RNA, 14 nt, Yersinia pestis KIM
cggacaucuuacug

SEQ ID NO: 2335670 - RNA, 21 nt, Yersinia pestis KIM
cggaagguugcccccaccaug

SEQ ID NO: 2335671 - RNA, 17 nt, Yersinia pestis KIM
cggaacucaucuuucuc

SEQ ID NO: 2335672 - RNA, 15 nt, Yersinia pestis KIM
cggaaaucagcuuca

SEQ ID NO: 2335673 - RNA, 13 nt, Yersinia pestis KIM
cggaaaucaccaa

SEQ ID NO: 2335674 - RNA, 15 nt, Yersinia pestis KIM
cggaaauaaggcgca

SEQ ID NO: 2335675 - RNA, 15 nt, Yersinia pestis KIM
cggaaacguccaggg

SEQ ID NO: 2335676 - RNA, 13 nt, Yersinia pestis KIM
cggaacagcagcg

SEQ ID NO: 2335677 - RNA, 20 nt, Yersinia pestis KIM
cggaaaugccgauaaaaacu

SEQ ID NO: 2335678 - RNA, 22 nt, Yersinia pestis KIM
cggaaaugccgauaaaaacuau

SEQ ID NO: 2335679 - RNA, 14 nt, Yersinia pestis KIM
cgcuuuucuuuuuu

SEQ ID NO: 2335680 - RNA, 14 nt, Yersinia pestis KIM
cgcuuuuuacccag

SEQ ID NO: 2335681 - RNA, 22 nt, Yersinia pestis KIM
cgcuuuagugacuaauuguuug

SEQ ID NO: 2335682 - RNA, 23 nt, Yersinia pestis KIM
cgcuuuagugggugagcagagau

SEQ ID NO: 2335683 - RNA, 17 nt, Yersinia pestis KIM
cgcuuucuguucaucaa

SEQ ID NO: 2335684 - RNA, 18 nt, Yersinia pestis KIM
cgcuaagcugcgcugacc

SEQ ID NO: 2335685 - RNA, 18 nt, Yersinia pestis KIM
cgcuaauacggcuugcaa

SEQ ID NO: 2335686 - RNA, 14 nt, Yersinia pestis KIM
cgcuaacguuuauu

SEQ ID NO: 2335687 - RNA, 13 nt, Yersinia pestis KIM
cgcuaaccuuaac

SEQ ID NO: 2335688 - RNA, 14 nt, Yersinia pestis KIM
cgcuaaugggugau

SEQ ID NO: 2335689 - RNA, 17 nt, Yersinia pestis KIM
cgcuaaucaagccuuca

SEQ ID NO: 2335690 - RNA, 20 nt, Yersinia pestis KIM
cgcuaauauuuucagcccua

SEQ ID NO: 2335691 - RNA, 21 nt, Yersinia pestis KIM
cgcuaaccaacgcggcccccg

SEQ ID NO: 2335692 - RNA, 13 nt, Yersinia pestis KIM
cgcuaccaugagu

SEQ ID NO: 2335693 - RNA, 20 nt, Yersinia pestis KIM
cgcuuuacccugguuagcaa

SEQ ID NO: 2335694 - RNA, 17 nt, Yersinia pestis KIM
cgcuuuaaucagcccuu

SEQ ID NO: 2335695 - RNA, 22 nt, Yersinia pestis KIM
cgcuuuaaccuuucuaauuauu

SEQ ID NO: 2335696 - RNA, 17 nt, Yersinia pestis KIM
cgcuugugcucacguca

SEQ ID NO: 2335697 - RNA, 17 nt, Yersinia pestis KIM
cggcaaucccggccauu

SEQ ID NO: 2335698 - RNA, 15 nt, Yersinia pestis KIM
cggcaauagcgauca

SEQ ID NO: 2335699 - RNA, 15 nt, Yersinia pestis KIM
cggcaaauagagcac

SEQ ID NO: 2335700 - RNA, 19 nt, Yersinia pestis KIM
cggcaaauagagcaccaaa

SEQ ID NO: 2335701 - RNA, 22 nt, Yersinia pestis KIM
cggcaaauagagcaccaaaucu

SEQ ID NO: 2335702 - RNA, 14 nt, Yersinia pestis KIM
cggcaacagcgccu

SEQ ID NO: 2335703 - RNA, 16 nt, Yersinia pestis KIM
cggcacaggcgcuggc

SEQ ID NO: 2335704 - RNA, 14 nt, Yersinia pestis KIM
cggcacguuucccc

SEQ ID NO: 2335705 - RNA, 20 nt, Yersinia pestis KIM
cggcaccugcccgccccggc

SEQ ID NO: 2335706 - RNA, 14 nt, Yersinia pestis KIM
cggaucgcgacgaa

SEQ ID NO: 2335707 - RNA, 15 nt, Yersinia pestis KIM
cggauccccugauaa

SEQ ID NO: 2335708 - RNA, 21 nt, Yersinia pestis KIM
cggaucugcaacuucagccac

SEQ ID NO: 2335709 - RNA, 20 nt, Yersinia pestis KIM
cggaugaugaucaccgccug

SEQ ID NO: 2335710 - RNA, 16 nt, Yersinia pestis KIM
cggauugcaaauccgu

SEQ ID NO: 2335711 - RNA, 13 nt, Yersinia pestis KIM
cggaucagcgccu

SEQ ID NO: 2335712 - RNA, 18 nt, Yersinia pestis KIM
cggauauuuuuuugucug

SEQ ID NO: 2335713 - RNA, 22 nt, Yersinia pestis KIM
cggaucagagccaacugaggca

SEQ ID NO: 2335714 - RNA, 14 nt, Yersinia pestis KIM
cggauauucucaac

SEQ ID NO: 2335715 - RNA, 20 nt, Yersinia pestis KIM
cggauagcgcuucagugauu

SEQ ID NO: 2335716 - RNA, 22 nt, Yersinia pestis KIM
cggauaaccgcgaagaggguuu

SEQ ID NO: 2335717 - RNA, 17 nt, Yersinia pestis KIM
cggauaauguuaauauu

SEQ ID NO: 2335718 - RNA, 16 nt, Yersinia pestis KIM
cggaggagauuucaga

SEQ ID NO: 2335719 - RNA, 13 nt, Yersinia pestis KIM
cggauaaaacaau

SEQ ID NO: 2335720 - RNA, 13 nt, Yersinia pestis KIM
cgagcguaauucc

SEQ ID NO: 2335721 - RNA, 19 nt, Yersinia pestis KIM
aaacggaugagucgcuggu

SEQ ID NO: 2335722 - RNA, 19 nt, Yersinia pestis KIM
cgaggaaaacgccagcaga

SEQ ID NO: 2335723 - RNA, 17 nt, Yersinia pestis KIM
cgagcgugcgguagacc

SEQ ID NO: 2335724 - RNA, 16 nt, Yersinia pestis KIM
cgagcguuuaaauacc

SEQ ID NO: 2335725 - RNA, 20 nt, Yersinia pestis KIM
cgagcucucacugcuccagc

SEQ ID NO: 2335726 - RNA, 22 nt, Yersinia pestis KIM
cgagcucucacugcuccagcca

SEQ ID NO: 2335727 - RNA, 15 nt, Yersinia pestis KIM
cgaggcuucucagca

SEQ ID NO: 2335728 - RNA, 19 nt, Yersinia pestis KIM
cgaggacgaauacacagcg

SEQ ID NO: 2335729 - RNA, 15 nt, Yersinia pestis KIM
cgaggaauagccagc

SEQ ID NO: 2335730 - RNA, 19 nt, Yersinia pestis KIM
cgaggguucgaaucccucc

SEQ ID NO: 2335731 - RNA, 13 nt, Yersinia pestis KIM
cgaguaaugaaau

SEQ ID NO: 2335732 - RNA, 20 nt, Yersinia pestis KIM
cgagucacgaaggcaaccag

SEQ ID NO: 2335733 - RNA, 15 nt, Yersinia pestis KIM
cgagucucuuggaug

SEQ ID NO: 2335734 - RNA, 23 nt, Yersinia pestis KIM
cgagucuauugaaaaaauaaugu

SEQ ID NO: 2335735 - RNA, 13 nt, Yersinia pestis KIM
cgauaacauuuuu

SEQ ID NO: 2335736 - RNA, 15 nt, Yersinia pestis KIM
cgauaacauuuuuuc

SEQ ID NO: 2335737 - RNA, 14 nt, Yersinia pestis KIM
cgauaaccaaauca

SEQ ID NO: 2335738 - RNA, 16 nt, Yersinia pestis KIM
cgauaaccaaaucacc

SEQ ID NO: 2335739 - RNA, 21 nt, Yersinia pestis KIM
cgauaacagauauuacgcagc

SEQ ID NO: 2335740 - RNA, 14 nt, Yersinia pestis KIM
cgauaaagucaucc

SEQ ID NO: 2335741 - RNA, 21 nt, Yersinia pestis KIM
cgauaaauaauuacuuauaaa

SEQ ID NO: 2335742 - RNA, 17 nt, Yersinia pestis KIM
cgaguuguacgugaaga

SEQ ID NO: 2335743 - RNA, 13 nt, Yersinia pestis KIM
cgaguuucccuuu

SEQ ID NO: 2335744 - RNA, 20 nt, Yersinia pestis KIM
cgaguuuauauugccacggc

SEQ ID NO: 2335745 - RNA, 11 nt, Yersinia pestis KIM
cgauaaaagau

SEQ ID NO: 2335746 - RNA, 20 nt, Yersinia pestis KIM
cgauaaaaggcuauuuaaau

SEQ ID NO: 2335747 - RNA, 19 nt, Yersinia pestis KIM
cgauaaaaaccauuuuuau

SEQ ID NO: 2335748 - RNA, 14 nt, Yersinia pestis KIM
cgauacaguggcua

SEQ ID NO: 2335749 - RNA, 19 nt, Yersinia pestis KIM
cgauacaccauuuccaggc

SEQ ID NO: 2335750 - RNA, 22 nt, Yersinia pestis KIM
cgauaauggaugaauauccacc

SEQ ID NO: 2335751 - RNA, 23 nt, Yersinia pestis KIM
cgauaaucccugccagaaucagc

SEQ ID NO: 2335752 - RNA, 15 nt, Yersinia pestis KIM
cgauagagauagcca

SEQ ID NO: 2335753 - RNA, 14 nt, Yersinia pestis KIM
cgagccuacaugga

SEQ ID NO: 2335754 - RNA, 14 nt, Yersinia pestis KIM
aaacgcucaucaac

SEQ ID NO: 2335755 - RNA, 14 nt, Yersinia pestis KIM
cgagcacugccccg

SEQ ID NO: 2335756 - RNA, 18 nt, Yersinia pestis KIM
cgagaauucagaggcugc

SEQ ID NO: 2335757 - RNA, 20 nt, Yersinia pestis KIM
cgagagcgucccugaugggg

SEQ ID NO: 2335758 - RNA, 17 nt, Yersinia pestis KIM
cgagaggcuauuuaucg

SEQ ID NO: 2335759 - RNA, 22 nt, Yersinia pestis KIM
cgacuuaauggucuucuuuauu

SEQ ID NO: 2335760 - RNA, 17 nt, Yersinia pestis KIM
cgacuugaugaaguuau

SEQ ID NO: 2335761 - RNA, 20 nt, Yersinia pestis KIM
cgacgugaugccaguaauuc

SEQ ID NO: 2335762 - RNA, 23 nt, Yersinia pestis KIM
cgacgugcucgucuucgacagca

SEQ ID NO: 2335763 - RNA, 21 nt, Yersinia pestis KIM
cgacguuaucaauacugcaaa

SEQ ID NO: 2335764 - RNA, 18 nt, Yersinia pestis KIM
cgacuaaggcaaccugag

SEQ ID NO: 2335765 - RNA, 22 nt, Yersinia pestis KIM
cgaauagagacggaaagagcca

SEQ ID NO: 2335766 - RNA, 14 nt, Yersinia pestis KIM
cgaauaauugguag

SEQ ID NO: 2335767 - RNA, 17 nt, Yersinia pestis KIM
cgaauagcuggcugacc

SEQ ID NO: 2335768 - RNA, 12 nt, Yersinia pestis KIM
cgacuggucccg

SEQ ID NO: 2335769 - RNA, 14 nt, Yersinia pestis KIM
cgacuccuggcaau

SEQ ID NO: 2335770 - RNA, 15 nt, Yersinia pestis KIM
cgcacaaacauggcu

SEQ ID NO: 2335771 - RNA, 21 nt, Yersinia pestis KIM
cgcacaaacauggcugucccg

SEQ ID NO: 2335772 - RNA, 17 nt, Yersinia pestis KIM
cgcaaccaaucauucaa

SEQ ID NO: 2335773 - RNA, 22 nt, Yersinia pestis KIM
cgcaaccaccuuuaccaugcuc

SEQ ID NO: 2335774 - RNA, 14 nt, Yersinia pestis KIM
cgcaacagcgccuc

SEQ ID NO: 2335775 - RNA, 20 nt, Yersinia pestis KIM
cgcaaagcgggccagcaacc

SEQ ID NO: 2335776 - RNA, 16 nt, Yersinia pestis KIM
cgcacuuggccccauc

SEQ ID NO: 2335777 - RNA, 21 nt, Yersinia pestis KIM
cgcaccaaugccgguccagac

SEQ ID NO: 2335778 - RNA, 12 nt, Yersinia pestis KIM
cgcaccaaugcc

SEQ ID NO: 2335779 - RNA, 16 nt, Yersinia pestis KIM
cgcacauuacaagugc

SEQ ID NO: 2335780 - RNA, 18 nt, Yersinia pestis KIM
cgcacgaaaggcuggagc

SEQ ID NO: 2335781 - RNA, 23 nt, Yersinia pestis KIM
cgcacgaauaucuagcaacacau

SEQ ID NO: 2335782 - RNA, 13 nt, Yersinia pestis KIM
cgauggaaaaaau

SEQ ID NO: 2335783 - RNA, 19 nt, Yersinia pestis KIM
cgaucaaaaacguccaggc

SEQ ID NO: 2335784 - RNA, 16 nt, Yersinia pestis KIM
cgauaugaucagauuu

SEQ ID NO: 2335785 - RNA, 20 nt, Yersinia pestis KIM
cgauauucugauggugucaa

SEQ ID NO: 2335786 - RNA, 13 nt, Yersinia pestis KIM
cgauuuuuaaguc

SEQ ID NO: 2335787 - RNA, 11 nt, Yersinia pestis KIM
cgauuuuagcu

SEQ ID NO: 2335788 - RNA, 14 nt, Yersinia pestis KIM
cgauuuuaaaaaau

SEQ ID NO: 2335789 - RNA, 22 nt, Yersinia pestis KIM
cgcaaaaugccaacaacugggu

SEQ ID NO: 2335790 - RNA, 15 nt, Yersinia pestis KIM
cgcaaaauuuauauu

SEQ ID NO: 2335791 - RNA, 23 nt, Yersinia pestis KIM
cgcaaagagaacgggcaaccugu

SEQ ID NO: 2335792 - RNA, 19 nt, Yersinia pestis KIM
cgcaaacggguggccgccg

SEQ ID NO: 2335793 - RNA, 14 nt, Yersinia pestis KIM
cgauugaucagcca

SEQ ID NO: 2335794 - RNA, 22 nt, Yersinia pestis KIM
cgauuugcgggcuaaaacuggc

SEQ ID NO: 2335795 - RNA, 21 nt, Yersinia pestis KIM
cgccaccaaugcauccaagcc

SEQ ID NO: 2335796 - RNA, 20 nt, Yersinia pestis KIM
cgccaccaaugcauccaagc

SEQ ID NO: 2335797 - RNA, 22 nt, Yersinia pestis KIM
cgccacacaauacauagaagcu

SEQ ID NO: 2335798 - RNA, 14 nt, Yersinia pestis KIM
cgccaauuuuguag

SEQ ID NO: 2335799 - RNA, 19 nt, Yersinia pestis KIM
cgccaaggauggcgcggcu

SEQ ID NO: 2335800 - RNA, 13 nt, Yersinia pestis KIM
cgccaauucacgc

SEQ ID NO: 2335801 - RNA, 22 nt, Yersinia pestis KIM
cgccaauggggccauaagugca

SEQ ID NO: 2335802 - RNA, 12 nt, Yersinia pestis KIM
cgccaaucgcca

SEQ ID NO: 2335803 - RNA, 16 nt, Yersinia pestis KIM
cgcauucaccaccaua

SEQ ID NO: 2335804 - RNA, 14 nt, Yersinia pestis KIM
cgcauugaggucag

SEQ ID NO: 2335805 - RNA, 17 nt, Yersinia pestis KIM
cgcauucgugccauaaa

SEQ ID NO: 2335806 - RNA, 17 nt, Yersinia pestis KIM
cgcauugaggucagcgu

SEQ ID NO: 2335807 - RNA, 21 nt, Yersinia pestis KIM
cgcauuggguaauaucaccau

SEQ ID NO: 2335808 - RNA, 15 nt, Yersinia pestis KIM
cgcauugucacccac

SEQ ID NO: 2335809 - RNA, 20 nt, Yersinia pestis KIM
cgcauugucacccacuaaug

SEQ ID NO: 2335810 - RNA, 21 nt, Yersinia pestis KIM
cgcauugugcuuuuuggcaaa

SEQ ID NO: 2335811 - RNA, 18 nt, Yersinia pestis KIM
cgccaaccggcgcgcuuu

SEQ ID NO: 2335812 - RNA, 17 nt, Yersinia pestis KIM
cgccaaaacgcgcgcca

SEQ ID NO: 2335813 - RNA, 19 nt, Yersinia pestis KIM
cgcagagucucaccgcugg

SEQ ID NO: 2335814 - RNA, 18 nt, Yersinia pestis KIM
cgcagaauaacggcagua

SEQ ID NO: 2335815 - RNA, 12 nt, Yersinia pestis KIM
cgcaggcggcca

SEQ ID NO: 2335816 - RNA, 15 nt, Yersinia pestis KIM
cgcaucgcuugcuca

SEQ ID NO: 2335817 - RNA, 20 nt, Yersinia pestis KIM
cgcaucgccuguaaaucuug

SEQ ID NO: 2335818 - RNA, 14 nt, Yersinia pestis KIM
cgcaucuuccaaag

SEQ ID NO: 2335819 - RNA, 15 nt, Yersinia pestis KIM
cgcaucuuccaaagg

SEQ ID NO: 2335820 - RNA, 22 nt, Yersinia pestis KIM
aaacggcacaugggucucgccg

SEQ ID NO: 2335821 - RNA, 14 nt, Yersinia pestis KIM
cgcgagacggcgca

SEQ ID NO: 2335822 - RNA, 16 nt, Yersinia pestis KIM
cgcgaucacaauacag

SEQ ID NO: 2335823 - RNA, 17 nt, Yersinia pestis KIM
cgcgaucagacauuuuu

SEQ ID NO: 2335824 - RNA, 21 nt, Yersinia pestis KIM
cgcgaauccccccauucacac

SEQ ID NO: 2335825 - RNA, 19 nt, Yersinia pestis KIM
cgccuuuuuuauaauaaug

SEQ ID NO: 2335826 - RNA, 21 nt, Yersinia pestis KIM
cgccuguuucggcaggcagaa

SEQ ID NO: 2335827 - RNA, 16 nt, Yersinia pestis KIM
cgccuuaccgcaauuu

SEQ ID NO: 2335828 - RNA, 15 nt, Yersinia pestis KIM
cgccugcgcuaauac

SEQ ID NO: 2335829 - RNA, 12 nt, Yersinia pestis KIM
cgcgccgcggcu

SEQ ID NO: 2335830 - RNA, 16 nt, Yersinia pestis KIM
cgcgccaaccaucgga

SEQ ID NO: 2335831 - RNA, 23 nt, Yersinia pestis KIM
cgcgcagugccgucaauuaucaa

SEQ ID NO: 2335832 - RNA, 21 nt, Yersinia pestis KIM
cgcgauugaucagccaacaag

SEQ ID NO: 2335833 - RNA, 17 nt, Yersinia pestis KIM
cgcgaucuugaacggug

SEQ ID NO: 2335834 - RNA, 17 nt, Yersinia pestis KIM
cgcgcuucgagccccca

SEQ ID NO: 2335835 - RNA, 15 nt, Yersinia pestis KIM
cgcgcuucgagcccc

SEQ ID NO: 2335836 - RNA, 18 nt, Yersinia pestis KIM
cgcggacguuuuacucuu

SEQ ID NO: 2335837 - RNA, 15 nt, Yersinia pestis KIM
cgcgcuuggaagggu

SEQ ID NO: 2335838 - RNA, 17 nt, Yersinia pestis KIM
cgcgguuuuuccgccgu

SEQ ID NO: 2335839 - RNA, 16 nt, Yersinia pestis KIM
cgcguuaaucugcugc

SEQ ID NO: 2335840 - RNA, 18 nt, Yersinia pestis KIM
cgcguuaaugcuaaugcc

SEQ ID NO: 2335841 - RNA, 16 nt, Yersinia pestis KIM
cgcguucaaaucugcu

SEQ ID NO: 2335842 - RNA, 16 nt, Yersinia pestis KIM
cgcgguucgcagcuuc

SEQ ID NO: 2335843 - RNA, 14 nt, Yersinia pestis KIM
cgcgguuacaccaa

SEQ ID NO: 2335844 - RNA, 17 nt, Yersinia pestis KIM
cgcggguuuugccgggc

SEQ ID NO: 2335845 - RNA, 12 nt, Yersinia pestis KIM
cgccccggccgc

SEQ ID NO: 2335846 - RNA, 19 nt, Yersinia pestis KIM
cgccccgauaaaugucgcu

SEQ ID NO: 2335847 - RNA, 14 nt, Yersinia pestis KIM
cgccccgauaaaug

SEQ ID NO: 2335848 - RNA, 19 nt, Yersinia pestis KIM
cgccaucgucagccccugc

SEQ ID NO: 2335849 - RNA, 18 nt, Yersinia pestis KIM
cgccaucguauauccacc

SEQ ID NO: 2335850 - RNA, 15 nt, Yersinia pestis KIM
cgccacggauaaggu

SEQ ID NO: 2335851 - RNA, 17 nt, Yersinia pestis KIM
cgccauggcaugccaug

SEQ ID NO: 2335852 - RNA, 19 nt, Yersinia pestis KIM
cgccauggcaugccaugca

SEQ ID NO: 2335853 - RNA, 16 nt, Yersinia pestis KIM
cgccgaguaagucaau

SEQ ID NO: 2335854 - RNA, 16 nt, Yersinia pestis KIM
cgcccuccugcggcgg

SEQ ID NO: 2335855 - RNA, 12 nt, Yersinia pestis KIM
cgcccuccugcg

SEQ ID NO: 2335856 - RNA, 14 nt, Yersinia pestis KIM
cgcccgcugauucu

SEQ ID NO: 2335857 - RNA, 13 nt, Yersinia pestis KIM
cgcccuguuucaa

SEQ ID NO: 2335858 - RNA, 23 nt, Yersinia pestis KIM
cgccgacaaaaucccccaccagu

SEQ ID NO: 2335859 - RNA, 15 nt, Yersinia pestis KIM
cgccguagauuuaac

SEQ ID NO: 2335860 - RNA, 13 nt, Yersinia pestis KIM
cgccguaaacugc

SEQ ID NO: 2335861 - RNA, 17 nt, Yersinia pestis KIM
cgccguauuuguauuua

SEQ ID NO: 2335862 - RNA, 22 nt, Yersinia pestis KIM
cgccgcucaauuaaccugagcg

SEQ ID NO: 2335863 - RNA, 19 nt, Yersinia pestis KIM
aaacguccaggcuuucacg

SEQ ID NO: 2335864 - RNA, 23 nt, Yersinia pestis KIM
aaacgucacuucgccuuaucagc

SEQ ID NO: 2335865 - RNA, 14 nt, Yersinia pestis KIM
aaacgauuacccac

SEQ ID NO: 2335866 - RNA, 11 nt, Yersinia pestis KIM
ccgugacuaaa

SEQ ID NO: 2335867 - RNA, 13 nt, Yersinia pestis KIM
ccgugacauuuuc

SEQ ID NO: 2335868 - RNA, 17 nt, Yersinia pestis KIM
ccgucuuggauauuuga

SEQ ID NO: 2335869 - RNA, 21 nt, Yersinia pestis KIM
ccgucaccucaucagugacua

SEQ ID NO: 2335870 - RNA, 16 nt, Yersinia pestis KIM
ccgucagacugcugac

SEQ ID NO: 2335871 - RNA, 14 nt, Yersinia pestis KIM
ccgucagcaucaua

SEQ ID NO: 2335872 - RNA, 11 nt, Yersinia pestis KIM
ccgucaucucu

SEQ ID NO: 2335873 - RNA, 14 nt, Yersinia pestis KIM
aaacgaacgaauaa

SEQ ID NO: 2335874 - RNA, 15 nt, Yersinia pestis KIM
aaaccuuauuuuugc

SEQ ID NO: 2335875 - RNA, 17 nt, Yersinia pestis KIM
ccggugguucaaccacc

SEQ ID NO: 2335876 - RNA, 19 nt, Yersinia pestis KIM
ccggucgaacccauucauc

SEQ ID NO: 2335877 - RNA, 18 nt, Yersinia pestis KIM
ccggguaagguaaagaaa

SEQ ID NO: 2335878 - RNA, 18 nt, Yersinia pestis KIM
ccggggugaucaacugcc

SEQ ID NO: 2335879 - RNA, 22 nt, Yersinia pestis KIM
ccggggugaucaacugccuguu

SEQ ID NO: 2335880 - RNA, 19 nt, Yersinia pestis KIM
ccguauuuuauaucugcgc

SEQ ID NO: 2335881 - RNA, 11 nt, Yersinia pestis KIM
ccguauuauuu

SEQ ID NO: 2335882 - RNA, 14 nt, Yersinia pestis KIM
ccguaugggggaug

SEQ ID NO: 2335883 - RNA, 23 nt, Yersinia pestis KIM
ccguaugggggauggccgggcug

SEQ ID NO: 2335884 - RNA, 13 nt, Yersinia pestis KIM
ccgucaauaucau

SEQ ID NO: 2335885 - RNA, 21 nt, Yersinia pestis KIM
ccgucaauaucaucaucuuua

SEQ ID NO: 2335886 - RNA, 16 nt, Yersinia pestis KIM
ccgucaagacaacaaa

SEQ ID NO: 2335887 - RNA, 15 nt, Yersinia pestis KIM
ccgucaaugccuguu

SEQ ID NO: 2335888 - RNA, 12 nt, Yersinia pestis KIM
ccguauaaucag

SEQ ID NO: 2335889 - RNA, 18 nt, Yersinia pestis KIM
ccguauagauuauuuucu

SEQ ID NO: 2335890 - RNA, 13 nt, Yersinia pestis KIM
ccguaucagcccc

SEQ ID NO: 2335891 - RNA, 18 nt, Yersinia pestis KIM
ccguaucaccgguuuuug

SEQ ID NO: 2335892 - RNA, 18 nt, Yersinia pestis KIM
ccguagccaacacaugcu

SEQ ID NO: 2335893 - RNA, 12 nt, Yersinia pestis KIM
ccguacccgcuc

SEQ ID NO: 2335894 - RNA, 15 nt, Yersinia pestis KIM
ccguaccaguugucu

SEQ ID NO: 2335895 - RNA, 12 nt, Yersinia pestis KIM
ccguacaaauau

SEQ ID NO: 2335896 - RNA, 13 nt, Yersinia pestis KIM
ccguaacuucuuc

SEQ ID NO: 2335897 - RNA, 14 nt, Yersinia pestis KIM
ccguaacuucuucg

SEQ ID NO: 2335898 - RNA, 17 nt, Yersinia pestis KIM
ccguaacgcccuccugc

SEQ ID NO: 2335899 - RNA, 23 nt, Yersinia pestis KIM
ccguaagauucgccgcaaggcaa

SEQ ID NO: 2335900 - RNA, 15 nt, Yersinia pestis KIM
ccgguuuuggucagu

SEQ ID NO: 2335901 - RNA, 13 nt, Yersinia pestis KIM
ccggccugauuua

SEQ ID NO: 2335902 - RNA, 15 nt, Yersinia pestis KIM
ccggauacaccguau

SEQ ID NO: 2335903 - RNA, 19 nt, Yersinia pestis KIM
aaaccugugugaccuccgu

SEQ ID NO: 2335904 - RNA, 19 nt, Yersinia pestis KIM
aaaccuccgcgauaccaau

SEQ ID NO: 2335905 - RNA, 19 nt, Yersinia pestis KIM
aaaccucagaaaaaugccu

SEQ ID NO: 2335906 - RNA, 16 nt, Yersinia pestis KIM
aaaccugauaggccaa

SEQ ID NO: 2335907 - RNA, 18 nt, Yersinia pestis KIM
aaaccuagucucacuaaa

SEQ ID NO: 2335908 - RNA, 22 nt, Yersinia pestis KIM
aaaccuagucucacuaaaucaa

SEQ ID NO: 2335909 - RNA, 20 nt, Yersinia pestis KIM
ccggcugacuggacaaauaa

SEQ ID NO: 2335910 - RNA, 14 nt, Yersinia pestis KIM
ccgggaaaaaauac

SEQ ID NO: 2335911 - RNA, 19 nt, Yersinia pestis KIM
ccgggaaccccuucaggcc

SEQ ID NO: 2335912 - RNA, 14 nt, Yersinia pestis KIM
ccgggaacaacgaa

SEQ ID NO: 2335913 - RNA, 19 nt, Yersinia pestis KIM
aaaccggaugauuucaaac

SEQ ID NO: 2335914 - RNA, 14 nt, Yersinia pestis KIM
aaaccggacauaau

SEQ ID NO: 2335915 - RNA, 14 nt, Yersinia pestis KIM
aaaccgguuaaaac

SEQ ID NO: 2335916 - RNA, 18 nt, Yersinia pestis KIM
ccgcgccauccuugccuu

SEQ ID NO: 2335917 - RNA, 14 nt, Yersinia pestis KIM
ccgcgcccucccug

SEQ ID NO: 2335918 - RNA, 18 nt, Yersinia pestis KIM
aaaccgaaaugaucuuca

SEQ ID NO: 2335919 - RNA, 16 nt, Yersinia pestis KIM
ccgcgcuuccaggcug

SEQ ID NO: 2335920 - RNA, 16 nt, Yersinia pestis KIM
aaaccgcagcagacaa

SEQ ID NO: 2335921 - RNA, 19 nt, Yersinia pestis KIM
aaaccgcauuaugccccca

SEQ ID NO: 2335922 - RNA, 15 nt, Yersinia pestis KIM
ccgcgcaaccuggcc

SEQ ID NO: 2335923 - RNA, 12 nt, Yersinia pestis KIM
ccgcgcacagca

SEQ ID NO: 2335924 - RNA, 13 nt, Yersinia pestis KIM
ccgcgauaaaaaa

SEQ ID NO: 2335925 - RNA, 18 nt, Yersinia pestis KIM
ccgcagcaggcagagcaa

SEQ ID NO: 2335926 - RNA, 21 nt, Yersinia pestis KIM
ccgcagccuucagaugaauga

SEQ ID NO: 2335927 - RNA, 17 nt, Yersinia pestis KIM
ccgcugaucaggaaggu

SEQ ID NO: 2335928 - RNA, 20 nt, Yersinia pestis KIM
ccgcugcaagccgcguucaa

SEQ ID NO: 2335929 - RNA, 16 nt, Yersinia pestis KIM
ccgcucgucacacugg

SEQ ID NO: 2335930 - RNA, 12 nt, Yersinia pestis KIM
ccgcugcccggc

SEQ ID NO: 2335931 - RNA, 24 nt, Yersinia pestis KIM
ccgcugcuaccagcagugcagcca

SEQ ID NO: 2335932 - RNA, 21 nt, Yersinia pestis KIM
ccgcuggcgaccacuuccugu

SEQ ID NO: 2335933 - RNA, 23 nt, Yersinia pestis KIM
ccggagcaagggcgcauccccau

SEQ ID NO: 2335934 - RNA, 14 nt, Yersinia pestis KIM
ccgcugggccgucu

SEQ ID NO: 2335935 - RNA, 12 nt, Yersinia pestis KIM
ccgcuucugggc

SEQ ID NO: 2335936 - RNA, 12 nt, Yersinia pestis KIM
ccgcuuggguaa

SEQ ID NO: 2335937 - RNA, 21 nt, Yersinia pestis KIM
ccgcuuguuguaucacagcaa

SEQ ID NO: 2335938 - RNA, 24 nt, Yersinia pestis KIM
ccgcggucaucaugguucugcuca

SEQ ID NO: 2335939 - RNA, 14 nt, Yersinia pestis KIM
ccgcucaacuuugc

SEQ ID NO: 2335940 - RNA, 11 nt, Yersinia pestis KIM
ccgcuccagca

SEQ ID NO: 2335941 - RNA, 21 nt, Yersinia pestis KIM
ccgcuaccgagucuauuuucg

SEQ ID NO: 2335942 - RNA, 18 nt, Yersinia pestis KIM
ccgcuagugauagcgggc

SEQ ID NO: 2335943 - RNA, 19 nt, Yersinia pestis KIM
ccgcuagugauagcgggcc

SEQ ID NO: 2335944 - RNA, 20 nt, Yersinia pestis KIM
ccgcuaucacuagcgggccu

SEQ ID NO: 2335945 - RNA, 13 nt, Yersinia pestis KIM
ccgcuaaccuuaa

SEQ ID NO: 2335946 - RNA, 23 nt, Yersinia pestis KIM
ccgcuaacguuuauuuauaagaa

SEQ ID NO: 2335947 - RNA, 18 nt, Yersinia pestis KIM
ccgcuaauucaggcaaau

SEQ ID NO: 2335948 - RNA, 15 nt, Yersinia pestis KIM
ccgcguucaaaucug

SEQ ID NO: 2335949 - RNA, 19 nt, Yersinia pestis KIM
ccgcguucaaaucugcucc

SEQ ID NO: 2335950 - RNA, 15 nt, Yersinia pestis KIM
ccugacucccugacu

SEQ ID NO: 2335951 - RNA, 18 nt, Yersinia pestis KIM
ccugacucccugacuccc

SEQ ID NO: 2335952 - RNA, 19 nt, Yersinia pestis KIM
ccugacucccugacucccu

SEQ ID NO: 2335953 - RNA, 15 nt, Yersinia pestis KIM
ccugacgcacagcac

SEQ ID NO: 2335954 - RNA, 21 nt, Yersinia pestis KIM
ccugacgaugauaaaucagca

SEQ ID NO: 2335955 - RNA, 17 nt, Yersinia pestis KIM
ccugacccccaauuuca

SEQ ID NO: 2335956 - RNA, 18 nt, Yersinia pestis KIM
ccugacacugcaucucug

SEQ ID NO: 2335957 - RNA, 11 nt, Yersinia pestis KIM
ccugacauuug

SEQ ID NO: 2335958 - RNA, 16 nt, Yersinia pestis KIM
ccugaaucgauaaacc

SEQ ID NO: 2335959 - RNA, 18 nt, Yersinia pestis KIM
ccugaaucucgcgcccug

SEQ ID NO: 2335960 - RNA, 19 nt, Yersinia pestis KIM
ccugaauggaaaaauuagc

SEQ ID NO: 2335961 - RNA, 15 nt, Yersinia pestis KIM
ccugaggauaaaaac

SEQ ID NO: 2335962 - RNA, 19 nt, Yersinia pestis KIM
ccugagaaucaaaaaacag

SEQ ID NO: 2335963 - RNA, 16 nt, Yersinia pestis KIM
ccugacuguuuugcua

SEQ ID NO: 2335964 - RNA, 19 nt, Yersinia pestis KIM
ccugacucacagggcuguu

SEQ ID NO: 2335965 - RNA, 15 nt, Yersinia pestis KIM
ccugagucaguaauu

SEQ ID NO: 2335966 - RNA, 19 nt, Yersinia pestis KIM
ccugagucaguaauucacc

SEQ ID NO: 2335967 - RNA, 17 nt, Yersinia pestis KIM
ccugaguaauauuauuc

SEQ ID NO: 2335968 - RNA, 21 nt, Yersinia pestis KIM
ccugaguuaucuguuucaaau

SEQ ID NO: 2335969 - RNA, 18 nt, Yersinia pestis KIM
ccugauaaggagagaggc

SEQ ID NO: 2335970 - RNA, 19 nt, Yersinia pestis KIM
ccugaacgccuugcccugc

SEQ ID NO: 2335971 - RNA, 17 nt, Yersinia pestis KIM
ccugaaggcugauuaau

SEQ ID NO: 2335972 - RNA, 16 nt, Yersinia pestis KIM
ccugaauagaagucca

SEQ ID NO: 2335973 - RNA, 14 nt, Yersinia pestis KIM
ccucuguccccgcu

SEQ ID NO: 2335974 - RNA, 15 nt, Yersinia pestis KIM
ccucugcugcugccc

SEQ ID NO: 2335975 - RNA, 20 nt, Yersinia pestis KIM
ccucugcugcugcccgcgaa

SEQ ID NO: 2335976 - RNA, 23 nt, Yersinia pestis KIM
ccucuggcggugacguuccuugg

SEQ ID NO: 2335977 - RNA, 20 nt, Yersinia pestis KIM
ccucuucagguaagccuuuc

SEQ ID NO: 2335978 - RNA, 21 nt, Yersinia pestis KIM
ccucuuauuaaauggagggca

SEQ ID NO: 2335979 - RNA, 13 nt, Yersinia pestis KIM
ccucuuaaugucu

SEQ ID NO: 2335980 - RNA, 18 nt, Yersinia pestis KIM
ccucuuccgguuguucua

SEQ ID NO: 2335981 - RNA, 21 nt, Yersinia pestis KIM
ccucuuuacgcucugccuguu

SEQ ID NO: 2335982 - RNA, 15 nt, Yersinia pestis KIM
ccugcgcugcuuuuu

SEQ ID NO: 2335983 - RNA, 14 nt, Yersinia pestis KIM
ccugcgccagcagc

SEQ ID NO: 2335984 - RNA, 18 nt, Yersinia pestis KIM
ccugcgauagccccauau

SEQ ID NO: 2335985 - RNA, 21 nt, Yersinia pestis KIM
ccugcauccccggcaucccac

SEQ ID NO: 2335986 - RNA, 19 nt, Yersinia pestis KIM
ccugcaucaucacauucaa

SEQ ID NO: 2335987 - RNA, 15 nt, Yersinia pestis KIM
ccugcauaucauucg

SEQ ID NO: 2335988 - RNA, 14 nt, Yersinia pestis KIM
ccugccaaauuaaa

SEQ ID NO: 2335989 - RNA, 21 nt, Yersinia pestis KIM
ccugccacagacuuucuuuaa

SEQ ID NO: 2335990 - RNA, 18 nt, Yersinia pestis KIM
ccugcagcaacaauaacu

SEQ ID NO: 2335991 - RNA, 17 nt, Yersinia pestis KIM
ccugcaauaaccagaau

SEQ ID NO: 2335992 - RNA, 23 nt, Yersinia pestis KIM
ccugcaacgccagugacuuuaac

SEQ ID NO: 2335993 - RNA, 18 nt, Yersinia pestis KIM
ccugaugccccaugguua

SEQ ID NO: 2335994 - RNA, 13 nt, Yersinia pestis KIM
ccugaugagucua

SEQ ID NO: 2335995 - RNA, 21 nt, Yersinia pestis KIM
ccugaugugguuguuuuuucc

SEQ ID NO: 2335996 - RNA, 21 nt, Yersinia pestis KIM
ccugauuacguuccacugcuu

SEQ ID NO: 2335997 - RNA, 22 nt, Yersinia pestis KIM
ccugauuacguuccacugcuuu

SEQ ID NO: 2335998 - RNA, 20 nt, Yersinia pestis KIM
ccugauucgcgaccagcaga

SEQ ID NO: 2335999 - RNA, 16 nt, Yersinia pestis KIM
ccugauuuaguuuauu

SEQ ID NO: 2336000 - RNA, 17 nt, Yersinia pestis KIM
ccugauagcgcacuguc

SEQ ID NO: 2336001 - RNA, 14 nt, Yersinia pestis KIM
ccugauccaacauc

SEQ ID NO: 2336002 - RNA, 21 nt, Yersinia pestis KIM
ccucgcgccacucuagcugug

SEQ ID NO: 2336003 - RNA, 20 nt, Yersinia pestis KIM
ccuccuagccgggacuuugc

SEQ ID NO: 2336004 - RNA, 19 nt, Yersinia pestis KIM
ccucgguggcucaauccaa

SEQ ID NO: 2336005 - RNA, 22 nt, Yersinia pestis KIM
ccucggugucaguacgcuggcc

SEQ ID NO: 2336006 - RNA, 15 nt, Yersinia pestis KIM
ccucggucacugccu

SEQ ID NO: 2336007 - RNA, 20 nt, Yersinia pestis KIM
ccucggucacugccugcaca

SEQ ID NO: 2336008 - RNA, 19 nt, Yersinia pestis KIM
ccucuagcuguauugcccg

SEQ ID NO: 2336009 - RNA, 14 nt, Yersinia pestis KIM
ccucuaaucacuua

SEQ ID NO: 2336010 - RNA, 12 nt, Yersinia pestis KIM
ccucucaccaag

SEQ ID NO: 2336011 - RNA, 17 nt, Yersinia pestis KIM
ccucucagacugcugac

SEQ ID NO: 2336012 - RNA, 20 nt, Yersinia pestis KIM
ccucugccgauuuaaacccu

SEQ ID NO: 2336013 - RNA, 18 nt, Yersinia pestis KIM
ccucugauuguaacaauc

SEQ ID NO: 2336014 - RNA, 17 nt, Yersinia pestis KIM
ccucugcaaugcccaga

SEQ ID NO: 2336015 - RNA, 23 nt, Yersinia pestis KIM
ccucucuggucuugcaccugauc

SEQ ID NO: 2336016 - RNA, 18 nt, Yersinia pestis KIM
ccucguuuaacucaaaua

SEQ ID NO: 2336017 - RNA, 16 nt, Yersinia pestis KIM
ccucuaacacucuuuc

SEQ ID NO: 2336018 - RNA, 13 nt, Yersinia pestis KIM
ccucacucuguga

SEQ ID NO: 2336019 - RNA, 16 nt, Yersinia pestis KIM
ccucacgggcuuccau

SEQ ID NO: 2336020 - RNA, 19 nt, Yersinia pestis KIM
ccucaguaaaacgcuccag

SEQ ID NO: 2336021 - RNA, 18 nt, Yersinia pestis KIM
ccucagggcgucucuacg

SEQ ID NO: 2336022 - RNA, 16 nt, Yersinia pestis KIM
ccucaggggccaacag

SEQ ID NO: 2336023 - RNA, 20 nt, Yersinia pestis KIM
ccucaggcccgcuaucacua

SEQ ID NO: 2336024 - RNA, 18 nt, Yersinia pestis KIM
ccucaacgcaccccacaa

SEQ ID NO: 2336025 - RNA, 14 nt, Yersinia pestis KIM
ccucaacgcacccc

SEQ ID NO: 2336026 - RNA, 21 nt, Yersinia pestis KIM
ccucaaaauucgugcucauca

SEQ ID NO: 2336027 - RNA, 21 nt, Yersinia pestis KIM
ccucaaaucgauacuuuuuau

SEQ ID NO: 2336028 - RNA, 11 nt, Yersinia pestis KIM
ccucaagaccg

SEQ ID NO: 2336029 - RNA, 23 nt, Yersinia pestis KIM
ccucaacgcgaauaucaggcacu

SEQ ID NO: 2336030 - RNA, 19 nt, Yersinia pestis KIM
ccuauucagcagcauuucu

SEQ ID NO: 2336031 - RNA, 20 nt, Yersinia pestis KIM
ccuauuaucccaguuuuuaa

SEQ ID NO: 2336032 - RNA, 19 nt, Yersinia pestis KIM
ccucaaaaggauggcccaa

SEQ ID NO: 2336033 - RNA, 18 nt, Yersinia pestis KIM
ccgugcggcuucuuauuu

SEQ ID NO: 2336034 - RNA, 22 nt, Yersinia pestis KIM
ccuaucgucagugcgguaacca

SEQ ID NO: 2336035 - RNA, 22 nt, Yersinia pestis KIM
ccuaucuauuuuuauuucuccu

SEQ ID NO: 2336036 - RNA, 22 nt, Yersinia pestis KIM
ccuaucgguaucucccgcaaag

SEQ ID NO: 2336037 - RNA, 21 nt, Yersinia pestis KIM
ccuaucuucucguaauuauug

SEQ ID NO: 2336038 - RNA, 17 nt, Yersinia pestis KIM
aaacgccaucaauaauu

SEQ ID NO: 2336039 - RNA, 15 nt, Yersinia pestis KIM
aaacgccaacaauac

SEQ ID NO: 2336040 - RNA, 14 nt, Yersinia pestis KIM
aaacgccccgauaa

SEQ ID NO: 2336041 - RNA, 20 nt, Yersinia pestis KIM
aaacgccccgauaaaccaac

SEQ ID NO: 2336042 - RNA, 13 nt, Yersinia pestis KIM
aaacgcauaagaa

SEQ ID NO: 2336043 - RNA, 23 nt, Yersinia pestis KIM
aaacgcauacucaaaaauggcaa

SEQ ID NO: 2336044 - RNA, 20 nt, Yersinia pestis KIM
ccucaguucuuggaacccgu

SEQ ID NO: 2336045 - RNA, 22 nt, Yersinia pestis KIM
ccucaguaucuuuccagccaau

SEQ ID NO: 2336046 - RNA, 21 nt, Yersinia pestis KIM
ccucaugaaugaggcugaggu

SEQ ID NO: 2336047 - RNA, 22 nt, Yersinia pestis KIM
aaacgccucguuuaacucaaau

SEQ ID NO: 2336048 - RNA, 20 nt, Yersinia pestis KIM
aaacgccugauccaacaucg

SEQ ID NO: 2336049 - RNA, 15 nt, Yersinia pestis KIM
aaacgccuccaguga

SEQ ID NO: 2336050 - RNA, 19 nt, Yersinia pestis KIM
ccucauuaaucagcauuaa

SEQ ID NO: 2336051 - RNA, 17 nt, Yersinia pestis KIM
ccucauuauuaaacuga

SEQ ID NO: 2336052 - RNA, 18 nt, Yersinia pestis KIM
ccucauucaugaggcuuc

SEQ ID NO: 2336053 - RNA, 17 nt, Yersinia pestis KIM
ccucauucaugaggcuu

SEQ ID NO: 2336054 - RNA, 19 nt, Yersinia pestis KIM
ccuccgauucauaguccaa

SEQ ID NO: 2336055 - RNA, 21 nt, Yersinia pestis KIM
ccucccuggcgcggacgcuuu

SEQ ID NO: 2336056 - RNA, 15 nt, Yersinia pestis KIM
ccucccgcuaacgca

SEQ ID NO: 2336057 - RNA, 19 nt, Yersinia pestis KIM
cgaacacaguccuguuuau

SEQ ID NO: 2336058 - RNA, 13 nt, Yersinia pestis KIM
cgaacagccccgc

SEQ ID NO: 2336059 - RNA, 10 nt, Yersinia pestis KIM
cgaacgcccg

SEQ ID NO: 2336060 - RNA, 14 nt, Yersinia pestis KIM
cgaaccaaggcccu

SEQ ID NO: 2336061 - RNA, 14 nt, Yersinia pestis KIM
cgaacaugccgaca

SEQ ID NO: 2336062 - RNA, 16 nt, Yersinia pestis KIM
cgaacaguagccccug

SEQ ID NO: 2336063 - RNA, 17 nt, Yersinia pestis KIM
cgaagggcgcagccccc

SEQ ID NO: 2336064 - RNA, 23 nt, Yersinia pestis KIM
cgaauaagcucugggacgugcau

SEQ ID NO: 2336065 - RNA, 17 nt, Yersinia pestis KIM
cgaaacacauacaaaua

SEQ ID NO: 2336066 - RNA, 22 nt, Yersinia pestis KIM
cgaaacaccacgcccaauucca

SEQ ID NO: 2336067 - RNA, 15 nt, Yersinia pestis KIM
cgaaagauagcaaaa

SEQ ID NO: 2336068 - RNA, 18 nt, Yersinia pestis KIM
cgaaagauagcaaaagaa

SEQ ID NO: 2336069 - RNA, 22 nt, Yersinia pestis KIM
cgaaagauaauuuagcaaagcg

SEQ ID NO: 2336070 - RNA, 18 nt, Yersinia pestis KIM
cgaaagaaauaaaagaaa

SEQ ID NO: 2336071 - RNA, 14 nt, Yersinia pestis KIM
cgaaagaaauaaaa

SEQ ID NO: 2336072 - RNA, 11 nt, Yersinia pestis KIM
cgaaacucuuc

SEQ ID NO: 2336073 - RNA, 11 nt, Yersinia pestis KIM
ccuuucugggc

SEQ ID NO: 2336074 - RNA, 15 nt, Yersinia pestis KIM
ccuuggggccucacu

SEQ ID NO: 2336075 - RNA, 17 nt, Yersinia pestis KIM
ccuuucucggugugcuc

SEQ ID NO: 2336076 - RNA, 13 nt, Yersinia pestis KIM
ccuuuuauuuaga

SEQ ID NO: 2336077 - RNA, 13 nt, Yersinia pestis KIM
ccuuugacagcau

SEQ ID NO: 2336078 - RNA, 19 nt, Yersinia pestis KIM
ccuuugacagcaucugcaa

SEQ ID NO: 2336079 - RNA, 12 nt, Yersinia pestis KIM
cgaaaacucaaa

SEQ ID NO: 2336080 - RNA, 12 nt, Yersinia pestis KIM
cgaaaagcagca

SEQ ID NO: 2336081 - RNA, 23 nt, Yersinia pestis KIM
ccuuuuuugaacgauauuuuuau

SEQ ID NO: 2336082 - RNA, 20 nt, Yersinia pestis KIM
ccuuggcugccagugccgcc

SEQ ID NO: 2336083 - RNA, 15 nt, Yersinia pestis KIM
ccuuggcguuucuga

SEQ ID NO: 2336084 - RNA, 15 nt, Yersinia pestis KIM
ccuugcgccaagucc

SEQ ID NO: 2336085 - RNA, 20 nt, Yersinia pestis KIM
ccuucuggcaaaccggacau

SEQ ID NO: 2336086 - RNA, 21 nt, Yersinia pestis KIM
ccuugaucgccaaauaaacaa

SEQ ID NO: 2336087 - RNA, 19 nt, Yersinia pestis KIM
ccuucccuauucaaaauag

SEQ ID NO: 2336088 - RNA, 11 nt, Yersinia pestis KIM
ccuucccuggg

SEQ ID NO: 2336089 - RNA, 13 nt, Yersinia pestis KIM
ccuucccauccua

SEQ ID NO: 2336090 - RNA, 11 nt, Yersinia pestis KIM
ccuuccaaugu

SEQ ID NO: 2336091 - RNA, 20 nt, Yersinia pestis KIM
ccuucgguauauuucccguu

SEQ ID NO: 2336092 - RNA, 18 nt, Yersinia pestis KIM
ccuucucgaugccuucuu

SEQ ID NO: 2336093 - RNA, 21 nt, Yersinia pestis KIM
ccuuaaccaacaugagccaca

SEQ ID NO: 2336094 - RNA, 21 nt, Yersinia pestis KIM
ccuuaaccccguagcacacac

SEQ ID NO: 2336095 - RNA, 14 nt, Yersinia pestis KIM
ccuuacuauuuuuc

SEQ ID NO: 2336096 - RNA, 16 nt, Yersinia pestis KIM
ccuuacuaucuuuauu

SEQ ID NO: 2336097 - RNA, 21 nt, Yersinia pestis KIM
ccuuagcgccaucgcuaauca

SEQ ID NO: 2336098 - RNA, 21 nt, Yersinia pestis KIM
ccuuauaaauccgcuaguuaa

SEQ ID NO: 2336099 - RNA, 17 nt, Yersinia pestis KIM
ccuuacuuuuuugccug

SEQ ID NO: 2336100 - RNA, 22 nt, Yersinia pestis KIM
ccuuacugggcggguuuuuuau

SEQ ID NO: 2336101 - RNA, 21 nt, Yersinia pestis KIM
ccuucaucucugacacugaca

SEQ ID NO: 2336102 - RNA, 16 nt, Yersinia pestis KIM
ccugguagcaccacau

SEQ ID NO: 2336103 - RNA, 13 nt, Yersinia pestis KIM
ccugcucuucugg

SEQ ID NO: 2336104 - RNA, 13 nt, Yersinia pestis KIM
ccugcugcaccuc

SEQ ID NO: 2336105 - RNA, 19 nt, Yersinia pestis KIM
ccugucaucaacuucacuu

SEQ ID NO: 2336106 - RNA, 20 nt, Yersinia pestis KIM
ccugguuuuuuaaaaaagug

SEQ ID NO: 2336107 - RNA, 15 nt, Yersinia pestis KIM
ccuguaaauaaauac

SEQ ID NO: 2336108 - RNA, 13 nt, Yersinia pestis KIM
ccuguaaaucuug

SEQ ID NO: 2336109 - RNA, 13 nt, Yersinia pestis KIM
ccuguauaaaaau

SEQ ID NO: 2336110 - RNA, 22 nt, Yersinia pestis KIM
ccuguauaaaaauagccuuccu

SEQ ID NO: 2336111 - RNA, 22 nt, Yersinia pestis KIM
ccuguguuuugagcaucacuuc

SEQ ID NO: 2336112 - RNA, 22 nt, Yersinia pestis KIM
ccugucuuaggugacaggcaaa

SEQ ID NO: 2336113 - RNA, 15 nt, Yersinia pestis KIM
ccugugaaucaagaa

SEQ ID NO: 2336114 - RNA, 16 nt, Yersinia pestis KIM
ccugugcaccacacag

SEQ ID NO: 2336115 - RNA, 23 nt, Yersinia pestis KIM
ccugugcgcccacgccaacccuc

SEQ ID NO: 2336116 - RNA, 15 nt, Yersinia pestis KIM
ccuguucucuccguc

SEQ ID NO: 2336117 - RNA, 14 nt, Yersinia pestis KIM
ccuguuuggccccc

SEQ ID NO: 2336118 - RNA, 16 nt, Yersinia pestis KIM
ccuguuuacguaaaua

SEQ ID NO: 2336119 - RNA, 18 nt, Yersinia pestis KIM
ccuguuuacguaaauaga

SEQ ID NO: 2336120 - RNA, 21 nt, Yersinia pestis KIM
ccgcaauaaauggcauuuuuu

SEQ ID NO: 2336121 - RNA, 23 nt, Yersinia pestis KIM
ccgcaaggcuucgacucugggcc

SEQ ID NO: 2336122 - RNA, 21 nt, Yersinia pestis KIM
ccgcagcaaccgucaccgugu

SEQ ID NO: 2336123 - RNA, 20 nt, Yersinia pestis KIM
ccgcaaccgggccggguuga

SEQ ID NO: 2336124 - RNA, 16 nt, Yersinia pestis KIM
ccgcaaccugacugcu

SEQ ID NO: 2336125 - RNA, 12 nt, Yersinia pestis KIM
ccgaugcaauaa

SEQ ID NO: 2336126 - RNA, 15 nt, Yersinia pestis KIM
ccgaugacuaaccaa

SEQ ID NO: 2336127 - RNA, 14 nt, Yersinia pestis KIM
ccgaugagugaaau

SEQ ID NO: 2336128 - RNA, 19 nt, Yersinia pestis KIM
ccgaugacgcgaucugaaa

SEQ ID NO: 2336129 - RNA, 19 nt, Yersinia pestis KIM
ccgaugaaccaaccgccaa

SEQ ID NO: 2336130 - RNA, 12 nt, Yersinia pestis KIM
ccgauaugcccu

SEQ ID NO: 2336131 - RNA, 20 nt, Yersinia pestis KIM
ccgauauugauagccacauc

SEQ ID NO: 2336132 - RNA, 18 nt, Yersinia pestis KIM
ccgaucaacaggccaccu

SEQ ID NO: 2336133 - RNA, 18 nt, Yersinia pestis KIM
ccgauacaggcucugaaa

SEQ ID NO: 2336134 - RNA, 15 nt, Yersinia pestis KIM
ccgauacuuuugcua

SEQ ID NO: 2336135 - RNA, 12 nt, Yersinia pestis KIM
ccgagaggcuga

SEQ ID NO: 2336136 - RNA, 19 nt, Yersinia pestis KIM
ccgacgugugcuguaagaa

SEQ ID NO: 2336137 - RNA, 15 nt, Yersinia pestis KIM
ccgagggcgugcucu

SEQ ID NO: 2336138 - RNA, 19 nt, Yersinia pestis KIM
ccgaggaauaugcccuuuu

SEQ ID NO: 2336139 - RNA, 16 nt, Yersinia pestis KIM
ccgaggugaagacacc

SEQ ID NO: 2336140 - RNA, 13 nt, Yersinia pestis KIM
ccgaguguaaaaa

SEQ ID NO: 2336141 - RNA, 19 nt, Yersinia pestis KIM
ccgauaaaaaccauuuuua

SEQ ID NO: 2336142 - RNA, 16 nt, Yersinia pestis KIM
ccgauaaaccaacuga

SEQ ID NO: 2336143 - RNA, 14 nt, Yersinia pestis KIM
ccgauaaacgccag

SEQ ID NO: 2336144 - RNA, 20 nt, Yersinia pestis KIM
ccgauaauaaauauccuccg

SEQ ID NO: 2336145 - RNA, 19 nt, Yersinia pestis KIM
ccgauaacgcgaucugaag

SEQ ID NO: 2336146 - RNA, 18 nt, Yersinia pestis KIM
cccuucggcaugcaacuu

SEQ ID NO: 2336147 - RNA, 22 nt, Yersinia pestis KIM
cccuucgggcuugguguugcaa

SEQ ID NO: 2336148 - RNA, 14 nt, Yersinia pestis KIM
cccuucgagcaccg

SEQ ID NO: 2336149 - RNA, 20 nt, Yersinia pestis KIM
cccuucgcccuguaaagcca

SEQ ID NO: 2336150 - RNA, 15 nt, Yersinia pestis KIM
cccuguugaucugag

SEQ ID NO: 2336151 - RNA, 13 nt, Yersinia pestis KIM
cccugugcgccca

SEQ ID NO: 2336152 - RNA, 15 nt, Yersinia pestis KIM
cccuguagaacaccu

SEQ ID NO: 2336153 - RNA, 21 nt, Yersinia pestis KIM
cccuguaguucaucauuauua

SEQ ID NO: 2336154 - RNA, 15 nt, Yersinia pestis KIM
cccuguauaaaaaua

SEQ ID NO: 2336155 - RNA, 11 nt, Yersinia pestis KIM
cccuguaaccg

SEQ ID NO: 2336156 - RNA, 14 nt, Yersinia pestis KIM
cccuguaacuuaau

SEQ ID NO: 2336157 - RNA, 16 nt, Yersinia pestis KIM
cccuuucgcagcccaa

SEQ ID NO: 2336158 - RNA, 22 nt, Yersinia pestis KIM
cccuuuaaaucuagcccuucag

SEQ ID NO: 2336159 - RNA, 13 nt, Yersinia pestis KIM
cccuuuacuauca

SEQ ID NO: 2336160 - RNA, 16 nt, Yersinia pestis KIM
cccuugaccucauuau

SEQ ID NO: 2336161 - RNA, 21 nt, Yersinia pestis KIM
cccgucgggauaucuucaauc

SEQ ID NO: 2336162 - RNA, 18 nt, Yersinia pestis KIM
aaacacuuggauccgcag

SEQ ID NO: 2336163 - RNA, 20 nt, Yersinia pestis KIM
aaacacuuaugaucuugaau

SEQ ID NO: 2336164 - RNA, 21 nt, Yersinia pestis KIM
aaacacuuauuugaaauacuu

SEQ ID NO: 2336165 - RNA, 15 nt, Yersinia pestis KIM
cccugcuuauacgcu

SEQ ID NO: 2336166 - RNA, 16 nt, Yersinia pestis KIM
aaacagucauuaacac

SEQ ID NO: 2336167 - RNA, 15 nt, Yersinia pestis KIM
aaacagugucacuuc

SEQ ID NO: 2336168 - RNA, 13 nt, Yersinia pestis KIM
aaacauaaaaaau

SEQ ID NO: 2336169 - RNA, 18 nt, Yersinia pestis KIM
ccgaaauggaaaggcggg

SEQ ID NO: 2336170 - RNA, 16 nt, Yersinia pestis KIM
aaacagacuaaaaacc

SEQ ID NO: 2336171 - RNA, 21 nt, Yersinia pestis KIM
aaacagaacccccgcgaacag

SEQ ID NO: 2336172 - RNA, 12 nt, Yersinia pestis KIM
aaacagacccca

SEQ ID NO: 2336173 - RNA, 14 nt, Yersinia pestis KIM
aaacagacaaaaaa

SEQ ID NO: 2336174 - RNA, 15 nt, Yersinia pestis KIM
aaacagacaaaaaau

SEQ ID NO: 2336175 - RNA, 12 nt, Yersinia pestis KIM
cccuuucuuauc

SEQ ID NO: 2336176 - RNA, 14 nt, Yersinia pestis KIM
cccuuugacagcau

SEQ ID NO: 2336177 - RNA, 16 nt, Yersinia pestis KIM
cccuuugacauacagu

SEQ ID NO: 2336178 - RNA, 23 nt, Yersinia pestis KIM
cccuuuugauuuguuaaaacagu

SEQ ID NO: 2336179 - RNA, 13 nt, Yersinia pestis KIM
cccuuuuaccgaa

SEQ ID NO: 2336180 - RNA, 16 nt, Yersinia pestis KIM
ccgacaccaauaccga

SEQ ID NO: 2336181 - RNA, 13 nt, Yersinia pestis KIM
ccgacacccagcc

SEQ ID NO: 2336182 - RNA, 17 nt, Yersinia pestis KIM
ccgaauuaauaaaaccu

SEQ ID NO: 2336183 - RNA, 19 nt, Yersinia pestis KIM
ccgaagcugauggcgauca

SEQ ID NO: 2336184 - RNA, 22 nt, Yersinia pestis KIM
aaacauuucauuccagauaaaa

SEQ ID NO: 2336185 - RNA, 16 nt, Yersinia pestis KIM
ccgacacccagccaga

SEQ ID NO: 2336186 - RNA, 15 nt, Yersinia pestis KIM
aaaccaccaaaauag

SEQ ID NO: 2336187 - RNA, 17 nt, Yersinia pestis KIM
aaaccaacugaaacugg

SEQ ID NO: 2336188 - RNA, 21 nt, Yersinia pestis KIM
cccgcuuauggggacucuuua

SEQ ID NO: 2336189 - RNA, 17 nt, Yersinia pestis KIM
cccggcaccuucaacga

SEQ ID NO: 2336190 - RNA, 22 nt, Yersinia pestis KIM
cccggauauuuuuuugucugac

SEQ ID NO: 2336191 - RNA, 15 nt, Yersinia pestis KIM
cccggaucacuggcu

SEQ ID NO: 2336192 - RNA, 23 nt, Yersinia pestis KIM
cccggaauggagccgcuagcgca

SEQ ID NO: 2336193 - RNA, 17 nt, Yersinia pestis KIM
cccgcuaccaagcccag

SEQ ID NO: 2336194 - RNA, 18 nt, Yersinia pestis KIM
cccgcuaccacuccuuag

SEQ ID NO: 2336195 - RNA, 13 nt, Yersinia pestis KIM
cccgcuaacaugc

SEQ ID NO: 2336196 - RNA, 16 nt, Yersinia pestis KIM
cccgcgcuuccaggcu

SEQ ID NO: 2336197 - RNA, 12 nt, Yersinia pestis KIM
cccgcgggggcc

SEQ ID NO: 2336198 - RNA, 15 nt, Yersinia pestis KIM
cccgcgacggagaga

SEQ ID NO: 2336199 - RNA, 21 nt, Yersinia pestis KIM
cccggccgccauugagucguu

SEQ ID NO: 2336200 - RNA, 19 nt, Yersinia pestis KIM
cccggcgauucuccacuga

SEQ ID NO: 2336201 - RNA, 15 nt, Yersinia pestis KIM
cccgguuagauaggc

SEQ ID NO: 2336202 - RNA, 21 nt, Yersinia pestis KIM
aaacacugauuuauaaauaau

SEQ ID NO: 2336203 - RNA, 21 nt, Yersinia pestis KIM
aaacacgauauaccucaguua

SEQ ID NO: 2336204 - RNA, 15 nt, Yersinia pestis KIM
aaacacgcauaugaa

SEQ ID NO: 2336205 - RNA, 22 nt, Yersinia pestis KIM
ccccacuuguaccugugccagu

SEQ ID NO: 2336206 - RNA, 13 nt, Yersinia pestis KIM
ccccagagcgcaa

SEQ ID NO: 2336207 - RNA, 18 nt, Yersinia pestis KIM
ccccacuauucuccaaca

SEQ ID NO: 2336208 - RNA, 14 nt, Yersinia pestis KIM
ccccacggccagag

SEQ ID NO: 2336209 - RNA, 21 nt, Yersinia pestis KIM
ccccaugguuacgccagcagc

SEQ ID NO: 2336210 - RNA, 14 nt, Yersinia pestis KIM
ccccaaugaugacu

SEQ ID NO: 2336211 - RNA, 21 nt, Yersinia pestis KIM
ccccaauucacgcaaggccag

SEQ ID NO: 2336212 - RNA, 22 nt, Yersinia pestis KIM
ccccaaugaguagcuguagcca

SEQ ID NO: 2336213 - RNA, 12 nt, Yersinia pestis KIM
ccccaaucaagc

SEQ ID NO: 2336214 - RNA, 19 nt, Yersinia pestis KIM
ccccaaccgaccacaaaau

SEQ ID NO: 2336215 - RNA, 22 nt, Yersinia pestis KIM
ccccaaccgaccacaaaaucau

SEQ ID NO: 2336216 - RNA, 15 nt, Yersinia pestis KIM
ccccaagcauagaag

SEQ ID NO: 2336217 - RNA, 14 nt, Yersinia pestis KIM
cccauucacaccau

SEQ ID NO: 2336218 - RNA, 22 nt, Yersinia pestis KIM
cccauucaucaaacucugcauc

SEQ ID NO: 2336219 - RNA, 15 nt, Yersinia pestis KIM
cccauucgcgcccca

SEQ ID NO: 2336220 - RNA, 18 nt, Yersinia pestis KIM
cccauucgcgccccaaau

SEQ ID NO: 2336221 - RNA, 21 nt, Yersinia pestis KIM
cccagccauuugaacaaaccc

SEQ ID NO: 2336222 - RNA, 19 nt, Yersinia pestis KIM
cccagcauucagguguuca

SEQ ID NO: 2336223 - RNA, 21 nt, Yersinia pestis KIM
ccccgcuucguccagaugcca

SEQ ID NO: 2336224 - RNA, 14 nt, Yersinia pestis KIM
ccccgcauaaauac

SEQ ID NO: 2336225 - RNA, 22 nt, Yersinia pestis KIM
ccccgacgauauuaccgagcgu

SEQ ID NO: 2336226 - RNA, 15 nt, Yersinia pestis KIM
cccccuuuggccgcu

SEQ ID NO: 2336227 - RNA, 16 nt, Yersinia pestis KIM
cccccgacccacgccc

SEQ ID NO: 2336228 - RNA, 11 nt, Yersinia pestis KIM
cccgccucuga

SEQ ID NO: 2336229 - RNA, 12 nt, Yersinia pestis KIM
cccgaugacgcg

SEQ ID NO: 2336230 - RNA, 17 nt, Yersinia pestis KIM
cccgaugauugcaucau

SEQ ID NO: 2336231 - RNA, 19 nt, Yersinia pestis KIM
cccgauuucaacgcaccau

SEQ ID NO: 2336232 - RNA, 16 nt, Yersinia pestis KIM
cccgauuucaacgcac

SEQ ID NO: 2336233 - RNA, 22 nt, Yersinia pestis KIM
cccgauuccaucagcgcacugc

SEQ ID NO: 2336234 - RNA, 19 nt, Yersinia pestis KIM
cccgaugguggcagccugc

SEQ ID NO: 2336235 - RNA, 20 nt, Yersinia pestis KIM
cccgcaguuugagaaacuga

SEQ ID NO: 2336236 - RNA, 11 nt, Yersinia pestis KIM
cccgaaucaag

SEQ ID NO: 2336237 - RNA, 13 nt, Yersinia pestis KIM
cccgaaucaagcu

SEQ ID NO: 2336238 - RNA, 18 nt, Yersinia pestis KIM
cccgaagcucaagcuggc

SEQ ID NO: 2336239 - RNA, 18 nt, Yersinia pestis KIM
cccgaucaucaucgguac

SEQ ID NO: 2336240 - RNA, 19 nt, Yersinia pestis KIM
cccgaucaggugaugucag

SEQ ID NO: 2336241 - RNA, 22 nt, Yersinia pestis KIM
ccccuucaaugaaugccgguga

SEQ ID NO: 2336242 - RNA, 19 nt, Yersinia pestis KIM
ccccuucgauauuacaguu

SEQ ID NO: 2336243 - RNA, 15 nt, Yersinia pestis KIM
ccccuguaaaacaag

SEQ ID NO: 2336244 - RNA, 12 nt, Yersinia pestis KIM
ccccugcgggua

SEQ ID NO: 2336245 - RNA, 15 nt, Yersinia pestis KIM
ccccuaauucuccuu

SEQ ID NO: 2336246 - RNA, 17 nt, Yersinia pestis KIM
ccccuagccagccaccg

SEQ ID NO: 2336247 - RNA, 20 nt, Yersinia pestis KIM
ccaguguuagcuguuuuagu

SEQ ID NO: 2336248 - RNA, 15 nt, Yersinia pestis KIM
ccaguguucauauuc

SEQ ID NO: 2336249 - RNA, 21 nt, Yersinia pestis KIM
ccaguggugcucccgcacucu

SEQ ID NO: 2336250 - RNA, 16 nt, Yersinia pestis KIM
ccaguggcaucaauau

SEQ ID NO: 2336251 - RNA, 19 nt, Yersinia pestis KIM
ccaguggcucgacggccaa

SEQ ID NO: 2336252 - RNA, 13 nt, Yersinia pestis KIM
ccagugcggaagc

SEQ ID NO: 2336253 - RNA, 20 nt, Yersinia pestis KIM
ccaguucugguagcugcuca

SEQ ID NO: 2336254 - RNA, 23 nt, Yersinia pestis KIM
ccaguuuccacgaaggcacccau

SEQ ID NO: 2336255 - RNA, 17 nt, Yersinia pestis KIM
ccaguuugcucaucagu

SEQ ID NO: 2336256 - RNA, 11 nt, Yersinia pestis KIM
ccauaaauaaa

SEQ ID NO: 2336257 - RNA, 12 nt, Yersinia pestis KIM
ccauaaccgaug

SEQ ID NO: 2336258 - RNA, 14 nt, Yersinia pestis KIM
ccauaaccauugaa

SEQ ID NO: 2336259 - RNA, 12 nt, Yersinia pestis KIM
ccaucaauaauu

SEQ ID NO: 2336260 - RNA, 21 nt, Yersinia pestis KIM
ccaucaauaccaauaaaaccu

SEQ ID NO: 2336261 - RNA, 15 nt, Yersinia pestis KIM
ccaucaauaaagcug

SEQ ID NO: 2336262 - RNA, 18 nt, Yersinia pestis KIM
ccaucaagccaccgcugg

SEQ ID NO: 2336263 - RNA, 18 nt, Yersinia pestis KIM
ccaucacaaaaccuuuaa

SEQ ID NO: 2336264 - RNA, 22 nt, Yersinia pestis KIM
ccauauccuggcgguaauaaau

SEQ ID NO: 2336265 - RNA, 23 nt, Yersinia pestis KIM
ccauauagcggcguucagcaaua

SEQ ID NO: 2336266 - RNA, 12 nt, Yersinia pestis KIM
ccaucaaccacg

SEQ ID NO: 2336267 - RNA, 13 nt, Yersinia pestis KIM
ccaucaaaggaga

SEQ ID NO: 2336268 - RNA, 16 nt, Yersinia pestis KIM
ccauaauccagaagcc

SEQ ID NO: 2336269 - RNA, 23 nt, Yersinia pestis KIM
ccauaacgccgacaacccgcuac

SEQ ID NO: 2336270 - RNA, 21 nt, Yersinia pestis KIM
ccauaagcgggguauuuuacu

SEQ ID NO: 2336271 - RNA, 23 nt, Yersinia pestis KIM
ccauaagcccccguaucauggaa

SEQ ID NO: 2336272 - RNA, 12 nt, Yersinia pestis KIM
ccauagauuaau

SEQ ID NO: 2336273 - RNA, 14 nt, Yersinia pestis KIM
ccauagaugggcca

SEQ ID NO: 2336274 - RNA, 21 nt, Yersinia pestis KIM
ccauagauuaagaaaacauua

SEQ ID NO: 2336275 - RNA, 23 nt, Yersinia pestis KIM
ccauccuuggcgcggacgcuuua

SEQ ID NO: 2336276 - RNA, 16 nt, Yersinia pestis KIM
ccauccgcaggaagca

SEQ ID NO: 2336277 - RNA, 13 nt, Yersinia pestis KIM
ccaucgccaauac

SEQ ID NO: 2336278 - RNA, 13 nt, Yersinia pestis KIM
ccaucucaauagc

SEQ ID NO: 2336279 - RNA, 21 nt, Yersinia pestis KIM
ccaucuaauagaauagauccc

SEQ ID NO: 2336280 - RNA, 18 nt, Yersinia pestis KIM
ccaucucauguuaaauga

SEQ ID NO: 2336281 - RNA, 16 nt, Yersinia pestis KIM
ccaugagugaaaauau

SEQ ID NO: 2336282 - RNA, 23 nt, Yersinia pestis KIM
ccaucugaugaguguuuauucuc

SEQ ID NO: 2336283 - RNA, 17 nt, Yersinia pestis KIM
ccaucagcgcacugcau

SEQ ID NO: 2336284 - RNA, 11 nt, Yersinia pestis KIM
ccaucaggaag

SEQ ID NO: 2336285 - RNA, 23 nt, Yersinia pestis KIM
ccaucaugaauaggauagacagu

SEQ ID NO: 2336286 - RNA, 18 nt, Yersinia pestis KIM
ccaucccccauggggcca

SEQ ID NO: 2336287 - RNA, 20 nt, Yersinia pestis KIM
ccaucccccauggggccacc

SEQ ID NO: 2336288 - RNA, 20 nt, Yersinia pestis KIM
ccauccaugggccucgcuuc

SEQ ID NO: 2336289 - RNA, 23 nt, Yersinia pestis KIM
aaacaauaaacagacuaaaaacc

SEQ ID NO: 2336290 - RNA, 13 nt, Yersinia pestis KIM
cccacauguucga

SEQ ID NO: 2336291 - RNA, 21 nt, Yersinia pestis KIM
cccaccauaaugugccucgaa

SEQ ID NO: 2336292 - RNA, 15 nt, Yersinia pestis KIM
cccacggcacauaau

SEQ ID NO: 2336293 - RNA, 18 nt, Yersinia pestis KIM
cccacuauucuccaacaa

SEQ ID NO: 2336294 - RNA, 11 nt, Yersinia pestis KIM
cccacguucag

SEQ ID NO: 2336295 - RNA, 16 nt, Yersinia pestis KIM
cccacucgccccacaa

SEQ ID NO: 2336296 - RNA, 19 nt, Yersinia pestis KIM
cccacuugaccuucccucu

SEQ ID NO: 2336297 - RNA, 13 nt, Yersinia pestis KIM
cccagcagugcug

SEQ ID NO: 2336298 - RNA, 19 nt, Yersinia pestis KIM
cccagcagugcugcgccca

SEQ ID NO: 2336299 - RNA, 15 nt, Yersinia pestis KIM
cccagaucauccaga

SEQ ID NO: 2336300 - RNA, 23 nt, Yersinia pestis KIM
cccagagcgcggcuucagcaccu

SEQ ID NO: 2336301 - RNA, 21 nt, Yersinia pestis KIM
cccagagcgcaaaagaccaag

SEQ ID NO: 2336302 - RNA, 22 nt, Yersinia pestis KIM
cccagagcgcggcuucagcacc

SEQ ID NO: 2336303 - RNA, 18 nt, Yersinia pestis KIM
ccauuuccaggcuaccaa

SEQ ID NO: 2336304 - RNA, 13 nt, Yersinia pestis KIM
cccaauggcaaca

SEQ ID NO: 2336305 - RNA, 14 nt, Yersinia pestis KIM
cccaaugucaggaa

SEQ ID NO: 2336306 - RNA, 13 nt, Yersinia pestis KIM
cccaauauugauc

SEQ ID NO: 2336307 - RNA, 21 nt, Yersinia pestis KIM
cccaaucgauaauauuauuau

SEQ ID NO: 2336308 - RNA, 17 nt, Yersinia pestis KIM
cccaauaauaaaaaaaa

SEQ ID NO: 2336309 - RNA, 20 nt, Yersinia pestis KIM
cccaauaauaaaaaaaaaua

SEQ ID NO: 2336310 - RNA, 20 nt, Yersinia pestis KIM
cccaauaagugaaacaaaua

SEQ ID NO: 2336311 - RNA, 20 nt, Yersinia pestis KIM
ccaugcuuucuaacaaaccu

SEQ ID NO: 2336312 - RNA, 21 nt, Yersinia pestis KIM
ccauucaucaaacucugcauc

SEQ ID NO: 2336313 - RNA, 17 nt, Yersinia pestis KIM
ccaugcucagaaaccug

SEQ ID NO: 2336314 - RNA, 18 nt, Yersinia pestis KIM
ccaugcucuacgccccau

SEQ ID NO: 2336315 - RNA, 19 nt, Yersinia pestis KIM
ccaugcugcccgcacacug

SEQ ID NO: 2336316 - RNA, 16 nt, Yersinia pestis KIM
ccauuguggcuaaacc

SEQ ID NO: 2336317 - RNA, 21 nt, Yersinia pestis KIM
ccauuuaauaacuuaaauaau

SEQ ID NO: 2336318 - RNA, 21 nt, Yersinia pestis KIM
ccauuguauugcucagggcca

SEQ ID NO: 2336319 - RNA, 21 nt, Yersinia pestis KIM
ccauugguuuuuagcuuaaca

SEQ ID NO: 2336320 - RNA, 17 nt, Yersinia pestis KIM
ccauuguauugcucagg

SEQ ID NO: 2336321 - RNA, 17 nt, Yersinia pestis KIM
ccauugguaauaaugcc

SEQ ID NO: 2336322 - RNA, 16 nt, Yersinia pestis KIM
ccauuggcaaaggcca

SEQ ID NO: 2336323 - RNA, 16 nt, Yersinia pestis KIM
ccauugauaauaauau

SEQ ID NO: 2336324 - RNA, 18 nt, Yersinia pestis KIM
ccauugcaccaauaacug

SEQ ID NO: 2336325 - RNA, 22 nt, Yersinia pestis KIM
ccauugauggccuugaaucaaa

SEQ ID NO: 2336326 - RNA, 18 nt, Yersinia pestis KIM
ccagggcguuuaccaucc

SEQ ID NO: 2336327 - RNA, 17 nt, Yersinia pestis KIM
ccaggucaaucaauucu

SEQ ID NO: 2336328 - RNA, 20 nt, Yersinia pestis KIM
ccaggcugaacgcacaaugg

SEQ ID NO: 2336329 - RNA, 12 nt, Yersinia pestis KIM
ccaggcuggcca

SEQ ID NO: 2336330 - RNA, 16 nt, Yersinia pestis KIM
ccaggcuuucacggug

SEQ ID NO: 2336331 - RNA, 21 nt, Yersinia pestis KIM
ccagggaaauuagcgccuccg

SEQ ID NO: 2336332 - RNA, 20 nt, Yersinia pestis KIM
ccaggcgaucucuucggccc

SEQ ID NO: 2336333 - RNA, 16 nt, Yersinia pestis KIM
ccaggcaagaaacuuc

SEQ ID NO: 2336334 - RNA, 13 nt, Yersinia pestis KIM
ccaggcaucaucu

SEQ ID NO: 2336335 - RNA, 20 nt, Yersinia pestis KIM
ccaggacgacauccacauug

SEQ ID NO: 2336336 - RNA, 24 nt, Yersinia pestis KIM
ccagcuuuagcauugcagauuucu

SEQ ID NO: 2336337 - RNA, 13 nt, Yersinia pestis KIM
ccagcgccccauc

SEQ ID NO: 2336338 - RNA, 11 nt, Yersinia pestis KIM
ccagcgcccgg

SEQ ID NO: 2336339 - RNA, 18 nt, Yersinia pestis KIM
ccagcgaagugccgccau

SEQ ID NO: 2336340 - RNA, 19 nt, Yersinia pestis KIM
ccagccuuaacugcauagc

SEQ ID NO: 2336341 - RNA, 16 nt, Yersinia pestis KIM
ccagcgaaucaaacag

SEQ ID NO: 2336342 - RNA, 23 nt, Yersinia pestis KIM
ccacugaccuauugauaaaacca

SEQ ID NO: 2336343 - RNA, 23 nt, Yersinia pestis KIM
ccacugaccuauugauaaaaccg

SEQ ID NO: 2336344 - RNA, 14 nt, Yersinia pestis KIM
ccacugaccgggaa

SEQ ID NO: 2336345 - RNA, 10 nt, Yersinia pestis KIM
ccacugaggg

SEQ ID NO: 2336346 - RNA, 16 nt, Yersinia pestis KIM
ccacugauacccaguu

SEQ ID NO: 2336347 - RNA, 16 nt, Yersinia pestis KIM
ccacucguucucaacc

SEQ ID NO: 2336348 - RNA, 13 nt, Yersinia pestis KIM
ccacucuagcugu

SEQ ID NO: 2336349 - RNA, 17 nt, Yersinia pestis KIM
ccacucucccucaguga

SEQ ID NO: 2336350 - RNA, 20 nt, Yersinia pestis KIM
ccacugacaaaaacagcacu

SEQ ID NO: 2336351 - RNA, 15 nt, Yersinia pestis KIM
ccagcggcaccgccg

SEQ ID NO: 2336352 - RNA, 17 nt, Yersinia pestis KIM
ccagcgggaaucaaacu

SEQ ID NO: 2336353 - RNA, 15 nt, Yersinia pestis KIM
ccagcgggcgcagcc

SEQ ID NO: 2336354 - RNA, 16 nt, Yersinia pestis KIM
ccagcgggcgcagcca

SEQ ID NO: 2336355 - RNA, 21 nt, Yersinia pestis KIM
ccagcgguaaauugcucacuc

SEQ ID NO: 2336356 - RNA, 22 nt, Yersinia pestis KIM
ccagcgguaaauugcucacuca

SEQ ID NO: 2336357 - RNA, 23 nt, Yersinia pestis KIM
ccagcguucuaucaaugccuugg

SEQ ID NO: 2336358 - RNA, 14 nt, Yersinia pestis KIM
ccagcuaggcuggg

SEQ ID NO: 2336359 - RNA, 13 nt, Yersinia pestis KIM
ccagcuccugcca

SEQ ID NO: 2336360 - RNA, 23 nt, Yersinia pestis KIM
ccagcuccugccacagacuuucu

SEQ ID NO: 2336361 - RNA, 21 nt, Yersinia pestis KIM
ccagcguccugugcaaagugc

SEQ ID NO: 2336362 - RNA, 19 nt, Yersinia pestis KIM
ccagcguaaacaguagcag

SEQ ID NO: 2336363 - RNA, 17 nt, Yersinia pestis KIM
cauuuguuaaucgcuga

SEQ ID NO: 2336364 - RNA, 15 nt, Yersinia pestis KIM
cauuuuaaaaaaauu

SEQ ID NO: 2336365 - RNA, 14 nt, Yersinia pestis KIM
cauuuuaaaaaaau

SEQ ID NO: 2336366 - RNA, 20 nt, Yersinia pestis KIM
cauuuuaacaacccauuucc

SEQ ID NO: 2336367 - RNA, 23 nt, Yersinia pestis KIM
cauuuuaaucucuccaugauaua

SEQ ID NO: 2336368 - RNA, 19 nt, Yersinia pestis KIM
cauuuuaaucucuccauga

SEQ ID NO: 2336369 - RNA, 15 nt, Yersinia pestis KIM
cauuuuacucccuga

SEQ ID NO: 2336370 - RNA, 17 nt, Yersinia pestis KIM
cauuuuacucccugacu

SEQ ID NO: 2336371 - RNA, 14 nt, Yersinia pestis KIM
cauuuuauccucuu

SEQ ID NO: 2336372 - RNA, 15 nt, Yersinia pestis KIM
cauuuuauccucuuc

SEQ ID NO: 2336373 - RNA, 16 nt, Yersinia pestis KIM
cauuuuauccucuucc

SEQ ID NO: 2336374 - RNA, 17 nt, Yersinia pestis KIM
cauuuuauccucuucca

SEQ ID NO: 2336375 - RNA, 15 nt, Yersinia pestis KIM
cauuugauacuaaau

SEQ ID NO: 2336376 - RNA, 17 nt, Yersinia pestis KIM
cauuugauacuaaauuu

SEQ ID NO: 2336377 - RNA, 17 nt, Yersinia pestis KIM
cauuugcacagcauuua

SEQ ID NO: 2336378 - RNA, 15 nt, Yersinia pestis KIM
cauuugcaacuuccu

SEQ ID NO: 2336379 - RNA, 19 nt, Yersinia pestis KIM
cauuucucaucgcuuuuuu

SEQ ID NO: 2336380 - RNA, 22 nt, Yersinia pestis KIM
cauuucugccacaccgucaucu

SEQ ID NO: 2336381 - RNA, 19 nt, Yersinia pestis KIM
cauuucuuuuuauguuaaa

SEQ ID NO: 2336382 - RNA, 23 nt, Yersinia pestis KIM
cauuucuuuuucaacucagcggc

SEQ ID NO: 2336383 - RNA, 21 nt, Yersinia pestis KIM
cauuucuugcucgaucagcgu

SEQ ID NO: 2336384 - RNA, 21 nt, Yersinia pestis KIM
cauuuauuuccacgacaugag

SEQ ID NO: 2336385 - RNA, 12 nt, Yersinia pestis KIM
cauuuauuucca

SEQ ID NO: 2336386 - RNA, 18 nt, Yersinia pestis KIM
cauuucaaccucaauuua

SEQ ID NO: 2336387 - RNA, 22 nt, Yersinia pestis KIM
cauuucaggacugucuucaacu

SEQ ID NO: 2336388 - RNA, 21 nt, Yersinia pestis KIM
cauuucaggacugucuucaac

SEQ ID NO: 2336389 - RNA, 15 nt, Yersinia pestis KIM
cauuucacggugcuc

SEQ ID NO: 2336390 - RNA, 15 nt, Yersinia pestis KIM
cauuuauuacauuua

SEQ ID NO: 2336391 - RNA, 22 nt, Yersinia pestis KIM
cauuuauugcggcuuagccacu

SEQ ID NO: 2336392 - RNA, 19 nt, Yersinia pestis KIM
cauuuaucauauuaacaua

SEQ ID NO: 2336393 - RNA, 18 nt, Yersinia pestis KIM
cauuuaucuaaaacugcc

SEQ ID NO: 2336394 - RNA, 21 nt, Yersinia pestis KIM
cauuuagggcagacggggagg

SEQ ID NO: 2336395 - RNA, 14 nt, Yersinia pestis KIM
cauuuacuuauaaa

SEQ ID NO: 2336396 - RNA, 16 nt, Yersinia pestis KIM
cauuuacuuauaaaca

SEQ ID NO: 2336397 - RNA, 21 nt, Yersinia pestis KIM
cauuucauagaacuuaagcaa

SEQ ID NO: 2336398 - RNA, 15 nt, Yersinia pestis KIM
cauuucccccaccug

SEQ ID NO: 2336399 - RNA, 16 nt, Yersinia pestis KIM
cauuucgcuccaccag

SEQ ID NO: 2336400 - RNA, 19 nt, Yersinia pestis KIM
cauuucgcuccaccagccc

SEQ ID NO: 2336401 - RNA, 17 nt, Yersinia pestis KIM
cauuucguuuaaagccu

SEQ ID NO: 2336402 - RNA, 23 nt, Yersinia pestis KIM
cauuuccuguguuuugagcauca

SEQ ID NO: 2336403 - RNA, 15 nt, Yersinia pestis KIM
cauugucugcuggcc

SEQ ID NO: 2336404 - RNA, 21 nt, Yersinia pestis KIM
cauugugcuuuuuggcaaacu

SEQ ID NO: 2336405 - RNA, 16 nt, Yersinia pestis KIM
cauugugauauaacga

SEQ ID NO: 2336406 - RNA, 13 nt, Yersinia pestis KIM
cauuguucuuacu

SEQ ID NO: 2336407 - RNA, 13 nt, Yersinia pestis KIM
cauuuaaacacuc

SEQ ID NO: 2336408 - RNA, 14 nt, Yersinia pestis KIM
cauuuaccaucagg

SEQ ID NO: 2336409 - RNA, 18 nt, Yersinia pestis KIM
cauuggcguuacagcaag

SEQ ID NO: 2336410 - RNA, 20 nt, Yersinia pestis KIM
cauuggcugguaauucgcua

SEQ ID NO: 2336411 - RNA, 20 nt, Yersinia pestis KIM
cauuggcuucaacuuuuuuc

SEQ ID NO: 2336412 - RNA, 13 nt, Yersinia pestis KIM
cauuggcuuuuug

SEQ ID NO: 2336413 - RNA, 16 nt, Yersinia pestis KIM
cauuggcaaaggccag

SEQ ID NO: 2336414 - RNA, 19 nt, Yersinia pestis KIM
cauuggagauccguuuuuu

SEQ ID NO: 2336415 - RNA, 13 nt, Yersinia pestis KIM
cauuggcacaaag

SEQ ID NO: 2336416 - RNA, 19 nt, Yersinia pestis KIM
cauugguuacccuaagaau

SEQ ID NO: 2336417 - RNA, 13 nt, Yersinia pestis KIM
cauugucaccuga

SEQ ID NO: 2336418 - RNA, 23 nt, Yersinia pestis KIM
cauugucagguuaauaccugcac

SEQ ID NO: 2336419 - RNA, 20 nt, Yersinia pestis KIM
cauuguccugcaauccuccc

SEQ ID NO: 2336420 - RNA, 16 nt, Yersinia pestis KIM
cauugccgaugucaau

SEQ ID NO: 2336421 - RNA, 19 nt, Yersinia pestis KIM
cauugcgugcaauaaagcg

SEQ ID NO: 2336422 - RNA, 12 nt, Yersinia pestis KIM
cauugcuaaauu

SEQ ID NO: 2336423 - RNA, 17 nt, Yersinia pestis KIM
cauugcguaauuaccca

SEQ ID NO: 2336424 - RNA, 20 nt, Yersinia pestis KIM
cauugcuccuguauauuguu

SEQ ID NO: 2336425 - RNA, 20 nt, Yersinia pestis KIM
cauugcuuugcgauacacca

SEQ ID NO: 2336426 - RNA, 20 nt, Yersinia pestis KIM
cauugcuguuguuauuacug

SEQ ID NO: 2336427 - RNA, 17 nt, Yersinia pestis KIM
cauucgccugauaaaau

SEQ ID NO: 2336428 - RNA, 23 nt, Yersinia pestis KIM
cauugauuggcuccuauagcuca

SEQ ID NO: 2336429 - RNA, 21 nt, Yersinia pestis KIM
cauugccacgacgcagcucca

SEQ ID NO: 2336430 - RNA, 15 nt, Yersinia pestis KIM
cauuccguuuaaacu

SEQ ID NO: 2336431 - RNA, 14 nt, Yersinia pestis KIM
cauucgccugauaa

SEQ ID NO: 2336432 - RNA, 23 nt, Yersinia pestis KIM
cauucgagcuaccggcauuggcu

SEQ ID NO: 2336433 - RNA, 13 nt, Yersinia pestis KIM
cauucaaacacuu

SEQ ID NO: 2336434 - RNA, 13 nt, Yersinia pestis KIM
cauucaagccuaa

SEQ ID NO: 2336435 - RNA, 20 nt, Yersinia pestis KIM
cauuaguaaugggaucaaau

SEQ ID NO: 2336436 - RNA, 20 nt, Yersinia pestis KIM
cauuagugaaucaucaauac

SEQ ID NO: 2336437 - RNA, 16 nt, Yersinia pestis KIM
cauuagucugaggcca

SEQ ID NO: 2336438 - RNA, 15 nt, Yersinia pestis KIM
caugugcauugacua

SEQ ID NO: 2336439 - RNA, 14 nt, Yersinia pestis KIM
caugugguuaccau

SEQ ID NO: 2336440 - RNA, 23 nt, Yersinia pestis KIM
cauuacaggccccaauccaccac

SEQ ID NO: 2336441 - RNA, 21 nt, Yersinia pestis KIM
cauguguuuguuuggauaaaa

SEQ ID NO: 2336442 - RNA, 15 nt, Yersinia pestis KIM
cauuaccaauaccau

SEQ ID NO: 2336443 - RNA, 13 nt, Yersinia pestis KIM
cauuacaucaucu

SEQ ID NO: 2336444 - RNA, 23 nt, Yersinia pestis KIM
cauuaccccguugcucuacacag

SEQ ID NO: 2336445 - RNA, 22 nt, Yersinia pestis KIM
cauuacccuguuuuaaaugcca

SEQ ID NO: 2336446 - RNA, 20 nt, Yersinia pestis KIM
cauuaccgcacacuacagcc

SEQ ID NO: 2336447 - RNA, 18 nt, Yersinia pestis KIM
cauuaccuuggugagaac

SEQ ID NO: 2336448 - RNA, 13 nt, Yersinia pestis KIM
cauuaccuuuaaa

SEQ ID NO: 2336449 - RNA, 17 nt, Yersinia pestis KIM
cauuaccuuuaaaacug

SEQ ID NO: 2336450 - RNA, 22 nt, Yersinia pestis KIM
cauuacguaauaguaaaacagg

SEQ ID NO: 2336451 - RNA, 20 nt, Yersinia pestis KIM
cauuacugaugcguugugau

SEQ ID NO: 2336452 - RNA, 20 nt, Yersinia pestis KIM
cauuacugcggaucaaccgc

SEQ ID NO: 2336453 - RNA, 22 nt, Yersinia pestis KIM
cauuacugcguucuucuugugg

SEQ ID NO: 2336454 - RNA, 21 nt, Yersinia pestis KIM
cauuacugcguucuucuugug

SEQ ID NO: 2336455 - RNA, 17 nt, Yersinia pestis KIM
cauuacuuugaauagca

SEQ ID NO: 2336456 - RNA, 16 nt, Yersinia pestis KIM
cauggcucucuuuuuu

SEQ ID NO: 2336457 - RNA, 18 nt, Yersinia pestis KIM
cauggccaugaaucaaau

SEQ ID NO: 2336458 - RNA, 16 nt, Yersinia pestis KIM
cauggccauggaaacc

SEQ ID NO: 2336459 - RNA, 13 nt, Yersinia pestis KIM
cauggcaugccau

SEQ ID NO: 2336460 - RNA, 15 nt, Yersinia pestis KIM
cauggcguaaccgcc

SEQ ID NO: 2336461 - RNA, 15 nt, Yersinia pestis KIM
cauggcggcucgccu

SEQ ID NO: 2336462 - RNA, 14 nt, Yersinia pestis KIM
caugguaagaauaa

SEQ ID NO: 2336463 - RNA, 15 nt, Yersinia pestis KIM
caugguaagaauaaa

SEQ ID NO: 2336464 - RNA, 17 nt, Yersinia pestis KIM
cauggcuuuaugaccaa

SEQ ID NO: 2336465 - RNA, 22 nt, Yersinia pestis KIM
caugggaaacaagggcaaugug

SEQ ID NO: 2336466 - RNA, 15 nt, Yersinia pestis KIM
cauggcuuuuugccc

SEQ ID NO: 2336467 - RNA, 20 nt, Yersinia pestis KIM
cauggcuuuuugcccgcgcu

SEQ ID NO: 2336468 - RNA, 18 nt, Yersinia pestis KIM
cauguccguguuggcaaa

SEQ ID NO: 2336469 - RNA, 19 nt, Yersinia pestis KIM
cauggugaugaucaugcuc

SEQ ID NO: 2336470 - RNA, 23 nt, Yersinia pestis KIM
cauguacgcuccgguucuugcgc

SEQ ID NO: 2336471 - RNA, 20 nt, Yersinia pestis KIM
cauguacuagaucacagacg

SEQ ID NO: 2336472 - RNA, 15 nt, Yersinia pestis KIM
caucuuccaaaggaa

SEQ ID NO: 2336473 - RNA, 18 nt, Yersinia pestis KIM
caucuuccaaaggaaggg

SEQ ID NO: 2336474 - RNA, 17 nt, Yersinia pestis KIM
caugcucaguuguauua

SEQ ID NO: 2336475 - RNA, 19 nt, Yersinia pestis KIM
caugcucugcuaauacgcu

SEQ ID NO: 2336476 - RNA, 19 nt, Yersinia pestis KIM
caugcugaaucuguaaguc

SEQ ID NO: 2336477 - RNA, 19 nt, Yersinia pestis KIM
caugcugcccgcacacuga

SEQ ID NO: 2336478 - RNA, 14 nt, Yersinia pestis KIM
caugcuggcggaua

SEQ ID NO: 2336479 - RNA, 16 nt, Yersinia pestis KIM
cauggaucacccguug

SEQ ID NO: 2336480 - RNA, 15 nt, Yersinia pestis KIM
cauggauguauuuac

SEQ ID NO: 2336481 - RNA, 15 nt, Yersinia pestis KIM
cauggacggcauaua

SEQ ID NO: 2336482 - RNA, 22 nt, Yersinia pestis KIM
cauggaagggccgcuauauuuu

SEQ ID NO: 2336483 - RNA, 21 nt, Yersinia pestis KIM
cauggcaaccccuaauccagc

SEQ ID NO: 2336484 - RNA, 22 nt, Yersinia pestis KIM
cauggcaaccccuaauccagca

SEQ ID NO: 2336485 - RNA, 17 nt, Yersinia pestis KIM
cauggcagcuugaagua

SEQ ID NO: 2336486 - RNA, 23 nt, Yersinia pestis KIM
cauggcauauucaccagacaccu

SEQ ID NO: 2336487 - RNA, 19 nt, Yersinia pestis KIM
cauggcaggucucgcaaug

SEQ ID NO: 2336488 - RNA, 16 nt, Yersinia pestis KIM
ccaauagaggcuccca

SEQ ID NO: 2336489 - RNA, 16 nt, Yersinia pestis KIM
ccaauagaggcucccu

SEQ ID NO: 2336490 - RNA, 14 nt, Yersinia pestis KIM
ccaauauaaaagcc

SEQ ID NO: 2336491 - RNA, 19 nt, Yersinia pestis KIM
ccaauagaaaaacacuggc

SEQ ID NO: 2336492 - RNA, 22 nt, Yersinia pestis KIM
ccaauagaaaaacacuggcagc

SEQ ID NO: 2336493 - RNA, 23 nt, Yersinia pestis KIM
ccaaguuuacuuuguauuuugca

SEQ ID NO: 2336494 - RNA, 16 nt, Yersinia pestis KIM
ccaauacaaacagggc

SEQ ID NO: 2336495 - RNA, 23 nt, Yersinia pestis KIM
ccaauacaaacagggcagccaau

SEQ ID NO: 2336496 - RNA, 23 nt, Yersinia pestis KIM
ccaaguguccgcgccauaaaaga

SEQ ID NO: 2336497 - RNA, 20 nt, Yersinia pestis KIM
ccaaggcgacuuugaugcca

SEQ ID NO: 2336498 - RNA, 20 nt, Yersinia pestis KIM
ccaaguccacgggcucaugc

SEQ ID NO: 2336499 - RNA, 12 nt, Yersinia pestis KIM
ccaagucucuag

SEQ ID NO: 2336500 - RNA, 13 nt, Yersinia pestis KIM
ccaaucaucaucc

SEQ ID NO: 2336501 - RNA, 17 nt, Yersinia pestis KIM
ccaauccuuuggauuua

SEQ ID NO: 2336502 - RNA, 18 nt, Yersinia pestis KIM
ccaaucggccuuaaccaa

SEQ ID NO: 2336503 - RNA, 16 nt, Yersinia pestis KIM
ccaaucgauaauauua

SEQ ID NO: 2336504 - RNA, 18 nt, Yersinia pestis KIM
ccaaucgauaauauuauu

SEQ ID NO: 2336505 - RNA, 21 nt, Yersinia pestis KIM
ccaauaucuguggugacauga

SEQ ID NO: 2336506 - RNA, 13 nt, Yersinia pestis KIM
ccaauauccauau

SEQ ID NO: 2336507 - RNA, 13 nt, Yersinia pestis KIM
ccaaucaaaaaac

SEQ ID NO: 2336508 - RNA, 24 nt, Yersinia pestis KIM
ccaaucaccuuggaaaacagcaac

SEQ ID NO: 2336509 - RNA, 22 nt, Yersinia pestis KIM
ccaauuggugcuuuauguauuc

SEQ ID NO: 2336510 - RNA, 19 nt, Yersinia pestis KIM
ccaauguugcugaauaaau

SEQ ID NO: 2336511 - RNA, 13 nt, Yersinia pestis KIM
ccaauuuggccaa

SEQ ID NO: 2336512 - RNA, 24 nt, Yersinia pestis KIM
ccaauuugucguuuacuggcugcc

SEQ ID NO: 2336513 - RNA, 16 nt, Yersinia pestis KIM
ccaauuuuucuguauc

SEQ ID NO: 2336514 - RNA, 11 nt, Yersinia pestis KIM
ccaaugcuuuu

SEQ ID NO: 2336515 - RNA, 20 nt, Yersinia pestis KIM
ccaaucucaaagcaaccaca

SEQ ID NO: 2336516 - RNA, 16 nt, Yersinia pestis KIM
ccaauggcaacaaaau

SEQ ID NO: 2336517 - RNA, 21 nt, Yersinia pestis KIM
ccacagcaaugcaccgacaaa

SEQ ID NO: 2336518 - RNA, 21 nt, Yersinia pestis KIM
ccacacaguauucugcuucca

SEQ ID NO: 2336519 - RNA, 16 nt, Yersinia pestis KIM
ccaacgcccugcaucu

SEQ ID NO: 2336520 - RNA, 21 nt, Yersinia pestis KIM
ccaacgguagguucaacccaa

SEQ ID NO: 2336521 - RNA, 22 nt, Yersinia pestis KIM
ccaacgucauuuccguuaaccc

SEQ ID NO: 2336522 - RNA, 15 nt, Yersinia pestis KIM
ccaacugacugaagu

SEQ ID NO: 2336523 - RNA, 17 nt, Yersinia pestis KIM
ccaaggcaugauaggca

SEQ ID NO: 2336524 - RNA, 13 nt, Yersinia pestis KIM
ccaaggauggcgc

SEQ ID NO: 2336525 - RNA, 23 nt, Yersinia pestis KIM
ccaaggauggcgcggcucgagcc

SEQ ID NO: 2336526 - RNA, 17 nt, Yersinia pestis KIM
ccaaggagaucgcucuc

SEQ ID NO: 2336527 - RNA, 14 nt, Yersinia pestis KIM
ccaagcuuaauauu

SEQ ID NO: 2336528 - RNA, 17 nt, Yersinia pestis KIM
ccaagauaccgaguucu

SEQ ID NO: 2336529 - RNA, 14 nt, Yersinia pestis KIM
ccaacuguaaaauc

SEQ ID NO: 2336530 - RNA, 16 nt, Yersinia pestis KIM
ccaacuggccgccauc

SEQ ID NO: 2336531 - RNA, 17 nt, Yersinia pestis KIM
ccaaaucugccugauac

SEQ ID NO: 2336532 - RNA, 19 nt, Yersinia pestis KIM
ccaaauccgacugauagca

SEQ ID NO: 2336533 - RNA, 14 nt, Yersinia pestis KIM
ccaacaacugcccc

SEQ ID NO: 2336534 - RNA, 14 nt, Yersinia pestis KIM
ccaacaacuuaauu

SEQ ID NO: 2336535 - RNA, 17 nt, Yersinia pestis KIM
ccaacaguuauuuuaau

SEQ ID NO: 2336536 - RNA, 16 nt, Yersinia pestis KIM
ccaaaggcuauuuaag

SEQ ID NO: 2336537 - RNA, 13 nt, Yersinia pestis KIM
ccaaagcugcgcc

SEQ ID NO: 2336538 - RNA, 16 nt, Yersinia pestis KIM
cauuuuccugcauauu

SEQ ID NO: 2336539 - RNA, 17 nt, Yersinia pestis KIM
ccacggcgcugcagcga

SEQ ID NO: 2336540 - RNA, 18 nt, Yersinia pestis KIM
ccacggcgcugcagcgau

SEQ ID NO: 2336541 - RNA, 13 nt, Yersinia pestis KIM
ccacggcgcugca

SEQ ID NO: 2336542 - RNA, 18 nt, Yersinia pestis KIM
ccacggcguuacuggcga

SEQ ID NO: 2336543 - RNA, 20 nt, Yersinia pestis KIM
ccacuacugaacgucauaau

SEQ ID NO: 2336544 - RNA, 16 nt, Yersinia pestis KIM
ccacuaauauuccuga

SEQ ID NO: 2336545 - RNA, 15 nt, Yersinia pestis KIM
ccacuaauucaucuc

SEQ ID NO: 2336546 - RNA, 18 nt, Yersinia pestis KIM
ccacucaccucagucauc

SEQ ID NO: 2336547 - RNA, 20 nt, Yersinia pestis KIM
ccacucaacugauguuuuag

SEQ ID NO: 2336548 - RNA, 18 nt, Yersinia pestis KIM
ccacgucuaauugcugcc

SEQ ID NO: 2336549 - RNA, 20 nt, Yersinia pestis KIM
ccacgucuaauugcugccca

SEQ ID NO: 2336550 - RNA, 16 nt, Yersinia pestis KIM
ccacggccaaguagau

SEQ ID NO: 2336551 - RNA, 13 nt, Yersinia pestis KIM
ccacggauuaacu

SEQ ID NO: 2336552 - RNA, 20 nt, Yersinia pestis KIM
ccaccgucaagacaacaaac

SEQ ID NO: 2336553 - RNA, 16 nt, Yersinia pestis KIM
ccacgaugugaagcaa

SEQ ID NO: 2336554 - RNA, 20 nt, Yersinia pestis KIM
ccacgaguuuucccugcgcc

SEQ ID NO: 2336555 - RNA, 19 nt, Yersinia pestis KIM
ccaccugaaucucgcgccc

SEQ ID NO: 2336556 - RNA, 22 nt, Yersinia pestis KIM
ccaccacgaaaaaauggcagcc

SEQ ID NO: 2336557 - RNA, 14 nt, Yersinia pestis KIM
ccaccacugcauca

SEQ ID NO: 2336558 - RNA, 20 nt, Yersinia pestis KIM
ccacccugccaaaaaauaag

SEQ ID NO: 2336559 - RNA, 16 nt, Yersinia pestis KIM
ccaccaucacuuccag

SEQ ID NO: 2336560 - RNA, 18 nt, Yersinia pestis KIM
ccaccaugaugaaucugu

SEQ ID NO: 2336561 - RNA, 24 nt, Yersinia pestis KIM
ccaccagguuaccuauaaacuuga

SEQ ID NO: 2336562 - RNA, 16 nt, Yersinia pestis KIM
ccaccaguaaacgcca

SEQ ID NO: 2336563 - RNA, 22 nt, Yersinia pestis KIM
caucauaaaaauacauaucaac

SEQ ID NO: 2336564 - RNA, 19 nt, Yersinia pestis KIM
caucaguuuauuguuauuu

SEQ ID NO: 2336565 - RNA, 23 nt, Yersinia pestis KIM
caucauaguggccuaauguacua

SEQ ID NO: 2336566 - RNA, 22 nt, Yersinia pestis KIM
caucauaaaggcuaaaccggca

SEQ ID NO: 2336567 - RNA, 14 nt, Yersinia pestis KIM
caucauauauuaaa

SEQ ID NO: 2336568 - RNA, 18 nt, Yersinia pestis KIM
caucauaucgaugacagc

SEQ ID NO: 2336569 - RNA, 15 nt, Yersinia pestis KIM
caucagguguuguau

SEQ ID NO: 2336570 - RNA, 19 nt, Yersinia pestis KIM
caucagguuguauuuugca

SEQ ID NO: 2336571 - RNA, 17 nt, Yersinia pestis KIM
caucagucacuaaacca

SEQ ID NO: 2336572 - RNA, 14 nt, Yersinia pestis KIM
caucaguaauguga

SEQ ID NO: 2336573 - RNA, 11 nt, Yersinia pestis KIM
caucaggcuua

SEQ ID NO: 2336574 - RNA, 18 nt, Yersinia pestis KIM
caucaggccuucuuuucu

SEQ ID NO: 2336575 - RNA, 14 nt, Yersinia pestis KIM
caucaucuucuuca

SEQ ID NO: 2336576 - RNA, 15 nt, Yersinia pestis KIM
caucaucuucuucau

SEQ ID NO: 2336577 - RNA, 12 nt, Yersinia pestis KIM
caucaucuucuu

SEQ ID NO: 2336578 - RNA, 22 nt, Yersinia pestis KIM
caucaucuucaaccuggaacca

SEQ ID NO: 2336579 - RNA, 21 nt, Yersinia pestis KIM
caucauuagccguaaugacuc

SEQ ID NO: 2336580 - RNA, 14 nt, Yersinia pestis KIM
caucaugacaaaaa

SEQ ID NO: 2336581 - RNA, 13 nt, Yersinia pestis KIM
caucauccauaaa

SEQ ID NO: 2336582 - RNA, 20 nt, Yersinia pestis KIM
caucauccagcucaacgacc

SEQ ID NO: 2336583 - RNA, 22 nt, Yersinia pestis KIM
caucaucccagucgucuucagc

SEQ ID NO: 2336584 - RNA, 12 nt, Yersinia pestis KIM
caucaucccagu

SEQ ID NO: 2336585 - RNA, 20 nt, Yersinia pestis KIM
caucaucccagucgucuuca

SEQ ID NO: 2336586 - RNA, 20 nt, Yersinia pestis KIM
caucaucaauggauucuugc

SEQ ID NO: 2336587 - RNA, 21 nt, Yersinia pestis KIM
caucaucacauucaaacacuu

SEQ ID NO: 2336588 - RNA, 13 nt, Yersinia pestis KIM
caucaucaaugga

SEQ ID NO: 2336589 - RNA, 13 nt, Yersinia pestis KIM
caucaucaauaaa

SEQ ID NO: 2336590 - RNA, 17 nt, Yersinia pestis KIM
caucaucaaaaccgaug

SEQ ID NO: 2336591 - RNA, 21 nt, Yersinia pestis KIM
caucagcgauucauugagcaa

SEQ ID NO: 2336592 - RNA, 19 nt, Yersinia pestis KIM
caucagcgccuuugccccg

SEQ ID NO: 2336593 - RNA, 18 nt, Yersinia pestis KIM
caucagcgccgccucuuc

SEQ ID NO: 2336594 - RNA, 18 nt, Yersinia pestis KIM
caucagcgcccuugccag

SEQ ID NO: 2336595 - RNA, 22 nt, Yersinia pestis KIM
caucagaucguuaaacccggca

SEQ ID NO: 2336596 - RNA, 18 nt, Yersinia pestis KIM
caucagacugcucuuucc

SEQ ID NO: 2336597 - RNA, 21 nt, Yersinia pestis KIM
caucagacugcucuuucccuu

SEQ ID NO: 2336598 - RNA, 17 nt, Yersinia pestis KIM
caucagcccauugcugu

SEQ ID NO: 2336599 - RNA, 16 nt, Yersinia pestis KIM
caucagcccagcggua

SEQ ID NO: 2336600 - RNA, 23 nt, Yersinia pestis KIM
caucacgcagugcaucuuccaau

SEQ ID NO: 2336601 - RNA, 20 nt, Yersinia pestis KIM
caucaaugauucgcugaaca

SEQ ID NO: 2336602 - RNA, 17 nt, Yersinia pestis KIM
caucaaugaaaauaucc

SEQ ID NO: 2336603 - RNA, 15 nt, Yersinia pestis KIM
caucagacggaauga

SEQ ID NO: 2336604 - RNA, 14 nt, Yersinia pestis KIM
caucagacugcucu

SEQ ID NO: 2336605 - RNA, 21 nt, Yersinia pestis KIM
cauaucagaaccaagcaauag

SEQ ID NO: 2336606 - RNA, 15 nt, Yersinia pestis KIM
cauaucguccaaagg

SEQ ID NO: 2336607 - RNA, 15 nt, Yersinia pestis KIM
cauaugacaaauaag

SEQ ID NO: 2336608 - RNA, 13 nt, Yersinia pestis KIM
cauaugaaacacc

SEQ ID NO: 2336609 - RNA, 14 nt, Yersinia pestis KIM
cauauaauccaaaa

SEQ ID NO: 2336610 - RNA, 17 nt, Yersinia pestis KIM
cauauacaaccucaacg

SEQ ID NO: 2336611 - RNA, 23 nt, Yersinia pestis KIM
cauagugcaaaauuccaccauuc

SEQ ID NO: 2336612 - RNA, 22 nt, Yersinia pestis KIM
cauacucccccauuuccugugu

SEQ ID NO: 2336613 - RNA, 23 nt, Yersinia pestis KIM
cauacucagucaucgcuaacccu

SEQ ID NO: 2336614 - RNA, 13 nt, Yersinia pestis KIM
cauaguccaacgc

SEQ ID NO: 2336615 - RNA, 14 nt, Yersinia pestis KIM
cauauuacucacac

SEQ ID NO: 2336616 - RNA, 16 nt, Yersinia pestis KIM
cauauuacucucuauu

SEQ ID NO: 2336617 - RNA, 13 nt, Yersinia pestis KIM
cauauuacccagu

SEQ ID NO: 2336618 - RNA, 21 nt, Yersinia pestis KIM
cauauguucgaucaaaacaau

SEQ ID NO: 2336619 - RNA, 13 nt, Yersinia pestis KIM
cauauguugaguc

SEQ ID NO: 2336620 - RNA, 23 nt, Yersinia pestis KIM
cauauuaaaugcauuauaaggaa

SEQ ID NO: 2336621 - RNA, 14 nt, Yersinia pestis KIM
cauaugcauggcau

SEQ ID NO: 2336622 - RNA, 14 nt, Yersinia pestis KIM
cauaugcagcaucc

SEQ ID NO: 2336623 - RNA, 19 nt, Yersinia pestis KIM
cauaugcgccuauaaggcu

SEQ ID NO: 2336624 - RNA, 20 nt, Yersinia pestis KIM
cauauuguccaaaggaaggg

SEQ ID NO: 2336625 - RNA, 14 nt, Yersinia pestis KIM
cauauugugcuauc

SEQ ID NO: 2336626 - RNA, 19 nt, Yersinia pestis KIM
cauauuguccaaaggaagg

SEQ ID NO: 2336627 - RNA, 15 nt, Yersinia pestis KIM
cauauuguccaaagg

SEQ ID NO: 2336628 - RNA, 17 nt, Yersinia pestis KIM
cauauuguccaaaggaa

SEQ ID NO: 2336629 - RNA, 22 nt, Yersinia pestis KIM
cauauuggccaguugccacuca

SEQ ID NO: 2336630 - RNA, 12 nt, Yersinia pestis KIM
cauauuggccag

SEQ ID NO: 2336631 - RNA, 16 nt, Yersinia pestis KIM
cauauuggcaauauuc

SEQ ID NO: 2336632 - RNA, 18 nt, Yersinia pestis KIM
cauauucaguaacaacau

SEQ ID NO: 2336633 - RNA, 12 nt, Yersinia pestis KIM
cauauucagccg

SEQ ID NO: 2336634 - RNA, 18 nt, Yersinia pestis KIM
cauauucaccguuuccag

SEQ ID NO: 2336635 - RNA, 11 nt, Yersinia pestis KIM
cauauuauuug

SEQ ID NO: 2336636 - RNA, 16 nt, Yersinia pestis KIM
cauauuauaaugaaau

SEQ ID NO: 2336637 - RNA, 21 nt, Yersinia pestis KIM
caucaacguuaaucgccaccc

SEQ ID NO: 2336638 - RNA, 12 nt, Yersinia pestis KIM
caucaaccugau

SEQ ID NO: 2336639 - RNA, 13 nt, Yersinia pestis KIM
caucaacuucacu

SEQ ID NO: 2336640 - RNA, 15 nt, Yersinia pestis KIM
caucaacugacagcg

SEQ ID NO: 2336641 - RNA, 16 nt, Yersinia pestis KIM
caucaacuucugcaaa

SEQ ID NO: 2336642 - RNA, 17 nt, Yersinia pestis KIM
cauauuuaucuuaucca

SEQ ID NO: 2336643 - RNA, 14 nt, Yersinia pestis KIM
caucaaaauugaug

SEQ ID NO: 2336644 - RNA, 15 nt, Yersinia pestis KIM
caucgcgcuuuuuag

SEQ ID NO: 2336645 - RNA, 18 nt, Yersinia pestis KIM
caucgacgcgccauaagc

SEQ ID NO: 2336646 - RNA, 16 nt, Yersinia pestis KIM
cauccuguucaaaagg

SEQ ID NO: 2336647 - RNA, 18 nt, Yersinia pestis KIM
caucccuugacugaccau

SEQ ID NO: 2336648 - RNA, 17 nt, Yersinia pestis KIM
cauccgaauuuuuacug

SEQ ID NO: 2336649 - RNA, 16 nt, Yersinia pestis KIM
cauccgcuugcagcaa

SEQ ID NO: 2336650 - RNA, 18 nt, Yersinia pestis KIM
cauccgcuuguucuuccg

SEQ ID NO: 2336651 - RNA, 22 nt, Yersinia pestis KIM
caucccgguugcgauacagcgc

SEQ ID NO: 2336652 - RNA, 19 nt, Yersinia pestis KIM
caucauucauuuuaaaaaa

SEQ ID NO: 2336653 - RNA, 21 nt, Yersinia pestis KIM
caucauucauuuuaaaaaaau

SEQ ID NO: 2336654 - RNA, 19 nt, Yersinia pestis KIM
cauccugaauccccgcuuc

SEQ ID NO: 2336655 - RNA, 13 nt, Yersinia pestis KIM
cauccuaaaaagc

SEQ ID NO: 2336656 - RNA, 20 nt, Yersinia pestis KIM
caucgcugaggucagugcug

SEQ ID NO: 2336657 - RNA, 21 nt, Yersinia pestis KIM
caucgcugcaauaaagcguca

SEQ ID NO: 2336658 - RNA, 22 nt, Yersinia pestis KIM
caucgcgggcgcgcugcugcuc

SEQ ID NO: 2336659 - RNA, 18 nt, Yersinia pestis KIM
caucgcgggcgcgcugcu

SEQ ID NO: 2336660 - RNA, 16 nt, Yersinia pestis KIM
caucgcucaucgccaa

SEQ ID NO: 2336661 - RNA, 17 nt, Yersinia pestis KIM
caucgucagaaccugca

SEQ ID NO: 2336662 - RNA, 19 nt, Yersinia pestis KIM
caucgucacgaucaaccau

SEQ ID NO: 2336663 - RNA, 20 nt, Yersinia pestis KIM
caucuaacucauucauaauu

SEQ ID NO: 2336664 - RNA, 15 nt, Yersinia pestis KIM
caucucacauagcug

SEQ ID NO: 2336665 - RNA, 18 nt, Yersinia pestis KIM
caucuccagaauauaaaa

SEQ ID NO: 2336666 - RNA, 16 nt, Yersinia pestis KIM
caucuccgcuauuuuc

SEQ ID NO: 2336667 - RNA, 14 nt, Yersinia pestis KIM
caucuagcagugau

SEQ ID NO: 2336668 - RNA, 18 nt, Yersinia pestis KIM
caucuagcagugauuuca

SEQ ID NO: 2336669 - RNA, 17 nt, Yersinia pestis KIM
caucuacaacaucaucg

SEQ ID NO: 2336670 - RNA, 13 nt, Yersinia pestis KIM
caucuccugguuc

SEQ ID NO: 2336671 - RNA, 23 nt, Yersinia pestis KIM
caucugaccagugagccaugugu

SEQ ID NO: 2336672 - RNA, 16 nt, Yersinia pestis KIM
caucuuaccggccucu

SEQ ID NO: 2336673 - RNA, 16 nt, Yersinia pestis KIM
caucuggcucagguaa

SEQ ID NO: 2336674 - RNA, 15 nt, Yersinia pestis KIM
cauaaauuaaaacug

SEQ ID NO: 2336675 - RNA, 20 nt, Yersinia pestis KIM
cauaaauaggugcgccagug

SEQ ID NO: 2336676 - RNA, 22 nt, Yersinia pestis KIM
cauaaauauucauuaaaaaaua

SEQ ID NO: 2336677 - RNA, 11 nt, Yersinia pestis KIM
cauaaauaaag

SEQ ID NO: 2336678 - RNA, 15 nt, Yersinia pestis KIM
cauaaauaauaaaua

SEQ ID NO: 2336679 - RNA, 23 nt, Yersinia pestis KIM
cauaaacugaaguuaaaaagccu

SEQ ID NO: 2336680 - RNA, 14 nt, Yersinia pestis KIM
cauaaacugaaguu

SEQ ID NO: 2336681 - RNA, 16 nt, Yersinia pestis KIM
cauaaaaagaaaaaaa

SEQ ID NO: 2336682 - RNA, 15 nt, Yersinia pestis KIM
cauaaaaacuucaga

SEQ ID NO: 2336683 - RNA, 14 nt, Yersinia pestis KIM
cauaaaaaccgccc

SEQ ID NO: 2336684 - RNA, 16 nt, Yersinia pestis KIM
cauaaaauaaauaauu

SEQ ID NO: 2336685 - RNA, 20 nt, Yersinia pestis KIM
cauaaaaggauggcccaagc

SEQ ID NO: 2336686 - RNA, 21 nt, Yersinia pestis KIM
cauaagcccccguaucaugga

SEQ ID NO: 2336687 - RNA, 20 nt, Yersinia pestis KIM
cauaagcacgaauuuuauuc

SEQ ID NO: 2336688 - RNA, 19 nt, Yersinia pestis KIM
cauaagcgacgacauuaau

SEQ ID NO: 2336689 - RNA, 18 nt, Yersinia pestis KIM
cauaacaggugcaguuuc

SEQ ID NO: 2336690 - RNA, 14 nt, Yersinia pestis KIM
cauaacaauggccg

SEQ ID NO: 2336691 - RNA, 14 nt, Yersinia pestis KIM
cauaacaauuaauu

SEQ ID NO: 2336692 - RNA, 12 nt, Yersinia pestis KIM
cauaaauuuauc

SEQ ID NO: 2336693 - RNA, 17 nt, Yersinia pestis KIM
cauaaccgcuaaggcca

SEQ ID NO: 2336694 - RNA, 18 nt, Yersinia pestis KIM
cauaaccauugaaaccac

SEQ ID NO: 2336695 - RNA, 19 nt, Yersinia pestis KIM
cauacagguguaccgcuuc

SEQ ID NO: 2336696 - RNA, 15 nt, Yersinia pestis KIM
cauacauaacauggu

SEQ ID NO: 2336697 - RNA, 15 nt, Yersinia pestis KIM
cauacauccacccau

SEQ ID NO: 2336698 - RNA, 18 nt, Yersinia pestis KIM
cauacagcucaucaccaa

SEQ ID NO: 2336699 - RNA, 13 nt, Yersinia pestis KIM
cauacacggucug

SEQ ID NO: 2336700 - RNA, 19 nt, Yersinia pestis KIM
cauacaagccgugaccaaa

SEQ ID NO: 2336701 - RNA, 17 nt, Yersinia pestis KIM
cauaccauaaggccagg

SEQ ID NO: 2336702 - RNA, 20 nt, Yersinia pestis KIM
cauacccugguagcaccaca

SEQ ID NO: 2336703 - RNA, 17 nt, Yersinia pestis KIM
cauaauaaagcgaugcu

SEQ ID NO: 2336704 - RNA, 16 nt, Yersinia pestis KIM
cauaauccagaagcca

SEQ ID NO: 2336705 - RNA, 18 nt, Yersinia pestis KIM
cauaaucaguacaucaau

SEQ ID NO: 2336706 - RNA, 17 nt, Yersinia pestis KIM
cauaauccucaaccuga

SEQ ID NO: 2336707 - RNA, 14 nt, Yersinia pestis KIM
cauaaucagccugc

SEQ ID NO: 2336708 - RNA, 14 nt, Yersinia pestis KIM
cauaauucugccga

SEQ ID NO: 2336709 - RNA, 23 nt, Yersinia pestis KIM
cauaauucugccgacuaauauuu

SEQ ID NO: 2336710 - RNA, 16 nt, Yersinia pestis KIM
cauaaugccggcggcc

SEQ ID NO: 2336711 - RNA, 15 nt, Yersinia pestis KIM
cauaaucuuuacugc

SEQ ID NO: 2336712 - RNA, 13 nt, Yersinia pestis KIM
cagugccaguaau

SEQ ID NO: 2336713 - RNA, 20 nt, Yersinia pestis KIM
cagugcgccguaaaucguca

SEQ ID NO: 2336714 - RNA, 23 nt, Yersinia pestis KIM
cagugcgcaaaaauuagaggccu

SEQ ID NO: 2336715 - RNA, 16 nt, Yersinia pestis KIM
cagugccguaugcgca

SEQ ID NO: 2336716 - RNA, 18 nt, Yersinia pestis KIM
cagugccugguuuuacgc

SEQ ID NO: 2336717 - RNA, 14 nt, Yersinia pestis KIM
caguggcuggaaag

SEQ ID NO: 2336718 - RNA, 13 nt, Yersinia pestis KIM
caguggcaucaau

SEQ ID NO: 2336719 - RNA, 14 nt, Yersinia pestis KIM
caguggguaacaua

SEQ ID NO: 2336720 - RNA, 23 nt, Yersinia pestis KIM
cagugcucccugaacgccuugcc

SEQ ID NO: 2336721 - RNA, 14 nt, Yersinia pestis KIM
cagugcuucaucac

SEQ ID NO: 2336722 - RNA, 20 nt, Yersinia pestis KIM
cagugcguaaucagccgcgg

SEQ ID NO: 2336723 - RNA, 14 nt, Yersinia pestis KIM
caguggaugauaaa

SEQ ID NO: 2336724 - RNA, 16 nt, Yersinia pestis KIM
caguggaacauuuucg

SEQ ID NO: 2336725 - RNA, 12 nt, Yersinia pestis KIM
caguuagugccu

SEQ ID NO: 2336726 - RNA, 16 nt, Yersinia pestis KIM
caguuauaaaaacccc

SEQ ID NO: 2336727 - RNA, 22 nt, Yersinia pestis KIM
caguuauaaaaaccccuuuuga

SEQ ID NO: 2336728 - RNA, 14 nt, Yersinia pestis KIM
caguuauuauuuuu

SEQ ID NO: 2336729 - RNA, 23 nt, Yersinia pestis KIM
caguuauuauuuuuaaugauuga

SEQ ID NO: 2336730 - RNA, 16 nt, Yersinia pestis KIM
caguucaucagcccag

SEQ ID NO: 2336731 - RNA, 17 nt, Yersinia pestis KIM
caguucaucagcccagc

SEQ ID NO: 2336732 - RNA, 20 nt, Yersinia pestis KIM
caguucaucagcccagcggu

SEQ ID NO: 2336733 - RNA, 14 nt, Yersinia pestis KIM
caguucagcccccu

SEQ ID NO: 2336734 - RNA, 21 nt, Yersinia pestis KIM
caguucauuacaggccccaau

SEQ ID NO: 2336735 - RNA, 13 nt, Yersinia pestis KIM
caguucauucccc

SEQ ID NO: 2336736 - RNA, 15 nt, Yersinia pestis KIM
caguucauggccaug

SEQ ID NO: 2336737 - RNA, 21 nt, Yersinia pestis KIM
caguucauuccccaucgccaa

SEQ ID NO: 2336738 - RNA, 22 nt, Yersinia pestis KIM
cagugucaguucgacaccuuca

SEQ ID NO: 2336739 - RNA, 20 nt, Yersinia pestis KIM
cagugucaucccguaggcuu

SEQ ID NO: 2336740 - RNA, 21 nt, Yersinia pestis KIM
cagugucagguaaaaagguaa

SEQ ID NO: 2336741 - RNA, 18 nt, Yersinia pestis KIM
cagugucacuuccgccgc

SEQ ID NO: 2336742 - RNA, 20 nt, Yersinia pestis KIM
caguguccagccugguuggu

SEQ ID NO: 2336743 - RNA, 13 nt, Yersinia pestis KIM
caguguugccaug

SEQ ID NO: 2336744 - RNA, 20 nt, Yersinia pestis KIM
cagugugugugcgcugagug

SEQ ID NO: 2336745 - RNA, 22 nt, Yersinia pestis KIM
caguuaagguguuguuuaaaaa

SEQ ID NO: 2336746 - RNA, 18 nt, Yersinia pestis KIM
caguuacgucaggaauaa

SEQ ID NO: 2336747 - RNA, 19 nt, Yersinia pestis KIM
caguuacgucaggaauaaa

SEQ ID NO: 2336748 - RNA, 19 nt, Yersinia pestis KIM
caguuacgcgucugcuggc

SEQ ID NO: 2336749 - RNA, 23 nt, Yersinia pestis KIM
caguugucuauuuucauuauuuu

SEQ ID NO: 2336750 - RNA, 15 nt, Yersinia pestis KIM
caguuguucaccuac

SEQ ID NO: 2336751 - RNA, 14 nt, Yersinia pestis KIM
caguuuauuuuccc

SEQ ID NO: 2336752 - RNA, 16 nt, Yersinia pestis KIM
caguuuauuuucccuu

SEQ ID NO: 2336753 - RNA, 17 nt, Yersinia pestis KIM
caguuuggcugccaugg

SEQ ID NO: 2336754 - RNA, 15 nt, Yersinia pestis KIM
caguuuuuucucaau

SEQ ID NO: 2336755 - RNA, 16 nt, Yersinia pestis KIM
caguucccuguucucu

SEQ ID NO: 2336756 - RNA, 22 nt, Yersinia pestis KIM
caguuccugauucgguuucguu

SEQ ID NO: 2336757 - RNA, 16 nt, Yersinia pestis KIM
caguucgacaccuuca

SEQ ID NO: 2336758 - RNA, 21 nt, Yersinia pestis KIM
caguucgauauuauucucuac

SEQ ID NO: 2336759 - RNA, 18 nt, Yersinia pestis KIM
caguugaugaaucaauga

SEQ ID NO: 2336760 - RNA, 18 nt, Yersinia pestis KIM
caguugauggcugucuau

SEQ ID NO: 2336761 - RNA, 19 nt, Yersinia pestis KIM
caguugauauuauuauugc

SEQ ID NO: 2336762 - RNA, 13 nt, Yersinia pestis KIM
caguucuggcucu

SEQ ID NO: 2336763 - RNA, 12 nt, Yersinia pestis KIM
caguugccacuc

SEQ ID NO: 2336764 - RNA, 17 nt, Yersinia pestis KIM
cagauaaagaaaaaccc

SEQ ID NO: 2336765 - RNA, 16 nt, Yersinia pestis KIM
cagauaaagaaaaacc

SEQ ID NO: 2336766 - RNA, 14 nt, Yersinia pestis KIM
cagauaaacaucau

SEQ ID NO: 2336767 - RNA, 19 nt, Yersinia pestis KIM
cagauaaagaaaaacccgu

SEQ ID NO: 2336768 - RNA, 15 nt, Yersinia pestis KIM
cagauaaauaaaaua

SEQ ID NO: 2336769 - RNA, 14 nt, Yersinia pestis KIM
cagagcggguuuuu

SEQ ID NO: 2336770 - RNA, 19 nt, Yersinia pestis KIM
cagagaucauguaguacuu

SEQ ID NO: 2336771 - RNA, 12 nt, Yersinia pestis KIM
cagagcaaaacu

SEQ ID NO: 2336772 - RNA, 19 nt, Yersinia pestis KIM
aaaaucaccucaaacugac

SEQ ID NO: 2336773 - RNA, 17 nt, Yersinia pestis KIM
cagauaaauaaaauaau

SEQ ID NO: 2336774 - RNA, 16 nt, Yersinia pestis KIM
cagauaaauaaaauaa

SEQ ID NO: 2336775 - RNA, 16 nt, Yersinia pestis KIM
cagauaauccccuugu

SEQ ID NO: 2336776 - RNA, 14 nt, Yersinia pestis KIM
cagauaccacauca

SEQ ID NO: 2336777 - RNA, 16 nt, Yersinia pestis KIM
cagauaccacaucaaa

SEQ ID NO: 2336778 - RNA, 11 nt, Yersinia pestis KIM
aaaauccccca

SEQ ID NO: 2336779 - RNA, 14 nt, Yersinia pestis KIM
aaaaucccccacca

SEQ ID NO: 2336780 - RNA, 15 nt, Yersinia pestis KIM
aaaaucccaaaauau

SEQ ID NO: 2336781 - RNA, 19 nt, Yersinia pestis KIM
cagauaggcgaaauugacu

SEQ ID NO: 2336782 - RNA, 18 nt, Yersinia pestis KIM
cagauacggcuccagaac

SEQ ID NO: 2336783 - RNA, 17 nt, Yersinia pestis KIM
cagauacggcuccagaa

SEQ ID NO: 2336784 - RNA, 18 nt, Yersinia pestis KIM
cagaucacccgcaaaacu

SEQ ID NO: 2336785 - RNA, 17 nt, Yersinia pestis KIM
cagaucaccgaugauaa

SEQ ID NO: 2336786 - RNA, 15 nt, Yersinia pestis KIM
cagaucaacagauuu

SEQ ID NO: 2336787 - RNA, 15 nt, Yersinia pestis KIM
cagauauuuuaccaa

SEQ ID NO: 2336788 - RNA, 16 nt, Yersinia pestis KIM
cagauauuuuaccaau

SEQ ID NO: 2336789 - RNA, 18 nt, Yersinia pestis KIM
cagauauuccugcaaagu

SEQ ID NO: 2336790 - RNA, 22 nt, Yersinia pestis KIM
cagauauuccugcaaaguuugu

SEQ ID NO: 2336791 - RNA, 23 nt, Yersinia pestis KIM
cagauaugccaggcaucaucugc

SEQ ID NO: 2336792 - RNA, 15 nt, Yersinia pestis KIM
cagauaucugcucau

SEQ ID NO: 2336793 - RNA, 23 nt, Yersinia pestis KIM
cagauaucacucagcgucacgga

SEQ ID NO: 2336794 - RNA, 16 nt, Yersinia pestis KIM
cagauaucagccagug

SEQ ID NO: 2336795 - RNA, 15 nt, Yersinia pestis KIM
cagauaucagcgcac

SEQ ID NO: 2336796 - RNA, 19 nt, Yersinia pestis KIM
aaaauccccggaccagccg

SEQ ID NO: 2336797 - RNA, 15 nt, Yersinia pestis KIM
cagaccaaauucccc

SEQ ID NO: 2336798 - RNA, 18 nt, Yersinia pestis KIM
cagaccaaauagcaagcc

SEQ ID NO: 2336799 - RNA, 16 nt, Yersinia pestis KIM
cagacccggcaaauaa

SEQ ID NO: 2336800 - RNA, 17 nt, Yersinia pestis KIM
cagacccggcaaauaaa

SEQ ID NO: 2336801 - RNA, 14 nt, Yersinia pestis KIM
cagaccccagaaga

SEQ ID NO: 2336802 - RNA, 18 nt, Yersinia pestis KIM
cagaccuuuaggaaagcc

SEQ ID NO: 2336803 - RNA, 13 nt, Yersinia pestis KIM
cagacggaaugag

SEQ ID NO: 2336804 - RNA, 18 nt, Yersinia pestis KIM
cagacgaguauuccccac

SEQ ID NO: 2336805 - RNA, 19 nt, Yersinia pestis KIM
cagacggggaggacuuccg

SEQ ID NO: 2336806 - RNA, 13 nt, Yersinia pestis KIM
cagacuccugccc

SEQ ID NO: 2336807 - RNA, 16 nt, Yersinia pestis KIM
cagacugcucuuuccc

SEQ ID NO: 2336808 - RNA, 18 nt, Yersinia pestis KIM
cagacugcugacaaaccc

SEQ ID NO: 2336809 - RNA, 17 nt, Yersinia pestis KIM
cagacugcugacaaccc

SEQ ID NO: 2336810 - RNA, 22 nt, Yersinia pestis KIM
cagacugaaaugacauugcgaa

SEQ ID NO: 2336811 - RNA, 20 nt, Yersinia pestis KIM
cagacugacgcagagcuaaa

SEQ ID NO: 2336812 - RNA, 21 nt, Yersinia pestis KIM
cagacugaaaguagaaauaaa

SEQ ID NO: 2336813 - RNA, 18 nt, Yersinia pestis KIM
cagacucuuauauaaauc

SEQ ID NO: 2336814 - RNA, 16 nt, Yersinia pestis KIM
cagacugaaaguagaa

SEQ ID NO: 2336815 - RNA, 23 nt, Yersinia pestis KIM
cagaaugaaguucaccagcuugg

SEQ ID NO: 2336816 - RNA, 12 nt, Yersinia pestis KIM
cagaaugaaagg

SEQ ID NO: 2336817 - RNA, 17 nt, Yersinia pestis KIM
cagaaugaaguucacca

SEQ ID NO: 2336818 - RNA, 19 nt, Yersinia pestis KIM
cagacauuuuucuauuucu

SEQ ID NO: 2336819 - RNA, 20 nt, Yersinia pestis KIM
cagacauuuuucuauuucug

SEQ ID NO: 2336820 - RNA, 14 nt, Yersinia pestis KIM
cagacauuuuucua

SEQ ID NO: 2336821 - RNA, 15 nt, Yersinia pestis KIM
cagacaacugacaac

SEQ ID NO: 2336822 - RNA, 19 nt, Yersinia pestis KIM
cagacaacagucacaccaa

SEQ ID NO: 2336823 - RNA, 17 nt, Yersinia pestis KIM
cagacaaccaauacaca

SEQ ID NO: 2336824 - RNA, 21 nt, Yersinia pestis KIM
cagacaaccaauacacagcac

SEQ ID NO: 2336825 - RNA, 18 nt, Yersinia pestis KIM
cagaaucgccugcacacg

SEQ ID NO: 2336826 - RNA, 16 nt, Yersinia pestis KIM
cagaauaucguggaga

SEQ ID NO: 2336827 - RNA, 15 nt, Yersinia pestis KIM
cagaauauaaaagca

SEQ ID NO: 2336828 - RNA, 21 nt, Yersinia pestis KIM
cagaaucaccaacaccaccau

SEQ ID NO: 2336829 - RNA, 21 nt, Yersinia pestis KIM
cagaauaauaagccgugccug

SEQ ID NO: 2336830 - RNA, 20 nt, Yersinia pestis KIM
cagaauaauaagccgugccu

SEQ ID NO: 2336831 - RNA, 18 nt, Yersinia pestis KIM
cagaauacuguguggauc

SEQ ID NO: 2336832 - RNA, 13 nt, Yersinia pestis KIM
cagcacgguaacc

SEQ ID NO: 2336833 - RNA, 15 nt, Yersinia pestis KIM
cagcacuauccccaa

SEQ ID NO: 2336834 - RNA, 23 nt, Yersinia pestis KIM
cagcacuacguguuuuucaucug

SEQ ID NO: 2336835 - RNA, 15 nt, Yersinia pestis KIM
cagcacuccccgccc

SEQ ID NO: 2336836 - RNA, 17 nt, Yersinia pestis KIM
cagcacuccccgcccgu

SEQ ID NO: 2336837 - RNA, 19 nt, Yersinia pestis KIM
aaaauggcuuuuuuaauaa

SEQ ID NO: 2336838 - RNA, 22 nt, Yersinia pestis KIM
aaaauggcguuuaaaguaaauc

SEQ ID NO: 2336839 - RNA, 13 nt, Yersinia pestis KIM
aaaaugguuucag

SEQ ID NO: 2336840 - RNA, 22 nt, Yersinia pestis KIM
aaaaugguuugcuguucuugca

SEQ ID NO: 2336841 - RNA, 14 nt, Yersinia pestis KIM
cagcagcaguauua

SEQ ID NO: 2336842 - RNA, 11 nt, Yersinia pestis KIM
cagcaccaccg

SEQ ID NO: 2336843 - RNA, 17 nt, Yersinia pestis KIM
cagcaauacgccccuga

SEQ ID NO: 2336844 - RNA, 14 nt, Yersinia pestis KIM
cagcacauuuuuau

SEQ ID NO: 2336845 - RNA, 16 nt, Yersinia pestis KIM
cagcacauuuuuauag

SEQ ID NO: 2336846 - RNA, 18 nt, Yersinia pestis KIM
aaaaugccaacaacuggg

SEQ ID NO: 2336847 - RNA, 15 nt, Yersinia pestis KIM
cagcaauaaaccacu

SEQ ID NO: 2336848 - RNA, 17 nt, Yersinia pestis KIM
cagcaauaaaccacugg

SEQ ID NO: 2336849 - RNA, 18 nt, Yersinia pestis KIM
cagcaauaaaccacuggu

SEQ ID NO: 2336850 - RNA, 16 nt, Yersinia pestis KIM
cagcaauaagccacgc

SEQ ID NO: 2336851 - RNA, 22 nt, Yersinia pestis KIM
cagcaaguuagcgauaucugcg

SEQ ID NO: 2336852 - RNA, 17 nt, Yersinia pestis KIM
cagcaacucaagccacu

SEQ ID NO: 2336853 - RNA, 12 nt, Yersinia pestis KIM
cagcaaaucaaa

SEQ ID NO: 2336854 - RNA, 14 nt, Yersinia pestis KIM
cagcaaaucauaaa

SEQ ID NO: 2336855 - RNA, 15 nt, Yersinia pestis KIM
cagcaaaucauuuaa

SEQ ID NO: 2336856 - RNA, 17 nt, Yersinia pestis KIM
cagcaaacaucgguaaa

SEQ ID NO: 2336857 - RNA, 22 nt, Yersinia pestis KIM
cagcaaagccucuaccaaugcc

SEQ ID NO: 2336858 - RNA, 14 nt, Yersinia pestis KIM
cagcaaauugcuga

SEQ ID NO: 2336859 - RNA, 14 nt, Yersinia pestis KIM
cagcaacacaaaag

SEQ ID NO: 2336860 - RNA, 17 nt, Yersinia pestis KIM
aaaaugagaauaucuau

SEQ ID NO: 2336861 - RNA, 20 nt, Yersinia pestis KIM
cagauugccgucacuuuuuu

SEQ ID NO: 2336862 - RNA, 21 nt, Yersinia pestis KIM
cagauucgcaaagcgggccag

SEQ ID NO: 2336863 - RNA, 17 nt, Yersinia pestis KIM
cagauucccgcgccgcg

SEQ ID NO: 2336864 - RNA, 19 nt, Yersinia pestis KIM
aaaaucguauaacauaaua

SEQ ID NO: 2336865 - RNA, 21 nt, Yersinia pestis KIM
cagauccucaucacugccguc

SEQ ID NO: 2336866 - RNA, 23 nt, Yersinia pestis KIM
cagauccguaccaccacgaaaau

SEQ ID NO: 2336867 - RNA, 17 nt, Yersinia pestis KIM
cagauccagaauuucau

SEQ ID NO: 2336868 - RNA, 14 nt, Yersinia pestis KIM
cacugaaucccaga

SEQ ID NO: 2336869 - RNA, 17 nt, Yersinia pestis KIM
cacucuuuuuaauuuau

SEQ ID NO: 2336870 - RNA, 20 nt, Yersinia pestis KIM
cacugacagcaacgacgccc

SEQ ID NO: 2336871 - RNA, 14 nt, Yersinia pestis KIM
cacugacagcaacg

SEQ ID NO: 2336872 - RNA, 15 nt, Yersinia pestis KIM
cacugacaaaaacag

SEQ ID NO: 2336873 - RNA, 14 nt, Yersinia pestis KIM
cacugacaucauca

SEQ ID NO: 2336874 - RNA, 23 nt, Yersinia pestis KIM
cacucuagcuguguuuuaucugu

SEQ ID NO: 2336875 - RNA, 14 nt, Yersinia pestis KIM
cacucuguuuuaaa

SEQ ID NO: 2336876 - RNA, 22 nt, Yersinia pestis KIM
cacucuggggcaaucaauguau

SEQ ID NO: 2336877 - RNA, 16 nt, Yersinia pestis KIM
cacuccauuaauuuau

SEQ ID NO: 2336878 - RNA, 12 nt, Yersinia pestis KIM
cacucgaaucac

SEQ ID NO: 2336879 - RNA, 15 nt, Yersinia pestis KIM
cacucggccagagcu

SEQ ID NO: 2336880 - RNA, 16 nt, Yersinia pestis KIM
cacugccugcucucug

SEQ ID NO: 2336881 - RNA, 20 nt, Yersinia pestis KIM
cacugccugcucucugcugc

SEQ ID NO: 2336882 - RNA, 16 nt, Yersinia pestis KIM
cacugccgucaaugcc

SEQ ID NO: 2336883 - RNA, 13 nt, Yersinia pestis KIM
cacugccaucuca

SEQ ID NO: 2336884 - RNA, 17 nt, Yersinia pestis KIM
cacugcccgaacggcag

SEQ ID NO: 2336885 - RNA, 16 nt, Yersinia pestis KIM
cacugcuccagccaac

SEQ ID NO: 2336886 - RNA, 15 nt, Yersinia pestis KIM
cacuggaaaaagugu

SEQ ID NO: 2336887 - RNA, 23 nt, Yersinia pestis KIM
cacugcgggagggauuucuucau

SEQ ID NO: 2336888 - RNA, 14 nt, Yersinia pestis KIM
cacugagcaccgca

SEQ ID NO: 2336889 - RNA, 15 nt, Yersinia pestis KIM
cacugagaaccgaua

SEQ ID NO: 2336890 - RNA, 20 nt, Yersinia pestis KIM
cacugacggcagacaaccau

SEQ ID NO: 2336891 - RNA, 21 nt, Yersinia pestis KIM
cacugauauagccuucuucac

SEQ ID NO: 2336892 - RNA, 15 nt, Yersinia pestis KIM
cacugauacccaguu

SEQ ID NO: 2336893 - RNA, 15 nt, Yersinia pestis KIM
cacugaguucugcug

SEQ ID NO: 2336894 - RNA, 15 nt, Yersinia pestis KIM
cacugaguugcagga

SEQ ID NO: 2336895 - RNA, 23 nt, Yersinia pestis KIM
cacugauuuuuuaccugagaaaa

SEQ ID NO: 2336896 - RNA, 14 nt, Yersinia pestis KIM
cacugauuuauaaa

SEQ ID NO: 2336897 - RNA, 20 nt, Yersinia pestis KIM
cacugauuuauaaauaauua

SEQ ID NO: 2336898 - RNA, 15 nt, Yersinia pestis KIM
cacucauugccuggc

SEQ ID NO: 2336899 - RNA, 15 nt, Yersinia pestis KIM
cacucaugacaaaau

SEQ ID NO: 2336900 - RNA, 15 nt, Yersinia pestis KIM
cacucauccucuggc

SEQ ID NO: 2336901 - RNA, 23 nt, Yersinia pestis KIM
cacucaggguuagggaugagugu

SEQ ID NO: 2336902 - RNA, 15 nt, Yersinia pestis KIM
cacucaccgccagca

SEQ ID NO: 2336903 - RNA, 14 nt, Yersinia pestis KIM
cacucacucuucgc

SEQ ID NO: 2336904 - RNA, 14 nt, Yersinia pestis KIM
cacucagcgcuggc

SEQ ID NO: 2336905 - RNA, 15 nt, Yersinia pestis KIM
cacucagacaaucau

SEQ ID NO: 2336906 - RNA, 14 nt, Yersinia pestis KIM
cacucacauaagaa

SEQ ID NO: 2336907 - RNA, 16 nt, Yersinia pestis KIM
cacucacaacccgcug

SEQ ID NO: 2336908 - RNA, 12 nt, Yersinia pestis KIM
cacucaacugau

SEQ ID NO: 2336909 - RNA, 12 nt, Yersinia pestis KIM
cacucaagccag

SEQ ID NO: 2336910 - RNA, 22 nt, Yersinia pestis KIM
cacucaagccaguaacuacuau

SEQ ID NO: 2336911 - RNA, 19 nt, Yersinia pestis KIM
cacuauuuuaccuauuuau

SEQ ID NO: 2336912 - RNA, 22 nt, Yersinia pestis KIM
cacuauuuucuacugaauaaac

SEQ ID NO: 2336913 - RNA, 14 nt, Yersinia pestis KIM
cacuaugggggauu

SEQ ID NO: 2336914 - RNA, 23 nt, Yersinia pestis KIM
cacuauuucguguauaucacuau

SEQ ID NO: 2336915 - RNA, 17 nt, Yersinia pestis KIM
cacuauuucguguauau

SEQ ID NO: 2336916 - RNA, 14 nt, Yersinia pestis KIM
cacuauuucagaca

SEQ ID NO: 2336917 - RNA, 13 nt, Yersinia pestis KIM
cacuauccuuuga

SEQ ID NO: 2336918 - RNA, 18 nt, Yersinia pestis KIM
cacuauccuuugauagaa

SEQ ID NO: 2336919 - RNA, 21 nt, Yersinia pestis KIM
cacuauccuuugauagaaaua

SEQ ID NO: 2336920 - RNA, 14 nt, Yersinia pestis KIM
cacuacucaguugc

SEQ ID NO: 2336921 - RNA, 13 nt, Yersinia pestis KIM
cacuagcgggccu

SEQ ID NO: 2336922 - RNA, 22 nt, Yersinia pestis KIM
cacuagggggcaauugaaaaug

SEQ ID NO: 2336923 - RNA, 18 nt, Yersinia pestis KIM
cacguucaccaaagcaau

SEQ ID NO: 2336924 - RNA, 17 nt, Yersinia pestis KIM
cacguggguauccagug

SEQ ID NO: 2336925 - RNA, 20 nt, Yersinia pestis KIM
cacguucggcgucgccaccc

SEQ ID NO: 2336926 - RNA, 14 nt, Yersinia pestis KIM
cacguucccccgcc

SEQ ID NO: 2336927 - RNA, 13 nt, Yersinia pestis KIM
cacguuuccaaaa

SEQ ID NO: 2336928 - RNA, 18 nt, Yersinia pestis KIM
cacguugucaaaaaccca

SEQ ID NO: 2336929 - RNA, 19 nt, Yersinia pestis KIM
cacuaauuagugacaguag

SEQ ID NO: 2336930 - RNA, 14 nt, Yersinia pestis KIM
cacuaauagcauuu

SEQ ID NO: 2336931 - RNA, 20 nt, Yersinia pestis KIM
cacuaauacucuguuaccaa

SEQ ID NO: 2336932 - RNA, 13 nt, Yersinia pestis KIM
cacuaacgccccu

SEQ ID NO: 2336933 - RNA, 17 nt, Yersinia pestis KIM
cacuaacgcugaggcga

SEQ ID NO: 2336934 - RNA, 12 nt, Yersinia pestis KIM
cacuaaaucaaa

SEQ ID NO: 2336935 - RNA, 21 nt, Yersinia pestis KIM
cacuaccgucuuggauauuug

SEQ ID NO: 2336936 - RNA, 14 nt, Yersinia pestis KIM
cacuacauucugau

SEQ ID NO: 2336937 - RNA, 22 nt, Yersinia pestis KIM
aaaauaugauaguguaaaaacc

SEQ ID NO: 2336938 - RNA, 19 nt, Yersinia pestis KIM
aaaauaugauaguguaaaa

SEQ ID NO: 2336939 - RNA, 12 nt, Yersinia pestis KIM
cacuuugcauuu

SEQ ID NO: 2336940 - RNA, 15 nt, Yersinia pestis KIM
cacuuugcauuuucu

SEQ ID NO: 2336941 - RNA, 19 nt, Yersinia pestis KIM
aaaauaucgcgcuucaggu

SEQ ID NO: 2336942 - RNA, 17 nt, Yersinia pestis KIM
cacuuuagccaagguua

SEQ ID NO: 2336943 - RNA, 16 nt, Yersinia pestis KIM
aaaauauccagcaacg

SEQ ID NO: 2336944 - RNA, 22 nt, Yersinia pestis KIM
cacuuuaaauacccagcuucuu

SEQ ID NO: 2336945 - RNA, 13 nt, Yersinia pestis KIM
cacuuguucagag

SEQ ID NO: 2336946 - RNA, 21 nt, Yersinia pestis KIM
cagaaaaccuucagcaaagag

SEQ ID NO: 2336947 - RNA, 16 nt, Yersinia pestis KIM
cagaaacggcaucugc

SEQ ID NO: 2336948 - RNA, 16 nt, Yersinia pestis KIM
cagaaacggcuauuuu

SEQ ID NO: 2336949 - RNA, 12 nt, Yersinia pestis KIM
cagaaagcagca

SEQ ID NO: 2336950 - RNA, 19 nt, Yersinia pestis KIM
cagaaagaagucuaacaaa

SEQ ID NO: 2336951 - RNA, 14 nt, Yersinia pestis KIM
cacuuuucagauag

SEQ ID NO: 2336952 - RNA, 18 nt, Yersinia pestis KIM
cacuuuugucgcucaagc

SEQ ID NO: 2336953 - RNA, 11 nt, Yersinia pestis KIM
cagaaaacccc

SEQ ID NO: 2336954 - RNA, 16 nt, Yersinia pestis KIM
cagaaaacccccugcu

SEQ ID NO: 2336955 - RNA, 15 nt, Yersinia pestis KIM
cagaaaaauaggcca

SEQ ID NO: 2336956 - RNA, 21 nt, Yersinia pestis KIM
cacuuuuaagauccuguggcu

SEQ ID NO: 2336957 - RNA, 18 nt, Yersinia pestis KIM
cacuuuuaccgcaaccac

SEQ ID NO: 2336958 - RNA, 22 nt, Yersinia pestis KIM
cacuuuuauuuuuuaugacuuc

SEQ ID NO: 2336959 - RNA, 17 nt, Yersinia pestis KIM
cagaaaguaaucuuuga

SEQ ID NO: 2336960 - RNA, 21 nt, Yersinia pestis KIM
cagaaaguuguucaacgccau

SEQ ID NO: 2336961 - RNA, 22 nt, Yersinia pestis KIM
cagaacccccgcgaacagcaga

SEQ ID NO: 2336962 - RNA, 16 nt, Yersinia pestis KIM
cagaacgcaaucaggg

SEQ ID NO: 2336963 - RNA, 17 nt, Yersinia pestis KIM
cagaacuaacaugccag

SEQ ID NO: 2336964 - RNA, 19 nt, Yersinia pestis KIM
cagaacuaauaucaacaga

SEQ ID NO: 2336965 - RNA, 15 nt, Yersinia pestis KIM
cagaacuaaacgcca

SEQ ID NO: 2336966 - RNA, 19 nt, Yersinia pestis KIM
cagaacuaaacgccaacaa

SEQ ID NO: 2336967 - RNA, 16 nt, Yersinia pestis KIM
cagaagguaagccagu

SEQ ID NO: 2336968 - RNA, 20 nt, Yersinia pestis KIM
cagaagggcggccagcaaga

SEQ ID NO: 2336969 - RNA, 21 nt, Yersinia pestis KIM
cagaauaaaagcgguaugacc

SEQ ID NO: 2336970 - RNA, 20 nt, Yersinia pestis KIM
cagaacugauuucaggaaug

SEQ ID NO: 2336971 - RNA, 14 nt, Yersinia pestis KIM
cagaacugggggua

SEQ ID NO: 2336972 - RNA, 23 nt, Yersinia pestis KIM
cagaagaacagcccuccagccgg

SEQ ID NO: 2336973 - RNA, 22 nt, Yersinia pestis KIM
cacuggugcucacugauuuuuu

SEQ ID NO: 2336974 - RNA, 20 nt, Yersinia pestis KIM
cacuguacugggaugaagaa

SEQ ID NO: 2336975 - RNA, 13 nt, Yersinia pestis KIM
cacuguagaccuc

SEQ ID NO: 2336976 - RNA, 14 nt, Yersinia pestis KIM
cacugucuauuuuu

SEQ ID NO: 2336977 - RNA, 16 nt, Yersinia pestis KIM
cacuggaggaacugag

SEQ ID NO: 2336978 - RNA, 21 nt, Yersinia pestis KIM
cacuggaggaacugagucuca

SEQ ID NO: 2336979 - RNA, 13 nt, Yersinia pestis KIM
cacuggcaccgcu

SEQ ID NO: 2336980 - RNA, 19 nt, Yersinia pestis KIM
cacuggauguguggcaguc

SEQ ID NO: 2336981 - RNA, 18 nt, Yersinia pestis KIM
cacuggcgguugaauaug

SEQ ID NO: 2336982 - RNA, 15 nt, Yersinia pestis KIM
cacuguuuuucauua

SEQ ID NO: 2336983 - RNA, 12 nt, Yersinia pestis KIM
cacuguucagac

SEQ ID NO: 2336984 - RNA, 13 nt, Yersinia pestis KIM
cacuguucagacg

SEQ ID NO: 2336985 - RNA, 21 nt, Yersinia pestis KIM
cacuguuggcgggauccaucu

SEQ ID NO: 2336986 - RNA, 21 nt, Yersinia pestis KIM
cacuguucuugauggucaaua

SEQ ID NO: 2336987 - RNA, 22 nt, Yersinia pestis KIM
cacuuauuugaaauacuuauuu

SEQ ID NO: 2336988 - RNA, 21 nt, Yersinia pestis KIM
cacuuauuccuuucguucacu

SEQ ID NO: 2336989 - RNA, 23 nt, Yersinia pestis KIM
cacuuauuugaaauacuuauuug

SEQ ID NO: 2336990 - RNA, 13 nt, Yersinia pestis KIM
cacuuagugcugg

SEQ ID NO: 2336991 - RNA, 15 nt, Yersinia pestis KIM
cacuuaguggcauug

SEQ ID NO: 2336992 - RNA, 17 nt, Yersinia pestis KIM
cacuuggcuaauuguca

SEQ ID NO: 2336993 - RNA, 16 nt, Yersinia pestis KIM
cacuuguaccugugcc

SEQ ID NO: 2336994 - RNA, 19 nt, Yersinia pestis KIM
cacuuguaccugugccagu

SEQ ID NO: 2336995 - RNA, 11 nt, Yersinia pestis KIM
cacuugcuacc

SEQ ID NO: 2336996 - RNA, 14 nt, Yersinia pestis KIM
cacuugagagaaac

SEQ ID NO: 2336997 - RNA, 16 nt, Yersinia pestis KIM
cacuugauagcguggc

SEQ ID NO: 2336998 - RNA, 13 nt, Yersinia pestis KIM
cacuucuaacaag

SEQ ID NO: 2336999 - RNA, 18 nt, Yersinia pestis KIM
cacuucuggccgcucuuu

SEQ ID NO: 2337000 - RNA, 11 nt, Yersinia pestis KIM
cacuugaccuu

SEQ ID NO: 2337001 - RNA, 14 nt, Yersinia pestis KIM
cacuucuuucacua

SEQ ID NO: 2337002 - RNA, 18 nt, Yersinia pestis KIM
cacuucgauacuacaauc

SEQ ID NO: 2337003 - RNA, 14 nt, Yersinia pestis KIM
cacuuccagcgccc

SEQ ID NO: 2337004 - RNA, 15 nt, Yersinia pestis KIM
cacuuccucauucau

SEQ ID NO: 2337005 - RNA, 22 nt, Yersinia pestis KIM
cacuucaacguggaaguucaga

SEQ ID NO: 2337006 - RNA, 20 nt, Yersinia pestis KIM
cacuucaauugccaugccga

SEQ ID NO: 2337007 - RNA, 13 nt, Yersinia pestis KIM
cacuucagaaccg

SEQ ID NO: 2337008 - RNA, 20 nt, Yersinia pestis KIM
caggauuaaauaaagauaau

SEQ ID NO: 2337009 - RNA, 20 nt, Yersinia pestis KIM
caggaucaggccagagacac

SEQ ID NO: 2337010 - RNA, 21 nt, Yersinia pestis KIM
caggaucgaucuggauauauu

SEQ ID NO: 2337011 - RNA, 20 nt, Yersinia pestis KIM
caggcauaucacuauuucgu

SEQ ID NO: 2337012 - RNA, 15 nt, Yersinia pestis KIM
caggcaguaaaauau

SEQ ID NO: 2337013 - RNA, 17 nt, Yersinia pestis KIM
caggcaguaaaauauug

SEQ ID NO: 2337014 - RNA, 13 nt, Yersinia pestis KIM
caggcagaaauaa

SEQ ID NO: 2337015 - RNA, 21 nt, Yersinia pestis KIM
caggcacuuugucaacaaccu

SEQ ID NO: 2337016 - RNA, 19 nt, Yersinia pestis KIM
caggcacuuugucaauaac

SEQ ID NO: 2337017 - RNA, 14 nt, Yersinia pestis KIM
caggcagcacggcu

SEQ ID NO: 2337018 - RNA, 15 nt, Yersinia pestis KIM
caggcagauuauuuu

SEQ ID NO: 2337019 - RNA, 15 nt, Yersinia pestis KIM
caggcacugcagaaa

SEQ ID NO: 2337020 - RNA, 14 nt, Yersinia pestis KIM
caggcaacgacagc

SEQ ID NO: 2337021 - RNA, 20 nt, Yersinia pestis KIM
caggcaacgacagcaacaac

SEQ ID NO: 2337022 - RNA, 17 nt, Yersinia pestis KIM
caggcaaugagugcagc

SEQ ID NO: 2337023 - RNA, 19 nt, Yersinia pestis KIM
caggcaaaguguaauuugu

SEQ ID NO: 2337024 - RNA, 20 nt, Yersinia pestis KIM
caggcaaagacuacacacag

SEQ ID NO: 2337025 - RNA, 17 nt, Yersinia pestis KIM
cagcguuuuauucguuc

SEQ ID NO: 2337026 - RNA, 23 nt, Yersinia pestis KIM
cagcuaaaaggggauaacaguuu

SEQ ID NO: 2337027 - RNA, 21 nt, Yersinia pestis KIM
cagcugauaugaaaaaucuga

SEQ ID NO: 2337028 - RNA, 17 nt, Yersinia pestis KIM
cagcugacccccgccgc

SEQ ID NO: 2337029 - RNA, 16 nt, Yersinia pestis KIM
caggaagcaagaaacu

SEQ ID NO: 2337030 - RNA, 19 nt, Yersinia pestis KIM
caggaagcggccagguuca

SEQ ID NO: 2337031 - RNA, 16 nt, Yersinia pestis KIM
caggaagagaaaagca

SEQ ID NO: 2337032 - RNA, 23 nt, Yersinia pestis KIM
cagcugggauaugccguauacgu

SEQ ID NO: 2337033 - RNA, 19 nt, Yersinia pestis KIM
cagcuuccugugaaauaaa

SEQ ID NO: 2337034 - RNA, 16 nt, Yersinia pestis KIM
caggcgugcugcuucc

SEQ ID NO: 2337035 - RNA, 17 nt, Yersinia pestis KIM
caggcuaauacaugcug

SEQ ID NO: 2337036 - RNA, 23 nt, Yersinia pestis KIM
caggcgugggcuaauugaauaca

SEQ ID NO: 2337037 - RNA, 15 nt, Yersinia pestis KIM
caggcucuaucucuu

SEQ ID NO: 2337038 - RNA, 21 nt, Yersinia pestis KIM
caggcuuugguuuugauuuuu

SEQ ID NO: 2337039 - RNA, 23 nt, Yersinia pestis KIM
cagggaaaaacgcagagcgauug

SEQ ID NO: 2337040 - RNA, 15 nt, Yersinia pestis KIM
cagggagucagggag

SEQ ID NO: 2337041 - RNA, 18 nt, Yersinia pestis KIM
cagggagucagggaguca

SEQ ID NO: 2337042 - RNA, 20 nt, Yersinia pestis KIM
cagggagucagggagucagg

SEQ ID NO: 2337043 - RNA, 19 nt, Yersinia pestis KIM
caggcgcuauuccgcgccu

SEQ ID NO: 2337044 - RNA, 21 nt, Yersinia pestis KIM
caggcgacccagcgccauaac

SEQ ID NO: 2337045 - RNA, 22 nt, Yersinia pestis KIM
caggccuagcccaguaccgcug

SEQ ID NO: 2337046 - RNA, 16 nt, Yersinia pestis KIM
cagguaaugucacugc

SEQ ID NO: 2337047 - RNA, 14 nt, Yersinia pestis KIM
cagguaauuacagu

SEQ ID NO: 2337048 - RNA, 14 nt, Yersinia pestis KIM
cagguaccccauaa

SEQ ID NO: 2337049 - RNA, 22 nt, Yersinia pestis KIM
cagguaccgggccauagcccau

SEQ ID NO: 2337050 - RNA, 16 nt, Yersinia pestis KIM
cagguaaugcauucug

SEQ ID NO: 2337051 - RNA, 18 nt, Yersinia pestis KIM
cagguagaucaaacauaa

SEQ ID NO: 2337052 - RNA, 20 nt, Yersinia pestis KIM
cagggugaccgcacugccca

SEQ ID NO: 2337053 - RNA, 14 nt, Yersinia pestis KIM
cagggugaaagccc

SEQ ID NO: 2337054 - RNA, 24 nt, Yersinia pestis KIM
cagggugaaagcccaacugacuga

SEQ ID NO: 2337055 - RNA, 22 nt, Yersinia pestis KIM
cagguaaaccgguuaaaacaga

SEQ ID NO: 2337056 - RNA, 13 nt, Yersinia pestis KIM
cagguaagaaaga

SEQ ID NO: 2337057 - RNA, 18 nt, Yersinia pestis KIM
caggguuuaacgggcuua

SEQ ID NO: 2337058 - RNA, 23 nt, Yersinia pestis KIM
caggggauagcaacugccaauau

SEQ ID NO: 2337059 - RNA, 16 nt, Yersinia pestis KIM
caggggcaauuaucuu

SEQ ID NO: 2337060 - RNA, 18 nt, Yersinia pestis KIM
caggguauuccacccgca

SEQ ID NO: 2337061 - RNA, 16 nt, Yersinia pestis KIM
cagggcgaucaggaag

SEQ ID NO: 2337062 - RNA, 15 nt, Yersinia pestis KIM
cagggaucaccucuu

SEQ ID NO: 2337063 - RNA, 23 nt, Yersinia pestis KIM
aaacaaaaccuaacgccaaaaug

SEQ ID NO: 2337064 - RNA, 14 nt, Yersinia pestis KIM
cagccuaaaaugaa

SEQ ID NO: 2337065 - RNA, 14 nt, Yersinia pestis KIM
cagccuaaggccau

SEQ ID NO: 2337066 - RNA, 17 nt, Yersinia pestis KIM
cagccguaucuucugcc

SEQ ID NO: 2337067 - RNA, 22 nt, Yersinia pestis KIM
cagccgggaugaucaacaguga

SEQ ID NO: 2337068 - RNA, 18 nt, Yersinia pestis KIM
cagccuguuuaguaaaua

SEQ ID NO: 2337069 - RNA, 20 nt, Yersinia pestis KIM
cagccuguuuaguaaauaua

SEQ ID NO: 2337070 - RNA, 12 nt, Yersinia pestis KIM
cagccuguuaau

SEQ ID NO: 2337071 - RNA, 12 nt, Yersinia pestis KIM
cagccugugccc

SEQ ID NO: 2337072 - RNA, 16 nt, Yersinia pestis KIM
cagcgacauaaaccgc

SEQ ID NO: 2337073 - RNA, 17 nt, Yersinia pestis KIM
cagccuuuaaccacgag

SEQ ID NO: 2337074 - RNA, 15 nt, Yersinia pestis KIM
cagcgaggcuucuca

SEQ ID NO: 2337075 - RNA, 18 nt, Yersinia pestis KIM
cagcgauuuuaaaaaauc

SEQ ID NO: 2337076 - RNA, 11 nt, Yersinia pestis KIM
cagccccgcca

SEQ ID NO: 2337077 - RNA, 17 nt, Yersinia pestis KIM
cagccccgccaggaaaa

SEQ ID NO: 2337078 - RNA, 18 nt, Yersinia pestis KIM
cagccccuaacagcagug

SEQ ID NO: 2337079 - RNA, 19 nt, Yersinia pestis KIM
cagcccggauagaauugaa

SEQ ID NO: 2337080 - RNA, 19 nt, Yersinia pestis KIM
cagcccagucucuuugcca

SEQ ID NO: 2337081 - RNA, 22 nt, Yersinia pestis KIM
cagcccauuuagcuggcugaac

SEQ ID NO: 2337082 - RNA, 20 nt, Yersinia pestis KIM
cagccccaaacacuuagcac

SEQ ID NO: 2337083 - RNA, 13 nt, Yersinia pestis KIM
cagcccagcaggc

SEQ ID NO: 2337084 - RNA, 23 nt, Yersinia pestis KIM
cagccauuugaacaaaccccacu

SEQ ID NO: 2337085 - RNA, 17 nt, Yersinia pestis KIM
cagccauugagcgaaga

SEQ ID NO: 2337086 - RNA, 15 nt, Yersinia pestis KIM
cagccaagucaggga

SEQ ID NO: 2337087 - RNA, 13 nt, Yersinia pestis KIM
cagccaauggcca

SEQ ID NO: 2337088 - RNA, 15 nt, Yersinia pestis KIM
cagccacucaauggc

SEQ ID NO: 2337089 - RNA, 18 nt, Yersinia pestis KIM
cagccacucacauaagaa

SEQ ID NO: 2337090 - RNA, 13 nt, Yersinia pestis KIM
cagccaacuccuu

SEQ ID NO: 2337091 - RNA, 21 nt, Yersinia pestis KIM
cagccaacuccuugaauauuu

SEQ ID NO: 2337092 - RNA, 13 nt, Yersinia pestis KIM
cagccagaaccuc

SEQ ID NO: 2337093 - RNA, 18 nt, Yersinia pestis KIM
cagcggagaaucgcuguu

SEQ ID NO: 2337094 - RNA, 23 nt, Yersinia pestis KIM
cagcgcuuuaggcaagaguugac

SEQ ID NO: 2337095 - RNA, 17 nt, Yersinia pestis KIM
cagcggcguaucaaacg

SEQ ID NO: 2337096 - RNA, 16 nt, Yersinia pestis KIM
aaaauuacccagcauc

SEQ ID NO: 2337097 - RNA, 22 nt, Yersinia pestis KIM
aaaauuacaguucuuuauccac

SEQ ID NO: 2337098 - RNA, 12 nt, Yersinia pestis KIM
aaaauuaaaaua

SEQ ID NO: 2337099 - RNA, 11 nt, Yersinia pestis KIM
aaaauuaagac

SEQ ID NO: 2337100 - RNA, 16 nt, Yersinia pestis KIM
aaaauuaauaaauuau

SEQ ID NO: 2337101 - RNA, 17 nt, Yersinia pestis KIM
aaaauuaauaaauuaua

SEQ ID NO: 2337102 - RNA, 17 nt, Yersinia pestis KIM
cagcggcaaauagagca

SEQ ID NO: 2337103 - RNA, 20 nt, Yersinia pestis KIM
cagcggcaaauagagcacca

SEQ ID NO: 2337104 - RNA, 23 nt, Yersinia pestis KIM
cagcguagguaacuaagcugccu

SEQ ID NO: 2337105 - RNA, 18 nt, Yersinia pestis KIM
cagcguagccguuaaaua

SEQ ID NO: 2337106 - RNA, 16 nt, Yersinia pestis KIM
cagcguauucaguaaa

SEQ ID NO: 2337107 - RNA, 13 nt, Yersinia pestis KIM
cagcguaaacagu

SEQ ID NO: 2337108 - RNA, 23 nt, Yersinia pestis KIM
cagcgguuuuuucuuucuucagc

SEQ ID NO: 2337109 - RNA, 17 nt, Yersinia pestis KIM
cagcguaagcgguuugu

SEQ ID NO: 2337110 - RNA, 22 nt, Yersinia pestis KIM
cagcguagacaaugacugugcg

SEQ ID NO: 2337111 - RNA, 18 nt, Yersinia pestis KIM
cagcguagauuuucucag

SEQ ID NO: 2337112 - RNA, 22 nt, Yersinia pestis KIM
cagcgguaugaggaucccuucu

SEQ ID NO: 2337113 - RNA, 23 nt, Yersinia pestis KIM
cagcgguaugaggaucccuucug

SEQ ID NO: 2337114 - RNA, 16 nt, Yersinia pestis KIM
cagcgguaucccacug

SEQ ID NO: 2337115 - RNA, 21 nt, Yersinia pestis KIM
cagcgguaucccacuggacgu

SEQ ID NO: 2337116 - RNA, 18 nt, Yersinia pestis KIM
cagcgguagagaucucug

SEQ ID NO: 2337117 - RNA, 20 nt, Yersinia pestis KIM
cagcggucgguauucagccg

SEQ ID NO: 2337118 - RNA, 17 nt, Yersinia pestis KIM
aaaauucaaacaaauau

SEQ ID NO: 2337119 - RNA, 15 nt, Yersinia pestis KIM
cagcggggcauucau

SEQ ID NO: 2337120 - RNA, 15 nt, Yersinia pestis KIM
cagcgggcgcagcca

SEQ ID NO: 2337121 - RNA, 13 nt, Yersinia pestis KIM
aaaauuagagcaa

SEQ ID NO: 2337122 - RNA, 21 nt, Yersinia pestis KIM
cagcguggcccaggcaaucuc

SEQ ID NO: 2337123 - RNA, 16 nt, Yersinia pestis KIM
cagcguugacaccaga

SEQ ID NO: 2337124 - RNA, 18 nt, Yersinia pestis KIM
cagcguucuucugauuca

SEQ ID NO: 2337125 - RNA, 15 nt, Yersinia pestis KIM
cagcguuacccagau

SEQ ID NO: 2337126 - RNA, 20 nt, Yersinia pestis KIM
aaaauucgugcucaucaacc

SEQ ID NO: 2337127 - RNA, 22 nt, Yersinia pestis KIM
aaaauucauucuuuuauacagc

SEQ ID NO: 2337128 - RNA, 19 nt, Yersinia pestis KIM
cagcgucauggucucacug

SEQ ID NO: 2337129 - RNA, 15 nt, Bordetella pertussis
gucuggcuucguugg

SEQ ID NO: 2337130 - RNA, 14 nt, Bordetella pertussis
gucugggccaugcc

SEQ ID NO: 2337131 - RNA, 22 nt, Bordetella pertussis
gucugggcgcggaacagccugg

SEQ ID NO: 2337132 - RNA, 21 nt, Bordetella pertussis
gucugggcgugaaaggccagc

SEQ ID NO: 2337133 - RNA, 20 nt, Bordetella pertussis
gucuggucgcacaucagguc

SEQ ID NO: 2337134 - RNA, 20 nt, Bordetella pertussis
gucuggucgcacgacagcau

SEQ ID NO: 2337135 - RNA, 15 nt, Bordetella pertussis
gucuggucuggcaac

SEQ ID NO: 2337136 - RNA, 20 nt, Bordetella pertussis
gucugguuuuucgaagagca

SEQ ID NO: 2337137 - RNA, 13 nt, Bordetella pertussis
gucugugggcggu

SEQ ID NO: 2337138 - RNA, 11 nt, Bordetella pertussis
gucuuccaggc

SEQ ID NO: 2337139 - RNA, 14 nt, Bordetella pertussis
gucuuccaggcgca

SEQ ID NO: 2337140 - RNA, 15 nt, Bordetella pertussis
gucuucggcgcggcg

SEQ ID NO: 2337141 - RNA, 16 nt, Bordetella pertussis
gucuucgguggcccgc

SEQ ID NO: 2337142 - RNA, 19 nt, Bordetella pertussis
gucuugagcggcccgggcg

SEQ ID NO: 2337143 - RNA, 19 nt, Bordetella pertussis
gucuugaggauaucggcca

SEQ ID NO: 2337144 - RNA, 20 nt, Bordetella pertussis
gucuugcccgccagcgcggc

SEQ ID NO: 2337145 - RNA, 21 nt, Bordetella pertussis
gucuugcccgccagcgcggcu

SEQ ID NO: 2337146 - RNA, 18 nt, Bordetella pertussis
gucuugcgcccgcaucgg

SEQ ID NO: 2337147 - RNA, 19 nt, Bordetella pertussis
gucuugcugccguccuugu

SEQ ID NO: 2337148 - RNA, 20 nt, Bordetella pertussis
gucuuugaagggcggcgcgg

SEQ ID NO: 2337149 - RNA, 14 nt, Bordetella pertussis
gugaaacagcauca

SEQ ID NO: 2337150 - RNA, 20 nt, Bordetella pertussis
gugaaacagcaucagcggca

SEQ ID NO: 2337151 - RNA, 15 nt, Bordetella pertussis
gugaaaggccagcgg

SEQ ID NO: 2337152 - RNA, 19 nt, Bordetella pertussis
gugaaagguucggagcacg

SEQ ID NO: 2337153 - RNA, 20 nt, Bordetella pertussis
gugaacaccaggguggcgcc

SEQ ID NO: 2337154 - RNA, 23 nt, Bordetella pertussis
gugaacaccucgaacucgaacgc

SEQ ID NO: 2337155 - RNA, 14 nt, Bordetella pertussis
gugaacgacagcga

SEQ ID NO: 2337156 - RNA, 22 nt, Bordetella pertussis
gugaacgccccggccgaucgcg

SEQ ID NO: 2337157 - RNA, 21 nt, Bordetella pertussis
gugaacggccccgccagggcg

SEQ ID NO: 2337158 - RNA, 15 nt, Bordetella pertussis
gugaacucggggugg

SEQ ID NO: 2337159 - RNA, 16 nt, Bordetella pertussis
gugaagccguccuuga

SEQ ID NO: 2337160 - RNA, 15 nt, Bordetella pertussis
gugaaggcgcccggg

SEQ ID NO: 2337161 - RNA, 17 nt, Bordetella pertussis
gugaaggcgcccgggcu

SEQ ID NO: 2337162 - RNA, 12 nt, Bordetella pertussis
gugaaggugccg

SEQ ID NO: 2337163 - RNA, 14 nt, Bordetella pertussis
gugaagucggcccu

SEQ ID NO: 2337164 - RNA, 16 nt, Bordetella pertussis
gugaauaccgcgcaca

SEQ ID NO: 2337165 - RNA, 14 nt, Bordetella pertussis
gugaccaccaggcc

SEQ ID NO: 2337166 - RNA, 15 nt, Bordetella pertussis
gugaccaccaggccg

SEQ ID NO: 2337167 - RNA, 15 nt, Bordetella pertussis
gugaccacggcgcgc

SEQ ID NO: 2337168 - RNA, 13 nt, Bordetella pertussis
gugacccggggca

SEQ ID NO: 2337169 - RNA, 13 nt, Bordetella pertussis
gugacccgguggc

SEQ ID NO: 2337170 - RNA, 19 nt, Bordetella pertussis
gugaccgacaggccuggcu

SEQ ID NO: 2337171 - RNA, 21 nt, Bordetella pertussis
gugaccgacaggccuggcuug

SEQ ID NO: 2337172 - RNA, 16 nt, Bordetella pertussis
gugaccgccagcaggc

SEQ ID NO: 2337173 - RNA, 18 nt, Bordetella pertussis
gugaccgcguaggccuuc

SEQ ID NO: 2337174 - RNA, 19 nt, Bordetella pertussis
gugaccgcguaggccuuca

SEQ ID NO: 2337175 - RNA, 19 nt, Bordetella pertussis
gugaccggcgugacgcgcg

SEQ ID NO: 2337176 - RNA, 20 nt, Bordetella pertussis
gugaccuggcgcgcgaacgg

SEQ ID NO: 2337177 - RNA, 23 nt, Bordetella pertussis
gugaccuuggucggguccagcac

SEQ ID NO: 2337178 - RNA, 18 nt, Bordetella pertussis
gugacgauauccaggcgc

SEQ ID NO: 2337179 - RNA, 17 nt, Bordetella pertussis
gugacgaugcccgacga

SEQ ID NO: 2337180 - RNA, 19 nt, Bordetella pertussis
gugacgcgcggguccaggc

SEQ ID NO: 2337181 - RNA, 17 nt, Bordetella pertussis
gugacgcuggagauggc

SEQ ID NO: 2337182 - RNA, 22 nt, Bordetella pertussis
gugacgcuggagauggcgccga

SEQ ID NO: 2337183 - RNA, 20 nt, Bordetella pertussis
gugacggauucccagcucca

SEQ ID NO: 2337184 - RNA, 17 nt, Bordetella pertussis
gugacggcggcgcgcgg

SEQ ID NO: 2337185 - RNA, 21 nt, Bordetella pertussis
gugacgggcugggccgaggcg

SEQ ID NO: 2337186 - RNA, 19 nt, Bordetella pertussis
gugacguugagcgccgggg

SEQ ID NO: 2337187 - RNA, 16 nt, Bordetella pertussis
gugacguugccgcgcg

SEQ ID NO: 2337188 - RNA, 17 nt, Bordetella pertussis
gugacguugccgcgcgc

SEQ ID NO: 2337189 - RNA, 22 nt, Bordetella pertussis
gugacguugccgcgcgcguaug

SEQ ID NO: 2337190 - RNA, 22 nt, Bordetella pertussis
gugacuucggccgccagccggc

SEQ ID NO: 2337191 - RNA, 22 nt, Bordetella pertussis
gugagaaaagugaucaccgcca

SEQ ID NO: 2337192 - RNA, 23 nt, Bordetella pertussis
gugagcaagcgcuggauggucac

SEQ ID NO: 2337193 - RNA, 16 nt, Bordetella pertussis
gugagcgccgccgcca

SEQ ID NO: 2337194 - RNA, 14 nt, Bordetella pertussis
gugagcggcacgac

SEQ ID NO: 2337195 - RNA, 18 nt, Bordetella pertussis
gugagcguaagcccacuc

SEQ ID NO: 2337196 - RNA, 22 nt, Bordetella pertussis
gugaggcgacgguggcuggggc

SEQ ID NO: 2337197 - RNA, 17 nt, Bordetella pertussis
gugaggggccagccugg

SEQ ID NO: 2337198 - RNA, 15 nt, Bordetella pertussis
gugagugcagcgcuc

SEQ ID NO: 2337199 - RNA, 23 nt, Bordetella pertussis
gugaucaugccgcugaccagcac

SEQ ID NO: 2337200 - RNA, 17 nt, Bordetella pertussis
gugauccacugcagcag

SEQ ID NO: 2337201 - RNA, 20 nt, Bordetella pertussis
gugaucgacaacaagccggg

SEQ ID NO: 2337202 - RNA, 15 nt, Bordetella pertussis
gugaucgaccgccag

SEQ ID NO: 2337203 - RNA, 17 nt, Bordetella pertussis
gugaucgaccgccagca

SEQ ID NO: 2337204 - RNA, 18 nt, Bordetella pertussis
gugaucgaguaggccggc

SEQ ID NO: 2337205 - RNA, 19 nt, Bordetella pertussis
gugaucgaguaggccggca

SEQ ID NO: 2337206 - RNA, 20 nt, Bordetella pertussis
gugaucgaguaggccggcac

SEQ ID NO: 2337207 - RNA, 15 nt, Bordetella pertussis
gugaucgcgcgggcu

SEQ ID NO: 2337208 - RNA, 16 nt, Bordetella pertussis
gugaucuugccgaugc

SEQ ID NO: 2337209 - RNA, 10 nt, Bordetella pertussis
gugaugccga

SEQ ID NO: 2337210 - RNA, 15 nt, Bordetella pertussis
gugaugcgcgcggcc

SEQ ID NO: 2337211 - RNA, 20 nt, Bordetella pertussis
gugaugcgcgcggccagcgc

SEQ ID NO: 2337212 - RNA, 16 nt, Bordetella pertussis
gugauggacgccgggu

SEQ ID NO: 2337213 - RNA, 20 nt, Bordetella pertussis
gugauggauuucgaccgcau

SEQ ID NO: 2337214 - RNA, 22 nt, Bordetella pertussis
gugauggcguagccguccucgc

SEQ ID NO: 2337215 - RNA, 13 nt, Bordetella pertussis
gugaugggcgcau

SEQ ID NO: 2337216 - RNA, 15 nt, Bordetella pertussis
gugaugggcgcaucc

SEQ ID NO: 2337217 - RNA, 15 nt, Bordetella pertussis
gugauggggccgggc

SEQ ID NO: 2337218 - RNA, 16 nt, Bordetella pertussis
gugaugucgccgguca

SEQ ID NO: 2337219 - RNA, 13 nt, Bordetella pertussis
gugaugucgccgu

SEQ ID NO: 2337220 - RNA, 15 nt, Bordetella pertussis
gugcaagcggccggc

SEQ ID NO: 2337221 - RNA, 17 nt, Bordetella pertussis
gugcaaggugaacgauu

SEQ ID NO: 2337222 - RNA, 16 nt, Bordetella pertussis
augccgcagcaccaca

SEQ ID NO: 2337223 - RNA, 22 nt, Bordetella pertussis
augccgcagcaccacaucgccg

SEQ ID NO: 2337224 - RNA, 22 nt, Bordetella pertussis
augccgcaguugaacacgcggu

SEQ ID NO: 2337225 - RNA, 15 nt, Bordetella pertussis
augccgccaucaucc

SEQ ID NO: 2337226 - RNA, 18 nt, Bordetella pertussis
augccgccaugcagcugg

SEQ ID NO: 2337227 - RNA, 19 nt, Bordetella pertussis
augccgccaugcgccagca

SEQ ID NO: 2337228 - RNA, 21 nt, Bordetella pertussis
augccgcccacgaucaccacg

SEQ ID NO: 2337229 - RNA, 12 nt, Bordetella pertussis
augccgcccgca

SEQ ID NO: 2337230 - RNA, 22 nt, Bordetella pertussis
augccgcccgcaaggaccaugc

SEQ ID NO: 2337231 - RNA, 13 nt, Bordetella pertussis
augccgcccgugc

SEQ ID NO: 2337232 - RNA, 22 nt, Bordetella pertussis
augccgccgaaccagcgcacca

SEQ ID NO: 2337233 - RNA, 10 nt, Bordetella pertussis
augccgcgca

SEQ ID NO: 2337234 - RNA, 15 nt, Bordetella pertussis
augccgcgcaccugg

SEQ ID NO: 2337235 - RNA, 19 nt, Bordetella pertussis
augccgcgcaccugggcgu

SEQ ID NO: 2337236 - RNA, 14 nt, Bordetella pertussis
augccgcgcccgcc

SEQ ID NO: 2337237 - RNA, 16 nt, Bordetella pertussis
augccgcgcccgccuu

SEQ ID NO: 2337238 - RNA, 11 nt, Bordetella pertussis
augccgcgcgc

SEQ ID NO: 2337239 - RNA, 19 nt, Bordetella pertussis
augccgcgggcggcgccgg

SEQ ID NO: 2337240 - RNA, 20 nt, Bordetella pertussis
augccgcgggcggcgccggc

SEQ ID NO: 2337241 - RNA, 17 nt, Bordetella pertussis
augccgcgguggcgggc

SEQ ID NO: 2337242 - RNA, 16 nt, Bordetella pertussis
augccgcgguugcggu

SEQ ID NO: 2337243 - RNA, 17 nt, Bordetella pertussis
augccgcgguugcgguu

SEQ ID NO: 2337244 - RNA, 16 nt, Bordetella pertussis
augccgcugaccagca

SEQ ID NO: 2337245 - RNA, 17 nt, Bordetella pertussis
augccgcugaccagcac

SEQ ID NO: 2337246 - RNA, 19 nt, Bordetella pertussis
augccgcuggcgauggccu

SEQ ID NO: 2337247 - RNA, 20 nt, Bordetella pertussis
augccgcuggcgauggccug

SEQ ID NO: 2337248 - RNA, 19 nt, Bordetella pertussis
augccggaacaggcgccua

SEQ ID NO: 2337249 - RNA, 23 nt, Bordetella pertussis
augccggcauaggcggcgcaggc

SEQ ID NO: 2337250 - RNA, 12 nt, Bordetella pertussis
augccggccagc

SEQ ID NO: 2337251 - RNA, 13 nt, Bordetella pertussis
augccggccagca

SEQ ID NO: 2337252 - RNA, 17 nt, Bordetella pertussis
augccggccagcagcga

SEQ ID NO: 2337253 - RNA, 21 nt, Bordetella pertussis
augccggccagcagcgacggc

SEQ ID NO: 2337254 - RNA, 23 nt, Bordetella pertussis
augccggccagcagcgacggccc

SEQ ID NO: 2337255 - RNA, 21 nt, Bordetella pertussis
augccggccgauagccgcggc

SEQ ID NO: 2337256 - RNA, 13 nt, Bordetella pertussis
augccggcgcugc

SEQ ID NO: 2337257 - RNA, 18 nt, Bordetella pertussis
augccggcgcugcgcagc

SEQ ID NO: 2337258 - RNA, 13 nt, Bordetella pertussis
augccggcggcgc

SEQ ID NO: 2337259 - RNA, 15 nt, Bordetella pertussis
augccggcggcgccu

SEQ ID NO: 2337260 - RNA, 23 nt, Bordetella pertussis
augccggcguucuggucagccgu

SEQ ID NO: 2337261 - RNA, 22 nt, Bordetella pertussis
augccggucaggaugcgcgcca

SEQ ID NO: 2337262 - RNA, 15 nt, Bordetella pertussis
augccgguucgggcg

SEQ ID NO: 2337263 - RNA, 19 nt, Bordetella pertussis
augccguacacguugggga

SEQ ID NO: 2337264 - RNA, 20 nt, Bordetella pertussis
augccguaccaggugcgcau

SEQ ID NO: 2337265 - RNA, 21 nt, Bordetella pertussis
augccguaccaguacaccggc

SEQ ID NO: 2337266 - RNA, 16 nt, Bordetella pertussis
augccguccacgccca

SEQ ID NO: 2337267 - RNA, 17 nt, Bordetella pertussis
augccguccacgcccag

SEQ ID NO: 2337268 - RNA, 16 nt, Bordetella pertussis
augccguccacgccgc

SEQ ID NO: 2337269 - RNA, 20 nt, Bordetella pertussis
augccguccacgccgcgcgc

SEQ ID NO: 2337270 - RNA, 19 nt, Bordetella pertussis
augccguccugcugcggca

SEQ ID NO: 2337271 - RNA, 15 nt, Bordetella pertussis
augccguccuggccg

SEQ ID NO: 2337272 - RNA, 14 nt, Bordetella pertussis
augccgucgaaggc

SEQ ID NO: 2337273 - RNA, 22 nt, Bordetella pertussis
augccgucgagcgcggccaggc

SEQ ID NO: 2337274 - RNA, 20 nt, Bordetella pertussis
augccgucgccgcccacggc

SEQ ID NO: 2337275 - RNA, 13 nt, Bordetella pertussis
augccgucggccu

SEQ ID NO: 2337276 - RNA, 14 nt, Bordetella pertussis
augccgucggccug

SEQ ID NO: 2337277 - RNA, 15 nt, Bordetella pertussis
augccgucggccugg

SEQ ID NO: 2337278 - RNA, 18 nt, Bordetella pertussis
augccgucuggcggcagc

SEQ ID NO: 2337279 - RNA, 21 nt, Bordetella pertussis
augccgucuggcggcagcucg

SEQ ID NO: 2337280 - RNA, 21 nt, Bordetella pertussis
augccguggacgugcgcgacc

SEQ ID NO: 2337281 - RNA, 18 nt, Bordetella pertussis
augccguuggccgcgaag

SEQ ID NO: 2337282 - RNA, 15 nt, Bordetella pertussis
augccuauuggcugu

SEQ ID NO: 2337283 - RNA, 21 nt, Bordetella pertussis
augccucgaagcggcucaggc

SEQ ID NO: 2337284 - RNA, 20 nt, Bordetella pertussis
augccugguuagagcagcgg

SEQ ID NO: 2337285 - RNA, 20 nt, Bordetella pertussis
augccugucccgcacgcagc

SEQ ID NO: 2337286 - RNA, 15 nt, Bordetella pertussis
augccuucgacggcg

SEQ ID NO: 2337287 - RNA, 23 nt, Bordetella pertussis
augccuugguggggucgaugcca

SEQ ID NO: 2337288 - RNA, 14 nt, Bordetella pertussis
augcgaaagcggcc

SEQ ID NO: 2337289 - RNA, 16 nt, Bordetella pertussis
augcgaaagcggccag

SEQ ID NO: 2337290 - RNA, 15 nt, Bordetella pertussis
augcgacagcgacag

SEQ ID NO: 2337291 - RNA, 11 nt, Bordetella pertussis
aguccagcacc

SEQ ID NO: 2337292 - RNA, 16 nt, Bordetella pertussis
aguccagcaccggcug

SEQ ID NO: 2337293 - RNA, 13 nt, Bordetella pertussis
aguccagcgcgcc

SEQ ID NO: 2337294 - RNA, 15 nt, Bordetella pertussis
aguccaggccggccu

SEQ ID NO: 2337295 - RNA, 20 nt, Bordetella pertussis
aguccaggguguccuggucg

SEQ ID NO: 2337296 - RNA, 18 nt, Bordetella pertussis
agucccagccggcccccu

SEQ ID NO: 2337297 - RNA, 17 nt, Bordetella pertussis
agucccaggaucaccgc

SEQ ID NO: 2337298 - RNA, 20 nt, Bordetella pertussis
agucccaguccggcagcacc

SEQ ID NO: 2337299 - RNA, 16 nt, Bordetella pertussis
aguccccaugcggccc

SEQ ID NO: 2337300 - RNA, 22 nt, Bordetella pertussis
aguccccauguggggacaggca

SEQ ID NO: 2337301 - RNA, 20 nt, Bordetella pertussis
agucccccugcggggacagg

SEQ ID NO: 2337302 - RNA, 19 nt, Bordetella pertussis
aguccccgcagggacaggc

SEQ ID NO: 2337303 - RNA, 20 nt, Bordetella pertussis
aguccccgcagggacaggcu

SEQ ID NO: 2337304 - RNA, 22 nt, Bordetella pertussis
aguccccgcauggggacuggcg

SEQ ID NO: 2337305 - RNA, 22 nt, Bordetella pertussis
aguccccguucggggacaggca

SEQ ID NO: 2337306 - RNA, 23 nt, Bordetella pertussis
aguccccugcggggacaggcacc

SEQ ID NO: 2337307 - RNA, 19 nt, Bordetella pertussis
aguccgaaucuucgaugcg

SEQ ID NO: 2337308 - RNA, 16 nt, Bordetella pertussis
aguccgacaggcagac

SEQ ID NO: 2337309 - RNA, 21 nt, Bordetella pertussis
aguccgagcccgggcgugccu

SEQ ID NO: 2337310 - RNA, 13 nt, Bordetella pertussis
aguccgcagcgca

SEQ ID NO: 2337311 - RNA, 14 nt, Bordetella pertussis
aguccgcagcgcag

SEQ ID NO: 2337312 - RNA, 19 nt, Bordetella pertussis
aguccgcagcgcagcgcca

SEQ ID NO: 2337313 - RNA, 23 nt, Bordetella pertussis
aguccgcagcgcagcgccacgcu

SEQ ID NO: 2337314 - RNA, 17 nt, Bordetella pertussis
aguccgcccagccaggc

SEQ ID NO: 2337315 - RNA, 18 nt, Bordetella pertussis
aguccgcccagccaggcg

SEQ ID NO: 2337316 - RNA, 20 nt, Bordetella pertussis
aguccgcccagccaggcgcc

SEQ ID NO: 2337317 - RNA, 22 nt, Bordetella pertussis
aguccgcgcucgcccagccgcc

SEQ ID NO: 2337318 - RNA, 14 nt, Bordetella pertussis
aguccggcgccgcc

SEQ ID NO: 2337319 - RNA, 19 nt, Bordetella pertussis
aguccgguauccuggcgcg

SEQ ID NO: 2337320 - RNA, 20 nt, Bordetella pertussis
aguccgguauccuggcgcgg

SEQ ID NO: 2337321 - RNA, 21 nt, Bordetella pertussis
aguccucaugcgggacaggcg

SEQ ID NO: 2337322 - RNA, 13 nt, Bordetella pertussis
aguccucuacugg

SEQ ID NO: 2337323 - RNA, 16 nt, Bordetella pertussis
aguccucuacuggcug

SEQ ID NO: 2337324 - RNA, 17 nt, Bordetella pertussis
aguccucuacuggcuga

SEQ ID NO: 2337325 - RNA, 18 nt, Bordetella pertussis
aguccugcaucgccaugc

SEQ ID NO: 2337326 - RNA, 14 nt, Bordetella pertussis
aguccugcaugcca

SEQ ID NO: 2337327 - RNA, 19 nt, Bordetella pertussis
aguccugcgaucaguucgg

SEQ ID NO: 2337328 - RNA, 18 nt, Bordetella pertussis
aguccugguuggccucgc

SEQ ID NO: 2337329 - RNA, 22 nt, Bordetella pertussis
aguccugguuggccucgcgcuc

SEQ ID NO: 2337330 - RNA, 19 nt, Bordetella pertussis
aguccuucagccgcugacu

SEQ ID NO: 2337331 - RNA, 14 nt, Bordetella pertussis
agucgaaccagccg

SEQ ID NO: 2337332 - RNA, 20 nt, Bordetella pertussis
agucgacgcugaucggccga

SEQ ID NO: 2337333 - RNA, 13 nt, Bordetella pertussis
agucgagcaccgc

SEQ ID NO: 2337334 - RNA, 14 nt, Bordetella pertussis
agucgagcaccgcg

SEQ ID NO: 2337335 - RNA, 17 nt, Bordetella pertussis
agucgagcaccgcgcgg

SEQ ID NO: 2337336 - RNA, 20 nt, Bordetella pertussis
agucgaugaaggcgccgacu

SEQ ID NO: 2337337 - RNA, 18 nt, Bordetella pertussis
agucgcaguucggccuca

SEQ ID NO: 2337338 - RNA, 13 nt, Bordetella pertussis
agucgccgcgccc

SEQ ID NO: 2337339 - RNA, 17 nt, Bordetella pertussis
agucgccgcugccgggc

SEQ ID NO: 2337340 - RNA, 18 nt, Bordetella pertussis
agucgccgcugccgggcu

SEQ ID NO: 2337341 - RNA, 19 nt, Bordetella pertussis
agucgccggcuuccagcag

SEQ ID NO: 2337342 - RNA, 21 nt, Bordetella pertussis
agucgccggcuuccagcagca

SEQ ID NO: 2337343 - RNA, 22 nt, Bordetella pertussis
agucgcgcagcaccucggggcg

SEQ ID NO: 2337344 - RNA, 15 nt, Bordetella pertussis
agucgcgcagccaca

SEQ ID NO: 2337345 - RNA, 18 nt, Bordetella pertussis
agucggaguagggcagcg

SEQ ID NO: 2337346 - RNA, 16 nt, Bordetella pertussis
agucggccuggcgcuc

SEQ ID NO: 2337347 - RNA, 19 nt, Bordetella pertussis
agucggcgcccagcuccac

SEQ ID NO: 2337348 - RNA, 13 nt, Bordetella pertussis
agucggcgccgcg

SEQ ID NO: 2337349 - RNA, 15 nt, Bordetella pertussis
agucggcgccgcgca

SEQ ID NO: 2337350 - RNA, 14 nt, Bordetella pertussis
agucggcgcgcgcu

SEQ ID NO: 2337351 - RNA, 21 nt, Bordetella pertussis
agucgggcaccagcacuucga

SEQ ID NO: 2337352 - RNA, 18 nt, Bordetella pertussis
agucggggccgcagcugg

SEQ ID NO: 2337353 - RNA, 15 nt, Bordetella pertussis
agucggggcgccggu

SEQ ID NO: 2337354 - RNA, 15 nt, Bordetella pertussis
agucggucgccgcag

SEQ ID NO: 2337355 - RNA, 19 nt, Bordetella pertussis
agucggucgccgcaguucc

SEQ ID NO: 2337356 - RNA, 20 nt, Bordetella pertussis
agucguauucggaccagggc

SEQ ID NO: 2337357 - RNA, 22 nt, Bordetella pertussis
agucguccagcacgcggcgcag

SEQ ID NO: 2337358 - RNA, 14 nt, Bordetella pertussis
agucgucgaaggcg

SEQ ID NO: 2337359 - RNA, 16 nt, Bordetella pertussis
agucgucgaaggcgcg

SEQ ID NO: 2337360 - RNA, 21 nt, Bordetella pertussis
agucgugcaggauggcgucga

SEQ ID NO: 2337361 - RNA, 22 nt, Bordetella pertussis
agugcaggccgcgcagcacgcc

SEQ ID NO: 2337362 - RNA, 11 nt, Bordetella pertussis
agugcaggggg

SEQ ID NO: 2337363 - RNA, 14 nt, Bordetella pertussis
agugcccaggcccg

SEQ ID NO: 2337364 - RNA, 16 nt, Bordetella pertussis
agugcccaggcccgug

SEQ ID NO: 2337365 - RNA, 21 nt, Bordetella pertussis
agugcccccacgcugcgcccg

SEQ ID NO: 2337366 - RNA, 22 nt, Bordetella pertussis
agugcccugacccgcuggcugg

SEQ ID NO: 2337367 - RNA, 19 nt, Bordetella pertussis
agugccugcgaacgcccgg

SEQ ID NO: 2337368 - RNA, 20 nt, Bordetella pertussis
agugccuggacgcgcuggcc

SEQ ID NO: 2337369 - RNA, 22 nt, Bordetella pertussis
agugccuggacgcgcuggccga

SEQ ID NO: 2337370 - RNA, 17 nt, Bordetella pertussis
agugcgaggacgaccuu

SEQ ID NO: 2337371 - RNA, 23 nt, Bordetella pertussis
agugcgaggacgaccuugcugga

SEQ ID NO: 2337372 - RNA, 17 nt, Bordetella pertussis
agugcgccggcgcggcg

SEQ ID NO: 2337373 - RNA, 15 nt, Bordetella pertussis
agugcgccuggcuga

SEQ ID NO: 2337374 - RNA, 20 nt, Bordetella pertussis
agugcggcgccagcugggcg

SEQ ID NO: 2337375 - RNA, 13 nt, Bordetella pertussis
agugcucgggcug

SEQ ID NO: 2337376 - RNA, 14 nt, Bordetella pertussis
agugcuggcccgcc

SEQ ID NO: 2337377 - RNA, 18 nt, Bordetella pertussis
agugcuggcccgccagca

SEQ ID NO: 2337378 - RNA, 23 nt, Bordetella pertussis
agugcuggcccgccagcaaggcg

SEQ ID NO: 2337379 - RNA, 22 nt, Bordetella pertussis
agugcuucgagauccgccggcg

SEQ ID NO: 2337380 - RNA, 23 nt, Bordetella pertussis
aguggaaccgcgguacgcgggca

SEQ ID NO: 2337381 - RNA, 21 nt, Bordetella pertussis
aguggccguagagggucuggc

SEQ ID NO: 2337382 - RNA, 11 nt, Bordetella pertussis
aguggcggcgg

SEQ ID NO: 2337383 - RNA, 22 nt, Bordetella pertussis
aguggcucaugguuucgagcau

SEQ ID NO: 2337384 - RNA, 16 nt, Bordetella pertussis
agugggcugcggcgug

SEQ ID NO: 2337385 - RNA, 16 nt, Bordetella pertussis
agugguaugaccggcg

SEQ ID NO: 2337386 - RNA, 21 nt, Bordetella pertussis
agugguaugaccggcgcggcc

SEQ ID NO: 2337387 - RNA, 14 nt, Bordetella pertussis
aguggucgccggcg

SEQ ID NO: 2337388 - RNA, 20 nt, Bordetella pertussis
agugguggugcagcggcagc

SEQ ID NO: 2337389 - RNA, 21 nt, Bordetella pertussis
agugguggugcagcggcagca

SEQ ID NO: 2337390 - RNA, 16 nt, Bordetella pertussis
agugguguagccagga

SEQ ID NO: 2337391 - RNA, 20 nt, Bordetella pertussis
agugguucaucgggccggcg

SEQ ID NO: 2337392 - RNA, 17 nt, Bordetella pertussis
aguucagcagcgccacg

SEQ ID NO: 2337393 - RNA, 13 nt, Bordetella pertussis
aguucagccacac

SEQ ID NO: 2337394 - RNA, 17 nt, Bordetella pertussis
aguucaucaucgccgac

SEQ ID NO: 2337395 - RNA, 14 nt, Bordetella pertussis
aguucauccacagc

SEQ ID NO: 2337396 - RNA, 22 nt, Bordetella pertussis
aguuccaggcauucccgcccag

SEQ ID NO: 2337397 - RNA, 15 nt, Bordetella pertussis
aguucccagcgcgcg

SEQ ID NO: 2337398 - RNA, 15 nt, Bordetella pertussis
aguuccgugcgcgcc

SEQ ID NO: 2337399 - RNA, 16 nt, Bordetella pertussis
aguucgccggcgccgu

SEQ ID NO: 2337400 - RNA, 14 nt, Bordetella pertussis
aguucgcggccggc

SEQ ID NO: 2337401 - RNA, 16 nt, Bordetella pertussis
aguucgcggccggccg

SEQ ID NO: 2337402 - RNA, 22 nt, Bordetella pertussis
aguucgcugcgaaacagcagcg

SEQ ID NO: 2337403 - RNA, 23 nt, Bordetella pertussis
aguucggagcgguugaaauccuu

SEQ ID NO: 2337404 - RNA, 16 nt, Bordetella pertussis
aguucggccagcggca

SEQ ID NO: 2337405 - RNA, 14 nt, Bordetella pertussis
aucgaagccgggcg

SEQ ID NO: 2337406 - RNA, 21 nt, Bordetella pertussis
aucgaaggcagcgcggccggc

SEQ ID NO: 2337407 - RNA, 16 nt, Bordetella pertussis
aucgaauggucggccu

SEQ ID NO: 2337408 - RNA, 20 nt, Bordetella pertussis
aucgaauuugaacagccgcc

SEQ ID NO: 2337409 - RNA, 12 nt, Bordetella pertussis
aucgacaagcgc

SEQ ID NO: 2337410 - RNA, 14 nt, Bordetella pertussis
aucgacagcgcgcc

SEQ ID NO: 2337411 - RNA, 18 nt, Bordetella pertussis
aucgacaugcccgccggc

SEQ ID NO: 2337412 - RNA, 14 nt, Bordetella pertussis
aucgacaugcuggc

SEQ ID NO: 2337413 - RNA, 17 nt, Bordetella pertussis
aucgaccaggaccugua

SEQ ID NO: 2337414 - RNA, 18 nt, Bordetella pertussis
aucgacccaggccggcgc

SEQ ID NO: 2337415 - RNA, 19 nt, Bordetella pertussis
aucgaccgcauagcgcaug

SEQ ID NO: 2337416 - RNA, 17 nt, Bordetella pertussis
aucgacgcgauguccag

SEQ ID NO: 2337417 - RNA, 18 nt, Bordetella pertussis
aucgacgcgauguccagc

SEQ ID NO: 2337418 - RNA, 12 nt, Bordetella pertussis
aucgacgcgcgu

SEQ ID NO: 2337419 - RNA, 16 nt, Bordetella pertussis
aucgacgcggcgacgu

SEQ ID NO: 2337420 - RNA, 19 nt, Bordetella pertussis
aucgacgggcggcugccag

SEQ ID NO: 2337421 - RNA, 14 nt, Bordetella pertussis
aucgacgucggccu

SEQ ID NO: 2337422 - RNA, 15 nt, Bordetella pertussis
aucgacgucggccuc

SEQ ID NO: 2337423 - RNA, 16 nt, Bordetella pertussis
aucgacuuggccuggu

SEQ ID NO: 2337424 - RNA, 14 nt, Bordetella pertussis
aucgagaaguuggc

SEQ ID NO: 2337425 - RNA, 13 nt, Bordetella pertussis
aucgagcaccgcc

SEQ ID NO: 2337426 - RNA, 20 nt, Bordetella pertussis
aucgagcauugccgcggcaa

SEQ ID NO: 2337427 - RNA, 20 nt, Bordetella pertussis
aucgagcgccugggcggcca

SEQ ID NO: 2337428 - RNA, 17 nt, Bordetella pertussis
aucgaggcguucggcca

SEQ ID NO: 2337429 - RNA, 22 nt, Bordetella pertussis
aucgagggcgucaucggcgcgc

SEQ ID NO: 2337430 - RNA, 16 nt, Bordetella pertussis
aucgagguggcgggcg

SEQ ID NO: 2337431 - RNA, 17 nt, Bordetella pertussis
aucgagguggcgggcga

SEQ ID NO: 2337432 - RNA, 18 nt, Bordetella pertussis
aucgagguuuccgccaug

SEQ ID NO: 2337433 - RNA, 23 nt, Bordetella pertussis
aucgaguggugcgcgguccaugc

SEQ ID NO: 2337434 - RNA, 18 nt, Bordetella pertussis
aucgauaccaacugccug

SEQ ID NO: 2337435 - RNA, 16 nt, Bordetella pertussis
aucgauaugggcggcc

SEQ ID NO: 2337436 - RNA, 15 nt, Bordetella pertussis
aucgaucagcgcgcc

SEQ ID NO: 2337437 - RNA, 23 nt, Bordetella pertussis
aucgaugaagaucaggcggcugc

SEQ ID NO: 2337438 - RNA, 18 nt, Bordetella pertussis
aucgaugcgccgcaccag

SEQ ID NO: 2337439 - RNA, 16 nt, Bordetella pertussis
aucgcagcagaaugua

SEQ ID NO: 2337440 - RNA, 14 nt, Bordetella pertussis
aucgcaucgcggca

SEQ ID NO: 2337441 - RNA, 18 nt, Bordetella pertussis
aucgcaugcgguuucuca

SEQ ID NO: 2337442 - RNA, 15 nt, Bordetella pertussis
aucgccaacgucggc

SEQ ID NO: 2337443 - RNA, 21 nt, Bordetella pertussis
aucgccaacgucggcagccag

SEQ ID NO: 2337444 - RNA, 14 nt, Bordetella pertussis
aucgccagcaggcg

SEQ ID NO: 2337445 - RNA, 11 nt, Bordetella pertussis
aucgccaggac

SEQ ID NO: 2337446 - RNA, 16 nt, Bordetella pertussis
aucgccaggcgcgugc

SEQ ID NO: 2337447 - RNA, 14 nt, Bordetella pertussis
aucgccaugccggc

SEQ ID NO: 2337448 - RNA, 15 nt, Bordetella pertussis
aucgccaugccggcc

SEQ ID NO: 2337449 - RNA, 12 nt, Bordetella pertussis
aucgccaugcug

SEQ ID NO: 2337450 - RNA, 13 nt, Bordetella pertussis
aucgccaugcugc

SEQ ID NO: 2337451 - RNA, 14 nt, Bordetella pertussis
aucgccaugcugcc

SEQ ID NO: 2337452 - RNA, 22 nt, Bordetella pertussis
aucgccauggccacgacgagag

SEQ ID NO: 2337453 - RNA, 13 nt, Bordetella pertussis
aucgcccggcgcc

SEQ ID NO: 2337454 - RNA, 14 nt, Bordetella pertussis
aucgcccggcgcca

SEQ ID NO: 2337455 - RNA, 20 nt, Bordetella pertussis
aucgcccgggcgccggcacg

SEQ ID NO: 2337456 - RNA, 22 nt, Bordetella pertussis
aucgcccugaaaaccaaggagu

SEQ ID NO: 2337457 - RNA, 23 nt, Bordetella pertussis
aucgcccugaaaaccaaggaguc

SEQ ID NO: 2337458 - RNA, 11 nt, Bordetella pertussis
aucgccgaaca

SEQ ID NO: 2337459 - RNA, 18 nt, Bordetella pertussis
aucgccgaagucggcgcg

SEQ ID NO: 2337460 - RNA, 19 nt, Bordetella pertussis
aucgccgacgaugucgccg

SEQ ID NO: 2337461 - RNA, 14 nt, Bordetella pertussis
aucgccgacgcgcc

SEQ ID NO: 2337462 - RNA, 21 nt, Bordetella pertussis
aucgccgagccgcugucgcag

SEQ ID NO: 2337463 - RNA, 15 nt, Bordetella pertussis
aucgccgaucggcaa

SEQ ID NO: 2337464 - RNA, 18 nt, Bordetella pertussis
aucgccgcaugggcgcgc

SEQ ID NO: 2337465 - RNA, 23 nt, Bordetella pertussis
aucgccgcaugggcgcgcccggc

SEQ ID NO: 2337466 - RNA, 11 nt, Bordetella pertussis
aucgccgccga

SEQ ID NO: 2337467 - RNA, 12 nt, Bordetella pertussis
aucgccgccgaa

SEQ ID NO: 2337468 - RNA, 15 nt, Bordetella pertussis
aucgccgccgccggc

SEQ ID NO: 2337469 - RNA, 11 nt, Bordetella pertussis
aucgccgccgg

SEQ ID NO: 2337470 - RNA, 18 nt, Bordetella pertussis
aucgccgccugcaucacg

SEQ ID NO: 2337471 - RNA, 16 nt, Bordetella pertussis
aucgccgcggcgggcg

SEQ ID NO: 2337472 - RNA, 19 nt, Bordetella pertussis
aucgccgcugaugcuggca

SEQ ID NO: 2337473 - RNA, 21 nt, Bordetella pertussis
aucgccggcgcccccagcagc

SEQ ID NO: 2337474 - RNA, 22 nt, Bordetella pertussis
aucgccggcgcccccagcagcg

SEQ ID NO: 2337475 - RNA, 17 nt, Bordetella pertussis
aucgccgguagcgcugg

SEQ ID NO: 2337476 - RNA, 20 nt, Bordetella pertussis
aucgccgguagcgcugggcg

SEQ ID NO: 2337477 - RNA, 20 nt, Bordetella pertussis
aucgccucguauucgcccgg

SEQ ID NO: 2337478 - RNA, 13 nt, Bordetella pertussis
aucgccuggggca

SEQ ID NO: 2337479 - RNA, 22 nt, Bordetella pertussis
aucgccuggggcgggcgcugcg

SEQ ID NO: 2337480 - RNA, 17 nt, Bordetella pertussis
aucgcgaugcgcagcag

SEQ ID NO: 2337481 - RNA, 16 nt, Bordetella pertussis
aucgcgcaagggccag

SEQ ID NO: 2337482 - RNA, 16 nt, Bordetella pertussis
aucgcgcagcaccgcc

SEQ ID NO: 2337483 - RNA, 18 nt, Bordetella pertussis
aucgcgcagcaccgccag

SEQ ID NO: 2337484 - RNA, 14 nt, Bordetella pertussis
aucgcgcagcgccu

SEQ ID NO: 2337485 - RNA, 16 nt, Bordetella pertussis
aucgcgcagcgccugg

SEQ ID NO: 2337486 - RNA, 18 nt, Bordetella pertussis
aucgcgcagcgccuggcc

SEQ ID NO: 2337487 - RNA, 15 nt, Bordetella pertussis
aucgcgcauggcgau

SEQ ID NO: 2337488 - RNA, 22 nt, Bordetella pertussis
aucgcgcauuucgaacaaggcg

SEQ ID NO: 2337489 - RNA, 21 nt, Bordetella pertussis
aucgcgccagcgccgcgcgcg

SEQ ID NO: 2337490 - RNA, 13 nt, Bordetella pertussis
aucgcgccaggcg

SEQ ID NO: 2337491 - RNA, 13 nt, Bordetella pertussis
aucgcgccggccu

SEQ ID NO: 2337492 - RNA, 15 nt, Bordetella pertussis
aucgcgccggccugg

SEQ ID NO: 2337493 - RNA, 22 nt, Bordetella pertussis
aucgcgccggccugggcggcgg

SEQ ID NO: 2337494 - RNA, 19 nt, Bordetella pertussis
aucgcgcgccgccgcccgc

SEQ ID NO: 2337495 - RNA, 24 nt, Bordetella pertussis
aucgcgcgccgccgcccgcacgaa

SEQ ID NO: 2337496 - RNA, 14 nt, Bordetella pertussis
aucgcgcuggcgcg

SEQ ID NO: 2337497 - RNA, 15 nt, Bordetella pertussis
aucgcgcuggcgcgc

SEQ ID NO: 2337498 - RNA, 21 nt, Bordetella pertussis
aucgcgcuggcgcgcgacggc

SEQ ID NO: 2337499 - RNA, 12 nt, Bordetella pertussis
aucgcggcagcc

SEQ ID NO: 2337500 - RNA, 19 nt, Bordetella pertussis
aucgcggcagcccggcacg

SEQ ID NO: 2337501 - RNA, 21 nt, Bordetella pertussis
aucgcggcagcccggcacguc

SEQ ID NO: 2337502 - RNA, 18 nt, Bordetella pertussis
aucgcggcgcaggcgggc

SEQ ID NO: 2337503 - RNA, 13 nt, Bordetella pertussis
aucgcggcgcggc

SEQ ID NO: 2337504 - RNA, 15 nt, Bordetella pertussis
aucgcggcgcggcgc

SEQ ID NO: 2337505 - RNA, 14 nt, Bordetella pertussis
aucgcggcgcggcu

SEQ ID NO: 2337506 - RNA, 21 nt, Bordetella pertussis
aucgcggcgcggcuuucgccg

SEQ ID NO: 2337507 - RNA, 14 nt, Bordetella pertussis
augcgcgaaguggc

SEQ ID NO: 2337508 - RNA, 17 nt, Bordetella pertussis
augcgcgagccgcccac

SEQ ID NO: 2337509 - RNA, 12 nt, Bordetella pertussis
augcgcgagcgc

SEQ ID NO: 2337510 - RNA, 13 nt, Bordetella pertussis
augcgcgccagca

SEQ ID NO: 2337511 - RNA, 13 nt, Bordetella pertussis
augcgcgccaggc

SEQ ID NO: 2337512 - RNA, 14 nt, Bordetella pertussis
augcgcgccaggcu

SEQ ID NO: 2337513 - RNA, 22 nt, Bordetella pertussis
augcgcgccaggcugucgucgu

SEQ ID NO: 2337514 - RNA, 12 nt, Bordetella pertussis
augcgcgccagu

SEQ ID NO: 2337515 - RNA, 19 nt, Bordetella pertussis
augcgcgccccgucggccg

SEQ ID NO: 2337516 - RNA, 21 nt, Bordetella pertussis
augcgcgccccgucggccguc

SEQ ID NO: 2337517 - RNA, 17 nt, Bordetella pertussis
augcgcgccgcucuugg

SEQ ID NO: 2337518 - RNA, 13 nt, Bordetella pertussis
augcgcgcgcgga

SEQ ID NO: 2337519 - RNA, 18 nt, Bordetella pertussis
augcgcgcgcgggccagc

SEQ ID NO: 2337520 - RNA, 14 nt, Bordetella pertussis
augcgcgcggccag

SEQ ID NO: 2337521 - RNA, 15 nt, Bordetella pertussis
augcgcgcggccagc

SEQ ID NO: 2337522 - RNA, 14 nt, Bordetella pertussis
augcgcgcggccuc

SEQ ID NO: 2337523 - RNA, 21 nt, Bordetella pertussis
augcgcgcggcucgccgcgca

SEQ ID NO: 2337524 - RNA, 22 nt, Bordetella pertussis
augcgcgcggcucgccgcgcac

SEQ ID NO: 2337525 - RNA, 14 nt, Bordetella pertussis
augcgcggcacguc

SEQ ID NO: 2337526 - RNA, 14 nt, Bordetella pertussis
augcgcggcccggc

SEQ ID NO: 2337527 - RNA, 16 nt, Bordetella pertussis
augcgcggcgggacgg

SEQ ID NO: 2337528 - RNA, 16 nt, Bordetella pertussis
augcgcggggccaggc

SEQ ID NO: 2337529 - RNA, 17 nt, Bordetella pertussis
augcgcggggccaggcg

SEQ ID NO: 2337530 - RNA, 21 nt, Bordetella pertussis
augcgcgucuccagcgccggc

SEQ ID NO: 2337531 - RNA, 22 nt, Bordetella pertussis
augcgcgucuccagcgccggca

SEQ ID NO: 2337532 - RNA, 23 nt, Bordetella pertussis
augcgcguugccggugcgcgugg

SEQ ID NO: 2337533 - RNA, 18 nt, Bordetella pertussis
augcgcguuggccugacc

SEQ ID NO: 2337534 - RNA, 22 nt, Bordetella pertussis
augcgcucgguccagacgggcu

SEQ ID NO: 2337535 - RNA, 13 nt, Bordetella pertussis
augcgcugcugga

SEQ ID NO: 2337536 - RNA, 22 nt, Bordetella pertussis
augcgcugcuggaggccggcgu

SEQ ID NO: 2337537 - RNA, 14 nt, Bordetella pertussis
augcgcuggccggc

SEQ ID NO: 2337538 - RNA, 17 nt, Bordetella pertussis
augcgcuggccggccgc

SEQ ID NO: 2337539 - RNA, 17 nt, Bordetella pertussis
augcgcugggccaggcc

SEQ ID NO: 2337540 - RNA, 19 nt, Bordetella pertussis
augcgcuggucgcgcagca

SEQ ID NO: 2337541 - RNA, 22 nt, Bordetella pertussis
augcgcuggucgcgcagcacga

SEQ ID NO: 2337542 - RNA, 16 nt, Bordetella pertussis
augcgcuugccgccca

SEQ ID NO: 2337543 - RNA, 19 nt, Bordetella pertussis
augcgcuugucgccgcugc

SEQ ID NO: 2337544 - RNA, 22 nt, Bordetella pertussis
augcgcuugucgccgcugcgcu

SEQ ID NO: 2337545 - RNA, 16 nt, Bordetella pertussis
augcggacgccagccc

SEQ ID NO: 2337546 - RNA, 21 nt, Bordetella pertussis
augcggaugaacgaccagcac

SEQ ID NO: 2337547 - RNA, 20 nt, Bordetella pertussis
augcggcacaaccuggcgcg

SEQ ID NO: 2337548 - RNA, 21 nt, Bordetella pertussis
augcggcacaaccuggcgcgc

SEQ ID NO: 2337549 - RNA, 13 nt, Bordetella pertussis
augcggcagcagg

SEQ ID NO: 2337550 - RNA, 16 nt, Bordetella pertussis
augcggcagcagggcc

SEQ ID NO: 2337551 - RNA, 20 nt, Bordetella pertussis
augcggcagcagggccacgc

SEQ ID NO: 2337552 - RNA, 13 nt, Bordetella pertussis
augcggccaggcc

SEQ ID NO: 2337553 - RNA, 14 nt, Bordetella pertussis
augcggcccgcgcu

SEQ ID NO: 2337554 - RNA, 22 nt, Bordetella pertussis
augcggccgucgccgcccaugc

SEQ ID NO: 2337555 - RNA, 17 nt, Bordetella pertussis
augcggccuucgccggu

SEQ ID NO: 2337556 - RNA, 13 nt, Bordetella pertussis
augcggcgcaugc

SEQ ID NO: 2337557 - RNA, 16 nt, Bordetella pertussis
augcggcgcaugcugc

SEQ ID NO: 2337558 - RNA, 22 nt, Bordetella pertussis
augcggcgcaugcugcgcgagg

SEQ ID NO: 2337559 - RNA, 15 nt, Bordetella pertussis
augcggcgccacgca

SEQ ID NO: 2337560 - RNA, 18 nt, Bordetella pertussis
augcggcgcccaggccca

SEQ ID NO: 2337561 - RNA, 21 nt, Bordetella pertussis
augcggcgcccaggcccagcg

SEQ ID NO: 2337562 - RNA, 17 nt, Bordetella pertussis
augcggcgccugucccg

SEQ ID NO: 2337563 - RNA, 13 nt, Bordetella pertussis
augcggcgcgccg

SEQ ID NO: 2337564 - RNA, 19 nt, Bordetella pertussis
augcggcgcgccgcgucgg

SEQ ID NO: 2337565 - RNA, 19 nt, Bordetella pertussis
augcggcggcgcuggccug

SEQ ID NO: 2337566 - RNA, 15 nt, Bordetella pertussis
augcggcguccugcc

SEQ ID NO: 2337567 - RNA, 13 nt, Bordetella pertussis
augcgggacaggc

SEQ ID NO: 2337568 - RNA, 13 nt, Bordetella pertussis
augcgggccacgc

SEQ ID NO: 2337569 - RNA, 15 nt, Bordetella pertussis
augcgggccacgccg

SEQ ID NO: 2337570 - RNA, 17 nt, Bordetella pertussis
augcgggccacgccggc

SEQ ID NO: 2337571 - RNA, 13 nt, Bordetella pertussis
augcgggcggcgg

SEQ ID NO: 2337572 - RNA, 14 nt, Bordetella pertussis
augcgggcggcggu

SEQ ID NO: 2337573 - RNA, 15 nt, Bordetella pertussis
augcggggacaggca

SEQ ID NO: 2337574 - RNA, 11 nt, Bordetella pertussis
augcggggacu

SEQ ID NO: 2337575 - RNA, 20 nt, Bordetella pertussis
augcggggacuggcaccagg

SEQ ID NO: 2337576 - RNA, 13 nt, Bordetella pertussis
augcggggcggcg

SEQ ID NO: 2337577 - RNA, 16 nt, Bordetella pertussis
augcgggucaaggcgg

SEQ ID NO: 2337578 - RNA, 13 nt, Bordetella pertussis
augcgggucaggc

SEQ ID NO: 2337579 - RNA, 19 nt, Bordetella pertussis
augcgggucaggccgccgu

SEQ ID NO: 2337580 - RNA, 16 nt, Bordetella pertussis
augcugcucggccaug

SEQ ID NO: 2337581 - RNA, 15 nt, Bordetella pertussis
augcuggagauguuc

SEQ ID NO: 2337582 - RNA, 22 nt, Bordetella pertussis
augcuggcccagcugggcggcg

SEQ ID NO: 2337583 - RNA, 15 nt, Bordetella pertussis
augcuggccgccgcg

SEQ ID NO: 2337584 - RNA, 20 nt, Bordetella pertussis
augcugggcgggcugguggu

SEQ ID NO: 2337585 - RNA, 23 nt, Bordetella pertussis
augcuggucgccaucugcugcga

SEQ ID NO: 2337586 - RNA, 21 nt, Bordetella pertussis
auggaacucguuggccagcgc

SEQ ID NO: 2337587 - RNA, 15 nt, Bordetella pertussis
auggaagcggcagac

SEQ ID NO: 2337588 - RNA, 20 nt, Bordetella pertussis
auggaaucauuggccagcgc

SEQ ID NO: 2337589 - RNA, 21 nt, Bordetella pertussis
auggaaucgucgaccagcagc

SEQ ID NO: 2337590 - RNA, 21 nt, Bordetella pertussis
auggacacagcggcgcgagcg

SEQ ID NO: 2337591 - RNA, 14 nt, Bordetella pertussis
auggacagcaccga

SEQ ID NO: 2337592 - RNA, 15 nt, Bordetella pertussis
auggaccgccgccgu

SEQ ID NO: 2337593 - RNA, 20 nt, Bordetella pertussis
auggacgagggccggcgcca

SEQ ID NO: 2337594 - RNA, 21 nt, Bordetella pertussis
auggacgagggccggcgccag

SEQ ID NO: 2337595 - RNA, 15 nt, Bordetella pertussis
auggagaccggcgcc

SEQ ID NO: 2337596 - RNA, 20 nt, Bordetella pertussis
auggagaccggcgccugcgg

SEQ ID NO: 2337597 - RNA, 15 nt, Bordetella pertussis
auggaggcgcagcgc

SEQ ID NO: 2337598 - RNA, 16 nt, Bordetella pertussis
auggaggggcgcaggc

SEQ ID NO: 2337599 - RNA, 19 nt, Bordetella pertussis
auggagucggucagccuga

SEQ ID NO: 2337600 - RNA, 20 nt, Bordetella pertussis
auggagucggucagccugau

SEQ ID NO: 2337601 - RNA, 13 nt, Bordetella pertussis
auggaugcgcgcc

SEQ ID NO: 2337602 - RNA, 17 nt, Bordetella pertussis
auggauucgcgccggcc

SEQ ID NO: 2337603 - RNA, 18 nt, Bordetella pertussis
auggauucgcgccggccg

SEQ ID NO: 2337604 - RNA, 13 nt, Bordetella pertussis
auggcacagcgcg

SEQ ID NO: 2337605 - RNA, 18 nt, Bordetella pertussis
auggcagcagaucggcgg

SEQ ID NO: 2337606 - RNA, 19 nt, Bordetella pertussis
auggcaggguccgucggau

SEQ ID NO: 2337607 - RNA, 15 nt, Bordetella pertussis
auggcaugaaaaagg

SEQ ID NO: 2337608 - RNA, 23 nt, Bordetella pertussis
auggcaugaaaaagggcgcacca

SEQ ID NO: 2337609 - RNA, 15 nt, Bordetella pertussis
auggcaugcaccgcg

SEQ ID NO: 2337610 - RNA, 16 nt, Bordetella pertussis
auggcauggggcaggc

SEQ ID NO: 2337611 - RNA, 17 nt, Bordetella pertussis
auggcauggggcaggcg

SEQ ID NO: 2337612 - RNA, 14 nt, Bordetella pertussis
auggccacgaccac

SEQ ID NO: 2337613 - RNA, 19 nt, Bordetella pertussis
auggccacgaccaccagcg

SEQ ID NO: 2337614 - RNA, 20 nt, Bordetella pertussis
auggccagcacauacgccgc

SEQ ID NO: 2337615 - RNA, 13 nt, Bordetella pertussis
auggccagcagcg

SEQ ID NO: 2337616 - RNA, 20 nt, Bordetella pertussis
auggccagcagcgccgccag

SEQ ID NO: 2337617 - RNA, 22 nt, Bordetella pertussis
auggccagcagcgccgccagca

SEQ ID NO: 2337618 - RNA, 14 nt, Bordetella pertussis
auggccagcgcgca

SEQ ID NO: 2337619 - RNA, 14 nt, Bordetella pertussis
auggccagcgcgcg

SEQ ID NO: 2337620 - RNA, 20 nt, Bordetella pertussis
auggccagggaggaacuggg

SEQ ID NO: 2337621 - RNA, 23 nt, Bordetella pertussis
auggccagguacaggccgccggu

SEQ ID NO: 2337622 - RNA, 15 nt, Bordetella pertussis
auggccaucgacgcc

SEQ ID NO: 2337623 - RNA, 16 nt, Bordetella pertussis
auggccaucgcggucc

SEQ ID NO: 2337624 - RNA, 13 nt, Bordetella pertussis
auggcccagggca

SEQ ID NO: 2337625 - RNA, 22 nt, Bordetella pertussis
auggcccgccaccacggcgcgg

SEQ ID NO: 2337626 - RNA, 23 nt, Bordetella pertussis
auggcccgccccgggcaggagcg

SEQ ID NO: 2337627 - RNA, 23 nt, Bordetella pertussis
auggcccgggugaucaguccgac

SEQ ID NO: 2337628 - RNA, 20 nt, Bordetella pertussis
auggccgaaucguucacgcc

SEQ ID NO: 2337629 - RNA, 18 nt, Bordetella pertussis
auggccgaaugcccgccc

SEQ ID NO: 2337630 - RNA, 16 nt, Bordetella pertussis
auggccgccagcggcu

SEQ ID NO: 2337631 - RNA, 17 nt, Bordetella pertussis
auggccgcgcccagcgc

SEQ ID NO: 2337632 - RNA, 18 nt, Bordetella pertussis
auggccgcgcgcagcgag

SEQ ID NO: 2337633 - RNA, 21 nt, Bordetella pertussis
auggccgcgcggcgccugccu

SEQ ID NO: 2337634 - RNA, 13 nt, Bordetella pertussis
auggccggcgcga

SEQ ID NO: 2337635 - RNA, 16 nt, Bordetella pertussis
auggccggggcgucgu

SEQ ID NO: 2337636 - RNA, 17 nt, Bordetella pertussis
auggccgguucgaugac

SEQ ID NO: 2337637 - RNA, 21 nt, Bordetella pertussis
auggccguggcgugcaggccg

SEQ ID NO: 2337638 - RNA, 23 nt, Bordetella pertussis
auggccguggcgugcaggccggc

SEQ ID NO: 2337639 - RNA, 23 nt, Bordetella pertussis
auggccguuggccagcgccgcca

SEQ ID NO: 2337640 - RNA, 22 nt, Bordetella pertussis
auggccucgcugccagggugca

SEQ ID NO: 2337641 - RNA, 23 nt, Bordetella pertussis
auggccucgucgaccacgccggc

SEQ ID NO: 2337642 - RNA, 12 nt, Bordetella pertussis
auggccugcagg

SEQ ID NO: 2337643 - RNA, 20 nt, Bordetella pertussis
auggccuggaugugcaggcc

SEQ ID NO: 2337644 - RNA, 15 nt, Bordetella pertussis
auggccugugcggcc

SEQ ID NO: 2337645 - RNA, 15 nt, Bordetella pertussis
auggcgaucgaacgc

SEQ ID NO: 2337646 - RNA, 20 nt, Bordetella pertussis
auggcgaucgaacgcggcca

SEQ ID NO: 2337647 - RNA, 19 nt, Bordetella pertussis
auggcgaugaccucggcga

SEQ ID NO: 2337648 - RNA, 17 nt, Bordetella pertussis
auggcgauguaggccag

SEQ ID NO: 2337649 - RNA, 16 nt, Bordetella pertussis
auggcgcaggcgcgcc

SEQ ID NO: 2337650 - RNA, 18 nt, Bordetella pertussis
auggcgcaggcgcgcgcc

SEQ ID NO: 2337651 - RNA, 20 nt, Bordetella pertussis
auggcgccaccuucgccgcg

SEQ ID NO: 2337652 - RNA, 19 nt, Bordetella pertussis
auggcgccagcccgcccgc

SEQ ID NO: 2337653 - RNA, 15 nt, Bordetella pertussis
auggcgccaugcgac

SEQ ID NO: 2337654 - RNA, 20 nt, Bordetella pertussis
auggcgccaugcgacagccc

SEQ ID NO: 2337655 - RNA, 16 nt, Bordetella pertussis
auggcgcccacggccg

SEQ ID NO: 2337656 - RNA, 18 nt, Bordetella pertussis
auggcgccgcgccgccgc

SEQ ID NO: 2337657 - RNA, 23 nt, Bordetella pertussis
auggcgccggccagcgcgccggc

SEQ ID NO: 2337658 - RNA, 16 nt, Bordetella pertussis
auggcgccggcggccu

SEQ ID NO: 2337659 - RNA, 17 nt, Bordetella pertussis
auggcgccggcggccuc

SEQ ID NO: 2337660 - RNA, 17 nt, Bordetella pertussis
auggcgcgcagcacaua

SEQ ID NO: 2337661 - RNA, 17 nt, Bordetella pertussis
auggcgcgccggccggu

SEQ ID NO: 2337662 - RNA, 12 nt, Bordetella pertussis
auggcgcgcgcc

SEQ ID NO: 2337663 - RNA, 19 nt, Bordetella pertussis
auggcgcgcgccagcggcu

SEQ ID NO: 2337664 - RNA, 15 nt, Bordetella pertussis
auggcgcgcggcugg

SEQ ID NO: 2337665 - RNA, 19 nt, Bordetella pertussis
auggcgcgcggcuggggcu

SEQ ID NO: 2337666 - RNA, 15 nt, Bordetella pertussis
auggcgcgcgggccc

SEQ ID NO: 2337667 - RNA, 20 nt, Bordetella pertussis
auggcgcgucgccgcgccgu

SEQ ID NO: 2337668 - RNA, 19 nt, Bordetella pertussis
auggcgcgugcgcgcgcca

SEQ ID NO: 2337669 - RNA, 16 nt, Bordetella pertussis
auggcgcuccagcccu

SEQ ID NO: 2337670 - RNA, 18 nt, Bordetella pertussis
auggcgcuggcaggcgcc

SEQ ID NO: 2337671 - RNA, 23 nt, Bordetella pertussis
auggcgcuguuggccggcgcgcc

SEQ ID NO: 2337672 - RNA, 19 nt, Bordetella pertussis
auggcgcuugugcgucggc

SEQ ID NO: 2337673 - RNA, 18 nt, Bordetella pertussis
auggcggaugcgccacaa

SEQ ID NO: 2337674 - RNA, 20 nt, Bordetella pertussis
auggcggcaacgugcaggcc

SEQ ID NO: 2337675 - RNA, 18 nt, Bordetella pertussis
auggcggcaggcgcgagg

SEQ ID NO: 2337676 - RNA, 12 nt, Bordetella pertussis
auggcggccagc

SEQ ID NO: 2337677 - RNA, 23 nt, Bordetella pertussis
auggcggccagcuugaccgccag

SEQ ID NO: 2337678 - RNA, 12 nt, Bordetella pertussis
auggcggccagg

SEQ ID NO: 2337679 - RNA, 14 nt, Bordetella pertussis
auggcggccaggcg

SEQ ID NO: 2337680 - RNA, 13 nt, Bordetella pertussis
auggcggccaggg

SEQ ID NO: 2337681 - RNA, 14 nt, Bordetella pertussis
auggcggccagggc

SEQ ID NO: 2337682 - RNA, 20 nt, Bordetella pertussis
auggcggccgccagcgccau

SEQ ID NO: 2337683 - RNA, 21 nt, Bordetella pertussis
auggcggccgccagcgccaug

SEQ ID NO: 2337684 - RNA, 21 nt, Bordetella pertussis
auggcggcgaugccgcugucg

SEQ ID NO: 2337685 - RNA, 13 nt, Bordetella pertussis
auggcggcgccga

SEQ ID NO: 2337686 - RNA, 13 nt, Bordetella pertussis
auggcggcgcugg

SEQ ID NO: 2337687 - RNA, 13 nt, Bordetella pertussis
auggcggcggcca

SEQ ID NO: 2337688 - RNA, 14 nt, Bordetella pertussis
auggcggcggcguc

SEQ ID NO: 2337689 - RNA, 15 nt, Bordetella pertussis
auggcggggauggag

SEQ ID NO: 2337690 - RNA, 16 nt, Bordetella pertussis
auggcggggauggagu

SEQ ID NO: 2337691 - RNA, 16 nt, Bordetella pertussis
augugccaccgcccag

SEQ ID NO: 2337692 - RNA, 18 nt, Bordetella pertussis
augugccaccgcccaggc

SEQ ID NO: 2337693 - RNA, 21 nt, Bordetella pertussis
augugcgagagcuccagccgg

SEQ ID NO: 2337694 - RNA, 16 nt, Bordetella pertussis
augugcgcgggcgcgg

SEQ ID NO: 2337695 - RNA, 23 nt, Bordetella pertussis
augugcucgggacgcaggcccau

SEQ ID NO: 2337696 - RNA, 20 nt, Bordetella pertussis
augugcugacggugccggcc

SEQ ID NO: 2337697 - RNA, 18 nt, Bordetella pertussis
augugcugcggcagccag

SEQ ID NO: 2337698 - RNA, 14 nt, Bordetella pertussis
auguggggacaggc

SEQ ID NO: 2337699 - RNA, 15 nt, Bordetella pertussis
auguggggacaggca

SEQ ID NO: 2337700 - RNA, 13 nt, Bordetella pertussis
auguggggguugu

SEQ ID NO: 2337701 - RNA, 16 nt, Bordetella pertussis
auguggucggcgccga

SEQ ID NO: 2337702 - RNA, 18 nt, Bordetella pertussis
auguucagcuucagccug

SEQ ID NO: 2337703 - RNA, 13 nt, Bordetella pertussis
auguucaggccau

SEQ ID NO: 2337704 - RNA, 20 nt, Bordetella pertussis
auguucaggccaugcugggc

SEQ ID NO: 2337705 - RNA, 14 nt, Bordetella pertussis
auguucuggucucc

SEQ ID NO: 2337706 - RNA, 13 nt, Bordetella pertussis
auguugccgccgg

SEQ ID NO: 2337707 - RNA, 22 nt, Bordetella pertussis
auguugcuuggcgucagcgugc

SEQ ID NO: 2337708 - RNA, 19 nt, Bordetella pertussis
auguuguguacuccuaucu

SEQ ID NO: 2337709 - RNA, 21 nt, Bordetella pertussis
auguuguuggucgccacgcca

SEQ ID NO: 2337710 - RNA, 12 nt, Bordetella pertussis
auuaccagcaac

SEQ ID NO: 2337711 - RNA, 14 nt, Bordetella pertussis
auuagggcccagcu

SEQ ID NO: 2337712 - RNA, 17 nt, Bordetella pertussis
auuagggcccagcugca

SEQ ID NO: 2337713 - RNA, 16 nt, Bordetella pertussis
auuccaccuugccgcu

SEQ ID NO: 2337714 - RNA, 12 nt, Bordetella pertussis
auuccagccagg

SEQ ID NO: 2337715 - RNA, 14 nt, Bordetella pertussis
auuccagccaggcc

SEQ ID NO: 2337716 - RNA, 14 nt, Bordetella pertussis
auuccagcgccgcc

SEQ ID NO: 2337717 - RNA, 19 nt, Bordetella pertussis
auuccagcgccgccuucac

SEQ ID NO: 2337718 - RNA, 18 nt, Bordetella pertussis
auucccgcccugacgccu

SEQ ID NO: 2337719 - RNA, 16 nt, Bordetella pertussis
auucccuggcgcgcca

SEQ ID NO: 2337720 - RNA, 17 nt, Bordetella pertussis
auuccugggugcugccg

SEQ ID NO: 2337721 - RNA, 18 nt, Bordetella pertussis
auuccugucgcgcugcuu

SEQ ID NO: 2337722 - RNA, 22 nt, Bordetella pertussis
auuccugucgcgcugcuuuccc

SEQ ID NO: 2337723 - RNA, 17 nt, Bordetella pertussis
auucgaacaacagcgcc

SEQ ID NO: 2337724 - RNA, 19 nt, Bordetella pertussis
auucgaacaacagcgccug

SEQ ID NO: 2337725 - RNA, 16 nt, Bordetella pertussis
auucgcgcggcgacac

SEQ ID NO: 2337726 - RNA, 20 nt, Bordetella pertussis
auucgcgcuggcgcgagaac

SEQ ID NO: 2337727 - RNA, 15 nt, Bordetella pertussis
auucggaccagggcu

SEQ ID NO: 2337728 - RNA, 22 nt, Bordetella pertussis
auucggccacuuucgcgcgcgc

SEQ ID NO: 2337729 - RNA, 11 nt, Bordetella pertussis
auucggccagg

SEQ ID NO: 2337730 - RNA, 21 nt, Bordetella pertussis
auucggcgcgcucggcgccgg

SEQ ID NO: 2337731 - RNA, 14 nt, Bordetella pertussis
auucggcggccggc

SEQ ID NO: 2337732 - RNA, 22 nt, Bordetella pertussis
auucggcggugaugucgccggu

SEQ ID NO: 2337733 - RNA, 19 nt, Bordetella pertussis
auucgucgcugccgcgcga

SEQ ID NO: 2337734 - RNA, 18 nt, Bordetella pertussis
auucguuggugcccagcg

SEQ ID NO: 2337735 - RNA, 15 nt, Bordetella pertussis
auucucaccagcgca

SEQ ID NO: 2337736 - RNA, 17 nt, Bordetella pertussis
auucucgcccugcuggc

SEQ ID NO: 2337737 - RNA, 16 nt, Bordetella pertussis
auucugcugcaugccg

SEQ ID NO: 2337738 - RNA, 18 nt, Bordetella pertussis
auugacggcgcucuuggu

SEQ ID NO: 2337739 - RNA, 15 nt, Bordetella pertussis
auugaucgaucagcc

SEQ ID NO: 2337740 - RNA, 13 nt, Bordetella pertussis
auugaugcagcac

SEQ ID NO: 2337741 - RNA, 19 nt, Bordetella pertussis
auugcagggugucggccag

SEQ ID NO: 2337742 - RNA, 14 nt, Bordetella pertussis
auugcaucgcagca

SEQ ID NO: 2337743 - RNA, 14 nt, Bordetella pertussis
auugcccaccacgg

SEQ ID NO: 2337744 - RNA, 13 nt, Bordetella pertussis
auugcccagguug

SEQ ID NO: 2337745 - RNA, 13 nt, Bordetella pertussis
auugccccagcac

SEQ ID NO: 2337746 - RNA, 16 nt, Bordetella pertussis
auugcccuucggggca

SEQ ID NO: 2337747 - RNA, 16 nt, Bordetella pertussis
auugccgcacgaucgc

SEQ ID NO: 2337748 - RNA, 20 nt, Bordetella pertussis
auugccgcacgaucgcgccg

SEQ ID NO: 2337749 - RNA, 14 nt, Bordetella pertussis
auugccgccgcgca

SEQ ID NO: 2337750 - RNA, 22 nt, Bordetella pertussis
auugccgccgcugccggccgac

SEQ ID NO: 2337751 - RNA, 16 nt, Bordetella pertussis
auugccggagcagcag

SEQ ID NO: 2337752 - RNA, 17 nt, Bordetella pertussis
auugccggagcagcagc

SEQ ID NO: 2337753 - RNA, 22 nt, Bordetella pertussis
auugccgucggccgcgcccauu

SEQ ID NO: 2337754 - RNA, 16 nt, Bordetella pertussis
auugcgacgccgccga

SEQ ID NO: 2337755 - RNA, 23 nt, Bordetella pertussis
auugcgccagcgcuguccaggcc

SEQ ID NO: 2337756 - RNA, 14 nt, Bordetella pertussis
auugcgcggccagg

SEQ ID NO: 2337757 - RNA, 15 nt, Bordetella pertussis
auugcgcggccaggg

SEQ ID NO: 2337758 - RNA, 17 nt, Bordetella pertussis
auugcgcguauccagca

SEQ ID NO: 2337759 - RNA, 18 nt, Bordetella pertussis
auugcggcccgcggccuu

SEQ ID NO: 2337760 - RNA, 22 nt, Bordetella pertussis
auugcgguacaggucguagacc

SEQ ID NO: 2337761 - RNA, 19 nt, Bordetella pertussis
auugcgguccaggaagcgc

SEQ ID NO: 2337762 - RNA, 14 nt, Bordetella pertussis
auugcggugcccuu

SEQ ID NO: 2337763 - RNA, 13 nt, Bordetella pertussis
auugcgucagggc

SEQ ID NO: 2337764 - RNA, 16 nt, Bordetella pertussis
auugcugcugcuggcu

SEQ ID NO: 2337765 - RNA, 15 nt, Bordetella pertussis
auugcuugacgccgc

SEQ ID NO: 2337766 - RNA, 11 nt, Bordetella pertussis
auugcuugccg

SEQ ID NO: 2337767 - RNA, 22 nt, Bordetella pertussis
auuggacagcaguucggccggc

SEQ ID NO: 2337768 - RNA, 19 nt, Bordetella pertussis
auuggaguaguggcccaag

SEQ ID NO: 2337769 - RNA, 15 nt, Bordetella pertussis
auuggcccugcuggg

SEQ ID NO: 2337770 - RNA, 12 nt, Bordetella pertussis
auuggccgccgc

SEQ ID NO: 2337771 - RNA, 17 nt, Bordetella pertussis
auuggcgaaaggcaccg

SEQ ID NO: 2337772 - RNA, 19 nt, Bordetella pertussis
auuggcgaacgugcgcgcc

SEQ ID NO: 2337773 - RNA, 19 nt, Bordetella pertussis
auuggcggcggcguucagg

SEQ ID NO: 2337774 - RNA, 19 nt, Bordetella pertussis
auuggcgucggccgccgug

SEQ ID NO: 2337775 - RNA, 19 nt, Bordetella pertussis
auuggcuguaucuggccug

SEQ ID NO: 2337776 - RNA, 22 nt, Bordetella pertussis
auuggcuguaucuggccugucu

SEQ ID NO: 2337777 - RNA, 16 nt, Bordetella pertussis
auugggacgccagccc

SEQ ID NO: 2337778 - RNA, 23 nt, Bordetella pertussis
auugggacgccagcccgccggcg

SEQ ID NO: 2337779 - RNA, 19 nt, Bordetella pertussis
auugggcggcaucucgcgg

SEQ ID NO: 2337780 - RNA, 17 nt, Bordetella pertussis
caauaucggcacccgca

SEQ ID NO: 2337781 - RNA, 13 nt, Bordetella pertussis
caaucagccccag

SEQ ID NO: 2337782 - RNA, 15 nt, Bordetella pertussis
caaucaugcgcugcu

SEQ ID NO: 2337783 - RNA, 19 nt, Bordetella pertussis
caaucaugcgcugcuggcc

SEQ ID NO: 2337784 - RNA, 19 nt, Bordetella pertussis
caaucccggcgacaccgcg

SEQ ID NO: 2337785 - RNA, 18 nt, Bordetella pertussis
caauccgcccguugcggc

SEQ ID NO: 2337786 - RNA, 21 nt, Bordetella pertussis
caauccgccgccagcacgcca

SEQ ID NO: 2337787 - RNA, 20 nt, Bordetella pertussis
caauccgcgaagugccuguc

SEQ ID NO: 2337788 - RNA, 20 nt, Bordetella pertussis
caauccgucaggcagcaacc

SEQ ID NO: 2337789 - RNA, 18 nt, Bordetella pertussis
caaucgacgaacaaggcc

SEQ ID NO: 2337790 - RNA, 15 nt, Bordetella pertussis
caaucgaugaagauc

SEQ ID NO: 2337791 - RNA, 22 nt, Bordetella pertussis
caaucgaugaucacgcgcuccg

SEQ ID NO: 2337792 - RNA, 17 nt, Bordetella pertussis
caaucggcgugcagcaa

SEQ ID NO: 2337793 - RNA, 23 nt, Bordetella pertussis
caaucgggcagcacgcgcaccag

SEQ ID NO: 2337794 - RNA, 16 nt, Bordetella pertussis
caaucugaucaucuuc

SEQ ID NO: 2337795 - RNA, 20 nt, Bordetella pertussis
caaucugcgucgccuggucg

SEQ ID NO: 2337796 - RNA, 14 nt, Bordetella pertussis
caaucuugccaggc

SEQ ID NO: 2337797 - RNA, 17 nt, Bordetella pertussis
caaucuugccaggcccg

SEQ ID NO: 2337798 - RNA, 13 nt, Bordetella pertussis
caaucuugccgcc

SEQ ID NO: 2337799 - RNA, 19 nt, Bordetella pertussis
caaugaagggcugcaaggc

SEQ ID NO: 2337800 - RNA, 20 nt, Bordetella pertussis
caaugacauccucgggcgac

SEQ ID NO: 2337801 - RNA, 20 nt, Bordetella pertussis
caaugccaaucaugcgcugc

SEQ ID NO: 2337802 - RNA, 22 nt, Bordetella pertussis
caaugccagggugaccuggcgc

SEQ ID NO: 2337803 - RNA, 15 nt, Bordetella pertussis
caaugcgcaggcccg

SEQ ID NO: 2337804 - RNA, 17 nt, Bordetella pertussis
caaugcgcaggcccgac

SEQ ID NO: 2337805 - RNA, 16 nt, Bordetella pertussis
caaugcggccaggccc

SEQ ID NO: 2337806 - RNA, 13 nt, Bordetella pertussis
caagcgcuggaug

SEQ ID NO: 2337807 - RNA, 21 nt, Bordetella pertussis
caagcggcaggcggcagaagg

SEQ ID NO: 2337808 - RNA, 20 nt, Bordetella pertussis
caagcggccccagguagacc

SEQ ID NO: 2337809 - RNA, 22 nt, Bordetella pertussis
caagcggccccagucgcugcuc

SEQ ID NO: 2337810 - RNA, 17 nt, Bordetella pertussis
caagcggcccgcgcccu

SEQ ID NO: 2337811 - RNA, 21 nt, Bordetella pertussis
caagcggcguggggccggccg

SEQ ID NO: 2337812 - RNA, 20 nt, Bordetella pertussis
caagcguacguaccaggccg

SEQ ID NO: 2337813 - RNA, 12 nt, Bordetella pertussis
cacagcccggcc

SEQ ID NO: 2337814 - RNA, 16 nt, Bordetella pertussis
cacagcccggccccca

SEQ ID NO: 2337815 - RNA, 11 nt, Bordetella pertussis
cacagccgcag

SEQ ID NO: 2337816 - RNA, 15 nt, Bordetella pertussis
cacagccgccauacc

SEQ ID NO: 2337817 - RNA, 21 nt, Bordetella pertussis
cacagccggggcgagcgcagc

SEQ ID NO: 2337818 - RNA, 16 nt, Bordetella pertussis
cacagcgccaucgcgc

SEQ ID NO: 2337819 - RNA, 17 nt, Bordetella pertussis
cacagcgccaucgcgcg

SEQ ID NO: 2337820 - RNA, 19 nt, Bordetella pertussis
cacagcgcgcaacuccagc

SEQ ID NO: 2337821 - RNA, 20 nt, Bordetella pertussis
cacagcgugacggcggcgcg

SEQ ID NO: 2337822 - RNA, 18 nt, Bordetella pertussis
cacaggccaucggcgcca

SEQ ID NO: 2337823 - RNA, 20 nt, Bordetella pertussis
cacaggcccgcgcggccagc

SEQ ID NO: 2337824 - RNA, 21 nt, Bordetella pertussis
cacaggccuucguugaccgcu

SEQ ID NO: 2337825 - RNA, 18 nt, Bordetella pertussis
cacaggcgcuugccauaa

SEQ ID NO: 2337826 - RNA, 16 nt, Bordetella pertussis
cacaggcggcgccggc

SEQ ID NO: 2337827 - RNA, 20 nt, Bordetella pertussis
cacagggcgaaggccagcgc

SEQ ID NO: 2337828 - RNA, 21 nt, Bordetella pertussis
cacagggcgaaggccagcgcc

SEQ ID NO: 2337829 - RNA, 22 nt, Bordetella pertussis
cacagggcgaaggccagcgccu

SEQ ID NO: 2337830 - RNA, 20 nt, Bordetella pertussis
cacagggggacuggcacccg

SEQ ID NO: 2337831 - RNA, 19 nt, Bordetella pertussis
cacagggggucuggcaccu

SEQ ID NO: 2337832 - RNA, 20 nt, Bordetella pertussis
cacagggucaaggcgcggcc

SEQ ID NO: 2337833 - RNA, 15 nt, Bordetella pertussis
cacaggguggcgccc

SEQ ID NO: 2337834 - RNA, 20 nt, Bordetella pertussis
cacagguagaucagccgcug

SEQ ID NO: 2337835 - RNA, 14 nt, Bordetella pertussis
cacaggugcgcggc

SEQ ID NO: 2337836 - RNA, 17 nt, Bordetella pertussis
cacaggugcgcggcgcg

SEQ ID NO: 2337837 - RNA, 19 nt, Bordetella pertussis
cacaggugcgcggcgcgcc

SEQ ID NO: 2337838 - RNA, 22 nt, Bordetella pertussis
cacaggugcgcggcgcgccguc

SEQ ID NO: 2337839 - RNA, 14 nt, Bordetella pertussis
cacagguuggccgc

SEQ ID NO: 2337840 - RNA, 17 nt, Bordetella pertussis
cacagguuggccgcgac

SEQ ID NO: 2337841 - RNA, 21 nt, Bordetella pertussis
cacaguacuuguugcgugccg

SEQ ID NO: 2337842 - RNA, 18 nt, Bordetella pertussis
cacagucggucgccgcag

SEQ ID NO: 2337843 - RNA, 15 nt, Bordetella pertussis
cacaguucggccagc

SEQ ID NO: 2337844 - RNA, 20 nt, Bordetella pertussis
cacaguucggccagcggcag

SEQ ID NO: 2337845 - RNA, 17 nt, Bordetella pertussis
cacaguucgugcaccag

SEQ ID NO: 2337846 - RNA, 16 nt, Bordetella pertussis
cacaguugcaggccau

SEQ ID NO: 2337847 - RNA, 14 nt, Bordetella pertussis
cacauacaaggcgc

SEQ ID NO: 2337848 - RNA, 18 nt, Bordetella pertussis
cacauacagcggagccgc

SEQ ID NO: 2337849 - RNA, 20 nt, Bordetella pertussis
cacauacagcggagccgcgc

SEQ ID NO: 2337850 - RNA, 16 nt, Bordetella pertussis
cacauagcccggcgcg

SEQ ID NO: 2337851 - RNA, 16 nt, Bordetella pertussis
cacauagcgcaagccc

SEQ ID NO: 2337852 - RNA, 14 nt, Bordetella pertussis
cacauaggccggca

SEQ ID NO: 2337853 - RNA, 15 nt, Bordetella pertussis
cacauaggccggcac

SEQ ID NO: 2337854 - RNA, 23 nt, Bordetella pertussis
cacaucaggucgaccugcuugcc

SEQ ID NO: 2337855 - RNA, 14 nt, Bordetella pertussis
cacauccagcgcca

SEQ ID NO: 2337856 - RNA, 17 nt, Bordetella pertussis
cacauccagcgccagca

SEQ ID NO: 2337857 - RNA, 23 nt, Bordetella pertussis
cacauccagcgccagcaccggca

SEQ ID NO: 2337858 - RNA, 23 nt, Bordetella pertussis
cacaucgaauuugaacagccgcc

SEQ ID NO: 2337859 - RNA, 24 nt, Bordetella pertussis
cacaucgaauuugaacagccgccc

SEQ ID NO: 2337860 - RNA, 14 nt, Bordetella pertussis
cacaucgcccggca

SEQ ID NO: 2337861 - RNA, 16 nt, Bordetella pertussis
cacaucgcccggcagg

SEQ ID NO: 2337862 - RNA, 18 nt, Bordetella pertussis
cacaucgcccggcagguc

SEQ ID NO: 2337863 - RNA, 14 nt, Bordetella pertussis
cacaucgccggcgg

SEQ ID NO: 2337864 - RNA, 15 nt, Bordetella pertussis
cacaucgccggcggc

SEQ ID NO: 2337865 - RNA, 22 nt, Bordetella pertussis
cacaucgccggcggcguggccg

SEQ ID NO: 2337866 - RNA, 22 nt, Bordetella pertussis
cacaucgcuaugcagcugcgcc

SEQ ID NO: 2337867 - RNA, 19 nt, Bordetella pertussis
caccaugccuugcgcgaca

SEQ ID NO: 2337868 - RNA, 14 nt, Bordetella pertussis
caccaugcgcacca

SEQ ID NO: 2337869 - RNA, 22 nt, Bordetella pertussis
caccaugcgcaccaggcgcucg

SEQ ID NO: 2337870 - RNA, 13 nt, Bordetella pertussis
caccaugcgcagc

SEQ ID NO: 2337871 - RNA, 17 nt, Bordetella pertussis
caccaugcgcagcaaca

SEQ ID NO: 2337872 - RNA, 17 nt, Bordetella pertussis
caccaugcggucgauga

SEQ ID NO: 2337873 - RNA, 19 nt, Bordetella pertussis
caccaugcggucgaugacc

SEQ ID NO: 2337874 - RNA, 21 nt, Bordetella pertussis
caccauggccgacagcgucga

SEQ ID NO: 2337875 - RNA, 20 nt, Bordetella pertussis
caccauggcgcccacggccg

SEQ ID NO: 2337876 - RNA, 19 nt, Bordetella pertussis
caccaugggcgucgucgcc

SEQ ID NO: 2337877 - RNA, 22 nt, Bordetella pertussis
caccaugggcgucgucgccguc

SEQ ID NO: 2337878 - RNA, 22 nt, Bordetella pertussis
caccaugggcucgugcagcagg

SEQ ID NO: 2337879 - RNA, 17 nt, Bordetella pertussis
caccaugucccuggcca

SEQ ID NO: 2337880 - RNA, 23 nt, Bordetella pertussis
caccaugugcgagagcuccagcc

SEQ ID NO: 2337881 - RNA, 15 nt, Bordetella pertussis
caccauugccggcgc

SEQ ID NO: 2337882 - RNA, 16 nt, Bordetella pertussis
caccauugccggcgcg

SEQ ID NO: 2337883 - RNA, 20 nt, Bordetella pertussis
cacccacacuuggccggcga

SEQ ID NO: 2337884 - RNA, 15 nt, Bordetella pertussis
cacccacagcagcgc

SEQ ID NO: 2337885 - RNA, 18 nt, Bordetella pertussis
cacccacagcagcgcgcc

SEQ ID NO: 2337886 - RNA, 15 nt, Bordetella pertussis
cacccagcggcuggc

SEQ ID NO: 2337887 - RNA, 22 nt, Bordetella pertussis
cacccaggcccaguugacgaug

SEQ ID NO: 2337888 - RNA, 21 nt, Bordetella pertussis
cacccagggcuugacgcgcgu

SEQ ID NO: 2337889 - RNA, 19 nt, Bordetella pertussis
cacccagguaucggccagc

SEQ ID NO: 2337890 - RNA, 23 nt, Bordetella pertussis
cacccaugaacacuugacggcca

SEQ ID NO: 2337891 - RNA, 12 nt, Bordetella pertussis
caccccaccacg

SEQ ID NO: 2337892 - RNA, 12 nt, Bordetella pertussis
cacccccagcag

SEQ ID NO: 2337893 - RNA, 14 nt, Bordetella pertussis
cacccccagcagca

SEQ ID NO: 2337894 - RNA, 13 nt, Bordetella pertussis
cacccccagggcg

SEQ ID NO: 2337895 - RNA, 16 nt, Bordetella pertussis
cacccccagggcgcgc

SEQ ID NO: 2337896 - RNA, 21 nt, Bordetella pertussis
cacccccgaccgagccacacc

SEQ ID NO: 2337897 - RNA, 14 nt, Bordetella pertussis
cacccccgggcgca

SEQ ID NO: 2337898 - RNA, 22 nt, Bordetella pertussis
caccccgagauaggcggccagg

SEQ ID NO: 2337899 - RNA, 23 nt, Bordetella pertussis
caccccgagauaggcggccaggc

SEQ ID NO: 2337900 - RNA, 14 nt, Bordetella pertussis
caccccgcccugcc

SEQ ID NO: 2337901 - RNA, 15 nt, Bordetella pertussis
caccccggcgccgcg

SEQ ID NO: 2337902 - RNA, 16 nt, Bordetella pertussis
caccccggugucgccg

SEQ ID NO: 2337903 - RNA, 13 nt, Bordetella pertussis
caccccguagcgc

SEQ ID NO: 2337904 - RNA, 19 nt, Bordetella pertussis
caccccguugcucuuggca

SEQ ID NO: 2337905 - RNA, 13 nt, Bordetella pertussis
caccccugcgcug

SEQ ID NO: 2337906 - RNA, 19 nt, Bordetella pertussis
cacccgauacgacacgccg

SEQ ID NO: 2337907 - RNA, 20 nt, Bordetella pertussis
cacccgauacgacacgccgc

SEQ ID NO: 2337908 - RNA, 22 nt, Bordetella pertussis
cacccgauacgacacgccgcgc

SEQ ID NO: 2337909 - RNA, 22 nt, Bordetella pertussis
cacccgaugacggggcggcgcc

SEQ ID NO: 2337910 - RNA, 23 nt, Bordetella pertussis
cacccgaugacggggcggcgccu

SEQ ID NO: 2337911 - RNA, 22 nt, Bordetella pertussis
cacccgcaaaccugaugccugu

SEQ ID NO: 2337912 - RNA, 13 nt, Bordetella pertussis
cacccgcacgccg

SEQ ID NO: 2337913 - RNA, 16 nt, Bordetella pertussis
cacccgcacgccggcc

SEQ ID NO: 2337914 - RNA, 13 nt, Bordetella pertussis
cacccgcaggccg

SEQ ID NO: 2337915 - RNA, 14 nt, Bordetella pertussis
cacccgcaggccgu

SEQ ID NO: 2337916 - RNA, 15 nt, Bordetella pertussis
cacccgcaugguggc

SEQ ID NO: 2337917 - RNA, 14 nt, Bordetella pertussis
cacccgccgccggc

SEQ ID NO: 2337918 - RNA, 16 nt, Bordetella pertussis
cacccgccgccggcga

SEQ ID NO: 2337919 - RNA, 12 nt, Bordetella pertussis
cacccgccugga

SEQ ID NO: 2337920 - RNA, 13 nt, Bordetella pertussis
cacccgccuggac

SEQ ID NO: 2337921 - RNA, 12 nt, Bordetella pertussis
cacccgcgcgca

SEQ ID NO: 2337922 - RNA, 13 nt, Bordetella pertussis
cacccgcgcgcag

SEQ ID NO: 2337923 - RNA, 16 nt, Bordetella pertussis
cacccgcgcgcagcgu

SEQ ID NO: 2337924 - RNA, 12 nt, Bordetella pertussis
cacccgcggcca

SEQ ID NO: 2337925 - RNA, 22 nt, Bordetella pertussis
cacccgcuaccccggcagcguc

SEQ ID NO: 2337926 - RNA, 22 nt, Bordetella pertussis
cacccggaucgacaggaacagc

SEQ ID NO: 2337927 - RNA, 19 nt, Bordetella pertussis
cacccggcccaugaccggc

SEQ ID NO: 2337928 - RNA, 13 nt, Bordetella pertussis
cacccggccgcug

SEQ ID NO: 2337929 - RNA, 17 nt, Bordetella pertussis
cacccggguacguggcc

SEQ ID NO: 2337930 - RNA, 17 nt, Bordetella pertussis
cacccgguauccgcgca

SEQ ID NO: 2337931 - RNA, 14 nt, Bordetella pertussis
cacccggucggccc

SEQ ID NO: 2337932 - RNA, 20 nt, Bordetella pertussis
cacccgucccugguccagca

SEQ ID NO: 2337933 - RNA, 17 nt, Bordetella pertussis
cacccguuccagcaugu

SEQ ID NO: 2337934 - RNA, 20 nt, Bordetella pertussis
cacccuccuacgccaugaca

SEQ ID NO: 2337935 - RNA, 14 nt, Bordetella pertussis
cacccugcaggccg

SEQ ID NO: 2337936 - RNA, 16 nt, Bordetella pertussis
cacccugccccauccc

SEQ ID NO: 2337937 - RNA, 20 nt, Bordetella pertussis
cacccugccccaucccaucc

SEQ ID NO: 2337938 - RNA, 23 nt, Bordetella pertussis
cacccugccgugggacaggcacu

SEQ ID NO: 2337939 - RNA, 23 nt, Bordetella pertussis
caccgaagcaucccagucgaugc

SEQ ID NO: 2337940 - RNA, 16 nt, Bordetella pertussis
caccgacaagccgguc

SEQ ID NO: 2337941 - RNA, 19 nt, Bordetella pertussis
caccgacagcaagggcaga

SEQ ID NO: 2337942 - RNA, 14 nt, Bordetella pertussis
caccgacaggaugg

SEQ ID NO: 2337943 - RNA, 18 nt, Bordetella pertussis
caccgacaggaugggcgc

SEQ ID NO: 2337944 - RNA, 14 nt, Bordetella pertussis
caccgacaggccga

SEQ ID NO: 2337945 - RNA, 19 nt, Bordetella pertussis
caccgacaggccgaugcug

SEQ ID NO: 2337946 - RNA, 17 nt, Bordetella pertussis
caccgaccagcgcgcgc

SEQ ID NO: 2337947 - RNA, 20 nt, Bordetella pertussis
caccgaccagcgcgcgccgg

SEQ ID NO: 2337948 - RNA, 21 nt, Bordetella pertussis
caccgaccagcgcgcgccggc

SEQ ID NO: 2337949 - RNA, 22 nt, Bordetella pertussis
caccgacggcgcggcgaucggc

SEQ ID NO: 2337950 - RNA, 12 nt, Bordetella pertussis
caccgacuucuc

SEQ ID NO: 2337951 - RNA, 22 nt, Bordetella pertussis
caccgacuucucuuucucgggc

SEQ ID NO: 2337952 - RNA, 23 nt, Bordetella pertussis
caccgacuucucuuucucgggcg

SEQ ID NO: 2337953 - RNA, 13 nt, Bordetella pertussis
caccgagacgcug

SEQ ID NO: 2337954 - RNA, 16 nt, Bordetella pertussis
caccgagacgcugucg

SEQ ID NO: 2337955 - RNA, 23 nt, Bordetella pertussis
caccgagauguuccugcgcgaca

SEQ ID NO: 2337956 - RNA, 21 nt, Bordetella pertussis
caccgagccgcagguccaggc

SEQ ID NO: 2337957 - RNA, 17 nt, Bordetella pertussis
caccgagcugagcacca

SEQ ID NO: 2337958 - RNA, 14 nt, Bordetella pertussis
caccgagggccgga

SEQ ID NO: 2337959 - RNA, 23 nt, Bordetella pertussis
caccgagggccggacuggcgcgc

SEQ ID NO: 2337960 - RNA, 14 nt, Bordetella pertussis
caccgauacgcugg

SEQ ID NO: 2337961 - RNA, 19 nt, Bordetella pertussis
caccgaugcgccggccugg

SEQ ID NO: 2337962 - RNA, 12 nt, Bordetella pertussis
caccgcaaggaa

SEQ ID NO: 2337963 - RNA, 20 nt, Bordetella pertussis
caccgcaaggaaguggccga

SEQ ID NO: 2337964 - RNA, 24 nt, Bordetella pertussis
caccgcaaggaaguggccgagcgc

SEQ ID NO: 2337965 - RNA, 15 nt, Bordetella pertussis
caccgcaggugccug

SEQ ID NO: 2337966 - RNA, 16 nt, Bordetella pertussis
caccgcaggugccugu

SEQ ID NO: 2337967 - RNA, 15 nt, Bordetella pertussis
caccgcaucgcgcag

SEQ ID NO: 2337968 - RNA, 17 nt, Bordetella pertussis
caccgcaucgcgcagcg

SEQ ID NO: 2337969 - RNA, 16 nt, Bordetella pertussis
caccgcaugggccagg

SEQ ID NO: 2337970 - RNA, 16 nt, Bordetella pertussis
caccgcauggggcgag

SEQ ID NO: 2337971 - RNA, 23 nt, Bordetella pertussis
caccgcauggggcgaggucagca

SEQ ID NO: 2337972 - RNA, 15 nt, Bordetella pertussis
caccgccaccguggc

SEQ ID NO: 2337973 - RNA, 16 nt, Bordetella pertussis
caccgccagcccgguc

SEQ ID NO: 2337974 - RNA, 23 nt, Bordetella pertussis
caccgccagcccggucgucccca

SEQ ID NO: 2337975 - RNA, 23 nt, Bordetella pertussis
caccgccaggaagaucggcccgg

SEQ ID NO: 2337976 - RNA, 18 nt, Bordetella pertussis
caccgccauggcggccgc

SEQ ID NO: 2337977 - RNA, 19 nt, Bordetella pertussis
caccgccauggcggccgcc

SEQ ID NO: 2337978 - RNA, 21 nt, Bordetella pertussis
caccgccauggcggccgccgc

SEQ ID NO: 2337979 - RNA, 21 nt, Bordetella pertussis
caccgccaugugcgccgcgcc

SEQ ID NO: 2337980 - RNA, 15 nt, Bordetella pertussis
caccgcccagaaugc

SEQ ID NO: 2337981 - RNA, 21 nt, Bordetella pertussis
caccgcccagaaugcggcgga

SEQ ID NO: 2337982 - RNA, 17 nt, Bordetella pertussis
caccgcccccgccgcca

SEQ ID NO: 2337983 - RNA, 18 nt, Bordetella pertussis
caccgcccccgccgccau

SEQ ID NO: 2337984 - RNA, 15 nt, Bordetella pertussis
caccgccccgacccu

SEQ ID NO: 2337985 - RNA, 18 nt, Bordetella pertussis
caccgccgauaccacgcg

SEQ ID NO: 2337986 - RNA, 16 nt, Bordetella pertussis
caccgccgaugccgcc

SEQ ID NO: 2337987 - RNA, 19 nt, Bordetella pertussis
caccgccgaugccgccauc

SEQ ID NO: 2337988 - RNA, 12 nt, Bordetella pertussis
caccgccgcccg

SEQ ID NO: 2337989 - RNA, 13 nt, Bordetella pertussis
caccgccgcccgc

SEQ ID NO: 2337990 - RNA, 21 nt, Bordetella pertussis
caccgccgcccgccaggccag

SEQ ID NO: 2337991 - RNA, 16 nt, Bordetella pertussis
caccgccgccgccacc

SEQ ID NO: 2337992 - RNA, 14 nt, Bordetella pertussis
caccgccgccgcgc

SEQ ID NO: 2337993 - RNA, 14 nt, Bordetella pertussis
caccgccgccggcc

SEQ ID NO: 2337994 - RNA, 16 nt, Bordetella pertussis
caccgccgcgccgccc

SEQ ID NO: 2337995 - RNA, 21 nt, Bordetella pertussis
caccgccgcgccgcccgcggc

SEQ ID NO: 2337996 - RNA, 13 nt, Bordetella pertussis
caccgccgcggcg

SEQ ID NO: 2337997 - RNA, 22 nt, Bordetella pertussis
caccgccgcggcgaugccggcc

SEQ ID NO: 2337998 - RNA, 23 nt, Bordetella pertussis
caccgccgcguccucggccuggc

SEQ ID NO: 2337999 - RNA, 20 nt, Bordetella pertussis
caccgccgguucggucgacg

SEQ ID NO: 2338000 - RNA, 23 nt, Bordetella pertussis
caccgccgguucggucgacgacg

SEQ ID NO: 2338001 - RNA, 17 nt, Bordetella pertussis
caccgccguggccggca

SEQ ID NO: 2338002 - RNA, 23 nt, Bordetella pertussis
caccgccugcgggaacugcguga

SEQ ID NO: 2338003 - RNA, 23 nt, Bordetella pertussis
caccgccugcugcauguccugca

SEQ ID NO: 2338004 - RNA, 19 nt, Bordetella pertussis
caccgccugcugcgccugg

SEQ ID NO: 2338005 - RNA, 19 nt, Bordetella pertussis
caccgccugugccagcugg

SEQ ID NO: 2338006 - RNA, 21 nt, Bordetella pertussis
caccgccugugccagcuggcc

SEQ ID NO: 2338007 - RNA, 20 nt, Bordetella pertussis
caccgcgaccaugcggccgu

SEQ ID NO: 2338008 - RNA, 20 nt, Bordetella pertussis
caccgcgcagcccggcgugc

SEQ ID NO: 2338009 - RNA, 14 nt, Bordetella pertussis
caccgcgccagcgc

SEQ ID NO: 2338010 - RNA, 16 nt, Bordetella pertussis
caccgcgccagcgccg

SEQ ID NO: 2338011 - RNA, 23 nt, Bordetella pertussis
caccgcgcccagggugguggccu

SEQ ID NO: 2338012 - RNA, 12 nt, Bordetella pertussis
caccgcgccgcc

SEQ ID NO: 2338013 - RNA, 15 nt, Bordetella pertussis
caccgcgccgcccac

SEQ ID NO: 2338014 - RNA, 19 nt, Bordetella pertussis
caccgcgcgcacgaccacc

SEQ ID NO: 2338015 - RNA, 23 nt, Bordetella pertussis
caccgcggcgggcucggcgccgg

SEQ ID NO: 2338016 - RNA, 16 nt, Bordetella pertussis
caccgcggugccgcgc

SEQ ID NO: 2338017 - RNA, 17 nt, Bordetella pertussis
caccgcggugccgcgcg

SEQ ID NO: 2338018 - RNA, 19 nt, Bordetella pertussis
caccgcggugccgcgcgcg

SEQ ID NO: 2338019 - RNA, 23 nt, Bordetella pertussis
caccgcggugccgcgcgcggccg

SEQ ID NO: 2338020 - RNA, 23 nt, Bordetella pertussis
caccgcgucauacacggcgcggg

SEQ ID NO: 2338021 - RNA, 21 nt, Bordetella pertussis
caccgcugcgggaggugccgc

SEQ ID NO: 2338022 - RNA, 23 nt, Bordetella pertussis
caccgcuucuucgucgcgccaga

SEQ ID NO: 2338023 - RNA, 16 nt, Bordetella pertussis
caccggaggcgccgcg

SEQ ID NO: 2338024 - RNA, 18 nt, Bordetella pertussis
caccggauccugcggcgc

SEQ ID NO: 2338025 - RNA, 19 nt, Bordetella pertussis
caccggcaagccuugcggc

SEQ ID NO: 2338026 - RNA, 15 nt, Bordetella pertussis
caccggcaaggccgc

SEQ ID NO: 2338027 - RNA, 15 nt, Bordetella pertussis
caccggcacgacggc

SEQ ID NO: 2338028 - RNA, 17 nt, Bordetella pertussis
caccggcacgacggccu

SEQ ID NO: 2338029 - RNA, 21 nt, Bordetella pertussis
caccggcacgacggccuccgc

SEQ ID NO: 2338030 - RNA, 15 nt, Bordetella pertussis
caccggcacgccggc

SEQ ID NO: 2338031 - RNA, 17 nt, Bordetella pertussis
caccggcacgccggcgg

SEQ ID NO: 2338032 - RNA, 19 nt, Bordetella pertussis
caccggcacgccggcggcg

SEQ ID NO: 2338033 - RNA, 16 nt, Bordetella pertussis
caccggcaggccgcgc

SEQ ID NO: 2338034 - RNA, 17 nt, Bordetella pertussis
caccggcaugccgucca

SEQ ID NO: 2338035 - RNA, 16 nt, Bordetella pertussis
caccggccaggggcgc

SEQ ID NO: 2338036 - RNA, 16 nt, Bordetella pertussis
caccggccagucgcgg

SEQ ID NO: 2338037 - RNA, 13 nt, Bordetella pertussis
caccggccccauc

SEQ ID NO: 2338038 - RNA, 14 nt, Bordetella pertussis
caccggccccauca

SEQ ID NO: 2338039 - RNA, 15 nt, Bordetella pertussis
caccggcccgaagau

SEQ ID NO: 2338040 - RNA, 13 nt, Bordetella pertussis
caccggccggccg

SEQ ID NO: 2338041 - RNA, 15 nt, Bordetella pertussis
caccggcgagccgau

SEQ ID NO: 2338042 - RNA, 16 nt, Bordetella pertussis
caccggcgcgccuggc

SEQ ID NO: 2338043 - RNA, 14 nt, Bordetella pertussis
caccggcgcgcgca

SEQ ID NO: 2338044 - RNA, 18 nt, Bordetella pertussis
caccggcgcgcgcaugcc

SEQ ID NO: 2338045 - RNA, 23 nt, Bordetella pertussis
caccggcgcgcgcaugcccgacc

SEQ ID NO: 2338046 - RNA, 16 nt, Bordetella pertussis
caccggcgugagcgcc

SEQ ID NO: 2338047 - RNA, 17 nt, Bordetella pertussis
caccggcgugagcgcca

SEQ ID NO: 2338048 - RNA, 20 nt, Bordetella pertussis
caccggcgugcagagcacca

SEQ ID NO: 2338049 - RNA, 14 nt, Bordetella pertussis
caccggcgugcgcu

SEQ ID NO: 2338050 - RNA, 16 nt, Bordetella pertussis
caccggcgugcgcugg

SEQ ID NO: 2338051 - RNA, 13 nt, Bordetella pertussis
caccggcugccag

SEQ ID NO: 2338052 - RNA, 14 nt, Bordetella pertussis
caccggcuuggccu

SEQ ID NO: 2338053 - RNA, 20 nt, Bordetella pertussis
caccggcuuggccucggccg

SEQ ID NO: 2338054 - RNA, 17 nt, Bordetella pertussis
caccggcuugggcgugc

SEQ ID NO: 2338055 - RNA, 20 nt, Bordetella pertussis
caccggcuugggcgugcccu

SEQ ID NO: 2338056 - RNA, 13 nt, Bordetella pertussis
caccgggacaggc

SEQ ID NO: 2338057 - RNA, 16 nt, Bordetella pertussis
caccgggcaaucggcg

SEQ ID NO: 2338058 - RNA, 14 nt, Bordetella pertussis
caccgggccgaaca

SEQ ID NO: 2338059 - RNA, 22 nt, Bordetella pertussis
caccgggccggccugcgucgcc

SEQ ID NO: 2338060 - RNA, 16 nt, Bordetella pertussis
caccgggcggcccggc

SEQ ID NO: 2338061 - RNA, 21 nt, Bordetella pertussis
caccggggcagggcgggcggg

SEQ ID NO: 2338062 - RNA, 23 nt, Bordetella pertussis
caccggguaauggcgcuccagcc

SEQ ID NO: 2338063 - RNA, 22 nt, Bordetella pertussis
caccggucgccguccaggcgcc

SEQ ID NO: 2338064 - RNA, 23 nt, Bordetella pertussis
caccgguugcagcgcgccaggcg

SEQ ID NO: 2338065 - RNA, 24 nt, Bordetella pertussis
caccgguugcagcgcgccaggcgc

SEQ ID NO: 2338066 - RNA, 13 nt, Bordetella pertussis
caccgucacgcgc

SEQ ID NO: 2338067 - RNA, 17 nt, Bordetella pertussis
caccgucacgcgcucca

SEQ ID NO: 2338068 - RNA, 18 nt, Bordetella pertussis
caccgucacgcgcuccag

SEQ ID NO: 2338069 - RNA, 16 nt, Bordetella pertussis
caccgucacgcgcugg

SEQ ID NO: 2338070 - RNA, 23 nt, Bordetella pertussis
caccguccagcauuucucgggcg

SEQ ID NO: 2338071 - RNA, 15 nt, Bordetella pertussis
caccgucgacuucga

SEQ ID NO: 2338072 - RNA, 22 nt, Bordetella pertussis
caccgucgacuucgacccggac

SEQ ID NO: 2338073 - RNA, 23 nt, Bordetella pertussis
caccgucgacuucgacccggaca

SEQ ID NO: 2338074 - RNA, 14 nt, Bordetella pertussis
caccgucgccaggg

SEQ ID NO: 2338075 - RNA, 14 nt, Bordetella pertussis
caccgucuggcgua

SEQ ID NO: 2338076 - RNA, 15 nt, Bordetella pertussis
caccgucuugcccgc

SEQ ID NO: 2338077 - RNA, 17 nt, Bordetella pertussis
caccgucuugcccgcca

SEQ ID NO: 2338078 - RNA, 24 nt, Bordetella pertussis
caccgucuugcccgccagcgcggc

SEQ ID NO: 2338079 - RNA, 21 nt, Bordetella pertussis
caccgugaaggugccggacgc

SEQ ID NO: 2338080 - RNA, 14 nt, Bordetella pertussis
caccgugaccagcg

SEQ ID NO: 2338081 - RNA, 18 nt, Bordetella pertussis
caccgugauauagaccag

SEQ ID NO: 2338082 - RNA, 19 nt, Bordetella pertussis
caccgugauauagaccagc

SEQ ID NO: 2338083 - RNA, 20 nt, Bordetella pertussis
caccgugauauagaccagca

SEQ ID NO: 2338084 - RNA, 23 nt, Bordetella pertussis
caccgugauauagaccagcagcu

SEQ ID NO: 2338085 - RNA, 15 nt, Bordetella pertussis
caccgugaugcgcgc

SEQ ID NO: 2338086 - RNA, 18 nt, Bordetella pertussis
caccgugaugcgcgccgc

SEQ ID NO: 2338087 - RNA, 14 nt, Bordetella pertussis
caccgugaugggcg

SEQ ID NO: 2338088 - RNA, 16 nt, Bordetella pertussis
caccgugaugggcgca

SEQ ID NO: 2338089 - RNA, 21 nt, Bordetella pertussis
caccgugaugucgccgucggc

SEQ ID NO: 2338090 - RNA, 22 nt, Bordetella pertussis
caccgugaugucgccgucggca

SEQ ID NO: 2338091 - RNA, 16 nt, Bordetella pertussis
caccgugcuggccgac

SEQ ID NO: 2338092 - RNA, 18 nt, Bordetella pertussis
caccgugcuggccgacgc

SEQ ID NO: 2338093 - RNA, 22 nt, Bordetella pertussis
caccgugcuggccgacgcgcug

SEQ ID NO: 2338094 - RNA, 23 nt, Bordetella pertussis
caccgugcuggccgacgcgcugg

SEQ ID NO: 2338095 - RNA, 20 nt, Bordetella pertussis
caccguggcaugccaugcgc

SEQ ID NO: 2338096 - RNA, 17 nt, Bordetella pertussis
caccguggccacggccg

SEQ ID NO: 2338097 - RNA, 20 nt, Bordetella pertussis
caccguggccacggccgcga

SEQ ID NO: 2338098 - RNA, 19 nt, Bordetella pertussis
caccgugugaucgccgacg

SEQ ID NO: 2338099 - RNA, 14 nt, Bordetella pertussis
caccguucuuccgc

SEQ ID NO: 2338100 - RNA, 22 nt, Bordetella pertussis
caccguucuuccgcacgccgac

SEQ ID NO: 2338101 - RNA, 16 nt, Bordetella pertussis
caccuccaccgccagc

SEQ ID NO: 2338102 - RNA, 20 nt, Bordetella pertussis
caccuccaccgccagcccgg

SEQ ID NO: 2338103 - RNA, 14 nt, Bordetella pertussis
caccuccaccucga

SEQ ID NO: 2338104 - RNA, 23 nt, Bordetella pertussis
caccucgcuugcccgugccuugc

SEQ ID NO: 2338105 - RNA, 22 nt, Bordetella pertussis
caccucggacgagacaggcgcg

SEQ ID NO: 2338106 - RNA, 23 nt, Bordetella pertussis
caccucggacgagacaggcgcgc

SEQ ID NO: 2338107 - RNA, 13 nt, Bordetella pertussis
caccucggccucg

SEQ ID NO: 2338108 - RNA, 18 nt, Bordetella pertussis
caccucggccucgcuggc

SEQ ID NO: 2338109 - RNA, 22 nt, Bordetella pertussis
caccucggcgcccagcugcuuc

SEQ ID NO: 2338110 - RNA, 15 nt, Bordetella pertussis
caccucggcgccgcg

SEQ ID NO: 2338111 - RNA, 20 nt, Bordetella pertussis
caccucggcgccgcggcgcu

SEQ ID NO: 2338112 - RNA, 15 nt, Bordetella pertussis
caccucggcgucgcc

SEQ ID NO: 2338113 - RNA, 19 nt, Bordetella pertussis
caccucggcguggcgggga

SEQ ID NO: 2338114 - RNA, 15 nt, Bordetella pertussis
caccucggggcgcgg

SEQ ID NO: 2338115 - RNA, 19 nt, Bordetella pertussis
caccucggggugcagcuuc

SEQ ID NO: 2338116 - RNA, 15 nt, Bordetella pertussis
caccucguaaguggc

SEQ ID NO: 2338117 - RNA, 18 nt, Bordetella pertussis
caccucgucguccagcgu

SEQ ID NO: 2338118 - RNA, 18 nt, Bordetella pertussis
caccucguucaccccccg

SEQ ID NO: 2338119 - RNA, 17 nt, Bordetella pertussis
caccucuucagcccggc

SEQ ID NO: 2338120 - RNA, 15 nt, Bordetella pertussis
caccugaacaccggc

SEQ ID NO: 2338121 - RNA, 17 nt, Bordetella pertussis
caccugaacaccggcgc

SEQ ID NO: 2338122 - RNA, 15 nt, Bordetella pertussis
caccugcaccgccgc

SEQ ID NO: 2338123 - RNA, 14 nt, Bordetella pertussis
caccugcaggccca

SEQ ID NO: 2338124 - RNA, 17 nt, Bordetella pertussis
caccugcaggcccaccg

SEQ ID NO: 2338125 - RNA, 19 nt, Bordetella pertussis
caccugcaggcccaccggc

SEQ ID NO: 2338126 - RNA, 14 nt, Bordetella pertussis
caccugcaggccgc

SEQ ID NO: 2338127 - RNA, 18 nt, Bordetella pertussis
caccugcaggccgccggc

SEQ ID NO: 2338128 - RNA, 17 nt, Bordetella pertussis
caccugcagggucagcc

SEQ ID NO: 2338129 - RNA, 15 nt, Bordetella pertussis
caccugccugccgcc

SEQ ID NO: 2338130 - RNA, 21 nt, Bordetella pertussis
caccugccugccgccugccag

SEQ ID NO: 2338131 - RNA, 17 nt, Bordetella pertussis
caccugcgaccgagcca

SEQ ID NO: 2338132 - RNA, 19 nt, Bordetella pertussis
caccugcgucugcacgcug

SEQ ID NO: 2338133 - RNA, 14 nt, Bordetella pertussis
caccugcugcggca

SEQ ID NO: 2338134 - RNA, 21 nt, Bordetella pertussis
caccugcugcggcacggccag

SEQ ID NO: 2338135 - RNA, 17 nt, Bordetella pertussis
caccugcuugagcacca

SEQ ID NO: 2338136 - RNA, 19 nt, Bordetella pertussis
caccuggacccgcucgacc

SEQ ID NO: 2338137 - RNA, 15 nt, Bordetella pertussis
caccuggcgcccggc

SEQ ID NO: 2338138 - RNA, 16 nt, Bordetella pertussis
caccuggcgcccggcg

SEQ ID NO: 2338139 - RNA, 20 nt, Bordetella pertussis
caccuggcgcccggcggcgc

SEQ ID NO: 2338140 - RNA, 15 nt, Bordetella pertussis
caccuggcggugcgc

SEQ ID NO: 2338141 - RNA, 18 nt, Bordetella pertussis
caccuggcggugcgccgc

SEQ ID NO: 2338142 - RNA, 19 nt, Bordetella pertussis
caccugggaggggccggcu

SEQ ID NO: 2338143 - RNA, 12 nt, Bordetella pertussis
caccugggccgc

SEQ ID NO: 2338144 - RNA, 19 nt, Bordetella pertussis
caccugggccgccugcugg

SEQ ID NO: 2338145 - RNA, 14 nt, Bordetella pertussis
caccugggcgucga

SEQ ID NO: 2338146 - RNA, 17 nt, Bordetella pertussis
caccuggucgucggcca

SEQ ID NO: 2338147 - RNA, 16 nt, Bordetella pertussis
caccuguucggcggcg

SEQ ID NO: 2338148 - RNA, 17 nt, Bordetella pertussis
caccuguucggcggcgc

SEQ ID NO: 2338149 - RNA, 18 nt, Bordetella pertussis
caccuguucggcggcgcc

SEQ ID NO: 2338150 - RNA, 19 nt, Bordetella pertussis
caccuguucggcggcgccc

SEQ ID NO: 2338151 - RNA, 20 nt, Bordetella pertussis
caccuguucggcggcgccca

SEQ ID NO: 2338152 - RNA, 17 nt, Bordetella pertussis
caccuucaacaucgccc

SEQ ID NO: 2338153 - RNA, 15 nt, Bordetella pertussis
caccuucagggcgcc

SEQ ID NO: 2338154 - RNA, 16 nt, Bordetella pertussis
caccuucagggcgccg

SEQ ID NO: 2338155 - RNA, 20 nt, Bordetella pertussis
caccuucagggcgccggcgu

SEQ ID NO: 2338156 - RNA, 21 nt, Bordetella pertussis
caccuuccugcuggaccugcu

SEQ ID NO: 2338157 - RNA, 21 nt, Bordetella pertussis
caccuucgaggaaagcggccu

SEQ ID NO: 2338158 - RNA, 19 nt, Bordetella pertussis
caccuucgcgcagcggcgc

SEQ ID NO: 2338159 - RNA, 21 nt, Bordetella pertussis
caccuucgcgcagcggcgcgc

SEQ ID NO: 2338160 - RNA, 23 nt, Bordetella pertussis
caccuucuuccaggcgcccgcca

SEQ ID NO: 2338161 - RNA, 16 nt, Bordetella pertussis
caccuugaccuggucg

SEQ ID NO: 2338162 - RNA, 14 nt, Bordetella pertussis
caccuugcccagca

SEQ ID NO: 2338163 - RNA, 15 nt, Bordetella pertussis
caccuugcgcgcgaa

SEQ ID NO: 2338164 - RNA, 16 nt, Bordetella pertussis
caccuugcgcgcgaac

SEQ ID NO: 2338165 - RNA, 22 nt, Bordetella pertussis
caccuuggccaauggccgcggc

SEQ ID NO: 2338166 - RNA, 15 nt, Bordetella pertussis
caccuuggcccggcg

SEQ ID NO: 2338167 - RNA, 17 nt, Bordetella pertussis
caccuuggcccggcggg

SEQ ID NO: 2338168 - RNA, 20 nt, Bordetella pertussis
caccuugggaucgucccagg

SEQ ID NO: 2338169 - RNA, 23 nt, Bordetella pertussis
caccuugggaucgucccaggugc

SEQ ID NO: 2338170 - RNA, 13 nt, Bordetella pertussis
caccuugggcgcc

SEQ ID NO: 2338171 - RNA, 17 nt, Bordetella pertussis
caccuuguacuggucgc

SEQ ID NO: 2338172 - RNA, 20 nt, Bordetella pertussis
caccuuguacuggucgcgca

SEQ ID NO: 2338173 - RNA, 19 nt, Bordetella pertussis
caccuugucgcgcagcgcc

SEQ ID NO: 2338174 - RNA, 21 nt, Bordetella pertussis
caccuugucgcgcagcgccgc

SEQ ID NO: 2338175 - RNA, 22 nt, Bordetella pertussis
caccuugucgcgcagcgccgcc

SEQ ID NO: 2338176 - RNA, 21 nt, Bordetella pertussis
caccuuguuggcgccggccgc

SEQ ID NO: 2338177 - RNA, 13 nt, Bordetella pertussis
caccuuucugcug

SEQ ID NO: 2338178 - RNA, 16 nt, Bordetella pertussis
caccuuucugcugcuc

SEQ ID NO: 2338179 - RNA, 17 nt, Bordetella pertussis
caccuuucugcugcucg

SEQ ID NO: 2338180 - RNA, 18 nt, Bordetella pertussis
cacgaaacccacggcgau

SEQ ID NO: 2338181 - RNA, 16 nt, Bordetella pertussis
cacgaaagcgcccagg

SEQ ID NO: 2338182 - RNA, 19 nt, Bordetella pertussis
cacgaaagcgcccaggccg

SEQ ID NO: 2338183 - RNA, 20 nt, Bordetella pertussis
cacgaaagcgcccaggccga

SEQ ID NO: 2338184 - RNA, 16 nt, Bordetella pertussis
cacgaacagcgccagg

SEQ ID NO: 2338185 - RNA, 21 nt, Bordetella pertussis
cacgaacagcgccaggcucca

SEQ ID NO: 2338186 - RNA, 13 nt, Bordetella pertussis
cacgaacgccacg

SEQ ID NO: 2338187 - RNA, 24 nt, Bordetella pertussis
cacgaagcaggugaugcgcgcggc

SEQ ID NO: 2338188 - RNA, 14 nt, Bordetella pertussis
cacgaagccgaugc

SEQ ID NO: 2338189 - RNA, 22 nt, Bordetella pertussis
cacgaaggcagcaccucggacg

SEQ ID NO: 2338190 - RNA, 16 nt, Bordetella pertussis
cacgaaggcgccgaaa

SEQ ID NO: 2338191 - RNA, 20 nt, Bordetella pertussis
cacgaaguacucgccggcgc

SEQ ID NO: 2338192 - RNA, 19 nt, Bordetella pertussis
cacgacacgcccagcaggc

SEQ ID NO: 2338193 - RNA, 17 nt, Bordetella pertussis
cacgacagcaucuuggc

SEQ ID NO: 2338194 - RNA, 20 nt, Bordetella pertussis
cacgacagcaucuuggccgc

SEQ ID NO: 2338195 - RNA, 13 nt, Bordetella pertussis
cacgaccaccagc

SEQ ID NO: 2338196 - RNA, 14 nt, Bordetella pertussis
cacgaccaccagcg

SEQ ID NO: 2338197 - RNA, 16 nt, Bordetella pertussis
cacgaccaccagcgca

SEQ ID NO: 2338198 - RNA, 23 nt, Bordetella pertussis
cacgaccaccagcgcacugagaa

SEQ ID NO: 2338199 - RNA, 14 nt, Bordetella pertussis
cacgaccagcaggc

SEQ ID NO: 2338200 - RNA, 17 nt, Bordetella pertussis
cacgaccagcaggccca

SEQ ID NO: 2338201 - RNA, 13 nt, Bordetella pertussis
cacgaccaggccg

SEQ ID NO: 2338202 - RNA, 15 nt, Bordetella pertussis
cacgaccgagccggc

SEQ ID NO: 2338203 - RNA, 17 nt, Bordetella pertussis
cacgaccgagccggcca

SEQ ID NO: 2338204 - RNA, 23 nt, Bordetella pertussis
cacgaccgagccggccagcgccu

SEQ ID NO: 2338205 - RNA, 15 nt, Bordetella pertussis
cacgaccggcucgau

SEQ ID NO: 2338206 - RNA, 23 nt, Bordetella pertussis
cacgaccggcucgaucgccgccg

SEQ ID NO: 2338207 - RNA, 23 nt, Bordetella pertussis
cacgaccugcaaccccaccggca

SEQ ID NO: 2338208 - RNA, 13 nt, Bordetella pertussis
cacgaccugcgca

SEQ ID NO: 2338209 - RNA, 19 nt, Bordetella pertussis
cacaucggaauuggcggcg

SEQ ID NO: 2338210 - RNA, 13 nt, Bordetella pertussis
cacaucggccacc

SEQ ID NO: 2338211 - RNA, 21 nt, Bordetella pertussis
cacaucggccacccggaucga

SEQ ID NO: 2338212 - RNA, 16 nt, Bordetella pertussis
cacaucgucgacgucg

SEQ ID NO: 2338213 - RNA, 19 nt, Bordetella pertussis
cacaucgucgacgucgauc

SEQ ID NO: 2338214 - RNA, 15 nt, Bordetella pertussis
cacaugaugcccagc

SEQ ID NO: 2338215 - RNA, 18 nt, Bordetella pertussis
cacaugaugcccagcgcc

SEQ ID NO: 2338216 - RNA, 22 nt, Bordetella pertussis
cacaugccgugccagauaccca

SEQ ID NO: 2338217 - RNA, 17 nt, Bordetella pertussis
cacauggcgcaucucgu

SEQ ID NO: 2338218 - RNA, 13 nt, Bordetella pertussis
cacauggcgcgcc

SEQ ID NO: 2338219 - RNA, 14 nt, Bordetella pertussis
cacauggcgcgccg

SEQ ID NO: 2338220 - RNA, 20 nt, Bordetella pertussis
cacauggcgcgccggccggu

SEQ ID NO: 2338221 - RNA, 15 nt, Bordetella pertussis
cacauggggacuggc

SEQ ID NO: 2338222 - RNA, 19 nt, Bordetella pertussis
caccaaccaacaugccgga

SEQ ID NO: 2338223 - RNA, 12 nt, Bordetella pertussis
caccaaccugcu

SEQ ID NO: 2338224 - RNA, 21 nt, Bordetella pertussis
caccaacugguagugcggcgc

SEQ ID NO: 2338225 - RNA, 13 nt, Bordetella pertussis
caccaagggcgcc

SEQ ID NO: 2338226 - RNA, 16 nt, Bordetella pertussis
caccaagggcgccggg

SEQ ID NO: 2338227 - RNA, 17 nt, Bordetella pertussis
caccaagggcgccgggc

SEQ ID NO: 2338228 - RNA, 22 nt, Bordetella pertussis
caccaaucuugccaggcccggc

SEQ ID NO: 2338229 - RNA, 23 nt, Bordetella pertussis
caccacaaggauggacuggccgc

SEQ ID NO: 2338230 - RNA, 14 nt, Bordetella pertussis
caccaccaccgccc

SEQ ID NO: 2338231 - RNA, 16 nt, Bordetella pertussis
caccaccaccgcccgc

SEQ ID NO: 2338232 - RNA, 14 nt, Bordetella pertussis
caccaccagcaccg

SEQ ID NO: 2338233 - RNA, 18 nt, Bordetella pertussis
caccaccagcaccgccac

SEQ ID NO: 2338234 - RNA, 19 nt, Bordetella pertussis
caccaccagcaccgccacg

SEQ ID NO: 2338235 - RNA, 13 nt, Bordetella pertussis
caccaccagcgcg

SEQ ID NO: 2338236 - RNA, 16 nt, Bordetella pertussis
caccaccagcgcggcc

SEQ ID NO: 2338237 - RNA, 19 nt, Bordetella pertussis
caccaccagcgcggccagc

SEQ ID NO: 2338238 - RNA, 20 nt, Bordetella pertussis
caccaccagcgcggccagca

SEQ ID NO: 2338239 - RNA, 14 nt, Bordetella pertussis
caccaccagcggcg

SEQ ID NO: 2338240 - RNA, 15 nt, Bordetella pertussis
caccaccagcggcgu

SEQ ID NO: 2338241 - RNA, 13 nt, Bordetella pertussis
caccaccaggccc

SEQ ID NO: 2338242 - RNA, 16 nt, Bordetella pertussis
caccaccaggccggcc

SEQ ID NO: 2338243 - RNA, 19 nt, Bordetella pertussis
caccaccaggccggccagg

SEQ ID NO: 2338244 - RNA, 22 nt, Bordetella pertussis
caccaccaggccggccagggcc

SEQ ID NO: 2338245 - RNA, 16 nt, Bordetella pertussis
caccaccaucugcgag

SEQ ID NO: 2338246 - RNA, 22 nt, Bordetella pertussis
caccaccaugugcuugccgcag

SEQ ID NO: 2338247 - RNA, 23 nt, Bordetella pertussis
caccaccaugugcuugccgcagc

SEQ ID NO: 2338248 - RNA, 15 nt, Bordetella pertussis
caccacccaggccca

SEQ ID NO: 2338249 - RNA, 13 nt, Bordetella pertussis
caccacccgcacg

SEQ ID NO: 2338250 - RNA, 12 nt, Bordetella pertussis
caccaccgaggg

SEQ ID NO: 2338251 - RNA, 12 nt, Bordetella pertussis
caccaccgccga

SEQ ID NO: 2338252 - RNA, 18 nt, Bordetella pertussis
cacgaccugcgcaugcgc

SEQ ID NO: 2338253 - RNA, 22 nt, Bordetella pertussis
cacgaccuuggcggccgacagc

SEQ ID NO: 2338254 - RNA, 20 nt, Bordetella pertussis
cacgacgaagaacaccauca

SEQ ID NO: 2338255 - RNA, 22 nt, Bordetella pertussis
cacgacgaagguguugaccacg

SEQ ID NO: 2338256 - RNA, 18 nt, Bordetella pertussis
cacgacgacggccggcgc

SEQ ID NO: 2338257 - RNA, 18 nt, Bordetella pertussis
cacgacgcgaaccaggcc

SEQ ID NO: 2338258 - RNA, 22 nt, Bordetella pertussis
cacgacgcgaaccaggccaccg

SEQ ID NO: 2338259 - RNA, 14 nt, Bordetella pertussis
cacgacggccuccg

SEQ ID NO: 2338260 - RNA, 16 nt, Bordetella pertussis
cacgacguagucggcg

SEQ ID NO: 2338261 - RNA, 19 nt, Bordetella pertussis
cacgacguagucggcgccc

SEQ ID NO: 2338262 - RNA, 12 nt, Bordetella pertussis
cacgacguggcc

SEQ ID NO: 2338263 - RNA, 20 nt, Bordetella pertussis
cacgacguugggcaugccga

SEQ ID NO: 2338264 - RNA, 22 nt, Bordetella pertussis
cacgacuacggcggacuggccg

SEQ ID NO: 2338265 - RNA, 16 nt, Bordetella pertussis
cacgagaucgccuggg

SEQ ID NO: 2338266 - RNA, 16 nt, Bordetella pertussis
cacgagauguccaugg

SEQ ID NO: 2338267 - RNA, 14 nt, Bordetella pertussis
cacgaggucuugcc

SEQ ID NO: 2338268 - RNA, 23 nt, Bordetella pertussis
cacgaggucuugccgaucggcgu

SEQ ID NO: 2338269 - RNA, 22 nt, Bordetella pertussis
cacgauauuggcgucggccgcc

SEQ ID NO: 2338270 - RNA, 23 nt, Bordetella pertussis
cacgauauuggcgucggccgccg

SEQ ID NO: 2338271 - RNA, 15 nt, Bordetella pertussis
cacgaucaccacgcc

SEQ ID NO: 2338272 - RNA, 19 nt, Bordetella pertussis
cacgaucacgaacagcgcc

SEQ ID NO: 2338273 - RNA, 20 nt, Bordetella pertussis
cacgaucagcauaucgucgc

SEQ ID NO: 2338274 - RNA, 15 nt, Bordetella pertussis
cacgaucagcgccca

SEQ ID NO: 2338275 - RNA, 17 nt, Bordetella pertussis
cacgaucauggucaugc

SEQ ID NO: 2338276 - RNA, 19 nt, Bordetella pertussis
cacgaucauggucaugccc

SEQ ID NO: 2338277 - RNA, 17 nt, Bordetella pertussis
cacgauccacggccggc

SEQ ID NO: 2338278 - RNA, 18 nt, Bordetella pertussis
cacgauccacggccggcg

SEQ ID NO: 2338279 - RNA, 21 nt, Bordetella pertussis
cacgauccacggccggcgcac

SEQ ID NO: 2338280 - RNA, 21 nt, Bordetella pertussis
cacgaucccgucauggcggca

SEQ ID NO: 2338281 - RNA, 15 nt, Bordetella pertussis
cacgaucgcgccggc

SEQ ID NO: 2338282 - RNA, 15 nt, Bordetella pertussis
cacgaucgucagcag

SEQ ID NO: 2338283 - RNA, 14 nt, Bordetella pertussis
cacgaucuggcgcg

SEQ ID NO: 2338284 - RNA, 17 nt, Bordetella pertussis
cacgaucuggcgcgcga

SEQ ID NO: 2338285 - RNA, 17 nt, Bordetella pertussis
cacgaugaacgcgcgca

SEQ ID NO: 2338286 - RNA, 20 nt, Bordetella pertussis
cacgaugaucgcgccgacga

SEQ ID NO: 2338287 - RNA, 19 nt, Bordetella pertussis
cacgaugauggaggccagg

SEQ ID NO: 2338288 - RNA, 15 nt, Bordetella pertussis
cacgaugcccagggc

SEQ ID NO: 2338289 - RNA, 20 nt, Bordetella pertussis
cacgaugcccagggccgcgc

SEQ ID NO: 2338290 - RNA, 20 nt, Bordetella pertussis
cacgaugccgaccgagccga

SEQ ID NO: 2338291 - RNA, 14 nt, Bordetella pertussis
cacgaugccgucgc

SEQ ID NO: 2338292 - RNA, 15 nt, Bordetella pertussis
cacgaugccgucgcc

SEQ ID NO: 2338293 - RNA, 20 nt, Bordetella pertussis
cacgaugccgucgccgccca

SEQ ID NO: 2338294 - RNA, 17 nt, Bordetella pertussis
cacgauggccgcgccca

SEQ ID NO: 2338295 - RNA, 15 nt, Bordetella pertussis
cacgauggccggcgc

SEQ ID NO: 2338296 - RNA, 19 nt, Bordetella pertussis
cacgauggccggcgcgaac

SEQ ID NO: 2338297 - RNA, 22 nt, Bordetella pertussis
cacgauggcgcaauaggccgcg

SEQ ID NO: 2338298 - RNA, 13 nt, Bordetella pertussis
cacgauggcgccc

SEQ ID NO: 2338299 - RNA, 14 nt, Bordetella pertussis
cacgauggcgccca

SEQ ID NO: 2338300 - RNA, 18 nt, Bordetella pertussis
cacgauggcgcccacggc

SEQ ID NO: 2338301 - RNA, 20 nt, Bordetella pertussis
cacgauggcgcccacggccu

SEQ ID NO: 2338302 - RNA, 13 nt, Bordetella pertussis
cacgauggcgcgc

SEQ ID NO: 2338303 - RNA, 14 nt, Bordetella pertussis
cacgauggcgcgcg

SEQ ID NO: 2338304 - RNA, 17 nt, Bordetella pertussis
cacgauggggccgucgc

SEQ ID NO: 2338305 - RNA, 16 nt, Bordetella pertussis
cacgauggucagcggc

SEQ ID NO: 2338306 - RNA, 20 nt, Bordetella pertussis
cacgauguugcgcaggcugu

SEQ ID NO: 2338307 - RNA, 23 nt, Bordetella pertussis
cacgauuucggccaugugcgcca

SEQ ID NO: 2338308 - RNA, 13 nt, Bordetella pertussis
cacgauuuuucgc

SEQ ID NO: 2338309 - RNA, 13 nt, Bordetella pertussis
cacgcaaggccga

SEQ ID NO: 2338310 - RNA, 14 nt, Bordetella pertussis
cacgcaaggccgac

SEQ ID NO: 2338311 - RNA, 14 nt, Bordetella pertussis
cacgcacagcaccu

SEQ ID NO: 2338312 - RNA, 15 nt, Bordetella pertussis
cacgcacagcaccug

SEQ ID NO: 2338313 - RNA, 17 nt, Bordetella pertussis
cacgcacagcaugcgcu

SEQ ID NO: 2338314 - RNA, 15 nt, Bordetella pertussis
cacgcaccaggcgca

SEQ ID NO: 2338315 - RNA, 18 nt, Bordetella pertussis
cacgcaccaggcgcacgg

SEQ ID NO: 2338316 - RNA, 23 nt, Bordetella pertussis
cacgcaccaggcgcacggcggca

SEQ ID NO: 2338317 - RNA, 18 nt, Bordetella pertussis
cacgcaccgcgccagcgc

SEQ ID NO: 2338318 - RNA, 20 nt, Bordetella pertussis
cacgcaccgcgccagcgccg

SEQ ID NO: 2338319 - RNA, 22 nt, Bordetella pertussis
cacgcaccgcgccagcgccggc

SEQ ID NO: 2338320 - RNA, 19 nt, Bordetella pertussis
cacgcacgguacgccgaac

SEQ ID NO: 2338321 - RNA, 23 nt, Bordetella pertussis
cacgcagaaauggaugcgcgccc

SEQ ID NO: 2338322 - RNA, 20 nt, Bordetella pertussis
cacgcagaaggcgaacuggg

SEQ ID NO: 2338323 - RNA, 14 nt, Bordetella pertussis
cacgcagcugaacg

SEQ ID NO: 2338324 - RNA, 18 nt, Bordetella pertussis
cacgcccgcggcgcccag

SEQ ID NO: 2338325 - RNA, 12 nt, Bordetella pertussis
cacgcccguccc

SEQ ID NO: 2338326 - RNA, 19 nt, Bordetella pertussis
cacgcccgucucgcgcgcc

SEQ ID NO: 2338327 - RNA, 20 nt, Bordetella pertussis
cacgcccgucucgcgcgcca

SEQ ID NO: 2338328 - RNA, 22 nt, Bordetella pertussis
cacgcccgucucgcgcgccagg

SEQ ID NO: 2338329 - RNA, 21 nt, Bordetella pertussis
cacgcccugcaccgucacgcg

SEQ ID NO: 2338330 - RNA, 13 nt, Bordetella pertussis
cacgcccuggcag

SEQ ID NO: 2338331 - RNA, 15 nt, Bordetella pertussis
cacgcccuggcgguc

SEQ ID NO: 2338332 - RNA, 21 nt, Bordetella pertussis
cacgcccuggcuggcggccca

SEQ ID NO: 2338333 - RNA, 22 nt, Bordetella pertussis
cacgcccuguugcuucaacucc

SEQ ID NO: 2338334 - RNA, 14 nt, Bordetella pertussis
cacgccgaaggcgu

SEQ ID NO: 2338335 - RNA, 23 nt, Bordetella pertussis
cacgccgaauacgcucaggguuu

SEQ ID NO: 2338336 - RNA, 20 nt, Bordetella pertussis
cacgccgaugaacgacaggg

SEQ ID NO: 2338337 - RNA, 19 nt, Bordetella pertussis
cacgccgaugaccagggcg

SEQ ID NO: 2338338 - RNA, 17 nt, Bordetella pertussis
cacgccgauugaggcca

SEQ ID NO: 2338339 - RNA, 20 nt, Bordetella pertussis
cacgccgauugaggccagca

SEQ ID NO: 2338340 - RNA, 14 nt, Bordetella pertussis
cacgccgcccagcg

SEQ ID NO: 2338341 - RNA, 12 nt, Bordetella pertussis
cacgccgccggc

SEQ ID NO: 2338342 - RNA, 14 nt, Bordetella pertussis
cacgccgccggcca

SEQ ID NO: 2338343 - RNA, 13 nt, Bordetella pertussis
cacgccgcgccgg

SEQ ID NO: 2338344 - RNA, 18 nt, Bordetella pertussis
cacgccgcgcgcgucgcc

SEQ ID NO: 2338345 - RNA, 19 nt, Bordetella pertussis
cacgccgcgcgcgucgccg

SEQ ID NO: 2338346 - RNA, 20 nt, Bordetella pertussis
cacgccgcgcucguugcgcg

SEQ ID NO: 2338347 - RNA, 17 nt, Bordetella pertussis
cacgccggaccagucga

SEQ ID NO: 2338348 - RNA, 20 nt, Bordetella pertussis
cacgccggccacgaacggcg

SEQ ID NO: 2338349 - RNA, 13 nt, Bordetella pertussis
cacgccggccagc

SEQ ID NO: 2338350 - RNA, 11 nt, Bordetella pertussis
cacgccggccg

SEQ ID NO: 2338351 - RNA, 17 nt, Bordetella pertussis
cacgccggccgccuggc

SEQ ID NO: 2338352 - RNA, 20 nt, Bordetella pertussis
cacgccggccugcgccagcu

SEQ ID NO: 2338353 - RNA, 14 nt, Bordetella pertussis
cacgccggcgcgcc

SEQ ID NO: 2338354 - RNA, 17 nt, Bordetella pertussis
cacgccggcgcgccggc

SEQ ID NO: 2338355 - RNA, 19 nt, Bordetella pertussis
cacgccggcgcgccggccg

SEQ ID NO: 2338356 - RNA, 21 nt, Bordetella pertussis
cacgccggcgcgccggccgcg

SEQ ID NO: 2338357 - RNA, 19 nt, Bordetella pertussis
cacgccggcgcgccgggcc

SEQ ID NO: 2338358 - RNA, 15 nt, Bordetella pertussis
cacgccggcggccau

SEQ ID NO: 2338359 - RNA, 17 nt, Bordetella pertussis
cacgccggcggccauga

SEQ ID NO: 2338360 - RNA, 21 nt, Bordetella pertussis
cacgccggcggccaugacggg

SEQ ID NO: 2338361 - RNA, 15 nt, Bordetella pertussis
cacgccggcggccca

SEQ ID NO: 2338362 - RNA, 15 nt, Bordetella pertussis
cacgccggcggcgcu

SEQ ID NO: 2338363 - RNA, 17 nt, Bordetella pertussis
cacgccggcggucacgc

SEQ ID NO: 2338364 - RNA, 15 nt, Bordetella pertussis
cacgccgggcgcgcu

SEQ ID NO: 2338365 - RNA, 17 nt, Bordetella pertussis
cacgccgggcgcgcugc

SEQ ID NO: 2338366 - RNA, 19 nt, Bordetella pertussis
cacgccgggcgcgcugccc

SEQ ID NO: 2338367 - RNA, 16 nt, Bordetella pertussis
cacgccgggcgcggcc

SEQ ID NO: 2338368 - RNA, 22 nt, Bordetella pertussis
cacgccgucagcgacaucgugc

SEQ ID NO: 2338369 - RNA, 23 nt, Bordetella pertussis
cacgccgucgagcugcucgagca

SEQ ID NO: 2338370 - RNA, 18 nt, Bordetella pertussis
cacgccguggcgcaaggc

SEQ ID NO: 2338371 - RNA, 16 nt, Bordetella pertussis
cacgccucgccggccc

SEQ ID NO: 2338372 - RNA, 14 nt, Bordetella pertussis
cacgccugccgcgc

SEQ ID NO: 2338373 - RNA, 15 nt, Bordetella pertussis
cacgccugccgcgcc

SEQ ID NO: 2338374 - RNA, 16 nt, Bordetella pertussis
cacgccugccgcgccc

SEQ ID NO: 2338375 - RNA, 17 nt, Bordetella pertussis
cacgccugccgcgcccg

SEQ ID NO: 2338376 - RNA, 13 nt, Bordetella pertussis
cacgccuggccgc

SEQ ID NO: 2338377 - RNA, 15 nt, Bordetella pertussis
cacgccuggccgcgc

SEQ ID NO: 2338378 - RNA, 16 nt, Bordetella pertussis
cacgccuggccgcgcu

SEQ ID NO: 2338379 - RNA, 17 nt, Bordetella pertussis
cacgccuggccgcgcuc

SEQ ID NO: 2338380 - RNA, 17 nt, Bordetella pertussis
cacgccuucgagcacca

SEQ ID NO: 2338381 - RNA, 18 nt, Bordetella pertussis
cacgccuucggcgcgcgc

SEQ ID NO: 2338382 - RNA, 19 nt, Bordetella pertussis
cacgccuucggcgcgcgcc

SEQ ID NO: 2338383 - RNA, 16 nt, Bordetella pertussis
cacgccuugcucgacc

SEQ ID NO: 2338384 - RNA, 19 nt, Bordetella pertussis
cacgccuugcucgaccagg

SEQ ID NO: 2338385 - RNA, 17 nt, Bordetella pertussis
cacgccuuguucgcgcg

SEQ ID NO: 2338386 - RNA, 18 nt, Bordetella pertussis
cacgccuuguucgcgcgc

SEQ ID NO: 2338387 - RNA, 15 nt, Bordetella pertussis
aggacggcgccgucc

SEQ ID NO: 2338388 - RNA, 18 nt, Bordetella pertussis
aggacggggaacaggcgc

SEQ ID NO: 2338389 - RNA, 23 nt, Bordetella pertussis
aggacggggaacaggcgcgccag

SEQ ID NO: 2338390 - RNA, 14 nt, Bordetella pertussis
aggacguccaggcc

SEQ ID NO: 2338391 - RNA, 15 nt, Bordetella pertussis
aggacuucgucgauc

SEQ ID NO: 2338392 - RNA, 15 nt, Bordetella pertussis
aggagacacgcuagg

SEQ ID NO: 2338393 - RNA, 21 nt, Bordetella pertussis
aggagacaucaugcagaaaca

SEQ ID NO: 2338394 - RNA, 16 nt, Bordetella pertussis
aggagcaacuggggcg

SEQ ID NO: 2338395 - RNA, 13 nt, Bordetella pertussis
aggagcaugcccu

SEQ ID NO: 2338396 - RNA, 20 nt, Bordetella pertussis
aggagccggcgggcggcugc

SEQ ID NO: 2338397 - RNA, 21 nt, Bordetella pertussis
aggagccuguccccgcgggga

SEQ ID NO: 2338398 - RNA, 17 nt, Bordetella pertussis
aggagcugcacaagguc

SEQ ID NO: 2338399 - RNA, 14 nt, Bordetella pertussis
aggaggcgcgggca

SEQ ID NO: 2338400 - RNA, 21 nt, Bordetella pertussis
aggauaccggagcggcucgcc

SEQ ID NO: 2338401 - RNA, 14 nt, Bordetella pertussis
aggaucaccgccgc

SEQ ID NO: 2338402 - RNA, 15 nt, Bordetella pertussis
aggaucaggccggcg

SEQ ID NO: 2338403 - RNA, 17 nt, Bordetella pertussis
aggaucgaaggcagcgc

SEQ ID NO: 2338404 - RNA, 12 nt, Bordetella pertussis
aggaucgcggcc

SEQ ID NO: 2338405 - RNA, 15 nt, Bordetella pertussis
aggaucgcggccagc

SEQ ID NO: 2338406 - RNA, 20 nt, Bordetella pertussis
aggaucgucgucaugaugua

SEQ ID NO: 2338407 - RNA, 13 nt, Bordetella pertussis
aggaugaacaucg

SEQ ID NO: 2338408 - RNA, 22 nt, Bordetella pertussis
aggaugaagaccacguggauga

SEQ ID NO: 2338409 - RNA, 16 nt, Bordetella pertussis
aggaugagcgccugca

SEQ ID NO: 2338410 - RNA, 16 nt, Bordetella pertussis
aggaugcccgcgggca

SEQ ID NO: 2338411 - RNA, 22 nt, Bordetella pertussis
aggaugcccuggguggcggggc

SEQ ID NO: 2338412 - RNA, 19 nt, Bordetella pertussis
aggaugcgcaccggccagg

SEQ ID NO: 2338413 - RNA, 20 nt, Bordetella pertussis
aggaugcgcaccggccaggg

SEQ ID NO: 2338414 - RNA, 14 nt, Bordetella pertussis
aggaugcgcgccag

SEQ ID NO: 2338415 - RNA, 14 nt, Bordetella pertussis
aggaugcgcgcggc

SEQ ID NO: 2338416 - RNA, 16 nt, Bordetella pertussis
aggaugcgcgcggcca

SEQ ID NO: 2338417 - RNA, 17 nt, Bordetella pertussis
aggaugcgcggcacguu

SEQ ID NO: 2338418 - RNA, 18 nt, Bordetella pertussis
aggaugcgcuggccggcc

SEQ ID NO: 2338419 - RNA, 14 nt, Bordetella pertussis
aggauggagagggc

SEQ ID NO: 2338420 - RNA, 18 nt, Bordetella pertussis
aggauggccacgaccacc

SEQ ID NO: 2338421 - RNA, 16 nt, Bordetella pertussis
aggauggcgccagccc

SEQ ID NO: 2338422 - RNA, 21 nt, Bordetella pertussis
aggaugggcgcggcgcgcgcc

SEQ ID NO: 2338423 - RNA, 18 nt, Bordetella pertussis
aggaugggcgcuuggccc

SEQ ID NO: 2338424 - RNA, 19 nt, Bordetella pertussis
aggaugggcgcuuggcccu

SEQ ID NO: 2338425 - RNA, 18 nt, Bordetella pertussis
aggauguccacggucgcc

SEQ ID NO: 2338426 - RNA, 14 nt, Bordetella pertussis
aggaugugcagcgc

SEQ ID NO: 2338427 - RNA, 19 nt, Bordetella pertussis
aggauguucaugaccgccg

SEQ ID NO: 2338428 - RNA, 20 nt, Bordetella pertussis
aggauguucaugaccgccgc

SEQ ID NO: 2338429 - RNA, 21 nt, Bordetella pertussis
aggauguucaugaccgccgcg

SEQ ID NO: 2338430 - RNA, 16 nt, Bordetella pertussis
aggauuccugcgagga

SEQ ID NO: 2338431 - RNA, 19 nt, Bordetella pertussis
aggauuccugcgaggacag

SEQ ID NO: 2338432 - RNA, 20 nt, Bordetella pertussis
aggauuccugcgaggacagg

SEQ ID NO: 2338433 - RNA, 21 nt, Bordetella pertussis
aggcaaagcgcggcugcgggc

SEQ ID NO: 2338434 - RNA, 16 nt, Bordetella pertussis
aggcaaaggcccaggc

SEQ ID NO: 2338435 - RNA, 17 nt, Bordetella pertussis
aggcaaaggcccaggca

SEQ ID NO: 2338436 - RNA, 12 nt, Bordetella pertussis
aggcgcggcgua

SEQ ID NO: 2338437 - RNA, 16 nt, Bordetella pertussis
aggcgcggcucgccgg

SEQ ID NO: 2338438 - RNA, 12 nt, Bordetella pertussis
aggcgcggcugg

SEQ ID NO: 2338439 - RNA, 17 nt, Bordetella pertussis
aggcgcgucgcugcgcg

SEQ ID NO: 2338440 - RNA, 14 nt, Bordetella pertussis
aggcgcgugagguc

SEQ ID NO: 2338441 - RNA, 20 nt, Bordetella pertussis
aggcgcgugaggucgcgcgu

SEQ ID NO: 2338442 - RNA, 18 nt, Bordetella pertussis
aggcgcgugcucaucggc

SEQ ID NO: 2338443 - RNA, 22 nt, Bordetella pertussis
aggcgcgugcucaucggcaggc

SEQ ID NO: 2338444 - RNA, 16 nt, Bordetella pertussis
aggcgcguggccacgg

SEQ ID NO: 2338445 - RNA, 21 nt, Bordetella pertussis
aggcgcgugggcaggugcuug

SEQ ID NO: 2338446 - RNA, 17 nt, Bordetella pertussis
aggcgcucaagggccug

SEQ ID NO: 2338447 - RNA, 22 nt, Bordetella pertussis
aggcgcucagccgugccgcgcg

SEQ ID NO: 2338448 - RNA, 18 nt, Bordetella pertussis
aggcgcuccagcaccugc

SEQ ID NO: 2338449 - RNA, 22 nt, Bordetella pertussis
aggcgcuccagcaccugcaccg

SEQ ID NO: 2338450 - RNA, 13 nt, Bordetella pertussis
aggcgcuccaugg

SEQ ID NO: 2338451 - RNA, 19 nt, Bordetella pertussis
aggcgcuccauggcgccgg

SEQ ID NO: 2338452 - RNA, 21 nt, Bordetella pertussis
aggcgcuccauggcgccggcg

SEQ ID NO: 2338453 - RNA, 14 nt, Bordetella pertussis
aggcgcucgcccuc

SEQ ID NO: 2338454 - RNA, 13 nt, Bordetella pertussis
aggcgcucgcgcg

SEQ ID NO: 2338455 - RNA, 14 nt, Bordetella pertussis
aggcgcucgcgcgc

SEQ ID NO: 2338456 - RNA, 17 nt, Bordetella pertussis
aggcgcucgcgcgccag

SEQ ID NO: 2338457 - RNA, 19 nt, Bordetella pertussis
aggcgcucgcgcugcagga

SEQ ID NO: 2338458 - RNA, 14 nt, Bordetella pertussis
aggcgcucggccag

SEQ ID NO: 2338459 - RNA, 14 nt, Bordetella pertussis
aggcgcucggccuu

SEQ ID NO: 2338460 - RNA, 21 nt, Bordetella pertussis
aggcgcucggcguugcuggca

SEQ ID NO: 2338461 - RNA, 21 nt, Bordetella pertussis
aggcgcugcagcaauccaucg

SEQ ID NO: 2338462 - RNA, 22 nt, Bordetella pertussis
aggcgcugguaguaggccacug

SEQ ID NO: 2338463 - RNA, 16 nt, Bordetella pertussis
aggcgcuguuggccgu

SEQ ID NO: 2338464 - RNA, 17 nt, Bordetella pertussis
aggcggcaagcggcgug

SEQ ID NO: 2338465 - RNA, 16 nt, Bordetella pertussis
aggcggcagaaggcga

SEQ ID NO: 2338466 - RNA, 14 nt, Bordetella pertussis
aggcggcaggcgcc

SEQ ID NO: 2338467 - RNA, 16 nt, Bordetella pertussis
aggcggcaggcgccgc

SEQ ID NO: 2338468 - RNA, 17 nt, Bordetella pertussis
aggcggcaggcgccgcc

SEQ ID NO: 2338469 - RNA, 19 nt, Bordetella pertussis
aggcggcaggcgccgccgc

SEQ ID NO: 2338470 - RNA, 13 nt, Bordetella pertussis
aggcggccaccac

SEQ ID NO: 2338471 - RNA, 17 nt, Bordetella pertussis
aggcggccagcaugcug

SEQ ID NO: 2338472 - RNA, 11 nt, Bordetella pertussis
aggcggccagg

SEQ ID NO: 2338473 - RNA, 12 nt, Bordetella pertussis
aggcggccaggc

SEQ ID NO: 2338474 - RNA, 23 nt, Bordetella pertussis
aggcggccaggcucugggcggag

SEQ ID NO: 2338475 - RNA, 13 nt, Bordetella pertussis
aggcggccagggc

SEQ ID NO: 2338476 - RNA, 18 nt, Bordetella pertussis
aggcggccagggccugcg

SEQ ID NO: 2338477 - RNA, 23 nt, Bordetella pertussis
aggcggccagggccugcgggccg

SEQ ID NO: 2338478 - RNA, 18 nt, Bordetella pertussis
aggcggccaucgccgcca

SEQ ID NO: 2338479 - RNA, 19 nt, Bordetella pertussis
aggcggccaucgccgccac

SEQ ID NO: 2338480 - RNA, 21 nt, Bordetella pertussis
aggcggcccagcguggcggug

SEQ ID NO: 2338481 - RNA, 12 nt, Bordetella pertussis
aggcggcccagg

SEQ ID NO: 2338482 - RNA, 20 nt, Bordetella pertussis
aggcggcccaggcguccagg

SEQ ID NO: 2338483 - RNA, 21 nt, Bordetella pertussis
aggcggcccaggcguccaggc

SEQ ID NO: 2338484 - RNA, 16 nt, Bordetella pertussis
aggcggcccggccgcc

SEQ ID NO: 2338485 - RNA, 18 nt, Bordetella pertussis
aggcggcccggccgccgc

SEQ ID NO: 2338486 - RNA, 23 nt, Bordetella pertussis
aggcggcccggccgccgccggca

SEQ ID NO: 2338487 - RNA, 16 nt, Bordetella pertussis
aggcggccgaccagca

SEQ ID NO: 2338488 - RNA, 17 nt, Bordetella pertussis
aggcggccgaccagcac

SEQ ID NO: 2338489 - RNA, 13 nt, Bordetella pertussis
aggcggccgcgcc

SEQ ID NO: 2338490 - RNA, 17 nt, Bordetella pertussis
aggcggccgcgcccgca

SEQ ID NO: 2338491 - RNA, 20 nt, Bordetella pertussis
aggcggccgcgggcggcgcg

SEQ ID NO: 2338492 - RNA, 22 nt, Bordetella pertussis
aggcggccgcgggcggcgcgcc

SEQ ID NO: 2338493 - RNA, 15 nt, Bordetella pertussis
aggcggccggcaggc

SEQ ID NO: 2338494 - RNA, 18 nt, Bordetella pertussis
aggcggccggcaggccgg

SEQ ID NO: 2338495 - RNA, 22 nt, Bordetella pertussis
aggcggccggcaggccggccag

SEQ ID NO: 2338496 - RNA, 23 nt, Bordetella pertussis
aggcggccggcaggccggccagc

SEQ ID NO: 2338497 - RNA, 18 nt, Bordetella pertussis
aggcggcgacgcagcacg

SEQ ID NO: 2338498 - RNA, 13 nt, Bordetella pertussis
aggcggcgcucga

SEQ ID NO: 2338499 - RNA, 21 nt, Bordetella pertussis
aggcggcggccggggccgccc

SEQ ID NO: 2338500 - RNA, 18 nt, Bordetella pertussis
aggcggcggugccagcgc

SEQ ID NO: 2338501 - RNA, 19 nt, Bordetella pertussis
aggcggcggugccagcgca

SEQ ID NO: 2338502 - RNA, 21 nt, Bordetella pertussis
aggcggcguaguucagccaca

SEQ ID NO: 2338503 - RNA, 17 nt, Bordetella pertussis
aggcggcugcccaccuu

SEQ ID NO: 2338504 - RNA, 23 nt, Bordetella pertussis
aggcggcuggugccgacggcgcg

SEQ ID NO: 2338505 - RNA, 13 nt, Bordetella pertussis
aggcgggacuggc

SEQ ID NO: 2338506 - RNA, 15 nt, Bordetella pertussis
aggcgggacuggcga

SEQ ID NO: 2338507 - RNA, 19 nt, Bordetella pertussis
aggcgggacuggcgagcac

SEQ ID NO: 2338508 - RNA, 19 nt, Bordetella pertussis
aggcgggcagcauggcgcc

SEQ ID NO: 2338509 - RNA, 22 nt, Bordetella pertussis
aggcgggcagcauggcgccaug

SEQ ID NO: 2338510 - RNA, 14 nt, Bordetella pertussis
aggcgggcagcggc

SEQ ID NO: 2338511 - RNA, 15 nt, Bordetella pertussis
aggcgggcagcggcg

SEQ ID NO: 2338512 - RNA, 17 nt, Bordetella pertussis
aggcgggcaucgcccac

SEQ ID NO: 2338513 - RNA, 12 nt, Bordetella pertussis
aggcgggcuggu

SEQ ID NO: 2338514 - RNA, 18 nt, Bordetella pertussis
aggcgggcuggucgcgcc

SEQ ID NO: 2338515 - RNA, 21 nt, Bordetella pertussis
aggcgguacaggccggcggcg

SEQ ID NO: 2338516 - RNA, 22 nt, Bordetella pertussis
aggcgguacaggccggcggcga

SEQ ID NO: 2338517 - RNA, 23 nt, Bordetella pertussis
aggcggucuucgaugcuggcgcg

SEQ ID NO: 2338518 - RNA, 18 nt, Bordetella pertussis
aggcggugccccggccuc

SEQ ID NO: 2338519 - RNA, 13 nt, Bordetella pertussis
aggcgguggccag

SEQ ID NO: 2338520 - RNA, 19 nt, Bordetella pertussis
aggcguaucgauagccgac

SEQ ID NO: 2338521 - RNA, 13 nt, Bordetella pertussis
aggcgucggccag

SEQ ID NO: 2338522 - RNA, 15 nt, Bordetella pertussis
aggcgucggccagcg

SEQ ID NO: 2338523 - RNA, 18 nt, Bordetella pertussis
aggcgucggccaggccga

SEQ ID NO: 2338524 - RNA, 17 nt, Bordetella pertussis
aggcgucggccauggcg

SEQ ID NO: 2338525 - RNA, 23 nt, Bordetella pertussis
aggcgucugcuacaccgugcugg

SEQ ID NO: 2338526 - RNA, 14 nt, Bordetella pertussis
aggcgugccgcgca

SEQ ID NO: 2338527 - RNA, 15 nt, Bordetella pertussis
aggcgugccgcgcag

SEQ ID NO: 2338528 - RNA, 16 nt, Bordetella pertussis
aggcgugcgcagcugu

SEQ ID NO: 2338529 - RNA, 15 nt, Bordetella pertussis
aggcgugcgcgggcg

SEQ ID NO: 2338530 - RNA, 17 nt, Bordetella pertussis
aggcgugcgcgggcgcc

SEQ ID NO: 2338531 - RNA, 21 nt, Bordetella pertussis
aggcgugcgcgggcgccaucg

SEQ ID NO: 2338532 - RNA, 12 nt, Bordetella pertussis
aggcgugcguga

SEQ ID NO: 2338533 - RNA, 17 nt, Bordetella pertussis
aggcgugcugcaccugc

SEQ ID NO: 2338534 - RNA, 21 nt, Bordetella pertussis
aggcguucggccacuuccugg

SEQ ID NO: 2338535 - RNA, 14 nt, Bordetella pertussis
aggcguuucgccag

SEQ ID NO: 2338536 - RNA, 18 nt, Bordetella pertussis
aggcguuucgccaggacg

SEQ ID NO: 2338537 - RNA, 17 nt, Bordetella pertussis
aggcucagcccggcgag

SEQ ID NO: 2338538 - RNA, 13 nt, Bordetella pertussis
aggcucaggcggc

SEQ ID NO: 2338539 - RNA, 14 nt, Bordetella pertussis
aggcucaggcggcc

SEQ ID NO: 2338540 - RNA, 16 nt, Bordetella pertussis
aggcucaggcggccag

SEQ ID NO: 2338541 - RNA, 17 nt, Bordetella pertussis
aggcucaggcggccagg

SEQ ID NO: 2338542 - RNA, 18 nt, Bordetella pertussis
aggcucaggcggccaggg

SEQ ID NO: 2338543 - RNA, 19 nt, Bordetella pertussis
aggcucaggcggccagggc

SEQ ID NO: 2338544 - RNA, 16 nt, Bordetella pertussis
aggcucccgcuggcgg

SEQ ID NO: 2338545 - RNA, 13 nt, Bordetella pertussis
aggcucuugacca

SEQ ID NO: 2338546 - RNA, 17 nt, Bordetella pertussis
aggcucuugaccagcuu

SEQ ID NO: 2338547 - RNA, 20 nt, Bordetella pertussis
aggcucuuuuucccggcgcg

SEQ ID NO: 2338548 - RNA, 22 nt, Bordetella pertussis
aggcucuuuuucgagccgcaga

SEQ ID NO: 2338549 - RNA, 16 nt, Bordetella pertussis
aggcugaaugccgccg

SEQ ID NO: 2338550 - RNA, 15 nt, Bordetella pertussis
aggcugaccagcgcg

SEQ ID NO: 2338551 - RNA, 17 nt, Bordetella pertussis
aggcugaccagcgcguc

SEQ ID NO: 2338552 - RNA, 16 nt, Bordetella pertussis
aggcugacgcccggcu

SEQ ID NO: 2338553 - RNA, 20 nt, Bordetella pertussis
aggcugacgcccggcucgcu

SEQ ID NO: 2338554 - RNA, 20 nt, Bordetella pertussis
aggcugaucacccacagcag

SEQ ID NO: 2338555 - RNA, 22 nt, Bordetella pertussis
aggcugcagcuugcgcgccagu

SEQ ID NO: 2338556 - RNA, 18 nt, Bordetella pertussis
aggcugcccuggcccagg

SEQ ID NO: 2338557 - RNA, 23 nt, Bordetella pertussis
aggcugcccuggcccaggccgaa

SEQ ID NO: 2338558 - RNA, 13 nt, Bordetella pertussis
aggcugccgccgg

SEQ ID NO: 2338559 - RNA, 15 nt, Bordetella pertussis
aggcugccgccggcg

SEQ ID NO: 2338560 - RNA, 19 nt, Bordetella pertussis
aggcugcgcaggcgccgca

SEQ ID NO: 2338561 - RNA, 17 nt, Bordetella pertussis
aggcugcgcgccggcgc

SEQ ID NO: 2338562 - RNA, 20 nt, Bordetella pertussis
aggcuguggccgcggcccag

SEQ ID NO: 2338563 - RNA, 21 nt, Bordetella pertussis
aggcuguggccgcggcccagc

SEQ ID NO: 2338564 - RNA, 18 nt, Bordetella pertussis
aggcuucgauggcggcgg

SEQ ID NO: 2338565 - RNA, 14 nt, Bordetella pertussis
aggcuucgcccgcc

SEQ ID NO: 2338566 - RNA, 16 nt, Bordetella pertussis
aggcuucgcccgccac

SEQ ID NO: 2338567 - RNA, 16 nt, Bordetella pertussis
aggcuugcagcaacgc

SEQ ID NO: 2338568 - RNA, 20 nt, Bordetella pertussis
aggcuugcagcuugcgcgcc

SEQ ID NO: 2338569 - RNA, 21 nt, Bordetella pertussis
aggcuugcagcuugcgcgccc

SEQ ID NO: 2338570 - RNA, 23 nt, Bordetella pertussis
aggcuugcagcuugcgcgccccc

SEQ ID NO: 2338571 - RNA, 17 nt, Bordetella pertussis
aggcuuucgcacagccg

SEQ ID NO: 2338572 - RNA, 16 nt, Bordetella pertussis
aggcuuugcgcgccau

SEQ ID NO: 2338573 - RNA, 19 nt, Bordetella pertussis
aggcuuugcgcgccaugca

SEQ ID NO: 2338574 - RNA, 20 nt, Bordetella pertussis
aggcuuuuuuucgccgggcg

SEQ ID NO: 2338575 - RNA, 10 nt, Bordetella pertussis
agggacaggc

SEQ ID NO: 2338576 - RNA, 14 nt, Bordetella pertussis
agggacaggcaccg

SEQ ID NO: 2338577 - RNA, 15 nt, Bordetella pertussis
agggaccaccccgag

SEQ ID NO: 2338578 - RNA, 22 nt, Bordetella pertussis
agggaccaccccgagauaggcg

SEQ ID NO: 2338579 - RNA, 15 nt, Bordetella pertussis
agggacgggccagcc

SEQ ID NO: 2338580 - RNA, 16 nt, Bordetella pertussis
agggacgggccagccc

SEQ ID NO: 2338581 - RNA, 18 nt, Bordetella pertussis
agggacuugggcaggccu

SEQ ID NO: 2338582 - RNA, 18 nt, Bordetella pertussis
agggagccguucuggcag

SEQ ID NO: 2338583 - RNA, 16 nt, Bordetella pertussis
agggaggcuguccccg

SEQ ID NO: 2338584 - RNA, 16 nt, Bordetella pertussis
agggaucagcccaguu

SEQ ID NO: 2338585 - RNA, 16 nt, Bordetella pertussis
agggcacaucggccac

SEQ ID NO: 2338586 - RNA, 17 nt, Bordetella pertussis
agggcacaucggccacc

SEQ ID NO: 2338587 - RNA, 18 nt, Bordetella pertussis
agggcacaucggccaccc

SEQ ID NO: 2338588 - RNA, 20 nt, Bordetella pertussis
agggcacaucggccacccgg

SEQ ID NO: 2338589 - RNA, 15 nt, Bordetella pertussis
agggcagcggccaga

SEQ ID NO: 2338590 - RNA, 19 nt, Bordetella pertussis
agggcaggaggcgcgggca

SEQ ID NO: 2338591 - RNA, 15 nt, Bordetella pertussis
agggcagggcgccgu

SEQ ID NO: 2338592 - RNA, 16 nt, Bordetella pertussis
agggcagggcgccguc

SEQ ID NO: 2338593 - RNA, 18 nt, Bordetella pertussis
agggcaugggcccgggcg

SEQ ID NO: 2338594 - RNA, 15 nt, Bordetella pertussis
agggccaccacgccg

SEQ ID NO: 2338595 - RNA, 14 nt, Bordetella pertussis
agggccacgcccag

SEQ ID NO: 2338596 - RNA, 15 nt, Bordetella pertussis
agggccacgcccagg

SEQ ID NO: 2338597 - RNA, 22 nt, Bordetella pertussis
agggccacgccggccgccuggc

SEQ ID NO: 2338598 - RNA, 18 nt, Bordetella pertussis
agggccacgcgcuugcgc

SEQ ID NO: 2338599 - RNA, 19 nt, Bordetella pertussis
agggccacgcgcuugcgcg

SEQ ID NO: 2338600 - RNA, 16 nt, Bordetella pertussis
agggccagcgccagca

SEQ ID NO: 2338601 - RNA, 19 nt, Bordetella pertussis
agggccaggcccacggcgc

SEQ ID NO: 2338602 - RNA, 16 nt, Bordetella pertussis
agggccaggccgccgc

SEQ ID NO: 2338603 - RNA, 15 nt, Bordetella pertussis
agggccauggcaggg

SEQ ID NO: 2338604 - RNA, 19 nt, Bordetella pertussis
agggccauguggcgcagcg

SEQ ID NO: 2338605 - RNA, 14 nt, Bordetella pertussis
agggccccagcauc

SEQ ID NO: 2338606 - RNA, 20 nt, Bordetella pertussis
agggccccccggcgcggccg

SEQ ID NO: 2338607 - RNA, 21 nt, Bordetella pertussis
agggccccccggcgcggccgg

SEQ ID NO: 2338608 - RNA, 19 nt, Bordetella pertussis
agggccccuccggcgccgc

SEQ ID NO: 2338609 - RNA, 18 nt, Bordetella pertussis
agggcccggacgcggccg

SEQ ID NO: 2338610 - RNA, 11 nt, Bordetella pertussis
agggccgcagc

SEQ ID NO: 2338611 - RNA, 15 nt, Bordetella pertussis
agggccgccagcacc

SEQ ID NO: 2338612 - RNA, 19 nt, Bordetella pertussis
agggccgccagcaccugcu

SEQ ID NO: 2338613 - RNA, 23 nt, Bordetella pertussis
agggccgccagggcggcugccga

SEQ ID NO: 2338614 - RNA, 14 nt, Bordetella pertussis
agggccgccgcgcc

SEQ ID NO: 2338615 - RNA, 15 nt, Bordetella pertussis
agggccgccgcgccc

SEQ ID NO: 2338616 - RNA, 19 nt, Bordetella pertussis
agggccgccgcgcccagcc

SEQ ID NO: 2338617 - RNA, 21 nt, Bordetella pertussis
agggccgcgagcaugcgcagc

SEQ ID NO: 2338618 - RNA, 12 nt, Bordetella pertussis
agggccgcggcg

SEQ ID NO: 2338619 - RNA, 21 nt, Bordetella pertussis
agggccgcggcgagcucggca

SEQ ID NO: 2338620 - RNA, 14 nt, Bordetella pertussis
agggccggaacagc

SEQ ID NO: 2338621 - RNA, 15 nt, Bordetella pertussis
agggccggaacagcg

SEQ ID NO: 2338622 - RNA, 17 nt, Bordetella pertussis
agggccggacuggcgcg

SEQ ID NO: 2338623 - RNA, 19 nt, Bordetella pertussis
agggccggacuggcgcgca

SEQ ID NO: 2338624 - RNA, 21 nt, Bordetella pertussis
agggccggacuggcgcgcacc

SEQ ID NO: 2338625 - RNA, 20 nt, Bordetella pertussis
agggccggccgggcgcggcg

SEQ ID NO: 2338626 - RNA, 23 nt, Bordetella pertussis
agggccggcgccagcauccggug

SEQ ID NO: 2338627 - RNA, 21 nt, Bordetella pertussis
agggccgugcccgagggcgcg

SEQ ID NO: 2338628 - RNA, 20 nt, Bordetella pertussis
agggccucgcgggccuuggc

SEQ ID NO: 2338629 - RNA, 13 nt, Bordetella pertussis
agggccugcgggc

SEQ ID NO: 2338630 - RNA, 19 nt, Bordetella pertussis
agggccugcgggccgggca

SEQ ID NO: 2338631 - RNA, 15 nt, Bordetella pertussis
agggccuggaagcug

SEQ ID NO: 2338632 - RNA, 22 nt, Bordetella pertussis
agggccuggaagcuggccagcg

SEQ ID NO: 2338633 - RNA, 18 nt, Bordetella pertussis
agggccuggcacaucggc

SEQ ID NO: 2338634 - RNA, 12 nt, Bordetella pertussis
agggccuggcgu

SEQ ID NO: 2338635 - RNA, 23 nt, Bordetella pertussis
agggcgaacgggguggccggcgc

SEQ ID NO: 2338636 - RNA, 15 nt, Bordetella pertussis
agggcgaagcgcgcc

SEQ ID NO: 2338637 - RNA, 14 nt, Bordetella pertussis
agggcgaaggccag

SEQ ID NO: 2338638 - RNA, 15 nt, Bordetella pertussis
agggcgacugcagca

SEQ ID NO: 2338639 - RNA, 20 nt, Bordetella pertussis
agggcgacugcagcaggcug

SEQ ID NO: 2338640 - RNA, 17 nt, Bordetella pertussis
agggcgaucagcaccgc

SEQ ID NO: 2338641 - RNA, 21 nt, Bordetella pertussis
agggcgaucagcaccgcggcg

SEQ ID NO: 2338642 - RNA, 17 nt, Bordetella pertussis
agggcgucggccgcgcc

SEQ ID NO: 2338643 - RNA, 12 nt, Bordetella pertussis
agggcgucggcg

SEQ ID NO: 2338644 - RNA, 18 nt, Bordetella pertussis
agggcgucggcgacguga

SEQ ID NO: 2338645 - RNA, 21 nt, Bordetella pertussis
agggcgucugcucgccguucu

SEQ ID NO: 2338646 - RNA, 14 nt, Bordetella pertussis
agggcgucuucgcc

SEQ ID NO: 2338647 - RNA, 21 nt, Bordetella pertussis
agggcgucuucgccgaccagc

SEQ ID NO: 2338648 - RNA, 13 nt, Bordetella pertussis
agggcgugcggga

SEQ ID NO: 2338649 - RNA, 14 nt, Bordetella pertussis
agggcuccaggcug

SEQ ID NO: 2338650 - RNA, 15 nt, Bordetella pertussis
agggcuccaggcuga

SEQ ID NO: 2338651 - RNA, 22 nt, Bordetella pertussis
agggcucgaccgccgccacgcg

SEQ ID NO: 2338652 - RNA, 18 nt, Bordetella pertussis
agggcucguagucggugg

SEQ ID NO: 2338653 - RNA, 19 nt, Bordetella pertussis
agggcugaucuugaugcgg

SEQ ID NO: 2338654 - RNA, 22 nt, Bordetella pertussis
agggcugcgugcgggacaggca

SEQ ID NO: 2338655 - RNA, 23 nt, Bordetella pertussis
agggcugcgugcgggacaggcau

SEQ ID NO: 2338656 - RNA, 15 nt, Bordetella pertussis
agggcuggccggcca

SEQ ID NO: 2338657 - RNA, 20 nt, Bordetella pertussis
agggcuuccaguucgcgcag

SEQ ID NO: 2338658 - RNA, 18 nt, Bordetella pertussis
agggcuugaccagggcgg

SEQ ID NO: 2338659 - RNA, 16 nt, Bordetella pertussis
agggcuugcggcgcug

SEQ ID NO: 2338660 - RNA, 20 nt, Bordetella pertussis
aggggacggcgcacccgcgg

SEQ ID NO: 2338661 - RNA, 17 nt, Bordetella pertussis
aggggauugccgcgcgg

SEQ ID NO: 2338662 - RNA, 15 nt, Bordetella pertussis
aggggcaggcgcacg

SEQ ID NO: 2338663 - RNA, 18 nt, Bordetella pertussis
aggggcaggugccccacg

SEQ ID NO: 2338664 - RNA, 17 nt, Bordetella pertussis
aggggccagccuggccu

SEQ ID NO: 2338665 - RNA, 22 nt, Bordetella pertussis
aggggccggcuuuggacaggcg

SEQ ID NO: 2338666 - RNA, 11 nt, Bordetella pertussis
aggggcggcgc

SEQ ID NO: 2338667 - RNA, 13 nt, Bordetella pertussis
aggggcggcgcgg

SEQ ID NO: 2338668 - RNA, 15 nt, Bordetella pertussis
aggggcggcgcggcg

SEQ ID NO: 2338669 - RNA, 18 nt, Bordetella pertussis
aggggcggcuucaggcgc

SEQ ID NO: 2338670 - RNA, 16 nt, Bordetella pertussis
aggggcgggugcggau

SEQ ID NO: 2338671 - RNA, 22 nt, Bordetella pertussis
aggggcuccaggaacaccaccu

SEQ ID NO: 2338672 - RNA, 13 nt, Bordetella pertussis
aggggcucgcgcc

SEQ ID NO: 2338673 - RNA, 17 nt, Bordetella pertussis
aggggcucggccaggug

SEQ ID NO: 2338674 - RNA, 19 nt, Bordetella pertussis
aggggcucggccaggugcg

SEQ ID NO: 2338675 - RNA, 22 nt, Bordetella pertussis
aggggcucuucgacagcgcgca

SEQ ID NO: 2338676 - RNA, 22 nt, Bordetella pertussis
aggggcugccgugaggcagccu

SEQ ID NO: 2338677 - RNA, 21 nt, Bordetella pertussis
agggggcuuuuugccuugggg

SEQ ID NO: 2338678 - RNA, 22 nt, Bordetella pertussis
agggggcuuuuuugccuugggg

SEQ ID NO: 2338679 - RNA, 14 nt, Bordetella pertussis
aggggggcgguuca

SEQ ID NO: 2338680 - RNA, 18 nt, Bordetella pertussis
agggguccguggcggccg

SEQ ID NO: 2338681 - RNA, 17 nt, Bordetella pertussis
aggguacggcgaugccg

SEQ ID NO: 2338682 - RNA, 20 nt, Bordetella pertussis
aggguacggcgaugccggcg

SEQ ID NO: 2338683 - RNA, 13 nt, Bordetella pertussis
agggucaaggcgc

SEQ ID NO: 2338684 - RNA, 17 nt, Bordetella pertussis
agggucaaggcgcggcc

SEQ ID NO: 2338685 - RNA, 18 nt, Bordetella pertussis
agggucaaggcgcggccg

SEQ ID NO: 2338686 - RNA, 22 nt, Bordetella pertussis
agggucagcccgccaucgcgca

SEQ ID NO: 2338687 - RNA, 17 nt, Bordetella pertussis
agggucugcuggucgcg

SEQ ID NO: 2338688 - RNA, 21 nt, Bordetella pertussis
agggucuggccggugaugcgg

SEQ ID NO: 2338689 - RNA, 21 nt, Bordetella pertussis
agggugaccaugucgccguug

SEQ ID NO: 2338690 - RNA, 14 nt, Bordetella pertussis
agggugacgggcug

SEQ ID NO: 2338691 - RNA, 16 nt, Bordetella pertussis
agggugacgggcuggg

SEQ ID NO: 2338692 - RNA, 13 nt, Bordetella pertussis
agggugagugccc

SEQ ID NO: 2338693 - RNA, 13 nt, Bordetella pertussis
agggugcaccagg

SEQ ID NO: 2338694 - RNA, 21 nt, Bordetella pertussis
agggugcccaguucgcggccg

SEQ ID NO: 2338695 - RNA, 14 nt, Bordetella pertussis
agggugccuguccc

SEQ ID NO: 2338696 - RNA, 22 nt, Bordetella pertussis
agggugccuguccccgcgggga

SEQ ID NO: 2338697 - RNA, 19 nt, Bordetella pertussis
agggugccugucccggcug

SEQ ID NO: 2338698 - RNA, 22 nt, Bordetella pertussis
agggugccugucccugccggga

SEQ ID NO: 2338699 - RNA, 15 nt, Bordetella pertussis
agggugcggcgccac

SEQ ID NO: 2338700 - RNA, 17 nt, Bordetella pertussis
agggugcggcgccacug

SEQ ID NO: 2338701 - RNA, 21 nt, Bordetella pertussis
aggguggagaauucggcgcgu

SEQ ID NO: 2338702 - RNA, 20 nt, Bordetella pertussis
aggguggcauugacgcccac

SEQ ID NO: 2338703 - RNA, 17 nt, Bordetella pertussis
aggguggcgccggccac

SEQ ID NO: 2338704 - RNA, 19 nt, Bordetella pertussis
aggucggccaccgccgugg

SEQ ID NO: 2338705 - RNA, 18 nt, Bordetella pertussis
aggucggccagccggccg

SEQ ID NO: 2338706 - RNA, 19 nt, Bordetella pertussis
aggucggccagccggccga

SEQ ID NO: 2338707 - RNA, 12 nt, Bordetella pertussis
aggucggccagg

SEQ ID NO: 2338708 - RNA, 13 nt, Bordetella pertussis
aggucggcgccca

SEQ ID NO: 2338709 - RNA, 18 nt, Bordetella pertussis
aggucggcgcccacgccg

SEQ ID NO: 2338710 - RNA, 16 nt, Bordetella pertussis
aggucggcggccagcg

SEQ ID NO: 2338711 - RNA, 14 nt, Bordetella pertussis
aggucggcgucguc

SEQ ID NO: 2338712 - RNA, 21 nt, Bordetella pertussis
aggucgggauaguccagcacc

SEQ ID NO: 2338713 - RNA, 23 nt, Bordetella pertussis
aggucgggcacgaucaccgccgc

SEQ ID NO: 2338714 - RNA, 16 nt, Bordetella pertussis
aggucggggcgcucga

SEQ ID NO: 2338715 - RNA, 18 nt, Bordetella pertussis
aggucggggcgcucgagc

SEQ ID NO: 2338716 - RNA, 21 nt, Bordetella pertussis
aggucguacagcgccugcgcg

SEQ ID NO: 2338717 - RNA, 17 nt, Bordetella pertussis
aggucguagaccgccgc

SEQ ID NO: 2338718 - RNA, 20 nt, Bordetella pertussis
aggucguaguauccgacgcg

SEQ ID NO: 2338719 - RNA, 18 nt, Bordetella pertussis
aggucgucgagccgggcc

SEQ ID NO: 2338720 - RNA, 22 nt, Bordetella pertussis
aggucguggcccagccggugcg

SEQ ID NO: 2338721 - RNA, 21 nt, Bordetella pertussis
aggucugcacgaggcgcucgg

SEQ ID NO: 2338722 - RNA, 17 nt, Bordetella pertussis
aggucugggccagcagg

SEQ ID NO: 2338723 - RNA, 18 nt, Bordetella pertussis
aggucugggccagcaggc

SEQ ID NO: 2338724 - RNA, 21 nt, Bordetella pertussis
aggucugggccagcaggcuca

SEQ ID NO: 2338725 - RNA, 21 nt, Bordetella pertussis
aggucuuggcgugcaggcugg

SEQ ID NO: 2338726 - RNA, 16 nt, Bordetella pertussis
aggugaaacagcagcg

SEQ ID NO: 2338727 - RNA, 19 nt, Bordetella pertussis
aggugaucugguccacggc

SEQ ID NO: 2338728 - RNA, 17 nt, Bordetella pertussis
aggugaugauggccgag

SEQ ID NO: 2338729 - RNA, 15 nt, Bordetella pertussis
aggugcacgugggca

SEQ ID NO: 2338730 - RNA, 18 nt, Bordetella pertussis
aggugcagaaaccccagg

SEQ ID NO: 2338731 - RNA, 18 nt, Bordetella pertussis
aggugcaggguuggcgcg

SEQ ID NO: 2338732 - RNA, 20 nt, Bordetella pertussis
aggugcaggguuggcgcgcc

SEQ ID NO: 2338733 - RNA, 21 nt, Bordetella pertussis
aggugcaggguuggcgcgccg

SEQ ID NO: 2338734 - RNA, 21 nt, Bordetella pertussis
aggugccagccuguugcagga

SEQ ID NO: 2338735 - RNA, 18 nt, Bordetella pertussis
aggugcccaucaggccga

SEQ ID NO: 2338736 - RNA, 15 nt, Bordetella pertussis
aggugccccacgccg

SEQ ID NO: 2338737 - RNA, 19 nt, Bordetella pertussis
aguucggccagcggcaggc

SEQ ID NO: 2338738 - RNA, 13 nt, Bordetella pertussis
aguucggccgcca

SEQ ID NO: 2338739 - RNA, 17 nt, Bordetella pertussis
aguucggccgccaggua

SEQ ID NO: 2338740 - RNA, 18 nt, Bordetella pertussis
aguucggccgccagguag

SEQ ID NO: 2338741 - RNA, 23 nt, Bordetella pertussis
aguucggccgccaggucggccac

SEQ ID NO: 2338742 - RNA, 21 nt, Bordetella pertussis
aguucggccggcggcccaucg

SEQ ID NO: 2338743 - RNA, 22 nt, Bordetella pertussis
aguucggcgcgcgugccgcgca

SEQ ID NO: 2338744 - RNA, 21 nt, Bordetella pertussis
aguucgggguccagcaaaugg

SEQ ID NO: 2338745 - RNA, 12 nt, Bordetella pertussis
aguucggugcgg

SEQ ID NO: 2338746 - RNA, 19 nt, Bordetella pertussis
aguucgucgucgccaccgc

SEQ ID NO: 2338747 - RNA, 15 nt, Bordetella pertussis
aguucuucuuggcca

SEQ ID NO: 2338748 - RNA, 21 nt, Bordetella pertussis
aguugaaccgcaacgccagca

SEQ ID NO: 2338749 - RNA, 14 nt, Bordetella pertussis
aguugacgaugccc

SEQ ID NO: 2338750 - RNA, 16 nt, Bordetella pertussis
aguugacgaugcccag

SEQ ID NO: 2338751 - RNA, 17 nt, Bordetella pertussis
aguugaggaugcgcgcg

SEQ ID NO: 2338752 - RNA, 21 nt, Bordetella pertussis
aguugcaccagugcgccggcg

SEQ ID NO: 2338753 - RNA, 11 nt, Bordetella pertussis
aguugcagcau

SEQ ID NO: 2338754 - RNA, 12 nt, Bordetella pertussis
aguugccgccgc

SEQ ID NO: 2338755 - RNA, 15 nt, Bordetella pertussis
aguugcgcgccgucg

SEQ ID NO: 2338756 - RNA, 21 nt, Bordetella pertussis
aguugcggccgugcgccagcg

SEQ ID NO: 2338757 - RNA, 13 nt, Bordetella pertussis
aguugcggggcgc

SEQ ID NO: 2338758 - RNA, 21 nt, Bordetella pertussis
aguugcgggucgucccagcgc

SEQ ID NO: 2338759 - RNA, 23 nt, Bordetella pertussis
aguugcgucuccagcgcggcgga

SEQ ID NO: 2338760 - RNA, 21 nt, Bordetella pertussis
aguugcuugcgauaggugcgc

SEQ ID NO: 2338761 - RNA, 13 nt, Bordetella pertussis
aguuggcagagug

SEQ ID NO: 2338762 - RNA, 21 nt, Bordetella pertussis
aguuggcggcgcagccgccau

SEQ ID NO: 2338763 - RNA, 16 nt, Bordetella pertussis
aguugggcgccuugcc

SEQ ID NO: 2338764 - RNA, 21 nt, Bordetella pertussis
aguugggcgcgcccagccccg

SEQ ID NO: 2338765 - RNA, 14 nt, Bordetella pertussis
aguugguggcaggc

SEQ ID NO: 2338766 - RNA, 14 nt, Bordetella pertussis
aguuguagguccag

SEQ ID NO: 2338767 - RNA, 15 nt, Bordetella pertussis
aguuguaguggugua

SEQ ID NO: 2338768 - RNA, 18 nt, Bordetella pertussis
aguugucggcgcagaugg

SEQ ID NO: 2338769 - RNA, 16 nt, Bordetella pertussis
aguuugcgggugccag

SEQ ID NO: 2338770 - RNA, 18 nt, Bordetella pertussis
aguuuuuccucuaccccg

SEQ ID NO: 2338771 - RNA, 20 nt, Bordetella pertussis
auaacgccacuugcaggccg

SEQ ID NO: 2338772 - RNA, 20 nt, Bordetella pertussis
auaacguggcgcgcaccugg

SEQ ID NO: 2338773 - RNA, 13 nt, Bordetella pertussis
auaaggcgugccg

SEQ ID NO: 2338774 - RNA, 17 nt, Bordetella pertussis
auaaggcucaccucgcg

SEQ ID NO: 2338775 - RNA, 21 nt, Bordetella pertussis
auacaacgaguaccugcuggu

SEQ ID NO: 2338776 - RNA, 12 nt, Bordetella pertussis
auacaaggugcc

SEQ ID NO: 2338777 - RNA, 17 nt, Bordetella pertussis
auacaaggugccugucc

SEQ ID NO: 2338778 - RNA, 17 nt, Bordetella pertussis
auacagaucgccgccgc

SEQ ID NO: 2338779 - RNA, 13 nt, Bordetella pertussis
auacagcaaggac

SEQ ID NO: 2338780 - RNA, 16 nt, Bordetella pertussis
auacagcuuggcgcgc

SEQ ID NO: 2338781 - RNA, 14 nt, Bordetella pertussis
auacaggaagcgcu

SEQ ID NO: 2338782 - RNA, 17 nt, Bordetella pertussis
auacaggaagcgcuggc

SEQ ID NO: 2338783 - RNA, 13 nt, Bordetella pertussis
auaccacgcgcgg

SEQ ID NO: 2338784 - RNA, 16 nt, Bordetella pertussis
auaccacgcgcggcgg

SEQ ID NO: 2338785 - RNA, 17 nt, Bordetella pertussis
auaccagcccggcgcga

SEQ ID NO: 2338786 - RNA, 18 nt, Bordetella pertussis
auacccgcuucgacggcu

SEQ ID NO: 2338787 - RNA, 15 nt, Bordetella pertussis
auacccguccuuggc

SEQ ID NO: 2338788 - RNA, 18 nt, Bordetella pertussis
auaccgaaggaccaaguc

SEQ ID NO: 2338789 - RNA, 14 nt, Bordetella pertussis
auaccggagcggcu

SEQ ID NO: 2338790 - RNA, 15 nt, Bordetella pertussis
auaccggagcggcuc

SEQ ID NO: 2338791 - RNA, 15 nt, Bordetella pertussis
auaccggccgcgggu

SEQ ID NO: 2338792 - RNA, 16 nt, Bordetella pertussis
auaccgggcuggucag

SEQ ID NO: 2338793 - RNA, 16 nt, Bordetella pertussis
auaccgucgcgcucga

SEQ ID NO: 2338794 - RNA, 17 nt, Bordetella pertussis
auaccgucuuggcaguc

SEQ ID NO: 2338795 - RNA, 17 nt, Bordetella pertussis
auaccucgauggcggug

SEQ ID NO: 2338796 - RNA, 17 nt, Bordetella pertussis
auaccuucggcaugguc

SEQ ID NO: 2338797 - RNA, 23 nt, Bordetella pertussis
auacgccgccauggugccgcgca

SEQ ID NO: 2338798 - RNA, 14 nt, Bordetella pertussis
auacgccgcugaug

SEQ ID NO: 2338799 - RNA, 14 nt, Bordetella pertussis
auacgccgugcugu

SEQ ID NO: 2338800 - RNA, 19 nt, Bordetella pertussis
auacgcgacaguucgcccc

SEQ ID NO: 2338801 - RNA, 18 nt, Bordetella pertussis
auacgcgaugccgaucgc

SEQ ID NO: 2338802 - RNA, 12 nt, Bordetella pertussis
auacgcgccgcc

SEQ ID NO: 2338803 - RNA, 12 nt, Bordetella pertussis
auacggccacgc

SEQ ID NO: 2338804 - RNA, 16 nt, Bordetella pertussis
auacggccagcgccag

SEQ ID NO: 2338805 - RNA, 18 nt, Bordetella pertussis
auacgggcgcggcgucga

SEQ ID NO: 2338806 - RNA, 14 nt, Bordetella pertussis
auacguccuuuggc

SEQ ID NO: 2338807 - RNA, 16 nt, Bordetella pertussis
auacguccuuuggcgu

SEQ ID NO: 2338808 - RNA, 19 nt, Bordetella pertussis
auacgugcugcaggaaguc

SEQ ID NO: 2338809 - RNA, 19 nt, Bordetella pertussis
auacucgaugcccagcacc

SEQ ID NO: 2338810 - RNA, 20 nt, Bordetella pertussis
auacugcgcaugggcgcagg

SEQ ID NO: 2338811 - RNA, 21 nt, Bordetella pertussis
auacuucguggcgcagcuccg

SEQ ID NO: 2338812 - RNA, 21 nt, Bordetella pertussis
auagacauugcccagcaccac

SEQ ID NO: 2338813 - RNA, 12 nt, Bordetella pertussis
auagaccagcag

SEQ ID NO: 2338814 - RNA, 13 nt, Bordetella pertussis
auagaccagcagc

SEQ ID NO: 2338815 - RNA, 22 nt, Bordetella pertussis
auagacgcgcagcggcaggccc

SEQ ID NO: 2338816 - RNA, 14 nt, Bordetella pertussis
auagacggcgucgg

SEQ ID NO: 2338817 - RNA, 17 nt, Bordetella pertussis
auagaucauccaggugg

SEQ ID NO: 2338818 - RNA, 20 nt, Bordetella pertussis
auagccaugcggacgccagc

SEQ ID NO: 2338819 - RNA, 13 nt, Bordetella pertussis
auagcccagcacc

SEQ ID NO: 2338820 - RNA, 22 nt, Bordetella pertussis
auagcccagcaccugcaggccg

SEQ ID NO: 2338821 - RNA, 17 nt, Bordetella pertussis
auagcccaggccgccgg

SEQ ID NO: 2338822 - RNA, 13 nt, Bordetella pertussis
auagcccaggcgg

SEQ ID NO: 2338823 - RNA, 23 nt, Bordetella pertussis
auagcccggcgcgauggucacca

SEQ ID NO: 2338824 - RNA, 16 nt, Bordetella pertussis
auagcccgugcgggcc

SEQ ID NO: 2338825 - RNA, 17 nt, Bordetella pertussis
auagcccgugcgggccu

SEQ ID NO: 2338826 - RNA, 18 nt, Bordetella pertussis
auagcccgugcgggccug

SEQ ID NO: 2338827 - RNA, 14 nt, Bordetella pertussis
auagccgcgcgccu

SEQ ID NO: 2338828 - RNA, 21 nt, Bordetella pertussis
auagccgcggcgccgcauuuc

SEQ ID NO: 2338829 - RNA, 14 nt, Bordetella pertussis
auagcgcgccacaa

SEQ ID NO: 2338830 - RNA, 23 nt, Bordetella pertussis
auagcgcuugccugacgugcgcc

SEQ ID NO: 2338831 - RNA, 17 nt, Bordetella pertussis
auagcggaugaugggca

SEQ ID NO: 2338832 - RNA, 20 nt, Bordetella pertussis
auagcgggccugcagcauga

SEQ ID NO: 2338833 - RNA, 17 nt, Bordetella pertussis
auagcgguggcgggcca

SEQ ID NO: 2338834 - RNA, 17 nt, Bordetella pertussis
auaggcgcgcaccagcc

SEQ ID NO: 2338835 - RNA, 14 nt, Bordetella pertussis
auaggcggccaggc

SEQ ID NO: 2338836 - RNA, 19 nt, Bordetella pertussis
auagggccauggcagggcg

SEQ ID NO: 2338837 - RNA, 19 nt, Bordetella pertussis
auagggggcauggcgccgc

SEQ ID NO: 2338838 - RNA, 13 nt, Bordetella pertussis
auaguccagcacc

SEQ ID NO: 2338839 - RNA, 20 nt, Bordetella pertussis
auaguggucgccggcgcaac

SEQ ID NO: 2338840 - RNA, 14 nt, Bordetella pertussis
auauagaccagcag

SEQ ID NO: 2338841 - RNA, 16 nt, Bordetella pertussis
auauagaccagcagcu

SEQ ID NO: 2338842 - RNA, 15 nt, Bordetella pertussis
auauagggccauggc

SEQ ID NO: 2338843 - RNA, 20 nt, Bordetella pertussis
auauagggccauggcagggc

SEQ ID NO: 2338844 - RNA, 18 nt, Bordetella pertussis
auauagggggcauggcgc

SEQ ID NO: 2338845 - RNA, 22 nt, Bordetella pertussis
auauagggggcauggcgccgcg

SEQ ID NO: 2338846 - RNA, 12 nt, Bordetella pertussis
auauccacgcca

SEQ ID NO: 2338847 - RNA, 16 nt, Bordetella pertussis
auauccacgccacugg

SEQ ID NO: 2338848 - RNA, 24 nt, Bordetella pertussis
auauccacgccuucggcgcgcgcc

SEQ ID NO: 2338849 - RNA, 14 nt, Bordetella pertussis
auauccaggcgcgu

SEQ ID NO: 2338850 - RNA, 14 nt, Bordetella pertussis
auauccaggcggcg

SEQ ID NO: 2338851 - RNA, 15 nt, Bordetella pertussis
auauccaggcggcgc

SEQ ID NO: 2338852 - RNA, 22 nt, Bordetella pertussis
auaucgaagacaugcugcgaca

SEQ ID NO: 2338853 - RNA, 16 nt, Bordetella pertussis
auaucgacggcgccua

SEQ ID NO: 2338854 - RNA, 13 nt, Bordetella pertussis
auaucggccaggc

SEQ ID NO: 2338855 - RNA, 19 nt, Bordetella pertussis
auaucuggcaaugguccag

SEQ ID NO: 2338856 - RNA, 14 nt, Bordetella pertussis
auaugcagccgcac

SEQ ID NO: 2338857 - RNA, 15 nt, Bordetella pertussis
auaugcagccgcacc

SEQ ID NO: 2338858 - RNA, 18 nt, Bordetella pertussis
auaugcagccgcaccagc

SEQ ID NO: 2338859 - RNA, 20 nt, Bordetella pertussis
auaugcagccgcaccagcgc

SEQ ID NO: 2338860 - RNA, 21 nt, Bordetella pertussis
auaugcagccgcaccagcgca

SEQ ID NO: 2338861 - RNA, 12 nt, Bordetella pertussis
auaugccgccgg

SEQ ID NO: 2338862 - RNA, 14 nt, Bordetella pertussis
auaugccgccggcc

SEQ ID NO: 2338863 - RNA, 13 nt, Bordetella pertussis
auaugcgccaggc

SEQ ID NO: 2338864 - RNA, 21 nt, Bordetella pertussis
auaugcgcccgaugcucgccg

SEQ ID NO: 2338865 - RNA, 14 nt, Bordetella pertussis
auauggagccaggc

SEQ ID NO: 2338866 - RNA, 12 nt, Bordetella pertussis
auauggccaggg

SEQ ID NO: 2338867 - RNA, 23 nt, Bordetella pertussis
auauggccggcgcgcucgcugcc

SEQ ID NO: 2338868 - RNA, 17 nt, Bordetella pertussis
auauugaaggccgaggc

SEQ ID NO: 2338869 - RNA, 21 nt, Bordetella pertussis
aucaaaaaggcccuugagcaa

SEQ ID NO: 2338870 - RNA, 22 nt, Bordetella pertussis
aucaacgacaaagccuccgcau

SEQ ID NO: 2338871 - RNA, 19 nt, Bordetella pertussis
aucaacgggccgcugguca

SEQ ID NO: 2338872 - RNA, 19 nt, Bordetella pertussis
aucaacuucaucgucauca

SEQ ID NO: 2338873 - RNA, 21 nt, Bordetella pertussis
aucaacuuccagcgcccgcgg

SEQ ID NO: 2338874 - RNA, 16 nt, Bordetella pertussis
aucaaggccgauagcg

SEQ ID NO: 2338875 - RNA, 16 nt, Bordetella pertussis
aucaaucugaucaucu

SEQ ID NO: 2338876 - RNA, 22 nt, Bordetella pertussis
aucaaugccaaucaugcgcugc

SEQ ID NO: 2338877 - RNA, 15 nt, Bordetella pertussis
aucacauaggccggc

SEQ ID NO: 2338878 - RNA, 16 nt, Bordetella pertussis
aucacauaggccggca

SEQ ID NO: 2338879 - RNA, 16 nt, Bordetella pertussis
aucaccacgcccgcgc

SEQ ID NO: 2338880 - RNA, 20 nt, Bordetella pertussis
aucaccacgggcacgauggc

SEQ ID NO: 2338881 - RNA, 21 nt, Bordetella pertussis
aucaccagcccggcggugacc

SEQ ID NO: 2338882 - RNA, 15 nt, Bordetella pertussis
aucacccacagcagc

SEQ ID NO: 2338883 - RNA, 13 nt, Bordetella pertussis
aucacccagcggc

SEQ ID NO: 2338884 - RNA, 22 nt, Bordetella pertussis
aucacccgauacgacacgccgc

SEQ ID NO: 2338885 - RNA, 11 nt, Bordetella pertussis
aucaccgccau

SEQ ID NO: 2338886 - RNA, 18 nt, Bordetella pertussis
aucaccgccauggcggcc

SEQ ID NO: 2338887 - RNA, 20 nt, Bordetella pertussis
aucaccgccauggcggccgc

SEQ ID NO: 2338888 - RNA, 13 nt, Bordetella pertussis
aucaccugcaggc

SEQ ID NO: 2338889 - RNA, 15 nt, Bordetella pertussis
aucaccugcaggccc

SEQ ID NO: 2338890 - RNA, 22 nt, Bordetella pertussis
aucaccugcaggcccaccggca

SEQ ID NO: 2338891 - RNA, 12 nt, Bordetella pertussis
aucaccugggca

SEQ ID NO: 2338892 - RNA, 14 nt, Bordetella pertussis
aucacgagcagguu

SEQ ID NO: 2338893 - RNA, 13 nt, Bordetella pertussis
aucacgccgucga

SEQ ID NO: 2338894 - RNA, 23 nt, Bordetella pertussis
aucacgcgcuccggcugcgcgcg

SEQ ID NO: 2338895 - RNA, 12 nt, Bordetella pertussis
aucacgcggucg

SEQ ID NO: 2338896 - RNA, 19 nt, Bordetella pertussis
aucacgcguacggcccugg

SEQ ID NO: 2338897 - RNA, 18 nt, Bordetella pertussis
aucacgcuggccgcgccc

SEQ ID NO: 2338898 - RNA, 13 nt, Bordetella pertussis
aucacgggcgcca

SEQ ID NO: 2338899 - RNA, 19 nt, Bordetella pertussis
aucacgggcgccagcagcg

SEQ ID NO: 2338900 - RNA, 16 nt, Bordetella pertussis
aucacgguaggcgcgu

SEQ ID NO: 2338901 - RNA, 18 nt, Bordetella pertussis
aucacggugucgaugggc

SEQ ID NO: 2338902 - RNA, 23 nt, Bordetella pertussis
aucacggugucgaugggcccggg

SEQ ID NO: 2338903 - RNA, 15 nt, Bordetella pertussis
aucagauggcgcagc

SEQ ID NO: 2338904 - RNA, 17 nt, Bordetella pertussis
aucagauggcgcagcgg

SEQ ID NO: 2338905 - RNA, 19 nt, Bordetella pertussis
aucagcaagggccccagca

SEQ ID NO: 2338906 - RNA, 23 nt, Bordetella pertussis
aucagcaccacggcggccaggcc

SEQ ID NO: 2338907 - RNA, 16 nt, Bordetella pertussis
aucagcacgaucuggc

SEQ ID NO: 2338908 - RNA, 16 nt, Bordetella pertussis
aucagcagacccuggc

SEQ ID NO: 2338909 - RNA, 17 nt, Bordetella pertussis
aucagcaggcccaccag

SEQ ID NO: 2338910 - RNA, 16 nt, Bordetella pertussis
aucagcauaucgucgc

SEQ ID NO: 2338911 - RNA, 20 nt, Bordetella pertussis
aucagccagccggcggccag

SEQ ID NO: 2338912 - RNA, 18 nt, Bordetella pertussis
aucagcgacagcaggguc

SEQ ID NO: 2338913 - RNA, 14 nt, Bordetella pertussis
aucagcgcggccgc

SEQ ID NO: 2338914 - RNA, 14 nt, Bordetella pertussis
aucagcgcgggcca

SEQ ID NO: 2338915 - RNA, 20 nt, Bordetella pertussis
aucagcggcagcacgauggc

SEQ ID NO: 2338916 - RNA, 15 nt, Bordetella pertussis
aucagcgugccgccg

SEQ ID NO: 2338917 - RNA, 16 nt, Bordetella pertussis
aucagcucgaccacgg

SEQ ID NO: 2338918 - RNA, 17 nt, Bordetella pertussis
aucagcucgaccacggc

SEQ ID NO: 2338919 - RNA, 17 nt, Bordetella pertussis
aucagcuugaugccggc

SEQ ID NO: 2338920 - RNA, 21 nt, Bordetella pertussis
aucagcuugggcuugauggcc

SEQ ID NO: 2338921 - RNA, 18 nt, Bordetella pertussis
aucaggaacggcauggca

SEQ ID NO: 2338922 - RNA, 20 nt, Bordetella pertussis
aucaggaggaacaggaugcg

SEQ ID NO: 2338923 - RNA, 14 nt, Bordetella pertussis
aucaggaugggcgc

SEQ ID NO: 2338924 - RNA, 19 nt, Bordetella pertussis
aucaggcccagcacgauga

SEQ ID NO: 2338925 - RNA, 16 nt, Bordetella pertussis
aucaggcccuggggcc

SEQ ID NO: 2338926 - RNA, 13 nt, Bordetella pertussis
aucaggccgaacu

SEQ ID NO: 2338927 - RNA, 22 nt, Bordetella pertussis
aucaggccgaacugggacaggc

SEQ ID NO: 2338928 - RNA, 19 nt, Bordetella pertussis
aucaggccgaugcguccgc

SEQ ID NO: 2338929 - RNA, 12 nt, Bordetella pertussis
aucaggccgccc

SEQ ID NO: 2338930 - RNA, 13 nt, Bordetella pertussis
aucaggccggcga

SEQ ID NO: 2338931 - RNA, 21 nt, Bordetella pertussis
aucaggcgcaucgacagcgcg

SEQ ID NO: 2338932 - RNA, 17 nt, Bordetella pertussis
aucaggcgcuccauggc

SEQ ID NO: 2338933 - RNA, 21 nt, Bordetella pertussis
aucaggcggugccccggccuc

SEQ ID NO: 2338934 - RNA, 15 nt, Bordetella pertussis
aucagggugggcacg

SEQ ID NO: 2338935 - RNA, 19 nt, Bordetella pertussis
aucagggugggcacgcgcg

SEQ ID NO: 2338936 - RNA, 21 nt, Bordetella pertussis
aucagggugggcacgcgcgcg

SEQ ID NO: 2338937 - RNA, 21 nt, Bordetella pertussis
aucaggucgaccugcuugccc

SEQ ID NO: 2338938 - RNA, 16 nt, Bordetella pertussis
aucaggugggccgagc

SEQ ID NO: 2338939 - RNA, 18 nt, Bordetella pertussis
aucaggugggccgagccc

SEQ ID NO: 2338940 - RNA, 23 nt, Bordetella pertussis
aucaguccgacgacaaacccgac

SEQ ID NO: 2338941 - RNA, 23 nt, Bordetella pertussis
aucaguccgggcgcuugccguag

SEQ ID NO: 2338942 - RNA, 15 nt, Bordetella pertussis
aucaguucgcgcagg

SEQ ID NO: 2338943 - RNA, 14 nt, Bordetella pertussis
aucaucaggaugaa

SEQ ID NO: 2338944 - RNA, 22 nt, Bordetella pertussis
aucaucagguccacuucaccgc

SEQ ID NO: 2338945 - RNA, 15 nt, Bordetella pertussis
aucaucaucgucggc

SEQ ID NO: 2338946 - RNA, 14 nt, Bordetella pertussis
aucauccgcgcaug

SEQ ID NO: 2338947 - RNA, 20 nt, Bordetella pertussis
aucauccuggucgacgcgac

SEQ ID NO: 2338948 - RNA, 18 nt, Bordetella pertussis
aucaucgagcaccgccuc

SEQ ID NO: 2338949 - RNA, 20 nt, Bordetella pertussis
aucaucgaggcaaucagccc

SEQ ID NO: 2338950 - RNA, 20 nt, Bordetella pertussis
aucaucgcgcuggcgcgcga

SEQ ID NO: 2338951 - RNA, 15 nt, Bordetella pertussis
aucaugaggcggcgg

SEQ ID NO: 2338952 - RNA, 17 nt, Bordetella pertussis
aucaugaggcggcggua

SEQ ID NO: 2338953 - RNA, 17 nt, Bordetella pertussis
aucaugaugaugauguu

SEQ ID NO: 2338954 - RNA, 15 nt, Bordetella pertussis
aucaugaugcgcugg

SEQ ID NO: 2338955 - RNA, 22 nt, Bordetella pertussis
aucaugcccgccacggucgcga

SEQ ID NO: 2338956 - RNA, 20 nt, Bordetella pertussis
aucaugccgcugaccagcac

SEQ ID NO: 2338957 - RNA, 17 nt, Bordetella pertussis
aucaugcgcugcuggcc

SEQ ID NO: 2338958 - RNA, 18 nt, Bordetella pertussis
aucaugcgcugcuggcca

SEQ ID NO: 2338959 - RNA, 18 nt, Bordetella pertussis
aucaugcgguuugcagga

SEQ ID NO: 2338960 - RNA, 13 nt, Bordetella pertussis
aucauggccaggg

SEQ ID NO: 2338961 - RNA, 13 nt, Bordetella pertussis
aucauggcgccga

SEQ ID NO: 2338962 - RNA, 20 nt, Bordetella pertussis
aucauggcgccgauggcgcc

SEQ ID NO: 2338963 - RNA, 21 nt, Bordetella pertussis
aucauggcgccgauggcgccg

SEQ ID NO: 2338964 - RNA, 13 nt, Bordetella pertussis
aucauggcgucgg

SEQ ID NO: 2338965 - RNA, 22 nt, Bordetella pertussis
aucauggucaugcccuccucgg

SEQ ID NO: 2338966 - RNA, 18 nt, Bordetella pertussis
aucauguaaggcgcaugc

SEQ ID NO: 2338967 - RNA, 21 nt, Bordetella pertussis
aucauuggccagcgcgacggc

SEQ ID NO: 2338968 - RNA, 14 nt, Bordetella pertussis
auccaccggcgcgc

SEQ ID NO: 2338969 - RNA, 18 nt, Bordetella pertussis
auccaccggcgcgcgcau

SEQ ID NO: 2338970 - RNA, 17 nt, Bordetella pertussis
auccacgccgccggcca

SEQ ID NO: 2338971 - RNA, 18 nt, Bordetella pertussis
auccacgccuucggcgcg

SEQ ID NO: 2338972 - RNA, 14 nt, Bordetella pertussis
auccacggcgccau

SEQ ID NO: 2338973 - RNA, 15 nt, Bordetella pertussis
auccacucggccagc

SEQ ID NO: 2338974 - RNA, 15 nt, Bordetella pertussis
auccagcaucaccag

SEQ ID NO: 2338975 - RNA, 21 nt, Bordetella pertussis
auccagccauggaagcggcag

SEQ ID NO: 2338976 - RNA, 24 nt, Bordetella pertussis
auccagccauggaagcggcagacg

SEQ ID NO: 2338977 - RNA, 17 nt, Bordetella pertussis
auccagccguuggcgcc

SEQ ID NO: 2338978 - RNA, 20 nt, Bordetella pertussis
auccagcgccagcaccggca

SEQ ID NO: 2338979 - RNA, 22 nt, Bordetella pertussis
auccagcgccagcaccggcacg

SEQ ID NO: 2338980 - RNA, 14 nt, Bordetella pertussis
auccagcgccuggg

SEQ ID NO: 2338981 - RNA, 23 nt, Bordetella pertussis
auccagcgcgcccgaggcgcgca

SEQ ID NO: 2338982 - RNA, 16 nt, Bordetella pertussis
auccagcgcggccacg

SEQ ID NO: 2338983 - RNA, 23 nt, Bordetella pertussis
auccagcgcucgggcucgcgcgc

SEQ ID NO: 2338984 - RNA, 11 nt, Bordetella pertussis
auccagcggca

SEQ ID NO: 2338985 - RNA, 21 nt, Bordetella pertussis
auccagcucgguggucaacgg

SEQ ID NO: 2338986 - RNA, 11 nt, Bordetella pertussis
auccagcuugc

SEQ ID NO: 2338987 - RNA, 17 nt, Bordetella pertussis
auccagcuugcguccca

SEQ ID NO: 2338988 - RNA, 21 nt, Bordetella pertussis
auccagcuugcgucccaccug

SEQ ID NO: 2338989 - RNA, 23 nt, Bordetella pertussis
auccaggccgugagcgccgccgc

SEQ ID NO: 2338990 - RNA, 12 nt, Bordetella pertussis
auccaggcgcuc

SEQ ID NO: 2338991 - RNA, 20 nt, Bordetella pertussis
auccaggcggccaccaccag

SEQ ID NO: 2338992 - RNA, 14 nt, Bordetella pertussis
auccaggcggcgcu

SEQ ID NO: 2338993 - RNA, 15 nt, Bordetella pertussis
auccaggcggcgcuc

SEQ ID NO: 2338994 - RNA, 16 nt, Bordetella pertussis
auccagggccacgccc

SEQ ID NO: 2338995 - RNA, 16 nt, Bordetella pertussis
auccagggccgcagca

SEQ ID NO: 2338996 - RNA, 22 nt, Bordetella pertussis
auccagggcgaucagcaccgcg

SEQ ID NO: 2338997 - RNA, 13 nt, Bordetella pertussis
auccagguacgac

SEQ ID NO: 2338998 - RNA, 18 nt, Bordetella pertussis
auccagguaggcggcgcg

SEQ ID NO: 2338999 - RNA, 19 nt, Bordetella pertussis
auccagguaggcggcgcgc

SEQ ID NO: 2339000 - RNA, 13 nt, Bordetella pertussis
auccaggucgaua

SEQ ID NO: 2339001 - RNA, 22 nt, Bordetella pertussis
auccaggucgauaucgccaucc

SEQ ID NO: 2339002 - RNA, 22 nt, Bordetella pertussis
auccagguggucuugaggucgc

SEQ ID NO: 2339003 - RNA, 16 nt, Bordetella pertussis
auccagguugucgcgc

SEQ ID NO: 2339004 - RNA, 18 nt, Bordetella pertussis
auccagguugucgcgcga

SEQ ID NO: 2339005 - RNA, 20 nt, Bordetella pertussis
auccaguugagaaugcccag

SEQ ID NO: 2339006 - RNA, 14 nt, Bordetella pertussis
auccaucugguggu

SEQ ID NO: 2339007 - RNA, 14 nt, Bordetella pertussis
auccauguggccag

SEQ ID NO: 2339008 - RNA, 14 nt, Bordetella pertussis
auccauuccauaug

SEQ ID NO: 2339009 - RNA, 15 nt, Bordetella pertussis
aucccaauuggccgc

SEQ ID NO: 2339010 - RNA, 20 nt, Bordetella pertussis
aucccaauuggccgcccugg

SEQ ID NO: 2339011 - RNA, 13 nt, Bordetella pertussis
aucccaggccggc

SEQ ID NO: 2339012 - RNA, 22 nt, Bordetella pertussis
aucccaggcgcucagccgugcc

SEQ ID NO: 2339013 - RNA, 12 nt, Bordetella pertussis
auccccagcgcc

SEQ ID NO: 2339014 - RNA, 16 nt, Bordetella pertussis
auccccagcgccgcca

SEQ ID NO: 2339015 - RNA, 14 nt, Bordetella pertussis
aucccccgcggagg

SEQ ID NO: 2339016 - RNA, 13 nt, Bordetella pertussis
auccccgcucagg

SEQ ID NO: 2339017 - RNA, 14 nt, Bordetella pertussis
auccccugcccgcc

SEQ ID NO: 2339018 - RNA, 17 nt, Bordetella pertussis
aucccgauuucggagcg

SEQ ID NO: 2339019 - RNA, 17 nt, Bordetella pertussis
aucccgcccccgccgca

SEQ ID NO: 2339020 - RNA, 19 nt, Bordetella pertussis
aucccggccaggcgccggc

SEQ ID NO: 2339021 - RNA, 22 nt, Bordetella pertussis
aucccggcgaucaugccgccga

SEQ ID NO: 2339022 - RNA, 16 nt, Bordetella pertussis
aucccggcgccagcca

SEQ ID NO: 2339023 - RNA, 22 nt, Bordetella pertussis
aucccggcgcucagcgcgccga

SEQ ID NO: 2339024 - RNA, 13 nt, Bordetella pertussis
aucccggcgcugg

SEQ ID NO: 2339025 - RNA, 23 nt, Bordetella pertussis
aucccgggcuccggucguggcca

SEQ ID NO: 2339026 - RNA, 19 nt, Bordetella pertussis
aucccgucauggcggcagg

SEQ ID NO: 2339027 - RNA, 22 nt, Bordetella pertussis
aucccucgcccagcgagccggc

SEQ ID NO: 2339028 - RNA, 18 nt, Bordetella pertussis
aucccugaucccggcgcu

SEQ ID NO: 2339029 - RNA, 15 nt, Bordetella pertussis
aucccugcggcagcg

SEQ ID NO: 2339030 - RNA, 22 nt, Bordetella pertussis
auccgaauuccugaacgccggg

SEQ ID NO: 2339031 - RNA, 19 nt, Bordetella pertussis
auccgaggcccguuuuguu

SEQ ID NO: 2339032 - RNA, 19 nt, Bordetella pertussis
auccgcaaaguccucgcac

SEQ ID NO: 2339033 - RNA, 16 nt, Bordetella pertussis
auccgcaacccagcag

SEQ ID NO: 2339034 - RNA, 17 nt, Bordetella pertussis
auccgcaacccagcagc

SEQ ID NO: 2339035 - RNA, 19 nt, Bordetella pertussis
auccgcaaguucggcagcg

SEQ ID NO: 2339036 - RNA, 24 nt, Bordetella pertussis
auccgcaaguucggcagcgaggcg

SEQ ID NO: 2339037 - RNA, 21 nt, Bordetella pertussis
auccgcaccggcgugcgcugg

SEQ ID NO: 2339038 - RNA, 22 nt, Bordetella pertussis
auccgccauaugcgcgaagugg

SEQ ID NO: 2339039 - RNA, 21 nt, Bordetella pertussis
auccgcccguugcggcgccuc

SEQ ID NO: 2339040 - RNA, 19 nt, Bordetella pertussis
auccgccguugcucgcgcg

SEQ ID NO: 2339041 - RNA, 18 nt, Bordetella pertussis
auccgcgaagugccuguc

SEQ ID NO: 2339042 - RNA, 14 nt, Bordetella pertussis
auccgcgacgcccu

SEQ ID NO: 2339043 - RNA, 17 nt, Bordetella pertussis
auccgcgacgcccuggc

SEQ ID NO: 2339044 - RNA, 13 nt, Bordetella pertussis
auccgcgcaugga

SEQ ID NO: 2339045 - RNA, 18 nt, Bordetella pertussis
auccgcgccacacgggcg

SEQ ID NO: 2339046 - RNA, 14 nt, Bordetella pertussis
auccgcgccaggcg

SEQ ID NO: 2339047 - RNA, 13 nt, Bordetella pertussis
auccgcugcgccg

SEQ ID NO: 2339048 - RNA, 21 nt, Bordetella pertussis
auccgcugcgccgaggccugc

SEQ ID NO: 2339049 - RNA, 13 nt, Bordetella pertussis
auccggcagcagc

SEQ ID NO: 2339050 - RNA, 13 nt, Bordetella pertussis
auccggccagcac

SEQ ID NO: 2339051 - RNA, 19 nt, Bordetella pertussis
auccggccagcacgccggc

SEQ ID NO: 2339052 - RNA, 22 nt, Bordetella pertussis
auccggccagcacgccggcggg

SEQ ID NO: 2339053 - RNA, 15 nt, Bordetella pertussis
auccggcccagcgcc

SEQ ID NO: 2339054 - RNA, 19 nt, Bordetella pertussis
auccggcccggugcagccg

SEQ ID NO: 2339055 - RNA, 13 nt, Bordetella pertussis
auccggccgcacg

SEQ ID NO: 2339056 - RNA, 22 nt, Bordetella pertussis
auccggccgcacgcggccgcgg

SEQ ID NO: 2339057 - RNA, 17 nt, Bordetella pertussis
auccggcgaccgacggc

SEQ ID NO: 2339058 - RNA, 21 nt, Bordetella pertussis
auccggcgaccgacggcaucg

SEQ ID NO: 2339059 - RNA, 12 nt, Bordetella pertussis
auccggcgcacg

SEQ ID NO: 2339060 - RNA, 22 nt, Bordetella pertussis
auccgggccuggcguucggcac

SEQ ID NO: 2339061 - RNA, 21 nt, Bordetella pertussis
auccgggugaaguugucgucg

SEQ ID NO: 2339062 - RNA, 23 nt, Bordetella pertussis
auccgguugacgaucucgcccug

SEQ ID NO: 2339063 - RNA, 15 nt, Bordetella pertussis
auccguaagcgcugg

SEQ ID NO: 2339064 - RNA, 15 nt, Bordetella pertussis
auccguuggugccga

SEQ ID NO: 2339065 - RNA, 17 nt, Bordetella pertussis
auccuagucaugcguga

SEQ ID NO: 2339066 - RNA, 14 nt, Bordetella pertussis
auccucaucgugcu

SEQ ID NO: 2339067 - RNA, 16 nt, Bordetella pertussis
auccucgccagcggca

SEQ ID NO: 2339068 - RNA, 21 nt, Bordetella pertussis
auccucgcccagcggcgccga

SEQ ID NO: 2339069 - RNA, 18 nt, Bordetella pertussis
auccucgcugccggcgcc

SEQ ID NO: 2339070 - RNA, 21 nt, Bordetella pertussis
auccugaacgccgcgcugccu

SEQ ID NO: 2339071 - RNA, 17 nt, Bordetella pertussis
auccugaccaucaucaa

SEQ ID NO: 2339072 - RNA, 15 nt, Bordetella pertussis
auccugaugucggcc

SEQ ID NO: 2339073 - RNA, 15 nt, Bordetella pertussis
auccugcggcgcggu

SEQ ID NO: 2339074 - RNA, 23 nt, Bordetella pertussis
auccugcugguggcgauguucac

SEQ ID NO: 2339075 - RNA, 22 nt, Bordetella pertussis
auccugggcgcgcgccagguug

SEQ ID NO: 2339076 - RNA, 19 nt, Bordetella pertussis
auccuucacgaaccgcaga

SEQ ID NO: 2339077 - RNA, 13 nt, Bordetella pertussis
auccuugcgcucg

SEQ ID NO: 2339078 - RNA, 22 nt, Bordetella pertussis
auccuuuuuguuuuggcgcacg

SEQ ID NO: 2339079 - RNA, 23 nt, Bordetella pertussis
auccuuuuuguuuuggcgcacgc

SEQ ID NO: 2339080 - RNA, 19 nt, Bordetella pertussis
aucgaaaccggcgcgcgcg

SEQ ID NO: 2339081 - RNA, 16 nt, Bordetella pertussis
aucgaacucgauccgg

SEQ ID NO: 2339082 - RNA, 23 nt, Bordetella pertussis
cacgcugggccagaccgcgcgca

SEQ ID NO: 2339083 - RNA, 18 nt, Bordetella pertussis
cacgcugggcuacgaccc

SEQ ID NO: 2339084 - RNA, 16 nt, Bordetella pertussis
cacgcugguggccacc

SEQ ID NO: 2339085 - RNA, 22 nt, Bordetella pertussis
cacgcuguacugguaccaggcg

SEQ ID NO: 2339086 - RNA, 17 nt, Bordetella pertussis
cacgcuguuuucggccg

SEQ ID NO: 2339087 - RNA, 20 nt, Bordetella pertussis
cacgcuguuuucggccgacu

SEQ ID NO: 2339088 - RNA, 23 nt, Bordetella pertussis
cacgcuguuuucggccgacucga

SEQ ID NO: 2339089 - RNA, 19 nt, Bordetella pertussis
cacgcuuugcgucuccacg

SEQ ID NO: 2339090 - RNA, 22 nt, Bordetella pertussis
cacgcuuugcgucuccacgccg

SEQ ID NO: 2339091 - RNA, 23 nt, Bordetella pertussis
cacggaacgugccgucgggcgcc

SEQ ID NO: 2339092 - RNA, 23 nt, Bordetella pertussis
cacggaauggucaagcggcugcc

SEQ ID NO: 2339093 - RNA, 18 nt, Bordetella pertussis
cacggaauguugauccgg

SEQ ID NO: 2339094 - RNA, 14 nt, Bordetella pertussis
cacggacagcccgc

SEQ ID NO: 2339095 - RNA, 16 nt, Bordetella pertussis
cacggacagcccgcgc

SEQ ID NO: 2339096 - RNA, 14 nt, Bordetella pertussis
cacggagggugcgc

SEQ ID NO: 2339097 - RNA, 15 nt, Bordetella pertussis
cacggagggugcgca

SEQ ID NO: 2339098 - RNA, 22 nt, Bordetella pertussis
cacggcaaaagccggggugcca

SEQ ID NO: 2339099 - RNA, 16 nt, Bordetella pertussis
cacggcaagacggcgc

SEQ ID NO: 2339100 - RNA, 23 nt, Bordetella pertussis
cacggcaagacggcgcucggccu

SEQ ID NO: 2339101 - RNA, 13 nt, Bordetella pertussis
cacggcaaugucg

SEQ ID NO: 2339102 - RNA, 22 nt, Bordetella pertussis
cacggcaaugucgcaggccgcg

SEQ ID NO: 2339103 - RNA, 14 nt, Bordetella pertussis
cacggcaucgccgc

SEQ ID NO: 2339104 - RNA, 14 nt, Bordetella pertussis
cacggcaucggcca

SEQ ID NO: 2339105 - RNA, 16 nt, Bordetella pertussis
cacggcaucggccagc

SEQ ID NO: 2339106 - RNA, 15 nt, Bordetella pertussis
cacggcauggccagc

SEQ ID NO: 2339107 - RNA, 16 nt, Bordetella pertussis
cacggcauggccagcu

SEQ ID NO: 2339108 - RNA, 22 nt, Bordetella pertussis
cacggcaugucccgaggcgccc

SEQ ID NO: 2339109 - RNA, 23 nt, Bordetella pertussis
cacggcaugucccgaggcgcccc

SEQ ID NO: 2339110 - RNA, 15 nt, Bordetella pertussis
cacggccacggccgg

SEQ ID NO: 2339111 - RNA, 14 nt, Bordetella pertussis
cacggccagcacca

SEQ ID NO: 2339112 - RNA, 17 nt, Bordetella pertussis
cacggccagcaccaugg

SEQ ID NO: 2339113 - RNA, 19 nt, Bordetella pertussis
cacggccagcaccaugggc

SEQ ID NO: 2339114 - RNA, 18 nt, Bordetella pertussis
cacggccagcagcacgau

SEQ ID NO: 2339115 - RNA, 22 nt, Bordetella pertussis
cacggccagcagcacgaucgcg

SEQ ID NO: 2339116 - RNA, 12 nt, Bordetella pertussis
cacggccagcau

SEQ ID NO: 2339117 - RNA, 14 nt, Bordetella pertussis
cacggcccgccagg

SEQ ID NO: 2339118 - RNA, 18 nt, Bordetella pertussis
cacggcccgccaggaagc

SEQ ID NO: 2339119 - RNA, 14 nt, Bordetella pertussis
cacggcccuggucu

SEQ ID NO: 2339120 - RNA, 14 nt, Bordetella pertussis
cacggccgcaugcg

SEQ ID NO: 2339121 - RNA, 14 nt, Bordetella pertussis
cacggccgccaccu

SEQ ID NO: 2339122 - RNA, 18 nt, Bordetella pertussis
cacggccgccaccugggc

SEQ ID NO: 2339123 - RNA, 18 nt, Bordetella pertussis
cacggccgcggccggcac

SEQ ID NO: 2339124 - RNA, 18 nt, Bordetella pertussis
cacggccggcagcgccuu

SEQ ID NO: 2339125 - RNA, 16 nt, Bordetella pertussis
cacggccggccaggcg

SEQ ID NO: 2339126 - RNA, 18 nt, Bordetella pertussis
cacggccggccaggcgcc

SEQ ID NO: 2339127 - RNA, 19 nt, Bordetella pertussis
cacggccggccaggcgccg

SEQ ID NO: 2339128 - RNA, 20 nt, Bordetella pertussis
cacggccggccaggcgccgc

SEQ ID NO: 2339129 - RNA, 14 nt, Bordetella pertussis
cacggccggccugc

SEQ ID NO: 2339130 - RNA, 16 nt, Bordetella pertussis
cacggccggccugcag

SEQ ID NO: 2339131 - RNA, 12 nt, Bordetella pertussis
cacggccggcgc

SEQ ID NO: 2339132 - RNA, 20 nt, Bordetella pertussis
cacggccgucaacagcaugg

SEQ ID NO: 2339133 - RNA, 14 nt, Bordetella pertussis
cacggccugcccgg

SEQ ID NO: 2339134 - RNA, 15 nt, Bordetella pertussis
cacggccugcccggg

SEQ ID NO: 2339135 - RNA, 17 nt, Bordetella pertussis
cacggccugcgcgccga

SEQ ID NO: 2339136 - RNA, 15 nt, Bordetella pertussis
cacggcgacuuccag

SEQ ID NO: 2339137 - RNA, 17 nt, Bordetella pertussis
cacggcgaugaacagcg

SEQ ID NO: 2339138 - RNA, 20 nt, Bordetella pertussis
cacggcgaugaacagcggca

SEQ ID NO: 2339139 - RNA, 13 nt, Bordetella pertussis
cacggcgaugcug

SEQ ID NO: 2339140 - RNA, 20 nt, Bordetella pertussis
cacggcgaugcugccgucgc

SEQ ID NO: 2339141 - RNA, 22 nt, Bordetella pertussis
cacggcgaugcugccgucgcca

SEQ ID NO: 2339142 - RNA, 16 nt, Bordetella pertussis
cacggcgauggccgac

SEQ ID NO: 2339143 - RNA, 19 nt, Bordetella pertussis
cacggcgcacaccaucagc

SEQ ID NO: 2339144 - RNA, 20 nt, Bordetella pertussis
cacggcgccaaagcacagga

SEQ ID NO: 2339145 - RNA, 15 nt, Bordetella pertussis
cacggcgcgcgccug

SEQ ID NO: 2339146 - RNA, 19 nt, Bordetella pertussis
cacggcgcgggcggucggc

SEQ ID NO: 2339147 - RNA, 21 nt, Bordetella pertussis
cacggcgcgggcggucggcgc

SEQ ID NO: 2339148 - RNA, 22 nt, Bordetella pertussis
cacggcgcgggcggucggcgcg

SEQ ID NO: 2339149 - RNA, 22 nt, Bordetella pertussis
cacggcggcaaagucggggcgc

SEQ ID NO: 2339150 - RNA, 13 nt, Bordetella pertussis
cacggcggccagg

SEQ ID NO: 2339151 - RNA, 14 nt, Bordetella pertussis
cacggcggcgauca

SEQ ID NO: 2339152 - RNA, 23 nt, Bordetella pertussis
cacggcggcgaucacgccgucga

SEQ ID NO: 2339153 - RNA, 12 nt, Bordetella pertussis
cacggcggcggc

SEQ ID NO: 2339154 - RNA, 17 nt, Bordetella pertussis
cacggcggcuucggccg

SEQ ID NO: 2339155 - RNA, 16 nt, Bordetella pertussis
cacggcgggaucgggc

SEQ ID NO: 2339156 - RNA, 23 nt, Bordetella pertussis
cacggcgggaucgggcagcuugg

SEQ ID NO: 2339157 - RNA, 12 nt, Bordetella pertussis
cacggcgggccg

SEQ ID NO: 2339158 - RNA, 20 nt, Bordetella pertussis
cacggcgggccggcucggcg

SEQ ID NO: 2339159 - RNA, 18 nt, Bordetella pertussis
cacggcggugaccaccag

SEQ ID NO: 2339160 - RNA, 19 nt, Bordetella pertussis
cacggcggugaccaccagg

SEQ ID NO: 2339161 - RNA, 21 nt, Bordetella pertussis
cacggcggugaccaccaggcc

SEQ ID NO: 2339162 - RNA, 21 nt, Bordetella pertussis
cacggcggugaucugcucgcc

SEQ ID NO: 2339163 - RNA, 23 nt, Bordetella pertussis
cacggcggugaucugcucgccgc

SEQ ID NO: 2339164 - RNA, 16 nt, Bordetella pertussis
cacggcggugccgcgc

SEQ ID NO: 2339165 - RNA, 14 nt, Bordetella pertussis
cacggcgucgaugc

SEQ ID NO: 2339166 - RNA, 16 nt, Bordetella pertussis
cacggcgucgaugcgc

SEQ ID NO: 2339167 - RNA, 13 nt, Bordetella pertussis
cacggcgucgccg

SEQ ID NO: 2339168 - RNA, 16 nt, Bordetella pertussis
cacggcgucgccggcc

SEQ ID NO: 2339169 - RNA, 17 nt, Bordetella pertussis
cacggcguggcgcgcac

SEQ ID NO: 2339170 - RNA, 18 nt, Bordetella pertussis
cacggcguggcgcgcaca

SEQ ID NO: 2339171 - RNA, 21 nt, Bordetella pertussis
cacggcguggcgcgcacacug

SEQ ID NO: 2339172 - RNA, 16 nt, Bordetella pertussis
cacggcguggcgcgcc

SEQ ID NO: 2339173 - RNA, 17 nt, Bordetella pertussis
cacggcguggcgcgccc

SEQ ID NO: 2339174 - RNA, 15 nt, Bordetella pertussis
cacggcuucgcccag

SEQ ID NO: 2339175 - RNA, 16 nt, Bordetella pertussis
cacggcuucgcccagc

SEQ ID NO: 2339176 - RNA, 17 nt, Bordetella pertussis
cacggcuucgcccagcg

SEQ ID NO: 2339177 - RNA, 16 nt, Bordetella pertussis
cacggcuugcgcgccu

SEQ ID NO: 2339178 - RNA, 17 nt, Bordetella pertussis
cacggcuugcgcgccug

SEQ ID NO: 2339179 - RNA, 22 nt, Bordetella pertussis
cacggcuugcgcgccugcuggu

SEQ ID NO: 2339180 - RNA, 23 nt, Bordetella pertussis
cacggcuuuggcguagccggugc

SEQ ID NO: 2339181 - RNA, 19 nt, Bordetella pertussis
cacgggaaugaagcgcgac

SEQ ID NO: 2339182 - RNA, 20 nt, Bordetella pertussis
cacgggaaugaagcgcgaca

SEQ ID NO: 2339183 - RNA, 12 nt, Bordetella pertussis
cacgggaccgcu

SEQ ID NO: 2339184 - RNA, 14 nt, Bordetella pertussis
cacgggccauggau

SEQ ID NO: 2339185 - RNA, 13 nt, Bordetella pertussis
cacgggccgacgg

SEQ ID NO: 2339186 - RNA, 14 nt, Bordetella pertussis
cacgggcgaagcgg

SEQ ID NO: 2339187 - RNA, 19 nt, Bordetella pertussis
cacgggcgaggcggggcug

SEQ ID NO: 2339188 - RNA, 18 nt, Bordetella pertussis
cacgggcgagggcugccc

SEQ ID NO: 2339189 - RNA, 12 nt, Bordetella pertussis
cacgggcgccag

SEQ ID NO: 2339190 - RNA, 18 nt, Bordetella pertussis
cacgggcgccagcagcgg

SEQ ID NO: 2339191 - RNA, 16 nt, Bordetella pertussis
cacgggcgccuguccc

SEQ ID NO: 2339192 - RNA, 17 nt, Bordetella pertussis
cacgggcgccugucccc

SEQ ID NO: 2339193 - RNA, 18 nt, Bordetella pertussis
cacgggcgccuguccccg

SEQ ID NO: 2339194 - RNA, 15 nt, Bordetella pertussis
cacgggcgcugccca

SEQ ID NO: 2339195 - RNA, 18 nt, Bordetella pertussis
cacgugaagcgccgcgcc

SEQ ID NO: 2339196 - RNA, 22 nt, Bordetella pertussis
cacgugcacgaucuugauccag

SEQ ID NO: 2339197 - RNA, 14 nt, Bordetella pertussis
cacgugccagccga

SEQ ID NO: 2339198 - RNA, 15 nt, Bordetella pertussis
cacgugccagccgaa

SEQ ID NO: 2339199 - RNA, 20 nt, Bordetella pertussis
cacgugccagccgaacuggg

SEQ ID NO: 2339200 - RNA, 14 nt, Bordetella pertussis
cacgugcugcugga

SEQ ID NO: 2339201 - RNA, 16 nt, Bordetella pertussis
cacgugcugcuggaga

SEQ ID NO: 2339202 - RNA, 22 nt, Bordetella pertussis
cacgugcugcuggagaucgccg

SEQ ID NO: 2339203 - RNA, 13 nt, Bordetella pertussis
cacguggacaggc

SEQ ID NO: 2339204 - RNA, 15 nt, Bordetella pertussis
cacguggacaggcac

SEQ ID NO: 2339205 - RNA, 17 nt, Bordetella pertussis
cacguggacaggcaccu

SEQ ID NO: 2339206 - RNA, 17 nt, Bordetella pertussis
cacguggaccagggacg

SEQ ID NO: 2339207 - RNA, 15 nt, Bordetella pertussis
cacguggcgacgucg

SEQ ID NO: 2339208 - RNA, 16 nt, Bordetella pertussis
cacguggcgacgucgg

SEQ ID NO: 2339209 - RNA, 15 nt, Bordetella pertussis
cacgugggcacgccg

SEQ ID NO: 2339210 - RNA, 18 nt, Bordetella pertussis
cacgugggcacgccggcc

SEQ ID NO: 2339211 - RNA, 16 nt, Bordetella pertussis
cacguguggcaggcca

SEQ ID NO: 2339212 - RNA, 20 nt, Bordetella pertussis
cacguguggcaggccagcgc

SEQ ID NO: 2339213 - RNA, 15 nt, Bordetella pertussis
cacguucagcgccgg

SEQ ID NO: 2339214 - RNA, 16 nt, Bordetella pertussis
cacguucagcgccggc

SEQ ID NO: 2339215 - RNA, 18 nt, Bordetella pertussis
cacguucgaccugccgcc

SEQ ID NO: 2339216 - RNA, 20 nt, Bordetella pertussis
cacguugucgagcaggccgc

SEQ ID NO: 2339217 - RNA, 23 nt, Bordetella pertussis
cacguugucgagcaggccgccgc

SEQ ID NO: 2339218 - RNA, 14 nt, Bordetella pertussis
cacuacacucugcc

SEQ ID NO: 2339219 - RNA, 14 nt, Bordetella pertussis
cacucacgcaaggc

SEQ ID NO: 2339220 - RNA, 16 nt, Bordetella pertussis
cacuccauagcgccgc

SEQ ID NO: 2339221 - RNA, 17 nt, Bordetella pertussis
cacuccauagcgccgcu

SEQ ID NO: 2339222 - RNA, 14 nt, Bordetella pertussis
cacucccguaagca

SEQ ID NO: 2339223 - RNA, 15 nt, Bordetella pertussis
cacucgaccgccggg

SEQ ID NO: 2339224 - RNA, 17 nt, Bordetella pertussis
cacucgaccgccgggac

SEQ ID NO: 2339225 - RNA, 23 nt, Bordetella pertussis
cacucgaccgccgggacaggcac

SEQ ID NO: 2339226 - RNA, 18 nt, Bordetella pertussis
cacucggugcgcgcgccc

SEQ ID NO: 2339227 - RNA, 22 nt, Bordetella pertussis
cacucugcccgaagcggcccgg

SEQ ID NO: 2339228 - RNA, 14 nt, Bordetella pertussis
cacucuugccgcug

SEQ ID NO: 2339229 - RNA, 18 nt, Bordetella pertussis
cacugagaaaggccgcca

SEQ ID NO: 2339230 - RNA, 22 nt, Bordetella pertussis
cacugaugcuggucagccuggg

SEQ ID NO: 2339231 - RNA, 16 nt, Bordetella pertussis
cacugcaaggcccgcc

SEQ ID NO: 2339232 - RNA, 13 nt, Bordetella pertussis
cacugcaggccau

SEQ ID NO: 2339233 - RNA, 13 nt, Bordetella pertussis
cacugccaggcga

SEQ ID NO: 2339234 - RNA, 20 nt, Bordetella pertussis
cacugccaggcgagcgccgc

SEQ ID NO: 2339235 - RNA, 14 nt, Bordetella pertussis
cacugccaggcgcc

SEQ ID NO: 2339236 - RNA, 16 nt, Bordetella pertussis
cacugccaggcgcccc

SEQ ID NO: 2339237 - RNA, 18 nt, Bordetella pertussis
cacugccaguaggcgccc

SEQ ID NO: 2339238 - RNA, 19 nt, Bordetella pertussis
cacugccaguaggcgcccc

SEQ ID NO: 2339239 - RNA, 12 nt, Bordetella pertussis
cacugcggcccg

SEQ ID NO: 2339240 - RNA, 15 nt, Bordetella pertussis
cacugcguccuugag

SEQ ID NO: 2339241 - RNA, 20 nt, Bordetella pertussis
cacuggcagaccgagcgcgc

SEQ ID NO: 2339242 - RNA, 12 nt, Bordetella pertussis
cacuggccagca

SEQ ID NO: 2339243 - RNA, 15 nt, Bordetella pertussis
cacuggccagcaagc

SEQ ID NO: 2339244 - RNA, 17 nt, Bordetella pertussis
cacuggccagcaagcgc

SEQ ID NO: 2339245 - RNA, 14 nt, Bordetella pertussis
cacuggcccuggca

SEQ ID NO: 2339246 - RNA, 14 nt, Bordetella pertussis
cacuggccuucuuc

SEQ ID NO: 2339247 - RNA, 18 nt, Bordetella pertussis
cacuggccuugugcgccg

SEQ ID NO: 2339248 - RNA, 19 nt, Bordetella pertussis
cacuggccuugugcgccgu

SEQ ID NO: 2339249 - RNA, 16 nt, Bordetella pertussis
cacugggggacuggca

SEQ ID NO: 2339250 - RNA, 20 nt, Bordetella pertussis
cacugggggacuggcacccg

SEQ ID NO: 2339251 - RNA, 22 nt, Bordetella pertussis
cagaguuauuuuccggacucgc

SEQ ID NO: 2339252 - RNA, 15 nt, Bordetella pertussis
cagauaaaggccgca

SEQ ID NO: 2339253 - RNA, 22 nt, Bordetella pertussis
cagauaaaggccgcaacccacc

SEQ ID NO: 2339254 - RNA, 13 nt, Bordetella pertussis
cagauaaggcggg

SEQ ID NO: 2339255 - RNA, 17 nt, Bordetella pertussis
cagauaccgccuuggcc

SEQ ID NO: 2339256 - RNA, 17 nt, Bordetella pertussis
cagauaccggcauggca

SEQ ID NO: 2339257 - RNA, 14 nt, Bordetella pertussis
cagauaccgucuug

SEQ ID NO: 2339258 - RNA, 14 nt, Bordetella pertussis
cagauagcccaggc

SEQ ID NO: 2339259 - RNA, 14 nt, Bordetella pertussis
cagauaugccccuc

SEQ ID NO: 2339260 - RNA, 21 nt, Bordetella pertussis
cagaucaucgagcaccgccuc

SEQ ID NO: 2339261 - RNA, 13 nt, Bordetella pertussis
cagauccacgccc

SEQ ID NO: 2339262 - RNA, 17 nt, Bordetella pertussis
cagauccacgcccgcgc

SEQ ID NO: 2339263 - RNA, 23 nt, Bordetella pertussis
cagauccacgcccgcgccgaagu

SEQ ID NO: 2339264 - RNA, 14 nt, Bordetella pertussis
cagauccagcgcgg

SEQ ID NO: 2339265 - RNA, 15 nt, Bordetella pertussis
cagauccagcgcggc

SEQ ID NO: 2339266 - RNA, 17 nt, Bordetella pertussis
cagauccagcgcggcca

SEQ ID NO: 2339267 - RNA, 14 nt, Bordetella pertussis
cagauccagcuugc

SEQ ID NO: 2339268 - RNA, 16 nt, Bordetella pertussis
cagaucccaggcgcuc

SEQ ID NO: 2339269 - RNA, 14 nt, Bordetella pertussis
cagauccucgaaca

SEQ ID NO: 2339270 - RNA, 19 nt, Bordetella pertussis
cagauccucgaacaggcca

SEQ ID NO: 2339271 - RNA, 20 nt, Bordetella pertussis
cagauccucgaacaggccau

SEQ ID NO: 2339272 - RNA, 13 nt, Bordetella pertussis
cagaucgauccag

SEQ ID NO: 2339273 - RNA, 14 nt, Bordetella pertussis
cagaucgccaacgu

SEQ ID NO: 2339274 - RNA, 12 nt, Bordetella pertussis
cagaucgcggcg

SEQ ID NO: 2339275 - RNA, 22 nt, Bordetella pertussis
cagaucggcgcuggccuggccg

SEQ ID NO: 2339276 - RNA, 21 nt, Bordetella pertussis
cagaucuccggauccagccgc

SEQ ID NO: 2339277 - RNA, 20 nt, Bordetella pertussis
cagaucucgcguccggugcg

SEQ ID NO: 2339278 - RNA, 16 nt, Bordetella pertussis
cagaucugcacgcugu

SEQ ID NO: 2339279 - RNA, 22 nt, Bordetella pertussis
cagaugaucuacgcgcgcgccg

SEQ ID NO: 2339280 - RNA, 23 nt, Bordetella pertussis
cagaugauggucggugccgccga

SEQ ID NO: 2339281 - RNA, 13 nt, Bordetella pertussis
cagaugcaccagu

SEQ ID NO: 2339282 - RNA, 21 nt, Bordetella pertussis
cagaugccguccuggccguca

SEQ ID NO: 2339283 - RNA, 15 nt, Bordetella pertussis
cagaugcgcagcagg

SEQ ID NO: 2339284 - RNA, 18 nt, Bordetella pertussis
cagaugcgcagcaggcgc

SEQ ID NO: 2339285 - RNA, 16 nt, Bordetella pertussis
cagaugcgccgcacgu

SEQ ID NO: 2339286 - RNA, 19 nt, Bordetella pertussis
cagaugcgcgccaggcgcg

SEQ ID NO: 2339287 - RNA, 20 nt, Bordetella pertussis
cagaugcgcgccaggcgcgc

SEQ ID NO: 2339288 - RNA, 15 nt, Bordetella pertussis
cagauggacuugacc

SEQ ID NO: 2339289 - RNA, 13 nt, Bordetella pertussis
cagauggccagca

SEQ ID NO: 2339290 - RNA, 19 nt, Bordetella pertussis
cagauggccagcagcgccg

SEQ ID NO: 2339291 - RNA, 15 nt, Bordetella pertussis
cagauggcgcagcgg

SEQ ID NO: 2339292 - RNA, 16 nt, Bordetella pertussis
cagauggcgccuucga

SEQ ID NO: 2339293 - RNA, 23 nt, Bordetella pertussis
cagauggcgcuugugcgucggcu

SEQ ID NO: 2339294 - RNA, 17 nt, Bordetella pertussis
cagauggcguaggcggc

SEQ ID NO: 2339295 - RNA, 19 nt, Bordetella pertussis
cagauggcuuucuaucauc

SEQ ID NO: 2339296 - RNA, 23 nt, Bordetella pertussis
cagauggugcuccgacggcugga

SEQ ID NO: 2339297 - RNA, 14 nt, Bordetella pertussis
cagauguccgugcu

SEQ ID NO: 2339298 - RNA, 18 nt, Bordetella pertussis
cagauguccgugcuggcc

SEQ ID NO: 2339299 - RNA, 17 nt, Bordetella pertussis
cagauugaugcccaugc

SEQ ID NO: 2339300 - RNA, 14 nt, Bordetella pertussis
cagcaaccccagca

SEQ ID NO: 2339301 - RNA, 15 nt, Bordetella pertussis
cagcaaccccagcag

SEQ ID NO: 2339302 - RNA, 16 nt, Bordetella pertussis
cagcaaccccagcagc

SEQ ID NO: 2339303 - RNA, 19 nt, Bordetella pertussis
cagcaaccccagcagcgcc

SEQ ID NO: 2339304 - RNA, 20 nt, Bordetella pertussis
cagcaaccccagcagcgccg

SEQ ID NO: 2339305 - RNA, 13 nt, Bordetella pertussis
cagcaacccgccc

SEQ ID NO: 2339306 - RNA, 16 nt, Bordetella pertussis
cagcaacccgcccggg

SEQ ID NO: 2339307 - RNA, 16 nt, Bordetella pertussis
cagcaacgccacgcgc

SEQ ID NO: 2339308 - RNA, 19 nt, Bordetella pertussis
cagcaacgccacgcgcgga

SEQ ID NO: 2339309 - RNA, 17 nt, Bordetella pertussis
cagcaacgccggcggca

SEQ ID NO: 2339310 - RNA, 12 nt, Bordetella pertussis
cagcaacgcggc

SEQ ID NO: 2339311 - RNA, 14 nt, Bordetella pertussis
cagcaacgcggcgu

SEQ ID NO: 2339312 - RNA, 23 nt, Bordetella pertussis
cagcaacgcggcguaccggucca

SEQ ID NO: 2339313 - RNA, 23 nt, Bordetella pertussis
cagcaacggugagccggccaccu

SEQ ID NO: 2339314 - RNA, 19 nt, Bordetella pertussis
cagcaacucuuccccgucg

SEQ ID NO: 2339315 - RNA, 23 nt, Bordetella pertussis
cagcaacucuuccccgucggcgg

SEQ ID NO: 2339316 - RNA, 22 nt, Bordetella pertussis
cagcaagaaucggggcguagcu

SEQ ID NO: 2339317 - RNA, 16 nt, Bordetella pertussis
cagcaagcccaccggg

SEQ ID NO: 2339318 - RNA, 21 nt, Bordetella pertussis
cagcaagcccaccgggccggc

SEQ ID NO: 2339319 - RNA, 19 nt, Bordetella pertussis
cagcaagccgaucaaccug

SEQ ID NO: 2339320 - RNA, 16 nt, Bordetella pertussis
cagcaagcgcgccaug

SEQ ID NO: 2339321 - RNA, 17 nt, Bordetella pertussis
cagcaagcgcucggcca

SEQ ID NO: 2339322 - RNA, 21 nt, Bordetella pertussis
cagcaagcgcucggccacgcu

SEQ ID NO: 2339323 - RNA, 15 nt, Bordetella pertussis
cagcaagcugcugcu

SEQ ID NO: 2339324 - RNA, 16 nt, Bordetella pertussis
cagcaagcugcugcug

SEQ ID NO: 2339325 - RNA, 23 nt, Bordetella pertussis
cagcaagcugcugcuggaccugg

SEQ ID NO: 2339326 - RNA, 15 nt, Bordetella pertussis
cagcaaggcgucggc

SEQ ID NO: 2339327 - RNA, 20 nt, Bordetella pertussis
cagcaaggcgucggccaggc

SEQ ID NO: 2339328 - RNA, 23 nt, Bordetella pertussis
cagcaagggcagauugaugccca

SEQ ID NO: 2339329 - RNA, 18 nt, Bordetella pertussis
cagcaagggccccagcau

SEQ ID NO: 2339330 - RNA, 14 nt, Bordetella pertussis
cagcaagggcgucu

SEQ ID NO: 2339331 - RNA, 16 nt, Bordetella pertussis
cagcaagucagcccgc

SEQ ID NO: 2339332 - RNA, 22 nt, Bordetella pertussis
cagcaagucagcccgcgucgcu

SEQ ID NO: 2339333 - RNA, 20 nt, Bordetella pertussis
cagcaaugacgacgccggcu

SEQ ID NO: 2339334 - RNA, 22 nt, Bordetella pertussis
cagcaauuaugcguggccgccg

SEQ ID NO: 2339335 - RNA, 20 nt, Bordetella pertussis
cagcaauucaagccgcacca

SEQ ID NO: 2339336 - RNA, 15 nt, Bordetella pertussis
cagcaauugccccag

SEQ ID NO: 2339337 - RNA, 17 nt, Bordetella pertussis
cagcaauugccccagca

SEQ ID NO: 2339338 - RNA, 18 nt, Bordetella pertussis
cagcaauugccccagcac

SEQ ID NO: 2339339 - RNA, 20 nt, Bordetella pertussis
cagcaauugccccagcacga

SEQ ID NO: 2339340 - RNA, 15 nt, Bordetella pertussis
cagcacacggucagc

SEQ ID NO: 2339341 - RNA, 19 nt, Bordetella pertussis
cagcacauacgccgccgag

SEQ ID NO: 2339342 - RNA, 22 nt, Bordetella pertussis
cagcacauacgccgccgaggcg

SEQ ID NO: 2339343 - RNA, 12 nt, Bordetella pertussis
cagcacgcccag

SEQ ID NO: 2339344 - RNA, 13 nt, Bordetella pertussis
cagcacgcccaga

SEQ ID NO: 2339345 - RNA, 18 nt, Bordetella pertussis
cagcacgcccagauggcc

SEQ ID NO: 2339346 - RNA, 15 nt, Bordetella pertussis
cagcacgcccauggu

SEQ ID NO: 2339347 - RNA, 11 nt, Bordetella pertussis
cagcacgcccg

SEQ ID NO: 2339348 - RNA, 14 nt, Bordetella pertussis
cagcacgcccgcca

SEQ ID NO: 2339349 - RNA, 18 nt, Bordetella pertussis
cagcacgcccgcgcgcga

SEQ ID NO: 2339350 - RNA, 13 nt, Bordetella pertussis
cagcacgcccugg

SEQ ID NO: 2339351 - RNA, 15 nt, Bordetella pertussis
cagcacgcccuggcu

SEQ ID NO: 2339352 - RNA, 22 nt, Bordetella pertussis
cagcacgccgaucgcgcacagc

SEQ ID NO: 2339353 - RNA, 12 nt, Bordetella pertussis
cagcacgccgcg

SEQ ID NO: 2339354 - RNA, 17 nt, Bordetella pertussis
cagcacgccgcgccagg

SEQ ID NO: 2339355 - RNA, 14 nt, Bordetella pertussis
cagcacgccggcca

SEQ ID NO: 2339356 - RNA, 16 nt, Bordetella pertussis
cagcacgccggccagg

SEQ ID NO: 2339357 - RNA, 14 nt, Bordetella pertussis
cagcacgccggcgg

SEQ ID NO: 2339358 - RNA, 17 nt, Bordetella pertussis
cagcacgccggcgggca

SEQ ID NO: 2339359 - RNA, 18 nt, Bordetella pertussis
cagcacgccggcgggcag

SEQ ID NO: 2339360 - RNA, 20 nt, Bordetella pertussis
cagcacgccuugcucgacca

SEQ ID NO: 2339361 - RNA, 21 nt, Bordetella pertussis
cagcacgccuugcucgaccag

SEQ ID NO: 2339362 - RNA, 14 nt, Bordetella pertussis
cagcacgcgcacca

SEQ ID NO: 2339363 - RNA, 16 nt, Bordetella pertussis
cagcacgcgcaccagg

SEQ ID NO: 2339364 - RNA, 17 nt, Bordetella pertussis
cagcacgcgcagcuugc

SEQ ID NO: 2339365 - RNA, 13 nt, Bordetella pertussis
cagcacgcgcgcc

SEQ ID NO: 2339366 - RNA, 14 nt, Bordetella pertussis
cagcacgcgcgcca

SEQ ID NO: 2339367 - RNA, 17 nt, Bordetella pertussis
cagcacgcgcgccagcu

SEQ ID NO: 2339368 - RNA, 13 nt, Bordetella pertussis
cagcacgcggcgc

SEQ ID NO: 2339369 - RNA, 14 nt, Bordetella pertussis
cagcacgcggcgca

SEQ ID NO: 2339370 - RNA, 17 nt, Bordetella pertussis
cagcacgcggcgcagca

SEQ ID NO: 2339371 - RNA, 19 nt, Bordetella pertussis
cagcacgcucagcaugcgc

SEQ ID NO: 2339372 - RNA, 21 nt, Bordetella pertussis
cagcacggcaugucccgaggc

SEQ ID NO: 2339373 - RNA, 22 nt, Bordetella pertussis
cagcacggcaugucccgaggcg

SEQ ID NO: 2339374 - RNA, 13 nt, Bordetella pertussis
cagcacggccacg

SEQ ID NO: 2339375 - RNA, 15 nt, Bordetella pertussis
cagcacggccacggc

SEQ ID NO: 2339376 - RNA, 17 nt, Bordetella pertussis
cagcacggccacggccg

SEQ ID NO: 2339377 - RNA, 15 nt, Bordetella pertussis
cagcacggccgcggc

SEQ ID NO: 2339378 - RNA, 17 nt, Bordetella pertussis
cagcacggccgcggccg

SEQ ID NO: 2339379 - RNA, 18 nt, Bordetella pertussis
cagcacggcuugcgcgcc

SEQ ID NO: 2339380 - RNA, 21 nt, Bordetella pertussis
cagcacggcuugcgcgccugc

SEQ ID NO: 2339381 - RNA, 20 nt, Bordetella pertussis
cagcacgggaugcuccagcu

SEQ ID NO: 2339382 - RNA, 23 nt, Bordetella pertussis
cagcacgggaugcuccagcuugc

SEQ ID NO: 2339383 - RNA, 15 nt, Bordetella pertussis
cagcacggucggcgc

SEQ ID NO: 2339384 - RNA, 20 nt, Bordetella pertussis
cagcacggucugcaccugcg

SEQ ID NO: 2339385 - RNA, 18 nt, Bordetella pertussis
cagcacgguggcgcccgg

SEQ ID NO: 2339386 - RNA, 19 nt, Bordetella pertussis
cagcacgguggcgcccggc

SEQ ID NO: 2339387 - RNA, 22 nt, Bordetella pertussis
cagcacgguggcgcccggcggc

SEQ ID NO: 2339388 - RNA, 19 nt, Bordetella pertussis
cagcacgucauccugggcg

SEQ ID NO: 2339389 - RNA, 22 nt, Bordetella pertussis
cagcacgucauccugggcgcgc

SEQ ID NO: 2339390 - RNA, 23 nt, Bordetella pertussis
cagcacgucauccugggcgcgcg

SEQ ID NO: 2339391 - RNA, 14 nt, Bordetella pertussis
cagcacgucggcgu

SEQ ID NO: 2339392 - RNA, 15 nt, Bordetella pertussis
cagcacgucggcguc

SEQ ID NO: 2339393 - RNA, 16 nt, Bordetella pertussis
cagcacgucggcgucg

SEQ ID NO: 2339394 - RNA, 22 nt, Bordetella pertussis
cagcacgucggcgucgggcuug

SEQ ID NO: 2339395 - RNA, 15 nt, Bordetella pertussis
cagcacuucgaugcg

SEQ ID NO: 2339396 - RNA, 13 nt, Bordetella pertussis
cagcacuugccgg

SEQ ID NO: 2339397 - RNA, 16 nt, Bordetella pertussis
cagcacuugccggccg

SEQ ID NO: 2339398 - RNA, 18 nt, Bordetella pertussis
cagcacuugccggccgcc

SEQ ID NO: 2339399 - RNA, 22 nt, Bordetella pertussis
cagcacuugccggccgcccagg

SEQ ID NO: 2339400 - RNA, 23 nt, Bordetella pertussis
cagcacuugccggccgcccaggc

SEQ ID NO: 2339401 - RNA, 17 nt, Bordetella pertussis
cagcagaaugccgccca

SEQ ID NO: 2339402 - RNA, 20 nt, Bordetella pertussis
cagcagaaugccgcccacga

SEQ ID NO: 2339403 - RNA, 19 nt, Bordetella pertussis
cagcagacccuggcgcgcg

SEQ ID NO: 2339404 - RNA, 14 nt, Bordetella pertussis
cagcagacgcuuca

SEQ ID NO: 2339405 - RNA, 16 nt, Bordetella pertussis
cagcagaucggcggcc

SEQ ID NO: 2339406 - RNA, 19 nt, Bordetella pertussis
cagcagaucggcggccugg

SEQ ID NO: 2339407 - RNA, 19 nt, Bordetella pertussis
cagcagauggcccuugccc

SEQ ID NO: 2339408 - RNA, 17 nt, Bordetella pertussis
cagcagauucaugggcg

SEQ ID NO: 2339409 - RNA, 16 nt, Bordetella pertussis
cagcagauugccgcgc

SEQ ID NO: 2339410 - RNA, 17 nt, Bordetella pertussis
cagcagauugccgcgcg

SEQ ID NO: 2339411 - RNA, 16 nt, Bordetella pertussis
cagcagcaccgugccg

SEQ ID NO: 2339412 - RNA, 17 nt, Bordetella pertussis
cagcagcaccgugccgg

SEQ ID NO: 2339413 - RNA, 21 nt, Bordetella pertussis
cagcagcaccuucugccgcca

SEQ ID NO: 2339414 - RNA, 24 nt, Bordetella pertussis
cagcagcaccuucugccgccaggc

SEQ ID NO: 2339415 - RNA, 13 nt, Bordetella pertussis
cagcagcacgcag

SEQ ID NO: 2339416 - RNA, 13 nt, Bordetella pertussis
cagcagcacgccc

SEQ ID NO: 2339417 - RNA, 14 nt, Bordetella pertussis
cagcagcacgccca

SEQ ID NO: 2339418 - RNA, 15 nt, Bordetella pertussis
cagcagcacgcccau

SEQ ID NO: 2339419 - RNA, 22 nt, Bordetella pertussis
cagcagcacgccuucgagcugc

SEQ ID NO: 2339420 - RNA, 15 nt, Bordetella pertussis
cagcagcacggccac

SEQ ID NO: 2339421 - RNA, 17 nt, Bordetella pertussis
cagcagcacggccacga

SEQ ID NO: 2339422 - RNA, 14 nt, Bordetella pertussis
cagcagcacguucu

SEQ ID NO: 2339423 - RNA, 15 nt, Bordetella pertussis
cagcagcagcacggc

SEQ ID NO: 2339424 - RNA, 14 nt, Bordetella pertussis
cagcagcagcgagc

SEQ ID NO: 2339425 - RNA, 14 nt, Bordetella pertussis
cagcagcagcgugc

SEQ ID NO: 2339426 - RNA, 13 nt, Bordetella pertussis
cagcagcaggccc

SEQ ID NO: 2339427 - RNA, 14 nt, Bordetella pertussis
cagcagcaggcccu

SEQ ID NO: 2339428 - RNA, 23 nt, Bordetella pertussis
cagcagcaggcccuccggcgcca

SEQ ID NO: 2339429 - RNA, 12 nt, Bordetella pertussis
cagcagcaggcu

SEQ ID NO: 2339430 - RNA, 14 nt, Bordetella pertussis
cagcagcaggcugg

SEQ ID NO: 2339431 - RNA, 16 nt, Bordetella pertussis
cagcagcaggcuggcc

SEQ ID NO: 2339432 - RNA, 12 nt, Bordetella pertussis
cagcagcagggc

SEQ ID NO: 2339433 - RNA, 14 nt, Bordetella pertussis
cagcagcagggcca

SEQ ID NO: 2339434 - RNA, 16 nt, Bordetella pertussis
cagcagcagggccagg

SEQ ID NO: 2339435 - RNA, 17 nt, Bordetella pertussis
cagcagcaguugcagca

SEQ ID NO: 2339436 - RNA, 20 nt, Bordetella pertussis
cagcagcaguugcagcauga

SEQ ID NO: 2339437 - RNA, 13 nt, Bordetella pertussis
cagcagcaugccg

SEQ ID NO: 2339438 - RNA, 13 nt, Bordetella pertussis
cagcagcaugcgg

SEQ ID NO: 2339439 - RNA, 14 nt, Bordetella pertussis
cagcagcaugcggc

SEQ ID NO: 2339440 - RNA, 18 nt, Bordetella pertussis
cagcagcaugcggcccgc

SEQ ID NO: 2339441 - RNA, 21 nt, Bordetella pertussis
cagcagcaugcggcccgcgcu

SEQ ID NO: 2339442 - RNA, 20 nt, Bordetella pertussis
cagcagcauuucgaugcgca

SEQ ID NO: 2339443 - RNA, 23 nt, Bordetella pertussis
cagcagcauuucgaugcgcacca

SEQ ID NO: 2339444 - RNA, 17 nt, Bordetella pertussis
cagcagccccagcgucc

SEQ ID NO: 2339445 - RNA, 21 nt, Bordetella pertussis
cagcagccccagcguccaggc

SEQ ID NO: 2339446 - RNA, 14 nt, Bordetella pertussis
cagcagcccgcugg

SEQ ID NO: 2339447 - RNA, 15 nt, Bordetella pertussis
cagcagcccgcuggc

SEQ ID NO: 2339448 - RNA, 12 nt, Bordetella pertussis
cagcaugucgug

SEQ ID NO: 2339449 - RNA, 15 nt, Bordetella pertussis
cagcaugucguggcg

SEQ ID NO: 2339450 - RNA, 16 nt, Bordetella pertussis
cagcaugucguggcga

SEQ ID NO: 2339451 - RNA, 17 nt, Bordetella pertussis
cagcaugugcgcggcgu

SEQ ID NO: 2339452 - RNA, 19 nt, Bordetella pertussis
cagcaugugcgcggcguug

SEQ ID NO: 2339453 - RNA, 21 nt, Bordetella pertussis
cagcauucuggugcagcggcu

SEQ ID NO: 2339454 - RNA, 17 nt, Bordetella pertussis
cagcauuucgcgugcgu

SEQ ID NO: 2339455 - RNA, 18 nt, Bordetella pertussis
cagcauuucgcgugcgug

SEQ ID NO: 2339456 - RNA, 18 nt, Bordetella pertussis
cagcauuucggcgccgcc

SEQ ID NO: 2339457 - RNA, 20 nt, Bordetella pertussis
cagcauuucggcgccgccgg

SEQ ID NO: 2339458 - RNA, 21 nt, Bordetella pertussis
cagcauuucggcgccgccggc

SEQ ID NO: 2339459 - RNA, 18 nt, Bordetella pertussis
cagcauuucucgggcgca

SEQ ID NO: 2339460 - RNA, 20 nt, Bordetella pertussis
cagccacacgaucagcgccc

SEQ ID NO: 2339461 - RNA, 23 nt, Bordetella pertussis
cagccacacgaucagcgcccagg

SEQ ID NO: 2339462 - RNA, 24 nt, Bordetella pertussis
cagccacacgcugaagcgccgcca

SEQ ID NO: 2339463 - RNA, 13 nt, Bordetella pertussis
cagccacaggccc

SEQ ID NO: 2339464 - RNA, 17 nt, Bordetella pertussis
cagccacaggcccaugc

SEQ ID NO: 2339465 - RNA, 20 nt, Bordetella pertussis
cagccacaggcccaugccgc

SEQ ID NO: 2339466 - RNA, 18 nt, Bordetella pertussis
cagccaccccgucaucgc

SEQ ID NO: 2339467 - RNA, 19 nt, Bordetella pertussis
cagccaccccgucaucgcc

SEQ ID NO: 2339468 - RNA, 20 nt, Bordetella pertussis
cagccaccccgucaucgccg

SEQ ID NO: 2339469 - RNA, 22 nt, Bordetella pertussis
cagccaccgguugcagcgcgcc

SEQ ID NO: 2339470 - RNA, 23 nt, Bordetella pertussis
cagccaccgguugcagcgcgcca

SEQ ID NO: 2339471 - RNA, 13 nt, Bordetella pertussis
cagccacgccugg

SEQ ID NO: 2339472 - RNA, 14 nt, Bordetella pertussis
cagccacgccuggc

SEQ ID NO: 2339473 - RNA, 20 nt, Bordetella pertussis
cagccacgccuggccgcgcu

SEQ ID NO: 2339474 - RNA, 12 nt, Bordetella pertussis
cagccacgcgcg

SEQ ID NO: 2339475 - RNA, 18 nt, Bordetella pertussis
cagccacgcgcgcuggcg

SEQ ID NO: 2339476 - RNA, 24 nt, Bordetella pertussis
cagccacgcgcgcuggcgcccggc

SEQ ID NO: 2339477 - RNA, 16 nt, Bordetella pertussis
caccagcgcgccagca

SEQ ID NO: 2339478 - RNA, 13 nt, Bordetella pertussis
caccagcgcgccg

SEQ ID NO: 2339479 - RNA, 16 nt, Bordetella pertussis
caccagcgcgccgcgc

SEQ ID NO: 2339480 - RNA, 17 nt, Bordetella pertussis
caccagcgcgccgcgcg

SEQ ID NO: 2339481 - RNA, 19 nt, Bordetella pertussis
caccagcgcgccgcgcgcg

SEQ ID NO: 2339482 - RNA, 12 nt, Bordetella pertussis
caccagcgcggc

SEQ ID NO: 2339483 - RNA, 14 nt, Bordetella pertussis
caccagcgcggcca

SEQ ID NO: 2339484 - RNA, 15 nt, Bordetella pertussis
caccagcgcggccag

SEQ ID NO: 2339485 - RNA, 16 nt, Bordetella pertussis
caccagcgcggccagc

SEQ ID NO: 2339486 - RNA, 19 nt, Bordetella pertussis
caccagcgcggccagcacc

SEQ ID NO: 2339487 - RNA, 20 nt, Bordetella pertussis
caccagcgcggccagcaccg

SEQ ID NO: 2339488 - RNA, 21 nt, Bordetella pertussis
caccagcgcggccagcaccgg

SEQ ID NO: 2339489 - RNA, 12 nt, Bordetella pertussis
caccagcgcguc

SEQ ID NO: 2339490 - RNA, 15 nt, Bordetella pertussis
caccagcgcgucgcc

SEQ ID NO: 2339491 - RNA, 14 nt, Bordetella pertussis
caccagcggcgccg

SEQ ID NO: 2339492 - RNA, 16 nt, Bordetella pertussis
caccagcggcgccgga

SEQ ID NO: 2339493 - RNA, 21 nt, Bordetella pertussis
caccagcggcguggcggccag

SEQ ID NO: 2339494 - RNA, 18 nt, Bordetella pertussis
caccagcgucaccagcag

SEQ ID NO: 2339495 - RNA, 20 nt, Bordetella pertussis
caccagcguguagagcaggc

SEQ ID NO: 2339496 - RNA, 16 nt, Bordetella pertussis
caccagcuccucgacc

SEQ ID NO: 2339497 - RNA, 14 nt, Bordetella pertussis
caccagcucgcggc

SEQ ID NO: 2339498 - RNA, 17 nt, Bordetella pertussis
caccagcucgcggcccu

SEQ ID NO: 2339499 - RNA, 15 nt, Bordetella pertussis
caccagcucggcggc

SEQ ID NO: 2339500 - RNA, 13 nt, Bordetella pertussis
caccagcuugcgc

SEQ ID NO: 2339501 - RNA, 14 nt, Bordetella pertussis
caccagcuuggccu

SEQ ID NO: 2339502 - RNA, 15 nt, Bordetella pertussis
caccagcuuggccug

SEQ ID NO: 2339503 - RNA, 22 nt, Bordetella pertussis
caccagcuuggccugcggaugc

SEQ ID NO: 2339504 - RNA, 19 nt, Bordetella pertussis
caccaggaacagcaacgcc

SEQ ID NO: 2339505 - RNA, 20 nt, Bordetella pertussis
caccaggaacagcaacgcca

SEQ ID NO: 2339506 - RNA, 17 nt, Bordetella pertussis
caccaggaagagcuggc

SEQ ID NO: 2339507 - RNA, 18 nt, Bordetella pertussis
caccaggaagagcuggcg

SEQ ID NO: 2339508 - RNA, 20 nt, Bordetella pertussis
caccaggaagagcuggcgcu

SEQ ID NO: 2339509 - RNA, 22 nt, Bordetella pertussis
caccaggaagagcuggcgcugc

SEQ ID NO: 2339510 - RNA, 17 nt, Bordetella pertussis
caccaggaagcgcgccu

SEQ ID NO: 2339511 - RNA, 21 nt, Bordetella pertussis
caccaggaagcgcgccugcga

SEQ ID NO: 2339512 - RNA, 16 nt, Bordetella pertussis
caccaggauccccagc

SEQ ID NO: 2339513 - RNA, 14 nt, Bordetella pertussis
caccaggcccaggg

SEQ ID NO: 2339514 - RNA, 21 nt, Bordetella pertussis
caccaggcccaugaaggcggc

SEQ ID NO: 2339515 - RNA, 22 nt, Bordetella pertussis
caccaggccgauggcguccagc

SEQ ID NO: 2339516 - RNA, 16 nt, Bordetella pertussis
caccaggccgccggcc

SEQ ID NO: 2339517 - RNA, 17 nt, Bordetella pertussis
caccaggccgccggcca

SEQ ID NO: 2339518 - RNA, 18 nt, Bordetella pertussis
caccaggccgccggccag

SEQ ID NO: 2339519 - RNA, 19 nt, Bordetella pertussis
caccaggccgccggccagc

SEQ ID NO: 2339520 - RNA, 22 nt, Bordetella pertussis
caccaggccgccggccagcgcc

SEQ ID NO: 2339521 - RNA, 16 nt, Bordetella pertussis
caccaggccgcggcgc

SEQ ID NO: 2339522 - RNA, 12 nt, Bordetella pertussis
caccaggccggc

SEQ ID NO: 2339523 - RNA, 14 nt, Bordetella pertussis
caccaggccggcca

SEQ ID NO: 2339524 - RNA, 15 nt, Bordetella pertussis
caccaggccggccag

SEQ ID NO: 2339525 - RNA, 20 nt, Bordetella pertussis
caccaggccggccagggcca

SEQ ID NO: 2339526 - RNA, 17 nt, Bordetella pertussis
caccaggccgucggcca

SEQ ID NO: 2339527 - RNA, 20 nt, Bordetella pertussis
caccaggcgcgcgccaucga

SEQ ID NO: 2339528 - RNA, 22 nt, Bordetella pertussis
caccaggcgcgcgccaucgacg

SEQ ID NO: 2339529 - RNA, 13 nt, Bordetella pertussis
caccaggcgcggc

SEQ ID NO: 2339530 - RNA, 18 nt, Bordetella pertussis
caccaggcgcucgcgcgc

SEQ ID NO: 2339531 - RNA, 19 nt, Bordetella pertussis
caccaggcgcucgcgcgcc

SEQ ID NO: 2339532 - RNA, 23 nt, Bordetella pertussis
caccaggcgcucgcgcgccagca

SEQ ID NO: 2339533 - RNA, 16 nt, Bordetella pertussis
caccaggcugaucacc

SEQ ID NO: 2339534 - RNA, 18 nt, Bordetella pertussis
caccaggcugaucaccca

SEQ ID NO: 2339535 - RNA, 20 nt, Bordetella pertussis
caccaggcugaucacccaca

SEQ ID NO: 2339536 - RNA, 22 nt, Bordetella pertussis
caccaggcugaucacccacagc

SEQ ID NO: 2339537 - RNA, 23 nt, Bordetella pertussis
caccaggcugaucacccacagca

SEQ ID NO: 2339538 - RNA, 11 nt, Bordetella pertussis
caccaggcugg

SEQ ID NO: 2339539 - RNA, 15 nt, Bordetella pertussis
caccaggcuggggcc

SEQ ID NO: 2339540 - RNA, 23 nt, Bordetella pertussis
caccaggcuuucgaagccgcccc

SEQ ID NO: 2339541 - RNA, 19 nt, Bordetella pertussis
caccaggcuuugcgcgcca

SEQ ID NO: 2339542 - RNA, 13 nt, Bordetella pertussis
caccagggccagc

SEQ ID NO: 2339543 - RNA, 14 nt, Bordetella pertussis
caccagggccagcu

SEQ ID NO: 2339544 - RNA, 15 nt, Bordetella pertussis
caccagggcccggac

SEQ ID NO: 2339545 - RNA, 15 nt, Bordetella pertussis
caccagggcgcccgc

SEQ ID NO: 2339546 - RNA, 13 nt, Bordetella pertussis
caccagggcgcgc

SEQ ID NO: 2339547 - RNA, 18 nt, Bordetella pertussis
caccagggcgcgcagcag

SEQ ID NO: 2339548 - RNA, 19 nt, Bordetella pertussis
caccagggcgcgcagcagg

SEQ ID NO: 2339549 - RNA, 22 nt, Bordetella pertussis
caccagggcgcgcagcaggccc

SEQ ID NO: 2339550 - RNA, 15 nt, Bordetella pertussis
caccagggugccgcc

SEQ ID NO: 2339551 - RNA, 19 nt, Bordetella pertussis
caccagggugccgccuucg

SEQ ID NO: 2339552 - RNA, 19 nt, Bordetella pertussis
caccaggguggcgccggcc

SEQ ID NO: 2339553 - RNA, 22 nt, Bordetella pertussis
caccaggguggcgccggccacc

SEQ ID NO: 2339554 - RNA, 23 nt, Bordetella pertussis
caccaggguggcgccggccaccg

SEQ ID NO: 2339555 - RNA, 19 nt, Bordetella pertussis
caccaggguggcgggcgcc

SEQ ID NO: 2339556 - RNA, 21 nt, Bordetella pertussis
caccaggguggcgggcgccug

SEQ ID NO: 2339557 - RNA, 16 nt, Bordetella pertussis
caccaggguggcgucc

SEQ ID NO: 2339558 - RNA, 19 nt, Bordetella pertussis
caccaggguggcguccugg

SEQ ID NO: 2339559 - RNA, 23 nt, Bordetella pertussis
caccaggguuuccucgccgacga

SEQ ID NO: 2339560 - RNA, 21 nt, Bordetella pertussis
caccagguagggcagcagguc

SEQ ID NO: 2339561 - RNA, 16 nt, Bordetella pertussis
caccagguccuggcgg

SEQ ID NO: 2339562 - RNA, 23 nt, Bordetella pertussis
caccaggucgaacggauugcuga

SEQ ID NO: 2339563 - RNA, 22 nt, Bordetella pertussis
caccaggugguuggcgugcccg

SEQ ID NO: 2339564 - RNA, 21 nt, Bordetella pertussis
caccagguugcauccggcccg

SEQ ID NO: 2339565 - RNA, 22 nt, Bordetella pertussis
caccagguugcauccggcccgg

SEQ ID NO: 2339566 - RNA, 15 nt, Bordetella pertussis
caccagguugucggc

SEQ ID NO: 2339567 - RNA, 17 nt, Bordetella pertussis
caccagguugucggcgc

SEQ ID NO: 2339568 - RNA, 19 nt, Bordetella pertussis
caccagguugucggcgcca

SEQ ID NO: 2339569 - RNA, 18 nt, Bordetella pertussis
caccagguuuuccacagc

SEQ ID NO: 2339570 - RNA, 19 nt, Bordetella pertussis
caccagguuuuccacagcc

SEQ ID NO: 2339571 - RNA, 15 nt, Bordetella pertussis
caccagugcgccggc

SEQ ID NO: 2339572 - RNA, 18 nt, Bordetella pertussis
caccagugcgccggcgcg

SEQ ID NO: 2339573 - RNA, 22 nt, Bordetella pertussis
caccagugcgccggcgcggcgg

SEQ ID NO: 2339574 - RNA, 17 nt, Bordetella pertussis
caccagugcgccggcgg

SEQ ID NO: 2339575 - RNA, 18 nt, Bordetella pertussis
caccagugcgccggcggc

SEQ ID NO: 2339576 - RNA, 19 nt, Bordetella pertussis
caccagugcgccggcggcg

SEQ ID NO: 2339577 - RNA, 21 nt, Bordetella pertussis
caccaguuucucggccacuuc

SEQ ID NO: 2339578 - RNA, 12 nt, Bordetella pertussis
caccaguuuucu

SEQ ID NO: 2339579 - RNA, 21 nt, Bordetella pertussis
caccaguuuucucauggccgc

SEQ ID NO: 2339580 - RNA, 22 nt, Bordetella pertussis
caccaguuuucucauggccgcg

SEQ ID NO: 2339581 - RNA, 17 nt, Bordetella pertussis
caccaucaacgggccgc

SEQ ID NO: 2339582 - RNA, 19 nt, Bordetella pertussis
caccaucaagaugaacgcg

SEQ ID NO: 2339583 - RNA, 23 nt, Bordetella pertussis
caccaucaaggccaugaucaggc

SEQ ID NO: 2339584 - RNA, 15 nt, Bordetella pertussis
caccaucgccgcguc

SEQ ID NO: 2339585 - RNA, 16 nt, Bordetella pertussis
caccaucgccgcgucg

SEQ ID NO: 2339586 - RNA, 23 nt, Bordetella pertussis
caccaucguugccugggugcugg

SEQ ID NO: 2339587 - RNA, 17 nt, Bordetella pertussis
caccaugagcacgcccc

SEQ ID NO: 2339588 - RNA, 14 nt, Bordetella pertussis
caccaugccgacga

SEQ ID NO: 2339589 - RNA, 23 nt, Bordetella pertussis
caccaugccggggaacaggucgu

SEQ ID NO: 2339590 - RNA, 15 nt, Bordetella pertussis
caccaugccuugcgc

SEQ ID NO: 2339591 - RNA, 13 nt, Bordetella pertussis
auugguguugccg

SEQ ID NO: 2339592 - RNA, 14 nt, Bordetella pertussis
auuguccagcggca

SEQ ID NO: 2339593 - RNA, 21 nt, Bordetella pertussis
auuucaccuaccucagcaugg

SEQ ID NO: 2339594 - RNA, 23 nt, Bordetella pertussis
cagcaggcggccgaccagcacga

SEQ ID NO: 2339595 - RNA, 14 nt, Bordetella pertussis
cagcaggcucagcg

SEQ ID NO: 2339596 - RNA, 15 nt, Bordetella pertussis
cagcaggcucagcgg

SEQ ID NO: 2339597 - RNA, 16 nt, Bordetella pertussis
cagcaggcugccgccg

SEQ ID NO: 2339598 - RNA, 18 nt, Bordetella pertussis
cagcaggcugccgccggc

SEQ ID NO: 2339599 - RNA, 21 nt, Bordetella pertussis
cagcaggcuuucgcacagccg

SEQ ID NO: 2339600 - RNA, 22 nt, Bordetella pertussis
cagcaggcuuucgcacagccgg

SEQ ID NO: 2339601 - RNA, 23 nt, Bordetella pertussis
cagcaggcuuucgcacagccggg

SEQ ID NO: 2339602 - RNA, 19 nt, Bordetella pertussis
cagcagggacuugggcagg

SEQ ID NO: 2339603 - RNA, 22 nt, Bordetella pertussis
cagcagggacuugggcaggccu

SEQ ID NO: 2339604 - RNA, 16 nt, Bordetella pertussis
cagcagggccacgccc

SEQ ID NO: 2339605 - RNA, 22 nt, Bordetella pertussis
cagcagggccacgcccaggccg

SEQ ID NO: 2339606 - RNA, 14 nt, Bordetella pertussis
cagcagggccaggc

SEQ ID NO: 2339607 - RNA, 16 nt, Bordetella pertussis
cagcagggccaggccc

SEQ ID NO: 2339608 - RNA, 20 nt, Bordetella pertussis
cagcagggccaggcccacgg

SEQ ID NO: 2339609 - RNA, 22 nt, Bordetella pertussis
cagcagggccaggcccacggcg

SEQ ID NO: 2339610 - RNA, 18 nt, Bordetella pertussis
cagcagggcgccgacgau

SEQ ID NO: 2339611 - RNA, 16 nt, Bordetella pertussis
cagcagggucagcggc

SEQ ID NO: 2339612 - RNA, 19 nt, Bordetella pertussis
cagccacgggauguccgcg

SEQ ID NO: 2339613 - RNA, 19 nt, Bordetella pertussis
cagccacugcggcccgagc

SEQ ID NO: 2339614 - RNA, 22 nt, Bordetella pertussis
cagccacuggaacagcuugggc

SEQ ID NO: 2339615 - RNA, 17 nt, Bordetella pertussis
cagccagauaccguccu

SEQ ID NO: 2339616 - RNA, 15 nt, Bordetella pertussis
cagccagaucucgcg

SEQ ID NO: 2339617 - RNA, 22 nt, Bordetella pertussis
cagccagaucucgcguccggug

SEQ ID NO: 2339618 - RNA, 19 nt, Bordetella pertussis
cagccagauucccccgcac

SEQ ID NO: 2339619 - RNA, 14 nt, Bordetella pertussis
cagccagccgccgc

SEQ ID NO: 2339620 - RNA, 17 nt, Bordetella pertussis
cagccagccgccgcgcg

SEQ ID NO: 2339621 - RNA, 18 nt, Bordetella pertussis
cagccagccgccgcgcgg

SEQ ID NO: 2339622 - RNA, 13 nt, Bordetella pertussis
cagccagccgcuu

SEQ ID NO: 2339623 - RNA, 20 nt, Bordetella pertussis
cagccagccgcuugcggcca

SEQ ID NO: 2339624 - RNA, 22 nt, Bordetella pertussis
cagccagccgcuugcggccagg

SEQ ID NO: 2339625 - RNA, 17 nt, Bordetella pertussis
cagccagccggcggcca

SEQ ID NO: 2339626 - RNA, 19 nt, Bordetella pertussis
cagccagccggcggccagc

SEQ ID NO: 2339627 - RNA, 20 nt, Bordetella pertussis
cagccagccggcggccagcu

SEQ ID NO: 2339628 - RNA, 13 nt, Bordetella pertussis
cagccagcgccgc

SEQ ID NO: 2339629 - RNA, 17 nt, Bordetella pertussis
cagccagcgccgcagcg

SEQ ID NO: 2339630 - RNA, 18 nt, Bordetella pertussis
cagccagcgccgcagcgu

SEQ ID NO: 2339631 - RNA, 19 nt, Bordetella pertussis
cagccagcgccgcagcguc

SEQ ID NO: 2339632 - RNA, 14 nt, Bordetella pertussis
cagccagcggugcg

SEQ ID NO: 2339633 - RNA, 18 nt, Bordetella pertussis
cagccagcggugcgcggc

SEQ ID NO: 2339634 - RNA, 21 nt, Bordetella pertussis
cagccagcggugcgcggcgca

SEQ ID NO: 2339635 - RNA, 16 nt, Bordetella pertussis
cagccaggccagcgcc

SEQ ID NO: 2339636 - RNA, 17 nt, Bordetella pertussis
cagccaggccagcgcca

SEQ ID NO: 2339637 - RNA, 18 nt, Bordetella pertussis
cagccaggccagcgccag

SEQ ID NO: 2339638 - RNA, 19 nt, Bordetella pertussis
cagccaggccagcgccaga

SEQ ID NO: 2339639 - RNA, 12 nt, Bordetella pertussis
cagccaggccga

SEQ ID NO: 2339640 - RNA, 21 nt, Bordetella pertussis
cagccaggccgaucagcacca

SEQ ID NO: 2339641 - RNA, 13 nt, Bordetella pertussis
cagccaggcgcca

SEQ ID NO: 2339642 - RNA, 18 nt, Bordetella pertussis
cagccaggcgccagcggc

SEQ ID NO: 2339643 - RNA, 14 nt, Bordetella pertussis
cagccaggcgcgca

SEQ ID NO: 2339644 - RNA, 16 nt, Bordetella pertussis
cagccaggcgguggcc

SEQ ID NO: 2339645 - RNA, 13 nt, Bordetella pertussis
cagccagggcagg

SEQ ID NO: 2339646 - RNA, 15 nt, Bordetella pertussis
cagccagggcagggc

SEQ ID NO: 2339647 - RNA, 19 nt, Bordetella pertussis
cagccagguaagcuggcgc

SEQ ID NO: 2339648 - RNA, 14 nt, Bordetella pertussis
cagccaguugggcc

SEQ ID NO: 2339649 - RNA, 17 nt, Bordetella pertussis
cagccaguugggccagg

SEQ ID NO: 2339650 - RNA, 18 nt, Bordetella pertussis
cagccaguugggccaggg

SEQ ID NO: 2339651 - RNA, 20 nt, Bordetella pertussis
cagccaguugggccagggcc

SEQ ID NO: 2339652 - RNA, 14 nt, Bordetella pertussis
cagccaucaucauc

SEQ ID NO: 2339653 - RNA, 18 nt, Bordetella pertussis
cagccaucaucaucgucg

SEQ ID NO: 2339654 - RNA, 19 nt, Bordetella pertussis
cagccauccucgcccagcg

SEQ ID NO: 2339655 - RNA, 18 nt, Bordetella pertussis
cagccauguucgaccagg

SEQ ID NO: 2339656 - RNA, 19 nt, Bordetella pertussis
cagccauguucgaccagga

SEQ ID NO: 2339657 - RNA, 16 nt, Bordetella pertussis
cagccauucgauggcg

SEQ ID NO: 2339658 - RNA, 21 nt, Bordetella pertussis
cagccauucgauggcggcgcu

SEQ ID NO: 2339659 - RNA, 13 nt, Bordetella pertussis
cagccauucggcc

SEQ ID NO: 2339660 - RNA, 15 nt, Bordetella pertussis
cagccauucggccac

SEQ ID NO: 2339661 - RNA, 17 nt, Bordetella pertussis
cagcccacaagccguac

SEQ ID NO: 2339662 - RNA, 19 nt, Bordetella pertussis
cagcccagcaccacggcau

SEQ ID NO: 2339663 - RNA, 13 nt, Bordetella pertussis
cagcccagcgcga

SEQ ID NO: 2339664 - RNA, 22 nt, Bordetella pertussis
cagcccagcgcgauucccuggc

SEQ ID NO: 2339665 - RNA, 23 nt, Bordetella pertussis
cagcccagcgcgauucccuggcg

SEQ ID NO: 2339666 - RNA, 15 nt, Bordetella pertussis
cagcccggcgcgaca

SEQ ID NO: 2339667 - RNA, 14 nt, Bordetella pertussis
cagcccggcgcgcc

SEQ ID NO: 2339668 - RNA, 15 nt, Bordetella pertussis
cagcccggcgcgcca

SEQ ID NO: 2339669 - RNA, 21 nt, Bordetella pertussis
cagcccggcgcgccacccugg

SEQ ID NO: 2339670 - RNA, 13 nt, Bordetella pertussis
cagcccggcggcc

SEQ ID NO: 2339671 - RNA, 14 nt, Bordetella pertussis
cagcccggcggcca

SEQ ID NO: 2339672 - RNA, 17 nt, Bordetella pertussis
cagcccggcgugcccag

SEQ ID NO: 2339673 - RNA, 18 nt, Bordetella pertussis
cagcccggcgugcccagg

SEQ ID NO: 2339674 - RNA, 22 nt, Bordetella pertussis
cagcccgggaaacucgcgcagc

SEQ ID NO: 2339675 - RNA, 20 nt, Bordetella pertussis
cagcccgggcaugcgaaagc

SEQ ID NO: 2339676 - RNA, 12 nt, Bordetella pertussis
cagcccggucgu

SEQ ID NO: 2339677 - RNA, 22 nt, Bordetella pertussis
cagcccguccuggugcacgccg

SEQ ID NO: 2339678 - RNA, 15 nt, Bordetella pertussis
cagcccgugggcggc

SEQ ID NO: 2339679 - RNA, 17 nt, Bordetella pertussis
cagcccgugggcggcgu

SEQ ID NO: 2339680 - RNA, 19 nt, Bordetella pertussis
cagcccgugggcggcguag

SEQ ID NO: 2339681 - RNA, 16 nt, Bordetella pertussis
cagcccuucggagcca

SEQ ID NO: 2339682 - RNA, 19 nt, Bordetella pertussis
cagcccuugacgcguacga

SEQ ID NO: 2339683 - RNA, 15 nt, Bordetella pertussis
cagccgacaggcgcg

SEQ ID NO: 2339684 - RNA, 15 nt, Bordetella pertussis
cagccgagccuggcg

SEQ ID NO: 2339685 - RNA, 15 nt, Bordetella pertussis
cagccgaucagccgg

SEQ ID NO: 2339686 - RNA, 16 nt, Bordetella pertussis
cagccgaucagccggc

SEQ ID NO: 2339687 - RNA, 18 nt, Bordetella pertussis
cagccgaucagccggcca

SEQ ID NO: 2339688 - RNA, 15 nt, Bordetella pertussis
cagccgaugauggug

SEQ ID NO: 2339689 - RNA, 18 nt, Bordetella pertussis
cagccgaugauggugaac

SEQ ID NO: 2339690 - RNA, 15 nt, Bordetella pertussis
cagccgaugccgcuu

SEQ ID NO: 2339691 - RNA, 17 nt, Bordetella pertussis
cagccgcaagcuggcgg

SEQ ID NO: 2339692 - RNA, 14 nt, Bordetella pertussis
cagccgcaccagcg

SEQ ID NO: 2339693 - RNA, 17 nt, Bordetella pertussis
cagccgcaccagcgcau

SEQ ID NO: 2339694 - RNA, 12 nt, Bordetella pertussis
cagccgcagcag

SEQ ID NO: 2339695 - RNA, 13 nt, Bordetella pertussis
cagccgcagcagg

SEQ ID NO: 2339696 - RNA, 13 nt, Bordetella pertussis
cagccgcagccgu

SEQ ID NO: 2339697 - RNA, 16 nt, Bordetella pertussis
cagccgcagccgucgc

SEQ ID NO: 2339698 - RNA, 23 nt, Bordetella pertussis
cagccgcaguauuccugcuggua

SEQ ID NO: 2339699 - RNA, 15 nt, Bordetella pertussis
cagccgcaugccggc

SEQ ID NO: 2339700 - RNA, 23 nt, Bordetella pertussis
cagccgcaugccggcgaugaugg

SEQ ID NO: 2339701 - RNA, 14 nt, Bordetella pertussis
cagccgccagcgcc

SEQ ID NO: 2339702 - RNA, 15 nt, Bordetella pertussis
cagccgccagcgccu

SEQ ID NO: 2339703 - RNA, 22 nt, Bordetella pertussis
cagccgccagcgccuggaccug

SEQ ID NO: 2339704 - RNA, 13 nt, Bordetella pertussis
cagccgccccagc

SEQ ID NO: 2339705 - RNA, 17 nt, Bordetella pertussis
cagccgccccagcagca

SEQ ID NO: 2339706 - RNA, 13 nt, Bordetella pertussis
cagccgcccgccg

SEQ ID NO: 2339707 - RNA, 14 nt, Bordetella pertussis
cagccgcccgccgg

SEQ ID NO: 2339708 - RNA, 12 nt, Bordetella pertussis
cagccgcccggc

SEQ ID NO: 2339709 - RNA, 13 nt, Bordetella pertussis
cagccgcgccagc

SEQ ID NO: 2339710 - RNA, 16 nt, Bordetella pertussis
cagccgcgccagcgcc

SEQ ID NO: 2339711 - RNA, 17 nt, Bordetella pertussis
cagccgcgccagcgccu

SEQ ID NO: 2339712 - RNA, 20 nt, Bordetella pertussis
cagccgcgccagcgccucca

SEQ ID NO: 2339713 - RNA, 16 nt, Bordetella pertussis
cagccgcgccagggcg

SEQ ID NO: 2339714 - RNA, 19 nt, Bordetella pertussis
cagccgcgccagggcgcgg

SEQ ID NO: 2339715 - RNA, 20 nt, Bordetella pertussis
cagccgcgccagggcgcgga

SEQ ID NO: 2339716 - RNA, 16 nt, Bordetella pertussis
cagccgcgccugcagc

SEQ ID NO: 2339717 - RNA, 19 nt, Bordetella pertussis
cagccgcgccugcagcagc

SEQ ID NO: 2339718 - RNA, 15 nt, Bordetella pertussis
cagccgcgcgaccuu

SEQ ID NO: 2339719 - RNA, 18 nt, Bordetella pertussis
cagccgcgcgcggccggc

SEQ ID NO: 2339720 - RNA, 21 nt, Bordetella pertussis
cagccgcgcgcggccggcgcg

SEQ ID NO: 2339721 - RNA, 16 nt, Bordetella pertussis
cagccgcgcggccggg

SEQ ID NO: 2339722 - RNA, 23 nt, Bordetella pertussis
cagccgcuaugacgaccgcuacc

SEQ ID NO: 2339723 - RNA, 16 nt, Bordetella pertussis
cagccgcuccagccac

SEQ ID NO: 2339724 - RNA, 13 nt, Bordetella pertussis
cagccgcucgcgc

SEQ ID NO: 2339725 - RNA, 14 nt, Bordetella pertussis
cagccgcucggcca

SEQ ID NO: 2339726 - RNA, 15 nt, Bordetella pertussis
cagccgcucggccac

SEQ ID NO: 2339727 - RNA, 17 nt, Bordetella pertussis
cagccgcucggccacgc

SEQ ID NO: 2339728 - RNA, 21 nt, Bordetella pertussis
cagccgcucguaguguuccug

SEQ ID NO: 2339729 - RNA, 13 nt, Bordetella pertussis
cagccgcugcaga

SEQ ID NO: 2339730 - RNA, 16 nt, Bordetella pertussis
cagccgcugcagcacg

SEQ ID NO: 2339731 - RNA, 17 nt, Bordetella pertussis
cagccgcugcagcacgc

SEQ ID NO: 2339732 - RNA, 21 nt, Bordetella pertussis
cagccgcugcagcacgcacca

SEQ ID NO: 2339733 - RNA, 17 nt, Bordetella pertussis
cagccgcugcagcgacu

SEQ ID NO: 2339734 - RNA, 16 nt, Bordetella pertussis
cagccgcuggcgauca

SEQ ID NO: 2339735 - RNA, 22 nt, Bordetella pertussis
cagccgcuggcgaucaggccgc

SEQ ID NO: 2339736 - RNA, 14 nt, Bordetella pertussis
cagccgcuggcgcg

SEQ ID NO: 2339737 - RNA, 19 nt, Bordetella pertussis
cagccgcuggcgcgccgcc

SEQ ID NO: 2339738 - RNA, 21 nt, Bordetella pertussis
cagccgcuggcgcgccgccuc

SEQ ID NO: 2339739 - RNA, 12 nt, Bordetella pertussis
cagccgcuugaa

SEQ ID NO: 2339740 - RNA, 14 nt, Bordetella pertussis
cagccgcuugaagu

SEQ ID NO: 2339741 - RNA, 21 nt, Bordetella pertussis
cagccgcuugaaguaaucgcc

SEQ ID NO: 2339742 - RNA, 13 nt, Bordetella pertussis
cagccggaaacgg

SEQ ID NO: 2339743 - RNA, 23 nt, Bordetella pertussis
cagccggaaacggaaacugccau

SEQ ID NO: 2339744 - RNA, 16 nt, Bordetella pertussis
cagccggacccgcgcc

SEQ ID NO: 2339745 - RNA, 19 nt, Bordetella pertussis
cagccggacccgcgccgca

SEQ ID NO: 2339746 - RNA, 22 nt, Bordetella pertussis
cagccggacccgcgccgcaggc

SEQ ID NO: 2339747 - RNA, 14 nt, Bordetella pertussis
cagccggccaaggc

SEQ ID NO: 2339748 - RNA, 23 nt, Bordetella pertussis
cagccggccaaggcaagcagcga

SEQ ID NO: 2339749 - RNA, 20 nt, Bordetella pertussis
cagccggccauggccgccac

SEQ ID NO: 2339750 - RNA, 14 nt, Bordetella pertussis
cagccggcccagca

SEQ ID NO: 2339751 - RNA, 17 nt, Bordetella pertussis
cagccggcccagcacgc

SEQ ID NO: 2339752 - RNA, 19 nt, Bordetella pertussis
cagccggcccagcacgccg

SEQ ID NO: 2339753 - RNA, 22 nt, Bordetella pertussis
cagccggcccagcacgccgcgc

SEQ ID NO: 2339754 - RNA, 15 nt, Bordetella pertussis
cagccggcccagcau

SEQ ID NO: 2339755 - RNA, 13 nt, Bordetella pertussis
cagccggccccgc

SEQ ID NO: 2339756 - RNA, 14 nt, Bordetella pertussis
cagccggccgauga

SEQ ID NO: 2339757 - RNA, 20 nt, Bordetella pertussis
cagccggccgguaaggcgcu

SEQ ID NO: 2339758 - RNA, 14 nt, Bordetella pertussis
cagccggcgcgcca

SEQ ID NO: 2339759 - RNA, 14 nt, Bordetella pertussis
cagccggcggcaug

SEQ ID NO: 2339760 - RNA, 13 nt, Bordetella pertussis
cagccggcggcca

SEQ ID NO: 2339761 - RNA, 15 nt, Bordetella pertussis
cagccggcggccagc

SEQ ID NO: 2339762 - RNA, 16 nt, Bordetella pertussis
cagccggcggccagcu

SEQ ID NO: 2339763 - RNA, 19 nt, Bordetella pertussis
cagccggcggccagcuugu

SEQ ID NO: 2339764 - RNA, 24 nt, Bordetella pertussis
cagccggcugcaagacgcccaggc

SEQ ID NO: 2339765 - RNA, 21 nt, Bordetella pertussis
cagccgggcgaucgcgucggc

SEQ ID NO: 2339766 - RNA, 23 nt, Bordetella pertussis
cagccgggcgaucgcgucggcca

SEQ ID NO: 2339767 - RNA, 15 nt, Bordetella pertussis
cagccgggcggccac

SEQ ID NO: 2339768 - RNA, 18 nt, Bordetella pertussis
cagccgggcggccacggc

SEQ ID NO: 2339769 - RNA, 19 nt, Bordetella pertussis
cagccgggcggccacggcg

SEQ ID NO: 2339770 - RNA, 19 nt, Bordetella pertussis
cagccgggcugccggcagc

SEQ ID NO: 2339771 - RNA, 14 nt, Bordetella pertussis
cagccggggcgagc

SEQ ID NO: 2339772 - RNA, 22 nt, Bordetella pertussis
cagccgggucggcugaugcccu

SEQ ID NO: 2339773 - RNA, 17 nt, Bordetella pertussis
cagccggguggucgcgc

SEQ ID NO: 2339774 - RNA, 14 nt, Bordetella pertussis
cagccggugccagu

SEQ ID NO: 2339775 - RNA, 14 nt, Bordetella pertussis
cagccggugcgcgg

SEQ ID NO: 2339776 - RNA, 18 nt, Bordetella pertussis
cagccggugcgcggcuug

SEQ ID NO: 2339777 - RNA, 22 nt, Bordetella pertussis
cagccggugcgcggcuugcagc

SEQ ID NO: 2339778 - RNA, 19 nt, Bordetella pertussis
cagccgugccgcgcgcacc

SEQ ID NO: 2339779 - RNA, 19 nt, Bordetella pertussis
cagccguucaucagcgcgc

SEQ ID NO: 2339780 - RNA, 21 nt, Bordetella pertussis
cagccguucaucagcgcgcgc

SEQ ID NO: 2339781 - RNA, 22 nt, Bordetella pertussis
cagccguucaucagcgcgcgca

SEQ ID NO: 2339782 - RNA, 17 nt, Bordetella pertussis
cagccguugcgccagcg

SEQ ID NO: 2339783 - RNA, 21 nt, Bordetella pertussis
cagccguugcgccagcggcga

SEQ ID NO: 2339784 - RNA, 16 nt, Bordetella pertussis
cagccguuggcgccca

SEQ ID NO: 2339785 - RNA, 20 nt, Bordetella pertussis
cagccguuggcgcccagcgc

SEQ ID NO: 2339786 - RNA, 21 nt, Bordetella pertussis
cagccguuggcgcccagcgcc

SEQ ID NO: 2339787 - RNA, 14 nt, Bordetella pertussis
cagccucgaggugg

SEQ ID NO: 2339788 - RNA, 22 nt, Bordetella pertussis
cagccugauucccaggcccggc

SEQ ID NO: 2339789 - RNA, 15 nt, Bordetella pertussis
cagccugcccgucga

SEQ ID NO: 2339790 - RNA, 13 nt, Bordetella pertussis
cagccugcccucg

SEQ ID NO: 2339791 - RNA, 17 nt, Bordetella pertussis
cagccugcccucgggcg

SEQ ID NO: 2339792 - RNA, 20 nt, Bordetella pertussis
cagccugcccucgggcgaca

SEQ ID NO: 2339793 - RNA, 16 nt, Bordetella pertussis
cagccugccgcggccg

SEQ ID NO: 2339794 - RNA, 20 nt, Bordetella pertussis
cagccugccgcggccgcccc

SEQ ID NO: 2339795 - RNA, 21 nt, Bordetella pertussis
cagccugccgcggccgccccc

SEQ ID NO: 2339796 - RNA, 18 nt, Bordetella pertussis
cagccugccggcgcgccc

SEQ ID NO: 2339797 - RNA, 21 nt, Bordetella pertussis
cagccugccggcgcgcccagg

SEQ ID NO: 2339798 - RNA, 22 nt, Bordetella pertussis
cagccugccggcgcgcccaggg

SEQ ID NO: 2339799 - RNA, 15 nt, Bordetella pertussis
cagccugccggcggc

SEQ ID NO: 2339800 - RNA, 16 nt, Bordetella pertussis
cagccugccggcggcc

SEQ ID NO: 2339801 - RNA, 16 nt, Bordetella pertussis
cagccugcuggugcug

SEQ ID NO: 2339802 - RNA, 17 nt, Bordetella pertussis
cagccugcuggugcugg

SEQ ID NO: 2339803 - RNA, 15 nt, Bordetella pertussis
cagccuggcaaugcg

SEQ ID NO: 2339804 - RNA, 22 nt, Bordetella pertussis
cagccuggcaaugcguggccgg

SEQ ID NO: 2339805 - RNA, 11 nt, Bordetella pertussis
cagccuggccu

SEQ ID NO: 2339806 - RNA, 15 nt, Bordetella pertussis
cagccuggcgccaac

SEQ ID NO: 2339807 - RNA, 24 nt, Bordetella pertussis
cagccuggcgccaacccgccaucc

SEQ ID NO: 2339808 - RNA, 18 nt, Bordetella pertussis
cagccugggccuguacug

SEQ ID NO: 2339809 - RNA, 14 nt, Bordetella pertussis
cagccugggcgccu

SEQ ID NO: 2339810 - RNA, 19 nt, Bordetella pertussis
cagccugggcgccuggcug

SEQ ID NO: 2339811 - RNA, 15 nt, Bordetella pertussis
cagccuggggcaggc

SEQ ID NO: 2339812 - RNA, 18 nt, Bordetella pertussis
cagccuggggcaggcggc

SEQ ID NO: 2339813 - RNA, 23 nt, Bordetella pertussis
cagccuggucagguugcgccggc

SEQ ID NO: 2339814 - RNA, 24 nt, Bordetella pertussis
cagccuggucagguugcgccggcu

SEQ ID NO: 2339815 - RNA, 17 nt, Bordetella pertussis
cagccugucguucggcu

SEQ ID NO: 2339816 - RNA, 16 nt, Bordetella pertussis
cagccuugaaagaggc

SEQ ID NO: 2339817 - RNA, 23 nt, Bordetella pertussis
cagccuugaaagaggcauuggcg

SEQ ID NO: 2339818 - RNA, 17 nt, Bordetella pertussis
cagccuugcuccggcgu

SEQ ID NO: 2339819 - RNA, 18 nt, Bordetella pertussis
cagccuugcuccggcgug

SEQ ID NO: 2339820 - RNA, 17 nt, Bordetella pertussis
cagccuuggcccacuca

SEQ ID NO: 2339821 - RNA, 21 nt, Bordetella pertussis
cagccuuggcccacucaugcg

SEQ ID NO: 2339822 - RNA, 18 nt, Bordetella pertussis
cagccuugucgcgggcag

SEQ ID NO: 2339823 - RNA, 23 nt, Bordetella pertussis
cagccuuuccuccugccggcgga

SEQ ID NO: 2339824 - RNA, 16 nt, Bordetella pertussis
cagcgaaagcacggcg

SEQ ID NO: 2339825 - RNA, 22 nt, Bordetella pertussis
cagcgaaagcacggcgaugcug

SEQ ID NO: 2339826 - RNA, 23 nt, Bordetella pertussis
cagcgaaagcacggcgaugcugc

SEQ ID NO: 2339827 - RNA, 22 nt, Bordetella pertussis
cagcgaaaugccgaagcgcgcg

SEQ ID NO: 2339828 - RNA, 20 nt, Bordetella pertussis
cagcgaaccgaaaugccgca

SEQ ID NO: 2339829 - RNA, 19 nt, Bordetella pertussis
cagcgaacggauggucgug

SEQ ID NO: 2339830 - RNA, 19 nt, Bordetella pertussis
cagcgaauacggcaagcag

SEQ ID NO: 2339831 - RNA, 18 nt, Bordetella pertussis
cagcgaaucguaggcgcu

SEQ ID NO: 2339832 - RNA, 17 nt, Bordetella pertussis
cagcgaaugcgacagcg

SEQ ID NO: 2339833 - RNA, 20 nt, Bordetella pertussis
cagcgaaugcgacagcgaca

SEQ ID NO: 2339834 - RNA, 17 nt, Bordetella pertussis
cagcgacaacaggucgu

SEQ ID NO: 2339835 - RNA, 20 nt, Bordetella pertussis
cagcgacaacaggucguggc

SEQ ID NO: 2339836 - RNA, 14 nt, Bordetella pertussis
cagcgacacggcgg

SEQ ID NO: 2339837 - RNA, 15 nt, Bordetella pertussis
cagcgacacggcggu

SEQ ID NO: 2339838 - RNA, 14 nt, Bordetella pertussis
cagcgacagcacgg

SEQ ID NO: 2339839 - RNA, 15 nt, Bordetella pertussis
cagcgacagcacggu

SEQ ID NO: 2339840 - RNA, 13 nt, Bordetella pertussis
cagcgacagccag

SEQ ID NO: 2339841 - RNA, 20 nt, Bordetella pertussis
cagcgacagccaggccagcg

SEQ ID NO: 2339842 - RNA, 16 nt, Bordetella pertussis
cagcgaccgcggcggu

SEQ ID NO: 2339843 - RNA, 24 nt, Bordetella pertussis
cagcgacgacuugaucagggccac

SEQ ID NO: 2339844 - RNA, 20 nt, Bordetella pertussis
cagcgacgagggcgccauga

SEQ ID NO: 2339845 - RNA, 15 nt, Bordetella pertussis
cagcgacgcgcgccg

SEQ ID NO: 2339846 - RNA, 17 nt, Bordetella pertussis
cagcgacgcgcgccggc

SEQ ID NO: 2339847 - RNA, 18 nt, Bordetella pertussis
cagcgacgcgcgccggcg

SEQ ID NO: 2339848 - RNA, 19 nt, Bordetella pertussis
cagcgacgcgcgccggcgc

SEQ ID NO: 2339849 - RNA, 17 nt, Bordetella pertussis
cagcgacggccccagcg

SEQ ID NO: 2339850 - RNA, 20 nt, Bordetella pertussis
cagcgacggccccagcgccg

SEQ ID NO: 2339851 - RNA, 15 nt, Bordetella pertussis
cagcgacuccggccg

SEQ ID NO: 2339852 - RNA, 17 nt, Bordetella pertussis
cagcgacuccggccggg

SEQ ID NO: 2339853 - RNA, 14 nt, Bordetella pertussis
cagcgacucgaaca

SEQ ID NO: 2339854 - RNA, 20 nt, Bordetella pertussis
cagcgacucggucagcacga

SEQ ID NO: 2339855 - RNA, 16 nt, Bordetella pertussis
cagcgacuucuaccug

SEQ ID NO: 2339856 - RNA, 17 nt, Bordetella pertussis
cagcgacuugucgcgcc

SEQ ID NO: 2339857 - RNA, 19 nt, Bordetella pertussis
cagcgacuugucgcgcccg

SEQ ID NO: 2339858 - RNA, 14 nt, Bordetella pertussis
cagcgagaccgugg

SEQ ID NO: 2339859 - RNA, 14 nt, Bordetella pertussis
cagcgagagcgcca

SEQ ID NO: 2339860 - RNA, 17 nt, Bordetella pertussis
cagcgagaucagcaccg

SEQ ID NO: 2339861 - RNA, 21 nt, Bordetella pertussis
cagcgagaucagcaccgcgac

SEQ ID NO: 2339862 - RNA, 14 nt, Bordetella pertussis
cagcgagcccgcca

SEQ ID NO: 2339863 - RNA, 16 nt, Bordetella pertussis
cagcgagcccgccauc

SEQ ID NO: 2339864 - RNA, 19 nt, Bordetella pertussis
cagcgagcccgccaucgcc

SEQ ID NO: 2339865 - RNA, 14 nt, Bordetella pertussis
cagcgagccggcca

SEQ ID NO: 2339866 - RNA, 16 nt, Bordetella pertussis
cagcgagccggccagc

SEQ ID NO: 2339867 - RNA, 15 nt, Bordetella pertussis
cagcgagcggggcug

SEQ ID NO: 2339868 - RNA, 20 nt, Bordetella pertussis
cagcgagcggggcuggucga

SEQ ID NO: 2339869 - RNA, 14 nt, Bordetella pertussis
cagcgaggacacgc

SEQ ID NO: 2339870 - RNA, 17 nt, Bordetella pertussis
cagcgaggacacgcagc

SEQ ID NO: 2339871 - RNA, 19 nt, Bordetella pertussis
cagcgaggccucgugcugc

SEQ ID NO: 2339872 - RNA, 16 nt, Bordetella pertussis
cagcgaggcgcagcgc

SEQ ID NO: 2339873 - RNA, 19 nt, Bordetella pertussis
cagcgaggcggcaagcggc

SEQ ID NO: 2339874 - RNA, 15 nt, Bordetella pertussis
cagcgagguggugac

SEQ ID NO: 2339875 - RNA, 16 nt, Bordetella pertussis
cagcgaguagacgcag

SEQ ID NO: 2339876 - RNA, 18 nt, Bordetella pertussis
cagcgaguagacgcagcc

SEQ ID NO: 2339877 - RNA, 21 nt, Bordetella pertussis
cagcgaguagacgcagccgca

SEQ ID NO: 2339878 - RNA, 20 nt, Bordetella pertussis
cagcgagucgaccaguucgg

SEQ ID NO: 2339879 - RNA, 23 nt, Bordetella pertussis
cagcgagucgaccaguucggcca

SEQ ID NO: 2339880 - RNA, 19 nt, Bordetella pertussis
cagcgaguuguccuggccg

SEQ ID NO: 2339881 - RNA, 20 nt, Bordetella pertussis
cagcgaguuguccuggccgg

SEQ ID NO: 2339882 - RNA, 16 nt, Bordetella pertussis
cagcgcaaacgggggc

SEQ ID NO: 2339883 - RNA, 19 nt, Bordetella pertussis
cagcgcaaggguuguggcc

SEQ ID NO: 2339884 - RNA, 20 nt, Bordetella pertussis
cagcgcaccaccaccaugug

SEQ ID NO: 2339885 - RNA, 21 nt, Bordetella pertussis
cagcgcaccaccaccaugugc

SEQ ID NO: 2339886 - RNA, 23 nt, Bordetella pertussis
cagcgcaccaccaccaugugcuu

SEQ ID NO: 2339887 - RNA, 17 nt, Bordetella pertussis
cagcgcaccaccagcac

SEQ ID NO: 2339888 - RNA, 19 nt, Bordetella pertussis
cagcgcaccaccagcaccg

SEQ ID NO: 2339889 - RNA, 16 nt, Bordetella pertussis
cagcgcaccgacggca

SEQ ID NO: 2339890 - RNA, 21 nt, Bordetella pertussis
cagcgcacgauugucgucgcg

SEQ ID NO: 2339891 - RNA, 15 nt, Bordetella pertussis
cagcgcacgcagcgc

SEQ ID NO: 2339892 - RNA, 19 nt, Bordetella pertussis
cagcgcacgguccaggcgg

SEQ ID NO: 2339893 - RNA, 23 nt, Bordetella pertussis
cagcgcacgguccaggcggccgc

SEQ ID NO: 2339894 - RNA, 16 nt, Bordetella pertussis
cagcgcacugaucgcc

SEQ ID NO: 2339895 - RNA, 21 nt, Bordetella pertussis
cagcgcacugaucgccgccuu

SEQ ID NO: 2339896 - RNA, 14 nt, Bordetella pertussis
cagcugggcggcgu

SEQ ID NO: 2339897 - RNA, 20 nt, Bordetella pertussis
cagcuggugccgguugcgcg

SEQ ID NO: 2339898 - RNA, 21 nt, Bordetella pertussis
cagcuguaccgguagcccgcg

SEQ ID NO: 2339899 - RNA, 16 nt, Bordetella pertussis
cagcuguagcccuggc

SEQ ID NO: 2339900 - RNA, 16 nt, Bordetella pertussis
cagcuguucagacugc

SEQ ID NO: 2339901 - RNA, 23 nt, Bordetella pertussis
cagcuguucagacugcugccgga

SEQ ID NO: 2339902 - RNA, 14 nt, Bordetella pertussis
cagcuucagccugg

SEQ ID NO: 2339903 - RNA, 18 nt, Bordetella pertussis
cagcuucagccugggccu

SEQ ID NO: 2339904 - RNA, 19 nt, Bordetella pertussis
cagcuucagccugggccug

SEQ ID NO: 2339905 - RNA, 15 nt, Bordetella pertussis
cagcuuccagaucga

SEQ ID NO: 2339906 - RNA, 14 nt, Bordetella pertussis
cagcuucuaucugc

SEQ ID NO: 2339907 - RNA, 19 nt, Bordetella pertussis
cagcuucuaucugccgcgc

SEQ ID NO: 2339908 - RNA, 15 nt, Bordetella pertussis
cagcuucuccaugcg

SEQ ID NO: 2339909 - RNA, 17 nt, Bordetella pertussis
cagcuucugcgccugcu

SEQ ID NO: 2339910 - RNA, 23 nt, Bordetella pertussis
cagcuucuucuuugcccuggcca

SEQ ID NO: 2339911 - RNA, 20 nt, Bordetella pertussis
cagcuucuugaacucggcca

SEQ ID NO: 2339912 - RNA, 23 nt, Bordetella pertussis
cagcuucuugaacucggccagca

SEQ ID NO: 2339913 - RNA, 20 nt, Bordetella pertussis
cagcuugaccgccagcaucc

SEQ ID NO: 2339914 - RNA, 16 nt, Bordetella pertussis
cagcuugaccgccucc

SEQ ID NO: 2339915 - RNA, 18 nt, Bordetella pertussis
cagcuugaccuugagcac

SEQ ID NO: 2339916 - RNA, 21 nt, Bordetella pertussis
cagcuugaccuugagcacgcu

SEQ ID NO: 2339917 - RNA, 18 nt, Bordetella pertussis
cagcuugacguccagcca

SEQ ID NO: 2339918 - RNA, 22 nt, Bordetella pertussis
cagcuugacguccagccagggu

SEQ ID NO: 2339919 - RNA, 17 nt, Bordetella pertussis
cagcuugaugccggcgu

SEQ ID NO: 2339920 - RNA, 20 nt, Bordetella pertussis
cagcuugaugccggcguucu

SEQ ID NO: 2339921 - RNA, 14 nt, Bordetella pertussis
cagcuugaugggcg

SEQ ID NO: 2339922 - RNA, 20 nt, Bordetella pertussis
cagcuugaugggcgaggcga

SEQ ID NO: 2339923 - RNA, 13 nt, Bordetella pertussis
cagcuugcccacg

SEQ ID NO: 2339924 - RNA, 18 nt, Bordetella pertussis
cagcuugcccacgcgcuc

SEQ ID NO: 2339925 - RNA, 13 nt, Bordetella pertussis
cagcuugcccgcg

SEQ ID NO: 2339926 - RNA, 17 nt, Bordetella pertussis
cagcuugcccgcgcgca

SEQ ID NO: 2339927 - RNA, 13 nt, Bordetella pertussis
cagcuugcccggc

SEQ ID NO: 2339928 - RNA, 16 nt, Bordetella pertussis
cagcuugcccggcgug

SEQ ID NO: 2339929 - RNA, 16 nt, Bordetella pertussis
cagcuugccgcccagg

SEQ ID NO: 2339930 - RNA, 12 nt, Bordetella pertussis
cagcuugccgcu

SEQ ID NO: 2339931 - RNA, 15 nt, Bordetella pertussis
cagcuugcgcgcccc

SEQ ID NO: 2339932 - RNA, 16 nt, Bordetella pertussis
cagcuugcgcgccgca

SEQ ID NO: 2339933 - RNA, 17 nt, Bordetella pertussis
cagcuugcgcgccuugg

SEQ ID NO: 2339934 - RNA, 16 nt, Bordetella pertussis
cagcuugcgcuggcgc

SEQ ID NO: 2339935 - RNA, 18 nt, Bordetella pertussis
cagcuugcgcuggcgcgc

SEQ ID NO: 2339936 - RNA, 22 nt, Bordetella pertussis
cagcuugcgcuggcgcgcggcc

SEQ ID NO: 2339937 - RNA, 15 nt, Bordetella pertussis
cagcuugcgucccac

SEQ ID NO: 2339938 - RNA, 17 nt, Bordetella pertussis
cagcuuggacagcgcgu

SEQ ID NO: 2339939 - RNA, 23 nt, Bordetella pertussis
cagcuuggccaccacgcccaucu

SEQ ID NO: 2339940 - RNA, 14 nt, Bordetella pertussis
cagcuuggccaggc

SEQ ID NO: 2339941 - RNA, 17 nt, Bordetella pertussis
cagcuuggccaggcugu

SEQ ID NO: 2339942 - RNA, 16 nt, Bordetella pertussis
cagcuuggccugcgga

SEQ ID NO: 2339943 - RNA, 21 nt, Bordetella pertussis
cagcuuggccugcggaugcag

SEQ ID NO: 2339944 - RNA, 14 nt, Bordetella pertussis
cagcuuggcgcgcc

SEQ ID NO: 2339945 - RNA, 16 nt, Bordetella pertussis
cagcuuggcgcgccgg

SEQ ID NO: 2339946 - RNA, 16 nt, Bordetella pertussis
cagcuuggcgcgcgga

SEQ ID NO: 2339947 - RNA, 19 nt, Bordetella pertussis
cagcuuggcguacggcugc

SEQ ID NO: 2339948 - RNA, 21 nt, Bordetella pertussis
cagcuuggcguacggcugcac

SEQ ID NO: 2339949 - RNA, 18 nt, Bordetella pertussis
cagcuugggcauuuccca

SEQ ID NO: 2339950 - RNA, 23 nt, Bordetella pertussis
cagcuugggcauuucccagccgu

SEQ ID NO: 2339951 - RNA, 16 nt, Bordetella pertussis
cagcuugucgaccacc

SEQ ID NO: 2339952 - RNA, 23 nt, Bordetella pertussis
cagcuugucgaccaccggcuugg

SEQ ID NO: 2339953 - RNA, 19 nt, Bordetella pertussis
cagcuugucgaucgccacc

SEQ ID NO: 2339954 - RNA, 22 nt, Bordetella pertussis
cagcuugucgaucgccaccagc

SEQ ID NO: 2339955 - RNA, 16 nt, Bordetella pertussis
cagcuugucggccgcg

SEQ ID NO: 2339956 - RNA, 20 nt, Bordetella pertussis
cagcuugucggccgcgcgca

SEQ ID NO: 2339957 - RNA, 19 nt, Bordetella pertussis
caggaaaaccggcgccugg

SEQ ID NO: 2339958 - RNA, 19 nt, Bordetella pertussis
caggaaaaccuccuccgcg

SEQ ID NO: 2339959 - RNA, 14 nt, Bordetella pertussis
caggaaaagcaggc

SEQ ID NO: 2339960 - RNA, 18 nt, Bordetella pertussis
caggaaaccggcgaccac

SEQ ID NO: 2339961 - RNA, 16 nt, Bordetella pertussis
caggaaagaggccagg

SEQ ID NO: 2339962 - RNA, 17 nt, Bordetella pertussis
caggaaagaggccaggc

SEQ ID NO: 2339963 - RNA, 19 nt, Bordetella pertussis
caggaaagaggccaggccc

SEQ ID NO: 2339964 - RNA, 15 nt, Bordetella pertussis
caggaaagccggcgu

SEQ ID NO: 2339965 - RNA, 16 nt, Bordetella pertussis
caggaaagcgccgccg

SEQ ID NO: 2339966 - RNA, 14 nt, Bordetella pertussis
caggaacaccaccu

SEQ ID NO: 2339967 - RNA, 18 nt, Bordetella pertussis
caggaacagccugcccuc

SEQ ID NO: 2339968 - RNA, 23 nt, Bordetella pertussis
caggaacagccugcccucgggcg

SEQ ID NO: 2339969 - RNA, 14 nt, Bordetella pertussis
caggaacaggccgg

SEQ ID NO: 2339970 - RNA, 19 nt, Bordetella pertussis
caggaacauguccaccagc

SEQ ID NO: 2339971 - RNA, 21 nt, Bordetella pertussis
caggaacauguccaccagccg

SEQ ID NO: 2339972 - RNA, 23 nt, Bordetella pertussis
caggaacauguccaccagccggc

SEQ ID NO: 2339973 - RNA, 24 nt, Bordetella pertussis
caggaacauguccaccagccggcc

SEQ ID NO: 2339974 - RNA, 20 nt, Bordetella pertussis
caggaacauguucacgccca

SEQ ID NO: 2339975 - RNA, 23 nt, Bordetella pertussis
caggaacauguucacgcccagga

SEQ ID NO: 2339976 - RNA, 16 nt, Bordetella pertussis
caggaaccagcggcug

SEQ ID NO: 2339977 - RNA, 19 nt, Bordetella pertussis
caggaaccagcggcuggcg

SEQ ID NO: 2339978 - RNA, 13 nt, Bordetella pertussis
caggaacgccagc

SEQ ID NO: 2339979 - RNA, 15 nt, Bordetella pertussis
caggaacgccagcag

SEQ ID NO: 2339980 - RNA, 17 nt, Bordetella pertussis
caggaacgccagcagca

SEQ ID NO: 2339981 - RNA, 19 nt, Bordetella pertussis
caggaacgccagcagcacc

SEQ ID NO: 2339982 - RNA, 16 nt, Bordetella pertussis
caggaacggcauggca

SEQ ID NO: 2339983 - RNA, 16 nt, Bordetella pertussis
caggaacucagcgcac

SEQ ID NO: 2339984 - RNA, 18 nt, Bordetella pertussis
caggaacucagcgcacug

SEQ ID NO: 2339985 - RNA, 15 nt, Bordetella pertussis
caggaagaacgagaa

SEQ ID NO: 2339986 - RNA, 19 nt, Bordetella pertussis
caggaagacuuccgugcca

SEQ ID NO: 2339987 - RNA, 17 nt, Bordetella pertussis
caggaagagcuggcgcu

SEQ ID NO: 2339988 - RNA, 18 nt, Bordetella pertussis
caggaagaucggcccggc

SEQ ID NO: 2339989 - RNA, 16 nt, Bordetella pertussis
caggaagcagcccagc

SEQ ID NO: 2339990 - RNA, 15 nt, Bordetella pertussis
caggaagccggcccg

SEQ ID NO: 2339991 - RNA, 13 nt, Bordetella pertussis
caggaagcgcgcc

SEQ ID NO: 2339992 - RNA, 14 nt, Bordetella pertussis
caggaagcgcgccg

SEQ ID NO: 2339993 - RNA, 16 nt, Bordetella pertussis
caggaagcgcgccgcg

SEQ ID NO: 2339994 - RNA, 15 nt, Bordetella pertussis
caggaagcgcuggcc

SEQ ID NO: 2339995 - RNA, 22 nt, Bordetella pertussis
caggaagcgcuggcccgucaug

SEQ ID NO: 2339996 - RNA, 17 nt, Bordetella pertussis
caggaagcggcgcacca

SEQ ID NO: 2339997 - RNA, 14 nt, Bordetella pertussis
caggaaggcccggu

SEQ ID NO: 2339998 - RNA, 21 nt, Bordetella pertussis
caggaaggcgaaaccggugau

SEQ ID NO: 2339999 - RNA, 18 nt, Bordetella pertussis
caggaaggcgagcgcggc

SEQ ID NO: 2340000 - RNA, 20 nt, Bordetella pertussis
caggaaguccugguuggccu

SEQ ID NO: 2340001 - RNA, 20 nt, Bordetella pertussis
caggaaguccuucagccgcu

SEQ ID NO: 2340002 - RNA, 15 nt, Bordetella pertussis
caggaagucggucag

SEQ ID NO: 2340003 - RNA, 14 nt, Bordetella pertussis
caggaaguucaggg

SEQ ID NO: 2340004 - RNA, 15 nt, Bordetella pertussis
caggacaaggcgcgc

SEQ ID NO: 2340005 - RNA, 16 nt, Bordetella pertussis
caggacaaggcgcgcg

SEQ ID NO: 2340006 - RNA, 14 nt, Bordetella pertussis
caggaccaggauga

SEQ ID NO: 2340007 - RNA, 22 nt, Bordetella pertussis
caggaccaggaugaugcagcac

SEQ ID NO: 2340008 - RNA, 17 nt, Bordetella pertussis
caggaccguccgcgacg

SEQ ID NO: 2340009 - RNA, 20 nt, Bordetella pertussis
caggaccuguacuggcuggu

SEQ ID NO: 2340010 - RNA, 15 nt, Bordetella pertussis
caggacgacaggcau

SEQ ID NO: 2340011 - RNA, 13 nt, Bordetella pertussis
cagcgucccagcc

SEQ ID NO: 2340012 - RNA, 14 nt, Bordetella pertussis
cagcgucgagcuga

SEQ ID NO: 2340013 - RNA, 17 nt, Bordetella pertussis
cagcgucgagcugacga

SEQ ID NO: 2340014 - RNA, 22 nt, Bordetella pertussis
cagcgucggcguaaggccgccg

SEQ ID NO: 2340015 - RNA, 19 nt, Bordetella pertussis
cagcgucucgaucacgugg

SEQ ID NO: 2340016 - RNA, 13 nt, Bordetella pertussis
cagcgucugcugg

SEQ ID NO: 2340017 - RNA, 19 nt, Bordetella pertussis
cagcgucugcugguacagc

SEQ ID NO: 2340018 - RNA, 22 nt, Bordetella pertussis
cagcgucugcugguacagcccc

SEQ ID NO: 2340019 - RNA, 22 nt, Bordetella pertussis
cagcgucuggcacgcuugccgc

SEQ ID NO: 2340020 - RNA, 13 nt, Bordetella pertussis
cagcgugaccgac

SEQ ID NO: 2340021 - RNA, 17 nt, Bordetella pertussis
cagcgugaccgacaggc

SEQ ID NO: 2340022 - RNA, 21 nt, Bordetella pertussis
cagcgugaccgacaggccugg

SEQ ID NO: 2340023 - RNA, 23 nt, Bordetella pertussis
cagcgugaccgacaggccuggcu

SEQ ID NO: 2340024 - RNA, 23 nt, Bordetella pertussis
cagcgugacggcggcgcgcggau

SEQ ID NO: 2340025 - RNA, 20 nt, Bordetella pertussis
cagcgugaugcggucggcca

SEQ ID NO: 2340026 - RNA, 14 nt, Bordetella pertussis
cagcgugcccagcg

SEQ ID NO: 2340027 - RNA, 15 nt, Bordetella pertussis
cagcgugcccagcga

SEQ ID NO: 2340028 - RNA, 16 nt, Bordetella pertussis
cagcgugccgccggcg

SEQ ID NO: 2340029 - RNA, 17 nt, Bordetella pertussis
cagcgugccgccggcgc

SEQ ID NO: 2340030 - RNA, 20 nt, Bordetella pertussis
cagcgugccggugacgacgc

SEQ ID NO: 2340031 - RNA, 13 nt, Bordetella pertussis
cagcgugcgcccc

SEQ ID NO: 2340032 - RNA, 16 nt, Bordetella pertussis
cagcgugcgccccgcc

SEQ ID NO: 2340033 - RNA, 14 nt, Bordetella pertussis
cagcgugcggucgu

SEQ ID NO: 2340034 - RNA, 22 nt, Bordetella pertussis
cagcgugcugcguaucugaucg

SEQ ID NO: 2340035 - RNA, 15 nt, Bordetella pertussis
caggauggaucccug

SEQ ID NO: 2340036 - RNA, 14 nt, Bordetella pertussis
caggauggccaugc

SEQ ID NO: 2340037 - RNA, 13 nt, Bordetella pertussis
caggauggcgcca

SEQ ID NO: 2340038 - RNA, 17 nt, Bordetella pertussis
caggauggcgccagccc

SEQ ID NO: 2340039 - RNA, 21 nt, Bordetella pertussis
caggauggcgucgaccgccau

SEQ ID NO: 2340040 - RNA, 23 nt, Bordetella pertussis
caggaugggcgcggcgcgcgccg

SEQ ID NO: 2340041 - RNA, 21 nt, Bordetella pertussis
caggaugggcgcuuggcccug

SEQ ID NO: 2340042 - RNA, 23 nt, Bordetella pertussis
caggauggggcgguggucaucga

SEQ ID NO: 2340043 - RNA, 14 nt, Bordetella pertussis
caggauuucauggc

SEQ ID NO: 2340044 - RNA, 16 nt, Bordetella pertussis
caggauuucauggcau

SEQ ID NO: 2340045 - RNA, 21 nt, Bordetella pertussis
caggauuucauggcaucggcu

SEQ ID NO: 2340046 - RNA, 16 nt, Bordetella pertussis
caggauuuccucgccg

SEQ ID NO: 2340047 - RNA, 17 nt, Bordetella pertussis
caggcaaaggcccaggc

SEQ ID NO: 2340048 - RNA, 18 nt, Bordetella pertussis
caggcaaaggcccaggca

SEQ ID NO: 2340049 - RNA, 17 nt, Bordetella pertussis
caggcaagcugcuggcg

SEQ ID NO: 2340050 - RNA, 22 nt, Bordetella pertussis
caggcaagcugcuggcgcgcca

SEQ ID NO: 2340051 - RNA, 16 nt, Bordetella pertussis
caggcacaccacgcga

SEQ ID NO: 2340052 - RNA, 22 nt, Bordetella pertussis
caggcacacccuccuacgccau

SEQ ID NO: 2340053 - RNA, 13 nt, Bordetella pertussis
caggcacaccgug

SEQ ID NO: 2340054 - RNA, 15 nt, Bordetella pertussis
caggcacaccgugcc

SEQ ID NO: 2340055 - RNA, 17 nt, Bordetella pertussis
caggcacaccgugccgc

SEQ ID NO: 2340056 - RNA, 20 nt, Bordetella pertussis
caggcacaccgugccgcaga

SEQ ID NO: 2340057 - RNA, 15 nt, Bordetella pertussis
caggcacacgaccgg

SEQ ID NO: 2340058 - RNA, 19 nt, Bordetella pertussis
caggcacacgaccggcuug

SEQ ID NO: 2340059 - RNA, 15 nt, Bordetella pertussis
caggcacaggaacag

SEQ ID NO: 2340060 - RNA, 14 nt, Bordetella pertussis
caggcacauugccg

SEQ ID NO: 2340061 - RNA, 14 nt, Bordetella pertussis
caggcacccagggg

SEQ ID NO: 2340062 - RNA, 14 nt, Bordetella pertussis
caggcaccccagca

SEQ ID NO: 2340063 - RNA, 17 nt, Bordetella pertussis
caggcaccccagcaccc

SEQ ID NO: 2340064 - RNA, 20 nt, Bordetella pertussis
caggcaccccggcgccgcgu

SEQ ID NO: 2340065 - RNA, 21 nt, Bordetella pertussis
caggcaccccgucguccgucc

SEQ ID NO: 2340066 - RNA, 23 nt, Bordetella pertussis
caggcaccccgucguccguccug

SEQ ID NO: 2340067 - RNA, 20 nt, Bordetella pertussis
caggcacccgagggucaggu

SEQ ID NO: 2340068 - RNA, 22 nt, Bordetella pertussis
caggcacccgauggucacacug

SEQ ID NO: 2340069 - RNA, 16 nt, Bordetella pertussis
caggcacccgcgcgca

SEQ ID NO: 2340070 - RNA, 20 nt, Bordetella pertussis
caggcacccugccccauccc

SEQ ID NO: 2340071 - RNA, 22 nt, Bordetella pertussis
caggcacccugucauacgccau

SEQ ID NO: 2340072 - RNA, 23 nt, Bordetella pertussis
caggcacccugucauacgccaug

SEQ ID NO: 2340073 - RNA, 14 nt, Bordetella pertussis
caggcacccuugcc

SEQ ID NO: 2340074 - RNA, 16 nt, Bordetella pertussis
caggcacccuugccgc

SEQ ID NO: 2340075 - RNA, 22 nt, Bordetella pertussis
caggcacccuugccgcagcggg

SEQ ID NO: 2340076 - RNA, 18 nt, Bordetella pertussis
caggcacccuugccgcgg

SEQ ID NO: 2340077 - RNA, 19 nt, Bordetella pertussis
caggcaccgaacccugccu

SEQ ID NO: 2340078 - RNA, 23 nt, Bordetella pertussis
caggcaccgaacgggcguggcgc

SEQ ID NO: 2340079 - RNA, 21 nt, Bordetella pertussis
caggcaccgccgcacagccaa

SEQ ID NO: 2340080 - RNA, 14 nt, Bordetella pertussis
caggcaccugcgac

SEQ ID NO: 2340081 - RNA, 16 nt, Bordetella pertussis
caggcaccugcgaccg

SEQ ID NO: 2340082 - RNA, 14 nt, Bordetella pertussis
caggcaccuuggcc

SEQ ID NO: 2340083 - RNA, 15 nt, Bordetella pertussis
caggcaccuuggccc

SEQ ID NO: 2340084 - RNA, 18 nt, Bordetella pertussis
caggcaccuuggcccggc

SEQ ID NO: 2340085 - RNA, 20 nt, Bordetella pertussis
caggcacgacgcgaaccagg

SEQ ID NO: 2340086 - RNA, 23 nt, Bordetella pertussis
caggcacgacgcgaaccaggcca

SEQ ID NO: 2340087 - RNA, 15 nt, Bordetella pertussis
caggcacgccggggu

SEQ ID NO: 2340088 - RNA, 21 nt, Bordetella pertussis
caggcacgccgggguuggagu

SEQ ID NO: 2340089 - RNA, 14 nt, Bordetella pertussis
caggcacgcgccga

SEQ ID NO: 2340090 - RNA, 22 nt, Bordetella pertussis
caggcacgcgccgacuucagac

SEQ ID NO: 2340091 - RNA, 18 nt, Bordetella pertussis
caggcacucugccguggg

SEQ ID NO: 2340092 - RNA, 18 nt, Bordetella pertussis
caggcagacgaugcccag

SEQ ID NO: 2340093 - RNA, 14 nt, Bordetella pertussis
caggcagauccgcc

SEQ ID NO: 2340094 - RNA, 20 nt, Bordetella pertussis
caggcagcaaccggaacacc

SEQ ID NO: 2340095 - RNA, 21 nt, Bordetella pertussis
caggcagcaaccggaacacca

SEQ ID NO: 2340096 - RNA, 15 nt, Bordetella pertussis
caggcagccggcccc

SEQ ID NO: 2340097 - RNA, 17 nt, Bordetella pertussis
caggcagccggccccgc

SEQ ID NO: 2340098 - RNA, 19 nt, Bordetella pertussis
caggcagccggccccgcaa

SEQ ID NO: 2340099 - RNA, 13 nt, Bordetella pertussis
caggcagcggccg

SEQ ID NO: 2340100 - RNA, 16 nt, Bordetella pertussis
caggcagcggccgcgc

SEQ ID NO: 2340101 - RNA, 17 nt, Bordetella pertussis
caggcaggcgcgccggg

SEQ ID NO: 2340102 - RNA, 15 nt, Bordetella pertussis
caggcaggcgggccc

SEQ ID NO: 2340103 - RNA, 17 nt, Bordetella pertussis
caggcaguacgagcggc

SEQ ID NO: 2340104 - RNA, 22 nt, Bordetella pertussis
caggcagugguggugcagcggc

SEQ ID NO: 2340105 - RNA, 23 nt, Bordetella pertussis
caggcagugguggugcagcggca

SEQ ID NO: 2340106 - RNA, 17 nt, Bordetella pertussis
caggcaguuggcggcgc

SEQ ID NO: 2340107 - RNA, 19 nt, Bordetella pertussis
caggcaguuggcggcgcag

SEQ ID NO: 2340108 - RNA, 23 nt, Bordetella pertussis
caggcaguuggcggcgcagccgc

SEQ ID NO: 2340109 - RNA, 13 nt, Bordetella pertussis
caggcaugcagca

SEQ ID NO: 2340110 - RNA, 20 nt, Bordetella pertussis
caggcauucgaacaacagcg

SEQ ID NO: 2340111 - RNA, 23 nt, Bordetella pertussis
caggcauucgaacaacagcgccu

SEQ ID NO: 2340112 - RNA, 22 nt, Bordetella pertussis
caggcauucgugaugccccagg

SEQ ID NO: 2340113 - RNA, 23 nt, Bordetella pertussis
caggcauucgugaugccccaggu

SEQ ID NO: 2340114 - RNA, 15 nt, Bordetella pertussis
caggcauucucggac

SEQ ID NO: 2340115 - RNA, 18 nt, Bordetella pertussis
caggcauugaagcuggcg

SEQ ID NO: 2340116 - RNA, 20 nt, Bordetella pertussis
caggcauugaagcuggcgcc

SEQ ID NO: 2340117 - RNA, 23 nt, Bordetella pertussis
caggcauugaagcuggcgccggu

SEQ ID NO: 2340118 - RNA, 17 nt, Bordetella pertussis
caggcauugcgccagcc

SEQ ID NO: 2340119 - RNA, 23 nt, Bordetella pertussis
caggccaaaaaaaaccggcaagc

SEQ ID NO: 2340120 - RNA, 20 nt, Bordetella pertussis
caggccaccgacggcgcggc

SEQ ID NO: 2340121 - RNA, 15 nt, Bordetella pertussis
caggccaccgcggcg

SEQ ID NO: 2340122 - RNA, 17 nt, Bordetella pertussis
caggccaccgcggcgga

SEQ ID NO: 2340123 - RNA, 19 nt, Bordetella pertussis
caggccacgaugauggagg

SEQ ID NO: 2340124 - RNA, 13 nt, Bordetella pertussis
caggccagcagcu

SEQ ID NO: 2340125 - RNA, 17 nt, Bordetella pertussis
caggccagcagcucggc

SEQ ID NO: 2340126 - RNA, 22 nt, Bordetella pertussis
caggccagcagcucggccaccg

SEQ ID NO: 2340127 - RNA, 13 nt, Bordetella pertussis
caggccagcaugg

SEQ ID NO: 2340128 - RNA, 17 nt, Bordetella pertussis
caggccagcccgcgcgc

SEQ ID NO: 2340129 - RNA, 12 nt, Bordetella pertussis
caggccagcgac

SEQ ID NO: 2340130 - RNA, 23 nt, Bordetella pertussis
caggccagcgacccgcaaaaccg

SEQ ID NO: 2340131 - RNA, 13 nt, Bordetella pertussis
caggccagcgcca

SEQ ID NO: 2340132 - RNA, 14 nt, Bordetella pertussis
caggccagcgccag

SEQ ID NO: 2340133 - RNA, 15 nt, Bordetella pertussis
caggccagcgccgcg

SEQ ID NO: 2340134 - RNA, 17 nt, Bordetella pertussis
caggccagcgccgcggc

SEQ ID NO: 2340135 - RNA, 21 nt, Bordetella pertussis
caggccagcgccgcggccggc

SEQ ID NO: 2340136 - RNA, 17 nt, Bordetella pertussis
caggccaggaagcggcg

SEQ ID NO: 2340137 - RNA, 18 nt, Bordetella pertussis
caggccaggaagcggcgc

SEQ ID NO: 2340138 - RNA, 16 nt, Bordetella pertussis
caggccaggcucagca

SEQ ID NO: 2340139 - RNA, 17 nt, Bordetella pertussis
caggccagguagucguc

SEQ ID NO: 2340140 - RNA, 21 nt, Bordetella pertussis
caggccagugauggccugcuu

SEQ ID NO: 2340141 - RNA, 22 nt, Bordetella pertussis
caggccagugauggccugcuug

SEQ ID NO: 2340142 - RNA, 13 nt, Bordetella pertussis
caggccagugccu

SEQ ID NO: 2340143 - RNA, 17 nt, Bordetella pertussis
caggccagugccuggac

SEQ ID NO: 2340144 - RNA, 22 nt, Bordetella pertussis
caggccagugccuggacgcgcu

SEQ ID NO: 2340145 - RNA, 15 nt, Bordetella pertussis
caggccaucggcgcc

SEQ ID NO: 2340146 - RNA, 17 nt, Bordetella pertussis
caggccaucggcgccaa

SEQ ID NO: 2340147 - RNA, 20 nt, Bordetella pertussis
caggcccuggcuggccagcc

SEQ ID NO: 2340148 - RNA, 22 nt, Bordetella pertussis
caggcccuggcuggccagccgg

SEQ ID NO: 2340149 - RNA, 24 nt, Bordetella pertussis
caggcccuggcuggccagccggcc

SEQ ID NO: 2340150 - RNA, 16 nt, Bordetella pertussis
caggcccugggccagc

SEQ ID NO: 2340151 - RNA, 17 nt, Bordetella pertussis
caggcccugggccagca

SEQ ID NO: 2340152 - RNA, 20 nt, Bordetella pertussis
caggcccugggccagcagcu

SEQ ID NO: 2340153 - RNA, 22 nt, Bordetella pertussis
caggcccugggccagcagcugg

SEQ ID NO: 2340154 - RNA, 14 nt, Bordetella pertussis
caggcccuggggcc

SEQ ID NO: 2340155 - RNA, 16 nt, Bordetella pertussis
caggcccuggggccgc

SEQ ID NO: 2340156 - RNA, 19 nt, Bordetella pertussis
caggcccuugaucaggcgc

SEQ ID NO: 2340157 - RNA, 20 nt, Bordetella pertussis
caggcccuugauggccgggc

SEQ ID NO: 2340158 - RNA, 22 nt, Bordetella pertussis
caggcccuugauggccgggccg

SEQ ID NO: 2340159 - RNA, 20 nt, Bordetella pertussis
caggccgaaauggcggcggu

SEQ ID NO: 2340160 - RNA, 23 nt, Bordetella pertussis
caggccgaaauggcggcgguagc

SEQ ID NO: 2340161 - RNA, 18 nt, Bordetella pertussis
caggccgaaccacagcau

SEQ ID NO: 2340162 - RNA, 11 nt, Bordetella pertussis
caggccgaacu

SEQ ID NO: 2340163 - RNA, 23 nt, Bordetella pertussis
caggccgaacugggacaggccca

SEQ ID NO: 2340164 - RNA, 18 nt, Bordetella pertussis
caggccgaacuucagccc

SEQ ID NO: 2340165 - RNA, 20 nt, Bordetella pertussis
caggccgagaugugcggcgu

SEQ ID NO: 2340166 - RNA, 19 nt, Bordetella pertussis
caggccgaggaccugcugg

SEQ ID NO: 2340167 - RNA, 16 nt, Bordetella pertussis
caggccgaggcugcgc

SEQ ID NO: 2340168 - RNA, 19 nt, Bordetella pertussis
caggccgaggcugcgcgcg

SEQ ID NO: 2340169 - RNA, 18 nt, Bordetella pertussis
caggccgauauugcggua

SEQ ID NO: 2340170 - RNA, 20 nt, Bordetella pertussis
caggccgaucagcaccacgg

SEQ ID NO: 2340171 - RNA, 23 nt, Bordetella pertussis
caggccgaucagcaccacggcgg

SEQ ID NO: 2340172 - RNA, 21 nt, Bordetella pertussis
caggccgaucagcgacagcag

SEQ ID NO: 2340173 - RNA, 23 nt, Bordetella pertussis
caggccgaucagcgacagcaggg

SEQ ID NO: 2340174 - RNA, 22 nt, Bordetella pertussis
caggccgaucagcggauugacc

SEQ ID NO: 2340175 - RNA, 15 nt, Bordetella pertussis
caggccgaugccgaa

SEQ ID NO: 2340176 - RNA, 12 nt, Bordetella pertussis
caggccgaugcu

SEQ ID NO: 2340177 - RNA, 15 nt, Bordetella pertussis
caggccgaugcuggu

SEQ ID NO: 2340178 - RNA, 18 nt, Bordetella pertussis
caggccgaugcuggucgc

SEQ ID NO: 2340179 - RNA, 23 nt, Bordetella pertussis
caggccgauggcguccagcagca

SEQ ID NO: 2340180 - RNA, 16 nt, Bordetella pertussis
caggccgauguagccc

SEQ ID NO: 2340181 - RNA, 23 nt, Bordetella pertussis
caggccgauguagcccauggcca

SEQ ID NO: 2340182 - RNA, 14 nt, Bordetella pertussis
caggccgauuucgg

SEQ ID NO: 2340183 - RNA, 21 nt, Bordetella pertussis
caggccgauuucggccgccgg

SEQ ID NO: 2340184 - RNA, 17 nt, Bordetella pertussis
caggccgcagcgggccc

SEQ ID NO: 2340185 - RNA, 20 nt, Bordetella pertussis
caggccgcagcgggcccguc

SEQ ID NO: 2340186 - RNA, 22 nt, Bordetella pertussis
caggccgcauacgacacgucau

SEQ ID NO: 2340187 - RNA, 18 nt, Bordetella pertussis
caggccgccacuugcggc

SEQ ID NO: 2340188 - RNA, 15 nt, Bordetella pertussis
caggccgccagggcc

SEQ ID NO: 2340189 - RNA, 16 nt, Bordetella pertussis
caggccgccagggccg

SEQ ID NO: 2340190 - RNA, 14 nt, Bordetella pertussis
caggccgcccagcc

SEQ ID NO: 2340191 - RNA, 17 nt, Bordetella pertussis
caggccgccccaacggc

SEQ ID NO: 2340192 - RNA, 21 nt, Bordetella pertussis
caggccgccccaacggccuuc

SEQ ID NO: 2340193 - RNA, 22 nt, Bordetella pertussis
caggccgccccaacggccuucg

SEQ ID NO: 2340194 - RNA, 22 nt, Bordetella pertussis
caggccgccgccggucaccgcc

SEQ ID NO: 2340195 - RNA, 12 nt, Bordetella pertussis
caggccgccggc

SEQ ID NO: 2340196 - RNA, 14 nt, Bordetella pertussis
caggccgccggcca

SEQ ID NO: 2340197 - RNA, 19 nt, Bordetella pertussis
caggccgccggccagcgcc

SEQ ID NO: 2340198 - RNA, 20 nt, Bordetella pertussis
caggccgccggccagcgcgg

SEQ ID NO: 2340199 - RNA, 15 nt, Bordetella pertussis
caggccgccggcgcg

SEQ ID NO: 2340200 - RNA, 15 nt, Bordetella pertussis
caggccgccggcggc

SEQ ID NO: 2340201 - RNA, 15 nt, Bordetella pertussis
caggccgccggucac

SEQ ID NO: 2340202 - RNA, 20 nt, Bordetella pertussis
caggccgccggucacugccg

SEQ ID NO: 2340203 - RNA, 21 nt, Bordetella pertussis
caggccgccguacgaguggcc

SEQ ID NO: 2340204 - RNA, 18 nt, Bordetella pertussis
caggccgccguguaggcg

SEQ ID NO: 2340205 - RNA, 20 nt, Bordetella pertussis
caggccgccuauguaggcgc

SEQ ID NO: 2340206 - RNA, 14 nt, Bordetella pertussis
caggccgcgcagca

SEQ ID NO: 2340207 - RNA, 20 nt, Bordetella pertussis
caggccgcgcagcacgcccg

SEQ ID NO: 2340208 - RNA, 16 nt, Bordetella pertussis
caggccgcgcagggca

SEQ ID NO: 2340209 - RNA, 14 nt, Bordetella pertussis
caggccgcgccaca

SEQ ID NO: 2340210 - RNA, 16 nt, Bordetella pertussis
caggccgcgccacagg

SEQ ID NO: 2340211 - RNA, 17 nt, Bordetella pertussis
caggccgcgccggcucc

SEQ ID NO: 2340212 - RNA, 22 nt, Bordetella pertussis
caggccgcgcgcauccaggugc

SEQ ID NO: 2340213 - RNA, 17 nt, Bordetella pertussis
caggccgcgcgugcggg

SEQ ID NO: 2340214 - RNA, 14 nt, Bordetella pertussis
caggccgcgcugcc

SEQ ID NO: 2340215 - RNA, 17 nt, Bordetella pertussis
caggccgcgcugccagc

SEQ ID NO: 2340216 - RNA, 18 nt, Bordetella pertussis
caggccgcgcugccagcc

SEQ ID NO: 2340217 - RNA, 22 nt, Bordetella pertussis
caggccgcgcuggugcuggccg

SEQ ID NO: 2340218 - RNA, 13 nt, Bordetella pertussis
caggccgcggcca

SEQ ID NO: 2340219 - RNA, 18 nt, Bordetella pertussis
caggccgcggccaggccc

SEQ ID NO: 2340220 - RNA, 19 nt, Bordetella pertussis
caggccgcggccaggccca

SEQ ID NO: 2340221 - RNA, 14 nt, Bordetella pertussis
caggccgcggcgcc

SEQ ID NO: 2340222 - RNA, 13 nt, Bordetella pertussis
caggccgcugggc

SEQ ID NO: 2340223 - RNA, 23 nt, Bordetella pertussis
caggccgcuucgaugcuggcggc

SEQ ID NO: 2340224 - RNA, 20 nt, Bordetella pertussis
caggccgcuuucgaccagcg

SEQ ID NO: 2340225 - RNA, 18 nt, Bordetella pertussis
caggccggaaaugccgcg

SEQ ID NO: 2340226 - RNA, 16 nt, Bordetella pertussis
caggccggaccuugcg

SEQ ID NO: 2340227 - RNA, 13 nt, Bordetella pertussis
caggccggcaugc

SEQ ID NO: 2340228 - RNA, 15 nt, Bordetella pertussis
caggccggcaugcgc

SEQ ID NO: 2340229 - RNA, 19 nt, Bordetella pertussis
caggccggcaugcgccggc

SEQ ID NO: 2340230 - RNA, 20 nt, Bordetella pertussis
caggccggcaugcgccggcc

SEQ ID NO: 2340231 - RNA, 17 nt, Bordetella pertussis
caggccggccagcaagg

SEQ ID NO: 2340232 - RNA, 19 nt, Bordetella pertussis
caggccggccagcaagggg

SEQ ID NO: 2340233 - RNA, 18 nt, Bordetella pertussis
caggccggccagggccac

SEQ ID NO: 2340234 - RNA, 16 nt, Bordetella pertussis
caggccggccugggga

SEQ ID NO: 2340235 - RNA, 12 nt, Bordetella pertussis
caggccggccuu

SEQ ID NO: 2340236 - RNA, 16 nt, Bordetella pertussis
caggccggccuuggcc

SEQ ID NO: 2340237 - RNA, 13 nt, Bordetella pertussis
caggccggcgcca

SEQ ID NO: 2340238 - RNA, 15 nt, Bordetella pertussis
caggccggcgccagc

SEQ ID NO: 2340239 - RNA, 18 nt, Bordetella pertussis
caggccggcgccagccgc

SEQ ID NO: 2340240 - RNA, 17 nt, Bordetella pertussis
caggccggcgccugggg

SEQ ID NO: 2340241 - RNA, 14 nt, Bordetella pertussis
caggccggcgcgca

SEQ ID NO: 2340242 - RNA, 16 nt, Bordetella pertussis
caggccggcgcgcauc

SEQ ID NO: 2340243 - RNA, 19 nt, Bordetella pertussis
caggccggcgcgccggccc

SEQ ID NO: 2340244 - RNA, 20 nt, Bordetella pertussis
caggccggcgcgccggccca

SEQ ID NO: 2340245 - RNA, 14 nt, Bordetella pertussis
caggccggcgcgcg

SEQ ID NO: 2340246 - RNA, 15 nt, Bordetella pertussis
caggccggcgcgcgc

SEQ ID NO: 2340247 - RNA, 12 nt, Bordetella pertussis
caggccggcggc

SEQ ID NO: 2340248 - RNA, 16 nt, Bordetella pertussis
caggccggcggccagc

SEQ ID NO: 2340249 - RNA, 17 nt, Bordetella pertussis
caggccggcggccagcg

SEQ ID NO: 2340250 - RNA, 16 nt, Bordetella pertussis
caggccggcggcgagc

SEQ ID NO: 2340251 - RNA, 17 nt, Bordetella pertussis
caggccggcggcgauca

SEQ ID NO: 2340252 - RNA, 15 nt, Bordetella pertussis
caggccggcggcggg

SEQ ID NO: 2340253 - RNA, 20 nt, Bordetella pertussis
caggccggggaaacggccaa

SEQ ID NO: 2340254 - RNA, 18 nt, Bordetella pertussis
caggccggggccgcccag

SEQ ID NO: 2340255 - RNA, 23 nt, Bordetella pertussis
caggccggggccgcccagcaccu

SEQ ID NO: 2340256 - RNA, 20 nt, Bordetella pertussis
caggccgguggaccagggca

SEQ ID NO: 2340257 - RNA, 20 nt, Bordetella pertussis
caggccgucgagccgggcgc

SEQ ID NO: 2340258 - RNA, 21 nt, Bordetella pertussis
caggccgucgagccgggcgcc

SEQ ID NO: 2340259 - RNA, 22 nt, Bordetella pertussis
caggccgucgagccgggcgccg

SEQ ID NO: 2340260 - RNA, 17 nt, Bordetella pertussis
caggccgucggccaggg

SEQ ID NO: 2340261 - RNA, 18 nt, Bordetella pertussis
caggccgucggccagggg

SEQ ID NO: 2340262 - RNA, 20 nt, Bordetella pertussis
caggccgucggccaggggca

SEQ ID NO: 2340263 - RNA, 16 nt, Bordetella pertussis
caggccgugagcgccg

SEQ ID NO: 2340264 - RNA, 20 nt, Bordetella pertussis
caggccguggcccagccgca

SEQ ID NO: 2340265 - RNA, 17 nt, Bordetella pertussis
caggccguggcgcacca

SEQ ID NO: 2340266 - RNA, 23 nt, Bordetella pertussis
caggccguuccaguccagcgucg

SEQ ID NO: 2340267 - RNA, 23 nt, Bordetella pertussis
caggccguugccgcuguggcgcg

SEQ ID NO: 2340268 - RNA, 16 nt, Bordetella pertussis
caggccguuggcgcgc

SEQ ID NO: 2340269 - RNA, 23 nt, Bordetella pertussis
caggccguuguccuggcgcgcca

SEQ ID NO: 2340270 - RNA, 21 nt, Bordetella pertussis
caggccguuuacuccccagac

SEQ ID NO: 2340271 - RNA, 24 nt, Bordetella pertussis
caggccguuuacuccccagacgca

SEQ ID NO: 2340272 - RNA, 14 nt, Bordetella pertussis
caggccucgcccga

SEQ ID NO: 2340273 - RNA, 21 nt, Bordetella pertussis
caggccucgcccgaucggccg

SEQ ID NO: 2340274 - RNA, 20 nt, Bordetella pertussis
caggccucggcuccgccauu

SEQ ID NO: 2340275 - RNA, 16 nt, Bordetella pertussis
caggccucggucgccu

SEQ ID NO: 2340276 - RNA, 24 nt, Bordetella pertussis
caggccugcacgucccagucgccg

SEQ ID NO: 2340277 - RNA, 16 nt, Bordetella pertussis
caggccugcggcgcca

SEQ ID NO: 2340278 - RNA, 18 nt, Bordetella pertussis
caggccugcggcgccagc

SEQ ID NO: 2340279 - RNA, 19 nt, Bordetella pertussis
caggccugcggcgccagcg

SEQ ID NO: 2340280 - RNA, 21 nt, Bordetella pertussis
caggccugcggcgccagcgcc

SEQ ID NO: 2340281 - RNA, 22 nt, Bordetella pertussis
caggccugcggcgccagcgccg

SEQ ID NO: 2340282 - RNA, 23 nt, Bordetella pertussis
caggccugcggcgccagcgccgc

SEQ ID NO: 2340283 - RNA, 21 nt, Bordetella pertussis
caggccugcgggugcgccugc

SEQ ID NO: 2340284 - RNA, 22 nt, Bordetella pertussis
caggccugcugcagcgugaugg

SEQ ID NO: 2340285 - RNA, 20 nt, Bordetella pertussis
caggccuggcuuggcggcca

SEQ ID NO: 2340286 - RNA, 14 nt, Bordetella pertussis
caggccugggaacg

SEQ ID NO: 2340287 - RNA, 13 nt, Bordetella pertussis
caggccuggucga

SEQ ID NO: 2340288 - RNA, 16 nt, Bordetella pertussis
caggccuggucgagcg

SEQ ID NO: 2340289 - RNA, 20 nt, Bordetella pertussis
caggccuggucgagcgggcg

SEQ ID NO: 2340290 - RNA, 23 nt, Bordetella pertussis
caggccuggucgagcgggcgcca

SEQ ID NO: 2340291 - RNA, 16 nt, Bordetella pertussis
caggccuguucggccg

SEQ ID NO: 2340292 - RNA, 20 nt, Bordetella pertussis
caggccuguucggccgggac

SEQ ID NO: 2340293 - RNA, 22 nt, Bordetella pertussis
caggccuucgacguccagcccg

SEQ ID NO: 2340294 - RNA, 22 nt, Bordetella pertussis
caggccuucguaaacaucgcgc

SEQ ID NO: 2340295 - RNA, 19 nt, Bordetella pertussis
caggcgaaacgccagcccg

SEQ ID NO: 2340296 - RNA, 20 nt, Bordetella pertussis
caggcgaauccgcaacccag

SEQ ID NO: 2340297 - RNA, 23 nt, Bordetella pertussis
caggcgaauccgcaacccagcag

SEQ ID NO: 2340298 - RNA, 17 nt, Bordetella pertussis
caggcgacccagcaccg

SEQ ID NO: 2340299 - RNA, 13 nt, Bordetella pertussis
caggcgagcgccg

SEQ ID NO: 2340300 - RNA, 15 nt, Bordetella pertussis
caggcgagcgcggcg

SEQ ID NO: 2340301 - RNA, 16 nt, Bordetella pertussis
caggcgagcggcgucg

SEQ ID NO: 2340302 - RNA, 19 nt, Bordetella pertussis
caggcgaggcuggcgccca

SEQ ID NO: 2340303 - RNA, 21 nt, Bordetella pertussis
caggcgauccugcccaccgcc

SEQ ID NO: 2340304 - RNA, 22 nt, Bordetella pertussis
caggcgauccugcccaccgccg

SEQ ID NO: 2340305 - RNA, 13 nt, Bordetella pertussis
caggcgaugccca

SEQ ID NO: 2340306 - RNA, 21 nt, Bordetella pertussis
caggcgauggccgggagcggc

SEQ ID NO: 2340307 - RNA, 16 nt, Bordetella pertussis
caggcgcaccagcgcg

SEQ ID NO: 2340308 - RNA, 13 nt, Bordetella pertussis
caggcgcacgccg

SEQ ID NO: 2340309 - RNA, 14 nt, Bordetella pertussis
caggcgcacggcgg

SEQ ID NO: 2340310 - RNA, 15 nt, Bordetella pertussis
caggcgcacggcggc

SEQ ID NO: 2340311 - RNA, 16 nt, Bordetella pertussis
caggcgcacggcggca

SEQ ID NO: 2340312 - RNA, 23 nt, Bordetella pertussis
caggcgcagcccacucagggcgg

SEQ ID NO: 2340313 - RNA, 14 nt, Bordetella pertussis
caggcgcagccgcg

SEQ ID NO: 2340314 - RNA, 15 nt, Bordetella pertussis
caggcgcagccgcgc

SEQ ID NO: 2340315 - RNA, 16 nt, Bordetella pertussis
caggcgcagccgcgcg

SEQ ID NO: 2340316 - RNA, 20 nt, Bordetella pertussis
caggcgcagccgcgcgccuu

SEQ ID NO: 2340317 - RNA, 14 nt, Bordetella pertussis
caggcgcagcggcg

SEQ ID NO: 2340318 - RNA, 16 nt, Bordetella pertussis
caggcgcagcggcggc

SEQ ID NO: 2340319 - RNA, 17 nt, Bordetella pertussis
caggcgcagcucgaccg

SEQ ID NO: 2340320 - RNA, 13 nt, Bordetella pertussis
caggcgcaggccg

SEQ ID NO: 2340321 - RNA, 14 nt, Bordetella pertussis
caggcgcaggccgc

SEQ ID NO: 2340322 - RNA, 18 nt, Bordetella pertussis
caggcgcaggccgcgcgc

SEQ ID NO: 2340323 - RNA, 16 nt, Bordetella pertussis
caggcgcaggcgcgag

SEQ ID NO: 2340324 - RNA, 24 nt, Bordetella pertussis
caggcgcauauggagccaggcggc

SEQ ID NO: 2340325 - RNA, 17 nt, Bordetella pertussis
caggcgcaucgacagcg

SEQ ID NO: 2340326 - RNA, 18 nt, Bordetella pertussis
caggcgcaucgacagcgc

SEQ ID NO: 2340327 - RNA, 21 nt, Bordetella pertussis
caggcgcaucgacagcgcgcc

SEQ ID NO: 2340328 - RNA, 20 nt, Bordetella pertussis
caggcgcauggugagggcca

SEQ ID NO: 2340329 - RNA, 23 nt, Bordetella pertussis
caggcgcauggugagggccacgc

SEQ ID NO: 2340330 - RNA, 22 nt, Bordetella pertussis
caggcgcauguccgccacgccg

SEQ ID NO: 2340331 - RNA, 23 nt, Bordetella pertussis
caggcgcauguccgccacgccgg

SEQ ID NO: 2340332 - RNA, 14 nt, Bordetella pertussis
caggcgccacaggg

SEQ ID NO: 2340333 - RNA, 20 nt, Bordetella pertussis
caggcgccagaugcgccgca

SEQ ID NO: 2340334 - RNA, 14 nt, Bordetella pertussis
caggcgccaguccc

SEQ ID NO: 2340335 - RNA, 21 nt, Bordetella pertussis
caggcgcccaacccaggucgc

SEQ ID NO: 2340336 - RNA, 13 nt, Bordetella pertussis
caggcgccccacc

SEQ ID NO: 2340337 - RNA, 16 nt, Bordetella pertussis
caggcgccccacccgg

SEQ ID NO: 2340338 - RNA, 17 nt, Bordetella pertussis
caggcgcccggcgugac

SEQ ID NO: 2340339 - RNA, 12 nt, Bordetella pertussis
caggcgcccgug

SEQ ID NO: 2340340 - RNA, 19 nt, Bordetella pertussis
caggcgccgauccagggcc

SEQ ID NO: 2340341 - RNA, 22 nt, Bordetella pertussis
caggcgccgauccagggccgca

SEQ ID NO: 2340342 - RNA, 16 nt, Bordetella pertussis
caggcgccgcacccga

SEQ ID NO: 2340343 - RNA, 17 nt, Bordetella pertussis
caggcgccgcacgccgg

SEQ ID NO: 2340344 - RNA, 18 nt, Bordetella pertussis
caggcgccgcacgccggu

SEQ ID NO: 2340345 - RNA, 13 nt, Bordetella pertussis
caggcgccgcaga

SEQ ID NO: 2340346 - RNA, 17 nt, Bordetella pertussis
caggcgccgcagauggc

SEQ ID NO: 2340347 - RNA, 18 nt, Bordetella pertussis
caggcgccgccccgucau

SEQ ID NO: 2340348 - RNA, 16 nt, Bordetella pertussis
caggcgccgccgcccg

SEQ ID NO: 2340349 - RNA, 17 nt, Bordetella pertussis
caggcgccgccgcccgg

SEQ ID NO: 2340350 - RNA, 21 nt, Bordetella pertussis
caggcgccgccgcccggcaac

SEQ ID NO: 2340351 - RNA, 11 nt, Bordetella pertussis
caggcgccgcg

SEQ ID NO: 2340352 - RNA, 19 nt, Bordetella pertussis
caggcgccgcguccggcgc

SEQ ID NO: 2340353 - RNA, 23 nt, Bordetella pertussis
caggcgccgcguccggcgcccgc

SEQ ID NO: 2340354 - RNA, 16 nt, Bordetella pertussis
caggcgccgcucagcg

SEQ ID NO: 2340355 - RNA, 18 nt, Bordetella pertussis
caggcgccgcucagcgcg

SEQ ID NO: 2340356 - RNA, 19 nt, Bordetella pertussis
caggcgccgcucagcgcgg

SEQ ID NO: 2340357 - RNA, 13 nt, Bordetella pertussis
caggcgccgucga

SEQ ID NO: 2340358 - RNA, 22 nt, Bordetella pertussis
caggcgccuacaguuccaccug

SEQ ID NO: 2340359 - RNA, 15 nt, Bordetella pertussis
caggcgccucgcgac

SEQ ID NO: 2340360 - RNA, 18 nt, Bordetella pertussis
caggcgccucgcgacggc

SEQ ID NO: 2340361 - RNA, 20 nt, Bordetella pertussis
caggcgccucgcgacggccu

SEQ ID NO: 2340362 - RNA, 11 nt, Bordetella pertussis
caggcgccugc

SEQ ID NO: 2340363 - RNA, 16 nt, Bordetella pertussis
caggcgccugccccgc

SEQ ID NO: 2340364 - RNA, 19 nt, Bordetella pertussis
caggcgccugccccgccgg

SEQ ID NO: 2340365 - RNA, 23 nt, Bordetella pertussis
caggcgccugccccgccgggaca

SEQ ID NO: 2340366 - RNA, 19 nt, Bordetella pertussis
caggcgccugcucacgccc

SEQ ID NO: 2340367 - RNA, 22 nt, Bordetella pertussis
caggcgccugcucacgccccgc

SEQ ID NO: 2340368 - RNA, 19 nt, Bordetella pertussis
caggcgccuucggcgcggc

SEQ ID NO: 2340369 - RNA, 14 nt, Bordetella pertussis
caggcgcgagcgcc

SEQ ID NO: 2340370 - RNA, 15 nt, Bordetella pertussis
caggcgcgagcgccg

SEQ ID NO: 2340371 - RNA, 16 nt, Bordetella pertussis
caggcgcgagcgccgg

SEQ ID NO: 2340372 - RNA, 19 nt, Bordetella pertussis
caggcgcgagcgccgggcg

SEQ ID NO: 2340373 - RNA, 21 nt, Bordetella pertussis
caggcgcgagcgccgggcgcc

SEQ ID NO: 2340374 - RNA, 14 nt, Bordetella pertussis
caggcgcgcaucgc

SEQ ID NO: 2340375 - RNA, 17 nt, Bordetella pertussis
caggcgucggcggccca

SEQ ID NO: 2340376 - RNA, 18 nt, Bordetella pertussis
caggcgucggcggcccac

SEQ ID NO: 2340377 - RNA, 19 nt, Bordetella pertussis
caggcgucguuggccgcgu

SEQ ID NO: 2340378 - RNA, 20 nt, Bordetella pertussis
caggcgucguuggccgcgua

SEQ ID NO: 2340379 - RNA, 15 nt, Bordetella pertussis
caggcgucugcuaca

SEQ ID NO: 2340380 - RNA, 21 nt, Bordetella pertussis
caggcgucugcuacaccgugc

SEQ ID NO: 2340381 - RNA, 23 nt, Bordetella pertussis
caggcgucugcuacaccgugcug

SEQ ID NO: 2340382 - RNA, 15 nt, Bordetella pertussis
caggcgucuugccgg

SEQ ID NO: 2340383 - RNA, 20 nt, Bordetella pertussis
caggcgugaacgccccggcc

SEQ ID NO: 2340384 - RNA, 19 nt, Bordetella pertussis
caggcgugcgcgggcgcca

SEQ ID NO: 2340385 - RNA, 18 nt, Bordetella pertussis
caggcguggcgacagcaa

SEQ ID NO: 2340386 - RNA, 20 nt, Bordetella pertussis
caggcguucgcaccaguccc

SEQ ID NO: 2340387 - RNA, 21 nt, Bordetella pertussis
caggcguugcgccgcaacgcc

SEQ ID NO: 2340388 - RNA, 14 nt, Bordetella pertussis
caggcuaucguggc

SEQ ID NO: 2340389 - RNA, 23 nt, Bordetella pertussis
caggcuaucguggcuggcgagga

SEQ ID NO: 2340390 - RNA, 16 nt, Bordetella pertussis
caggcucagcaggguc

SEQ ID NO: 2340391 - RNA, 12 nt, Bordetella pertussis
caggcucagccc

SEQ ID NO: 2340392 - RNA, 14 nt, Bordetella pertussis
caggcucagcccgg

SEQ ID NO: 2340393 - RNA, 13 nt, Bordetella pertussis
caggcucaggcgg

SEQ ID NO: 2340394 - RNA, 16 nt, Bordetella pertussis
caggcucaggcggcca

SEQ ID NO: 2340395 - RNA, 17 nt, Bordetella pertussis
caggcuccacagccacu

SEQ ID NO: 2340396 - RNA, 15 nt, Bordetella pertussis
caggcucccgcuggc

SEQ ID NO: 2340397 - RNA, 17 nt, Bordetella pertussis
caggcucccgcuggcgg

SEQ ID NO: 2340398 - RNA, 22 nt, Bordetella pertussis
caggcuccucgccacacgccag

SEQ ID NO: 2340399 - RNA, 16 nt, Bordetella pertussis
caggcucuggcugacg

SEQ ID NO: 2340400 - RNA, 19 nt, Bordetella pertussis
caggcucuggcugacgaug

SEQ ID NO: 2340401 - RNA, 14 nt, Bordetella pertussis
caggcucugggcgg

SEQ ID NO: 2340402 - RNA, 15 nt, Bordetella pertussis
caggcucugggcgga

SEQ ID NO: 2340403 - RNA, 15 nt, Bordetella pertussis
caggcucuugaccag

SEQ ID NO: 2340404 - RNA, 17 nt, Bordetella pertussis
caggcucuugaccagcu

SEQ ID NO: 2340405 - RNA, 20 nt, Bordetella pertussis
caggcucuugaccagcuugu

SEQ ID NO: 2340406 - RNA, 21 nt, Bordetella pertussis
caggcucuuuuucccggcgcg

SEQ ID NO: 2340407 - RNA, 16 nt, Bordetella pertussis
caggcugaccagcgcg

SEQ ID NO: 2340408 - RNA, 19 nt, Bordetella pertussis
caggcugaccagcgcgucg

SEQ ID NO: 2340409 - RNA, 14 nt, Bordetella pertussis
caggcugagcguga

SEQ ID NO: 2340410 - RNA, 20 nt, Bordetella pertussis
caggcugaucacccacagca

SEQ ID NO: 2340411 - RNA, 21 nt, Bordetella pertussis
caggcugaucacccacagcag

SEQ ID NO: 2340412 - RNA, 19 nt, Bordetella pertussis
caggcugcccuggcccagg

SEQ ID NO: 2340413 - RNA, 20 nt, Bordetella pertussis
caggcugcccuggcccaggc

SEQ ID NO: 2340414 - RNA, 22 nt, Bordetella pertussis
caggcugcccuggcccaggccg

SEQ ID NO: 2340415 - RNA, 23 nt, Bordetella pertussis
caggcugcccuggcccaggccga

SEQ ID NO: 2340416 - RNA, 12 nt, Bordetella pertussis
caggcugccgcc

SEQ ID NO: 2340417 - RNA, 13 nt, Bordetella pertussis
caggcugccggcg

SEQ ID NO: 2340418 - RNA, 14 nt, Bordetella pertussis
caggcugccgucgu

SEQ ID NO: 2340419 - RNA, 18 nt, Bordetella pertussis
caggcugcgcaggcgccg

SEQ ID NO: 2340420 - RNA, 20 nt, Bordetella pertussis
caggcugcgcaggcgccgca

SEQ ID NO: 2340421 - RNA, 14 nt, Bordetella pertussis
caggcugcgcgccg

SEQ ID NO: 2340422 - RNA, 15 nt, Bordetella pertussis
caggcugcgcgccgg

SEQ ID NO: 2340423 - RNA, 18 nt, Bordetella pertussis
caggcugcgcgccggcgc

SEQ ID NO: 2340424 - RNA, 20 nt, Bordetella pertussis
caggcugcgcgccggcgccu

SEQ ID NO: 2340425 - RNA, 18 nt, Bordetella pertussis
caggcugcgcgucggcag

SEQ ID NO: 2340426 - RNA, 23 nt, Bordetella pertussis
caggcugcgcgucggcaggugca

SEQ ID NO: 2340427 - RNA, 16 nt, Bordetella pertussis
caggcugcugugccug

SEQ ID NO: 2340428 - RNA, 22 nt, Bordetella pertussis
caggcugcugugccugccaagc

SEQ ID NO: 2340429 - RNA, 12 nt, Bordetella pertussis
caggcuggaagu

SEQ ID NO: 2340430 - RNA, 13 nt, Bordetella pertussis
caggcuggacccg

SEQ ID NO: 2340431 - RNA, 14 nt, Bordetella pertussis
caggcuggcaugga

SEQ ID NO: 2340432 - RNA, 15 nt, Bordetella pertussis
caggcuggcauggaa

SEQ ID NO: 2340433 - RNA, 20 nt, Bordetella pertussis
caggcuggcauugagggcgu

SEQ ID NO: 2340434 - RNA, 13 nt, Bordetella pertussis
caggcuggccacc

SEQ ID NO: 2340435 - RNA, 22 nt, Bordetella pertussis
caggcuggccaccgaagcggcg

SEQ ID NO: 2340436 - RNA, 16 nt, Bordetella pertussis
caggcuggccggcgug

SEQ ID NO: 2340437 - RNA, 19 nt, Bordetella pertussis
caggcuggccggcguggcc

SEQ ID NO: 2340438 - RNA, 23 nt, Bordetella pertussis
caggcuggccggcguggccugcc

SEQ ID NO: 2340439 - RNA, 15 nt, Bordetella pertussis
caggcuggccugcag

SEQ ID NO: 2340440 - RNA, 13 nt, Bordetella pertussis
caggcuggcgcgg

SEQ ID NO: 2340441 - RNA, 14 nt, Bordetella pertussis
caggcuggcgcggu

SEQ ID NO: 2340442 - RNA, 14 nt, Bordetella pertussis
caggcugggagagc

SEQ ID NO: 2340443 - RNA, 20 nt, Bordetella pertussis
caggcugggagagccggcca

SEQ ID NO: 2340444 - RNA, 23 nt, Bordetella pertussis
caggcugggagagccggccacgc

SEQ ID NO: 2340445 - RNA, 17 nt, Bordetella pertussis
caggcugggccagaugg

SEQ ID NO: 2340446 - RNA, 16 nt, Bordetella pertussis
caggcuggggccgagc

SEQ ID NO: 2340447 - RNA, 17 nt, Bordetella pertussis
caggcuggggccgagcg

SEQ ID NO: 2340448 - RNA, 23 nt, Bordetella pertussis
caggcugguggcgucgaguucga

SEQ ID NO: 2340449 - RNA, 19 nt, Bordetella pertussis
caggcugucccagauggcg

SEQ ID NO: 2340450 - RNA, 17 nt, Bordetella pertussis
caggcugucgucgucgg

SEQ ID NO: 2340451 - RNA, 19 nt, Bordetella pertussis
caggcugucgucgucggca

SEQ ID NO: 2340452 - RNA, 24 nt, Bordetella pertussis
caggcugucgucgucggcaccuuc

SEQ ID NO: 2340453 - RNA, 16 nt, Bordetella pertussis
caggcuguggccgcgg

SEQ ID NO: 2340454 - RNA, 17 nt, Bordetella pertussis
caggcuguggccgcggc

SEQ ID NO: 2340455 - RNA, 20 nt, Bordetella pertussis
caggcuguggccgcggccca

SEQ ID NO: 2340456 - RNA, 21 nt, Bordetella pertussis
caggcuguggccgcggcccag

SEQ ID NO: 2340457 - RNA, 22 nt, Bordetella pertussis
caggcuguggccgcggcccagc

SEQ ID NO: 2340458 - RNA, 14 nt, Bordetella pertussis
caggcuugcagcaa

SEQ ID NO: 2340459 - RNA, 21 nt, Bordetella pertussis
caggcuuucgcaauacgucgc

SEQ ID NO: 2340460 - RNA, 23 nt, Bordetella pertussis
caggcuuucgcacagccggggcg

SEQ ID NO: 2340461 - RNA, 15 nt, Bordetella pertussis
caggcuuugcuggcc

SEQ ID NO: 2340462 - RNA, 16 nt, Bordetella pertussis
caggcuuugcuggcca

SEQ ID NO: 2340463 - RNA, 11 nt, Bordetella pertussis
cagggacaggc

SEQ ID NO: 2340464 - RNA, 20 nt, Bordetella pertussis
cagggaccaauacgccgcca

SEQ ID NO: 2340465 - RNA, 22 nt, Bordetella pertussis
cagggaccaauacgccgccaug

SEQ ID NO: 2340466 - RNA, 17 nt, Bordetella pertussis
cagggaccaccccgaga

SEQ ID NO: 2340467 - RNA, 21 nt, Bordetella pertussis
cagggacgggccagccccggc

SEQ ID NO: 2340468 - RNA, 17 nt, Bordetella pertussis
cagggacuugggcaggc

SEQ ID NO: 2340469 - RNA, 23 nt, Bordetella pertussis
cagggcaaagaaauugggcgugg

SEQ ID NO: 2340470 - RNA, 13 nt, Bordetella pertussis
cagggcagcggcc

SEQ ID NO: 2340471 - RNA, 14 nt, Bordetella pertussis
cagggcagcggcca

SEQ ID NO: 2340472 - RNA, 15 nt, Bordetella pertussis
cagggcaggaggcgc

SEQ ID NO: 2340473 - RNA, 15 nt, Bordetella pertussis
cagggcagggcgccg

SEQ ID NO: 2340474 - RNA, 14 nt, Bordetella pertussis
cagggcaugggccc

SEQ ID NO: 2340475 - RNA, 15 nt, Bordetella pertussis
cagggcaugggcccg

SEQ ID NO: 2340476 - RNA, 18 nt, Bordetella pertussis
cagggcaugggcccgggc

SEQ ID NO: 2340477 - RNA, 22 nt, Bordetella pertussis
cagggcaugggcccgggcgcgc

SEQ ID NO: 2340478 - RNA, 16 nt, Bordetella pertussis
cagggccaccacgccg

SEQ ID NO: 2340479 - RNA, 14 nt, Bordetella pertussis
cagggccacgccca

SEQ ID NO: 2340480 - RNA, 16 nt, Bordetella pertussis
cagggccacgcccacg

SEQ ID NO: 2340481 - RNA, 15 nt, Bordetella pertussis
cagggccacgcccag

SEQ ID NO: 2340482 - RNA, 16 nt, Bordetella pertussis
cagggccacgcccagg

SEQ ID NO: 2340483 - RNA, 22 nt, Bordetella pertussis
cagggccacgcccaggccgugg

SEQ ID NO: 2340484 - RNA, 13 nt, Bordetella pertussis
cagggccacgccg

SEQ ID NO: 2340485 - RNA, 14 nt, Bordetella pertussis
cagggccacgccgg

SEQ ID NO: 2340486 - RNA, 16 nt, Bordetella pertussis
cagggccacgccggcc

SEQ ID NO: 2340487 - RNA, 19 nt, Bordetella pertussis
cagggccacgccggccgcc

SEQ ID NO: 2340488 - RNA, 14 nt, Bordetella pertussis
cagggccagcgcca

SEQ ID NO: 2340489 - RNA, 15 nt, Bordetella pertussis
cagggccagcuugac

SEQ ID NO: 2340490 - RNA, 13 nt, Bordetella pertussis
cagggccaggccc

SEQ ID NO: 2340491 - RNA, 14 nt, Bordetella pertussis
cagggccaggccca

SEQ ID NO: 2340492 - RNA, 22 nt, Bordetella pertussis
cagggccaggcccacggcgcca

SEQ ID NO: 2340493 - RNA, 23 nt, Bordetella pertussis
cagggccaggcccacggcgccaa

SEQ ID NO: 2340494 - RNA, 15 nt, Bordetella pertussis
cagggccaggccgau

SEQ ID NO: 2340495 - RNA, 15 nt, Bordetella pertussis
cagggccaggccgcc

SEQ ID NO: 2340496 - RNA, 22 nt, Bordetella pertussis
cagggccgaucccuugugcgcg

SEQ ID NO: 2340497 - RNA, 12 nt, Bordetella pertussis
cagggccgcagc

SEQ ID NO: 2340498 - RNA, 13 nt, Bordetella pertussis
cagggccgcagca

SEQ ID NO: 2340499 - RNA, 17 nt, Bordetella pertussis
cagggccgccagcaccu

SEQ ID NO: 2340500 - RNA, 22 nt, Bordetella pertussis
cagggccgccagggcggcugcc

SEQ ID NO: 2340501 - RNA, 13 nt, Bordetella pertussis
cagggccgccaug

SEQ ID NO: 2340502 - RNA, 23 nt, Bordetella pertussis
cagggccgcccagucguccagca

SEQ ID NO: 2340503 - RNA, 11 nt, Bordetella pertussis
cagggccgcga

SEQ ID NO: 2340504 - RNA, 19 nt, Bordetella pertussis
cagggccgcgagcaugcgc

SEQ ID NO: 2340505 - RNA, 14 nt, Bordetella pertussis
cagggccgcgccgg

SEQ ID NO: 2340506 - RNA, 15 nt, Bordetella pertussis
cagggccgcgccggg

SEQ ID NO: 2340507 - RNA, 21 nt, Bordetella pertussis
cagggccggccgggcgcggcg

SEQ ID NO: 2340508 - RNA, 20 nt, Bordetella pertussis
cagggccgugcccgagggcg

SEQ ID NO: 2340509 - RNA, 22 nt, Bordetella pertussis
cagggccgugcccgagggcgcg

SEQ ID NO: 2340510 - RNA, 16 nt, Bordetella pertussis
cagggccuccugcagc

SEQ ID NO: 2340511 - RNA, 17 nt, Bordetella pertussis
cagggccuccugcagca

SEQ ID NO: 2340512 - RNA, 18 nt, Bordetella pertussis
cagggccuccugcagcag

SEQ ID NO: 2340513 - RNA, 21 nt, Bordetella pertussis
cagggccuccugcagcagguc

SEQ ID NO: 2340514 - RNA, 22 nt, Bordetella pertussis
cagggccuccugcagcaggucg

SEQ ID NO: 2340515 - RNA, 23 nt, Bordetella pertussis
cagggccuccugcagcaggucgg

SEQ ID NO: 2340516 - RNA, 22 nt, Bordetella pertussis
cagggccucgcgggccuuggcc

SEQ ID NO: 2340517 - RNA, 18 nt, Bordetella pertussis
cagggccugcgggccggg

SEQ ID NO: 2340518 - RNA, 22 nt, Bordetella pertussis
cagggccugcgggccgggcagg

SEQ ID NO: 2340519 - RNA, 22 nt, Bordetella pertussis
cagggccuggaagcuggccagc

SEQ ID NO: 2340520 - RNA, 23 nt, Bordetella pertussis
cagggccuggaagcuggccagcg

SEQ ID NO: 2340521 - RNA, 13 nt, Bordetella pertussis
cagggccuggcac

SEQ ID NO: 2340522 - RNA, 20 nt, Bordetella pertussis
cagggccuggcacaucggcc

SEQ ID NO: 2340523 - RNA, 18 nt, Bordetella pertussis
cagggccuggcagaugcg

SEQ ID NO: 2340524 - RNA, 23 nt, Bordetella pertussis
cagggccuggcagaugcgcgcca

SEQ ID NO: 2340525 - RNA, 22 nt, Bordetella pertussis
cagggcgaacgggguggccggc

SEQ ID NO: 2340526 - RNA, 20 nt, Bordetella pertussis
cagggcgaacguggccugcu

SEQ ID NO: 2340527 - RNA, 17 nt, Bordetella pertussis
cagggcgaagcgcgccu

SEQ ID NO: 2340528 - RNA, 20 nt, Bordetella pertussis
cagggcgaagcgcgccucgu

SEQ ID NO: 2340529 - RNA, 15 nt, Bordetella pertussis
cagggcgaaggccag

SEQ ID NO: 2340530 - RNA, 19 nt, Bordetella pertussis
cagggcgaaggccagcgcc

SEQ ID NO: 2340531 - RNA, 20 nt, Bordetella pertussis
cagggcgaaggccagcgccu

SEQ ID NO: 2340532 - RNA, 17 nt, Bordetella pertussis
cagggcgacgucccagg

SEQ ID NO: 2340533 - RNA, 20 nt, Bordetella pertussis
cagggcgacgucccaggccg

SEQ ID NO: 2340534 - RNA, 19 nt, Bordetella pertussis
cagggcgaucagcaccgcg

SEQ ID NO: 2340535 - RNA, 20 nt, Bordetella pertussis
cagggcgaucagcaccgcgg

SEQ ID NO: 2340536 - RNA, 19 nt, Bordetella pertussis
cagggcgaucuugccggcc

SEQ ID NO: 2340537 - RNA, 23 nt, Bordetella pertussis
cagggcgaucuugccggccuggc

SEQ ID NO: 2340538 - RNA, 22 nt, Bordetella pertussis
cagggcgaugaccggcaagcgc

SEQ ID NO: 2340539 - RNA, 17 nt, Bordetella pertussis
cagggcgaugccgcaga

SEQ ID NO: 2340540 - RNA, 16 nt, Bordetella pertussis
cagggcgcaacgccgg

SEQ ID NO: 2340541 - RNA, 18 nt, Bordetella pertussis
cagggcgcaacgccggcc

SEQ ID NO: 2340542 - RNA, 15 nt, Bordetella pertussis
cagggcgcccgccga

SEQ ID NO: 2340543 - RNA, 17 nt, Bordetella pertussis
cagggcgccgaccgggc

SEQ ID NO: 2340544 - RNA, 21 nt, Bordetella pertussis
cagggcgccgaccgggccgac

SEQ ID NO: 2340545 - RNA, 23 nt, Bordetella pertussis
cagggcgccgaccgggccgacca

SEQ ID NO: 2340546 - RNA, 14 nt, Bordetella pertussis
cagggcgccgcgcg

SEQ ID NO: 2340547 - RNA, 17 nt, Bordetella pertussis
cagggcgccgcggcggc

SEQ ID NO: 2340548 - RNA, 14 nt, Bordetella pertussis
cagggcgccggcgu

SEQ ID NO: 2340549 - RNA, 15 nt, Bordetella pertussis
cagggcgccugcaga

SEQ ID NO: 2340550 - RNA, 14 nt, Bordetella pertussis
cagggcgcgcagca

SEQ ID NO: 2340551 - RNA, 15 nt, Bordetella pertussis
cagggcgcgcagcag

SEQ ID NO: 2340552 - RNA, 20 nt, Bordetella pertussis
cagggcgcgcagcaggccca

SEQ ID NO: 2340553 - RNA, 21 nt, Bordetella pertussis
cagggcgcgcagcaggcccau

SEQ ID NO: 2340554 - RNA, 21 nt, Bordetella pertussis
cagggcgcgccgcagcguggc

SEQ ID NO: 2340555 - RNA, 13 nt, Bordetella pertussis
cagggcgcgccgg

SEQ ID NO: 2340556 - RNA, 17 nt, Bordetella pertussis
cagggcgcgccggaaca

SEQ ID NO: 2340557 - RNA, 21 nt, Bordetella pertussis
cagggcgcgccggaacauggc

SEQ ID NO: 2340558 - RNA, 22 nt, Bordetella pertussis
cagggcgcgccggaacauggcg

SEQ ID NO: 2340559 - RNA, 17 nt, Bordetella pertussis
cagggcgcggacuucgc

SEQ ID NO: 2340560 - RNA, 19 nt, Bordetella pertussis
cagggcgcggaucaugggc

SEQ ID NO: 2340561 - RNA, 20 nt, Bordetella pertussis
cagggcggaaaacagcacca

SEQ ID NO: 2340562 - RNA, 23 nt, Bordetella pertussis
cagggcggaaaacagcaccagca

SEQ ID NO: 2340563 - RNA, 14 nt, Bordetella pertussis
cagggcggccaggc

SEQ ID NO: 2340564 - RNA, 17 nt, Bordetella pertussis
cagggcggccaggccgg

SEQ ID NO: 2340565 - RNA, 18 nt, Bordetella pertussis
cagggcggccggcacgcc

SEQ ID NO: 2340566 - RNA, 19 nt, Bordetella pertussis
cagggcggccggcacgccg

SEQ ID NO: 2340567 - RNA, 14 nt, Bordetella pertussis
cagggcggccucga

SEQ ID NO: 2340568 - RNA, 18 nt, Bordetella pertussis
cagggcggccucgacggc

SEQ ID NO: 2340569 - RNA, 19 nt, Bordetella pertussis
cagggcggccucgacggcc

SEQ ID NO: 2340570 - RNA, 20 nt, Bordetella pertussis
cagggcgggcgggauuaugc

SEQ ID NO: 2340571 - RNA, 20 nt, Bordetella pertussis
cagggcgggggacgcccgcc

SEQ ID NO: 2340572 - RNA, 17 nt, Bordetella pertussis
cagggcggugcgcucga

SEQ ID NO: 2340573 - RNA, 18 nt, Bordetella pertussis
cagggcggugggcagcgc

SEQ ID NO: 2340574 - RNA, 19 nt, Bordetella pertussis
cagggcggugggcagcgcg

SEQ ID NO: 2340575 - RNA, 22 nt, Bordetella pertussis
cagggcgucgcgaugcgccagg

SEQ ID NO: 2340576 - RNA, 17 nt, Bordetella pertussis
cagggcgucgcggcgua

SEQ ID NO: 2340577 - RNA, 14 nt, Bordetella pertussis
cagggcgucggccg

SEQ ID NO: 2340578 - RNA, 23 nt, Bordetella pertussis
cagggcgucggccgcgcccaggu

SEQ ID NO: 2340579 - RNA, 17 nt, Bordetella pertussis
cagggcgucggcgacgu

SEQ ID NO: 2340580 - RNA, 12 nt, Bordetella pertussis
cagggcgugcgg

SEQ ID NO: 2340581 - RNA, 22 nt, Bordetella pertussis
cagggcgugcgggacggccagg

SEQ ID NO: 2340582 - RNA, 23 nt, Bordetella pertussis
cagggcgugcgggacggccaggg

SEQ ID NO: 2340583 - RNA, 23 nt, Bordetella pertussis
cagggcguuuuccagcaucaggg

SEQ ID NO: 2340584 - RNA, 23 nt, Bordetella pertussis
cagggcugaucuugaugcggccg

SEQ ID NO: 2340585 - RNA, 17 nt, Bordetella pertussis
cagggcuugacgcgcgu

SEQ ID NO: 2340586 - RNA, 18 nt, Bordetella pertussis
cagggcuugacgcgcguu

SEQ ID NO: 2340587 - RNA, 19 nt, Bordetella pertussis
cagggcuugcggcgcuggc

SEQ ID NO: 2340588 - RNA, 14 nt, Bordetella pertussis
caggggacggcgca

SEQ ID NO: 2340589 - RNA, 19 nt, Bordetella pertussis
caggggacggcgcacccgc

SEQ ID NO: 2340590 - RNA, 17 nt, Bordetella pertussis
caggggauugccgcgcg

SEQ ID NO: 2340591 - RNA, 17 nt, Bordetella pertussis
caggggcaaggcgaacg

SEQ ID NO: 2340592 - RNA, 14 nt, Bordetella pertussis
caggggcaggcgca

SEQ ID NO: 2340593 - RNA, 16 nt, Bordetella pertussis
caggggcaggcgcacg

SEQ ID NO: 2340594 - RNA, 21 nt, Bordetella pertussis
caggggcaggugccccacgcc

SEQ ID NO: 2340595 - RNA, 14 nt, Bordetella pertussis
caggggccgcacgc

SEQ ID NO: 2340596 - RNA, 20 nt, Bordetella pertussis
caggggccgcacgcgcggca

SEQ ID NO: 2340597 - RNA, 19 nt, Bordetella pertussis
caggggccggcgcgccgcg

SEQ ID NO: 2340598 - RNA, 18 nt, Bordetella pertussis
caggggccucaugacggg

SEQ ID NO: 2340599 - RNA, 16 nt, Bordetella pertussis
caggggcgcuggucga

SEQ ID NO: 2340600 - RNA, 20 nt, Bordetella pertussis
caggggcuccaggaacacca

SEQ ID NO: 2340601 - RNA, 17 nt, Bordetella pertussis
caggggcucgcgcccga

SEQ ID NO: 2340602 - RNA, 19 nt, Bordetella pertussis
caggggcucggccaggugc

SEQ ID NO: 2340603 - RNA, 19 nt, Bordetella pertussis
caggggcucuucgacagcg

SEQ ID NO: 2340604 - RNA, 20 nt, Bordetella pertussis
caggggcucuucgacagcgc

SEQ ID NO: 2340605 - RNA, 23 nt, Bordetella pertussis
caggggcucuucgacagcgcgca

SEQ ID NO: 2340606 - RNA, 14 nt, Bordetella pertussis
cagggggacuggca

SEQ ID NO: 2340607 - RNA, 19 nt, Bordetella pertussis
caggcgcgcaucgcgcggc

SEQ ID NO: 2340608 - RNA, 20 nt, Bordetella pertussis
caggcgcgcaucgcgcggca

SEQ ID NO: 2340609 - RNA, 16 nt, Bordetella pertussis
caggcgcgccagccgc

SEQ ID NO: 2340610 - RNA, 17 nt, Bordetella pertussis
caggcgcgccagccgcg

SEQ ID NO: 2340611 - RNA, 18 nt, Bordetella pertussis
caggcgcgccagccgcgc

SEQ ID NO: 2340612 - RNA, 23 nt, Bordetella pertussis
caggcgcgccagccgcugcagcg

SEQ ID NO: 2340613 - RNA, 24 nt, Bordetella pertussis
caggcgcgccaggggaugacgggc

SEQ ID NO: 2340614 - RNA, 13 nt, Bordetella pertussis
caggcgcgcccgc

SEQ ID NO: 2340615 - RNA, 14 nt, Bordetella pertussis
caggcgcgccgcga

SEQ ID NO: 2340616 - RNA, 18 nt, Bordetella pertussis
caggcgcgccgcgauggc

SEQ ID NO: 2340617 - RNA, 19 nt, Bordetella pertussis
caggcgcgccgcgauggcg

SEQ ID NO: 2340618 - RNA, 13 nt, Bordetella pertussis
caggcgcgccggg

SEQ ID NO: 2340619 - RNA, 14 nt, Bordetella pertussis
caggcgcgcgccuu

SEQ ID NO: 2340620 - RNA, 14 nt, Bordetella pertussis
caggcgcgcgcgcg

SEQ ID NO: 2340621 - RNA, 18 nt, Bordetella pertussis
caggcgcgcggcagggcg

SEQ ID NO: 2340622 - RNA, 23 nt, Bordetella pertussis
caggcgcgcggcagggcgucggc

SEQ ID NO: 2340623 - RNA, 14 nt, Bordetella pertussis
caggcgcgcggccu

SEQ ID NO: 2340624 - RNA, 13 nt, Bordetella pertussis
caggcgcgcggcg

SEQ ID NO: 2340625 - RNA, 15 nt, Bordetella pertussis
caggcgcgcggcguu

SEQ ID NO: 2340626 - RNA, 16 nt, Bordetella pertussis
caggcgcgcggcguug

SEQ ID NO: 2340627 - RNA, 24 nt, Bordetella pertussis
caggcgcgcggcguugcggcgcca

SEQ ID NO: 2340628 - RNA, 16 nt, Bordetella pertussis
caggcgcgcucaggcc

SEQ ID NO: 2340629 - RNA, 17 nt, Bordetella pertussis
caggcgcgcucaggccg

SEQ ID NO: 2340630 - RNA, 20 nt, Bordetella pertussis
caggcgcgcucaggccgccg

SEQ ID NO: 2340631 - RNA, 21 nt, Bordetella pertussis
caggcgcgcucaggccgccgg

SEQ ID NO: 2340632 - RNA, 13 nt, Bordetella pertussis
caggcgcgcuggc

SEQ ID NO: 2340633 - RNA, 15 nt, Bordetella pertussis
caggcgcgcuggcgc

SEQ ID NO: 2340634 - RNA, 16 nt, Bordetella pertussis
caggcgcgcuggcgcu

SEQ ID NO: 2340635 - RNA, 22 nt, Bordetella pertussis
caggcgcgcuucuuggcgacca

SEQ ID NO: 2340636 - RNA, 16 nt, Bordetella pertussis
caggcgcggcuggaug

SEQ ID NO: 2340637 - RNA, 19 nt, Bordetella pertussis
caggcgcgugaggucgcgc

SEQ ID NO: 2340638 - RNA, 20 nt, Bordetella pertussis
caggcgcgugaggucgcgcg

SEQ ID NO: 2340639 - RNA, 21 nt, Bordetella pertussis
caggcgcgugaggucgcgcgu

SEQ ID NO: 2340640 - RNA, 20 nt, Bordetella pertussis
caggcgcgugcgcaggcgcg

SEQ ID NO: 2340641 - RNA, 23 nt, Bordetella pertussis
caggcgcgugcgcaggcgcgugg

SEQ ID NO: 2340642 - RNA, 21 nt, Bordetella pertussis
caggcgcgugcucaucggcag

SEQ ID NO: 2340643 - RNA, 14 nt, Bordetella pertussis
caggcgcguggcca

SEQ ID NO: 2340644 - RNA, 18 nt, Bordetella pertussis
caggcgcguggccacggc

SEQ ID NO: 2340645 - RNA, 15 nt, Bordetella pertussis
caggcgcguggcgcc

SEQ ID NO: 2340646 - RNA, 18 nt, Bordetella pertussis
caggcgcguggcgcccag

SEQ ID NO: 2340647 - RNA, 13 nt, Bordetella pertussis
caggcgcgugggc

SEQ ID NO: 2340648 - RNA, 17 nt, Bordetella pertussis
caggcgcgugggcaggu

SEQ ID NO: 2340649 - RNA, 20 nt, Bordetella pertussis
caggcgcguugcgcuugcgc

SEQ ID NO: 2340650 - RNA, 23 nt, Bordetella pertussis
caggcgcguuucggucagggcga

SEQ ID NO: 2340651 - RNA, 20 nt, Bordetella pertussis
caggcgcucagccgugccgc

SEQ ID NO: 2340652 - RNA, 14 nt, Bordetella pertussis
caggcgcuccagca

SEQ ID NO: 2340653 - RNA, 16 nt, Bordetella pertussis
caggcgcuccauggcg

SEQ ID NO: 2340654 - RNA, 18 nt, Bordetella pertussis
caggcgcuccauggcgcc

SEQ ID NO: 2340655 - RNA, 21 nt, Bordetella pertussis
caggcgcuccauggcgccggc

SEQ ID NO: 2340656 - RNA, 23 nt, Bordetella pertussis
caggcgcucgaggcgcuggcguc

SEQ ID NO: 2340657 - RNA, 13 nt, Bordetella pertussis
caggcgcucgccc

SEQ ID NO: 2340658 - RNA, 14 nt, Bordetella pertussis
caggcgcucgcgcg

SEQ ID NO: 2340659 - RNA, 16 nt, Bordetella pertussis
caggcgcucgcgcgcc

SEQ ID NO: 2340660 - RNA, 17 nt, Bordetella pertussis
caggcgcucgcgcgcca

SEQ ID NO: 2340661 - RNA, 21 nt, Bordetella pertussis
caggcgcucgcgcgccagcag

SEQ ID NO: 2340662 - RNA, 20 nt, Bordetella pertussis
caggcgcucgcgcugcagga

SEQ ID NO: 2340663 - RNA, 13 nt, Bordetella pertussis
caggcgcucggcg

SEQ ID NO: 2340664 - RNA, 12 nt, Bordetella pertussis
caggcgcugcag

SEQ ID NO: 2340665 - RNA, 15 nt, Bordetella pertussis
caggcgcugcagcaa

SEQ ID NO: 2340666 - RNA, 22 nt, Bordetella pertussis
caggcgcugguaaagggcgcgg

SEQ ID NO: 2340667 - RNA, 22 nt, Bordetella pertussis
caggcgcuggucgucgcgaaac

SEQ ID NO: 2340668 - RNA, 22 nt, Bordetella pertussis
caggcggaucucuccgaacgcg

SEQ ID NO: 2340669 - RNA, 20 nt, Bordetella pertussis
caggcggcaggcgccgccgc

SEQ ID NO: 2340670 - RNA, 12 nt, Bordetella pertussis
caggcggccacc

SEQ ID NO: 2340671 - RNA, 21 nt, Bordetella pertussis
caggcggccaccaccaggccc

SEQ ID NO: 2340672 - RNA, 22 nt, Bordetella pertussis
caggcggccaccaccaggccca

SEQ ID NO: 2340673 - RNA, 13 nt, Bordetella pertussis
caggcggccaggg

SEQ ID NO: 2340674 - RNA, 18 nt, Bordetella pertussis
caggcggccaguucgucc

SEQ ID NO: 2340675 - RNA, 16 nt, Bordetella pertussis
caggcggccaucgccg

SEQ ID NO: 2340676 - RNA, 20 nt, Bordetella pertussis
caggcggccaucgccgccac

SEQ ID NO: 2340677 - RNA, 13 nt, Bordetella pertussis
caggcggcccagc

SEQ ID NO: 2340678 - RNA, 14 nt, Bordetella pertussis
caggcggcccagcg

SEQ ID NO: 2340679 - RNA, 16 nt, Bordetella pertussis
caggcggccgaccagc

SEQ ID NO: 2340680 - RNA, 17 nt, Bordetella pertussis
caggcggccgaccagca

SEQ ID NO: 2340681 - RNA, 16 nt, Bordetella pertussis
caggcggccgcggaag

SEQ ID NO: 2340682 - RNA, 13 nt, Bordetella pertussis
caggcggcgacga

SEQ ID NO: 2340683 - RNA, 14 nt, Bordetella pertussis
caggcggcgacgau

SEQ ID NO: 2340684 - RNA, 18 nt, Bordetella pertussis
caggcggcgcaucagcgc

SEQ ID NO: 2340685 - RNA, 22 nt, Bordetella pertussis
caggcggcgcaucagcgcgccc

SEQ ID NO: 2340686 - RNA, 14 nt, Bordetella pertussis
caggcggcgccggc

SEQ ID NO: 2340687 - RNA, 13 nt, Bordetella pertussis
caggcggcgcggc

SEQ ID NO: 2340688 - RNA, 20 nt, Bordetella pertussis
caggcggcgcucgaaggcgc

SEQ ID NO: 2340689 - RNA, 14 nt, Bordetella pertussis
caggcggcggccuc

SEQ ID NO: 2340690 - RNA, 22 nt, Bordetella pertussis
caggcggcggccuccagcaggg

SEQ ID NO: 2340691 - RNA, 20 nt, Bordetella pertussis
caggcggcggcgcggcgcca

SEQ ID NO: 2340692 - RNA, 20 nt, Bordetella pertussis
caggcggcggugccagcgca

SEQ ID NO: 2340693 - RNA, 17 nt, Bordetella pertussis
caggcggcugcccaccu

SEQ ID NO: 2340694 - RNA, 19 nt, Bordetella pertussis
caggcggcuguagucgccg

SEQ ID NO: 2340695 - RNA, 20 nt, Bordetella pertussis
caggcggcuuucaugggccu

SEQ ID NO: 2340696 - RNA, 21 nt, Bordetella pertussis
caggcggcuuucaugggccug

SEQ ID NO: 2340697 - RNA, 22 nt, Bordetella pertussis
caggcggcuuucaugggccugg

SEQ ID NO: 2340698 - RNA, 14 nt, Bordetella pertussis
caggcgggcaucgc

SEQ ID NO: 2340699 - RNA, 17 nt, Bordetella pertussis
caggcgggcaucgccca

SEQ ID NO: 2340700 - RNA, 23 nt, Bordetella pertussis
caggcgggcaucgcccaccauga

SEQ ID NO: 2340701 - RNA, 14 nt, Bordetella pertussis
caggcgggccaggc

SEQ ID NO: 2340702 - RNA, 16 nt, Bordetella pertussis
caggcgggccaggccg

SEQ ID NO: 2340703 - RNA, 14 nt, Bordetella pertussis
caggcgggccaggu

SEQ ID NO: 2340704 - RNA, 15 nt, Bordetella pertussis
caggcgggccaggua

SEQ ID NO: 2340705 - RNA, 21 nt, Bordetella pertussis
caggcgggcccgcaucgcgcg

SEQ ID NO: 2340706 - RNA, 20 nt, Bordetella pertussis
caggcgggguggcacagccg

SEQ ID NO: 2340707 - RNA, 14 nt, Bordetella pertussis
caggcgguacaggc

SEQ ID NO: 2340708 - RNA, 17 nt, Bordetella pertussis
caggcgguacaggccgg

SEQ ID NO: 2340709 - RNA, 14 nt, Bordetella pertussis
caggcgguccuggu

SEQ ID NO: 2340710 - RNA, 13 nt, Bordetella pertussis
caggcggugcgcg

SEQ ID NO: 2340711 - RNA, 14 nt, Bordetella pertussis
caggcggugcgcgc

SEQ ID NO: 2340712 - RNA, 19 nt, Bordetella pertussis
caggcggugcgcgcggccg

SEQ ID NO: 2340713 - RNA, 14 nt, Bordetella pertussis
caggcgguuggccu

SEQ ID NO: 2340714 - RNA, 23 nt, Bordetella pertussis
caggcgguuggccuugacggcgc

SEQ ID NO: 2340715 - RNA, 22 nt, Bordetella pertussis
caggcguacgaggaccuguggc

SEQ ID NO: 2340716 - RNA, 21 nt, Bordetella pertussis
caggcguacgcuuaucgcggc

SEQ ID NO: 2340717 - RNA, 15 nt, Bordetella pertussis
caggcguccaggcug

SEQ ID NO: 2340718 - RNA, 18 nt, Bordetella pertussis
caggcguccaggcugccg

SEQ ID NO: 2340719 - RNA, 22 nt, Bordetella pertussis
caggcguccaggcugccggcgu

SEQ ID NO: 2340720 - RNA, 13 nt, Bordetella pertussis
caggcgucggcca

SEQ ID NO: 2340721 - RNA, 15 nt, Bordetella pertussis
caggcgucggccagc

SEQ ID NO: 2340722 - RNA, 17 nt, Bordetella pertussis
cagcgcagcgccacgcu

SEQ ID NO: 2340723 - RNA, 22 nt, Bordetella pertussis
cagcgcagcuucuaucugccgc

SEQ ID NO: 2340724 - RNA, 13 nt, Bordetella pertussis
cagcgcaggaugg

SEQ ID NO: 2340725 - RNA, 17 nt, Bordetella pertussis
cagcgcaggaugggcag

SEQ ID NO: 2340726 - RNA, 22 nt, Bordetella pertussis
cagcgcaggauuuccucgccgu

SEQ ID NO: 2340727 - RNA, 19 nt, Bordetella pertussis
cagcgcauaggacgccacc

SEQ ID NO: 2340728 - RNA, 20 nt, Bordetella pertussis
cagcgcauaggacgccacca

SEQ ID NO: 2340729 - RNA, 20 nt, Bordetella pertussis
cagcgcaucgaucucggccu

SEQ ID NO: 2340730 - RNA, 18 nt, Bordetella pertussis
cagcgcaucgccgcaggc

SEQ ID NO: 2340731 - RNA, 19 nt, Bordetella pertussis
cagcgcaucgccgcaggcg

SEQ ID NO: 2340732 - RNA, 13 nt, Bordetella pertussis
cagcgcaucgcgc

SEQ ID NO: 2340733 - RNA, 16 nt, Bordetella pertussis
cagcgcaucgcgcgcg

SEQ ID NO: 2340734 - RNA, 20 nt, Bordetella pertussis
cagcgcaucgcgcgcgccgg

SEQ ID NO: 2340735 - RNA, 21 nt, Bordetella pertussis
cagcgcaucgcgcgcgccggc

SEQ ID NO: 2340736 - RNA, 16 nt, Bordetella pertussis
cagcgcaugccgucga

SEQ ID NO: 2340737 - RNA, 19 nt, Bordetella pertussis
cagcgcauugcgguccagg

SEQ ID NO: 2340738 - RNA, 17 nt, Bordetella pertussis
cagcgcauuggugagca

SEQ ID NO: 2340739 - RNA, 21 nt, Bordetella pertussis
cagcgcauuggugagcacgcg

SEQ ID NO: 2340740 - RNA, 22 nt, Bordetella pertussis
cagcgcauuggugagcacgcgc

SEQ ID NO: 2340741 - RNA, 23 nt, Bordetella pertussis
cagcgcauuggugagcacgcgca

SEQ ID NO: 2340742 - RNA, 15 nt, Bordetella pertussis
cagcgccaccaccgg

SEQ ID NO: 2340743 - RNA, 16 nt, Bordetella pertussis
cagcgccaccaccggc

SEQ ID NO: 2340744 - RNA, 17 nt, Bordetella pertussis
cagcgccaccaccggca

SEQ ID NO: 2340745 - RNA, 23 nt, Bordetella pertussis
cagcgccaccaccggcacgccgg

SEQ ID NO: 2340746 - RNA, 19 nt, Bordetella pertussis
cagcgccaccagcagcgcc

SEQ ID NO: 2340747 - RNA, 15 nt, Bordetella pertussis
cagcgccaccguggc

SEQ ID NO: 2340748 - RNA, 21 nt, Bordetella pertussis
cagcgccaccguggccacggc

SEQ ID NO: 2340749 - RNA, 22 nt, Bordetella pertussis
cagcgccaccguggccacggcc

SEQ ID NO: 2340750 - RNA, 16 nt, Bordetella pertussis
cagcgccacgacgccg

SEQ ID NO: 2340751 - RNA, 20 nt, Bordetella pertussis
cagcgccacgcccaggccgc

SEQ ID NO: 2340752 - RNA, 18 nt, Bordetella pertussis
cagcgccacgcccuggcg

SEQ ID NO: 2340753 - RNA, 20 nt, Bordetella pertussis
cagcgccacgcccuggcggu

SEQ ID NO: 2340754 - RNA, 16 nt, Bordetella pertussis
cagcgccacgccggcc

SEQ ID NO: 2340755 - RNA, 15 nt, Bordetella pertussis
cagcgccacgcgagc

SEQ ID NO: 2340756 - RNA, 14 nt, Bordetella pertussis
cagcgccacggcgg

SEQ ID NO: 2340757 - RNA, 15 nt, Bordetella pertussis
cagcgccagaaagcg

SEQ ID NO: 2340758 - RNA, 19 nt, Bordetella pertussis
cagcgccagaaagcgcggc

SEQ ID NO: 2340759 - RNA, 14 nt, Bordetella pertussis
cagcgccagcaccg

SEQ ID NO: 2340760 - RNA, 16 nt, Bordetella pertussis
cagcgccagcaccggc

SEQ ID NO: 2340761 - RNA, 23 nt, Bordetella pertussis
cagcgccagcaccggcacgcgcc

SEQ ID NO: 2340762 - RNA, 13 nt, Bordetella pertussis
cagcgccagcagc

SEQ ID NO: 2340763 - RNA, 18 nt, Bordetella pertussis
cagcgccagcagcaggcc

SEQ ID NO: 2340764 - RNA, 21 nt, Bordetella pertussis
cagcgccagcagggucagcgg

SEQ ID NO: 2340765 - RNA, 23 nt, Bordetella pertussis
cagcgccagcagggucagcggcc

SEQ ID NO: 2340766 - RNA, 15 nt, Bordetella pertussis
cagcgccagcccgcu

SEQ ID NO: 2340767 - RNA, 16 nt, Bordetella pertussis
cagcgccagcccgcug

SEQ ID NO: 2340768 - RNA, 13 nt, Bordetella pertussis
cagcgccagccgc

SEQ ID NO: 2340769 - RNA, 22 nt, Bordetella pertussis
cagcgccagccgcuugcccguc

SEQ ID NO: 2340770 - RNA, 14 nt, Bordetella pertussis
cagcgccagcguca

SEQ ID NO: 2340771 - RNA, 20 nt, Bordetella pertussis
cagcgccagcgucaggcugg

SEQ ID NO: 2340772 - RNA, 17 nt, Bordetella pertussis
cagcgccaggaacagcg

SEQ ID NO: 2340773 - RNA, 21 nt, Bordetella pertussis
cagcgccaggaacagcgccgg

SEQ ID NO: 2340774 - RNA, 22 nt, Bordetella pertussis
cagcgccaggaacagcgccggc

SEQ ID NO: 2340775 - RNA, 23 nt, Bordetella pertussis
cagcgccaggaacagcgccggca

SEQ ID NO: 2340776 - RNA, 20 nt, Bordetella pertussis
cagcgccaggaugaugaggu

SEQ ID NO: 2340777 - RNA, 16 nt, Bordetella pertussis
cagcgccagggccagg

SEQ ID NO: 2340778 - RNA, 19 nt, Bordetella pertussis
cagcgccagggccaggccg

SEQ ID NO: 2340779 - RNA, 20 nt, Bordetella pertussis
cagcgccagggccaggccgc

SEQ ID NO: 2340780 - RNA, 14 nt, Bordetella pertussis
cagcgccagggccg

SEQ ID NO: 2340781 - RNA, 18 nt, Bordetella pertussis
cagcgccagggccgccgc

SEQ ID NO: 2340782 - RNA, 20 nt, Bordetella pertussis
cagcgccagggccgccgcgc

SEQ ID NO: 2340783 - RNA, 23 nt, Bordetella pertussis
cagcgccagggccgccgcgccca

SEQ ID NO: 2340784 - RNA, 16 nt, Bordetella pertussis
cagcgccaguccgcgc

SEQ ID NO: 2340785 - RNA, 18 nt, Bordetella pertussis
cagcgccaguccgcgcuc

SEQ ID NO: 2340786 - RNA, 20 nt, Bordetella pertussis
cagcgccaucaagagcaccg

SEQ ID NO: 2340787 - RNA, 12 nt, Bordetella pertussis
cagcgccaucau

SEQ ID NO: 2340788 - RNA, 15 nt, Bordetella pertussis
cagcgccaucgcgcg

SEQ ID NO: 2340789 - RNA, 16 nt, Bordetella pertussis
cagcgccaucgcgcgc

SEQ ID NO: 2340790 - RNA, 23 nt, Bordetella pertussis
cagcgccaugaugucgcgcgccu

SEQ ID NO: 2340791 - RNA, 16 nt, Bordetella pertussis
cagcgccauuccgaug

SEQ ID NO: 2340792 - RNA, 18 nt, Bordetella pertussis
cagcgcccaaucgggcag

SEQ ID NO: 2340793 - RNA, 19 nt, Bordetella pertussis
cagcgcccaaucgggcagc

SEQ ID NO: 2340794 - RNA, 23 nt, Bordetella pertussis
cagcgcccaggcgaugcccagcg

SEQ ID NO: 2340795 - RNA, 24 nt, Bordetella pertussis
cagcgcccaggcgaugcccagcgc

SEQ ID NO: 2340796 - RNA, 12 nt, Bordetella pertussis
cagcgcccaggu

SEQ ID NO: 2340797 - RNA, 12 nt, Bordetella pertussis
cagcgcccccag

SEQ ID NO: 2340798 - RNA, 13 nt, Bordetella pertussis
cagcgcccccagc

SEQ ID NO: 2340799 - RNA, 14 nt, Bordetella pertussis
cagcgcccccagca

SEQ ID NO: 2340800 - RNA, 20 nt, Bordetella pertussis
cagcgccccgaucagcaagg

SEQ ID NO: 2340801 - RNA, 14 nt, Bordetella pertussis
cagcgccccggcgu

SEQ ID NO: 2340802 - RNA, 15 nt, Bordetella pertussis
cagcgcccgcgccau

SEQ ID NO: 2340803 - RNA, 16 nt, Bordetella pertussis
cagcgcccgcgccauc

SEQ ID NO: 2340804 - RNA, 17 nt, Bordetella pertussis
cagcgccgaccgcacga

SEQ ID NO: 2340805 - RNA, 13 nt, Bordetella pertussis
cagcgccgacggc

SEQ ID NO: 2340806 - RNA, 14 nt, Bordetella pertussis
cagcgccgacggca

SEQ ID NO: 2340807 - RNA, 16 nt, Bordetella pertussis
cagcgccgacggcaug

SEQ ID NO: 2340808 - RNA, 17 nt, Bordetella pertussis
cagcgccgacggcaugg

SEQ ID NO: 2340809 - RNA, 19 nt, Bordetella pertussis
cagcgccgccaccucggcg

SEQ ID NO: 2340810 - RNA, 20 nt, Bordetella pertussis
cagcgccgccaccucggcgu

SEQ ID NO: 2340811 - RNA, 23 nt, Bordetella pertussis
cagcgccgccaccucggcgucgc

SEQ ID NO: 2340812 - RNA, 13 nt, Bordetella pertussis
cagcgccgccagc

SEQ ID NO: 2340813 - RNA, 16 nt, Bordetella pertussis
cagcgccgccagcaug

SEQ ID NO: 2340814 - RNA, 16 nt, Bordetella pertussis
cagcgccgccagccgc

SEQ ID NO: 2340815 - RNA, 18 nt, Bordetella pertussis
cagcgccgccagccgcug

SEQ ID NO: 2340816 - RNA, 20 nt, Bordetella pertussis
cagcgccgccagccgcuggc

SEQ ID NO: 2340817 - RNA, 20 nt, Bordetella pertussis
cagcgccgccauggcggcgc

SEQ ID NO: 2340818 - RNA, 13 nt, Bordetella pertussis
cagcgccgccgac

SEQ ID NO: 2340819 - RNA, 17 nt, Bordetella pertussis
cagcgccgccgacggca

SEQ ID NO: 2340820 - RNA, 18 nt, Bordetella pertussis
cagcgccgccgacggcau

SEQ ID NO: 2340821 - RNA, 20 nt, Bordetella pertussis
cagcgccgccuucaccggcc

SEQ ID NO: 2340822 - RNA, 12 nt, Bordetella pertussis
cagcgccgcgaa

SEQ ID NO: 2340823 - RNA, 18 nt, Bordetella pertussis
cagcgccgcgagcgccga

SEQ ID NO: 2340824 - RNA, 15 nt, Bordetella pertussis
cagcgccgcgaugcg

SEQ ID NO: 2340825 - RNA, 13 nt, Bordetella pertussis
cagcgccgcgccg

SEQ ID NO: 2340826 - RNA, 14 nt, Bordetella pertussis
cagcgccgcgccgc

SEQ ID NO: 2340827 - RNA, 15 nt, Bordetella pertussis
cagcgccgcgccgga

SEQ ID NO: 2340828 - RNA, 16 nt, Bordetella pertussis
cagcgccgcgcgcucg

SEQ ID NO: 2340829 - RNA, 12 nt, Bordetella pertussis
cagcgccgcggc

SEQ ID NO: 2340830 - RNA, 14 nt, Bordetella pertussis
cagcgccgcggccg

SEQ ID NO: 2340831 - RNA, 14 nt, Bordetella pertussis
cagcgccgcgucga

SEQ ID NO: 2340832 - RNA, 17 nt, Bordetella pertussis
cagcgccgcuuccaccg

SEQ ID NO: 2340833 - RNA, 24 nt, Bordetella pertussis
cagcgccgcuuccaccgucuggcg

SEQ ID NO: 2340834 - RNA, 13 nt, Bordetella pertussis
cagcgccggcacg

SEQ ID NO: 2340835 - RNA, 16 nt, Bordetella pertussis
cagcgccggcacgcug

SEQ ID NO: 2340836 - RNA, 17 nt, Bordetella pertussis
cagcgccggcacgcuga

SEQ ID NO: 2340837 - RNA, 23 nt, Bordetella pertussis
caucagcggcagcacgauggcgc

SEQ ID NO: 2340838 - RNA, 18 nt, Bordetella pertussis
caucagcgugccgccggc

SEQ ID NO: 2340839 - RNA, 13 nt, Bordetella pertussis
caucagcucgacc

SEQ ID NO: 2340840 - RNA, 22 nt, Bordetella pertussis
caucagcucgaccacggcggcu

SEQ ID NO: 2340841 - RNA, 19 nt, Bordetella pertussis
caucagcuggaucugguga

SEQ ID NO: 2340842 - RNA, 20 nt, Bordetella pertussis
caucagcuuggccaccacgc

SEQ ID NO: 2340843 - RNA, 22 nt, Bordetella pertussis
caucagcuuggccaccacgccc

SEQ ID NO: 2340844 - RNA, 17 nt, Bordetella pertussis
caucaggaacggcaugg

SEQ ID NO: 2340845 - RNA, 22 nt, Bordetella pertussis
caucaggcccacgaugcgggca

SEQ ID NO: 2340846 - RNA, 19 nt, Bordetella pertussis
caucagggcgaugccgcag

SEQ ID NO: 2340847 - RNA, 15 nt, Bordetella pertussis
caucaggggcucggc

SEQ ID NO: 2340848 - RNA, 20 nt, Bordetella pertussis
caucaggggcucggccaggu

SEQ ID NO: 2340849 - RNA, 22 nt, Bordetella pertussis
caucagguccacuucaccgcug

SEQ ID NO: 2340850 - RNA, 18 nt, Bordetella pertussis
caucaggucgaccugcuu

SEQ ID NO: 2340851 - RNA, 17 nt, Bordetella pertussis
caucaggugaaacagca

SEQ ID NO: 2340852 - RNA, 21 nt, Bordetella pertussis
caucaggugaaacagcagcgg

SEQ ID NO: 2340853 - RNA, 16 nt, Bordetella pertussis
caucagguuguccagc

SEQ ID NO: 2340854 - RNA, 22 nt, Bordetella pertussis
caucagguuguccagcgcgccc

SEQ ID NO: 2340855 - RNA, 13 nt, Bordetella pertussis
caucaucagcaug

SEQ ID NO: 2340856 - RNA, 15 nt, Bordetella pertussis
caucaucaucgucgg

SEQ ID NO: 2340857 - RNA, 18 nt, Bordetella pertussis
caucaucaucgucggcgc

SEQ ID NO: 2340858 - RNA, 18 nt, Bordetella pertussis
caucaucgccgacgcgcc

SEQ ID NO: 2340859 - RNA, 19 nt, Bordetella pertussis
caucaucgccgacgcgccg

SEQ ID NO: 2340860 - RNA, 14 nt, Bordetella pertussis
caucaucgcgcugg

SEQ ID NO: 2340861 - RNA, 20 nt, Bordetella pertussis
caucaucgcgcuggcgcgcg

SEQ ID NO: 2340862 - RNA, 15 nt, Bordetella pertussis
caucaucgucggcgc

SEQ ID NO: 2340863 - RNA, 17 nt, Bordetella pertussis
caucaucgucggcgcca

SEQ ID NO: 2340864 - RNA, 18 nt, Bordetella pertussis
caucaugaggcggcggua

SEQ ID NO: 2340865 - RNA, 16 nt, Bordetella pertussis
caucauggccagggcc

SEQ ID NO: 2340866 - RNA, 17 nt, Bordetella pertussis
caucauggccagggccg

SEQ ID NO: 2340867 - RNA, 13 nt, Bordetella pertussis
caucauggcgcgc

SEQ ID NO: 2340868 - RNA, 16 nt, Bordetella pertussis
caucauggcgcgcgcc

SEQ ID NO: 2340869 - RNA, 17 nt, Bordetella pertussis
caucauggcgcgcgccg

SEQ ID NO: 2340870 - RNA, 17 nt, Bordetella pertussis
caucauggcgucggcca

SEQ ID NO: 2340871 - RNA, 22 nt, Bordetella pertussis
caucaugggcgaagccacggcc

SEQ ID NO: 2340872 - RNA, 14 nt, Bordetella pertussis
cauccacggcgcca

SEQ ID NO: 2340873 - RNA, 17 nt, Bordetella pertussis
cauccacggcgccaugc

SEQ ID NO: 2340874 - RNA, 12 nt, Bordetella pertussis
cauccagccagg

SEQ ID NO: 2340875 - RNA, 13 nt, Bordetella pertussis
cauccagccgaug

SEQ ID NO: 2340876 - RNA, 18 nt, Bordetella pertussis
cauccagccgaugccgcu

SEQ ID NO: 2340877 - RNA, 14 nt, Bordetella pertussis
cauccagcgccagc

SEQ ID NO: 2340878 - RNA, 21 nt, Bordetella pertussis
cauccagcgccagcaccggca

SEQ ID NO: 2340879 - RNA, 20 nt, Bordetella pertussis
cauccagcgcgcgaucgcca

SEQ ID NO: 2340880 - RNA, 17 nt, Bordetella pertussis
cauccagcggacgggcc

SEQ ID NO: 2340881 - RNA, 20 nt, Bordetella pertussis
cauccagcggacgggccagg

SEQ ID NO: 2340882 - RNA, 21 nt, Bordetella pertussis
cauccagcggacgggccaggc

SEQ ID NO: 2340883 - RNA, 23 nt, Bordetella pertussis
cauccagcggacgggccaggccg

SEQ ID NO: 2340884 - RNA, 17 nt, Bordetella pertussis
cauccagcucggcgaug

SEQ ID NO: 2340885 - RNA, 14 nt, Bordetella pertussis
cauccaggcgcuca

SEQ ID NO: 2340886 - RNA, 22 nt, Bordetella pertussis
cauccaggcgcucaagggccug

SEQ ID NO: 2340887 - RNA, 15 nt, Bordetella pertussis
cauccagguacgacc

SEQ ID NO: 2340888 - RNA, 15 nt, Bordetella pertussis
cauccaggugccgcg

SEQ ID NO: 2340889 - RNA, 13 nt, Bordetella pertussis
cauccagguggcg

SEQ ID NO: 2340890 - RNA, 20 nt, Bordetella pertussis
cauccagguggcggacaggc

SEQ ID NO: 2340891 - RNA, 14 nt, Bordetella pertussis
cauccaucuggugg

SEQ ID NO: 2340892 - RNA, 14 nt, Bordetella pertussis
caucccaauuggcc

SEQ ID NO: 2340893 - RNA, 19 nt, Bordetella pertussis
caucccaauuggccgcccu

SEQ ID NO: 2340894 - RNA, 18 nt, Bordetella pertussis
caucccagacagccacgc

SEQ ID NO: 2340895 - RNA, 13 nt, Bordetella pertussis
cauccccagcgcc

SEQ ID NO: 2340896 - RNA, 15 nt, Bordetella pertussis
cauccccagcgccgc

SEQ ID NO: 2340897 - RNA, 18 nt, Bordetella pertussis
caucccgacaugccgccc

SEQ ID NO: 2340898 - RNA, 14 nt, Bordetella pertussis
caucccgauuucgg

SEQ ID NO: 2340899 - RNA, 21 nt, Bordetella pertussis
caucccgauuucggagcggcu

SEQ ID NO: 2340900 - RNA, 15 nt, Bordetella pertussis
caucccgcccccgcc

SEQ ID NO: 2340901 - RNA, 15 nt, Bordetella pertussis
caucccuugagcgug

SEQ ID NO: 2340902 - RNA, 19 nt, Bordetella pertussis
caucccuugagcguggcgu

SEQ ID NO: 2340903 - RNA, 18 nt, Bordetella pertussis
cauccgacagauggcgcu

SEQ ID NO: 2340904 - RNA, 21 nt, Bordetella pertussis
cauccgcgccacacgggcgcc

SEQ ID NO: 2340905 - RNA, 14 nt, Bordetella pertussis
cauccgcgccagga

SEQ ID NO: 2340906 - RNA, 13 nt, Bordetella pertussis
cauccgcgcugcu

SEQ ID NO: 2340907 - RNA, 22 nt, Bordetella pertussis
cauccggaaacuggcuaaaagg

SEQ ID NO: 2340908 - RNA, 13 nt, Bordetella pertussis
cauccggccacgc

SEQ ID NO: 2340909 - RNA, 16 nt, Bordetella pertussis
cauccggcccagcgcc

SEQ ID NO: 2340910 - RNA, 17 nt, Bordetella pertussis
cauccggcccagcgcca

SEQ ID NO: 2340911 - RNA, 13 nt, Bordetella pertussis
cauccggcccggu

SEQ ID NO: 2340912 - RNA, 19 nt, Bordetella pertussis
cauccggcccggugcagcc

SEQ ID NO: 2340913 - RNA, 20 nt, Bordetella pertussis
cauccggugauuucggcgca

SEQ ID NO: 2340914 - RNA, 21 nt, Bordetella pertussis
cauccgguggugcugggcggc

SEQ ID NO: 2340915 - RNA, 15 nt, Bordetella pertussis
cauccguccgccagg

SEQ ID NO: 2340916 - RNA, 14 nt, Bordetella pertussis
cauccucaucgugc

SEQ ID NO: 2340917 - RNA, 18 nt, Bordetella pertussis
cauccucaucgugcucgu

SEQ ID NO: 2340918 - RNA, 19 nt, Bordetella pertussis
cauccucaucgugcucgug

SEQ ID NO: 2340919 - RNA, 20 nt, Bordetella pertussis
cauccucaucgugcucgugc

SEQ ID NO: 2340920 - RNA, 15 nt, Bordetella pertussis
cauccucgcccagcg

SEQ ID NO: 2340921 - RNA, 18 nt, Bordetella pertussis
cauccucgcccagcggcg

SEQ ID NO: 2340922 - RNA, 19 nt, Bordetella pertussis
cauccucgcccagcggcgc

SEQ ID NO: 2340923 - RNA, 21 nt, Bordetella pertussis
cauccucgggcgacuccagcc

SEQ ID NO: 2340924 - RNA, 14 nt, Bordetella pertussis
cauccugaugucgg

SEQ ID NO: 2340925 - RNA, 16 nt, Bordetella pertussis
cauccugaugucggcc

SEQ ID NO: 2340926 - RNA, 17 nt, Bordetella pertussis
cauccuggaugugcgcg

SEQ ID NO: 2340927 - RNA, 21 nt, Bordetella pertussis
cauccuggaugugcgcgggcg

SEQ ID NO: 2340928 - RNA, 22 nt, Bordetella pertussis
cauccuggaugugcgcgggcgc

SEQ ID NO: 2340929 - RNA, 23 nt, Bordetella pertussis
cauccuggccgauuucgcgcgcc

SEQ ID NO: 2340930 - RNA, 16 nt, Bordetella pertussis
cauccuggccgccgcg

SEQ ID NO: 2340931 - RNA, 18 nt, Bordetella pertussis
cauccugggcgcgcgcca

SEQ ID NO: 2340932 - RNA, 20 nt, Bordetella pertussis
cauccuggucgacgcgacgc

SEQ ID NO: 2340933 - RNA, 22 nt, Bordetella pertussis
cauccuuuuuguuuuggcgcac

SEQ ID NO: 2340934 - RNA, 21 nt, Bordetella pertussis
caucgaaggcaaucagcccgg

SEQ ID NO: 2340935 - RNA, 23 nt, Bordetella pertussis
caucgaauuugaacagccgcccc

SEQ ID NO: 2340936 - RNA, 15 nt, Bordetella pertussis
caucgacagcgcgcc

SEQ ID NO: 2340937 - RNA, 16 nt, Bordetella pertussis
caucgacagcgcgccc

SEQ ID NO: 2340938 - RNA, 19 nt, Bordetella pertussis
caucgacagcgcgcccgcu

SEQ ID NO: 2340939 - RNA, 17 nt, Bordetella pertussis
caucgacaugcccgccg

SEQ ID NO: 2340940 - RNA, 15 nt, Bordetella pertussis
caucgaccaccagcg

SEQ ID NO: 2340941 - RNA, 17 nt, Bordetella pertussis
caucgaccaccagcggc

SEQ ID NO: 2340942 - RNA, 16 nt, Bordetella pertussis
caucgaccacgcgcgc

SEQ ID NO: 2340943 - RNA, 20 nt, Bordetella pertussis
caucgaccacgcgcgcgccg

SEQ ID NO: 2340944 - RNA, 21 nt, Bordetella pertussis
caucgaccacgcgcgcgccgc

SEQ ID NO: 2340945 - RNA, 16 nt, Bordetella pertussis
caucgaccagcgcacg

SEQ ID NO: 2340946 - RNA, 21 nt, Bordetella pertussis
caucgaccgcauagcgcauga

SEQ ID NO: 2340947 - RNA, 14 nt, Bordetella pertussis
caucgacgcggcga

SEQ ID NO: 2340948 - RNA, 14 nt, Bordetella pertussis
caucgacgggcggc

SEQ ID NO: 2340949 - RNA, 18 nt, Bordetella pertussis
caucgagaaaccagccgc

SEQ ID NO: 2340950 - RNA, 19 nt, Bordetella pertussis
caucguacgcgugggcggc

SEQ ID NO: 2340951 - RNA, 18 nt, Bordetella pertussis
caucguaguugggcgccu

SEQ ID NO: 2340952 - RNA, 19 nt, Bordetella pertussis
caucguaguugggcgccuu

SEQ ID NO: 2340953 - RNA, 23 nt, Bordetella pertussis
caucguauggcggggugccuguc

SEQ ID NO: 2340954 - RNA, 15 nt, Bordetella pertussis
caucgucaggcaggc

SEQ ID NO: 2340955 - RNA, 18 nt, Bordetella pertussis
caucgucaggcaggcgcg

SEQ ID NO: 2340956 - RNA, 19 nt, Bordetella pertussis
caucgucaggcaggcgcgc

SEQ ID NO: 2340957 - RNA, 19 nt, Bordetella pertussis
caucgucgaggaugcgagc

SEQ ID NO: 2340958 - RNA, 20 nt, Bordetella pertussis
caucgucgcgcugcgacagc

SEQ ID NO: 2340959 - RNA, 14 nt, Bordetella pertussis
caucgugcgcgauc

SEQ ID NO: 2340960 - RNA, 19 nt, Bordetella pertussis
caucgugcgcgaucuugcc

SEQ ID NO: 2340961 - RNA, 21 nt, Bordetella pertussis
caucgugcgcgaucuugccgc

SEQ ID NO: 2340962 - RNA, 17 nt, Bordetella pertussis
caucgugcucgugcugg

SEQ ID NO: 2340963 - RNA, 14 nt, Bordetella pertussis
caucguugccuggg

SEQ ID NO: 2340964 - RNA, 14 nt, Bordetella pertussis
caucuacagcgccu

SEQ ID NO: 2340965 - RNA, 15 nt, Bordetella pertussis
caucuacagcgccug

SEQ ID NO: 2340966 - RNA, 21 nt, Bordetella pertussis
caucuacgugcuggacccgcu

SEQ ID NO: 2340967 - RNA, 15 nt, Bordetella pertussis
caucuaugucggcua

SEQ ID NO: 2340968 - RNA, 19 nt, Bordetella pertussis
caucucaaccacgaacacg

SEQ ID NO: 2340969 - RNA, 16 nt, Bordetella pertussis
caucucccgcaggccc

SEQ ID NO: 2340970 - RNA, 17 nt, Bordetella pertussis
caucucccgcaggccca

SEQ ID NO: 2340971 - RNA, 20 nt, Bordetella pertussis
caucucgaagcgcucguccu

SEQ ID NO: 2340972 - RNA, 14 nt, Bordetella pertussis
caucucgaugcggu

SEQ ID NO: 2340973 - RNA, 23 nt, Bordetella pertussis
caucucgaugcggucggccgcgc

SEQ ID NO: 2340974 - RNA, 20 nt, Bordetella pertussis
caucucgaugggauacgccg

SEQ ID NO: 2340975 - RNA, 15 nt, Bordetella pertussis
caucucgcggcggua

SEQ ID NO: 2340976 - RNA, 15 nt, Bordetella pertussis
caucucggccgcggc

SEQ ID NO: 2340977 - RNA, 15 nt, Bordetella pertussis
caucugccagggaau

SEQ ID NO: 2340978 - RNA, 19 nt, Bordetella pertussis
caucugcggcaccucggcc

SEQ ID NO: 2340979 - RNA, 20 nt, Bordetella pertussis
caucugcggcaccucggccg

SEQ ID NO: 2340980 - RNA, 13 nt, Bordetella pertussis
caucugcggcacg

SEQ ID NO: 2340981 - RNA, 20 nt, Bordetella pertussis
caucuggaccgcgcgcgacg

SEQ ID NO: 2340982 - RNA, 22 nt, Bordetella pertussis
caucuggaccgcgcgcgacgac

SEQ ID NO: 2340983 - RNA, 14 nt, Bordetella pertussis
caucuggcgcaugg

SEQ ID NO: 2340984 - RNA, 19 nt, Bordetella pertussis
caucugguugagcagcacc

SEQ ID NO: 2340985 - RNA, 18 nt, Bordetella pertussis
caucuguacggccggcuc

SEQ ID NO: 2340986 - RNA, 16 nt, Bordetella pertussis
caucuguccugauuca

SEQ ID NO: 2340987 - RNA, 14 nt, Bordetella pertussis
caucuucgugcugg

SEQ ID NO: 2340988 - RNA, 16 nt, Bordetella pertussis
caucuucgugcuggcc

SEQ ID NO: 2340989 - RNA, 18 nt, Bordetella pertussis
caucuugccggccuguuc

SEQ ID NO: 2340990 - RNA, 14 nt, Bordetella pertussis
caucuugcgccgcu

SEQ ID NO: 2340991 - RNA, 17 nt, Bordetella pertussis
caucuugcgccgcugcg

SEQ ID NO: 2340992 - RNA, 15 nt, Bordetella pertussis
caucuuggugcgcgc

SEQ ID NO: 2340993 - RNA, 23 nt, Bordetella pertussis
caucuuggugcgcgccaggucgc

SEQ ID NO: 2340994 - RNA, 21 nt, Bordetella pertussis
caugaaacggcaagagccugg

SEQ ID NO: 2340995 - RNA, 22 nt, Bordetella pertussis
caugaaaugcuggucgcgcacc

SEQ ID NO: 2340996 - RNA, 23 nt, Bordetella pertussis
caugaaaugcuggucgcgcaccu

SEQ ID NO: 2340997 - RNA, 19 nt, Bordetella pertussis
caugaacacuugacggcca

SEQ ID NO: 2340998 - RNA, 20 nt, Bordetella pertussis
caugaacacuugacggccaa

SEQ ID NO: 2340999 - RNA, 20 nt, Bordetella pertussis
caugaacaggcacgacgcga

SEQ ID NO: 2341000 - RNA, 17 nt, Bordetella pertussis
caugaaccgcagcgcca

SEQ ID NO: 2341001 - RNA, 15 nt, Bordetella pertussis
caugaacgcuugacg

SEQ ID NO: 2341002 - RNA, 22 nt, Bordetella pertussis
caugaacgcuugacggccagga

SEQ ID NO: 2341003 - RNA, 16 nt, Bordetella pertussis
caugaacggcagcgcg

SEQ ID NO: 2341004 - RNA, 17 nt, Bordetella pertussis
caugaagcgguggcggc

SEQ ID NO: 2341005 - RNA, 16 nt, Bordetella pertussis
caugaaggcggccagc

SEQ ID NO: 2341006 - RNA, 17 nt, Bordetella pertussis
caugaauaugcgcccga

SEQ ID NO: 2341007 - RNA, 19 nt, Bordetella pertussis
caugacaugcgggccucga

SEQ ID NO: 2341008 - RNA, 21 nt, Bordetella pertussis
caugacaugcgggccucgacg

SEQ ID NO: 2341009 - RNA, 15 nt, Bordetella pertussis
caugaccagcggcgu

SEQ ID NO: 2341010 - RNA, 15 nt, Bordetella pertussis
caugaccaucgcgca

SEQ ID NO: 2341011 - RNA, 12 nt, Bordetella pertussis
caugaccgccgc

SEQ ID NO: 2341012 - RNA, 14 nt, Bordetella pertussis
caugaccgccgcca

SEQ ID NO: 2341013 - RNA, 16 nt, Bordetella pertussis
caugaccgccgccagc

SEQ ID NO: 2341014 - RNA, 17 nt, Bordetella pertussis
caugaccgccgccagca

SEQ ID NO: 2341015 - RNA, 20 nt, Bordetella pertussis
caugaccgccgccagcagcg

SEQ ID NO: 2341016 - RNA, 15 nt, Bordetella pertussis
caugaccgccgcgcc

SEQ ID NO: 2341017 - RNA, 18 nt, Bordetella pertussis
caugaccgccgcgccggu

SEQ ID NO: 2341018 - RNA, 19 nt, Bordetella pertussis
caugaccgccggcaccagc

SEQ ID NO: 2341019 - RNA, 16 nt, Bordetella pertussis
caugaccgcguccgcg

SEQ ID NO: 2341020 - RNA, 20 nt, Bordetella pertussis
caugaccggcguguccagcg

SEQ ID NO: 2341021 - RNA, 17 nt, Bordetella pertussis
caugaccugcgacagca

SEQ ID NO: 2341022 - RNA, 18 nt, Bordetella pertussis
caugaccugcgacagcac

SEQ ID NO: 2341023 - RNA, 20 nt, Bordetella pertussis
caugaccugcgacagcaccg

SEQ ID NO: 2341024 - RNA, 15 nt, Bordetella pertussis
caugacgaccuugcg

SEQ ID NO: 2341025 - RNA, 17 nt, Bordetella pertussis
caugacgaccuugcggc

SEQ ID NO: 2341026 - RNA, 20 nt, Bordetella pertussis
caugacgauggucuugccgc

SEQ ID NO: 2341027 - RNA, 17 nt, Bordetella pertussis
caugacggccaggaugg

SEQ ID NO: 2341028 - RNA, 20 nt, Bordetella pertussis
caugacggcgucgagcacgc

SEQ ID NO: 2341029 - RNA, 21 nt, Bordetella pertussis
caugacgggcggcggcgcgcg

SEQ ID NO: 2341030 - RNA, 22 nt, Bordetella pertussis
caugacgggcggcggcgcgcgc

SEQ ID NO: 2341031 - RNA, 23 nt, Bordetella pertussis
caugacgggcggcggcgcgcgcg

SEQ ID NO: 2341032 - RNA, 13 nt, Bordetella pertussis
caugacggggccu

SEQ ID NO: 2341033 - RNA, 14 nt, Bordetella pertussis
caugacggugccga

SEQ ID NO: 2341034 - RNA, 18 nt, Bordetella pertussis
caugacggugccgagcag

SEQ ID NO: 2341035 - RNA, 14 nt, Bordetella pertussis
caugacguccagcg

SEQ ID NO: 2341036 - RNA, 18 nt, Bordetella pertussis
caugacguccagcgccac

SEQ ID NO: 2341037 - RNA, 17 nt, Bordetella pertussis
ccaagcugcgcgaggac

SEQ ID NO: 2341038 - RNA, 21 nt, Bordetella pertussis
ccaagcuggagaagcgccgcg

SEQ ID NO: 2341039 - RNA, 19 nt, Bordetella pertussis
ccaaggaaagcccggcccc

SEQ ID NO: 2341040 - RNA, 19 nt, Bordetella pertussis
ccaaggcauuggcgccgcg

SEQ ID NO: 2341041 - RNA, 16 nt, Bordetella pertussis
ccaagggcgcgccagc

SEQ ID NO: 2341042 - RNA, 15 nt, Bordetella pertussis
ccaaggugccugucc

SEQ ID NO: 2341043 - RNA, 22 nt, Bordetella pertussis
ccaagucgaguucggcgcgccc

SEQ ID NO: 2341044 - RNA, 20 nt, Bordetella pertussis
ccaauagcgguggcgggcca

SEQ ID NO: 2341045 - RNA, 15 nt, Bordetella pertussis
ccaauccgaucagca

SEQ ID NO: 2341046 - RNA, 16 nt, Bordetella pertussis
ccaauccgaucagcac

SEQ ID NO: 2341047 - RNA, 19 nt, Bordetella pertussis
ccaauccgaucagcacgau

SEQ ID NO: 2341048 - RNA, 11 nt, Bordetella pertussis
ccaaucggcgu

SEQ ID NO: 2341049 - RNA, 15 nt, Bordetella pertussis
ccaaugccaggguga

SEQ ID NO: 2341050 - RNA, 16 nt, Bordetella pertussis
ccaauggccgcggcgu

SEQ ID NO: 2341051 - RNA, 15 nt, Bordetella pertussis
ccaaugugcugacgg

SEQ ID NO: 2341052 - RNA, 17 nt, Bordetella pertussis
ccaauugcuugccuguc

SEQ ID NO: 2341053 - RNA, 14 nt, Bordetella pertussis
ccaauuggccgccc

SEQ ID NO: 2341054 - RNA, 19 nt, Bordetella pertussis
ccacaagccguacagcgaa

SEQ ID NO: 2341055 - RNA, 18 nt, Bordetella pertussis
ccacaagcggccccaggu

SEQ ID NO: 2341056 - RNA, 22 nt, Bordetella pertussis
ccacaaggauggacuggccgcg

SEQ ID NO: 2341057 - RNA, 14 nt, Bordetella pertussis
ccacaauugccagc

SEQ ID NO: 2341058 - RNA, 14 nt, Bordetella pertussis
ccacaccaucaaga

SEQ ID NO: 2341059 - RNA, 15 nt, Bordetella pertussis
ccacacgaucagcgc

SEQ ID NO: 2341060 - RNA, 19 nt, Bordetella pertussis
ccacacgaucagcgcccag

SEQ ID NO: 2341061 - RNA, 20 nt, Bordetella pertussis
ccacacgcgguagguagcgc

SEQ ID NO: 2341062 - RNA, 23 nt, Bordetella pertussis
ccacacgcgguagguagcgcgca

SEQ ID NO: 2341063 - RNA, 16 nt, Bordetella pertussis
ccacacgggcgccugc

SEQ ID NO: 2341064 - RNA, 17 nt, Bordetella pertussis
ccacacgggcgccugcc

SEQ ID NO: 2341065 - RNA, 16 nt, Bordetella pertussis
ccacacuuggccggcg

SEQ ID NO: 2341066 - RNA, 16 nt, Bordetella pertussis
ccacagauuggccacc

SEQ ID NO: 2341067 - RNA, 17 nt, Bordetella pertussis
ccacagauuggccacca

SEQ ID NO: 2341068 - RNA, 15 nt, Bordetella pertussis
ccacagcagcgcgcc

SEQ ID NO: 2341069 - RNA, 16 nt, Bordetella pertussis
ccacagcagcgcgccg

SEQ ID NO: 2341070 - RNA, 19 nt, Bordetella pertussis
ccacagcagcgcgccgccg

SEQ ID NO: 2341071 - RNA, 11 nt, Bordetella pertussis
ccacagccagg

SEQ ID NO: 2341072 - RNA, 14 nt, Bordetella pertussis
ccacagccaggccg

SEQ ID NO: 2341073 - RNA, 15 nt, Bordetella pertussis
ccacagccaggccga

SEQ ID NO: 2341074 - RNA, 16 nt, Bordetella pertussis
ccacagcccggccccc

SEQ ID NO: 2341075 - RNA, 18 nt, Bordetella pertussis
ccacagcccggcccccag

SEQ ID NO: 2341076 - RNA, 19 nt, Bordetella pertussis
ccacagcccggcccccagc

SEQ ID NO: 2341077 - RNA, 12 nt, Bordetella pertussis
ccacagcgcccc

SEQ ID NO: 2341078 - RNA, 16 nt, Bordetella pertussis
ccacagcgcguggccg

SEQ ID NO: 2341079 - RNA, 23 nt, Bordetella pertussis
ccacagcgugacggcggcgcgcg

SEQ ID NO: 2341080 - RNA, 19 nt, Bordetella pertussis
ccacagcuggugccgguug

SEQ ID NO: 2341081 - RNA, 16 nt, Bordetella pertussis
ccacaggaacaggccg

SEQ ID NO: 2341082 - RNA, 17 nt, Bordetella pertussis
ccacaggaacaggccgg

SEQ ID NO: 2341083 - RNA, 21 nt, Bordetella pertussis
ccacaggagacuggcagugcg

SEQ ID NO: 2341084 - RNA, 12 nt, Bordetella pertussis
ccacaggcgcgc

SEQ ID NO: 2341085 - RNA, 13 nt, Bordetella pertussis
ccacaggcgcgcg

SEQ ID NO: 2341086 - RNA, 17 nt, Bordetella pertussis
ccacaggcugacgcccg

SEQ ID NO: 2341087 - RNA, 19 nt, Bordetella pertussis
ccacaggcugacgcccggc

SEQ ID NO: 2341088 - RNA, 22 nt, Bordetella pertussis
ccacaggcugacgcccggcucg

SEQ ID NO: 2341089 - RNA, 15 nt, Bordetella pertussis
ccacagggcgaaggc

SEQ ID NO: 2341090 - RNA, 14 nt, Bordetella pertussis
ccacagggggacug

SEQ ID NO: 2341091 - RNA, 21 nt, Bordetella pertussis
ccacagggggacuggcacccg

SEQ ID NO: 2341092 - RNA, 16 nt, Bordetella pertussis
ccacaggguggcgccc

SEQ ID NO: 2341093 - RNA, 17 nt, Bordetella pertussis
ccacaggguggcgccca

SEQ ID NO: 2341094 - RNA, 19 nt, Bordetella pertussis
ccacaggguggcgcccagg

SEQ ID NO: 2341095 - RNA, 22 nt, Bordetella pertussis
ccacaggugcgcggcgcgccgu

SEQ ID NO: 2341096 - RNA, 16 nt, Bordetella pertussis
ccacagguuggccgcg

SEQ ID NO: 2341097 - RNA, 16 nt, Bordetella pertussis
ccacagucggucgccg

SEQ ID NO: 2341098 - RNA, 17 nt, Bordetella pertussis
ccacagucggucgccgc

SEQ ID NO: 2341099 - RNA, 18 nt, Bordetella pertussis
ccacagucggucgccgca

SEQ ID NO: 2341100 - RNA, 22 nt, Bordetella pertussis
ccacagucggucgccgcaguuc

SEQ ID NO: 2341101 - RNA, 16 nt, Bordetella pertussis
ccacaguucggccagc

SEQ ID NO: 2341102 - RNA, 17 nt, Bordetella pertussis
ccacaguucggccagcg

SEQ ID NO: 2341103 - RNA, 18 nt, Bordetella pertussis
ccacaguucggccagcgg

SEQ ID NO: 2341104 - RNA, 22 nt, Bordetella pertussis
ccacaguucggccagcggcagg

SEQ ID NO: 2341105 - RNA, 15 nt, Bordetella pertussis
ccacauaaucgucgg

SEQ ID NO: 2341106 - RNA, 14 nt, Bordetella pertussis
ccacauagcggccg

SEQ ID NO: 2341107 - RNA, 20 nt, Bordetella pertussis
ccacauagcggccggcgcgc

SEQ ID NO: 2341108 - RNA, 15 nt, Bordetella pertussis
ccacauccgcgcugc

SEQ ID NO: 2341109 - RNA, 19 nt, Bordetella pertussis
ccacauccgcgcugcugcc

SEQ ID NO: 2341110 - RNA, 13 nt, Bordetella pertussis
ccacaucgaaggc

SEQ ID NO: 2341111 - RNA, 15 nt, Bordetella pertussis
ccacaucgccggcgg

SEQ ID NO: 2341112 - RNA, 13 nt, Bordetella pertussis
ccacaucgucgcg

SEQ ID NO: 2341113 - RNA, 12 nt, Bordetella pertussis
ccacauggcggc

SEQ ID NO: 2341114 - RNA, 17 nt, Bordetella pertussis
ccacauggucgcccagc

SEQ ID NO: 2341115 - RNA, 12 nt, Bordetella pertussis
ccaccaccaggc

SEQ ID NO: 2341116 - RNA, 14 nt, Bordetella pertussis
ccaccaccaucugc

SEQ ID NO: 2341117 - RNA, 14 nt, Bordetella pertussis
ccaccaccaugugc

SEQ ID NO: 2341118 - RNA, 16 nt, Bordetella pertussis
ccaccacccaggccca

SEQ ID NO: 2341119 - RNA, 17 nt, Bordetella pertussis
ccaccacccaggcccag

SEQ ID NO: 2341120 - RNA, 17 nt, Bordetella pertussis
ccaccaccggcacgccg

SEQ ID NO: 2341121 - RNA, 17 nt, Bordetella pertussis
ccaccaccucggccucg

SEQ ID NO: 2341122 - RNA, 15 nt, Bordetella pertussis
ccaccaccucguccg

SEQ ID NO: 2341123 - RNA, 12 nt, Bordetella pertussis
ccaccacgccca

SEQ ID NO: 2341124 - RNA, 14 nt, Bordetella pertussis
ccaccacgccgccc

SEQ ID NO: 2341125 - RNA, 18 nt, Bordetella pertussis
ccaccacgcgcaccagcu

SEQ ID NO: 2341126 - RNA, 14 nt, Bordetella pertussis
ccaccacgcuggcu

SEQ ID NO: 2341127 - RNA, 13 nt, Bordetella pertussis
ccaccacggcgcg

SEQ ID NO: 2341128 - RNA, 23 nt, Bordetella pertussis
ccaccacggcgggaucgggcagc

SEQ ID NO: 2341129 - RNA, 19 nt, Bordetella pertussis
ccaccacugcaaggcccgc

SEQ ID NO: 2341130 - RNA, 11 nt, Bordetella pertussis
ccaccagcacc

SEQ ID NO: 2341131 - RNA, 15 nt, Bordetella pertussis
ccaccagcaccaugc

SEQ ID NO: 2341132 - RNA, 18 nt, Bordetella pertussis
ccaccagcaccgaugcgc

SEQ ID NO: 2341133 - RNA, 15 nt, Bordetella pertussis
ccaccagcagcgcca

SEQ ID NO: 2341134 - RNA, 14 nt, Bordetella pertussis
ccaccagccgcccg

SEQ ID NO: 2341135 - RNA, 15 nt, Bordetella pertussis
ccaccagccgcccgg

SEQ ID NO: 2341136 - RNA, 17 nt, Bordetella pertussis
ccaccagccgcccggcg

SEQ ID NO: 2341137 - RNA, 17 nt, Bordetella pertussis
ccaccagccggccgccg

SEQ ID NO: 2341138 - RNA, 17 nt, Bordetella pertussis
ccaccagccgggcggcc

SEQ ID NO: 2341139 - RNA, 15 nt, Bordetella pertussis
ccaccagcgccacgc

SEQ ID NO: 2341140 - RNA, 14 nt, Bordetella pertussis
ccaccagcggcgcc

SEQ ID NO: 2341141 - RNA, 15 nt, Bordetella pertussis
ccaccagcggcgccg

SEQ ID NO: 2341142 - RNA, 15 nt, Bordetella pertussis
ccaccagcggcgugc

SEQ ID NO: 2341143 - RNA, 17 nt, Bordetella pertussis
ccaccagcggcgugcgg

SEQ ID NO: 2341144 - RNA, 22 nt, Bordetella pertussis
ccaccagcggcgugcggcccag

SEQ ID NO: 2341145 - RNA, 23 nt, Bordetella pertussis
ccaccagcggcguggcggccagg

SEQ ID NO: 2341146 - RNA, 21 nt, Bordetella pertussis
ccaccagcgucaccagcaggc

SEQ ID NO: 2341147 - RNA, 17 nt, Bordetella pertussis
ccaccagcuugcgcgcc

SEQ ID NO: 2341148 - RNA, 18 nt, Bordetella pertussis
ccaccagcuugcgcgccg

SEQ ID NO: 2341149 - RNA, 20 nt, Bordetella pertussis
ccacgaccuuggcggccgac

SEQ ID NO: 2341150 - RNA, 16 nt, Bordetella pertussis
ccacgacggucugggc

SEQ ID NO: 2341151 - RNA, 22 nt, Bordetella pertussis
ccacgacggucugggccaugcc

SEQ ID NO: 2341152 - RNA, 23 nt, Bordetella pertussis
ccacgacggucugggccaugccg

SEQ ID NO: 2341153 - RNA, 23 nt, Bordetella pertussis
ccacgacguagucggcgcccagc

SEQ ID NO: 2341154 - RNA, 16 nt, Bordetella pertussis
ccacggccggcgcacg

SEQ ID NO: 2341155 - RNA, 17 nt, Bordetella pertussis
ccacggccggcgcacgc

SEQ ID NO: 2341156 - RNA, 15 nt, Bordetella pertussis
ccacggccugcccgg

SEQ ID NO: 2341157 - RNA, 16 nt, Bordetella pertussis
ccacggccugcccggg

SEQ ID NO: 2341158 - RNA, 17 nt, Bordetella pertussis
ccacggccugcgcgccg

SEQ ID NO: 2341159 - RNA, 22 nt, Bordetella pertussis
ccacggcgaugaacagcggcac

SEQ ID NO: 2341160 - RNA, 16 nt, Bordetella pertussis
ccacggcgauggccga

SEQ ID NO: 2341161 - RNA, 19 nt, Bordetella pertussis
ccacggcgccaaagcacag

SEQ ID NO: 2341162 - RNA, 21 nt, Bordetella pertussis
ccacggcgccaaagcacagga

SEQ ID NO: 2341163 - RNA, 17 nt, Bordetella pertussis
ccacggcgccaugccgg

SEQ ID NO: 2341164 - RNA, 16 nt, Bordetella pertussis
ccacggcgcccgaggc

SEQ ID NO: 2341165 - RNA, 13 nt, Bordetella pertussis
ccacggcgcgccc

SEQ ID NO: 2341166 - RNA, 15 nt, Bordetella pertussis
ccacggcgcgcccgc

SEQ ID NO: 2341167 - RNA, 21 nt, Bordetella pertussis
ccacggcgcgcccgcaggcgg

SEQ ID NO: 2341168 - RNA, 12 nt, Bordetella pertussis
ccacggcgcgcg

SEQ ID NO: 2341169 - RNA, 13 nt, Bordetella pertussis
ccacggcgcggau

SEQ ID NO: 2341170 - RNA, 15 nt, Bordetella pertussis
ccacggcggccaggc

SEQ ID NO: 2341171 - RNA, 16 nt, Bordetella pertussis
ccacggcggccaggcc

SEQ ID NO: 2341172 - RNA, 20 nt, Bordetella pertussis
ccacggcggccaggccggcg

SEQ ID NO: 2341173 - RNA, 17 nt, Bordetella pertussis
ccacggcggcuucggcc

SEQ ID NO: 2341174 - RNA, 18 nt, Bordetella pertussis
ccacggcggcuucggccg

SEQ ID NO: 2341175 - RNA, 22 nt, Bordetella pertussis
ccacggcggcuucggccgucag

SEQ ID NO: 2341176 - RNA, 15 nt, Bordetella pertussis
ccacggcgggccggc

SEQ ID NO: 2341177 - RNA, 17 nt, Bordetella pertussis
ccacggcgggccggcuc

SEQ ID NO: 2341178 - RNA, 22 nt, Bordetella pertussis
ccacggcggugaccaccaggcc

SEQ ID NO: 2341179 - RNA, 23 nt, Bordetella pertussis
ccacggcggugaccaccaggccg

SEQ ID NO: 2341180 - RNA, 22 nt, Bordetella pertussis
ccacggcggugaucugcucgcc

SEQ ID NO: 2341181 - RNA, 16 nt, Bordetella pertussis
ccacggcgucgaugcg

SEQ ID NO: 2341182 - RNA, 17 nt, Bordetella pertussis
ccacggcgucgaugcgc

SEQ ID NO: 2341183 - RNA, 14 nt, Bordetella pertussis
ccacggcgucgccg

SEQ ID NO: 2341184 - RNA, 18 nt, Bordetella pertussis
ccacggcgucgccggcca

SEQ ID NO: 2341185 - RNA, 19 nt, Bordetella pertussis
ccacggcgucgccggccag

SEQ ID NO: 2341186 - RNA, 16 nt, Bordetella pertussis
ccacggcguggcgcgc

SEQ ID NO: 2341187 - RNA, 17 nt, Bordetella pertussis
ccacggcguggcgcgcc

SEQ ID NO: 2341188 - RNA, 19 nt, Bordetella pertussis
ccacggcguggcgcgcccg

SEQ ID NO: 2341189 - RNA, 19 nt, Bordetella pertussis
ccacggcuucgcccagcgc

SEQ ID NO: 2341190 - RNA, 23 nt, Bordetella pertussis
ccacggcuugcgcguaggcgcgc

SEQ ID NO: 2341191 - RNA, 18 nt, Bordetella pertussis
ccacggcuuuggcguagc

SEQ ID NO: 2341192 - RNA, 13 nt, Bordetella pertussis
ccacgggaccgcu

SEQ ID NO: 2341193 - RNA, 23 nt, Bordetella pertussis
ccacgggauguccgcgucggccg

SEQ ID NO: 2341194 - RNA, 20 nt, Bordetella pertussis
ccacgggcacgauggccgcg

SEQ ID NO: 2341195 - RNA, 15 nt, Bordetella pertussis
ccacgggcccgcgca

SEQ ID NO: 2341196 - RNA, 15 nt, Bordetella pertussis
ccacgggcgucaccg

SEQ ID NO: 2341197 - RNA, 23 nt, Bordetella pertussis
ccacgggcgucaccggcgagccg

SEQ ID NO: 2341198 - RNA, 18 nt, Bordetella pertussis
ccacggggacuggcuccc

SEQ ID NO: 2341199 - RNA, 16 nt, Bordetella pertussis
ccacggucugcacgcc

SEQ ID NO: 2341200 - RNA, 17 nt, Bordetella pertussis
ccacggucugcacgccg

SEQ ID NO: 2341201 - RNA, 19 nt, Bordetella pertussis
ccacggucugcacgccggg

SEQ ID NO: 2341202 - RNA, 22 nt, Bordetella pertussis
ccacguagguggucagcauggu

SEQ ID NO: 2341203 - RNA, 23 nt, Bordetella pertussis
ccacgucacggaucagccgcuug

SEQ ID NO: 2341204 - RNA, 20 nt, Bordetella pertussis
ccacgucauaggcuucgccc

SEQ ID NO: 2341205 - RNA, 22 nt, Bordetella pertussis
ccacgucauaggcuucgcccgc

SEQ ID NO: 2341206 - RNA, 13 nt, Bordetella pertussis
ccacguccagcac

SEQ ID NO: 2341207 - RNA, 17 nt, Bordetella pertussis
ccacguccuggggcgcg

SEQ ID NO: 2341208 - RNA, 18 nt, Bordetella pertussis
ccacgucgaucaggccca

SEQ ID NO: 2341209 - RNA, 22 nt, Bordetella pertussis
ccacgucgccggcguucuucag

SEQ ID NO: 2341210 - RNA, 18 nt, Bordetella pertussis
ccacgucgcggcugggca

SEQ ID NO: 2341211 - RNA, 13 nt, Bordetella pertussis
ccacgucggcggc

SEQ ID NO: 2341212 - RNA, 15 nt, Bordetella pertussis
ccacgucggcggccg

SEQ ID NO: 2341213 - RNA, 16 nt, Bordetella pertussis
ccacgucggcggccgc

SEQ ID NO: 2341214 - RNA, 19 nt, Bordetella pertussis
ccacgucggucgcuuccag

SEQ ID NO: 2341215 - RNA, 17 nt, Bordetella pertussis
ccacgucggugggaauc

SEQ ID NO: 2341216 - RNA, 23 nt, Bordetella pertussis
ccacgucgucgaugccgaccagg

SEQ ID NO: 2341217 - RNA, 14 nt, Bordetella pertussis
ccacgugcggcagg

SEQ ID NO: 2341218 - RNA, 13 nt, Bordetella pertussis
ccacgugcugcug

SEQ ID NO: 2341219 - RNA, 17 nt, Bordetella pertussis
ccacgugcugcuggaga

SEQ ID NO: 2341220 - RNA, 13 nt, Bordetella pertussis
ccacguggacagg

SEQ ID NO: 2341221 - RNA, 16 nt, Bordetella pertussis
ccacguggacaggcac

SEQ ID NO: 2341222 - RNA, 22 nt, Bordetella pertussis
ccacguggcgacgucgggcagg

SEQ ID NO: 2341223 - RNA, 23 nt, Bordetella pertussis
ccacguguggcaggccagcgcca

SEQ ID NO: 2341224 - RNA, 17 nt, Bordetella pertussis
ccacguugaagcgcagc

SEQ ID NO: 2341225 - RNA, 18 nt, Bordetella pertussis
ccacguugauccagcgcu

SEQ ID NO: 2341226 - RNA, 17 nt, Bordetella pertussis
ccacuaucagcgcguca

SEQ ID NO: 2341227 - RNA, 17 nt, Bordetella pertussis
ccacucacgcaaggccg

SEQ ID NO: 2341228 - RNA, 18 nt, Bordetella pertussis
ccacucacgcaaggccga

SEQ ID NO: 2341229 - RNA, 15 nt, Bordetella pertussis
ccacucaugcgcugc

SEQ ID NO: 2341230 - RNA, 20 nt, Bordetella pertussis
ccacucgaugggcgcgcgca

SEQ ID NO: 2341231 - RNA, 17 nt, Bordetella pertussis
ccacucggugcgcgcgc

SEQ ID NO: 2341232 - RNA, 18 nt, Bordetella pertussis
ccacucggugcgcgcgcc

SEQ ID NO: 2341233 - RNA, 19 nt, Bordetella pertussis
ccacucggugcgcgcgccc

SEQ ID NO: 2341234 - RNA, 18 nt, Bordetella pertussis
ccacugcaaggcccgccc

SEQ ID NO: 2341235 - RNA, 19 nt, Bordetella pertussis
ccacugcaaggcccgcccg

SEQ ID NO: 2341236 - RNA, 17 nt, Bordetella pertussis
ccacugcagcaguucgg

SEQ ID NO: 2341237 - RNA, 18 nt, Bordetella pertussis
ccacugcagcaguucggc

SEQ ID NO: 2341238 - RNA, 23 nt, Bordetella pertussis
ccacugccaggcgagcgccgcgc

SEQ ID NO: 2341239 - RNA, 23 nt, Bordetella pertussis
ccacugccaguaggcgccccagg

SEQ ID NO: 2341240 - RNA, 21 nt, Bordetella pertussis
ccacuggaagcugcggccggu

SEQ ID NO: 2341241 - RNA, 17 nt, Bordetella pertussis
ccacuggaucgccgauc

SEQ ID NO: 2341242 - RNA, 18 nt, Bordetella pertussis
ccacuggccuucuucacg

SEQ ID NO: 2341243 - RNA, 18 nt, Bordetella pertussis
ccacugggggacuggcac

SEQ ID NO: 2341244 - RNA, 21 nt, Bordetella pertussis
ccacugggggacuggcacccg

SEQ ID NO: 2341245 - RNA, 15 nt, Bordetella pertussis
ccacuucaccgcuga

SEQ ID NO: 2341246 - RNA, 17 nt, Bordetella pertussis
ccacuuccagcgccugc

SEQ ID NO: 2341247 - RNA, 20 nt, Bordetella pertussis
ccacuuccagcgccugcucg

SEQ ID NO: 2341248 - RNA, 20 nt, Bordetella pertussis
ccacuuccucggcgcgcgcg

SEQ ID NO: 2341249 - RNA, 17 nt, Bordetella pertussis
ccacuuccuggugggcg

SEQ ID NO: 2341250 - RNA, 11 nt, Bordetella pertussis
ccacuuccuug

SEQ ID NO: 2341251 - RNA, 24 nt, Bordetella pertussis
ccacuuccuugccauccagccagg

SEQ ID NO: 2341252 - RNA, 20 nt, Bordetella pertussis
ccacuugcggguccagcagg

SEQ ID NO: 2341253 - RNA, 14 nt, Bordetella pertussis
ccagaaagcgcggc

SEQ ID NO: 2341254 - RNA, 23 nt, Bordetella pertussis
ccagaacccggccggcgccggca

SEQ ID NO: 2341255 - RNA, 13 nt, Bordetella pertussis
ccagaacgcgccg

SEQ ID NO: 2341256 - RNA, 22 nt, Bordetella pertussis
ccagaacgcgccguaccccagc

SEQ ID NO: 2341257 - RNA, 12 nt, Bordetella pertussis
ccagaacggcgc

SEQ ID NO: 2341258 - RNA, 23 nt, Bordetella pertussis
ccagacauugucaagcagcgccg

SEQ ID NO: 2341259 - RNA, 13 nt, Bordetella pertussis
ccagaccaagcgc

SEQ ID NO: 2341260 - RNA, 17 nt, Bordetella pertussis
ccagaccaagcgccaca

SEQ ID NO: 2341261 - RNA, 20 nt, Bordetella pertussis
ccagacccgaaucucccggc

SEQ ID NO: 2341262 - RNA, 16 nt, Bordetella pertussis
ccagaccgcgcgcacc

SEQ ID NO: 2341263 - RNA, 16 nt, Bordetella pertussis
ccagaccugcgcgccg

SEQ ID NO: 2341264 - RNA, 19 nt, Bordetella pertussis
ccagaccugcgcgccggca

SEQ ID NO: 2341265 - RNA, 17 nt, Bordetella pertussis
ccagaccuugcgcgacg

SEQ ID NO: 2341266 - RNA, 21 nt, Bordetella pertussis
ccagacgauggugccggccgu

SEQ ID NO: 2341267 - RNA, 15 nt, Bordetella pertussis
ccagacgcagaccac

SEQ ID NO: 2341268 - RNA, 17 nt, Bordetella pertussis
cauguucacgcccagga

SEQ ID NO: 2341269 - RNA, 18 nt, Bordetella pertussis
cauguucuucaggcucca

SEQ ID NO: 2341270 - RNA, 15 nt, Bordetella pertussis
cauguugcgcgaguu

SEQ ID NO: 2341271 - RNA, 20 nt, Bordetella pertussis
cauuaccagcaacgcgccgc

SEQ ID NO: 2341272 - RNA, 15 nt, Bordetella pertussis
cauuacccauggcac

SEQ ID NO: 2341273 - RNA, 18 nt, Bordetella pertussis
ccagcagccgguuggcgc

SEQ ID NO: 2341274 - RNA, 18 nt, Bordetella pertussis
ccagcagcgacggcccca

SEQ ID NO: 2341275 - RNA, 19 nt, Bordetella pertussis
ccagcagcgacggccccag

SEQ ID NO: 2341276 - RNA, 20 nt, Bordetella pertussis
ccagcagcgaggacacgcag

SEQ ID NO: 2341277 - RNA, 18 nt, Bordetella pertussis
ccagcagcgcaucgcgcg

SEQ ID NO: 2341278 - RNA, 11 nt, Bordetella pertussis
ccagcagcgcc

SEQ ID NO: 2341279 - RNA, 15 nt, Bordetella pertussis
ccagcagcgccaccg

SEQ ID NO: 2341280 - RNA, 15 nt, Bordetella pertussis
ccagcagcgccagga

SEQ ID NO: 2341281 - RNA, 18 nt, Bordetella pertussis
ccagcagcgccaggauga

SEQ ID NO: 2341282 - RNA, 17 nt, Bordetella pertussis
ccagcagcgccgccagc

SEQ ID NO: 2341283 - RNA, 12 nt, Bordetella pertussis
ccagcagcgccu

SEQ ID NO: 2341284 - RNA, 16 nt, Bordetella pertussis
ccagcagcgccugggg

SEQ ID NO: 2341285 - RNA, 23 nt, Bordetella pertussis
ccagcagcgcgugcagccagcgg

SEQ ID NO: 2341286 - RNA, 15 nt, Bordetella pertussis
ccagcagcggcagca

SEQ ID NO: 2341287 - RNA, 16 nt, Bordetella pertussis
ccagcagcggcagcag

SEQ ID NO: 2341288 - RNA, 23 nt, Bordetella pertussis
ccagcagcggcagcagcagcgcg

SEQ ID NO: 2341289 - RNA, 14 nt, Bordetella pertussis
ccagcagcggcagg

SEQ ID NO: 2341290 - RNA, 23 nt, Bordetella pertussis
ccagcagcgggcuggggcaggca

SEQ ID NO: 2341291 - RNA, 21 nt, Bordetella pertussis
ccagcagcggguugcgcgcca

SEQ ID NO: 2341292 - RNA, 23 nt, Bordetella pertussis
ccagcagcggguugcgcgccagc

SEQ ID NO: 2341293 - RNA, 14 nt, Bordetella pertussis
ccagcagcguggcc

SEQ ID NO: 2341294 - RNA, 15 nt, Bordetella pertussis
ccagcagcguggcca

SEQ ID NO: 2341295 - RNA, 18 nt, Bordetella pertussis
ccagcagcguggccacca

SEQ ID NO: 2341296 - RNA, 22 nt, Bordetella pertussis
ccagcagcguggccaccaggcg

SEQ ID NO: 2341297 - RNA, 23 nt, Bordetella pertussis
ccagcagcguggccaccaggcgc

SEQ ID NO: 2341298 - RNA, 13 nt, Bordetella pertussis
ccagcagcuccuc

SEQ ID NO: 2341299 - RNA, 22 nt, Bordetella pertussis
ccagcagcuccucggccugccg

SEQ ID NO: 2341300 - RNA, 12 nt, Bordetella pertussis
ccagcagcucgg

SEQ ID NO: 2341301 - RNA, 20 nt, Bordetella pertussis
ccagcagcucggcgaccagg

SEQ ID NO: 2341302 - RNA, 16 nt, Bordetella pertussis
ccagcagcucggcgau

SEQ ID NO: 2341303 - RNA, 22 nt, Bordetella pertussis
ccagcagcuggcgcagcacgcc

SEQ ID NO: 2341304 - RNA, 23 nt, Bordetella pertussis
ccagcagcuggcgcagcacgccg

SEQ ID NO: 2341305 - RNA, 18 nt, Bordetella pertussis
ccagcaggagcccgcugc

SEQ ID NO: 2341306 - RNA, 17 nt, Bordetella pertussis
ccagcaggauggauccc

SEQ ID NO: 2341307 - RNA, 24 nt, Bordetella pertussis
ccagcaggauggaucccuggucga

SEQ ID NO: 2341308 - RNA, 15 nt, Bordetella pertussis
ccagcaggauggcga

SEQ ID NO: 2341309 - RNA, 14 nt, Bordetella pertussis
ccagcaggcccacc

SEQ ID NO: 2341310 - RNA, 19 nt, Bordetella pertussis
ccagcaggcccugggccag

SEQ ID NO: 2341311 - RNA, 17 nt, Bordetella pertussis
ccagcaggcccugggcg

SEQ ID NO: 2341312 - RNA, 12 nt, Bordetella pertussis
ccagcaggccgg

SEQ ID NO: 2341313 - RNA, 19 nt, Bordetella pertussis
ccagcaggcgaaacgccag

SEQ ID NO: 2341314 - RNA, 23 nt, Bordetella pertussis
ccagcaggcgaaacgccagcccg

SEQ ID NO: 2341315 - RNA, 14 nt, Bordetella pertussis
ccagcaggcgcucg

SEQ ID NO: 2341316 - RNA, 16 nt, Bordetella pertussis
ccagcaggcgcucggc

SEQ ID NO: 2341317 - RNA, 13 nt, Bordetella pertussis
ccagcaggcggcc

SEQ ID NO: 2341318 - RNA, 20 nt, Bordetella pertussis
ccagcaggcggccgaccagc

SEQ ID NO: 2341319 - RNA, 16 nt, Bordetella pertussis
ccagcaggcucagcgg

SEQ ID NO: 2341320 - RNA, 21 nt, Bordetella pertussis
ccagcagggacuugggcaggc

SEQ ID NO: 2341321 - RNA, 23 nt, Bordetella pertussis
ccagcagggacuugggcaggccu

SEQ ID NO: 2341322 - RNA, 12 nt, Bordetella pertussis
ccagcagggcgg

SEQ ID NO: 2341323 - RNA, 14 nt, Bordetella pertussis
ccagcagggcggcg

SEQ ID NO: 2341324 - RNA, 17 nt, Bordetella pertussis
ccagcagggcggcgucg

SEQ ID NO: 2341325 - RNA, 23 nt, Bordetella pertussis
ccagcagggcggcgucgaucggc

SEQ ID NO: 2341326 - RNA, 22 nt, Bordetella pertussis
ccagcagggucagcggccggcc

SEQ ID NO: 2341327 - RNA, 21 nt, Bordetella pertussis
ccagcagguccugcacgcggg

SEQ ID NO: 2341328 - RNA, 12 nt, Bordetella pertussis
ccagcaggucgu

SEQ ID NO: 2341329 - RNA, 19 nt, Bordetella pertussis
ccagcaguucgggguccag

SEQ ID NO: 2341330 - RNA, 19 nt, Bordetella pertussis
ccagcauacccugcgcgcc

SEQ ID NO: 2341331 - RNA, 20 nt, Bordetella pertussis
ccagcauacccugcgcgccg

SEQ ID NO: 2341332 - RNA, 14 nt, Bordetella pertussis
ccagcaucaggccc

SEQ ID NO: 2341333 - RNA, 14 nt, Bordetella pertussis
ccagcauccagccg

SEQ ID NO: 2341334 - RNA, 18 nt, Bordetella pertussis
ccagcauccgcgccagga

SEQ ID NO: 2341335 - RNA, 15 nt, Bordetella pertussis
ccagcauccucacgu

SEQ ID NO: 2341336 - RNA, 13 nt, Bordetella pertussis
ccagcaucgccgc

SEQ ID NO: 2341337 - RNA, 15 nt, Bordetella pertussis
ccagcaucgccgcca

SEQ ID NO: 2341338 - RNA, 20 nt, Bordetella pertussis
ccagcaucgccgccagcuug

SEQ ID NO: 2341339 - RNA, 20 nt, Bordetella pertussis
ccagcaucgcgccuucggcg

SEQ ID NO: 2341340 - RNA, 22 nt, Bordetella pertussis
ccagcaucgcgccuucggcgcg

SEQ ID NO: 2341341 - RNA, 17 nt, Bordetella pertussis
ccagcaucggcacccag

SEQ ID NO: 2341342 - RNA, 15 nt, Bordetella pertussis
ccagcaucugcccca

SEQ ID NO: 2341343 - RNA, 19 nt, Bordetella pertussis
ccagcaucugccccagcuu

SEQ ID NO: 2341344 - RNA, 19 nt, Bordetella pertussis
ccagcaugacggggucggg

SEQ ID NO: 2341345 - RNA, 21 nt, Bordetella pertussis
ccagcaugacggggucggggc

SEQ ID NO: 2341346 - RNA, 21 nt, Bordetella pertussis
ccagcaugaucaugccgcugc

SEQ ID NO: 2341347 - RNA, 15 nt, Bordetella pertussis
ccagcaugcgcgcga

SEQ ID NO: 2341348 - RNA, 17 nt, Bordetella pertussis
ccagcaugcgcgcggcc

SEQ ID NO: 2341349 - RNA, 20 nt, Bordetella pertussis
ccagcaugcgcgcggccucg

SEQ ID NO: 2341350 - RNA, 21 nt, Bordetella pertussis
ccagcaugcgcgucuccagcg

SEQ ID NO: 2341351 - RNA, 24 nt, Bordetella pertussis
ccagcaugcgcgucuccagcgccg

SEQ ID NO: 2341352 - RNA, 14 nt, Bordetella pertussis
ccagcauggccgug

SEQ ID NO: 2341353 - RNA, 15 nt, Bordetella pertussis
ccagcauggccgugg

SEQ ID NO: 2341354 - RNA, 18 nt, Bordetella pertussis
ccagcauggccguggcgu

SEQ ID NO: 2341355 - RNA, 19 nt, Bordetella pertussis
ccagcauggccguggcgug

SEQ ID NO: 2341356 - RNA, 17 nt, Bordetella pertussis
ccagcauggcggccagg

SEQ ID NO: 2341357 - RNA, 18 nt, Bordetella pertussis
ccagcauggcggccaggc

SEQ ID NO: 2341358 - RNA, 22 nt, Bordetella pertussis
ccagcauggcggccaggcgcgc

SEQ ID NO: 2341359 - RNA, 23 nt, Bordetella pertussis
ccagcauggcgucgaaacgcugc

SEQ ID NO: 2341360 - RNA, 20 nt, Bordetella pertussis
ccagcauggucggcauggcc

SEQ ID NO: 2341361 - RNA, 23 nt, Bordetella pertussis
ccagcaugucguggcgauagcgc

SEQ ID NO: 2341362 - RNA, 24 nt, Bordetella pertussis
ccagcaugucguggcgauagcgcu

SEQ ID NO: 2341363 - RNA, 18 nt, Bordetella pertussis
ccagcauuucucgggcgc

SEQ ID NO: 2341364 - RNA, 16 nt, Bordetella pertussis
ccagccaaugccgcgg

SEQ ID NO: 2341365 - RNA, 14 nt, Bordetella pertussis
ccagccaccacugc

SEQ ID NO: 2341366 - RNA, 20 nt, Bordetella pertussis
ccagccaccaugucccuggc

SEQ ID NO: 2341367 - RNA, 15 nt, Bordetella pertussis
ccagccaccccguca

SEQ ID NO: 2341368 - RNA, 22 nt, Bordetella pertussis
ccagccaccccgucaucgccgc

SEQ ID NO: 2341369 - RNA, 17 nt, Bordetella pertussis
ccagccacgccggcgcg

SEQ ID NO: 2341370 - RNA, 18 nt, Bordetella pertussis
ccagccacgccggcgcgc

SEQ ID NO: 2341371 - RNA, 15 nt, Bordetella pertussis
ccagccacgcgcgcu

SEQ ID NO: 2341372 - RNA, 16 nt, Bordetella pertussis
ccagccacgcgcgcug

SEQ ID NO: 2341373 - RNA, 22 nt, Bordetella pertussis
ccagccacgcgcgcuggcgccc

SEQ ID NO: 2341374 - RNA, 17 nt, Bordetella pertussis
ccagccagcccuggccc

SEQ ID NO: 2341375 - RNA, 19 nt, Bordetella pertussis
ccagccagcccuggcccag

SEQ ID NO: 2341376 - RNA, 14 nt, Bordetella pertussis
ccagccagccgccg

SEQ ID NO: 2341377 - RNA, 17 nt, Bordetella pertussis
ccagccagccgccgcgc

SEQ ID NO: 2341378 - RNA, 17 nt, Bordetella pertussis
ccagccagcgcaugccg

SEQ ID NO: 2341379 - RNA, 13 nt, Bordetella pertussis
ccagccagcgccg

SEQ ID NO: 2341380 - RNA, 17 nt, Bordetella pertussis
ccagccagcgccgcagc

SEQ ID NO: 2341381 - RNA, 11 nt, Bordetella pertussis
ccagccagcgg

SEQ ID NO: 2341382 - RNA, 13 nt, Bordetella pertussis
ccagccaggccgc

SEQ ID NO: 2341383 - RNA, 12 nt, Bordetella pertussis
ccagccaggccu

SEQ ID NO: 2341384 - RNA, 17 nt, Bordetella pertussis
ccagccaggccucggcu

SEQ ID NO: 2341385 - RNA, 18 nt, Bordetella pertussis
ccagccaggcgccagcgg

SEQ ID NO: 2341386 - RNA, 23 nt, Bordetella pertussis
ccagccaggcgccagcggcauug

SEQ ID NO: 2341387 - RNA, 14 nt, Bordetella pertussis
ccagccaggcgcgc

SEQ ID NO: 2341388 - RNA, 16 nt, Bordetella pertussis
ccagccaggcgcgcag

SEQ ID NO: 2341389 - RNA, 12 nt, Bordetella pertussis
ccagccaggcgg

SEQ ID NO: 2341390 - RNA, 20 nt, Bordetella pertussis
ccagccaggcgguggccucg

SEQ ID NO: 2341391 - RNA, 23 nt, Bordetella pertussis
ccagccaggguuguccgaaccac

SEQ ID NO: 2341392 - RNA, 18 nt, Bordetella pertussis
ccagccaguacaggcugc

SEQ ID NO: 2341393 - RNA, 16 nt, Bordetella pertussis
ccagccauguucgacc

SEQ ID NO: 2341394 - RNA, 18 nt, Bordetella pertussis
ccagccauguucgaccag

SEQ ID NO: 2341395 - RNA, 16 nt, Bordetella pertussis
ccagccauugccgcac

SEQ ID NO: 2341396 - RNA, 17 nt, Bordetella pertussis
ccagccauugccgcacg

SEQ ID NO: 2341397 - RNA, 16 nt, Bordetella pertussis
ccagcccacaagccgu

SEQ ID NO: 2341398 - RNA, 22 nt, Bordetella pertussis
ccagcccaccagcgccacgccg

SEQ ID NO: 2341399 - RNA, 15 nt, Bordetella pertussis
ccagcccagcccgcc

SEQ ID NO: 2341400 - RNA, 16 nt, Bordetella pertussis
ccagccccaccuugcc

SEQ ID NO: 2341401 - RNA, 21 nt, Bordetella pertussis
ccagccccaccuugcccagca

SEQ ID NO: 2341402 - RNA, 17 nt, Bordetella pertussis
ccagccccacgccgacc

SEQ ID NO: 2341403 - RNA, 14 nt, Bordetella pertussis
ccagccccgcggcc

SEQ ID NO: 2341404 - RNA, 15 nt, Bordetella pertussis
ccagccccgcggccg

SEQ ID NO: 2341405 - RNA, 18 nt, Bordetella pertussis
ccagccccggcgcgccgg

SEQ ID NO: 2341406 - RNA, 19 nt, Bordetella pertussis
ccagccccggcgcgccggc

SEQ ID NO: 2341407 - RNA, 16 nt, Bordetella pertussis
ccagccccugcccguc

SEQ ID NO: 2341408 - RNA, 17 nt, Bordetella pertussis
ccagccccugcgggccg

SEQ ID NO: 2341409 - RNA, 16 nt, Bordetella pertussis
ccagcccgacggccag

SEQ ID NO: 2341410 - RNA, 19 nt, Bordetella pertussis
ccagcccgacggccagcgc

SEQ ID NO: 2341411 - RNA, 13 nt, Bordetella pertussis
ccagcccgaggca

SEQ ID NO: 2341412 - RNA, 19 nt, Bordetella pertussis
ccagcccgaugcgccaggc

SEQ ID NO: 2341413 - RNA, 20 nt, Bordetella pertussis
ccagcccgaugcgccaggcc

SEQ ID NO: 2341414 - RNA, 21 nt, Bordetella pertussis
ccagcccgaugcgccaggccu

SEQ ID NO: 2341415 - RNA, 14 nt, Bordetella pertussis
ccagcccgcccgcg

SEQ ID NO: 2341416 - RNA, 15 nt, Bordetella pertussis
ccagcccgcccgcgc

SEQ ID NO: 2341417 - RNA, 16 nt, Bordetella pertussis
ccagcccgcccgcgcc

SEQ ID NO: 2341418 - RNA, 19 nt, Bordetella pertussis
ccagcccgcccgcgcccag

SEQ ID NO: 2341419 - RNA, 15 nt, Bordetella pertussis
ccagcccgccggcgc

SEQ ID NO: 2341420 - RNA, 18 nt, Bordetella pertussis
ccagcccgccggcgcgcg

SEQ ID NO: 2341421 - RNA, 20 nt, Bordetella pertussis
ccagcccgccggcgcgcgcg

SEQ ID NO: 2341422 - RNA, 14 nt, Bordetella pertussis
ccagcccggccgcc

SEQ ID NO: 2341423 - RNA, 13 nt, Bordetella pertussis
ccagcccggcggu

SEQ ID NO: 2341424 - RNA, 14 nt, Bordetella pertussis
ccagcccggcuucg

SEQ ID NO: 2341425 - RNA, 22 nt, Bordetella pertussis
ccagcccggugaucgaguaggc

SEQ ID NO: 2341426 - RNA, 16 nt, Bordetella pertussis
ccagcccugcccgcac

SEQ ID NO: 2341427 - RNA, 13 nt, Bordetella pertussis
ccagcccuugcuu

SEQ ID NO: 2341428 - RNA, 16 nt, Bordetella pertussis
ccagccgagccuggcg

SEQ ID NO: 2341429 - RNA, 18 nt, Bordetella pertussis
ccagccgaucagccggcc

SEQ ID NO: 2341430 - RNA, 14 nt, Bordetella pertussis
ccagccgaugccgc

SEQ ID NO: 2341431 - RNA, 13 nt, Bordetella pertussis
ccagccgcagcag

SEQ ID NO: 2341432 - RNA, 15 nt, Bordetella pertussis
ccagccgcagcaggc

SEQ ID NO: 2341433 - RNA, 22 nt, Bordetella pertussis
ccagccgcagcaggcgcucggc

SEQ ID NO: 2341434 - RNA, 14 nt, Bordetella pertussis
ccagccgcccgugg

SEQ ID NO: 2341435 - RNA, 15 nt, Bordetella pertussis
ccagccgcccguggc

SEQ ID NO: 2341436 - RNA, 13 nt, Bordetella pertussis
ccagccgccgcca

SEQ ID NO: 2341437 - RNA, 14 nt, Bordetella pertussis
ccagccgccgcgcg

SEQ ID NO: 2341438 - RNA, 16 nt, Bordetella pertussis
ccagccgcgccugcag

SEQ ID NO: 2341439 - RNA, 17 nt, Bordetella pertussis
ccagccgcucgcgcgac

SEQ ID NO: 2341440 - RNA, 18 nt, Bordetella pertussis
ccagccgcucgcgcgacc

SEQ ID NO: 2341441 - RNA, 21 nt, Bordetella pertussis
ccagccgcucgcgcgaccacu

SEQ ID NO: 2341442 - RNA, 13 nt, Bordetella pertussis
ccagccgcucggc

SEQ ID NO: 2341443 - RNA, 14 nt, Bordetella pertussis
ccagccgcucggcc

SEQ ID NO: 2341444 - RNA, 15 nt, Bordetella pertussis
ccagccgcucggcca

SEQ ID NO: 2341445 - RNA, 17 nt, Bordetella pertussis
ccagccgcucggccacg

SEQ ID NO: 2341446 - RNA, 22 nt, Bordetella pertussis
ccagccgcucggccacgcgcug

SEQ ID NO: 2341447 - RNA, 14 nt, Bordetella pertussis
ccagccgcuggcga

SEQ ID NO: 2341448 - RNA, 22 nt, Bordetella pertussis
ccagccgcuggcgaucaggccg

SEQ ID NO: 2341449 - RNA, 16 nt, Bordetella pertussis
ccagccgcuggcgcgc

SEQ ID NO: 2341450 - RNA, 17 nt, Bordetella pertussis
ccagccgcuggcgcgcc

SEQ ID NO: 2341451 - RNA, 18 nt, Bordetella pertussis
ccagccgcuggcgcgccg

SEQ ID NO: 2341452 - RNA, 19 nt, Bordetella pertussis
ccagccgcuugcggccagg

SEQ ID NO: 2341453 - RNA, 19 nt, Bordetella pertussis
ccagccggacccgcgccgc

SEQ ID NO: 2341454 - RNA, 13 nt, Bordetella pertussis
ccagccggcccag

SEQ ID NO: 2341455 - RNA, 14 nt, Bordetella pertussis
ccagccggcccagc

SEQ ID NO: 2341456 - RNA, 15 nt, Bordetella pertussis
ccagccggcccagca

SEQ ID NO: 2341457 - RNA, 21 nt, Bordetella pertussis
ccagccggcccagcacgccgc

SEQ ID NO: 2341458 - RNA, 22 nt, Bordetella pertussis
ccagccggcccagcacgccgcg

SEQ ID NO: 2341459 - RNA, 14 nt, Bordetella pertussis
ccagccggcccgac

SEQ ID NO: 2341460 - RNA, 14 nt, Bordetella pertussis
ccagccggccgccg

SEQ ID NO: 2341461 - RNA, 14 nt, Bordetella pertussis
ccagccggcgcgcc

SEQ ID NO: 2341462 - RNA, 15 nt, Bordetella pertussis
ccagccggcgcgcca

SEQ ID NO: 2341463 - RNA, 23 nt, Bordetella pertussis
ccagccggcggcaugcgccagcc

SEQ ID NO: 2341464 - RNA, 16 nt, Bordetella pertussis
ccagccggcggccagc

SEQ ID NO: 2341465 - RNA, 14 nt, Bordetella pertussis
ccagccgggcggcc

SEQ ID NO: 2341466 - RNA, 15 nt, Bordetella pertussis
ccagccgggcggcca

SEQ ID NO: 2341467 - RNA, 17 nt, Bordetella pertussis
ccagccgggcggccacg

SEQ ID NO: 2341468 - RNA, 16 nt, Bordetella pertussis
ccagccgucgcgcugc

SEQ ID NO: 2341469 - RNA, 17 nt, Bordetella pertussis
ccagccgucgcgcugca

SEQ ID NO: 2341470 - RNA, 14 nt, Bordetella pertussis
ccagcgagcuggug

SEQ ID NO: 2341471 - RNA, 13 nt, Bordetella pertussis
ccagcgaggccgc

SEQ ID NO: 2341472 - RNA, 14 nt, Bordetella pertussis
ccagcgaggccgcu

SEQ ID NO: 2341473 - RNA, 19 nt, Bordetella pertussis
ccagcgaguuguccuggcc

SEQ ID NO: 2341474 - RNA, 21 nt, Bordetella pertussis
ccagcgaguuguccuggccgg

SEQ ID NO: 2341475 - RNA, 15 nt, Bordetella pertussis
ccagcgcaaggguug

SEQ ID NO: 2341476 - RNA, 19 nt, Bordetella pertussis
ccagcgcaccaccagcacc

SEQ ID NO: 2341477 - RNA, 18 nt, Bordetella pertussis
ccagcgcauaggacgcca

SEQ ID NO: 2341478 - RNA, 19 nt, Bordetella pertussis
ccagcgcauaggacgccac

SEQ ID NO: 2341479 - RNA, 20 nt, Bordetella pertussis
ccagcgcauaggacgccacc

SEQ ID NO: 2341480 - RNA, 22 nt, Bordetella pertussis
ccagcgcauaggacgccaccag

SEQ ID NO: 2341481 - RNA, 14 nt, Bordetella pertussis
ccagcgcaugccgu

SEQ ID NO: 2341482 - RNA, 22 nt, Bordetella pertussis
ccagcgcaugccgucgagcgcg

SEQ ID NO: 2341483 - RNA, 14 nt, Bordetella pertussis
ccagcgcauugccg

SEQ ID NO: 2341484 - RNA, 22 nt, Bordetella pertussis
ccagcgcauugccgccgcccug

SEQ ID NO: 2341485 - RNA, 21 nt, Bordetella pertussis
ccagcgcauuggugagcacgc

SEQ ID NO: 2341486 - RNA, 12 nt, Bordetella pertussis
ccagcgccacca

SEQ ID NO: 2341487 - RNA, 16 nt, Bordetella pertussis
ccagcgccaccaccgg

SEQ ID NO: 2341488 - RNA, 19 nt, Bordetella pertussis
ccagcgccaccaccggcac

SEQ ID NO: 2341489 - RNA, 14 nt, Bordetella pertussis
ccagcgccaccagc

SEQ ID NO: 2341490 - RNA, 15 nt, Bordetella pertussis
ccagcgccaccagca

SEQ ID NO: 2341491 - RNA, 18 nt, Bordetella pertussis
ccagcgccaccagcagcg

SEQ ID NO: 2341492 - RNA, 16 nt, Bordetella pertussis
ccagcgccacgcccag

SEQ ID NO: 2341493 - RNA, 17 nt, Bordetella pertussis
ccagcgccacgcccugg

SEQ ID NO: 2341494 - RNA, 18 nt, Bordetella pertussis
ccagcgccacgcccuggc

SEQ ID NO: 2341495 - RNA, 19 nt, Bordetella pertussis
ccagcgccacgcccuggcg

SEQ ID NO: 2341496 - RNA, 15 nt, Bordetella pertussis
ccagcgccacgccgg

SEQ ID NO: 2341497 - RNA, 16 nt, Bordetella pertussis
ccagcgccacgccggc

SEQ ID NO: 2341498 - RNA, 18 nt, Bordetella pertussis
ccagcgccacgccggcca

SEQ ID NO: 2341499 - RNA, 20 nt, Bordetella pertussis
ccagcgccacgccggccagc

SEQ ID NO: 2341500 - RNA, 23 nt, Bordetella pertussis
ccagcgccacgccggccagcuug

SEQ ID NO: 2341501 - RNA, 16 nt, Bordetella pertussis
ccagcgccacggcggu

SEQ ID NO: 2341502 - RNA, 22 nt, Bordetella pertussis
ccagcgccagaaagcgcggccg

SEQ ID NO: 2341503 - RNA, 11 nt, Bordetella pertussis
ccagcgccagc

SEQ ID NO: 2341504 - RNA, 23 nt, Bordetella pertussis
ccagcgccagcaccggcacgcgc

SEQ ID NO: 2341505 - RNA, 14 nt, Bordetella pertussis
ccagcgccagcacg

SEQ ID NO: 2341506 - RNA, 13 nt, Bordetella pertussis
ccagcgccagcag

SEQ ID NO: 2341507 - RNA, 14 nt, Bordetella pertussis
ccagcgccagcagc

SEQ ID NO: 2341508 - RNA, 20 nt, Bordetella pertussis
ccagcgccagcagcaggccg

SEQ ID NO: 2341509 - RNA, 15 nt, Bordetella pertussis
ccagcgccagcgugg

SEQ ID NO: 2341510 - RNA, 18 nt, Bordetella pertussis
ccagcgccagcguggccg

SEQ ID NO: 2341511 - RNA, 20 nt, Bordetella pertussis
ccagcgccaggaacagcgcc

SEQ ID NO: 2341512 - RNA, 13 nt, Bordetella pertussis
ccagcgccaggcc

SEQ ID NO: 2341513 - RNA, 14 nt, Bordetella pertussis
ccagcgccaggccg

SEQ ID NO: 2341514 - RNA, 17 nt, Bordetella pertussis
ccagcgccaggccgcgc

SEQ ID NO: 2341515 - RNA, 18 nt, Bordetella pertussis
ccagcgccaggccgcgca

SEQ ID NO: 2341516 - RNA, 20 nt, Bordetella pertussis
ccagcgccaggccgcgcagg

SEQ ID NO: 2341517 - RNA, 17 nt, Bordetella pertussis
ccagcgccagggccgcc

SEQ ID NO: 2341518 - RNA, 18 nt, Bordetella pertussis
ccagcgccagggccgccg

SEQ ID NO: 2341519 - RNA, 16 nt, Bordetella pertussis
ccagcgccaucggcau

SEQ ID NO: 2341520 - RNA, 20 nt, Bordetella pertussis
ccagcgccaugaugucgcgc

SEQ ID NO: 2341521 - RNA, 14 nt, Bordetella pertussis
ccagcgcccaggcg

SEQ ID NO: 2341522 - RNA, 14 nt, Bordetella pertussis
ccagcgcccgcgga

SEQ ID NO: 2341523 - RNA, 20 nt, Bordetella pertussis
ccagcgccgacggcauggcc

SEQ ID NO: 2341524 - RNA, 11 nt, Bordetella pertussis
ccagcgccgcc

SEQ ID NO: 2341525 - RNA, 12 nt, Bordetella pertussis
ccagcgccgcca

SEQ ID NO: 2341526 - RNA, 16 nt, Bordetella pertussis
ccagcgccgccagccg

SEQ ID NO: 2341527 - RNA, 13 nt, Bordetella pertussis
ccagcgccgccau

SEQ ID NO: 2341528 - RNA, 23 nt, Bordetella pertussis
ccagcgccgccgacggcauggcg

SEQ ID NO: 2341529 - RNA, 18 nt, Bordetella pertussis
ccagcgccgcgagcgccg

SEQ ID NO: 2341530 - RNA, 17 nt, Bordetella pertussis
ccagcgccgcggccggc

SEQ ID NO: 2341531 - RNA, 20 nt, Bordetella pertussis
ccagcgccgcggccggcggc

SEQ ID NO: 2341532 - RNA, 17 nt, Bordetella pertussis
ccagcgccggcacgcug

SEQ ID NO: 2341533 - RNA, 16 nt, Bordetella pertussis
ccagcgccggcagccc

SEQ ID NO: 2341534 - RNA, 18 nt, Bordetella pertussis
ccagcgccggcagcccca

SEQ ID NO: 2341535 - RNA, 13 nt, Bordetella pertussis
ccagcgccggcgc

SEQ ID NO: 2341536 - RNA, 19 nt, Bordetella pertussis
ccagcgccggcgcgcgcug

SEQ ID NO: 2341537 - RNA, 15 nt, Bordetella pertussis
ccagcgccggcgcgu

SEQ ID NO: 2341538 - RNA, 16 nt, Bordetella pertussis
ccagcgccggcgcguc

SEQ ID NO: 2341539 - RNA, 19 nt, Bordetella pertussis
ccagcgccggggucagcgc

SEQ ID NO: 2341540 - RNA, 21 nt, Bordetella pertussis
ccagcgccggggucagcgccg

SEQ ID NO: 2341541 - RNA, 13 nt, Bordetella pertussis
ccagcgccgucau

SEQ ID NO: 2341542 - RNA, 19 nt, Bordetella pertussis
ccagcgccgucaucugcgg

SEQ ID NO: 2341543 - RNA, 12 nt, Bordetella pertussis
ccagcgccucca

SEQ ID NO: 2341544 - RNA, 21 nt, Bordetella pertussis
ccagcgccucgcgcucgagcg

SEQ ID NO: 2341545 - RNA, 15 nt, Bordetella pertussis
ccagcgccucgucgc

SEQ ID NO: 2341546 - RNA, 13 nt, Bordetella pertussis
ccagcgccugccg

SEQ ID NO: 2341547 - RNA, 16 nt, Bordetella pertussis
ccagcgccugcgcggc

SEQ ID NO: 2341548 - RNA, 20 nt, Bordetella pertussis
ccagcgccugcgcggccucg

SEQ ID NO: 2341549 - RNA, 21 nt, Bordetella pertussis
ccagcgccuggaccuggacga

SEQ ID NO: 2341550 - RNA, 14 nt, Bordetella pertussis
ccagcgccuggcgg

SEQ ID NO: 2341551 - RNA, 20 nt, Bordetella pertussis
ccagcgccuggcgggccugg

SEQ ID NO: 2341552 - RNA, 23 nt, Bordetella pertussis
ccagcgccuggcgggccugggcg

SEQ ID NO: 2341553 - RNA, 13 nt, Bordetella pertussis
ccagcgccugggc

SEQ ID NO: 2341554 - RNA, 14 nt, Bordetella pertussis
ccagcgccugggcg

SEQ ID NO: 2341555 - RNA, 19 nt, Bordetella pertussis
ccagcgccugggcgcggau

SEQ ID NO: 2341556 - RNA, 18 nt, Bordetella pertussis
ccagcgcgaaaacccgcg

SEQ ID NO: 2341557 - RNA, 21 nt, Bordetella pertussis
ccagcgcgaaaacccgcggca

SEQ ID NO: 2341558 - RNA, 23 nt, Bordetella pertussis
ccagcgcgaaaugcccagcgagc

SEQ ID NO: 2341559 - RNA, 19 nt, Bordetella pertussis
ccagcgcgaacgccugcca

SEQ ID NO: 2341560 - RNA, 21 nt, Bordetella pertussis
ccagcgcgaaguaccagcgca

SEQ ID NO: 2341561 - RNA, 17 nt, Bordetella pertussis
ccagcgcgacggccucg

SEQ ID NO: 2341562 - RNA, 16 nt, Bordetella pertussis
ccagcgcgacgggcac

SEQ ID NO: 2341563 - RNA, 22 nt, Bordetella pertussis
ccagcgcgacgggcaccgacac

SEQ ID NO: 2341564 - RNA, 20 nt, Bordetella pertussis
ccagcgcgaugucgcccaug

SEQ ID NO: 2341565 - RNA, 16 nt, Bordetella pertussis
ccagcgcgauucccug

SEQ ID NO: 2341566 - RNA, 13 nt, Bordetella pertussis
ccagcgcgcaacc

SEQ ID NO: 2341567 - RNA, 13 nt, Bordetella pertussis
ccagcgcgccagc

SEQ ID NO: 2341568 - RNA, 14 nt, Bordetella pertussis
ccagcgcgccagca

SEQ ID NO: 2341569 - RNA, 14 nt, Bordetella pertussis
ccagcgcgccauac

SEQ ID NO: 2341570 - RNA, 11 nt, Bordetella pertussis
ccagcgcgccc

SEQ ID NO: 2341571 - RNA, 14 nt, Bordetella pertussis
ccagcgcgcccagc

SEQ ID NO: 2341572 - RNA, 20 nt, Bordetella pertussis
ccagcgcgcccgaggcgcgc

SEQ ID NO: 2341573 - RNA, 23 nt, Bordetella pertussis
ccagcgcgcccgaggcgcgcagc

SEQ ID NO: 2341574 - RNA, 18 nt, Bordetella pertussis
ccagcgcgccgaucacca

SEQ ID NO: 2341575 - RNA, 13 nt, Bordetella pertussis
ccagcgcgccgcc

SEQ ID NO: 2341576 - RNA, 14 nt, Bordetella pertussis
ccagcgcgccgcgc

SEQ ID NO: 2341577 - RNA, 19 nt, Bordetella pertussis
ccagcgcgccgcgcgcggc

SEQ ID NO: 2341578 - RNA, 18 nt, Bordetella pertussis
ccagcgcgccggccaggg

SEQ ID NO: 2341579 - RNA, 19 nt, Bordetella pertussis
ccagcgcgccggccagggc

SEQ ID NO: 2341580 - RNA, 21 nt, Bordetella pertussis
ccagcgcgccggccagggcca

SEQ ID NO: 2341581 - RNA, 13 nt, Bordetella pertussis
ccagcgcgccggg

SEQ ID NO: 2341582 - RNA, 11 nt, Bordetella pertussis
ccagcgcgccu

SEQ ID NO: 2341583 - RNA, 13 nt, Bordetella pertussis
ccagcgcgccugc

SEQ ID NO: 2341584 - RNA, 14 nt, Bordetella pertussis
ccagcgcgccugcc

SEQ ID NO: 2341585 - RNA, 16 nt, Bordetella pertussis
ccagcgcgccugccca

SEQ ID NO: 2341586 - RNA, 20 nt, Bordetella pertussis
ccagcgcgccugcccaggcc

SEQ ID NO: 2341587 - RNA, 14 nt, Bordetella pertussis
ccagcgcgcgaauu

SEQ ID NO: 2341588 - RNA, 12 nt, Bordetella pertussis
ccagcgcgcgau

SEQ ID NO: 2341589 - RNA, 22 nt, Bordetella pertussis
ccagcgcgcgaucgccagcagg

SEQ ID NO: 2341590 - RNA, 13 nt, Bordetella pertussis
ccagcgcgcgcga

SEQ ID NO: 2341591 - RNA, 14 nt, Bordetella pertussis
ccagcgcgcggccg

SEQ ID NO: 2341592 - RNA, 16 nt, Bordetella pertussis
ccagcgcgcggccggc

SEQ ID NO: 2341593 - RNA, 16 nt, Bordetella pertussis
ccagcgcgcggccucg

SEQ ID NO: 2341594 - RNA, 13 nt, Bordetella pertussis
ccagcgcgcggcg

SEQ ID NO: 2341595 - RNA, 14 nt, Bordetella pertussis
ccagcgcgcggcgc

SEQ ID NO: 2341596 - RNA, 20 nt, Bordetella pertussis
ccagcgcgcggggcaggccg

SEQ ID NO: 2341597 - RNA, 12 nt, Bordetella pertussis
ccagcgcgcgug

SEQ ID NO: 2341598 - RNA, 10 nt, Bordetella pertussis
ccagcgcggc

SEQ ID NO: 2341599 - RNA, 20 nt, Bordetella pertussis
ccagcgcggcaugccgcugc

SEQ ID NO: 2341600 - RNA, 19 nt, Bordetella pertussis
ccagcgcggccacggccug

SEQ ID NO: 2341601 - RNA, 21 nt, Bordetella pertussis
ccagcgcggccacggccugcc

SEQ ID NO: 2341602 - RNA, 14 nt, Bordetella pertussis
ccagcgcggccagc

SEQ ID NO: 2341603 - RNA, 23 nt, Bordetella pertussis
ccagcgcggccagcaccggccgc

SEQ ID NO: 2341604 - RNA, 18 nt, Bordetella pertussis
ccagcgcggccagcgcgu

SEQ ID NO: 2341605 - RNA, 20 nt, Bordetella pertussis
ccagcgcggccagcgcgucg

SEQ ID NO: 2341606 - RNA, 23 nt, Bordetella pertussis
ccagcgcggccaggucggcgucg

SEQ ID NO: 2341607 - RNA, 12 nt, Bordetella pertussis
ccagcgcggccg

SEQ ID NO: 2341608 - RNA, 14 nt, Bordetella pertussis
ccagcgcggcggca

SEQ ID NO: 2341609 - RNA, 17 nt, Bordetella pertussis
ccagcgcggcggcagcg

SEQ ID NO: 2341610 - RNA, 14 nt, Bordetella pertussis
ccagcgcggcggcc

SEQ ID NO: 2341611 - RNA, 13 nt, Bordetella pertussis
ccagcgcggcggg

SEQ ID NO: 2341612 - RNA, 23 nt, Bordetella pertussis
ccagcgcggcgggcggcgcggcc

SEQ ID NO: 2341613 - RNA, 19 nt, Bordetella pertussis
ccagcgcggcuugguuguc

SEQ ID NO: 2341614 - RNA, 19 nt, Bordetella pertussis
ccagcgcguccaggugcgg

SEQ ID NO: 2341615 - RNA, 20 nt, Bordetella pertussis
ccagcgcgucgagcagcgca

SEQ ID NO: 2341616 - RNA, 18 nt, Bordetella pertussis
ccagcgcgucgccgccau

SEQ ID NO: 2341617 - RNA, 24 nt, Bordetella pertussis
ccagcgcgucgcguagcgcggccg

SEQ ID NO: 2341618 - RNA, 14 nt, Bordetella pertussis
ccagcgcgucggcc

SEQ ID NO: 2341619 - RNA, 16 nt, Bordetella pertussis
ccagcgcgucggccag

SEQ ID NO: 2341620 - RNA, 17 nt, Bordetella pertussis
ccagcgcgucggccagc

SEQ ID NO: 2341621 - RNA, 22 nt, Bordetella pertussis
ccagcgcgucggccagcgccgc

SEQ ID NO: 2341622 - RNA, 23 nt, Bordetella pertussis
ccagcgcgucggccagcgccgcg

SEQ ID NO: 2341623 - RNA, 18 nt, Bordetella pertussis
ccagcgcgucggccaggc

SEQ ID NO: 2341624 - RNA, 20 nt, Bordetella pertussis
ccagcgcgucguccagcgug

SEQ ID NO: 2341625 - RNA, 21 nt, Bordetella pertussis
ccagcgcgucguccagcgugg

SEQ ID NO: 2341626 - RNA, 16 nt, Bordetella pertussis
ccagcgcucgggcucg

SEQ ID NO: 2341627 - RNA, 18 nt, Bordetella pertussis
ccagcgcuguccaggccg

SEQ ID NO: 2341628 - RNA, 20 nt, Bordetella pertussis
ccagcgcuguccaggccggg

SEQ ID NO: 2341629 - RNA, 22 nt, Bordetella pertussis
ccagcgcuguccaggccggggc

SEQ ID NO: 2341630 - RNA, 14 nt, Bordetella pertussis
ccagcgcuucgggc

SEQ ID NO: 2341631 - RNA, 23 nt, Bordetella pertussis
ccagcgcuucgggcagcucgcgc

SEQ ID NO: 2341632 - RNA, 18 nt, Bordetella pertussis
ccagcgcuucgugcagcg

SEQ ID NO: 2341633 - RNA, 17 nt, Bordetella pertussis
ccagcgcuugcacgcca

SEQ ID NO: 2341634 - RNA, 22 nt, Bordetella pertussis
ccagcggaaguauucgcgcggc

SEQ ID NO: 2341635 - RNA, 23 nt, Bordetella pertussis
ccagcggaaguauucgcgcggcg

SEQ ID NO: 2341636 - RNA, 21 nt, Bordetella pertussis
ccagcggacgggccaggccga

SEQ ID NO: 2341637 - RNA, 16 nt, Bordetella pertussis
ccagcggaucgccggg

SEQ ID NO: 2341638 - RNA, 18 nt, Bordetella pertussis
ccagcggaucgccgggca

SEQ ID NO: 2341639 - RNA, 14 nt, Bordetella pertussis
ccagcggaugaugc

SEQ ID NO: 2341640 - RNA, 19 nt, Bordetella pertussis
ccagcggaugaugcggcgc

SEQ ID NO: 2341641 - RNA, 14 nt, Bordetella pertussis
ccagcggcagcgcg

SEQ ID NO: 2341642 - RNA, 17 nt, Bordetella pertussis
ccagcggcagcgcgcag

SEQ ID NO: 2341643 - RNA, 18 nt, Bordetella pertussis
ccagcggcagcgcgcagg

SEQ ID NO: 2341644 - RNA, 15 nt, Bordetella pertussis
ccagcggcaggacgg

SEQ ID NO: 2341645 - RNA, 16 nt, Bordetella pertussis
ccagcggcaggacggg

SEQ ID NO: 2341646 - RNA, 12 nt, Bordetella pertussis
ccagcggcaggc

SEQ ID NO: 2341647 - RNA, 13 nt, Bordetella pertussis
ccagcggcaggcc

SEQ ID NO: 2341648 - RNA, 13 nt, Bordetella pertussis
ccagcggcaggcu

SEQ ID NO: 2341649 - RNA, 22 nt, Bordetella pertussis
ccagcggcaggcuggccggcgu

SEQ ID NO: 2341650 - RNA, 21 nt, Bordetella pertussis
ccagcggcauugcccagguug

SEQ ID NO: 2341651 - RNA, 14 nt, Bordetella pertussis
ccagcggccgucgc

SEQ ID NO: 2341652 - RNA, 17 nt, Bordetella pertussis
ccagcggccgucgccuu

SEQ ID NO: 2341653 - RNA, 21 nt, Bordetella pertussis
ccagcggcgaaaugucgagcg

SEQ ID NO: 2341654 - RNA, 14 nt, Bordetella pertussis
ccagcggcgcaccg

SEQ ID NO: 2341655 - RNA, 14 nt, Bordetella pertussis
ccagcggcgcagcc

SEQ ID NO: 2341656 - RNA, 15 nt, Bordetella pertussis
ccagcggcgcagccg

SEQ ID NO: 2341657 - RNA, 16 nt, Bordetella pertussis
ccagcggcgcagccgg

SEQ ID NO: 2341658 - RNA, 18 nt, Bordetella pertussis
ccagcggcgcagccggcc

SEQ ID NO: 2341659 - RNA, 12 nt, Bordetella pertussis
ccaggccagcgc

SEQ ID NO: 2341660 - RNA, 16 nt, Bordetella pertussis
ccaggccagcgccaga

SEQ ID NO: 2341661 - RNA, 15 nt, Bordetella pertussis
ccaggccagcgccgc

SEQ ID NO: 2341662 - RNA, 16 nt, Bordetella pertussis
ccaggccauggcgcga

SEQ ID NO: 2341663 - RNA, 22 nt, Bordetella pertussis
ccaggcccacgacgaacaacac

SEQ ID NO: 2341664 - RNA, 16 nt, Bordetella pertussis
ccaggcccacggcgcc

SEQ ID NO: 2341665 - RNA, 12 nt, Bordetella pertussis
ccaggcccaggc

SEQ ID NO: 2341666 - RNA, 16 nt, Bordetella pertussis
ccaggcccagggcgau

SEQ ID NO: 2341667 - RNA, 19 nt, Bordetella pertussis
ccaggcccaguucggcgcg

SEQ ID NO: 2341668 - RNA, 21 nt, Bordetella pertussis
ccaggcccaguucggcgcgcg

SEQ ID NO: 2341669 - RNA, 19 nt, Bordetella pertussis
ccaggcccauaugccgccg

SEQ ID NO: 2341670 - RNA, 21 nt, Bordetella pertussis
ccaggcccauaugccgccggc

SEQ ID NO: 2341671 - RNA, 12 nt, Bordetella pertussis
ccaggcccaugc

SEQ ID NO: 2341672 - RNA, 14 nt, Bordetella pertussis
ccaggcccaugccg

SEQ ID NO: 2341673 - RNA, 16 nt, Bordetella pertussis
ccaggcccaugccgcc

SEQ ID NO: 2341674 - RNA, 20 nt, Bordetella pertussis
ccaggccccgccgggccgcg

SEQ ID NO: 2341675 - RNA, 12 nt, Bordetella pertussis
ccaggcccgcca

SEQ ID NO: 2341676 - RNA, 16 nt, Bordetella pertussis
ccaggcccgccacggc

SEQ ID NO: 2341677 - RNA, 24 nt, Bordetella pertussis
ccaggcccgccacggcgcccgagg

SEQ ID NO: 2341678 - RNA, 14 nt, Bordetella pertussis
ccaggcccgccagg

SEQ ID NO: 2341679 - RNA, 13 nt, Bordetella pertussis
ccaggcccggcag

SEQ ID NO: 2341680 - RNA, 12 nt, Bordetella pertussis
ccaggcccggcc

SEQ ID NO: 2341681 - RNA, 14 nt, Bordetella pertussis
ccaggcccggccgc

SEQ ID NO: 2341682 - RNA, 15 nt, Bordetella pertussis
ccaggcccggccgca

SEQ ID NO: 2341683 - RNA, 15 nt, Bordetella pertussis
ccaggcccggcgcgc

SEQ ID NO: 2341684 - RNA, 17 nt, Bordetella pertussis
ccaggcccucgcggccg

SEQ ID NO: 2341685 - RNA, 20 nt, Bordetella pertussis
ccaggcccucgcggccgucg

SEQ ID NO: 2341686 - RNA, 20 nt, Bordetella pertussis
ccaggcccuggcggcgcagu

SEQ ID NO: 2341687 - RNA, 22 nt, Bordetella pertussis
ccaggcccuggcuggccagccg

SEQ ID NO: 2341688 - RNA, 13 nt, Bordetella pertussis
ccaggccgaacgc

SEQ ID NO: 2341689 - RNA, 21 nt, Bordetella pertussis
ccaggccgaacuucagcccgg

SEQ ID NO: 2341690 - RNA, 19 nt, Bordetella pertussis
ccaggccgaagccaccguc

SEQ ID NO: 2341691 - RNA, 15 nt, Bordetella pertussis
ccaggccgaccaugu

SEQ ID NO: 2341692 - RNA, 15 nt, Bordetella pertussis
ccaggccgaucagcg

SEQ ID NO: 2341693 - RNA, 19 nt, Bordetella pertussis
ccaggccgaucagcgacag

SEQ ID NO: 2341694 - RNA, 22 nt, Bordetella pertussis
ccaggccgaugaauugcgccac

SEQ ID NO: 2341695 - RNA, 19 nt, Bordetella pertussis
ccaggccgcauacgacacg

SEQ ID NO: 2341696 - RNA, 15 nt, Bordetella pertussis
ccaggccgccagggc

SEQ ID NO: 2341697 - RNA, 14 nt, Bordetella pertussis
ccaggccgcccagc

SEQ ID NO: 2341698 - RNA, 17 nt, Bordetella pertussis
ccaggccgcccagccgc

SEQ ID NO: 2341699 - RNA, 14 nt, Bordetella pertussis
ccaggccgccgccg

SEQ ID NO: 2341700 - RNA, 14 nt, Bordetella pertussis
ccaggccgccggcc

SEQ ID NO: 2341701 - RNA, 17 nt, Bordetella pertussis
ccaggccgccggccagc

SEQ ID NO: 2341702 - RNA, 16 nt, Bordetella pertussis
ccaggccgccggcggc

SEQ ID NO: 2341703 - RNA, 17 nt, Bordetella pertussis
ccaggccgccggcggcg

SEQ ID NO: 2341704 - RNA, 14 nt, Bordetella pertussis
ccaggccgcggcgc

SEQ ID NO: 2341705 - RNA, 19 nt, Bordetella pertussis
ccaggccgcggcgcccggu

SEQ ID NO: 2341706 - RNA, 21 nt, Bordetella pertussis
ccaggccgcggcgcccggugc

SEQ ID NO: 2341707 - RNA, 23 nt, Bordetella pertussis
ccaggccgcuuucgaccagcgac

SEQ ID NO: 2341708 - RNA, 16 nt, Bordetella pertussis
ccaggccggcaugcgc

SEQ ID NO: 2341709 - RNA, 12 nt, Bordetella pertussis
ccaggccggcca

SEQ ID NO: 2341710 - RNA, 16 nt, Bordetella pertussis
ccaggccggccagggc

SEQ ID NO: 2341711 - RNA, 18 nt, Bordetella pertussis
ccaggccggcccagucca

SEQ ID NO: 2341712 - RNA, 23 nt, Bordetella pertussis
ccaggccggcccaguccagggug

SEQ ID NO: 2341713 - RNA, 16 nt, Bordetella pertussis
ccaggccggccugcag

SEQ ID NO: 2341714 - RNA, 19 nt, Bordetella pertussis
ccaggccggccugcaggcu

SEQ ID NO: 2341715 - RNA, 18 nt, Bordetella pertussis
ccaggccggccuuggcca

SEQ ID NO: 2341716 - RNA, 19 nt, Bordetella pertussis
ccaggccggccuuggccau

SEQ ID NO: 2341717 - RNA, 17 nt, Bordetella pertussis
ccaggccggcgccagcc

SEQ ID NO: 2341718 - RNA, 14 nt, Bordetella pertussis
ccaggccggcgcgc

SEQ ID NO: 2341719 - RNA, 18 nt, Bordetella pertussis
ccaggccggcgcgccggc

SEQ ID NO: 2341720 - RNA, 16 nt, Bordetella pertussis
ccaggccggcggcggg

SEQ ID NO: 2341721 - RNA, 18 nt, Bordetella pertussis
ccaggccggcucgccgca

SEQ ID NO: 2341722 - RNA, 16 nt, Bordetella pertussis
ccaggccgggcgagcc

SEQ ID NO: 2341723 - RNA, 17 nt, Bordetella pertussis
ccaggccgggcgagccg

SEQ ID NO: 2341724 - RNA, 23 nt, Bordetella pertussis
ccaggccggggaaacggccaagc

SEQ ID NO: 2341725 - RNA, 12 nt, Bordetella pertussis
ccaggccggggc

SEQ ID NO: 2341726 - RNA, 17 nt, Bordetella pertussis
ccaggccggggccgccc

SEQ ID NO: 2341727 - RNA, 19 nt, Bordetella pertussis
ccaggccggggccgcccag

SEQ ID NO: 2341728 - RNA, 22 nt, Bordetella pertussis
ccaggccggggccgcccagcac

SEQ ID NO: 2341729 - RNA, 14 nt, Bordetella pertussis
ccaggccggugcgc

SEQ ID NO: 2341730 - RNA, 20 nt, Bordetella pertussis
ccaggccgguggaccagggc

SEQ ID NO: 2341731 - RNA, 22 nt, Bordetella pertussis
ccaggccgguggaccagggcac

SEQ ID NO: 2341732 - RNA, 12 nt, Bordetella pertussis
ccaggccgucga

SEQ ID NO: 2341733 - RNA, 21 nt, Bordetella pertussis
ccaggccgucgagcacggggc

SEQ ID NO: 2341734 - RNA, 14 nt, Bordetella pertussis
ccaggccgucggcc

SEQ ID NO: 2341735 - RNA, 15 nt, Bordetella pertussis
ccaggccgucggcca

SEQ ID NO: 2341736 - RNA, 17 nt, Bordetella pertussis
ccaggccguggcgcacc

SEQ ID NO: 2341737 - RNA, 11 nt, Bordetella pertussis
ccaggccugcc

SEQ ID NO: 2341738 - RNA, 21 nt, Bordetella pertussis
ccaggccuucgacguccagcc

SEQ ID NO: 2341739 - RNA, 15 nt, Bordetella pertussis
ccaggcgacccagca

SEQ ID NO: 2341740 - RNA, 16 nt, Bordetella pertussis
ccaggcgacccagcac

SEQ ID NO: 2341741 - RNA, 22 nt, Bordetella pertussis
ccaggcgaggcuggcgcccacg

SEQ ID NO: 2341742 - RNA, 16 nt, Bordetella pertussis
ccaggcgaugcccagc

SEQ ID NO: 2341743 - RNA, 21 nt, Bordetella pertussis
ccaggcgaugcccagcgccgc

SEQ ID NO: 2341744 - RNA, 15 nt, Bordetella pertussis
ccaggcgcagccgcg

SEQ ID NO: 2341745 - RNA, 20 nt, Bordetella pertussis
ccaggcgcagccgcgcgccu

SEQ ID NO: 2341746 - RNA, 15 nt, Bordetella pertussis
ccaggcgcaggcgcg

SEQ ID NO: 2341747 - RNA, 16 nt, Bordetella pertussis
ccaggcgcaguaucug

SEQ ID NO: 2341748 - RNA, 22 nt, Bordetella pertussis
ccaggcgcaguaucuggugcgc

SEQ ID NO: 2341749 - RNA, 22 nt, Bordetella pertussis
ccaggcgcauguccgccacgcc

SEQ ID NO: 2341750 - RNA, 13 nt, Bordetella pertussis
ccaggcgccagcg

SEQ ID NO: 2341751 - RNA, 18 nt, Bordetella pertussis
ccaggcgccccacccggg

SEQ ID NO: 2341752 - RNA, 20 nt, Bordetella pertussis
ccaggcgcccgagagcugcg

SEQ ID NO: 2341753 - RNA, 14 nt, Bordetella pertussis
ccaggcgcccgcca

SEQ ID NO: 2341754 - RNA, 16 nt, Bordetella pertussis
ccaggcgcccgccacc

SEQ ID NO: 2341755 - RNA, 12 nt, Bordetella pertussis
ccaggcgcccgg

SEQ ID NO: 2341756 - RNA, 13 nt, Bordetella pertussis
ccaggcgcccggc

SEQ ID NO: 2341757 - RNA, 21 nt, Bordetella pertussis
ccaggcgccgauccagggccg

SEQ ID NO: 2341758 - RNA, 12 nt, Bordetella pertussis
ccaggcgccgcg

SEQ ID NO: 2341759 - RNA, 18 nt, Bordetella pertussis
ccaggcgccgcguccggc

SEQ ID NO: 2341760 - RNA, 18 nt, Bordetella pertussis
ccaggcgccgcucagcgc

SEQ ID NO: 2341761 - RNA, 14 nt, Bordetella pertussis
ccaggcgccgggcc

SEQ ID NO: 2341762 - RNA, 16 nt, Bordetella pertussis
ccaggcgccgggccgc

SEQ ID NO: 2341763 - RNA, 11 nt, Bordetella pertussis
ccaggcgcgca

SEQ ID NO: 2341764 - RNA, 12 nt, Bordetella pertussis
ccaggcgcgcca

SEQ ID NO: 2341765 - RNA, 13 nt, Bordetella pertussis
ccaggcgcgccag

SEQ ID NO: 2341766 - RNA, 14 nt, Bordetella pertussis
ccaggcgcgccagc

SEQ ID NO: 2341767 - RNA, 15 nt, Bordetella pertussis
ccaggcgcgccagcc

SEQ ID NO: 2341768 - RNA, 18 nt, Bordetella pertussis
ccaggcgcgccagccgcu

SEQ ID NO: 2341769 - RNA, 23 nt, Bordetella pertussis
ccaggcgcgccagccgcugcagc

SEQ ID NO: 2341770 - RNA, 12 nt, Bordetella pertussis
ccaggcgcgccg

SEQ ID NO: 2341771 - RNA, 14 nt, Bordetella pertussis
ccaggcgcgccgcg

SEQ ID NO: 2341772 - RNA, 11 nt, Bordetella pertussis
ccaggcgcgcg

SEQ ID NO: 2341773 - RNA, 14 nt, Bordetella pertussis
ccaggcgcgcuggc

SEQ ID NO: 2341774 - RNA, 14 nt, Bordetella pertussis
ccaggcgcggcgua

SEQ ID NO: 2341775 - RNA, 17 nt, Bordetella pertussis
ccaggcgcgugcgcagg

SEQ ID NO: 2341776 - RNA, 21 nt, Bordetella pertussis
ccaggcgcgugggcaggugcu

SEQ ID NO: 2341777 - RNA, 16 nt, Bordetella pertussis
ccaggcgcucagccgu

SEQ ID NO: 2341778 - RNA, 20 nt, Bordetella pertussis
ccaggcgcucagccgugccg

SEQ ID NO: 2341779 - RNA, 16 nt, Bordetella pertussis
ccaggcgcuccagcac

SEQ ID NO: 2341780 - RNA, 19 nt, Bordetella pertussis
ccaggcgcuccagcaccug

SEQ ID NO: 2341781 - RNA, 15 nt, Bordetella pertussis
ccaggcgcucgcgcg

SEQ ID NO: 2341782 - RNA, 20 nt, Bordetella pertussis
ccaggcgcucgcgggugcgc

SEQ ID NO: 2341783 - RNA, 20 nt, Bordetella pertussis
ccaggcgcucggcguugcug

SEQ ID NO: 2341784 - RNA, 21 nt, Bordetella pertussis
ccaggcggcaggcgccgccgc

SEQ ID NO: 2341785 - RNA, 14 nt, Bordetella pertussis
ccaggcggccacca

SEQ ID NO: 2341786 - RNA, 20 nt, Bordetella pertussis
ccaggcggccaccaccaggc

SEQ ID NO: 2341787 - RNA, 15 nt, Bordetella pertussis
ccaggcggccaguuc

SEQ ID NO: 2341788 - RNA, 18 nt, Bordetella pertussis
ccaggcggccaucgccgc

SEQ ID NO: 2341789 - RNA, 19 nt, Bordetella pertussis
ccaggcggccaucgccgcc

SEQ ID NO: 2341790 - RNA, 14 nt, Bordetella pertussis
ccaggcggccgcgg

SEQ ID NO: 2341791 - RNA, 20 nt, Bordetella pertussis
ccaggcggcggcgcggcgcc

SEQ ID NO: 2341792 - RNA, 19 nt, Bordetella pertussis
ccaggcgggcaucgcccac

SEQ ID NO: 2341793 - RNA, 15 nt, Bordetella pertussis
ccaggcgggccaggu

SEQ ID NO: 2341794 - RNA, 20 nt, Bordetella pertussis
ccaggcgggguggcacagcc

SEQ ID NO: 2341795 - RNA, 17 nt, Bordetella pertussis
ccaggcgguacaggccg

SEQ ID NO: 2341796 - RNA, 20 nt, Bordetella pertussis
ccaggcgguacaggccggcg

SEQ ID NO: 2341797 - RNA, 22 nt, Bordetella pertussis
ccaggcgguacaggccggcggc

SEQ ID NO: 2341798 - RNA, 23 nt, Bordetella pertussis
ccaggcggucauagacggcgucg

SEQ ID NO: 2341799 - RNA, 18 nt, Bordetella pertussis
ccaggcggugcguccagg

SEQ ID NO: 2341800 - RNA, 16 nt, Bordetella pertussis
ccaggcgguuggccuu

SEQ ID NO: 2341801 - RNA, 19 nt, Bordetella pertussis
ccaggcguccaggcugccg

SEQ ID NO: 2341802 - RNA, 21 nt, Bordetella pertussis
ccaggcguccaggcugccggc

SEQ ID NO: 2341803 - RNA, 14 nt, Bordetella pertussis
ccaggcgucggcgg

SEQ ID NO: 2341804 - RNA, 18 nt, Bordetella pertussis
ccaggcgugaacgccccg

SEQ ID NO: 2341805 - RNA, 22 nt, Bordetella pertussis
ccaggcgugaacgccccggccg

SEQ ID NO: 2341806 - RNA, 14 nt, Bordetella pertussis
ccaggcucaggcgg

SEQ ID NO: 2341807 - RNA, 19 nt, Bordetella pertussis
ccaggcucaggcggccagg

SEQ ID NO: 2341808 - RNA, 18 nt, Bordetella pertussis
ccaggcuccggcuugccg

SEQ ID NO: 2341809 - RNA, 18 nt, Bordetella pertussis
ccaggcugaaugccgccg

SEQ ID NO: 2341810 - RNA, 16 nt, Bordetella pertussis
ccaggcugaucaccca

SEQ ID NO: 2341811 - RNA, 16 nt, Bordetella pertussis
ccaggcugcccuggcc

SEQ ID NO: 2341812 - RNA, 19 nt, Bordetella pertussis
ccaggcugcccuggcccag

SEQ ID NO: 2341813 - RNA, 20 nt, Bordetella pertussis
ccaggcugcccuggcccagg

SEQ ID NO: 2341814 - RNA, 13 nt, Bordetella pertussis
ccaggcuggaguc

SEQ ID NO: 2341815 - RNA, 22 nt, Bordetella pertussis
ccaggcuggagucgggcugcug

SEQ ID NO: 2341816 - RNA, 23 nt, Bordetella pertussis
ccaggcuggggccgagcgugccg

SEQ ID NO: 2341817 - RNA, 14 nt, Bordetella pertussis
ccaggcugucgucg

SEQ ID NO: 2341818 - RNA, 17 nt, Bordetella pertussis
ccaggcuuucgaagccg

SEQ ID NO: 2341819 - RNA, 20 nt, Bordetella pertussis
ccaggcuuucgaagccgccc

SEQ ID NO: 2341820 - RNA, 17 nt, Bordetella pertussis
ccaggcuuugcgcgcca

SEQ ID NO: 2341821 - RNA, 22 nt, Bordetella pertussis
ccagggaccaauacgccgccau

SEQ ID NO: 2341822 - RNA, 21 nt, Bordetella pertussis
ccagggagugcgaggacgacc

SEQ ID NO: 2341823 - RNA, 17 nt, Bordetella pertussis
ccagggcaagcgcgucg

SEQ ID NO: 2341824 - RNA, 13 nt, Bordetella pertussis
ccagggcaggagg

SEQ ID NO: 2341825 - RNA, 16 nt, Bordetella pertussis
ccagggcagggcgccg

SEQ ID NO: 2341826 - RNA, 22 nt, Bordetella pertussis
ccagggcagggcgccguccagu

SEQ ID NO: 2341827 - RNA, 17 nt, Bordetella pertussis
ccagggccaccacgccg

SEQ ID NO: 2341828 - RNA, 22 nt, Bordetella pertussis
ccagggccacgcccacgcgccg

SEQ ID NO: 2341829 - RNA, 16 nt, Bordetella pertussis
ccagggccacgccggc

SEQ ID NO: 2341830 - RNA, 18 nt, Bordetella pertussis
ccagggccacgccggccg

SEQ ID NO: 2341831 - RNA, 19 nt, Bordetella pertussis
ccagggccacgccggccgc

SEQ ID NO: 2341832 - RNA, 16 nt, Bordetella pertussis
ccagggccaggccgcc

SEQ ID NO: 2341833 - RNA, 17 nt, Bordetella pertussis
ccagggccaggccgccg

SEQ ID NO: 2341834 - RNA, 18 nt, Bordetella pertussis
ccagggccaggccgccgc

SEQ ID NO: 2341835 - RNA, 20 nt, Bordetella pertussis
ccagggccccuccggcgccg

SEQ ID NO: 2341836 - RNA, 15 nt, Bordetella pertussis
ccagggccgcagcaa

SEQ ID NO: 2341837 - RNA, 14 nt, Bordetella pertussis
ccagggccgccagc

SEQ ID NO: 2341838 - RNA, 15 nt, Bordetella pertussis
ccagggccgccagca

SEQ ID NO: 2341839 - RNA, 16 nt, Bordetella pertussis
ccagggccgccagcac

SEQ ID NO: 2341840 - RNA, 21 nt, Bordetella pertussis
ccagggccgccgcgcccagcc

SEQ ID NO: 2341841 - RNA, 22 nt, Bordetella pertussis
ccagggccgccgcgcccagccg

SEQ ID NO: 2341842 - RNA, 11 nt, Bordetella pertussis
ccagggccgcg

SEQ ID NO: 2341843 - RNA, 14 nt, Bordetella pertussis
ccagggccgcgccg

SEQ ID NO: 2341844 - RNA, 16 nt, Bordetella pertussis
ccagggccgcgccggg

SEQ ID NO: 2341845 - RNA, 19 nt, Bordetella pertussis
ccagggccugcgggccggg

SEQ ID NO: 2341846 - RNA, 20 nt, Bordetella pertussis
ccagggcgauuucgcugaug

SEQ ID NO: 2341847 - RNA, 12 nt, Bordetella pertussis
ccagggcgcccg

SEQ ID NO: 2341848 - RNA, 14 nt, Bordetella pertussis
ccagggcgcccgcc

SEQ ID NO: 2341849 - RNA, 15 nt, Bordetella pertussis
ccagggcgcccgccg

SEQ ID NO: 2341850 - RNA, 13 nt, Bordetella pertussis
ccagggcgccgcg

SEQ ID NO: 2341851 - RNA, 12 nt, Bordetella pertussis
ccagggcgcgca

SEQ ID NO: 2341852 - RNA, 12 nt, Bordetella pertussis
ccagggcgcgcc

SEQ ID NO: 2341853 - RNA, 13 nt, Bordetella pertussis
ccagggcgcgccg

SEQ ID NO: 2341854 - RNA, 14 nt, Bordetella pertussis
ccagggcgcgccgc

SEQ ID NO: 2341855 - RNA, 17 nt, Bordetella pertussis
ccagggcgcgccgcagc

SEQ ID NO: 2341856 - RNA, 20 nt, Bordetella pertussis
ccagggcgcgccggaacaug

SEQ ID NO: 2341857 - RNA, 18 nt, Bordetella pertussis
ccagggcggugggcagcg

SEQ ID NO: 2341858 - RNA, 20 nt, Bordetella pertussis
ccagggcggugggcagcgcg

SEQ ID NO: 2341859 - RNA, 15 nt, Bordetella pertussis
ccagggcgucggcga

SEQ ID NO: 2341860 - RNA, 18 nt, Bordetella pertussis
ccagggcuugacgcgcgu

SEQ ID NO: 2341861 - RNA, 19 nt, Bordetella pertussis
ccagggcuugcggcgcugg

SEQ ID NO: 2341862 - RNA, 22 nt, Bordetella pertussis
ccagggcuugcggcgcuggcug

SEQ ID NO: 2341863 - RNA, 14 nt, Bordetella pertussis
ccaggggacggcgc

SEQ ID NO: 2341864 - RNA, 21 nt, Bordetella pertussis
ccaggggacggcgcacccgcg

SEQ ID NO: 2341865 - RNA, 21 nt, Bordetella pertussis
ccaggggcagcucggugcagc

SEQ ID NO: 2341866 - RNA, 13 nt, Bordetella pertussis
ccaggggccggcg

SEQ ID NO: 2341867 - RNA, 18 nt, Bordetella pertussis
ccaggggccggcgcgccg

SEQ ID NO: 2341868 - RNA, 22 nt, Bordetella pertussis
ccaggggccggcgcgccgcgcc

SEQ ID NO: 2341869 - RNA, 24 nt, Bordetella pertussis
ccaggggccggcgcgccgcgccgc

SEQ ID NO: 2341870 - RNA, 16 nt, Bordetella pertussis
ccaggggcgcuggucg

SEQ ID NO: 2341871 - RNA, 12 nt, Bordetella pertussis
ccaggggcggcg

SEQ ID NO: 2341872 - RNA, 17 nt, Bordetella pertussis
ccaggggcggcgcggcg

SEQ ID NO: 2341873 - RNA, 18 nt, Bordetella pertussis
ccagggggucagggccgc

SEQ ID NO: 2341874 - RNA, 19 nt, Bordetella pertussis
ccagggggucagggccgcc

SEQ ID NO: 2341875 - RNA, 15 nt, Bordetella pertussis
ccagggucugcuggu

SEQ ID NO: 2341876 - RNA, 16 nt, Bordetella pertussis
ccagggugaccuggcg

SEQ ID NO: 2341877 - RNA, 22 nt, Bordetella pertussis
ccagggugaccuggcgcgcgaa

SEQ ID NO: 2341878 - RNA, 16 nt, Bordetella pertussis
ccagggugccccgccg

SEQ ID NO: 2341879 - RNA, 14 nt, Bordetella pertussis
ccagggugccgccu

SEQ ID NO: 2341880 - RNA, 18 nt, Bordetella pertussis
ccaggguggccaguuccg

SEQ ID NO: 2341881 - RNA, 16 nt, Bordetella pertussis
ccaggguggcgccggc

SEQ ID NO: 2341882 - RNA, 17 nt, Bordetella pertussis
ccaggguggcguccugg

SEQ ID NO: 2341883 - RNA, 17 nt, Bordetella pertussis
ccagggugguggccucg

SEQ ID NO: 2341884 - RNA, 14 nt, Bordetella pertussis
ccaggguguccugg

SEQ ID NO: 2341885 - RNA, 18 nt, Bordetella pertussis
ccaggguguccuggucgg

SEQ ID NO: 2341886 - RNA, 20 nt, Bordetella pertussis
ccaggguuuccucgccgacg

SEQ ID NO: 2341887 - RNA, 21 nt, Bordetella pertussis
ccaggguuuccucgccgacga

SEQ ID NO: 2341888 - RNA, 23 nt, Bordetella pertussis
ccagguaagcuggcgcuuggcca

SEQ ID NO: 2341889 - RNA, 13 nt, Bordetella pertussis
ccagguacaggcc

SEQ ID NO: 2341890 - RNA, 16 nt, Bordetella pertussis
ccagguacaggccgcc

SEQ ID NO: 2341891 - RNA, 21 nt, Bordetella pertussis
ccagguacaucauccccagcg

SEQ ID NO: 2341892 - RNA, 14 nt, Bordetella pertussis
ccagguacccggcu

SEQ ID NO: 2341893 - RNA, 16 nt, Bordetella pertussis
ccagguagcgccucgc

SEQ ID NO: 2341894 - RNA, 14 nt, Bordetella pertussis
ccagguagcgggug

SEQ ID NO: 2341895 - RNA, 15 nt, Bordetella pertussis
ccagguaggccggcg

SEQ ID NO: 2341896 - RNA, 17 nt, Bordetella pertussis
ccagguaggcggcgcgc

SEQ ID NO: 2341897 - RNA, 19 nt, Bordetella pertussis
ccagguaggcggcgcgccc

SEQ ID NO: 2341898 - RNA, 21 nt, Bordetella pertussis
ccagguaggcggcgcgcccgc

SEQ ID NO: 2341899 - RNA, 15 nt, Bordetella pertussis
ccagguagggcagca

SEQ ID NO: 2341900 - RNA, 23 nt, Bordetella pertussis
ccagguagucgucgaaggcgcgc

SEQ ID NO: 2341901 - RNA, 13 nt, Bordetella pertussis
ccagguaucggcc

SEQ ID NO: 2341902 - RNA, 17 nt, Bordetella pertussis
ccagguaucggccagca

SEQ ID NO: 2341903 - RNA, 20 nt, Bordetella pertussis
ccagguaucggccagcacgu

SEQ ID NO: 2341904 - RNA, 23 nt, Bordetella pertussis
ccagguauugcucggcggucagc

SEQ ID NO: 2341905 - RNA, 23 nt, Bordetella pertussis
ccagguccgaaccgaccgccacg

SEQ ID NO: 2341906 - RNA, 15 nt, Bordetella pertussis
ccagguccgccggca

SEQ ID NO: 2341907 - RNA, 16 nt, Bordetella pertussis
ccagguccgccggcac

SEQ ID NO: 2341908 - RNA, 15 nt, Bordetella pertussis
ccagguccugcgcca

SEQ ID NO: 2341909 - RNA, 18 nt, Bordetella pertussis
ccagguccugcgccagcu

SEQ ID NO: 2341910 - RNA, 12 nt, Bordetella pertussis
ccagguccuggc

SEQ ID NO: 2341911 - RNA, 14 nt, Bordetella pertussis
ccagguccuggcgg

SEQ ID NO: 2341912 - RNA, 19 nt, Bordetella pertussis
ccagguccuggcggccgcc

SEQ ID NO: 2341913 - RNA, 24 nt, Bordetella pertussis
ccagguccuggcggccgcccagca

SEQ ID NO: 2341914 - RNA, 20 nt, Bordetella pertussis
ccagguccuugagguaccac

SEQ ID NO: 2341915 - RNA, 15 nt, Bordetella pertussis
ccaggucgauaucgc

SEQ ID NO: 2341916 - RNA, 13 nt, Bordetella pertussis
ccaggucgcgcac

SEQ ID NO: 2341917 - RNA, 14 nt, Bordetella pertussis
ccaggucgcgcacc

SEQ ID NO: 2341918 - RNA, 17 nt, Bordetella pertussis
ccaggucgcgcaccagg

SEQ ID NO: 2341919 - RNA, 22 nt, Bordetella pertussis
ccaggucgcggugcgccacgau

SEQ ID NO: 2341920 - RNA, 13 nt, Bordetella pertussis
ccaggucggacgc

SEQ ID NO: 2341921 - RNA, 17 nt, Bordetella pertussis
ccaggucggacgcgccg

SEQ ID NO: 2341922 - RNA, 23 nt, Bordetella pertussis
ccaggucggacgcgccgggcgaa

SEQ ID NO: 2341923 - RNA, 12 nt, Bordetella pertussis
ccaggucggcca

SEQ ID NO: 2341924 - RNA, 14 nt, Bordetella pertussis
ccaggucggccacc

SEQ ID NO: 2341925 - RNA, 19 nt, Bordetella pertussis
ccaggucggccaccgccgu

SEQ ID NO: 2341926 - RNA, 14 nt, Bordetella pertussis
ccaggucggccagc

SEQ ID NO: 2341927 - RNA, 17 nt, Bordetella pertussis
ccaggucggccagccgg

SEQ ID NO: 2341928 - RNA, 17 nt, Bordetella pertussis
ccaggucggcggccagc

SEQ ID NO: 2341929 - RNA, 18 nt, Bordetella pertussis
ccaggucggcggccagcg

SEQ ID NO: 2341930 - RNA, 23 nt, Bordetella pertussis
ccaggucggcggccagcgcgcaa

SEQ ID NO: 2341931 - RNA, 17 nt, Bordetella pertussis
ccaggucggcgucgucg

SEQ ID NO: 2341932 - RNA, 19 nt, Bordetella pertussis
ccaggucguacagcgccug

SEQ ID NO: 2341933 - RNA, 22 nt, Bordetella pertussis
ccaggucguacagcgccugcgc

SEQ ID NO: 2341934 - RNA, 23 nt, Bordetella pertussis
ccaggucguacagcgccugcgcg

SEQ ID NO: 2341935 - RNA, 16 nt, Bordetella pertussis
ccaggucguugcgcga

SEQ ID NO: 2341936 - RNA, 21 nt, Bordetella pertussis
ccaggucguugcgcgaagcgg

SEQ ID NO: 2341937 - RNA, 16 nt, Bordetella pertussis
ccaggucuacccgcgc

SEQ ID NO: 2341938 - RNA, 18 nt, Bordetella pertussis
ccaggucuacccgcgcga

SEQ ID NO: 2341939 - RNA, 13 nt, Bordetella pertussis
ccaggugccgcgu

SEQ ID NO: 2341940 - RNA, 15 nt, Bordetella pertussis
ccaggugcgcaugua

SEQ ID NO: 2341941 - RNA, 16 nt, Bordetella pertussis
ccaggugcgggccgcu

SEQ ID NO: 2341942 - RNA, 17 nt, Bordetella pertussis
ccagguggacagcgcca

SEQ ID NO: 2341943 - RNA, 18 nt, Bordetella pertussis
ccagguggacagcgccag

SEQ ID NO: 2341944 - RNA, 19 nt, Bordetella pertussis
ccagguggcccgcaccggg

SEQ ID NO: 2341945 - RNA, 13 nt, Bordetella pertussis
ccagguggcgaug

SEQ ID NO: 2341946 - RNA, 20 nt, Bordetella pertussis
ccagguggcgaugccgggca

SEQ ID NO: 2341947 - RNA, 20 nt, Bordetella pertussis
ccagguggcggacaggcccu

SEQ ID NO: 2341948 - RNA, 16 nt, Bordetella pertussis
ccagguggcggcggca

SEQ ID NO: 2341949 - RNA, 18 nt, Bordetella pertussis
ccaggugguuggcgugcc

SEQ ID NO: 2341950 - RNA, 19 nt, Bordetella pertussis
ccaggugguuggcgugccc

SEQ ID NO: 2341951 - RNA, 15 nt, Bordetella pertussis
ccagguucuggucga

SEQ ID NO: 2341952 - RNA, 17 nt, Bordetella pertussis
ccagguugaaggccgcg

SEQ ID NO: 2341953 - RNA, 18 nt, Bordetella pertussis
ccagguugaaggccgcga

SEQ ID NO: 2341954 - RNA, 19 nt, Bordetella pertussis
ccagguugaaggccgcgau

SEQ ID NO: 2341955 - RNA, 19 nt, Bordetella pertussis
ccagguugcauccggcccg

SEQ ID NO: 2341956 - RNA, 19 nt, Bordetella pertussis
ccagguuggcgauggcguc

SEQ ID NO: 2341957 - RNA, 17 nt, Bordetella pertussis
ccagguugggugcgccg

SEQ ID NO: 2341958 - RNA, 20 nt, Bordetella pertussis
ccagguugggugcgccgccg

SEQ ID NO: 2341959 - RNA, 16 nt, Bordetella pertussis
ccagguugucgcgcga

SEQ ID NO: 2341960 - RNA, 15 nt, Bordetella pertussis
ccagguugucggcca

SEQ ID NO: 2341961 - RNA, 15 nt, Bordetella pertussis
ccagguugucggcgc

SEQ ID NO: 2341962 - RNA, 22 nt, Bordetella pertussis
ccagguugugguucaugacguc

SEQ ID NO: 2341963 - RNA, 18 nt, Bordetella pertussis
ccaguacaccaggucguc

SEQ ID NO: 2341964 - RNA, 24 nt, Bordetella pertussis
ccaguacaccggcgugcagagcac

SEQ ID NO: 2341965 - RNA, 16 nt, Bordetella pertussis
ccaguacaggcugccg

SEQ ID NO: 2341966 - RNA, 22 nt, Bordetella pertussis
ccaguaccugacccugcgcacc

SEQ ID NO: 2341967 - RNA, 16 nt, Bordetella pertussis
ccaguacgaugccguc

SEQ ID NO: 2341968 - RNA, 15 nt, Bordetella pertussis
ccaguacgucggaca

SEQ ID NO: 2341969 - RNA, 17 nt, Bordetella pertussis
ccaguacgucggacagg

SEQ ID NO: 2341970 - RNA, 23 nt, Bordetella pertussis
ccaguacgucggacagggccccg

SEQ ID NO: 2341971 - RNA, 18 nt, Bordetella pertussis
ccaguagcacacgccgau

SEQ ID NO: 2341972 - RNA, 14 nt, Bordetella pertussis
ccaguagcgccggc

SEQ ID NO: 2341973 - RNA, 17 nt, Bordetella pertussis
ccaguagcgugugcagg

SEQ ID NO: 2341974 - RNA, 20 nt, Bordetella pertussis
ccaguaggcgccccaggcgu

SEQ ID NO: 2341975 - RNA, 23 nt, Bordetella pertussis
ccaguaucguuuucgcgaccugc

SEQ ID NO: 2341976 - RNA, 17 nt, Bordetella pertussis
ccaguccagcgcgccgc

SEQ ID NO: 2341977 - RNA, 16 nt, Bordetella pertussis
ccaguccaggccggcc

SEQ ID NO: 2341978 - RNA, 18 nt, Bordetella pertussis
ccaguccaggccggccug

SEQ ID NO: 2341979 - RNA, 23 nt, Bordetella pertussis
ccaguccaggguguccuggucgg

SEQ ID NO: 2341980 - RNA, 24 nt, Bordetella pertussis
ccaguccccaugcggggacuggca

SEQ ID NO: 2341981 - RNA, 20 nt, Bordetella pertussis
ccaguccccauguggggaca

SEQ ID NO: 2341982 - RNA, 21 nt, Bordetella pertussis
ccaguccccauguggggacag

SEQ ID NO: 2341983 - RNA, 19 nt, Bordetella pertussis
ccagucccccgcggggaca

SEQ ID NO: 2341984 - RNA, 20 nt, Bordetella pertussis
ccagucccccgcggggacag

SEQ ID NO: 2341985 - RNA, 21 nt, Bordetella pertussis
ccaguccccgcauggggacug

SEQ ID NO: 2341986 - RNA, 18 nt, Bordetella pertussis
ccaguccccgcggggaca

SEQ ID NO: 2341987 - RNA, 19 nt, Bordetella pertussis
ccaguccccgcggggacag

SEQ ID NO: 2341988 - RNA, 23 nt, Bordetella pertussis
ccaguccccgcggggacaggcuc

SEQ ID NO: 2341989 - RNA, 20 nt, Bordetella pertussis
ccaguccccguucggggaca

SEQ ID NO: 2341990 - RNA, 21 nt, Bordetella pertussis
ccaguccccguucggggacag

SEQ ID NO: 2341991 - RNA, 19 nt, Bordetella pertussis
ccaguccccugcggggaca

SEQ ID NO: 2341992 - RNA, 24 nt, Bordetella pertussis
ccaguccccugcggggacaggcac

SEQ ID NO: 2341993 - RNA, 16 nt, Bordetella pertussis
ccagucccgcaccggg

SEQ ID NO: 2341994 - RNA, 13 nt, Bordetella pertussis
ccaguccggcagc

SEQ ID NO: 2341995 - RNA, 19 nt, Bordetella pertussis
ccaguccggcagcacccag

SEQ ID NO: 2341996 - RNA, 16 nt, Bordetella pertussis
ccagucgacccaccug

SEQ ID NO: 2341997 - RNA, 20 nt, Bordetella pertussis
ccagucgacccaccuggcca

SEQ ID NO: 2341998 - RNA, 21 nt, Bordetella pertussis
ccagucgacccaccuggccac

SEQ ID NO: 2341999 - RNA, 16 nt, Bordetella pertussis
ccagucgccgcgcccg

SEQ ID NO: 2342000 - RNA, 17 nt, Bordetella pertussis
ccagucgccgcgcccgc

SEQ ID NO: 2342001 - RNA, 14 nt, Bordetella pertussis
ccagucgccgcggu

SEQ ID NO: 2342002 - RNA, 18 nt, Bordetella pertussis
ccagucguccagcacgcg

SEQ ID NO: 2342003 - RNA, 20 nt, Bordetella pertussis
ccagucguccagcacgcggc

SEQ ID NO: 2342004 - RNA, 20 nt, Bordetella pertussis
ccagugaaacgcgacgcgcc

SEQ ID NO: 2342005 - RNA, 21 nt, Bordetella pertussis
ccagugaaacgcgacgcgccg

SEQ ID NO: 2342006 - RNA, 22 nt, Bordetella pertussis
ccagugaaacgcgacgcgccgg

SEQ ID NO: 2342007 - RNA, 22 nt, Bordetella pertussis
ccagugcaggggguggcggccg

SEQ ID NO: 2342008 - RNA, 12 nt, Bordetella pertussis
ccagugccugga

SEQ ID NO: 2342009 - RNA, 17 nt, Bordetella pertussis
ccagugccuggacgcgc

SEQ ID NO: 2342010 - RNA, 19 nt, Bordetella pertussis
ccagugcgccggcgcggcg

SEQ ID NO: 2342011 - RNA, 22 nt, Bordetella pertussis
ccaguggcgcggcgucgaaggc

SEQ ID NO: 2342012 - RNA, 14 nt, Bordetella pertussis
ccaguggugcuccc

SEQ ID NO: 2342013 - RNA, 17 nt, Bordetella pertussis
ccaguuccacgcggccg

SEQ ID NO: 2342014 - RNA, 16 nt, Bordetella pertussis
ccaguuccagcacgac

SEQ ID NO: 2342015 - RNA, 18 nt, Bordetella pertussis
ccaguuccgugcgcgccc

SEQ ID NO: 2342016 - RNA, 19 nt, Bordetella pertussis
ccaguuccgugcgcgcccg

SEQ ID NO: 2342017 - RNA, 19 nt, Bordetella pertussis
ccaguucgcgcagauccca

SEQ ID NO: 2342018 - RNA, 15 nt, Bordetella pertussis
ccaguucgcgcagca

SEQ ID NO: 2342019 - RNA, 17 nt, Bordetella pertussis
ccaguucgcggccggcc

SEQ ID NO: 2342020 - RNA, 16 nt, Bordetella pertussis
ccaguucgcggcgcag

SEQ ID NO: 2342021 - RNA, 16 nt, Bordetella pertussis
ccaguucgcuuuccag

SEQ ID NO: 2342022 - RNA, 14 nt, Bordetella pertussis
ccaguucggccagc

SEQ ID NO: 2342023 - RNA, 12 nt, Bordetella pertussis
ccaguucggccg

SEQ ID NO: 2342024 - RNA, 14 nt, Bordetella pertussis
ccaguucggccgcc

SEQ ID NO: 2342025 - RNA, 17 nt, Bordetella pertussis
ccaguucggccgccagg

SEQ ID NO: 2342026 - RNA, 14 nt, Bordetella pertussis
ccaguucgucgucg

SEQ ID NO: 2342027 - RNA, 23 nt, Bordetella pertussis
ccaguugaaucggcgcgagcgug

SEQ ID NO: 2342028 - RNA, 19 nt, Bordetella pertussis
ccaguugccgccgccggcg

SEQ ID NO: 2342029 - RNA, 15 nt, Bordetella pertussis
ccaguugcgggcgca

SEQ ID NO: 2342030 - RNA, 20 nt, Bordetella pertussis
ccaguugcggggcgcccagc

SEQ ID NO: 2342031 - RNA, 21 nt, Bordetella pertussis
ccaguugcggggcgcccagcg

SEQ ID NO: 2342032 - RNA, 18 nt, Bordetella pertussis
ccaguuggcccuucuuca

SEQ ID NO: 2342033 - RNA, 21 nt, Bordetella pertussis
ccauaaggcuucucgaccagg

SEQ ID NO: 2342034 - RNA, 20 nt, Bordetella pertussis
ccauacaacgaguaccugcu

SEQ ID NO: 2342035 - RNA, 20 nt, Bordetella pertussis
ccauacagcaaggacaaggc

SEQ ID NO: 2342036 - RNA, 23 nt, Bordetella pertussis
ccauacagcaaggacaaggcgcg

SEQ ID NO: 2342037 - RNA, 16 nt, Bordetella pertussis
ccauaccagcccggcg

SEQ ID NO: 2342038 - RNA, 15 nt, Bordetella pertussis
ccauaggccagcgcc

SEQ ID NO: 2342039 - RNA, 12 nt, Bordetella pertussis
ccauaggcgcgc

SEQ ID NO: 2342040 - RNA, 19 nt, Bordetella pertussis
ccauaggcgcgcaccagcc

SEQ ID NO: 2342041 - RNA, 20 nt, Bordetella pertussis
ccauagggcgacugcagcag

SEQ ID NO: 2342042 - RNA, 20 nt, Bordetella pertussis
ccauaucccugcggcagcga

SEQ ID NO: 2342043 - RNA, 12 nt, Bordetella pertussis
ccauaugcgcga

SEQ ID NO: 2342044 - RNA, 14 nt, Bordetella pertussis
ccauaugcgcgaag

SEQ ID NO: 2342045 - RNA, 16 nt, Bordetella pertussis
ccauauugaugcagca

SEQ ID NO: 2342046 - RNA, 22 nt, Bordetella pertussis
ccauauugaugcagcacgucgg

SEQ ID NO: 2342047 - RNA, 17 nt, Bordetella pertussis
ccaucaacgacaaagcc

SEQ ID NO: 2342048 - RNA, 23 nt, Bordetella pertussis
ccaucaacgggccgcuggucacc

SEQ ID NO: 2342049 - RNA, 12 nt, Bordetella pertussis
ccaucaaggcca

SEQ ID NO: 2342050 - RNA, 20 nt, Bordetella pertussis
ccaucaccauggccgacagc

SEQ ID NO: 2342051 - RNA, 15 nt, Bordetella pertussis
ccaucacgagcaggu

SEQ ID NO: 2342052 - RNA, 21 nt, Bordetella pertussis
ccaucagcagcaccuucugcc

SEQ ID NO: 2342053 - RNA, 16 nt, Bordetella pertussis
ccaucagccagccgcu

SEQ ID NO: 2342054 - RNA, 15 nt, Bordetella pertussis
ccaucagcucgacca

SEQ ID NO: 2342055 - RNA, 17 nt, Bordetella pertussis
ccaucagcucgaccacg

SEQ ID NO: 2342056 - RNA, 21 nt, Bordetella pertussis
ccaucagcucgaccacggcgg

SEQ ID NO: 2342057 - RNA, 15 nt, Bordetella pertussis
ccaucaggaacggca

SEQ ID NO: 2342058 - RNA, 12 nt, Bordetella pertussis
ccaucaggccga

SEQ ID NO: 2342059 - RNA, 22 nt, Bordetella pertussis
ccaucaggugcaggguuggcgc

SEQ ID NO: 2342060 - RNA, 23 nt, Bordetella pertussis
ccaucagguuguccagcgcgccc

SEQ ID NO: 2342061 - RNA, 17 nt, Bordetella pertussis
ccaucaucagcauggcg

SEQ ID NO: 2342062 - RNA, 19 nt, Bordetella pertussis
ccaucaucagcauggcgug

SEQ ID NO: 2342063 - RNA, 20 nt, Bordetella pertussis
ccaucauccuggucgacgcg

SEQ ID NO: 2342064 - RNA, 17 nt, Bordetella pertussis
ccaucaucugcggcacc

SEQ ID NO: 2342065 - RNA, 14 nt, Bordetella pertussis
ccaucauggccagg

SEQ ID NO: 2342066 - RNA, 13 nt, Bordetella pertussis
ccauccagccagg

SEQ ID NO: 2342067 - RNA, 14 nt, Bordetella pertussis
ccauccagccaggc

SEQ ID NO: 2342068 - RNA, 13 nt, Bordetella pertussis
ccauccgcgccac

SEQ ID NO: 2342069 - RNA, 22 nt, Bordetella pertussis
ccauccggccgcacgcggccgc

SEQ ID NO: 2342070 - RNA, 16 nt, Bordetella pertussis
ccauccguccgccagg

SEQ ID NO: 2342071 - RNA, 19 nt, Bordetella pertussis
ccauccguccgccaggacg

SEQ ID NO: 2342072 - RNA, 16 nt, Bordetella pertussis
ccauccucaucgugcu

SEQ ID NO: 2342073 - RNA, 15 nt, Bordetella pertussis
ccauccugccccagg

SEQ ID NO: 2342074 - RNA, 22 nt, Bordetella pertussis
ccauccuggccgauuucgcgcg

SEQ ID NO: 2342075 - RNA, 14 nt, Bordetella pertussis
ccauccuggccgcc

SEQ ID NO: 2342076 - RNA, 17 nt, Bordetella pertussis
ccauccuggccgccgcg

SEQ ID NO: 2342077 - RNA, 14 nt, Bordetella pertussis
ccaucgacaagcgc

SEQ ID NO: 2342078 - RNA, 21 nt, Bordetella pertussis
ccaucgacgcuugccggcgau

SEQ ID NO: 2342079 - RNA, 17 nt, Bordetella pertussis
ccaucgacgggcggcug

SEQ ID NO: 2342080 - RNA, 18 nt, Bordetella pertussis
ccaucgccgagccgcugu

SEQ ID NO: 2342081 - RNA, 13 nt, Bordetella pertussis
ccaucgccgccac

SEQ ID NO: 2342082 - RNA, 21 nt, Bordetella pertussis
ccaucgccgccacgugcacga

SEQ ID NO: 2342083 - RNA, 15 nt, Bordetella pertussis
ccaucgccgccgccg

SEQ ID NO: 2342084 - RNA, 20 nt, Bordetella pertussis
ccaucgccugcacgaccugc

SEQ ID NO: 2342085 - RNA, 19 nt, Bordetella pertussis
ccaucgcggucaucggcga

SEQ ID NO: 2342086 - RNA, 21 nt, Bordetella pertussis
ccaucgcggucgaugaccagc

SEQ ID NO: 2342087 - RNA, 15 nt, Bordetella pertussis
ccaucgcguccaggc

SEQ ID NO: 2342088 - RNA, 15 nt, Bordetella pertussis
ccaucgcgucgacgg

SEQ ID NO: 2342089 - RNA, 16 nt, Bordetella pertussis
ccaucgcgucgacggu

SEQ ID NO: 2342090 - RNA, 17 nt, Bordetella pertussis
ccaugcgggucaggccg

SEQ ID NO: 2342091 - RNA, 21 nt, Bordetella pertussis
ccaugcgggucaggccgccgu

SEQ ID NO: 2342092 - RNA, 15 nt, Bordetella pertussis
ccaugcggugcgccg

SEQ ID NO: 2342093 - RNA, 17 nt, Bordetella pertussis
ccaugcggugcgccgcg

SEQ ID NO: 2342094 - RNA, 15 nt, Bordetella pertussis
ccaugcucgcgcaca

SEQ ID NO: 2342095 - RNA, 22 nt, Bordetella pertussis
ccaugcucguccaucgccugca

SEQ ID NO: 2342096 - RNA, 20 nt, Bordetella pertussis
ccaugcugaauugcgggccg

SEQ ID NO: 2342097 - RNA, 24 nt, Bordetella pertussis
ccaugcugauccuggcauugagca

SEQ ID NO: 2342098 - RNA, 12 nt, Bordetella pertussis
ccaugcugccaa

SEQ ID NO: 2342099 - RNA, 15 nt, Bordetella pertussis
ccaugcugccaaccg

SEQ ID NO: 2342100 - RNA, 21 nt, Bordetella pertussis
ccaugcuggccgccgcgcuca

SEQ ID NO: 2342101 - RNA, 21 nt, Bordetella pertussis
ccaugcugggccaucagguug

SEQ ID NO: 2342102 - RNA, 12 nt, Bordetella pertussis
ccaugcugggcg

SEQ ID NO: 2342103 - RNA, 13 nt, Bordetella pertussis
ccaugcugggcgg

SEQ ID NO: 2342104 - RNA, 16 nt, Bordetella pertussis
ccaugcugggcgggcu

SEQ ID NO: 2342105 - RNA, 19 nt, Bordetella pertussis
ccaugcugggcgggcuggu

SEQ ID NO: 2342106 - RNA, 13 nt, Bordetella pertussis
ccauggacgccgg

SEQ ID NO: 2342107 - RNA, 14 nt, Bordetella pertussis
ccauggacgccggu

SEQ ID NO: 2342108 - RNA, 16 nt, Bordetella pertussis
ccauggaggcgcagcg

SEQ ID NO: 2342109 - RNA, 18 nt, Bordetella pertussis
ccauggaggcgcagcgcg

SEQ ID NO: 2342110 - RNA, 21 nt, Bordetella pertussis
ccauggaggcgcagcgcggca

SEQ ID NO: 2342111 - RNA, 14 nt, Bordetella pertussis
ccauggaugcgcgc

SEQ ID NO: 2342112 - RNA, 19 nt, Bordetella pertussis
ccauggcaagcgcaaugga

SEQ ID NO: 2342113 - RNA, 21 nt, Bordetella pertussis
ccauggcacaggccaucggcg

SEQ ID NO: 2342114 - RNA, 23 nt, Bordetella pertussis
ccauggcacaggccaucggcgcc

SEQ ID NO: 2342115 - RNA, 21 nt, Bordetella pertussis
ccauggcaccgauacgcugga

SEQ ID NO: 2342116 - RNA, 15 nt, Bordetella pertussis
ccauggcagggcgcc

SEQ ID NO: 2342117 - RNA, 22 nt, Bordetella pertussis
ccauggcaugaaaaagggcgca

SEQ ID NO: 2342118 - RNA, 19 nt, Bordetella pertussis
ccauggccagggaggaacu

SEQ ID NO: 2342119 - RNA, 22 nt, Bordetella pertussis
ccauggccagggaggaacuggg

SEQ ID NO: 2342120 - RNA, 14 nt, Bordetella pertussis
ccauggccggcguu

SEQ ID NO: 2342121 - RNA, 21 nt, Bordetella pertussis
ccauggccugcaaccugguca

SEQ ID NO: 2342122 - RNA, 22 nt, Bordetella pertussis
ccauggccugcaaccuggucaa

SEQ ID NO: 2342123 - RNA, 18 nt, Bordetella pertussis
ccauggcgcccacggccg

SEQ ID NO: 2342124 - RNA, 21 nt, Bordetella pertussis
ccauggcgccggcggccuccg

SEQ ID NO: 2342125 - RNA, 22 nt, Bordetella pertussis
ccauggcgcgauccuucgcggc

SEQ ID NO: 2342126 - RNA, 12 nt, Bordetella pertussis
ccauggcgcgca

SEQ ID NO: 2342127 - RNA, 17 nt, Bordetella pertussis
ccauggcgcuggcaggc

SEQ ID NO: 2342128 - RNA, 15 nt, Bordetella pertussis
ccauggcggccgccg

SEQ ID NO: 2342129 - RNA, 16 nt, Bordetella pertussis
ccauggcggccgccgc

SEQ ID NO: 2342130 - RNA, 18 nt, Bordetella pertussis
ccauggcggccgccgcca

SEQ ID NO: 2342131 - RNA, 14 nt, Bordetella pertussis
ccauggcggccggc

SEQ ID NO: 2342132 - RNA, 17 nt, Bordetella pertussis
ccauggcguaggccucg

SEQ ID NO: 2342133 - RNA, 21 nt, Bordetella pertussis
ccaugggacgacuucgacggc

SEQ ID NO: 2342134 - RNA, 21 nt, Bordetella pertussis
ccauggggugcuccugccagg

SEQ ID NO: 2342135 - RNA, 22 nt, Bordetella pertussis
ccauggggugcuccugccaggc

SEQ ID NO: 2342136 - RNA, 21 nt, Bordetella pertussis
ccauggugccgcgcaggcccu

SEQ ID NO: 2342137 - RNA, 14 nt, Bordetella pertussis
ccauggugggcagg

SEQ ID NO: 2342138 - RNA, 18 nt, Bordetella pertussis
ccauggugggcaggucgg

SEQ ID NO: 2342139 - RNA, 17 nt, Bordetella pertussis
ccauguagauggccgcc

SEQ ID NO: 2342140 - RNA, 22 nt, Bordetella pertussis
ccauguauaacguggcgcgcac

SEQ ID NO: 2342141 - RNA, 22 nt, Bordetella pertussis
ccauguccagguagcgccucgc

SEQ ID NO: 2342142 - RNA, 21 nt, Bordetella pertussis
ccaugucggccgaccacugga

SEQ ID NO: 2342143 - RNA, 20 nt, Bordetella pertussis
ccaugugcguugccagccca

SEQ ID NO: 2342144 - RNA, 14 nt, Bordetella pertussis
ccauguggccagcu

SEQ ID NO: 2342145 - RNA, 15 nt, Bordetella pertussis
ccauguggccagcuc

SEQ ID NO: 2342146 - RNA, 17 nt, Bordetella pertussis
ccauguggccagcucca

SEQ ID NO: 2342147 - RNA, 15 nt, Bordetella pertussis
ccauguggggacagg

SEQ ID NO: 2342148 - RNA, 20 nt, Bordetella pertussis
ccauguggggacaggcaccc

SEQ ID NO: 2342149 - RNA, 22 nt, Bordetella pertussis
ccauguugaacugcaggccgcc

SEQ ID NO: 2342150 - RNA, 23 nt, Bordetella pertussis
ccauguugaacugcaggccgccg

SEQ ID NO: 2342151 - RNA, 18 nt, Bordetella pertussis
ccauuagggcccagcugc

SEQ ID NO: 2342152 - RNA, 20 nt, Bordetella pertussis
ccauuagggcccagcugcag

SEQ ID NO: 2342153 - RNA, 14 nt, Bordetella pertussis
ccauucauccagcg

SEQ ID NO: 2342154 - RNA, 16 nt, Bordetella pertussis
ccauucauccagcgcg

SEQ ID NO: 2342155 - RNA, 23 nt, Bordetella pertussis
ccauucccgcccugacgccugcg

SEQ ID NO: 2342156 - RNA, 17 nt, Bordetella pertussis
ccauuccggcuggucgg

SEQ ID NO: 2342157 - RNA, 15 nt, Bordetella pertussis
ccauucgauggcggc

SEQ ID NO: 2342158 - RNA, 23 nt, Bordetella pertussis
ccauucggccacuuucgcgcgcg

SEQ ID NO: 2342159 - RNA, 16 nt, Bordetella pertussis
ccauucgguggucugc

SEQ ID NO: 2342160 - RNA, 14 nt, Bordetella pertussis
ccauugcagggugu

SEQ ID NO: 2342161 - RNA, 22 nt, Bordetella pertussis
ccauugcagggugucggccagg

SEQ ID NO: 2342162 - RNA, 23 nt, Bordetella pertussis
ccauugcagggugucggccaggg

SEQ ID NO: 2342163 - RNA, 22 nt, Bordetella pertussis
ccauugccacggcgggccggcu

SEQ ID NO: 2342164 - RNA, 16 nt, Bordetella pertussis
ccauugccggcgcgca

SEQ ID NO: 2342165 - RNA, 13 nt, Bordetella pertussis
ccauugcgcggcc

SEQ ID NO: 2342166 - RNA, 16 nt, Bordetella pertussis
ccauugcgcggccagg

SEQ ID NO: 2342167 - RNA, 14 nt, Bordetella pertussis
ccauugcgcggccu

SEQ ID NO: 2342168 - RNA, 17 nt, Bordetella pertussis
ccauugcggcaccugcu

SEQ ID NO: 2342169 - RNA, 21 nt, Bordetella pertussis
ccauugcgggugggcauccag

SEQ ID NO: 2342170 - RNA, 19 nt, Bordetella pertussis
ccauugggacgccagcccg

SEQ ID NO: 2342171 - RNA, 20 nt, Bordetella pertussis
ccauugggacgccagcccgc

SEQ ID NO: 2342172 - RNA, 17 nt, Bordetella pertussis
cagcguggagcugcuca

SEQ ID NO: 2342173 - RNA, 18 nt, Bordetella pertussis
cagcguggagcugcucac

SEQ ID NO: 2342174 - RNA, 13 nt, Bordetella pertussis
cagcguggccacc

SEQ ID NO: 2342175 - RNA, 16 nt, Bordetella pertussis
cagcguggccgaggug

SEQ ID NO: 2342176 - RNA, 18 nt, Bordetella pertussis
cagcguggccgccaccag

SEQ ID NO: 2342177 - RNA, 19 nt, Bordetella pertussis
cagcguggccgccaccagc

SEQ ID NO: 2342178 - RNA, 20 nt, Bordetella pertussis
cagcguggccgccaccagcg

SEQ ID NO: 2342179 - RNA, 17 nt, Bordetella pertussis
cagcguggcgcagucga

SEQ ID NO: 2342180 - RNA, 20 nt, Bordetella pertussis
cagcguggcgcggguggccg

SEQ ID NO: 2342181 - RNA, 17 nt, Bordetella pertussis
cagcguguagagcaggc

SEQ ID NO: 2342182 - RNA, 19 nt, Bordetella pertussis
cagcguguagagcaggccg

SEQ ID NO: 2342183 - RNA, 19 nt, Bordetella pertussis
cagcguguaggcggccggc

SEQ ID NO: 2342184 - RNA, 18 nt, Bordetella pertussis
cagcgugucgaacaccag

SEQ ID NO: 2342185 - RNA, 21 nt, Bordetella pertussis
cagcguguggugaaagccgcc

SEQ ID NO: 2342186 - RNA, 22 nt, Bordetella pertussis
cagcguguggugaaagccgccg

SEQ ID NO: 2342187 - RNA, 21 nt, Bordetella pertussis
cagcguucggccacccggccc

SEQ ID NO: 2342188 - RNA, 17 nt, Bordetella pertussis
cagcguuucaccgcugg

SEQ ID NO: 2342189 - RNA, 21 nt, Bordetella pertussis
cagcguuuccagggcgcgccg

SEQ ID NO: 2342190 - RNA, 14 nt, Bordetella pertussis
cagcuacggcuggc

SEQ ID NO: 2342191 - RNA, 15 nt, Bordetella pertussis
cagcuacggcuggcc

SEQ ID NO: 2342192 - RNA, 22 nt, Bordetella pertussis
cagcucaagaagaagccgggcu

SEQ ID NO: 2342193 - RNA, 18 nt, Bordetella pertussis
cagcucagcagcgccagg

SEQ ID NO: 2342194 - RNA, 19 nt, Bordetella pertussis
cagcucagcagcgccaggg

SEQ ID NO: 2342195 - RNA, 20 nt, Bordetella pertussis
cagcucagcagcgccagggc

SEQ ID NO: 2342196 - RNA, 13 nt, Bordetella pertussis
cagcucagcuugg

SEQ ID NO: 2342197 - RNA, 15 nt, Bordetella pertussis
cagcucauggcacag

SEQ ID NO: 2342198 - RNA, 22 nt, Bordetella pertussis
cagcucauggcacagcgcggcg

SEQ ID NO: 2342199 - RNA, 15 nt, Bordetella pertussis
cagcuccaccgggcu

SEQ ID NO: 2342200 - RNA, 20 nt, Bordetella pertussis
cagcuccacgcacaccgccc

SEQ ID NO: 2342201 - RNA, 15 nt, Bordetella pertussis
cagcuccagccgcag

SEQ ID NO: 2342202 - RNA, 16 nt, Bordetella pertussis
cagcuccagccgcagg

SEQ ID NO: 2342203 - RNA, 15 nt, Bordetella pertussis
cagcuccagcgcgcc

SEQ ID NO: 2342204 - RNA, 23 nt, Bordetella pertussis
cagcuccagcuggcgcaccaggc

SEQ ID NO: 2342205 - RNA, 14 nt, Bordetella pertussis
cagcuccggcggca

SEQ ID NO: 2342206 - RNA, 16 nt, Bordetella pertussis
cagcuccggcggcagc

SEQ ID NO: 2342207 - RNA, 20 nt, Bordetella pertussis
cagcuccguauccuggucga

SEQ ID NO: 2342208 - RNA, 22 nt, Bordetella pertussis
cagcucgaccacggcggcuucg

SEQ ID NO: 2342209 - RNA, 21 nt, Bordetella pertussis
cagcucgaccgucagcaugcc

SEQ ID NO: 2342210 - RNA, 13 nt, Bordetella pertussis
cagcucgacgcca

SEQ ID NO: 2342211 - RNA, 22 nt, Bordetella pertussis
cagcucgacgccaucucgcgcg

SEQ ID NO: 2342212 - RNA, 17 nt, Bordetella pertussis
cagcucgaucaggcgcu

SEQ ID NO: 2342213 - RNA, 20 nt, Bordetella pertussis
cagcucgaucaggcgcucca

SEQ ID NO: 2342214 - RNA, 22 nt, Bordetella pertussis
cagcucgcagucuugcuugagg

SEQ ID NO: 2342215 - RNA, 18 nt, Bordetella pertussis
cagcucgccggcgauggc

SEQ ID NO: 2342216 - RNA, 18 nt, Bordetella pertussis
cagcucgcgccagggccc

SEQ ID NO: 2342217 - RNA, 22 nt, Bordetella pertussis
cagcucgcgccagggccccucc

SEQ ID NO: 2342218 - RNA, 22 nt, Bordetella pertussis
cagcucgcgcgcuucgagccgg

SEQ ID NO: 2342219 - RNA, 13 nt, Bordetella pertussis
cagcucgcgcugc

SEQ ID NO: 2342220 - RNA, 16 nt, Bordetella pertussis
cagcucgcggcccugg

SEQ ID NO: 2342221 - RNA, 20 nt, Bordetella pertussis
cagcucgcguugcaccgcgu

SEQ ID NO: 2342222 - RNA, 17 nt, Bordetella pertussis
cagcucgcuaacaaggg

SEQ ID NO: 2342223 - RNA, 12 nt, Bordetella pertussis
cagcucggccac

SEQ ID NO: 2342224 - RNA, 13 nt, Bordetella pertussis
cagcucggccacc

SEQ ID NO: 2342225 - RNA, 19 nt, Bordetella pertussis
cagcucggcccauugcggc

SEQ ID NO: 2342226 - RNA, 22 nt, Bordetella pertussis
cagcucggcccauugcggcacc

SEQ ID NO: 2342227 - RNA, 20 nt, Bordetella pertussis
cagcucggccugcggcucga

SEQ ID NO: 2342228 - RNA, 18 nt, Bordetella pertussis
cagcucggcgaccaggcc

SEQ ID NO: 2342229 - RNA, 20 nt, Bordetella pertussis
cagcucggcgaugcgcgagc

SEQ ID NO: 2342230 - RNA, 17 nt, Bordetella pertussis
cagcucggcggccgccu

SEQ ID NO: 2342231 - RNA, 21 nt, Bordetella pertussis
cagcucggcggccgccugcgc

SEQ ID NO: 2342232 - RNA, 17 nt, Bordetella pertussis
cagcucggcggcgauca

SEQ ID NO: 2342233 - RNA, 23 nt, Bordetella pertussis
cagcucggggaaauugacggcgc

SEQ ID NO: 2342234 - RNA, 13 nt, Bordetella pertussis
cagcucggugcag

SEQ ID NO: 2342235 - RNA, 22 nt, Bordetella pertussis
cagcucgguggucaacggcaag

SEQ ID NO: 2342236 - RNA, 22 nt, Bordetella pertussis
cagcucguagaucuugccggcc

SEQ ID NO: 2342237 - RNA, 15 nt, Bordetella pertussis
cagcucgucgccgcu

SEQ ID NO: 2342238 - RNA, 17 nt, Bordetella pertussis
cagcucgucgccgcugg

SEQ ID NO: 2342239 - RNA, 19 nt, Bordetella pertussis
cagcucguggcgcgccucc

SEQ ID NO: 2342240 - RNA, 21 nt, Bordetella pertussis
cagcucguugaccugcugggg

SEQ ID NO: 2342241 - RNA, 20 nt, Bordetella pertussis
cagcucuucgagcgcggcgc

SEQ ID NO: 2342242 - RNA, 21 nt, Bordetella pertussis
cagcugaccucgcccaggccg

SEQ ID NO: 2342243 - RNA, 22 nt, Bordetella pertussis
cagcugaccucgcccaggccgg

SEQ ID NO: 2342244 - RNA, 22 nt, Bordetella pertussis
cccacagcgcccccagcacggu

SEQ ID NO: 2342245 - RNA, 21 nt, Bordetella pertussis
cccacaggaacaggccggccu

SEQ ID NO: 2342246 - RNA, 23 nt, Bordetella pertussis
cccacaggaacaggccggccugg

SEQ ID NO: 2342247 - RNA, 16 nt, Bordetella pertussis
cccacaggcgcgcggc

SEQ ID NO: 2342248 - RNA, 18 nt, Bordetella pertussis
cccacagggggacuggca

SEQ ID NO: 2342249 - RNA, 19 nt, Bordetella pertussis
cccacagggggacuggcac

SEQ ID NO: 2342250 - RNA, 17 nt, Bordetella pertussis
cccacagguuggccgcg

SEQ ID NO: 2342251 - RNA, 18 nt, Bordetella pertussis
cccacagguuggccgcga

SEQ ID NO: 2342252 - RNA, 20 nt, Bordetella pertussis
cccacagguuggccgcgacg

SEQ ID NO: 2342253 - RNA, 18 nt, Bordetella pertussis
cccacauagcggccggcg

SEQ ID NO: 2342254 - RNA, 11 nt, Bordetella pertussis
cccaccaccag

SEQ ID NO: 2342255 - RNA, 13 nt, Bordetella pertussis
cccaccaccagcg

SEQ ID NO: 2342256 - RNA, 21 nt, Bordetella pertussis
cccaccaccagcgcggccagc

SEQ ID NO: 2342257 - RNA, 12 nt, Bordetella pertussis
cccaccacgccg

SEQ ID NO: 2342258 - RNA, 15 nt, Bordetella pertussis
cccaccacgccgccc

SEQ ID NO: 2342259 - RNA, 14 nt, Bordetella pertussis
cccaccagccgccc

SEQ ID NO: 2342260 - RNA, 13 nt, Bordetella pertussis
cccaccagcgcca

SEQ ID NO: 2342261 - RNA, 13 nt, Bordetella pertussis
cccaccagggcca

SEQ ID NO: 2342262 - RNA, 13 nt, Bordetella pertussis
cccaccagggugc

SEQ ID NO: 2342263 - RNA, 19 nt, Bordetella pertussis
cccaccaugagcacgcccc

SEQ ID NO: 2342264 - RNA, 12 nt, Bordetella pertussis
cccaccgccagg

SEQ ID NO: 2342265 - RNA, 13 nt, Bordetella pertussis
cccaccgccagga

SEQ ID NO: 2342266 - RNA, 12 nt, Bordetella pertussis
cccaccgccgcc

SEQ ID NO: 2342267 - RNA, 19 nt, Bordetella pertussis
cccaccgccguggccggca

SEQ ID NO: 2342268 - RNA, 15 nt, Bordetella pertussis
cccaccgcgaaccag

SEQ ID NO: 2342269 - RNA, 15 nt, Bordetella pertussis
cccaccggcaagccu

SEQ ID NO: 2342270 - RNA, 15 nt, Bordetella pertussis
cccaccgggacaggc

SEQ ID NO: 2342271 - RNA, 14 nt, Bordetella pertussis
cccaccgggccggc

SEQ ID NO: 2342272 - RNA, 16 nt, Bordetella pertussis
cccaccgggccggccu

SEQ ID NO: 2342273 - RNA, 18 nt, Bordetella pertussis
cccaccgggccggccugc

SEQ ID NO: 2342274 - RNA, 13 nt, Bordetella pertussis
cccaccggugcgg

SEQ ID NO: 2342275 - RNA, 15 nt, Bordetella pertussis
cccaccuuccugcug

SEQ ID NO: 2342276 - RNA, 16 nt, Bordetella pertussis
cccaccuuccugcugg

SEQ ID NO: 2342277 - RNA, 18 nt, Bordetella pertussis
cccaccuugcgcgcgaac

SEQ ID NO: 2342278 - RNA, 19 nt, Bordetella pertussis
cccacgaacgccacgcccg

SEQ ID NO: 2342279 - RNA, 12 nt, Bordetella pertussis
cccacgaccugc

SEQ ID NO: 2342280 - RNA, 22 nt, Bordetella pertussis
cccacgcacaugaugcccagcg

SEQ ID NO: 2342281 - RNA, 20 nt, Bordetella pertussis
cccacgccauggacgccgaa

SEQ ID NO: 2342282 - RNA, 13 nt, Bordetella pertussis
cccacgccgccgu

SEQ ID NO: 2342283 - RNA, 18 nt, Bordetella pertussis
cccacgccgccguagccg

SEQ ID NO: 2342284 - RNA, 20 nt, Bordetella pertussis
cccacgccgccguagccgcu

SEQ ID NO: 2342285 - RNA, 12 nt, Bordetella pertussis
cccacgccgccu

SEQ ID NO: 2342286 - RNA, 22 nt, Bordetella pertussis
cccacgccgcugauguggcuga

SEQ ID NO: 2342287 - RNA, 20 nt, Bordetella pertussis
cccacgccuuccggccccau

SEQ ID NO: 2342288 - RNA, 21 nt, Bordetella pertussis
cccacgcucuggagccaccag

SEQ ID NO: 2342289 - RNA, 19 nt, Bordetella pertussis
cccacgcugucggggugcc

SEQ ID NO: 2342290 - RNA, 15 nt, Bordetella pertussis
cccacggcaucgccg

SEQ ID NO: 2342291 - RNA, 17 nt, Bordetella pertussis
cccacggcaucgccgcg

SEQ ID NO: 2342292 - RNA, 21 nt, Bordetella pertussis
cccacggcaucgccgcgggcg

SEQ ID NO: 2342293 - RNA, 12 nt, Bordetella pertussis
cccacggccagc

SEQ ID NO: 2342294 - RNA, 22 nt, Bordetella pertussis
cccacggcgacuuccagcagau

SEQ ID NO: 2342295 - RNA, 17 nt, Bordetella pertussis
cccacggcgagucugaa

SEQ ID NO: 2342296 - RNA, 22 nt, Bordetella pertussis
cccacggcgccaaagcacagga

SEQ ID NO: 2342297 - RNA, 16 nt, Bordetella pertussis
cccacggcguggcgcg

SEQ ID NO: 2342298 - RNA, 19 nt, Bordetella pertussis
cccacggcguggcgcgccc

SEQ ID NO: 2342299 - RNA, 21 nt, Bordetella pertussis
cccacggcguggcgcgcccgc

SEQ ID NO: 2342300 - RNA, 14 nt, Bordetella pertussis
cccacggggacagg

SEQ ID NO: 2342301 - RNA, 16 nt, Bordetella pertussis
cccacggggacaggca

SEQ ID NO: 2342302 - RNA, 17 nt, Bordetella pertussis
cccacggggacaggcac

SEQ ID NO: 2342303 - RNA, 19 nt, Bordetella pertussis
cccacggggacaggcaccu

SEQ ID NO: 2342304 - RNA, 14 nt, Bordetella pertussis
cccacguggacagg

SEQ ID NO: 2342305 - RNA, 15 nt, Bordetella pertussis
cccacguggacaggc

SEQ ID NO: 2342306 - RNA, 17 nt, Bordetella pertussis
cccacguggacaggcac

SEQ ID NO: 2342307 - RNA, 19 nt, Bordetella pertussis
cccacguggacaggcaccu

SEQ ID NO: 2342308 - RNA, 13 nt, Bordetella pertussis
cccacucaugcgc

SEQ ID NO: 2342309 - RNA, 17 nt, Bordetella pertussis
cccacucccguaagcag

SEQ ID NO: 2342310 - RNA, 22 nt, Bordetella pertussis
cccacugccaguaggcgcccca

SEQ ID NO: 2342311 - RNA, 16 nt, Bordetella pertussis
cccacuggaucgccga

SEQ ID NO: 2342312 - RNA, 21 nt, Bordetella pertussis
cccacuggaucgccgaucggc

SEQ ID NO: 2342313 - RNA, 23 nt, Bordetella pertussis
cccacuggaucgccgaucggcaa

SEQ ID NO: 2342314 - RNA, 22 nt, Bordetella pertussis
cccacuggggacaugcaugaac

SEQ ID NO: 2342315 - RNA, 18 nt, Bordetella pertussis
cccacugggggacuggca

SEQ ID NO: 2342316 - RNA, 15 nt, Bordetella pertussis
cccacuugagcagcg

SEQ ID NO: 2342317 - RNA, 19 nt, Bordetella pertussis
cccacuugagcagcgccuu

SEQ ID NO: 2342318 - RNA, 13 nt, Bordetella pertussis
cccagaaacuggc

SEQ ID NO: 2342319 - RNA, 17 nt, Bordetella pertussis
cccagaacccggccggc

SEQ ID NO: 2342320 - RNA, 18 nt, Bordetella pertussis
cccagaacccggccggcg

SEQ ID NO: 2342321 - RNA, 21 nt, Bordetella pertussis
cccagaacccggccggcgccg

SEQ ID NO: 2342322 - RNA, 14 nt, Bordetella pertussis
cccagacagccacg

SEQ ID NO: 2342323 - RNA, 17 nt, Bordetella pertussis
cccagacagccacgcgc

SEQ ID NO: 2342324 - RNA, 16 nt, Bordetella pertussis
cccagaccaagcgcca

SEQ ID NO: 2342325 - RNA, 14 nt, Bordetella pertussis
cccagaccugcgcg

SEQ ID NO: 2342326 - RNA, 15 nt, Bordetella pertussis
cccagaccugcgcgc

SEQ ID NO: 2342327 - RNA, 20 nt, Bordetella pertussis
cccagaccugcgcgccggca

SEQ ID NO: 2342328 - RNA, 23 nt, Bordetella pertussis
cccagacgcagaccacgccggcg

SEQ ID NO: 2342329 - RNA, 18 nt, Bordetella pertussis
cccagacuggcguaguag

SEQ ID NO: 2342330 - RNA, 23 nt, Bordetella pertussis
cccagagcaccgagaccgggcgg

SEQ ID NO: 2342331 - RNA, 15 nt, Bordetella pertussis
cccagauccagcuug

SEQ ID NO: 2342332 - RNA, 14 nt, Bordetella pertussis
cccagauccgcaag

SEQ ID NO: 2342333 - RNA, 22 nt, Bordetella pertussis
cccucgcccccgaaggccgcgc

SEQ ID NO: 2342334 - RNA, 19 nt, Bordetella pertussis
cccucgcggaugaccuggu

SEQ ID NO: 2342335 - RNA, 12 nt, Bordetella pertussis
cccucgcggccg

SEQ ID NO: 2342336 - RNA, 13 nt, Bordetella pertussis
cccucgggcgaca

SEQ ID NO: 2342337 - RNA, 20 nt, Bordetella pertussis
cccucgggcgacaggcgcgc

SEQ ID NO: 2342338 - RNA, 24 nt, Bordetella pertussis
cccucgggcgacaggcgcgcccgc

SEQ ID NO: 2342339 - RNA, 21 nt, Bordetella pertussis
cccucgggugccuguccccac

SEQ ID NO: 2342340 - RNA, 22 nt, Bordetella pertussis
cccucgggugccuguccccaca

SEQ ID NO: 2342341 - RNA, 13 nt, Bordetella pertussis
cccucggucagcg

SEQ ID NO: 2342342 - RNA, 17 nt, Bordetella pertussis
cccucggucagcgccag

SEQ ID NO: 2342343 - RNA, 20 nt, Bordetella pertussis
cccucggugcggaagacgau

SEQ ID NO: 2342344 - RNA, 13 nt, Bordetella pertussis
cccucggugcugc

SEQ ID NO: 2342345 - RNA, 15 nt, Bordetella pertussis
cccucggugcugcug

SEQ ID NO: 2342346 - RNA, 17 nt, Bordetella pertussis
cccucggugcugcuguu

SEQ ID NO: 2342347 - RNA, 17 nt, Bordetella pertussis
cccucguugacgccgac

SEQ ID NO: 2342348 - RNA, 18 nt, Bordetella pertussis
cccucguugacgccgacg

SEQ ID NO: 2342349 - RNA, 21 nt, Bordetella pertussis
cccucguugacgccgacgaug

SEQ ID NO: 2342350 - RNA, 17 nt, Bordetella pertussis
cccucuucggcggccag

SEQ ID NO: 2342351 - RNA, 18 nt, Bordetella pertussis
cccucuucggcggccagc

SEQ ID NO: 2342352 - RNA, 18 nt, Bordetella pertussis
cccucuuucgccgcgcgc

SEQ ID NO: 2342353 - RNA, 15 nt, Bordetella pertussis
cccugacccgcuggc

SEQ ID NO: 2342354 - RNA, 18 nt, Bordetella pertussis
cccugacccgcuggcugg

SEQ ID NO: 2342355 - RNA, 15 nt, Bordetella pertussis
cccugaucccggcgc

SEQ ID NO: 2342356 - RNA, 21 nt, Bordetella pertussis
cccugcaccgucacgcgcugg

SEQ ID NO: 2342357 - RNA, 16 nt, Bordetella pertussis
cccugcagcggccagu

SEQ ID NO: 2342358 - RNA, 13 nt, Bordetella pertussis
cccugcagggcau

SEQ ID NO: 2342359 - RNA, 15 nt, Bordetella pertussis
cccugcaugaccgcc

SEQ ID NO: 2342360 - RNA, 20 nt, Bordetella pertussis
cccugcaugaccgccgccag

SEQ ID NO: 2342361 - RNA, 20 nt, Bordetella pertussis
cccugcccauucccgcccug

SEQ ID NO: 2342362 - RNA, 21 nt, Bordetella pertussis
cccugcccauucccgcccuga

SEQ ID NO: 2342363 - RNA, 12 nt, Bordetella pertussis
cccugcccggcg

SEQ ID NO: 2342364 - RNA, 16 nt, Bordetella pertussis
cccugcccggcgagca

SEQ ID NO: 2342365 - RNA, 23 nt, Bordetella pertussis
cccugcccggcgagcauggcggu

SEQ ID NO: 2342366 - RNA, 16 nt, Bordetella pertussis
cccugcccugcggcuu

SEQ ID NO: 2342367 - RNA, 21 nt, Bordetella pertussis
cccugccgaucaagagccugg

SEQ ID NO: 2342368 - RNA, 15 nt, Bordetella pertussis
cccugccgggacagg

SEQ ID NO: 2342369 - RNA, 18 nt, Bordetella pertussis
cccugccgggacaggcac

SEQ ID NO: 2342370 - RNA, 21 nt, Bordetella pertussis
cccugccgggacaggcacccu

SEQ ID NO: 2342371 - RNA, 15 nt, Bordetella pertussis
cccugccgugggaca

SEQ ID NO: 2342372 - RNA, 17 nt, Bordetella pertussis
cccugccgugggacagg

SEQ ID NO: 2342373 - RNA, 16 nt, Bordetella pertussis
cccugccuacuugcgg

SEQ ID NO: 2342374 - RNA, 12 nt, Bordetella pertussis
cccugccuccag

SEQ ID NO: 2342375 - RNA, 18 nt, Bordetella pertussis
cccugccuccaggcgcaa

SEQ ID NO: 2342376 - RNA, 15 nt, Bordetella pertussis
cccugcgcacccgcc

SEQ ID NO: 2342377 - RNA, 16 nt, Bordetella pertussis
cccugcgccagcgccu

SEQ ID NO: 2342378 - RNA, 22 nt, Bordetella pertussis
cccugcgcgaggugccggacgc

SEQ ID NO: 2342379 - RNA, 12 nt, Bordetella pertussis
cccugcgcgccg

SEQ ID NO: 2342380 - RNA, 21 nt, Bordetella pertussis
cccugcgcguacguggcgcgg

SEQ ID NO: 2342381 - RNA, 22 nt, Bordetella pertussis
cccugcgcguacguggcgcggc

SEQ ID NO: 2342382 - RNA, 22 nt, Bordetella pertussis
cccugcgcguugagcagcaugu

SEQ ID NO: 2342383 - RNA, 16 nt, Bordetella pertussis
cccugcggcagcgacu

SEQ ID NO: 2342384 - RNA, 16 nt, Bordetella pertussis
cccugcggcgcggcca

SEQ ID NO: 2342385 - RNA, 17 nt, Bordetella pertussis
cccugcggcgcggccag

SEQ ID NO: 2342386 - RNA, 16 nt, Bordetella pertussis
cccugcgggccgcugg

SEQ ID NO: 2342387 - RNA, 13 nt, Bordetella pertussis
cccugcggggaca

SEQ ID NO: 2342388 - RNA, 17 nt, Bordetella pertussis
cccugcggggacaggca

SEQ ID NO: 2342389 - RNA, 19 nt, Bordetella pertussis
cccugcggggacaggcacc

SEQ ID NO: 2342390 - RNA, 23 nt, Bordetella pertussis
cccugcggggacaggcacccccg

SEQ ID NO: 2342391 - RNA, 16 nt, Bordetella pertussis
cccugcgggggcaggc

SEQ ID NO: 2342392 - RNA, 20 nt, Bordetella pertussis
cccugcgggggcaggcacgc

SEQ ID NO: 2342393 - RNA, 22 nt, Bordetella pertussis
cccugcgggggcaggcacgcgg

SEQ ID NO: 2342394 - RNA, 13 nt, Bordetella pertussis
cccugcguggcgc

SEQ ID NO: 2342395 - RNA, 15 nt, Bordetella pertussis
cccugcguggcgcag

SEQ ID NO: 2342396 - RNA, 22 nt, Bordetella pertussis
cccugcguggcgcagugggcca

SEQ ID NO: 2342397 - RNA, 16 nt, Bordetella pertussis
cccugcucgcgcagcg

SEQ ID NO: 2342398 - RNA, 17 nt, Bordetella pertussis
cccugcucuacaccauc

SEQ ID NO: 2342399 - RNA, 18 nt, Bordetella pertussis
cccugcugcccgccgccg

SEQ ID NO: 2342400 - RNA, 20 nt, Bordetella pertussis
cccugcuugagcgaaauggc

SEQ ID NO: 2342401 - RNA, 18 nt, Bordetella pertussis
cccuggagaucgccgccg

SEQ ID NO: 2342402 - RNA, 23 nt, Bordetella pertussis
cccuggaucaggaugggcgcggc

SEQ ID NO: 2342403 - RNA, 16 nt, Bordetella pertussis
cccuggauggccuggg

SEQ ID NO: 2342404 - RNA, 18 nt, Bordetella pertussis
cccuggauggcggccgcc

SEQ ID NO: 2342405 - RNA, 19 nt, Bordetella pertussis
cccuggauggcggccgcca

SEQ ID NO: 2342406 - RNA, 20 nt, Bordetella pertussis
cccuggauggcggccgccag

SEQ ID NO: 2342407 - RNA, 23 nt, Bordetella pertussis
cccuggauggcggccgccagcgc

SEQ ID NO: 2342408 - RNA, 23 nt, Bordetella pertussis
cccuggcaagaagaucgucgacg

SEQ ID NO: 2342409 - RNA, 13 nt, Bordetella pertussis
cccuggcagcugg

SEQ ID NO: 2342410 - RNA, 14 nt, Bordetella pertussis
cccuggcagcuggc

SEQ ID NO: 2342411 - RNA, 16 nt, Bordetella pertussis
cccuggcagcuggcgc

SEQ ID NO: 2342412 - RNA, 14 nt, Bordetella pertussis
cccuggccacgcug

SEQ ID NO: 2342413 - RNA, 18 nt, Bordetella pertussis
cccuggccacgcugcugc

SEQ ID NO: 2342414 - RNA, 23 nt, Bordetella pertussis
cccuggccauuccuuccgggccc

SEQ ID NO: 2342415 - RNA, 13 nt, Bordetella pertussis
cccuggcccaggc

SEQ ID NO: 2342416 - RNA, 14 nt, Bordetella pertussis
cccuggcccaggcc

SEQ ID NO: 2342417 - RNA, 13 nt, Bordetella pertussis
cccuggcccuggc

SEQ ID NO: 2342418 - RNA, 17 nt, Bordetella pertussis
cccuggcccuggcgggc

SEQ ID NO: 2342419 - RNA, 14 nt, Bordetella pertussis
cccuggccgaacgc

SEQ ID NO: 2342420 - RNA, 20 nt, Bordetella pertussis
cccuggccgaacgccgccgc

SEQ ID NO: 2342421 - RNA, 23 nt, Bordetella pertussis
cccuggccgaacgccgccgcagc

SEQ ID NO: 2342422 - RNA, 14 nt, Bordetella pertussis
cccuggccgcgccg

SEQ ID NO: 2342423 - RNA, 15 nt, Bordetella pertussis
cccuggcgcaggccg

SEQ ID NO: 2342424 - RNA, 18 nt, Bordetella pertussis
cccuggcgcaggccggcg

SEQ ID NO: 2342425 - RNA, 22 nt, Bordetella pertussis
cccuggcgcaggccggcggcca

SEQ ID NO: 2342426 - RNA, 17 nt, Bordetella pertussis
cccuggcgccgcggccg

SEQ ID NO: 2342427 - RNA, 15 nt, Bordetella pertussis
cccuggcgcgccagc

SEQ ID NO: 2342428 - RNA, 13 nt, Bordetella pertussis
cccuggcgcugca

SEQ ID NO: 2342429 - RNA, 20 nt, Bordetella pertussis
cccuggcguggcgcgcgccg

SEQ ID NO: 2342430 - RNA, 19 nt, Bordetella pertussis
cccuggcugagcgacaugu

SEQ ID NO: 2342431 - RNA, 20 nt, Bordetella pertussis
cccuggcuggccagccggcc

SEQ ID NO: 2342432 - RNA, 21 nt, Bordetella pertussis
cccuggcuggccagccggccc

SEQ ID NO: 2342433 - RNA, 14 nt, Bordetella pertussis
cccuggcuggcggc

SEQ ID NO: 2342434 - RNA, 21 nt, Bordetella pertussis
cccugggccagcagcuggcgc

SEQ ID NO: 2342435 - RNA, 15 nt, Bordetella pertussis
cccugggccagccag

SEQ ID NO: 2342436 - RNA, 23 nt, Bordetella pertussis
cccugggcgagguagggcgcggc

SEQ ID NO: 2342437 - RNA, 12 nt, Bordetella pertussis
cccugggcgcgg

SEQ ID NO: 2342438 - RNA, 14 nt, Bordetella pertussis
cccugggcgcggcg

SEQ ID NO: 2342439 - RNA, 16 nt, Bordetella pertussis
cccuggggccgcggcg

SEQ ID NO: 2342440 - RNA, 17 nt, Bordetella pertussis
cccuggggccgcggcgc

SEQ ID NO: 2342441 - RNA, 18 nt, Bordetella pertussis
cccuggguggcggggcgc

SEQ ID NO: 2342442 - RNA, 19 nt, Bordetella pertussis
cccuggguggcggggcgca

SEQ ID NO: 2342443 - RNA, 22 nt, Bordetella pertussis
cccuggguggcggggcgcauca

SEQ ID NO: 2342444 - RNA, 15 nt, Bordetella pertussis
cccugguacgaucag

SEQ ID NO: 2342445 - RNA, 14 nt, Bordetella pertussis
cccuggucaucgcc

SEQ ID NO: 2342446 - RNA, 15 nt, Bordetella pertussis
cccuggucaucgcca

SEQ ID NO: 2342447 - RNA, 17 nt, Bordetella pertussis
cccuggucgucgcggcc

SEQ ID NO: 2342448 - RNA, 17 nt, Bordetella pertussis
cccuguccucgcaggaa

SEQ ID NO: 2342449 - RNA, 19 nt, Bordetella pertussis
cccuguccucgcaggaauc

SEQ ID NO: 2342450 - RNA, 14 nt, Bordetella pertussis
cccugugggggaca

SEQ ID NO: 2342451 - RNA, 16 nt, Bordetella pertussis
cccugugggggacagg

SEQ ID NO: 2342452 - RNA, 17 nt, Bordetella pertussis
cccuguucgcgcggccc

SEQ ID NO: 2342453 - RNA, 15 nt, Bordetella pertussis
cccuuccacccgcau

SEQ ID NO: 2342454 - RNA, 13 nt, Bordetella pertussis
cccuuccuggcca

SEQ ID NO: 2342455 - RNA, 15 nt, Bordetella pertussis
cccuucgacgcggcg

SEQ ID NO: 2342456 - RNA, 20 nt, Bordetella pertussis
cccuucgacgcggcggccgg

SEQ ID NO: 2342457 - RNA, 21 nt, Bordetella pertussis
cccuucgcgcagcaacccgcc

SEQ ID NO: 2342458 - RNA, 16 nt, Bordetella pertussis
cccuucggcaugcugc

SEQ ID NO: 2342459 - RNA, 16 nt, Bordetella pertussis
cccuucggggcagcga

SEQ ID NO: 2342460 - RNA, 19 nt, Bordetella pertussis
cccuugagcaaucaagggc

SEQ ID NO: 2342461 - RNA, 16 nt, Bordetella pertussis
cccuugagcacggcgc

SEQ ID NO: 2342462 - RNA, 18 nt, Bordetella pertussis
cccuugagcguggcgucc

SEQ ID NO: 2342463 - RNA, 18 nt, Bordetella pertussis
cccuugauggccgggccg

SEQ ID NO: 2342464 - RNA, 17 nt, Bordetella pertussis
cccuugcccaacgcggc

SEQ ID NO: 2342465 - RNA, 11 nt, Bordetella pertussis
cccuugccgcg

SEQ ID NO: 2342466 - RNA, 19 nt, Bordetella pertussis
cccuugcgcgaacggcagg

SEQ ID NO: 2342467 - RNA, 17 nt, Bordetella pertussis
cccuugcggccgccgaa

SEQ ID NO: 2342468 - RNA, 18 nt, Bordetella pertussis
cccuugcggccgccgaac

SEQ ID NO: 2342469 - RNA, 21 nt, Bordetella pertussis
cccuugugcguuggcgcggcg

SEQ ID NO: 2342470 - RNA, 19 nt, Bordetella pertussis
cccuugugcugccaugccg

SEQ ID NO: 2342471 - RNA, 15 nt, Bordetella pertussis
cccuuguggccgccg

SEQ ID NO: 2342472 - RNA, 16 nt, Bordetella pertussis
cccuuguggccgccga

SEQ ID NO: 2342473 - RNA, 22 nt, Bordetella pertussis
cccuuucauuucggcgccgcgc

SEQ ID NO: 2342474 - RNA, 12 nt, Bordetella pertussis
ccgaaacgcugg

SEQ ID NO: 2342475 - RNA, 15 nt, Bordetella pertussis
ccgaaacucaccgcc

SEQ ID NO: 2342476 - RNA, 19 nt, Bordetella pertussis
ccgaaacucaccgccgccc

SEQ ID NO: 2342477 - RNA, 22 nt, Bordetella pertussis
ccgaacaagguccaggcccggc

SEQ ID NO: 2342478 - RNA, 17 nt, Bordetella pertussis
ccgaacacaucgagggc

SEQ ID NO: 2342479 - RNA, 12 nt, Bordetella pertussis
ccgaacaccagc

SEQ ID NO: 2342480 - RNA, 15 nt, Bordetella pertussis
ccgaacaccagcucg

SEQ ID NO: 2342481 - RNA, 18 nt, Bordetella pertussis
ccgaacagaaggcgugcg

SEQ ID NO: 2342482 - RNA, 20 nt, Bordetella pertussis
ccgaacagaaggcgugcgug

SEQ ID NO: 2342483 - RNA, 19 nt, Bordetella pertussis
ccgaacagcauggcggcgc

SEQ ID NO: 2342484 - RNA, 21 nt, Bordetella pertussis
ccgaacagcauggcggcgccc

SEQ ID NO: 2342485 - RNA, 12 nt, Bordetella pertussis
ccgaacagccag

SEQ ID NO: 2342486 - RNA, 18 nt, Bordetella pertussis
ccgaacauauccacgcca

SEQ ID NO: 2342487 - RNA, 22 nt, Bordetella pertussis
ccgaacauauccacgccacugg

SEQ ID NO: 2342488 - RNA, 13 nt, Bordetella pertussis
ccgaaccacagca

SEQ ID NO: 2342489 - RNA, 12 nt, Bordetella pertussis
ccgaaccacccg

SEQ ID NO: 2342490 - RNA, 22 nt, Bordetella pertussis
ccgaaccagcgcaccaccagca

SEQ ID NO: 2342491 - RNA, 14 nt, Bordetella pertussis
ccgaacccugccuc

SEQ ID NO: 2342492 - RNA, 17 nt, Bordetella pertussis
ccgaaccgauccagccc

SEQ ID NO: 2342493 - RNA, 14 nt, Bordetella pertussis
ccgaaccgcgcagc

SEQ ID NO: 2342494 - RNA, 13 nt, Bordetella pertussis
ccgaacgaggcgc

SEQ ID NO: 2342495 - RNA, 13 nt, Bordetella pertussis
ccgaacgccgccg

SEQ ID NO: 2342496 - RNA, 18 nt, Bordetella pertussis
ccgaacgcgacagcgcug

SEQ ID NO: 2342497 - RNA, 16 nt, Bordetella pertussis
ccgaacgcgcagcgaa

SEQ ID NO: 2342498 - RNA, 19 nt, Bordetella pertussis
ccgaacgcgugcaccagcc

SEQ ID NO: 2342499 - RNA, 17 nt, Bordetella pertussis
ccgaacggcccauccau

SEQ ID NO: 2342500 - RNA, 12 nt, Bordetella pertussis
ccgaacggccgg

SEQ ID NO: 2342501 - RNA, 22 nt, Bordetella pertussis
ccgaacggccggucagcccagg

SEQ ID NO: 2342502 - RNA, 13 nt, Bordetella pertussis
ccgaacgggcgug

SEQ ID NO: 2342503 - RNA, 17 nt, Bordetella pertussis
ccgaacggggacuggca

SEQ ID NO: 2342504 - RNA, 20 nt, Bordetella pertussis
ccgaacggggacuggcacca

SEQ ID NO: 2342505 - RNA, 16 nt, Bordetella pertussis
ccgaacggggccgccu

SEQ ID NO: 2342506 - RNA, 17 nt, Bordetella pertussis
ccgaacucgcgcucggc

SEQ ID NO: 2342507 - RNA, 19 nt, Bordetella pertussis
ccgaacucgcgcucggcca

SEQ ID NO: 2342508 - RNA, 20 nt, Bordetella pertussis
ccgaacucgcgcucggccag

SEQ ID NO: 2342509 - RNA, 22 nt, Bordetella pertussis
ccgaacugccggcgcgggcgca

SEQ ID NO: 2342510 - RNA, 23 nt, Bordetella pertussis
ccgaacugggacaggcccagccc

SEQ ID NO: 2342511 - RNA, 21 nt, Bordetella pertussis
ccgaagaucuccucgcgcgcg

SEQ ID NO: 2342512 - RNA, 16 nt, Bordetella pertussis
ccgaagcaaugcagcg

SEQ ID NO: 2342513 - RNA, 20 nt, Bordetella pertussis
ccgaagcaaugcagcgcgac

SEQ ID NO: 2342514 - RNA, 15 nt, Bordetella pertussis
ccgaagcacagaugc

SEQ ID NO: 2342515 - RNA, 15 nt, Bordetella pertussis
ccgaagccgccgccg

SEQ ID NO: 2342516 - RNA, 14 nt, Bordetella pertussis
ccgaagcgcaggcc

SEQ ID NO: 2342517 - RNA, 15 nt, Bordetella pertussis
ccgaagcgcaggccu

SEQ ID NO: 2342518 - RNA, 12 nt, Bordetella pertussis
ccgaagcgcggg

SEQ ID NO: 2342519 - RNA, 18 nt, Bordetella pertussis
ccgaagcggcccgggugg

SEQ ID NO: 2342520 - RNA, 13 nt, Bordetella pertussis
ccgaagcggcguu

SEQ ID NO: 2342521 - RNA, 20 nt, Bordetella pertussis
ccgaagcggcguucugcagc

SEQ ID NO: 2342522 - RNA, 14 nt, Bordetella pertussis
ccgaagcgucggcc

SEQ ID NO: 2342523 - RNA, 17 nt, Bordetella pertussis
ccgaagcgucggccugc

SEQ ID NO: 2342524 - RNA, 20 nt, Bordetella pertussis
ccgaaggaccaagucgucgc

SEQ ID NO: 2342525 - RNA, 16 nt, Bordetella pertussis
ccgaaggcgcggccgg

SEQ ID NO: 2342526 - RNA, 19 nt, Bordetella pertussis
ccgaaggcgcggccgggcu

SEQ ID NO: 2342527 - RNA, 15 nt, Bordetella pertussis
ccgaaggcggcgccg

SEQ ID NO: 2342528 - RNA, 17 nt, Bordetella pertussis
ccgaaggcggcgccggu

SEQ ID NO: 2342529 - RNA, 16 nt, Bordetella pertussis
ccgaaggcgugaggcc

SEQ ID NO: 2342530 - RNA, 13 nt, Bordetella pertussis
ccgaagggcugcg

SEQ ID NO: 2342531 - RNA, 18 nt, Bordetella pertussis
ccgaaggucuuggcgugc

SEQ ID NO: 2342532 - RNA, 22 nt, Bordetella pertussis
ccgaaggugggcgaaccgcggc

SEQ ID NO: 2342533 - RNA, 19 nt, Bordetella pertussis
ccgaaguacacggccagca

SEQ ID NO: 2342534 - RNA, 20 nt, Bordetella pertussis
ccgaaguacacggccagcac

SEQ ID NO: 2342535 - RNA, 18 nt, Bordetella pertussis
ccgaaguaguuggucgag

SEQ ID NO: 2342536 - RNA, 21 nt, Bordetella pertussis
ccgaaguaguuggucgagcgc

SEQ ID NO: 2342537 - RNA, 20 nt, Bordetella pertussis
ccgaagugucagguuagcgg

SEQ ID NO: 2342538 - RNA, 15 nt, Bordetella pertussis
ccgaauccagggcca

SEQ ID NO: 2342539 - RNA, 16 nt, Bordetella pertussis
ccgaauccggccagca

SEQ ID NO: 2342540 - RNA, 18 nt, Bordetella pertussis
ccgaaucguucacgcccg

SEQ ID NO: 2342541 - RNA, 23 nt, Bordetella pertussis
ccgaauuccggcucggaccuggc

SEQ ID NO: 2342542 - RNA, 15 nt, Bordetella pertussis
ccgaauugccgccgc

SEQ ID NO: 2342543 - RNA, 14 nt, Bordetella pertussis
ccgacaccuggacc

SEQ ID NO: 2342544 - RNA, 18 nt, Bordetella pertussis
ccgacacgcuggcggaca

SEQ ID NO: 2342545 - RNA, 14 nt, Bordetella pertussis
ccgacagauggcgc

SEQ ID NO: 2342546 - RNA, 15 nt, Bordetella pertussis
ccgacagauggcgcu

SEQ ID NO: 2342547 - RNA, 18 nt, Bordetella pertussis
ccgacagcaagggcagau

SEQ ID NO: 2342548 - RNA, 15 nt, Bordetella pertussis
ccgacagcacauggc

SEQ ID NO: 2342549 - RNA, 15 nt, Bordetella pertussis
ccgacagcacgcccg

SEQ ID NO: 2342550 - RNA, 18 nt, Bordetella pertussis
ccgacagcacgcccgcca

SEQ ID NO: 2342551 - RNA, 15 nt, Bordetella pertussis
ccgacagcgccagcg

SEQ ID NO: 2342552 - RNA, 13 nt, Bordetella pertussis
ccgacagcgcccc

SEQ ID NO: 2342553 - RNA, 16 nt, Bordetella pertussis
ccgacagcucggacgg

SEQ ID NO: 2342554 - RNA, 23 nt, Bordetella pertussis
ccgacaggaaggcgagcgcggca

SEQ ID NO: 2342555 - RNA, 15 nt, Bordetella pertussis
ccgacaggccuggcu

SEQ ID NO: 2342556 - RNA, 18 nt, Bordetella pertussis
ccgacaggcgcgcaggcg

SEQ ID NO: 2342557 - RNA, 17 nt, Bordetella pertussis
ccgacaggcggcuguag

SEQ ID NO: 2342558 - RNA, 22 nt, Bordetella pertussis
ccgacagguaggcgccggucca

SEQ ID NO: 2342559 - RNA, 11 nt, Bordetella pertussis
ccgacaugccg

SEQ ID NO: 2342560 - RNA, 16 nt, Bordetella pertussis
ccgacaugccgcccca

SEQ ID NO: 2342561 - RNA, 15 nt, Bordetella pertussis
ccgaccaccagcacc

SEQ ID NO: 2342562 - RNA, 12 nt, Bordetella pertussis
ccgaccacccgc

SEQ ID NO: 2342563 - RNA, 18 nt, Bordetella pertussis
ccgaccacccgcgccagg

SEQ ID NO: 2342564 - RNA, 18 nt, Bordetella pertussis
cccggcggccaggccggc

SEQ ID NO: 2342565 - RNA, 19 nt, Bordetella pertussis
cccggcggccaggccggcg

SEQ ID NO: 2342566 - RNA, 20 nt, Bordetella pertussis
cccggcggccaggccggcgc

SEQ ID NO: 2342567 - RNA, 14 nt, Bordetella pertussis
cccggcggcgcgcc

SEQ ID NO: 2342568 - RNA, 15 nt, Bordetella pertussis
cccggcggcgcgccg

SEQ ID NO: 2342569 - RNA, 23 nt, Bordetella pertussis
cccggcggcgcgccgccgggccu

SEQ ID NO: 2342570 - RNA, 14 nt, Bordetella pertussis
cccggcggcgcgcu

SEQ ID NO: 2342571 - RNA, 14 nt, Bordetella pertussis
cccggcggcgcggc

SEQ ID NO: 2342572 - RNA, 19 nt, Bordetella pertussis
cccggcgggaacaggcacc

SEQ ID NO: 2342573 - RNA, 12 nt, Bordetella pertussis
cccggcgggccg

SEQ ID NO: 2342574 - RNA, 15 nt, Bordetella pertussis
cccggcggggacagg

SEQ ID NO: 2342575 - RNA, 17 nt, Bordetella pertussis
cccggcggggcaggcgc

SEQ ID NO: 2342576 - RNA, 17 nt, Bordetella pertussis
cccggcguauugccggg

SEQ ID NO: 2342577 - RNA, 21 nt, Bordetella pertussis
cccggcucgcugucgugccgc

SEQ ID NO: 2342578 - RNA, 12 nt, Bordetella pertussis
cccggcugcgcg

SEQ ID NO: 2342579 - RNA, 19 nt, Bordetella pertussis
cccggcugcgcggccgagc

SEQ ID NO: 2342580 - RNA, 21 nt, Bordetella pertussis
cccggcuucgaucaugcccgc

SEQ ID NO: 2342581 - RNA, 22 nt, Bordetella pertussis
cccggcuucgaucaugcccgcc

SEQ ID NO: 2342582 - RNA, 23 nt, Bordetella pertussis
cccggcuucgaucaugcccgcca

SEQ ID NO: 2342583 - RNA, 19 nt, Bordetella pertussis
cccggcuucugggucagcu

SEQ ID NO: 2342584 - RNA, 22 nt, Bordetella pertussis
cccggcuucugggucagcuucc

SEQ ID NO: 2342585 - RNA, 20 nt, Bordetella pertussis
cccgggaaacucgcgcagcg

SEQ ID NO: 2342586 - RNA, 19 nt, Bordetella pertussis
cccgggcaccagguccugg

SEQ ID NO: 2342587 - RNA, 17 nt, Bordetella pertussis
cccgggcaggagcgccg

SEQ ID NO: 2342588 - RNA, 14 nt, Bordetella pertussis
cccgggcaggcuca

SEQ ID NO: 2342589 - RNA, 15 nt, Bordetella pertussis
cccgggcaggcucag

SEQ ID NO: 2342590 - RNA, 23 nt, Bordetella pertussis
cccgggcaugcgaaagccggccu

SEQ ID NO: 2342591 - RNA, 12 nt, Bordetella pertussis
cccgggccggcu

SEQ ID NO: 2342592 - RNA, 17 nt, Bordetella pertussis
cccgggccggcuacagc

SEQ ID NO: 2342593 - RNA, 11 nt, Bordetella pertussis
cccgggccguc

SEQ ID NO: 2342594 - RNA, 15 nt, Bordetella pertussis
cccgggccgucgccg

SEQ ID NO: 2342595 - RNA, 23 nt, Bordetella pertussis
cccgggcgagauggcgugcacgc

SEQ ID NO: 2342596 - RNA, 19 nt, Bordetella pertussis
cccgggcgcaagcgcgccg

SEQ ID NO: 2342597 - RNA, 17 nt, Bordetella pertussis
cccgggcgccugcgcca

SEQ ID NO: 2342598 - RNA, 20 nt, Bordetella pertussis
cccgggcgccugcgccaccu

SEQ ID NO: 2342599 - RNA, 23 nt, Bordetella pertussis
cccgggcgugaccagcugcacca

SEQ ID NO: 2342600 - RNA, 14 nt, Bordetella pertussis
cccgggcguggcgu

SEQ ID NO: 2342601 - RNA, 19 nt, Bordetella pertussis
cccgggcugauccgcaccg

SEQ ID NO: 2342602 - RNA, 20 nt, Bordetella pertussis
cccgggcuggccgccugcug

SEQ ID NO: 2342603 - RNA, 18 nt, Bordetella pertussis
cccgggggcgccuguccc

SEQ ID NO: 2342604 - RNA, 20 nt, Bordetella pertussis
cccgggggcgccuguccccg

SEQ ID NO: 2342605 - RNA, 22 nt, Bordetella pertussis
cccgggguuagaguuuuuccuc

SEQ ID NO: 2342606 - RNA, 19 nt, Bordetella pertussis
cccgggguucuggcaggug

SEQ ID NO: 2342607 - RNA, 23 nt, Bordetella pertussis
cccgggguugggaucgcgccagg

SEQ ID NO: 2342608 - RNA, 19 nt, Bordetella pertussis
cccggguacguggccccag

SEQ ID NO: 2342609 - RNA, 12 nt, Bordetella pertussis
cccgggugcagg

SEQ ID NO: 2342610 - RNA, 16 nt, Bordetella pertussis
cccgggugccuguccc

SEQ ID NO: 2342611 - RNA, 23 nt, Bordetella pertussis
cccgggugccuguccccgccggg

SEQ ID NO: 2342612 - RNA, 15 nt, Bordetella pertussis
cccggguggcgccau

SEQ ID NO: 2342613 - RNA, 14 nt, Bordetella pertussis
cccgguaggccacg

SEQ ID NO: 2342614 - RNA, 15 nt, Bordetella pertussis
cccgguaggccuggu

SEQ ID NO: 2342615 - RNA, 14 nt, Bordetella pertussis
cccgguauccgcgc

SEQ ID NO: 2342616 - RNA, 12 nt, Bordetella pertussis
cccggucagcag

SEQ ID NO: 2342617 - RNA, 22 nt, Bordetella pertussis
cccggucagcagggcgccgacg

SEQ ID NO: 2342618 - RNA, 19 nt, Bordetella pertussis
cccggugaucaugccgcug

SEQ ID NO: 2342619 - RNA, 13 nt, Bordetella pertussis
cccggugaucgag

SEQ ID NO: 2342620 - RNA, 23 nt, Bordetella pertussis
cccggugaucgaguaggccggca

SEQ ID NO: 2342621 - RNA, 18 nt, Bordetella pertussis
cccggugccagucccccg

SEQ ID NO: 2342622 - RNA, 19 nt, Bordetella pertussis
cccggugccagucccccgc

SEQ ID NO: 2342623 - RNA, 22 nt, Bordetella pertussis
cccggugccagucccccgcggg

SEQ ID NO: 2342624 - RNA, 13 nt, Bordetella pertussis
cccggugccgaag

SEQ ID NO: 2342625 - RNA, 22 nt, Bordetella pertussis
cccggugcgcgcagggcggccg

SEQ ID NO: 2342626 - RNA, 23 nt, Bordetella pertussis
cccgguguaggcgggcagcggcg

SEQ ID NO: 2342627 - RNA, 15 nt, Bordetella pertussis
cccgguucgccgucg

SEQ ID NO: 2342628 - RNA, 15 nt, Bordetella pertussis
cccgguucugcggcg

SEQ ID NO: 2342629 - RNA, 19 nt, Bordetella pertussis
cccgguuggggucgcgcug

SEQ ID NO: 2342630 - RNA, 18 nt, Bordetella pertussis
cccguacgucaaggccug

SEQ ID NO: 2342631 - RNA, 17 nt, Bordetella pertussis
cccguacuugcuccggu

SEQ ID NO: 2342632 - RNA, 20 nt, Bordetella pertussis
cccguaggcggcccaggcgu

SEQ ID NO: 2342633 - RNA, 21 nt, Bordetella pertussis
cccgucagcacggucggcgcg

SEQ ID NO: 2342634 - RNA, 13 nt, Bordetella pertussis
cccgucagcggcg

SEQ ID NO: 2342635 - RNA, 20 nt, Bordetella pertussis
cccgucagcggcgcgcccac

SEQ ID NO: 2342636 - RNA, 14 nt, Bordetella pertussis
cccgucaggguacg

SEQ ID NO: 2342637 - RNA, 13 nt, Bordetella pertussis
cccgucaucgccg

SEQ ID NO: 2342638 - RNA, 20 nt, Bordetella pertussis
cccgucaucgggugcggcgc

SEQ ID NO: 2342639 - RNA, 21 nt, Bordetella pertussis
cccgucaugaggccccugucc

SEQ ID NO: 2342640 - RNA, 20 nt, Bordetella pertussis
cccgucaugcgccgcagcac

SEQ ID NO: 2342641 - RNA, 19 nt, Bordetella pertussis
cccgucaugggcggggcca

SEQ ID NO: 2342642 - RNA, 22 nt, Bordetella pertussis
cccguccacggccugcgcgccg

SEQ ID NO: 2342643 - RNA, 12 nt, Bordetella pertussis
cccgucccuggu

SEQ ID NO: 2342644 - RNA, 15 nt, Bordetella pertussis
cccgucccuggucca

SEQ ID NO: 2342645 - RNA, 17 nt, Bordetella pertussis
cccguccuuacuugcgc

SEQ ID NO: 2342646 - RNA, 19 nt, Bordetella pertussis
cccguccuuggcguccggc

SEQ ID NO: 2342647 - RNA, 21 nt, Bordetella pertussis
cccguccuuggcguccggccc

SEQ ID NO: 2342648 - RNA, 16 nt, Bordetella pertussis
cccgucgaccgcggcg

SEQ ID NO: 2342649 - RNA, 12 nt, Bordetella pertussis
cccgucgcgcca

SEQ ID NO: 2342650 - RNA, 17 nt, Bordetella pertussis
cccgucgcgccaggccg

SEQ ID NO: 2342651 - RNA, 18 nt, Bordetella pertussis
cccgucgcgccaggccgg

SEQ ID NO: 2342652 - RNA, 16 nt, Bordetella pertussis
cccgucggcggcaagc

SEQ ID NO: 2342653 - RNA, 14 nt, Bordetella pertussis
cccgucgggacagg

SEQ ID NO: 2342654 - RNA, 23 nt, Bordetella pertussis
cccgucgggcaggucggcgcggg

SEQ ID NO: 2342655 - RNA, 12 nt, Bordetella pertussis
cccgucuuggcg

SEQ ID NO: 2342656 - RNA, 23 nt, Bordetella pertussis
cccgugcggggaccggcacccgc

SEQ ID NO: 2342657 - RNA, 19 nt, Bordetella pertussis
cccgugcgggugccugucc

SEQ ID NO: 2342658 - RNA, 16 nt, Bordetella pertussis
cccgugcgugcgccug

SEQ ID NO: 2342659 - RNA, 22 nt, Bordetella pertussis
cccgugcgugcgccuguccccg

SEQ ID NO: 2342660 - RNA, 22 nt, Bordetella pertussis
cccgugcgugugccuguccccg

SEQ ID NO: 2342661 - RNA, 13 nt, Bordetella pertussis
cccguggcgcuca

SEQ ID NO: 2342662 - RNA, 12 nt, Bordetella pertussis
cccguggcggga

SEQ ID NO: 2342663 - RNA, 19 nt, Bordetella pertussis
cccguggggacaggcaccu

SEQ ID NO: 2342664 - RNA, 20 nt, Bordetella pertussis
cccguggggacgagcuccug

SEQ ID NO: 2342665 - RNA, 22 nt, Bordetella pertussis
cccguggggacgagcuccugga

SEQ ID NO: 2342666 - RNA, 17 nt, Bordetella pertussis
cccguggucgccagcac

SEQ ID NO: 2342667 - RNA, 15 nt, Bordetella pertussis
cccgugucgccgucg

SEQ ID NO: 2342668 - RNA, 13 nt, Bordetella pertussis
cccgugucggcaa

SEQ ID NO: 2342669 - RNA, 19 nt, Bordetella pertussis
cccguucggggacaggcac

SEQ ID NO: 2342670 - RNA, 21 nt, Bordetella pertussis
cccguucggggacaggcaccg

SEQ ID NO: 2342671 - RNA, 13 nt, Bordetella pertussis
cccguuggcaggc

SEQ ID NO: 2342672 - RNA, 20 nt, Bordetella pertussis
cccguuggcaggccagcaug

SEQ ID NO: 2342673 - RNA, 15 nt, Bordetella pertussis
cccguugucgccgcg

SEQ ID NO: 2342674 - RNA, 19 nt, Bordetella pertussis
cccguugucgccgcggccg

SEQ ID NO: 2342675 - RNA, 14 nt, Bordetella pertussis
cccguuugcgcagc

SEQ ID NO: 2342676 - RNA, 12 nt, Bordetella pertussis
cccuacccugau

SEQ ID NO: 2342677 - RNA, 20 nt, Bordetella pertussis
cccuacgaguaccgccgccu

SEQ ID NO: 2342678 - RNA, 16 nt, Bordetella pertussis
cccuagagcaugcggc

SEQ ID NO: 2342679 - RNA, 18 nt, Bordetella pertussis
cccuagagcaugcggcgu

SEQ ID NO: 2342680 - RNA, 14 nt, Bordetella pertussis
cccuagcgccgcgc

SEQ ID NO: 2342681 - RNA, 16 nt, Bordetella pertussis
cccucagcccgcaccg

SEQ ID NO: 2342682 - RNA, 19 nt, Bordetella pertussis
cccucaguccagcuggccc

SEQ ID NO: 2342683 - RNA, 16 nt, Bordetella pertussis
cccucauuggcgcgcu

SEQ ID NO: 2342684 - RNA, 21 nt, Bordetella pertussis
cccucauuggcgcgcuugagc

SEQ ID NO: 2342685 - RNA, 12 nt, Bordetella pertussis
cccuccggcgcc

SEQ ID NO: 2342686 - RNA, 15 nt, Bordetella pertussis
cccuccggcgccagc

SEQ ID NO: 2342687 - RNA, 22 nt, Bordetella pertussis
cccuccggugccuggcuccccg

SEQ ID NO: 2342688 - RNA, 13 nt, Bordetella pertussis
cccuccuacgcca

SEQ ID NO: 2342689 - RNA, 15 nt, Bordetella pertussis
cccuccucggccagg

SEQ ID NO: 2342690 - RNA, 18 nt, Bordetella pertussis
cccuccucggccaggucg

SEQ ID NO: 2342691 - RNA, 18 nt, Bordetella pertussis
cccucgaugaggccaggg

SEQ ID NO: 2342692 - RNA, 18 nt, Bordetella pertussis
cccucgcacggccgucaa

SEQ ID NO: 2342693 - RNA, 13 nt, Bordetella pertussis
cccucgcccagga

SEQ ID NO: 2342694 - RNA, 21 nt, Bordetella pertussis
ccgaccaccugcaccgccgcg

SEQ ID NO: 2342695 - RNA, 21 nt, Bordetella pertussis
ccgaccacgcugggccagacc

SEQ ID NO: 2342696 - RNA, 21 nt, Bordetella pertussis
ccgaccacuggaagcugcggc

SEQ ID NO: 2342697 - RNA, 12 nt, Bordetella pertussis
ccgaccagcgcg

SEQ ID NO: 2342698 - RNA, 16 nt, Bordetella pertussis
ccgaccagcucgacgc

SEQ ID NO: 2342699 - RNA, 13 nt, Bordetella pertussis
ccgaccaggcccg

SEQ ID NO: 2342700 - RNA, 14 nt, Bordetella pertussis
ccgaccaggcccgc

SEQ ID NO: 2342701 - RNA, 18 nt, Bordetella pertussis
ccgaccaggcccgccacg

SEQ ID NO: 2342702 - RNA, 17 nt, Bordetella pertussis
ccgaccaggccggcggc

SEQ ID NO: 2342703 - RNA, 20 nt, Bordetella pertussis
ccgaccaggcugcgcgccgg

SEQ ID NO: 2342704 - RNA, 13 nt, Bordetella pertussis
ccgacccccggcc

SEQ ID NO: 2342705 - RNA, 16 nt, Bordetella pertussis
ccgacccccggcccgc

SEQ ID NO: 2342706 - RNA, 17 nt, Bordetella pertussis
ccgacccgagcccuggc

SEQ ID NO: 2342707 - RNA, 13 nt, Bordetella pertussis
ccgaccgaagagg

SEQ ID NO: 2342708 - RNA, 14 nt, Bordetella pertussis
ccgaccgaagagga

SEQ ID NO: 2342709 - RNA, 12 nt, Bordetella pertussis
ccgaccgcuucc

SEQ ID NO: 2342710 - RNA, 18 nt, Bordetella pertussis
ccgaccgcuuccgccacc

SEQ ID NO: 2342711 - RNA, 19 nt, Bordetella pertussis
ccgaccgcuuccgccaccg

SEQ ID NO: 2342712 - RNA, 14 nt, Bordetella pertussis
ccgaccggccccac

SEQ ID NO: 2342713 - RNA, 14 nt, Bordetella pertussis
ccgaccggcgcgcg

SEQ ID NO: 2342714 - RNA, 18 nt, Bordetella pertussis
ccgaccggcgcgcgcguu

SEQ ID NO: 2342715 - RNA, 17 nt, Bordetella pertussis
ccgaccgggccgaccag

SEQ ID NO: 2342716 - RNA, 12 nt, Bordetella pertussis
ccgaccuccagg

SEQ ID NO: 2342717 - RNA, 15 nt, Bordetella pertussis
ccgaccuccaggccc

SEQ ID NO: 2342718 - RNA, 16 nt, Bordetella pertussis
ccgaccuccaggccca

SEQ ID NO: 2342719 - RNA, 14 nt, Bordetella pertussis
ccgaccucgucggg

SEQ ID NO: 2342720 - RNA, 20 nt, Bordetella pertussis
ccgaccucuucguugucgcg

SEQ ID NO: 2342721 - RNA, 15 nt, Bordetella pertussis
ccgaccugaucgcgc

SEQ ID NO: 2342722 - RNA, 20 nt, Bordetella pertussis
ccgaccugaucgcgcagcgc

SEQ ID NO: 2342723 - RNA, 24 nt, Bordetella pertussis
ccgaccugaucgcgcagcgccugg

SEQ ID NO: 2342724 - RNA, 12 nt, Bordetella pertussis
ccgaccugcugg

SEQ ID NO: 2342725 - RNA, 16 nt, Bordetella pertussis
ccgaccugcuggcgcg

SEQ ID NO: 2342726 - RNA, 18 nt, Bordetella pertussis
ccgaccugcuggcgcgca

SEQ ID NO: 2342727 - RNA, 19 nt, Bordetella pertussis
ccgaccuggcgcccgacgg

SEQ ID NO: 2342728 - RNA, 22 nt, Bordetella pertussis
ccgaccuggcgcccgacggcgc

SEQ ID NO: 2342729 - RNA, 20 nt, Bordetella pertussis
ccgacgaaaugccggcgaau

SEQ ID NO: 2342730 - RNA, 21 nt, Bordetella pertussis
ccgacgaacugcgagugggug

SEQ ID NO: 2342731 - RNA, 17 nt, Bordetella pertussis
ccgacgagaaugcgccg

SEQ ID NO: 2342732 - RNA, 13 nt, Bordetella pertussis
ccgacgaggcgcu

SEQ ID NO: 2342733 - RNA, 22 nt, Bordetella pertussis
ccgacgauaucgcgaaagcggc

SEQ ID NO: 2342734 - RNA, 16 nt, Bordetella pertussis
ccgacgaugaucauga

SEQ ID NO: 2342735 - RNA, 15 nt, Bordetella pertussis
ccgacgaugccgccc

SEQ ID NO: 2342736 - RNA, 16 nt, Bordetella pertussis
ccgacgaugccgccgc

SEQ ID NO: 2342737 - RNA, 18 nt, Bordetella pertussis
ccgacgaugccgccgccg

SEQ ID NO: 2342738 - RNA, 19 nt, Bordetella pertussis
ccgacgaugccggucucca

SEQ ID NO: 2342739 - RNA, 15 nt, Bordetella pertussis
ccgacgaugucgccg

SEQ ID NO: 2342740 - RNA, 18 nt, Bordetella pertussis
ccgacgaugucgccgccg

SEQ ID NO: 2342741 - RNA, 19 nt, Bordetella pertussis
ccgacgaugucgccgccgc

SEQ ID NO: 2342742 - RNA, 15 nt, Bordetella pertussis
ccgacgcagcgcacc

SEQ ID NO: 2342743 - RNA, 12 nt, Bordetella pertussis
ccgacgccgcca

SEQ ID NO: 2342744 - RNA, 20 nt, Bordetella pertussis
ccgacgcgaggcagaagugg

SEQ ID NO: 2342745 - RNA, 14 nt, Bordetella pertussis
ccgacgcgcccggg

SEQ ID NO: 2342746 - RNA, 16 nt, Bordetella pertussis
ccgacgcgcccgggcu

SEQ ID NO: 2342747 - RNA, 12 nt, Bordetella pertussis
ccgacgcgccgg

SEQ ID NO: 2342748 - RNA, 14 nt, Bordetella pertussis
ccgacgcgccgggc

SEQ ID NO: 2342749 - RNA, 20 nt, Bordetella pertussis
ccgacgcgcugguccgccgc

SEQ ID NO: 2342750 - RNA, 16 nt, Bordetella pertussis
ccgacgcggccagcgg

SEQ ID NO: 2342751 - RNA, 17 nt, Bordetella pertussis
ccgacgcggccagcggc

SEQ ID NO: 2342752 - RNA, 19 nt, Bordetella pertussis
ccgacgcggccagcggcgc

SEQ ID NO: 2342753 - RNA, 15 nt, Bordetella pertussis
ccgacgcggucgccc

SEQ ID NO: 2342754 - RNA, 19 nt, Bordetella pertussis
ccgacgcuguaacaacacg

SEQ ID NO: 2342755 - RNA, 15 nt, Bordetella pertussis
ccgacggcagccccg

SEQ ID NO: 2342756 - RNA, 13 nt, Bordetella pertussis
ccgacggcauggc

SEQ ID NO: 2342757 - RNA, 16 nt, Bordetella pertussis
ccgacggcauggcggc

SEQ ID NO: 2342758 - RNA, 20 nt, Bordetella pertussis
ccgacggcauggcggccagc

SEQ ID NO: 2342759 - RNA, 13 nt, Bordetella pertussis
ccgacggccagcg

SEQ ID NO: 2342760 - RNA, 16 nt, Bordetella pertussis
ccgacggccagcgcga

SEQ ID NO: 2342761 - RNA, 17 nt, Bordetella pertussis
ccgacggccagcgcgac

SEQ ID NO: 2342762 - RNA, 16 nt, Bordetella pertussis
ccgacggccucggcca

SEQ ID NO: 2342763 - RNA, 19 nt, Bordetella pertussis
ccgacggccucggccagga

SEQ ID NO: 2342764 - RNA, 15 nt, Bordetella pertussis
ccgacggcgccgugc

SEQ ID NO: 2342765 - RNA, 18 nt, Bordetella pertussis
ccgacggcgccgugcugg

SEQ ID NO: 2342766 - RNA, 14 nt, Bordetella pertussis
ccgacggcgcgccc

SEQ ID NO: 2342767 - RNA, 15 nt, Bordetella pertussis
ccgacggcgcgcccg

SEQ ID NO: 2342768 - RNA, 14 nt, Bordetella pertussis
ccgacggcgcggcg

SEQ ID NO: 2342769 - RNA, 20 nt, Bordetella pertussis
ccgacggcgcggcgaucggc

SEQ ID NO: 2342770 - RNA, 19 nt, Bordetella pertussis
ccgacggcgcuggcgagca

SEQ ID NO: 2342771 - RNA, 22 nt, Bordetella pertussis
ccgacggcggcgcggcgccagc

SEQ ID NO: 2342772 - RNA, 23 nt, Bordetella pertussis
ccgacggcggcgcggcgccagcg

SEQ ID NO: 2342773 - RNA, 21 nt, Bordetella pertussis
ccgacggcucgcgcucgcccg

SEQ ID NO: 2342774 - RNA, 23 nt, Bordetella pertussis
ccgacggcucgcgcucgcccggc

SEQ ID NO: 2342775 - RNA, 18 nt, Bordetella pertussis
ccgacgggcggcugcugg

SEQ ID NO: 2342776 - RNA, 21 nt, Bordetella pertussis
ccgacggggugccuguccccg

SEQ ID NO: 2342777 - RNA, 20 nt, Bordetella pertussis
ccgacgguaucucagcgcgc

SEQ ID NO: 2342778 - RNA, 18 nt, Bordetella pertussis
ccgacgugaaagcuccac

SEQ ID NO: 2342779 - RNA, 12 nt, Bordetella pertussis
ccgacgugcugc

SEQ ID NO: 2342780 - RNA, 13 nt, Bordetella pertussis
ccgacgugcugcu

SEQ ID NO: 2342781 - RNA, 17 nt, Bordetella pertussis
ccgacgugcugcugcac

SEQ ID NO: 2342782 - RNA, 14 nt, Bordetella pertussis
ccgacguggaccgc

SEQ ID NO: 2342783 - RNA, 16 nt, Bordetella pertussis
ccgacguggaccgcgc

SEQ ID NO: 2342784 - RNA, 18 nt, Bordetella pertussis
ccgacguggaccgcgcgg

SEQ ID NO: 2342785 - RNA, 21 nt, Bordetella pertussis
ccgacuaugcuuuacccugaa

SEQ ID NO: 2342786 - RNA, 19 nt, Bordetella pertussis
ccgacucgaaacgggcggc

SEQ ID NO: 2342787 - RNA, 14 nt, Bordetella pertussis
ccgacugcgcaugg

SEQ ID NO: 2342788 - RNA, 19 nt, Bordetella pertussis
ccgacugcgcauggucgcg

SEQ ID NO: 2342789 - RNA, 20 nt, Bordetella pertussis
ccgacugcuguacgacagca

SEQ ID NO: 2342790 - RNA, 18 nt, Bordetella pertussis
ccgacuucaccgaggcgc

SEQ ID NO: 2342791 - RNA, 22 nt, Bordetella pertussis
ccgacuucuggggugccugucc

SEQ ID NO: 2342792 - RNA, 19 nt, Bordetella pertussis
ccgagaaaccgauggugcc

SEQ ID NO: 2342793 - RNA, 22 nt, Bordetella pertussis
ccgagaagauuucccagagcug

SEQ ID NO: 2342794 - RNA, 14 nt, Bordetella pertussis
ccgagaccgcccgc

SEQ ID NO: 2342795 - RNA, 16 nt, Bordetella pertussis
ccgagaccgcccgcug

SEQ ID NO: 2342796 - RNA, 16 nt, Bordetella pertussis
ccgagaccgggcggua

SEQ ID NO: 2342797 - RNA, 17 nt, Bordetella pertussis
ccgagacgcugucgcgc

SEQ ID NO: 2342798 - RNA, 20 nt, Bordetella pertussis
ccgagacgcugucgcgcccg

SEQ ID NO: 2342799 - RNA, 19 nt, Bordetella pertussis
ccgagaggcugaaggggcu

SEQ ID NO: 2342800 - RNA, 16 nt, Bordetella pertussis
ccgagauaggcggcca

SEQ ID NO: 2342801 - RNA, 18 nt, Bordetella pertussis
ccgagauaggcggccagg

SEQ ID NO: 2342802 - RNA, 15 nt, Bordetella pertussis
ccgagaugugcggcg

SEQ ID NO: 2342803 - RNA, 17 nt, Bordetella pertussis
ccgagaugugcggcgug

SEQ ID NO: 2342804 - RNA, 20 nt, Bordetella pertussis
ccgagaugugcggcguggcg

SEQ ID NO: 2342805 - RNA, 12 nt, Bordetella pertussis
ccgagcacagca

SEQ ID NO: 2342806 - RNA, 22 nt, Bordetella pertussis
ccgagcacagcaacucuucccc

SEQ ID NO: 2342807 - RNA, 13 nt, Bordetella pertussis
ccgagcccgacgc

SEQ ID NO: 2342808 - RNA, 17 nt, Bordetella pertussis
ccgagcccgggcgugcc

SEQ ID NO: 2342809 - RNA, 16 nt, Bordetella pertussis
ccgagccgcaggucca

SEQ ID NO: 2342810 - RNA, 17 nt, Bordetella pertussis
ccgagccgcagguccag

SEQ ID NO: 2342811 - RNA, 21 nt, Bordetella pertussis
ccgagccgccccggcgcggcg

SEQ ID NO: 2342812 - RNA, 20 nt, Bordetella pertussis
ccgagccgcugucgcaggcg

SEQ ID NO: 2342813 - RNA, 18 nt, Bordetella pertussis
ccgagccggccagcgccu

SEQ ID NO: 2342814 - RNA, 12 nt, Bordetella pertussis
ccgagccggugg

SEQ ID NO: 2342815 - RNA, 13 nt, Bordetella pertussis
ccgagccgguggg

SEQ ID NO: 2342816 - RNA, 21 nt, Bordetella pertussis
ccgagccuggcguagggcugc

SEQ ID NO: 2342817 - RNA, 14 nt, Bordetella pertussis
ccgagcgcaccccg

SEQ ID NO: 2342818 - RNA, 21 nt, Bordetella pertussis
ccgagcgcaccccggccgacg

SEQ ID NO: 2342819 - RNA, 12 nt, Bordetella pertussis
ccgagcgccaca

SEQ ID NO: 2342820 - RNA, 23 nt, Bordetella pertussis
ccgagcgccacauaaucgucggc

SEQ ID NO: 2342821 - RNA, 14 nt, Bordetella pertussis
ccgagcgcgagcag

SEQ ID NO: 2342822 - RNA, 15 nt, Bordetella pertussis
ccgagcgcgagcagg

SEQ ID NO: 2342823 - RNA, 12 nt, Bordetella pertussis
ccgagcgcgcca

SEQ ID NO: 2342824 - RNA, 14 nt, Bordetella pertussis
ccgagcgcgccagc

SEQ ID NO: 2342825 - RNA, 15 nt, Bordetella pertussis
ccgagcgcgccagca

SEQ ID NO: 2342826 - RNA, 17 nt, Bordetella pertussis
ccgagcgcgccagcacg

SEQ ID NO: 2342827 - RNA, 11 nt, Bordetella pertussis
ccgagcgcggc

SEQ ID NO: 2342828 - RNA, 14 nt, Bordetella pertussis
ccgagcgcggcaug

SEQ ID NO: 2342829 - RNA, 17 nt, Bordetella pertussis
ccgagcgcggcaugcgc

SEQ ID NO: 2342830 - RNA, 11 nt, Bordetella pertussis
ccgagcgcugc

SEQ ID NO: 2342831 - RNA, 15 nt, Bordetella pertussis
ccgagcgggccagcg

SEQ ID NO: 2342832 - RNA, 16 nt, Bordetella pertussis
ccgagcgggccagcgc

SEQ ID NO: 2342833 - RNA, 19 nt, Bordetella pertussis
ccgagcgggccagcgcggc

SEQ ID NO: 2342834 - RNA, 14 nt, Bordetella pertussis
ccgagcgggcccga

SEQ ID NO: 2342835 - RNA, 20 nt, Bordetella pertussis
ccgagcgggcccgacagcgc

SEQ ID NO: 2342836 - RNA, 22 nt, Bordetella pertussis
ccgagcgggcccgacagcgccc

SEQ ID NO: 2342837 - RNA, 15 nt, Bordetella pertussis
ccgagcggggccgcg

SEQ ID NO: 2342838 - RNA, 12 nt, Bordetella pertussis
ccgagcgugccg

SEQ ID NO: 2342839 - RNA, 15 nt, Bordetella pertussis
ccgagcugagcacca

SEQ ID NO: 2342840 - RNA, 17 nt, Bordetella pertussis
ccgagcugagcaccagc

SEQ ID NO: 2342841 - RNA, 23 nt, Bordetella pertussis
ccgagcugccgccuucgucgcgc

SEQ ID NO: 2342842 - RNA, 14 nt, Bordetella pertussis
ccgaggaccugcug

SEQ ID NO: 2342843 - RNA, 13 nt, Bordetella pertussis
ccgaggccugcug

SEQ ID NO: 2342844 - RNA, 14 nt, Bordetella pertussis
ccgaggccugcugu

SEQ ID NO: 2342845 - RNA, 18 nt, Bordetella pertussis
ccgaggccuugcucgccc

SEQ ID NO: 2342846 - RNA, 13 nt, Bordetella pertussis
ccgaggcgcccca

SEQ ID NO: 2342847 - RNA, 14 nt, Bordetella pertussis
ccgaggcgccgccg

SEQ ID NO: 2342848 - RNA, 14 nt, Bordetella pertussis
ccgaggcgcugccc

SEQ ID NO: 2342849 - RNA, 18 nt, Bordetella pertussis
ccgaggcgggcagcaugg

SEQ ID NO: 2342850 - RNA, 23 nt, Bordetella pertussis
ccgaggcgggcagcauggcgcca

SEQ ID NO: 2342851 - RNA, 19 nt, Bordetella pertussis
ccgaggcuucgauggcggc

SEQ ID NO: 2342852 - RNA, 22 nt, Bordetella pertussis
ccgaggcuucgauggcggcggc

SEQ ID NO: 2342853 - RNA, 19 nt, Bordetella pertussis
ccgagggccggaacagcgu

SEQ ID NO: 2342854 - RNA, 22 nt, Bordetella pertussis
ccgagggccggacuggcgcgca

SEQ ID NO: 2342855 - RNA, 17 nt, Bordetella pertussis
ccgagggcgcggcgccg

SEQ ID NO: 2342856 - RNA, 18 nt, Bordetella pertussis
ccgagggcgcggcgccgc

SEQ ID NO: 2342857 - RNA, 13 nt, Bordetella pertussis
ccgaggucggcgg

SEQ ID NO: 2342858 - RNA, 24 nt, Bordetella pertussis
ccgaggucggcgguccacagcccg

SEQ ID NO: 2342859 - RNA, 19 nt, Bordetella pertussis
ccgaggugcccaucaggcc

SEQ ID NO: 2342860 - RNA, 14 nt, Bordetella pertussis
ccgaguagcggcgc

SEQ ID NO: 2342861 - RNA, 19 nt, Bordetella pertussis
ccgaguccuugacgccgcc

SEQ ID NO: 2342862 - RNA, 20 nt, Bordetella pertussis
ccgaguccuugacgccgccg

SEQ ID NO: 2342863 - RNA, 12 nt, Bordetella pertussis
ccgagucggcga

SEQ ID NO: 2342864 - RNA, 21 nt, Bordetella pertussis
ccgagucggcgauggcgcgcg

SEQ ID NO: 2342865 - RNA, 22 nt, Bordetella pertussis
ccgagucggcgauggcgcgcgc

SEQ ID NO: 2342866 - RNA, 23 nt, Bordetella pertussis
ccgagucggcgauggcgcgcgcc

SEQ ID NO: 2342867 - RNA, 15 nt, Bordetella pertussis
ccgaguggcgggcca

SEQ ID NO: 2342868 - RNA, 22 nt, Bordetella pertussis
ccgaguugaggaugcgcgcggc

SEQ ID NO: 2342869 - RNA, 23 nt, Bordetella pertussis
ccgaguugaggaugcgcgcggcc

SEQ ID NO: 2342870 - RNA, 24 nt, Bordetella pertussis
ccgaguugaggaugcgcgcggcca

SEQ ID NO: 2342871 - RNA, 21 nt, Bordetella pertussis
ccgauacaaggugccuguccc

SEQ ID NO: 2342872 - RNA, 22 nt, Bordetella pertussis
ccgauacaggcgcucgcgcugc

SEQ ID NO: 2342873 - RNA, 15 nt, Bordetella pertussis
ccgauaccacgcgcg

SEQ ID NO: 2342874 - RNA, 17 nt, Bordetella pertussis
ccgauacgacacgccgc

SEQ ID NO: 2342875 - RNA, 21 nt, Bordetella pertussis
ccgauacgacacgccgcgcga

SEQ ID NO: 2342876 - RNA, 22 nt, Bordetella pertussis
ccgauacgacacgccgcgcgau

SEQ ID NO: 2342877 - RNA, 21 nt, Bordetella pertussis
ccgauacgcgugcgcggccgc

SEQ ID NO: 2342878 - RNA, 23 nt, Bordetella pertussis
ccgauacgcgugcgcggccgcgc

SEQ ID NO: 2342879 - RNA, 16 nt, Bordetella pertussis
ccgauagccgcggcgc

SEQ ID NO: 2342880 - RNA, 18 nt, Bordetella pertussis
ccgauagccgcggcgccg

SEQ ID NO: 2342881 - RNA, 15 nt, Bordetella pertussis
ccgauagccgugacc

SEQ ID NO: 2342882 - RNA, 23 nt, Bordetella pertussis
ccgauagccgugaccugcucguc

SEQ ID NO: 2342883 - RNA, 15 nt, Bordetella pertussis
ccgauagcggcgccg

SEQ ID NO: 2342884 - RNA, 16 nt, Bordetella pertussis
ccgauagcggcgccgc

SEQ ID NO: 2342885 - RNA, 23 nt, Bordetella pertussis
ccgauagcggcgccgcuuccggc

SEQ ID NO: 2342886 - RNA, 16 nt, Bordetella pertussis
ccgauagcguucgaua

SEQ ID NO: 2342887 - RNA, 14 nt, Bordetella pertussis
ccgauagguucgug

SEQ ID NO: 2342888 - RNA, 19 nt, Bordetella pertussis
ccgauaucgauaccaacug

SEQ ID NO: 2342889 - RNA, 22 nt, Bordetella pertussis
ccgauaucgauaccaacugccu

SEQ ID NO: 2342890 - RNA, 22 nt, Bordetella pertussis
ccgauaugcagccgcaccagcg

SEQ ID NO: 2342891 - RNA, 22 nt, Bordetella pertussis
ccgaucaaccugaucguucccu

SEQ ID NO: 2342892 - RNA, 13 nt, Bordetella pertussis
ccgaucagccggc

SEQ ID NO: 2342893 - RNA, 15 nt, Bordetella pertussis
ccgaucagccggcca

SEQ ID NO: 2342894 - RNA, 19 nt, Bordetella pertussis
ccgaucagcgacagcaggg

SEQ ID NO: 2342895 - RNA, 19 nt, Bordetella pertussis
ccgauccagcccaccgcga

SEQ ID NO: 2342896 - RNA, 12 nt, Bordetella pertussis
ccgauccagcgc

SEQ ID NO: 2342897 - RNA, 13 nt, Bordetella pertussis
ccgauccagcgcc

SEQ ID NO: 2342898 - RNA, 14 nt, Bordetella pertussis
ccgauccagcgccu

SEQ ID NO: 2342899 - RNA, 14 nt, Bordetella pertussis
ccgauccccugccc

SEQ ID NO: 2342900 - RNA, 16 nt, Bordetella pertussis
ccgauccccugcccgc

SEQ ID NO: 2342901 - RNA, 19 nt, Bordetella pertussis
ccgauccccugcccgccug

SEQ ID NO: 2342902 - RNA, 15 nt, Bordetella pertussis
ccgauccgaugaugc

SEQ ID NO: 2342903 - RNA, 17 nt, Bordetella pertussis
ccgauccgcgggcgggc

SEQ ID NO: 2342904 - RNA, 15 nt, Bordetella pertussis
ccgaucgacggccgc

SEQ ID NO: 2342905 - RNA, 16 nt, Bordetella pertussis
ccgaucgagcaggccg

SEQ ID NO: 2342906 - RNA, 18 nt, Bordetella pertussis
ccgaucgagcaggccgcc

SEQ ID NO: 2342907 - RNA, 21 nt, Bordetella pertussis
ccgaucgagcaggccgccggg

SEQ ID NO: 2342908 - RNA, 15 nt, Bordetella pertussis
ccgaucgccgacagg

SEQ ID NO: 2342909 - RNA, 19 nt, Bordetella pertussis
ccgaucgcgcacagcaugg

SEQ ID NO: 2342910 - RNA, 13 nt, Bordetella pertussis
ccgaucgcgccgu

SEQ ID NO: 2342911 - RNA, 17 nt, Bordetella pertussis
ccgaucgcggcuccagc

SEQ ID NO: 2342912 - RNA, 18 nt, Bordetella pertussis
ccgaucgcggcuccagcu

SEQ ID NO: 2342913 - RNA, 21 nt, Bordetella pertussis
ccgaucgcggcuccagcucag

SEQ ID NO: 2342914 - RNA, 15 nt, Bordetella pertussis
ccgaucggcgccgcg

SEQ ID NO: 2342915 - RNA, 18 nt, Bordetella pertussis
ccgaucggcgccgcgcgc

SEQ ID NO: 2342916 - RNA, 19 nt, Bordetella pertussis
ccgaucuccgggagccugu

SEQ ID NO: 2342917 - RNA, 22 nt, Bordetella pertussis
ccgaugaacgacaggguccagg

SEQ ID NO: 2342918 - RNA, 22 nt, Bordetella pertussis
ccgaugaauugcgccacgccca

SEQ ID NO: 2342919 - RNA, 14 nt, Bordetella pertussis
ccgaugacaucgcc

SEQ ID NO: 2342920 - RNA, 13 nt, Bordetella pertussis
ccgaugaccggcc

SEQ ID NO: 2342921 - RNA, 16 nt, Bordetella pertussis
ccgaugaugcccagga

SEQ ID NO: 2342922 - RNA, 20 nt, Bordetella pertussis
ccgaugauggauucgcgccg

SEQ ID NO: 2342923 - RNA, 20 nt, Bordetella pertussis
ccgaugauggugaacgccac

SEQ ID NO: 2342924 - RNA, 15 nt, Bordetella pertussis
ccgaugccuuggugg

SEQ ID NO: 2342925 - RNA, 19 nt, Bordetella pertussis
ccgaugccuuggugggguc

SEQ ID NO: 2342926 - RNA, 19 nt, Bordetella pertussis
ccgaugcgccaggccucgg

SEQ ID NO: 2342927 - RNA, 13 nt, Bordetella pertussis
ccgaugcgccggc

SEQ ID NO: 2342928 - RNA, 14 nt, Bordetella pertussis
ccgaugcgccggcc

SEQ ID NO: 2342929 - RNA, 21 nt, Bordetella pertussis
ccgaugcgccggccuggcgcg

SEQ ID NO: 2342930 - RNA, 16 nt, Bordetella pertussis
ccgaugcggcgcaugc

SEQ ID NO: 2342931 - RNA, 18 nt, Bordetella pertussis
ccgaugcgguaggcccag

SEQ ID NO: 2342932 - RNA, 20 nt, Bordetella pertussis
ccgaugcgguaggcccagca

SEQ ID NO: 2342933 - RNA, 15 nt, Bordetella pertussis
ccgaugcguccgccg

SEQ ID NO: 2342934 - RNA, 18 nt, Bordetella pertussis
ccgaugcucgccggcgcc

SEQ ID NO: 2342935 - RNA, 13 nt, Bordetella pertussis
ccgauggcaucgc

SEQ ID NO: 2342936 - RNA, 21 nt, Bordetella pertussis
ccgauggcauggggcaggcgc

SEQ ID NO: 2342937 - RNA, 23 nt, Bordetella pertussis
ccgauggcauggggcaggcgcag

SEQ ID NO: 2342938 - RNA, 13 nt, Bordetella pertussis
ccgauggcgccgc

SEQ ID NO: 2342939 - RNA, 13 nt, Bordetella pertussis
ccgauggcgcgcg

SEQ ID NO: 2342940 - RNA, 15 nt, Bordetella pertussis
ccgauggcgcggccg

SEQ ID NO: 2342941 - RNA, 20 nt, Bordetella pertussis
ccgauggcgcggccgccagc

SEQ ID NO: 2342942 - RNA, 22 nt, Bordetella pertussis
ccgauggcgcggccgccagccc

SEQ ID NO: 2342943 - RNA, 18 nt, Bordetella pertussis
ccgauggcguccagcagc

SEQ ID NO: 2342944 - RNA, 19 nt, Bordetella pertussis
ccgauggcguccagcagca

SEQ ID NO: 2342945 - RNA, 16 nt, Bordetella pertussis
ccgauggucagcaugu

SEQ ID NO: 2342946 - RNA, 13 nt, Bordetella pertussis
ccgauggucagcg

SEQ ID NO: 2342947 - RNA, 15 nt, Bordetella pertussis
ccgauggugccgggc

SEQ ID NO: 2342948 - RNA, 14 nt, Bordetella pertussis
ccgauggugcgggc

SEQ ID NO: 2342949 - RNA, 17 nt, Bordetella pertussis
ccgaugucgaacagcug

SEQ ID NO: 2342950 - RNA, 18 nt, Bordetella pertussis
ccgaugucgaacagcugc

SEQ ID NO: 2342951 - RNA, 18 nt, Bordetella pertussis
ccgaugucgaccaugucc

SEQ ID NO: 2342952 - RNA, 15 nt, Bordetella pertussis
ccgaugucgccgccu

SEQ ID NO: 2342953 - RNA, 17 nt, Bordetella pertussis
ccgaugucgccgccugc

SEQ ID NO: 2342954 - RNA, 19 nt, Bordetella pertussis
ccgauguuguuggccgcca

SEQ ID NO: 2342955 - RNA, 21 nt, Bordetella pertussis
ccgauguuguuggccgccagc

SEQ ID NO: 2342956 - RNA, 23 nt, Bordetella pertussis
ccgauguuguuggccgccagccg

SEQ ID NO: 2342957 - RNA, 19 nt, Bordetella pertussis
ccgauuccaggacgacagg

SEQ ID NO: 2342958 - RNA, 14 nt, Bordetella pertussis
ccgauucgcgcacc

SEQ ID NO: 2342959 - RNA, 16 nt, Bordetella pertussis
ccgauucgcgcaccga

SEQ ID NO: 2342960 - RNA, 16 nt, Bordetella pertussis
ccgauugaggccagca

SEQ ID NO: 2342961 - RNA, 14 nt, Bordetella pertussis
ccgauuucgccgcc

SEQ ID NO: 2342962 - RNA, 14 nt, Bordetella pertussis
ccgauuucgcgcgc

SEQ ID NO: 2342963 - RNA, 16 nt, Bordetella pertussis
ccgauuucgcgcgcca

SEQ ID NO: 2342964 - RNA, 19 nt, Bordetella pertussis
ccgauuucggccgccggcg

SEQ ID NO: 2342965 - RNA, 16 nt, Bordetella pertussis
ccgauuuucaccaucc

SEQ ID NO: 2342966 - RNA, 23 nt, Bordetella pertussis
ccgcaacaggcagcugcgcgucg

SEQ ID NO: 2342967 - RNA, 23 nt, Bordetella pertussis
ccgcaacccacccccagcagcau

SEQ ID NO: 2342968 - RNA, 16 nt, Bordetella pertussis
ccgcaacccagcagcg

SEQ ID NO: 2342969 - RNA, 14 nt, Bordetella pertussis
ccgcaacccgcuuu

SEQ ID NO: 2342970 - RNA, 16 nt, Bordetella pertussis
ccgcaaccgucgaccg

SEQ ID NO: 2342971 - RNA, 13 nt, Bordetella pertussis
ccgcaacgccgcc

SEQ ID NO: 2342972 - RNA, 16 nt, Bordetella pertussis
ccgcaacgccgccggc

SEQ ID NO: 2342973 - RNA, 21 nt, Bordetella pertussis
ccgcaagauuucauggcgucu

SEQ ID NO: 2342974 - RNA, 22 nt, Bordetella pertussis
ccgcaagcaagccccaggcagg

SEQ ID NO: 2342975 - RNA, 22 nt, Bordetella pertussis
ccgcaagcauuugcgcgacggc

SEQ ID NO: 2342976 - RNA, 23 nt, Bordetella pertussis
ccgcaagcguacguaccaggccg

SEQ ID NO: 2342977 - RNA, 23 nt, Bordetella pertussis
ccgcaagcuggccgaugucgccg

SEQ ID NO: 2342978 - RNA, 12 nt, Bordetella pertussis
ccgcaaggaagu

SEQ ID NO: 2342979 - RNA, 22 nt, Bordetella pertussis
ccgcaaggaaguggccgagcgc

SEQ ID NO: 2342980 - RNA, 15 nt, Bordetella pertussis
ccgcaaggggccggc

SEQ ID NO: 2342981 - RNA, 17 nt, Bordetella pertussis
ccgcaaggggccggcgc

SEQ ID NO: 2342982 - RNA, 17 nt, Bordetella pertussis
ccgcaagggggacuggc

SEQ ID NO: 2342983 - RNA, 23 nt, Bordetella pertussis
ccgcaagggggacuggcaccggc

SEQ ID NO: 2342984 - RNA, 18 nt, Bordetella pertussis
ccgcaaguucggcagcga

SEQ ID NO: 2342985 - RNA, 17 nt, Bordetella pertussis
ccgcacauacaaggcgc

SEQ ID NO: 2342986 - RNA, 19 nt, Bordetella pertussis
ccgcacauacaaggcgcgg

SEQ ID NO: 2342987 - RNA, 21 nt, Bordetella pertussis
ccgcacauacaaggcgcggca

SEQ ID NO: 2342988 - RNA, 16 nt, Bordetella pertussis
ccgcacaucgucgacg

SEQ ID NO: 2342989 - RNA, 13 nt, Bordetella pertussis
ccgcaccagccug

SEQ ID NO: 2342990 - RNA, 13 nt, Bordetella pertussis
ccgcaccagcggc

SEQ ID NO: 2342991 - RNA, 19 nt, Bordetella pertussis
ccgcaccaggccgcggcgc

SEQ ID NO: 2342992 - RNA, 21 nt, Bordetella pertussis
ccgcaccaggccgcggcgccc

SEQ ID NO: 2342993 - RNA, 11 nt, Bordetella pertussis
ccgcaccaugc

SEQ ID NO: 2342994 - RNA, 23 nt, Bordetella pertussis
ccgcacccgguauccgcgcaugg

SEQ ID NO: 2342995 - RNA, 24 nt, Bordetella pertussis
ccgcaccgaccagcgcgcgccggc

SEQ ID NO: 2342996 - RNA, 12 nt, Bordetella pertussis
ccgcaccgacgg

SEQ ID NO: 2342997 - RNA, 17 nt, Bordetella pertussis
ccgcaccgacgggcuga

SEQ ID NO: 2342998 - RNA, 18 nt, Bordetella pertussis
ccgcaccgacgggcugau

SEQ ID NO: 2342999 - RNA, 13 nt, Bordetella pertussis
ccgcaccgcccgc

SEQ ID NO: 2343000 - RNA, 12 nt, Bordetella pertussis
ccgcaccggagg

SEQ ID NO: 2343001 - RNA, 15 nt, Bordetella pertussis
ccgcaccggaggcgc

SEQ ID NO: 2343002 - RNA, 15 nt, Bordetella pertussis
ccgcaccggcgugcg

SEQ ID NO: 2343003 - RNA, 19 nt, Bordetella pertussis
ccgcaccgggcaaucggcg

SEQ ID NO: 2343004 - RNA, 14 nt, Bordetella pertussis
ccgcaccgggcggc

SEQ ID NO: 2343005 - RNA, 16 nt, Bordetella pertussis
ccgcaccgggcggccc

SEQ ID NO: 2343006 - RNA, 17 nt, Bordetella pertussis
ccgcaccgggcggcccg

SEQ ID NO: 2343007 - RNA, 13 nt, Bordetella pertussis
ccgcaccugaaca

SEQ ID NO: 2343008 - RNA, 20 nt, Bordetella pertussis
ccgcaccugaacaccggcgc

SEQ ID NO: 2343009 - RNA, 18 nt, Bordetella pertussis
ccgcacgaagcggcaucg

SEQ ID NO: 2343010 - RNA, 16 nt, Bordetella pertussis
ccgcacgaucgcgccg

SEQ ID NO: 2343011 - RNA, 18 nt, Bordetella pertussis
ccgcacgaucgcgccggc

SEQ ID NO: 2343012 - RNA, 20 nt, Bordetella pertussis
ccgcacgaucgcgccggccu

SEQ ID NO: 2343013 - RNA, 13 nt, Bordetella pertussis
ccgcacgcagccc

SEQ ID NO: 2343014 - RNA, 23 nt, Bordetella pertussis
ccgcacgcagcccuucggagcca

SEQ ID NO: 2343015 - RNA, 13 nt, Bordetella pertussis
ccgcacgcccgcc

SEQ ID NO: 2343016 - RNA, 23 nt, Bordetella pertussis
ccgcacgcccgccugcagcagcg

SEQ ID NO: 2343017 - RNA, 14 nt, Bordetella pertussis
ccgcacgccgaccu

SEQ ID NO: 2343018 - RNA, 14 nt, Bordetella pertussis
ccgcacgccggccu

SEQ ID NO: 2343019 - RNA, 15 nt, Bordetella pertussis
ccgcacgccggccug

SEQ ID NO: 2343020 - RNA, 18 nt, Bordetella pertussis
ccgcacgccggccugcgc

SEQ ID NO: 2343021 - RNA, 13 nt, Bordetella pertussis
ccgcacgccgguc

SEQ ID NO: 2343022 - RNA, 23 nt, Bordetella pertussis
ccgcacgccggucgccagcgauc

SEQ ID NO: 2343023 - RNA, 13 nt, Bordetella pertussis
ccgcacgcgcggc

SEQ ID NO: 2343024 - RNA, 16 nt, Bordetella pertussis
ccgcacgcgcggcagc

SEQ ID NO: 2343025 - RNA, 15 nt, Bordetella pertussis
ccgcacgcggccgcg

SEQ ID NO: 2343026 - RNA, 16 nt, Bordetella pertussis
ccgcacgcggccgcgg

SEQ ID NO: 2343027 - RNA, 22 nt, Bordetella pertussis
ccgcacgcggccgcgggccgcu

SEQ ID NO: 2343028 - RNA, 20 nt, Bordetella pertussis
ccgcacgcucuacacggccg

SEQ ID NO: 2343029 - RNA, 21 nt, Bordetella pertussis
ccgcacgcucuacacggccgc

SEQ ID NO: 2343030 - RNA, 14 nt, Bordetella pertussis
ccgcacgggccgac

SEQ ID NO: 2343031 - RNA, 12 nt, Bordetella pertussis
ccgcacgggcgc

SEQ ID NO: 2343032 - RNA, 14 nt, Bordetella pertussis
ccgcacgggcgccu

SEQ ID NO: 2343033 - RNA, 21 nt, Bordetella pertussis
ccgcacgggcgccuguccccg

SEQ ID NO: 2343034 - RNA, 19 nt, Bordetella pertussis
ccgcacggggacuggcacc

SEQ ID NO: 2343035 - RNA, 22 nt, Bordetella pertussis
ccgcacggggacuggcaccggc

SEQ ID NO: 2343036 - RNA, 22 nt, Bordetella pertussis
ccgcacggggacuggcacgcgc

SEQ ID NO: 2343037 - RNA, 17 nt, Bordetella pertussis
ccgcacggggagcgacc

SEQ ID NO: 2343038 - RNA, 14 nt, Bordetella pertussis
ccgcacgguggcgc

SEQ ID NO: 2343039 - RNA, 21 nt, Bordetella pertussis
ccgcacgguggcgccgucgcg

SEQ ID NO: 2343040 - RNA, 15 nt, Bordetella pertussis
ccgcacuucgggcca

SEQ ID NO: 2343041 - RNA, 23 nt, Bordetella pertussis
ccgcacuucgggccacccgccgc

SEQ ID NO: 2343042 - RNA, 13 nt, Bordetella pertussis
ccgcagaacagca

SEQ ID NO: 2343043 - RNA, 15 nt, Bordetella pertussis
ccgcagaacagcagc

SEQ ID NO: 2343044 - RNA, 20 nt, Bordetella pertussis
ccgcagaagcagccgcgcgg

SEQ ID NO: 2343045 - RNA, 13 nt, Bordetella pertussis
ccgcagauggcca

SEQ ID NO: 2343046 - RNA, 14 nt, Bordetella pertussis
ccgcagauggccag

SEQ ID NO: 2343047 - RNA, 19 nt, Bordetella pertussis
ccgcagauuuccagcgcgu

SEQ ID NO: 2343048 - RNA, 20 nt, Bordetella pertussis
ccgcagcaauugccccagca

SEQ ID NO: 2343049 - RNA, 13 nt, Bordetella pertussis
ccgcagcaccaca

SEQ ID NO: 2343050 - RNA, 16 nt, Bordetella pertussis
ccgcagcaccucggcg

SEQ ID NO: 2343051 - RNA, 18 nt, Bordetella pertussis
ccgcagcaccucggcgug

SEQ ID NO: 2343052 - RNA, 23 nt, Bordetella pertussis
ccgcagcaccuugaccuggucgg

SEQ ID NO: 2343053 - RNA, 13 nt, Bordetella pertussis
ccgcagcaggcgc

SEQ ID NO: 2343054 - RNA, 14 nt, Bordetella pertussis
ccgcagcaggcgcu

SEQ ID NO: 2343055 - RNA, 23 nt, Bordetella pertussis
ccgcagcaguucggucagcgcgg

SEQ ID NO: 2343056 - RNA, 11 nt, Bordetella pertussis
ccgcagcaugg

SEQ ID NO: 2343057 - RNA, 14 nt, Bordetella pertussis
ccgcagcauggcgc

SEQ ID NO: 2343058 - RNA, 20 nt, Bordetella pertussis
ccgcagccgccagcgccugg

SEQ ID NO: 2343059 - RNA, 16 nt, Bordetella pertussis
ccgcagccggcugcaa

SEQ ID NO: 2343060 - RNA, 19 nt, Bordetella pertussis
ccgcagccggcugcaagac

SEQ ID NO: 2343061 - RNA, 22 nt, Bordetella pertussis
ccgcagccguugaucugguuca

SEQ ID NO: 2343062 - RNA, 21 nt, Bordetella pertussis
ccgcagcgagguggugacgau

SEQ ID NO: 2343063 - RNA, 16 nt, Bordetella pertussis
ccgcagcgcagcgcca

SEQ ID NO: 2343064 - RNA, 11 nt, Bordetella pertussis
ccgcagcgcca

SEQ ID NO: 2343065 - RNA, 19 nt, Bordetella pertussis
ccgcagcgcucgcacggca

SEQ ID NO: 2343066 - RNA, 13 nt, Bordetella pertussis
ccgcagcggcagc

SEQ ID NO: 2343067 - RNA, 14 nt, Bordetella pertussis
ccgcagcggcagcg

SEQ ID NO: 2343068 - RNA, 15 nt, Bordetella pertussis
ccgcagcggcagcgc

SEQ ID NO: 2343069 - RNA, 21 nt, Bordetella pertussis
ccgcagcggcagcgcaccguc

SEQ ID NO: 2343070 - RNA, 20 nt, Bordetella pertussis
ccgcagcgggcccgucgcgc

SEQ ID NO: 2343071 - RNA, 22 nt, Bordetella pertussis
ccgcagcgggcccgucgcgcca

SEQ ID NO: 2343072 - RNA, 13 nt, Bordetella pertussis
ccgcagcgucgcg

SEQ ID NO: 2343073 - RNA, 15 nt, Bordetella pertussis
ccgcagcgucgcggc

SEQ ID NO: 2343074 - RNA, 14 nt, Bordetella pertussis
ccgcagcguggcgu

SEQ ID NO: 2343075 - RNA, 23 nt, Bordetella pertussis
ccgcagcuggacuauggccugga

SEQ ID NO: 2343076 - RNA, 15 nt, Bordetella pertussis
ccgcaggagcaugcc

SEQ ID NO: 2343077 - RNA, 16 nt, Bordetella pertussis
ccgcaggagcaugccc

SEQ ID NO: 2343078 - RNA, 17 nt, Bordetella pertussis
ccgcaggagcaugcccu

SEQ ID NO: 2343079 - RNA, 16 nt, Bordetella pertussis
ccgcaggcauugcgcc

SEQ ID NO: 2343080 - RNA, 14 nt, Bordetella pertussis
ccgcaggccguugg

SEQ ID NO: 2343081 - RNA, 22 nt, Bordetella pertussis
ccgcaggccguuggccgcgcgg

SEQ ID NO: 2343082 - RNA, 18 nt, Bordetella pertussis
ccgcaggcggcggccucc

SEQ ID NO: 2343083 - RNA, 15 nt, Bordetella pertussis
ccgcaggcggcuggu

SEQ ID NO: 2343084 - RNA, 15 nt, Bordetella pertussis
ccgcagggacaggca

SEQ ID NO: 2343085 - RNA, 19 nt, Bordetella pertussis
ccgcagggcccgcaucggc

SEQ ID NO: 2343086 - RNA, 14 nt, Bordetella pertussis
ccgcagggcgugcg

SEQ ID NO: 2343087 - RNA, 22 nt, Bordetella pertussis
ccgcaggggauugccgcgcggu

SEQ ID NO: 2343088 - RNA, 14 nt, Bordetella pertussis
ccgcagguccaggc

SEQ ID NO: 2343089 - RNA, 16 nt, Bordetella pertussis
ccgcaggugccugucc

SEQ ID NO: 2343090 - RNA, 20 nt, Bordetella pertussis
ccgcagguggggcagcaggc

SEQ ID NO: 2343091 - RNA, 18 nt, Bordetella pertussis
ccgcaguauuccugcugg

SEQ ID NO: 2343092 - RNA, 14 nt, Bordetella pertussis
ccgcagugcgcgcg

SEQ ID NO: 2343093 - RNA, 15 nt, Bordetella pertussis
ccgcaguuccaggca

SEQ ID NO: 2343094 - RNA, 14 nt, Bordetella pertussis
ccgcaguugaacac

SEQ ID NO: 2343095 - RNA, 21 nt, Bordetella pertussis
ccgcauaccuuggcgcccagc

SEQ ID NO: 2343096 - RNA, 17 nt, Bordetella pertussis
ccgcauagacgccgacc

SEQ ID NO: 2343097 - RNA, 22 nt, Bordetella pertussis
ccgcauagcgcaugaugcugcc

SEQ ID NO: 2343098 - RNA, 13 nt, Bordetella pertussis
ccgcaucaccgau

SEQ ID NO: 2343099 - RNA, 16 nt, Bordetella pertussis
ccgcaucccgcccccg

SEQ ID NO: 2343100 - RNA, 16 nt, Bordetella pertussis
ccgcauccgacuccca

SEQ ID NO: 2343101 - RNA, 22 nt, Bordetella pertussis
ccgcaucgcgcaagggccaguc

SEQ ID NO: 2343102 - RNA, 17 nt, Bordetella pertussis
ccgcaucgcgcagcgug

SEQ ID NO: 2343103 - RNA, 18 nt, Bordetella pertussis
ccgcaucgcgcagcgugc

SEQ ID NO: 2343104 - RNA, 12 nt, Bordetella pertussis
ccgcaucgcgcg

SEQ ID NO: 2343105 - RNA, 14 nt, Bordetella pertussis
ccgcaucgcgcgcc

SEQ ID NO: 2343106 - RNA, 16 nt, Bordetella pertussis
ccgcaucgcgcgccgc

SEQ ID NO: 2343107 - RNA, 21 nt, Bordetella pertussis
ccgcaucgcgcgccgccgccc

SEQ ID NO: 2343108 - RNA, 19 nt, Bordetella pertussis
ccgcaucggcguaccaggc

SEQ ID NO: 2343109 - RNA, 13 nt, Bordetella pertussis
ccgcaucugcggg

SEQ ID NO: 2343110 - RNA, 13 nt, Bordetella pertussis
ccgcaugccggcg

SEQ ID NO: 2343111 - RNA, 13 nt, Bordetella pertussis
ccgcaugcgcaga

SEQ ID NO: 2343112 - RNA, 13 nt, Bordetella pertussis
ccgcaugcggcac

SEQ ID NO: 2343113 - RNA, 15 nt, Bordetella pertussis
ccgcaugcggcggcu

SEQ ID NO: 2343114 - RNA, 22 nt, Bordetella pertussis
ccgcaugcgugaagcccauggc

SEQ ID NO: 2343115 - RNA, 17 nt, Bordetella pertussis
ccgcaugcugcagcugc

SEQ ID NO: 2343116 - RNA, 21 nt, Bordetella pertussis
ccgcauggaccgccgccgucg

SEQ ID NO: 2343117 - RNA, 16 nt, Bordetella pertussis
ccgcauggagaccggc

SEQ ID NO: 2343118 - RNA, 18 nt, Bordetella pertussis
ccgcauggagaccggcgc

SEQ ID NO: 2343119 - RNA, 15 nt, Bordetella pertussis
ccgcaugggccaggc

SEQ ID NO: 2343120 - RNA, 15 nt, Bordetella pertussis
ccgcaugggcgcgcc

SEQ ID NO: 2343121 - RNA, 16 nt, Bordetella pertussis
ccgcaugggcgcgccc

SEQ ID NO: 2343122 - RNA, 18 nt, Bordetella pertussis
ccgcaugggcgcgcccgg

SEQ ID NO: 2343123 - RNA, 16 nt, Bordetella pertussis
ccgcauggggacuggc

SEQ ID NO: 2343124 - RNA, 22 nt, Bordetella pertussis
ccgcauggggacuggcgccugc

SEQ ID NO: 2343125 - RNA, 15 nt, Bordetella pertussis
ccgcauggggcgagg

SEQ ID NO: 2343126 - RNA, 15 nt, Bordetella pertussis
ccgcaugggggcugg

SEQ ID NO: 2343127 - RNA, 14 nt, Bordetella pertussis
ccgcaugguggcgc

SEQ ID NO: 2343128 - RNA, 17 nt, Bordetella pertussis
ccgcaugguggcgcagg

SEQ ID NO: 2343129 - RNA, 14 nt, Bordetella pertussis
ccgcaugucccagc

SEQ ID NO: 2343130 - RNA, 15 nt, Bordetella pertussis
ccgcaugucccagcg

SEQ ID NO: 2343131 - RNA, 20 nt, Bordetella pertussis
ccgcauugaucgaucagcca

SEQ ID NO: 2343132 - RNA, 19 nt, Bordetella pertussis
ccgcauuuccucgaccagc

SEQ ID NO: 2343133 - RNA, 23 nt, Bordetella pertussis
ccgcauuuccucgaccagcgcgc

SEQ ID NO: 2343134 - RNA, 22 nt, Bordetella pertussis
ccgccaacacgauccacggccg

SEQ ID NO: 2343135 - RNA, 18 nt, Bordetella pertussis
ccgccaacgccaagcugc

SEQ ID NO: 2343136 - RNA, 15 nt, Bordetella pertussis
ccgccaacgcggcgc

SEQ ID NO: 2343137 - RNA, 20 nt, Bordetella pertussis
ccgccaagcagaccuaccag

SEQ ID NO: 2343138 - RNA, 19 nt, Bordetella pertussis
ccgccaagggcgcgccagc

SEQ ID NO: 2343139 - RNA, 21 nt, Bordetella pertussis
ccgccaauugcuugccugucc

SEQ ID NO: 2343140 - RNA, 18 nt, Bordetella pertussis
ccgccacacgaggaccgc

SEQ ID NO: 2343141 - RNA, 19 nt, Bordetella pertussis
ccgccacagauuggccacc

SEQ ID NO: 2343142 - RNA, 22 nt, Bordetella pertussis
ccgccacagauuggccaccagg

SEQ ID NO: 2343143 - RNA, 14 nt, Bordetella pertussis
ccgccacagcgccg

SEQ ID NO: 2343144 - RNA, 13 nt, Bordetella pertussis
ccgccacaggcug

SEQ ID NO: 2343145 - RNA, 16 nt, Bordetella pertussis
ccgccacaggcugacg

SEQ ID NO: 2343146 - RNA, 20 nt, Bordetella pertussis
ccgccaccaccucggccucg

SEQ ID NO: 2343147 - RNA, 12 nt, Bordetella pertussis
ccgccaccacgg

SEQ ID NO: 2343148 - RNA, 15 nt, Bordetella pertussis
ccgccaccacggcgc

SEQ ID NO: 2343149 - RNA, 15 nt, Bordetella pertussis
ccgccaccagcgcgu

SEQ ID NO: 2343150 - RNA, 14 nt, Bordetella pertussis
ccgccaccagcggc

SEQ ID NO: 2343151 - RNA, 19 nt, Bordetella pertussis
ccgccaccagggcgcccgc

SEQ ID NO: 2343152 - RNA, 22 nt, Bordetella pertussis
ccgccaccagggcgcccgccga

SEQ ID NO: 2343153 - RNA, 14 nt, Bordetella pertussis
ccgccacccaggcg

SEQ ID NO: 2343154 - RNA, 21 nt, Bordetella pertussis
ccgccacccaggcggcaggcg

SEQ ID NO: 2343155 - RNA, 14 nt, Bordetella pertussis
ccgccacccagggc

SEQ ID NO: 2343156 - RNA, 15 nt, Bordetella pertussis
ccgccacccagggcu

SEQ ID NO: 2343157 - RNA, 16 nt, Bordetella pertussis
ccgccacccagggcuu

SEQ ID NO: 2343158 - RNA, 16 nt, Bordetella pertussis
ccgccacccuggcacg

SEQ ID NO: 2343159 - RNA, 21 nt, Bordetella pertussis
ccgccaccgcccccgccgcca

SEQ ID NO: 2343160 - RNA, 12 nt, Bordetella pertussis
ccgccaccgcgc

SEQ ID NO: 2343161 - RNA, 21 nt, Bordetella pertussis
ccgccaccguggcguccaugc

SEQ ID NO: 2343162 - RNA, 16 nt, Bordetella pertussis
ccgccaccucggcguc

SEQ ID NO: 2343163 - RNA, 19 nt, Bordetella pertussis
ccgccaccugggccgccug

SEQ ID NO: 2343164 - RNA, 20 nt, Bordetella pertussis
ccgccaccugggccgccugc

SEQ ID NO: 2343165 - RNA, 23 nt, Bordetella pertussis
ccgccaccugggccgccugcugg

SEQ ID NO: 2343166 - RNA, 19 nt, Bordetella pertussis
ccgccacgaaacccacggc

SEQ ID NO: 2343167 - RNA, 21 nt, Bordetella pertussis
ccgccacgaaacccacggcga

SEQ ID NO: 2343168 - RNA, 22 nt, Bordetella pertussis
ccgccacgaaacccacggcgau

SEQ ID NO: 2343169 - RNA, 15 nt, Bordetella pertussis
ccgccacgcccuggc

SEQ ID NO: 2343170 - RNA, 13 nt, Bordetella pertussis
ccgccacgccggc

SEQ ID NO: 2343171 - RNA, 15 nt, Bordetella pertussis
ccgccacgccggcca

SEQ ID NO: 2343172 - RNA, 11 nt, Bordetella pertussis
ccgccacgccu

SEQ ID NO: 2343173 - RNA, 23 nt, Bordetella pertussis
ccgccacgccuuguucgcgcgcg

SEQ ID NO: 2343174 - RNA, 16 nt, Bordetella pertussis
ccgccacgcgcacggc

SEQ ID NO: 2343175 - RNA, 18 nt, Bordetella pertussis
ccgccacgcgguccagcc

SEQ ID NO: 2343176 - RNA, 12 nt, Bordetella pertussis
ccgccacgcugg

SEQ ID NO: 2343177 - RNA, 17 nt, Bordetella pertussis
ccgccacgcuggccgcg

SEQ ID NO: 2343178 - RNA, 19 nt, Bordetella pertussis
ccgccacgcuggccgcgcu

SEQ ID NO: 2343179 - RNA, 18 nt, Bordetella pertussis
ccgccacggcgcccgagg

SEQ ID NO: 2343180 - RNA, 20 nt, Bordetella pertussis
ccgccacggcgcccgaggcc

SEQ ID NO: 2343181 - RNA, 18 nt, Bordetella pertussis
ccgccacgggcccgcgca

SEQ ID NO: 2343182 - RNA, 12 nt, Bordetella pertussis
ccgccacggucg

SEQ ID NO: 2343183 - RNA, 22 nt, Bordetella pertussis
ccgccacggucgcgagcugcgc

SEQ ID NO: 2343184 - RNA, 16 nt, Bordetella pertussis
ccgccacgucauaggc

SEQ ID NO: 2343185 - RNA, 14 nt, Bordetella pertussis
ccgccacgucgccg

SEQ ID NO: 2343186 - RNA, 15 nt, Bordetella pertussis
ccgccacgugcacga

SEQ ID NO: 2343187 - RNA, 14 nt, Bordetella pertussis
ccgccacgugcugc

SEQ ID NO: 2343188 - RNA, 20 nt, Bordetella pertussis
ccgccacgugcugcuggaga

SEQ ID NO: 2343189 - RNA, 17 nt, Bordetella pertussis
ccgccacuugcggcagg

SEQ ID NO: 2343190 - RNA, 13 nt, Bordetella pertussis
ccgccagaucguu

SEQ ID NO: 2343191 - RNA, 20 nt, Bordetella pertussis
ccgccagaucguugaucucg

SEQ ID NO: 2343192 - RNA, 17 nt, Bordetella pertussis
ccgccagcaaggcggca

SEQ ID NO: 2343193 - RNA, 23 nt, Bordetella pertussis
ccgccagcaaggcgucggccagg

SEQ ID NO: 2343194 - RNA, 20 nt, Bordetella pertussis
ccgccagcaccugcuugacg

SEQ ID NO: 2343195 - RNA, 14 nt, Bordetella pertussis
ccgccagcacgcca

SEQ ID NO: 2343196 - RNA, 13 nt, Bordetella pertussis
ccgccagcagcgc

SEQ ID NO: 2343197 - RNA, 23 nt, Bordetella pertussis
ccgccagcagcucggcgaccagg

SEQ ID NO: 2343198 - RNA, 13 nt, Bordetella pertussis
ccgccagcaggcc

SEQ ID NO: 2343199 - RNA, 15 nt, Bordetella pertussis
ccgccagcaggcgcu

SEQ ID NO: 2343200 - RNA, 22 nt, Bordetella pertussis
ccgccagccaccccgucaucgc

SEQ ID NO: 2343201 - RNA, 17 nt, Bordetella pertussis
ccgccagcccgaggcac

SEQ ID NO: 2343202 - RNA, 13 nt, Bordetella pertussis
ccgccagccgcug

SEQ ID NO: 2343203 - RNA, 12 nt, Bordetella pertussis
ccgccagccggc

SEQ ID NO: 2343204 - RNA, 13 nt, Bordetella pertussis
ccgccagccggcc

SEQ ID NO: 2343205 - RNA, 15 nt, Bordetella pertussis
ccgccagccggccca

SEQ ID NO: 2343206 - RNA, 22 nt, Bordetella pertussis
ccgccagccggcccagcacgcc

SEQ ID NO: 2343207 - RNA, 17 nt, Bordetella pertussis
ccgccagcgccuggacc

SEQ ID NO: 2343208 - RNA, 12 nt, Bordetella pertussis
ccgccagcgcgc

SEQ ID NO: 2343209 - RNA, 14 nt, Bordetella pertussis
ccgccagcgcgccg

SEQ ID NO: 2343210 - RNA, 15 nt, Bordetella pertussis
ccgccagcgcgccgc

SEQ ID NO: 2343211 - RNA, 15 nt, Bordetella pertussis
ccgccagcgcgcgcg

SEQ ID NO: 2343212 - RNA, 16 nt, Bordetella pertussis
ccgccagcgcgcgcga

SEQ ID NO: 2343213 - RNA, 20 nt, Bordetella pertussis
ccgccagcgcgcgcgaggcg

SEQ ID NO: 2343214 - RNA, 13 nt, Bordetella pertussis
ccgccagcggcug

SEQ ID NO: 2343215 - RNA, 14 nt, Bordetella pertussis
ccgccagcgggagc

SEQ ID NO: 2343216 - RNA, 20 nt, Bordetella pertussis
ccgccagcguaucgccgccg

SEQ ID NO: 2343217 - RNA, 13 nt, Bordetella pertussis
ccgccagcucggc

SEQ ID NO: 2343218 - RNA, 16 nt, Bordetella pertussis
ccgccagcucggccug

SEQ ID NO: 2343219 - RNA, 18 nt, Bordetella pertussis
ccgccaggaaaagccgcc

SEQ ID NO: 2343220 - RNA, 20 nt, Bordetella pertussis
ccgccaggaagcgggccugc

SEQ ID NO: 2343221 - RNA, 13 nt, Bordetella pertussis
ccgccaggccagg

SEQ ID NO: 2343222 - RNA, 16 nt, Bordetella pertussis
ccgccaggccagguag

SEQ ID NO: 2343223 - RNA, 14 nt, Bordetella pertussis
ccgccaggccgucg

SEQ ID NO: 2343224 - RNA, 15 nt, Bordetella pertussis
ccgccaggccgucga

SEQ ID NO: 2343225 - RNA, 14 nt, Bordetella pertussis
ccgccagggccaug

SEQ ID NO: 2343226 - RNA, 20 nt, Bordetella pertussis
ccgccagggccauguggcgc

SEQ ID NO: 2343227 - RNA, 22 nt, Bordetella pertussis
ccgccagggccauguggcgcag

SEQ ID NO: 2343228 - RNA, 14 nt, Bordetella pertussis
ccgccagggccgag

SEQ ID NO: 2343229 - RNA, 16 nt, Bordetella pertussis
ccgccagggcggggcc

SEQ ID NO: 2343230 - RNA, 22 nt, Bordetella pertussis
ccgccagggcguuuuccagcau

SEQ ID NO: 2343231 - RNA, 19 nt, Bordetella pertussis
ccgccaggucggccaccgc

SEQ ID NO: 2343232 - RNA, 18 nt, Bordetella pertussis
ccgccagguucgccuggc

SEQ ID NO: 2343233 - RNA, 19 nt, Bordetella pertussis
ccgccagguucgccuggcg

SEQ ID NO: 2343234 - RNA, 17 nt, Bordetella pertussis
ccgccaguucgucgucg

SEQ ID NO: 2343235 - RNA, 15 nt, Bordetella pertussis
ccgccauaggcgcgc

SEQ ID NO: 2343236 - RNA, 18 nt, Bordetella pertussis
ccgccauaggcgcgcacc

SEQ ID NO: 2343237 - RNA, 21 nt, Bordetella pertussis
ccgccauaggcgcgcaccagc

SEQ ID NO: 2343238 - RNA, 13 nt, Bordetella pertussis
ccgccauaugcgc

SEQ ID NO: 2343239 - RNA, 23 nt, Bordetella pertussis
ccgccaucauccuggucgacgcg

SEQ ID NO: 2343240 - RNA, 13 nt, Bordetella pertussis
ccgccaucauggc

SEQ ID NO: 2343241 - RNA, 18 nt, Bordetella pertussis
ccgccaucauggcgucgg

SEQ ID NO: 2343242 - RNA, 19 nt, Bordetella pertussis
ccgccaucauggcgucggc

SEQ ID NO: 2343243 - RNA, 21 nt, Bordetella pertussis
ccgccaucauggcgucggcca

SEQ ID NO: 2343244 - RNA, 15 nt, Bordetella pertussis
ccgccauccuggccg

SEQ ID NO: 2343245 - RNA, 19 nt, Bordetella pertussis
ccgccauccuggccgccgc

SEQ ID NO: 2343246 - RNA, 21 nt, Bordetella pertussis
ccgccauccuggccgccgcgg

SEQ ID NO: 2343247 - RNA, 14 nt, Bordetella pertussis
ccgccaucgcgcau

SEQ ID NO: 2343248 - RNA, 19 nt, Bordetella pertussis
ccgccaucgucguagcgcc

SEQ ID NO: 2343249 - RNA, 23 nt, Bordetella pertussis
ccgccaucgucguagcgccagcg

SEQ ID NO: 2343250 - RNA, 16 nt, Bordetella pertussis
ccgccaugcagcugga

SEQ ID NO: 2343251 - RNA, 14 nt, Bordetella pertussis
ccgccaugcgcagg

SEQ ID NO: 2343252 - RNA, 16 nt, Bordetella pertussis
ccgccaugcgcauggc

SEQ ID NO: 2343253 - RNA, 15 nt, Bordetella pertussis
ccgccaugcgccagc

SEQ ID NO: 2343254 - RNA, 19 nt, Bordetella pertussis
ccgccaugcgccagcagga

SEQ ID NO: 2343255 - RNA, 16 nt, Bordetella pertussis
ccgccaugcggcgcca

SEQ ID NO: 2343256 - RNA, 14 nt, Bordetella pertussis
ccgccauggaggcg

SEQ ID NO: 2343257 - RNA, 23 nt, Bordetella pertussis
ccgccauggaggcgcagcgcggc

SEQ ID NO: 2343258 - RNA, 16 nt, Bordetella pertussis
ccgccauggccggcgu

SEQ ID NO: 2343259 - RNA, 21 nt, Bordetella pertussis
ccgccauggccggcguugccg

SEQ ID NO: 2343260 - RNA, 13 nt, Bordetella pertussis
ccgccauggcgcu

SEQ ID NO: 2343261 - RNA, 23 nt, Bordetella pertussis
ccgccauggcgcuggcaggcgcc

SEQ ID NO: 2343262 - RNA, 17 nt, Bordetella pertussis
ccgccauggcggccgcc

SEQ ID NO: 2343263 - RNA, 15 nt, Bordetella pertussis
ccgccauggcggcgc

SEQ ID NO: 2343264 - RNA, 14 nt, Bordetella pertussis
ccgccauggucgcg

SEQ ID NO: 2343265 - RNA, 22 nt, Bordetella pertussis
ccgccauggugccgcgcaggcc

SEQ ID NO: 2343266 - RNA, 23 nt, Bordetella pertussis
ccgccauggugccgcgcaggccc

SEQ ID NO: 2343267 - RNA, 20 nt, Bordetella pertussis
ccgccauguauaacguggcg

SEQ ID NO: 2343268 - RNA, 22 nt, Bordetella pertussis
ccgccauguauaacguggcgcg

SEQ ID NO: 2343269 - RNA, 23 nt, Bordetella pertussis
ccgccauguauaacguggcgcgc

SEQ ID NO: 2343270 - RNA, 20 nt, Bordetella pertussis
ccgccaugugcgccgcgccg

SEQ ID NO: 2343271 - RNA, 15 nt, Bordetella pertussis
ccgccauugcacgcg

SEQ ID NO: 2343272 - RNA, 19 nt, Bordetella pertussis
ccgccauugcacgcgcagg

SEQ ID NO: 2343273 - RNA, 15 nt, Bordetella pertussis
ccgcccacauggcgg

SEQ ID NO: 2343274 - RNA, 19 nt, Bordetella pertussis
ccgcccacauggcggcgaa

SEQ ID NO: 2343275 - RNA, 14 nt, Bordetella pertussis
ccgcccaccaccag

SEQ ID NO: 2343276 - RNA, 13 nt, Bordetella pertussis
ccgcccaccguga

SEQ ID NO: 2343277 - RNA, 14 nt, Bordetella pertussis
ccgcccaccgugac

SEQ ID NO: 2343278 - RNA, 12 nt, Bordetella pertussis
ccgcccacgcca

SEQ ID NO: 2343279 - RNA, 13 nt, Bordetella pertussis
ccgcccacgccgc

SEQ ID NO: 2343280 - RNA, 16 nt, Bordetella pertussis
ccgcccagaaugcggc

SEQ ID NO: 2343281 - RNA, 11 nt, Bordetella pertussis
ccgcccagcau

SEQ ID NO: 2343282 - RNA, 15 nt, Bordetella pertussis
ccgcccagcaugcgc

SEQ ID NO: 2343283 - RNA, 19 nt, Bordetella pertussis
ccgcccagcauuucgcgug

SEQ ID NO: 2343284 - RNA, 14 nt, Bordetella pertussis
ccgcccagccaggc

SEQ ID NO: 2343285 - RNA, 16 nt, Bordetella pertussis
ccgcccagccaggcgc

SEQ ID NO: 2343286 - RNA, 16 nt, Bordetella pertussis
ccgcccagccgcgcca

SEQ ID NO: 2343287 - RNA, 15 nt, Bordetella pertussis
ccgcccagcgccugc

SEQ ID NO: 2343288 - RNA, 21 nt, Bordetella pertussis
ccgcccagcgcgugggccagc

SEQ ID NO: 2343289 - RNA, 11 nt, Bordetella pertussis
ccgcccaggcg

SEQ ID NO: 2343290 - RNA, 15 nt, Bordetella pertussis
ccgcccaggcgcagc

SEQ ID NO: 2343291 - RNA, 16 nt, Bordetella pertussis
ccgcccaggcgcagcc

SEQ ID NO: 2343292 - RNA, 22 nt, Bordetella pertussis
ccgcccaggcgcagccgcgcgc

SEQ ID NO: 2343293 - RNA, 19 nt, Bordetella pertussis
ccgcccaggucggacgcgc

SEQ ID NO: 2343294 - RNA, 22 nt, Bordetella pertussis
ccgcccaggugcgggagccggc

SEQ ID NO: 2343295 - RNA, 19 nt, Bordetella pertussis
ccgcccagucguccagcac

SEQ ID NO: 2343296 - RNA, 13 nt, Bordetella pertussis
ccgcccaugccgc

SEQ ID NO: 2343297 - RNA, 18 nt, Bordetella pertussis
ccgcccaugccgcccaug

SEQ ID NO: 2343298 - RNA, 23 nt, Bordetella pertussis
ccgcccaugccgcccaugccgcc

SEQ ID NO: 2343299 - RNA, 18 nt, Bordetella pertussis
ccgcccaugccgccgggc

SEQ ID NO: 2343300 - RNA, 14 nt, Bordetella pertussis
ccgccccagcagca

SEQ ID NO: 2343301 - RNA, 15 nt, Bordetella pertussis
ccgccccagcagcag

SEQ ID NO: 2343302 - RNA, 16 nt, Bordetella pertussis
ccgccccagcagcagc

SEQ ID NO: 2343303 - RNA, 12 nt, Bordetella pertussis
ccgccccaggcg

SEQ ID NO: 2343304 - RNA, 22 nt, Bordetella pertussis
ccgcccccagcgcgccugccca

SEQ ID NO: 2343305 - RNA, 15 nt, Bordetella pertussis
ccgcccccgacgcca

SEQ ID NO: 2343306 - RNA, 14 nt, Bordetella pertussis
ccgcccccgcccag

SEQ ID NO: 2343307 - RNA, 15 nt, Bordetella pertussis
ccgcccccgcccagc

SEQ ID NO: 2343308 - RNA, 14 nt, Bordetella pertussis
ccgcccccgccgca

SEQ ID NO: 2343309 - RNA, 12 nt, Bordetella pertussis
ccgccccgaccc

SEQ ID NO: 2343310 - RNA, 14 nt, Bordetella pertussis
ccgccccggcgcgg

SEQ ID NO: 2343311 - RNA, 15 nt, Bordetella pertussis
ccgccccggcgcggc

SEQ ID NO: 2343312 - RNA, 17 nt, Bordetella pertussis
ccgccccggcgcggcgc

SEQ ID NO: 2343313 - RNA, 21 nt, Bordetella pertussis
ccgccccggcgcggcgcgcgc

SEQ ID NO: 2343314 - RNA, 21 nt, Bordetella pertussis
ccgccccgggcaggagcgccg

SEQ ID NO: 2343315 - RNA, 15 nt, Bordetella pertussis
ccgccccgugcacca

SEQ ID NO: 2343316 - RNA, 20 nt, Bordetella pertussis
ccgcccgaaagguccuggag

SEQ ID NO: 2343317 - RNA, 15 nt, Bordetella pertussis
ccgcccgacagcacg

SEQ ID NO: 2343318 - RNA, 14 nt, Bordetella pertussis
ccgcgagcaugcgc

SEQ ID NO: 2343319 - RNA, 17 nt, Bordetella pertussis
ccgcgagcaugcgcagc

SEQ ID NO: 2343320 - RNA, 21 nt, Bordetella pertussis
ccgcgagcggccagccugccg

SEQ ID NO: 2343321 - RNA, 15 nt, Bordetella pertussis
ccgcgaggcgcaggc

SEQ ID NO: 2343322 - RNA, 17 nt, Bordetella pertussis
ccgcgaggcgcaggccg

SEQ ID NO: 2343323 - RNA, 20 nt, Bordetella pertussis
ccgcgaggcgcaggccgacg

SEQ ID NO: 2343324 - RNA, 22 nt, Bordetella pertussis
ccgcgaggcgcaggccgacgcg

SEQ ID NO: 2343325 - RNA, 16 nt, Bordetella pertussis
ccgcgaggggcccuug

SEQ ID NO: 2343326 - RNA, 16 nt, Bordetella pertussis
ccgcgauauccuugcg

SEQ ID NO: 2343327 - RNA, 22 nt, Bordetella pertussis
ccgcgauauccuugcgcucgcc

SEQ ID NO: 2343328 - RNA, 22 nt, Bordetella pertussis
ccgcgauauugaaggccgaggc

SEQ ID NO: 2343329 - RNA, 18 nt, Bordetella pertussis
ccgcgaucagcgcggccg

SEQ ID NO: 2343330 - RNA, 22 nt, Bordetella pertussis
ccgcgaugcacggaacgugccg

SEQ ID NO: 2343331 - RNA, 14 nt, Bordetella pertussis
ccgcgauggcgccg

SEQ ID NO: 2343332 - RNA, 12 nt, Bordetella pertussis
ccgcgaugucgc

SEQ ID NO: 2343333 - RNA, 13 nt, Bordetella pertussis
ccgcgaugucgcg

SEQ ID NO: 2343334 - RNA, 15 nt, Bordetella pertussis
ccgcgaugucgcgcg

SEQ ID NO: 2343335 - RNA, 16 nt, Bordetella pertussis
ccgcgaugucgcgcgc

SEQ ID NO: 2343336 - RNA, 17 nt, Bordetella pertussis
ccgcgaugucgcgcgcg

SEQ ID NO: 2343337 - RNA, 15 nt, Bordetella pertussis
ccgcgauugcaggug

SEQ ID NO: 2343338 - RNA, 20 nt, Bordetella pertussis
ccgcgauugcagguggccag

SEQ ID NO: 2343339 - RNA, 21 nt, Bordetella pertussis
ccgcgcaaggccugcucgggc

SEQ ID NO: 2343340 - RNA, 14 nt, Bordetella pertussis
ccgcgcaaggcggc

SEQ ID NO: 2343341 - RNA, 19 nt, Bordetella pertussis
ccgcgcaaggcggcccggc

SEQ ID NO: 2343342 - RNA, 15 nt, Bordetella pertussis
ccgcgcacacauggc

SEQ ID NO: 2343343 - RNA, 18 nt, Bordetella pertussis
ccgcgcacacauggcgca

SEQ ID NO: 2343344 - RNA, 14 nt, Bordetella pertussis
ccgcgcacagcgcg

SEQ ID NO: 2343345 - RNA, 17 nt, Bordetella pertussis
ccgcgcacagcgcggcg

SEQ ID NO: 2343346 - RNA, 12 nt, Bordetella pertussis
ccgcgcaccagg

SEQ ID NO: 2343347 - RNA, 16 nt, Bordetella pertussis
ccgcgcacccaggccc

SEQ ID NO: 2343348 - RNA, 19 nt, Bordetella pertussis
ccgcgcaccugcugcggca

SEQ ID NO: 2343349 - RNA, 20 nt, Bordetella pertussis
ccgcgcaccugcugcggcac

SEQ ID NO: 2343350 - RNA, 18 nt, Bordetella pertussis
ccgcgcaccugggcgucg

SEQ ID NO: 2343351 - RNA, 19 nt, Bordetella pertussis
ccgcgcacgauggggcagc

SEQ ID NO: 2343352 - RNA, 21 nt, Bordetella pertussis
ccgcgcacgauggggcagcca

SEQ ID NO: 2343353 - RNA, 24 nt, Bordetella pertussis
ccgcgcacgauggggcagccaucc

SEQ ID NO: 2343354 - RNA, 23 nt, Bordetella pertussis
ccgcgcacgcacugagcuucgcc

SEQ ID NO: 2343355 - RNA, 14 nt, Bordetella pertussis
ccgcgcacgcccgc

SEQ ID NO: 2343356 - RNA, 19 nt, Bordetella pertussis
ccgcgcacgggcgccuguc

SEQ ID NO: 2343357 - RNA, 20 nt, Bordetella pertussis
ccgcgcacgggcgccugucc

SEQ ID NO: 2343358 - RNA, 23 nt, Bordetella pertussis
ccgcgcacgggcgccuguccccg

SEQ ID NO: 2343359 - RNA, 17 nt, Bordetella pertussis
ccgcgcagaaaccgcca

SEQ ID NO: 2343360 - RNA, 18 nt, Bordetella pertussis
ccgcgcagaaaccgccac

SEQ ID NO: 2343361 - RNA, 20 nt, Bordetella pertussis
ccgcgcagaaaccgccacag

SEQ ID NO: 2343362 - RNA, 17 nt, Bordetella pertussis
ccgcgcagcacgcccgc

SEQ ID NO: 2343363 - RNA, 14 nt, Bordetella pertussis
ccgcgcagcagcaa

SEQ ID NO: 2343364 - RNA, 12 nt, Bordetella pertussis
ccgcgcagcccg

SEQ ID NO: 2343365 - RNA, 13 nt, Bordetella pertussis
ccgcgcagcccgg

SEQ ID NO: 2343366 - RNA, 14 nt, Bordetella pertussis
ccgcgcagcccggc

SEQ ID NO: 2343367 - RNA, 15 nt, Bordetella pertussis
ccgcgcagccgacag

SEQ ID NO: 2343368 - RNA, 16 nt, Bordetella pertussis
ccgcgcagccgacagg

SEQ ID NO: 2343369 - RNA, 20 nt, Bordetella pertussis
ccgcgcagccgacaggcgcg

SEQ ID NO: 2343370 - RNA, 21 nt, Bordetella pertussis
ccgcgcagccgcuucacgcug

SEQ ID NO: 2343371 - RNA, 17 nt, Bordetella pertussis
ccgcgcaggaugacgug

SEQ ID NO: 2343372 - RNA, 19 nt, Bordetella pertussis
ccgcgcaggauuucaucgc

SEQ ID NO: 2343373 - RNA, 12 nt, Bordetella pertussis
ccgcgcagggca

SEQ ID NO: 2343374 - RNA, 23 nt, Bordetella pertussis
ccgcgcaucgaucaggcugucgc

SEQ ID NO: 2343375 - RNA, 22 nt, Bordetella pertussis
ccgcgcaugcaagacaggccgc

SEQ ID NO: 2343376 - RNA, 23 nt, Bordetella pertussis
ccgcgcaugcaagacaggccgcu

SEQ ID NO: 2343377 - RNA, 23 nt, Bordetella pertussis
ccgcgcaugccagcuugcaggcg

SEQ ID NO: 2343378 - RNA, 24 nt, Bordetella pertussis
ccgcgcauggacugcaggcgcugc

SEQ ID NO: 2343379 - RNA, 22 nt, Bordetella pertussis
ccgcgccaacccggccucagcg

SEQ ID NO: 2343380 - RNA, 14 nt, Bordetella pertussis
ccgcgccaagggcg

SEQ ID NO: 2343381 - RNA, 18 nt, Bordetella pertussis
ccgcgccaagggcgugcg

SEQ ID NO: 2343382 - RNA, 21 nt, Bordetella pertussis
ccgcgccaagggcgugcgcuu

SEQ ID NO: 2343383 - RNA, 17 nt, Bordetella pertussis
ccgcgccacacgggcgc

SEQ ID NO: 2343384 - RNA, 13 nt, Bordetella pertussis
ccgcgccaccacc

SEQ ID NO: 2343385 - RNA, 11 nt, Bordetella pertussis
ccgcgccagcg

SEQ ID NO: 2343386 - RNA, 13 nt, Bordetella pertussis
ccgcgccagcgcc

SEQ ID NO: 2343387 - RNA, 20 nt, Bordetella pertussis
ccgcgccagcgccacgcccu

SEQ ID NO: 2343388 - RNA, 15 nt, Bordetella pertussis
ccgcgccagcgccgg

SEQ ID NO: 2343389 - RNA, 16 nt, Bordetella pertussis
ccgcgccagcgccucc

SEQ ID NO: 2343390 - RNA, 18 nt, Bordetella pertussis
ccgcgccagcugcgcagc

SEQ ID NO: 2343391 - RNA, 13 nt, Bordetella pertussis
ccgcgccaggcgg

SEQ ID NO: 2343392 - RNA, 14 nt, Bordetella pertussis
ccgcgccagggcgc

SEQ ID NO: 2343393 - RNA, 16 nt, Bordetella pertussis
ccgcgccagggcgcgg

SEQ ID NO: 2343394 - RNA, 19 nt, Bordetella pertussis
ccgcgccagguaggccggc

SEQ ID NO: 2343395 - RNA, 23 nt, Bordetella pertussis
ccgcgccagguaggccggcgcga

SEQ ID NO: 2343396 - RNA, 19 nt, Bordetella pertussis
ccgcgccaucgcgucgacg

SEQ ID NO: 2343397 - RNA, 18 nt, Bordetella pertussis
ccgcgccauugccacggc

SEQ ID NO: 2343398 - RNA, 22 nt, Bordetella pertussis
ccgcgccauugccacggcgggc

SEQ ID NO: 2343399 - RNA, 15 nt, Bordetella pertussis
ccgcgcccagcagcg

SEQ ID NO: 2343400 - RNA, 23 nt, Bordetella pertussis
ccgcgcccguccacggccugcgc

SEQ ID NO: 2343401 - RNA, 21 nt, Bordetella pertussis
ccgcgcccuggcgccgcggcc

SEQ ID NO: 2343402 - RNA, 20 nt, Bordetella pertussis
ccgcgcccuggcgcggcggc

SEQ ID NO: 2343403 - RNA, 17 nt, Bordetella pertussis
ccgcgcccuggggcgcg

SEQ ID NO: 2343404 - RNA, 18 nt, Bordetella pertussis
ccgcgccgaacgcgcagc

SEQ ID NO: 2343405 - RNA, 19 nt, Bordetella pertussis
ccgcgccgaacgcgcagcg

SEQ ID NO: 2343406 - RNA, 13 nt, Bordetella pertussis
ccgcgccgaaggc

SEQ ID NO: 2343407 - RNA, 23 nt, Bordetella pertussis
ccgcgccgaaguugcggccgugc

SEQ ID NO: 2343408 - RNA, 14 nt, Bordetella pertussis
ccgcgccgaccggc

SEQ ID NO: 2343409 - RNA, 15 nt, Bordetella pertussis
ccgcgccgaccggcc

SEQ ID NO: 2343410 - RNA, 18 nt, Bordetella pertussis
ccgcgccgacggcggcgc

SEQ ID NO: 2343411 - RNA, 22 nt, Bordetella pertussis
ccgcgccgacggcggcgcggcg

SEQ ID NO: 2343412 - RNA, 23 nt, Bordetella pertussis
ccgcgccgaguuuccgcacccgg

SEQ ID NO: 2343413 - RNA, 15 nt, Bordetella pertussis
ccgcgccgcaggccg

SEQ ID NO: 2343414 - RNA, 14 nt, Bordetella pertussis
ccgcgccgcccacg

SEQ ID NO: 2343415 - RNA, 20 nt, Bordetella pertussis
ccgcgccgcccacgccgcug

SEQ ID NO: 2343416 - RNA, 14 nt, Bordetella pertussis
ccgcgccgcccccg

SEQ ID NO: 2343417 - RNA, 17 nt, Bordetella pertussis
ccgcgccgcccccgccc

SEQ ID NO: 2343418 - RNA, 20 nt, Bordetella pertussis
ccgcgccgcccgcggccagc

SEQ ID NO: 2343419 - RNA, 22 nt, Bordetella pertussis
ccgcgccgcccgcggccagcca

SEQ ID NO: 2343420 - RNA, 15 nt, Bordetella pertussis
ccgcgccgccgcccu

SEQ ID NO: 2343421 - RNA, 16 nt, Bordetella pertussis
ccgcgccgccgcccug

SEQ ID NO: 2343422 - RNA, 18 nt, Bordetella pertussis
ccgcgccgccgcccuggc

SEQ ID NO: 2343423 - RNA, 17 nt, Bordetella pertussis
ccgcgccgccgccuggc

SEQ ID NO: 2343424 - RNA, 10 nt, Bordetella pertussis
ccgcgccgcg

SEQ ID NO: 2343425 - RNA, 16 nt, Bordetella pertussis
ccgcgccgcggcaagc

SEQ ID NO: 2343426 - RNA, 19 nt, Bordetella pertussis
ccgcgccgcggcaagccgc

SEQ ID NO: 2343427 - RNA, 14 nt, Bordetella pertussis
ccgcgccgcggcac

SEQ ID NO: 2343428 - RNA, 16 nt, Bordetella pertussis
ccgcgccgcgucaugg

SEQ ID NO: 2343429 - RNA, 12 nt, Bordetella pertussis
ccgcgccgcugg

SEQ ID NO: 2343430 - RNA, 19 nt, Bordetella pertussis
ccgcgccgcuggcggccgc

SEQ ID NO: 2343431 - RNA, 20 nt, Bordetella pertussis
ccgcgccgcuggcggccgcg

SEQ ID NO: 2343432 - RNA, 23 nt, Bordetella pertussis
ccgcgccgcuggcguccagguug

SEQ ID NO: 2343433 - RNA, 22 nt, Bordetella pertussis
ccgcgccgcuguugcccaccag

SEQ ID NO: 2343434 - RNA, 23 nt, Bordetella pertussis
ccgcgccgcuguugcccaccagc

SEQ ID NO: 2343435 - RNA, 14 nt, Bordetella pertussis
ccgcgccggcgcgc

SEQ ID NO: 2343436 - RNA, 16 nt, Bordetella pertussis
ccgcgccggcgcgcga

SEQ ID NO: 2343437 - RNA, 13 nt, Bordetella pertussis
ccgcgccggcggc

SEQ ID NO: 2343438 - RNA, 17 nt, Bordetella pertussis
ccgcgccggcggcaagg

SEQ ID NO: 2343439 - RNA, 13 nt, Bordetella pertussis
ccgcgccggcucc

SEQ ID NO: 2343440 - RNA, 23 nt, Bordetella pertussis
ccgcgccggcucccgcgcugccg

SEQ ID NO: 2343441 - RNA, 13 nt, Bordetella pertussis
ccgcgccgggcgc

SEQ ID NO: 2343442 - RNA, 20 nt, Bordetella pertussis
ccgcgccggggcggcucggc

SEQ ID NO: 2343443 - RNA, 17 nt, Bordetella pertussis
ccgcgccggucgccgcg

SEQ ID NO: 2343444 - RNA, 20 nt, Bordetella pertussis
ccgcgccguaccugcagcag

SEQ ID NO: 2343445 - RNA, 19 nt, Bordetella pertussis
ccgcgccguucucaggccg

SEQ ID NO: 2343446 - RNA, 19 nt, Bordetella pertussis
ccgcgccuauaucgacggc

SEQ ID NO: 2343447 - RNA, 14 nt, Bordetella pertussis
ccgcgccucggacg

SEQ ID NO: 2343448 - RNA, 20 nt, Bordetella pertussis
ccgcgccucggacgccuggc

SEQ ID NO: 2343449 - RNA, 14 nt, Bordetella pertussis
ccgcgccucggcau

SEQ ID NO: 2343450 - RNA, 22 nt, Bordetella pertussis
ccgcgccucguccucggugcug

SEQ ID NO: 2343451 - RNA, 16 nt, Bordetella pertussis
ccgcgccuucgaggcc

SEQ ID NO: 2343452 - RNA, 15 nt, Bordetella pertussis
ccgcgccuugcccgu

SEQ ID NO: 2343453 - RNA, 16 nt, Bordetella pertussis
ccgcgccuugcccguc

SEQ ID NO: 2343454 - RNA, 16 nt, Bordetella pertussis
ccgcgcgaacauccgg

SEQ ID NO: 2343455 - RNA, 19 nt, Bordetella pertussis
ccgcgcgacagccgcgcca

SEQ ID NO: 2343456 - RNA, 21 nt, Bordetella pertussis
ccgcgcgacagccgcgccagc

SEQ ID NO: 2343457 - RNA, 16 nt, Bordetella pertussis
ccgcgcgagcggcgug

SEQ ID NO: 2343458 - RNA, 17 nt, Bordetella pertussis
ccgcgcgauccggcgug

SEQ ID NO: 2343459 - RNA, 19 nt, Bordetella pertussis
ccgcgcgauccggcguggu

SEQ ID NO: 2343460 - RNA, 21 nt, Bordetella pertussis
ccgcgcgaucgccgcaugggc

SEQ ID NO: 2343461 - RNA, 18 nt, Bordetella pertussis
ccgcgcgaugcgcggccc

SEQ ID NO: 2343462 - RNA, 21 nt, Bordetella pertussis
ccgcgcgaugcgcggcccggc

SEQ ID NO: 2343463 - RNA, 19 nt, Bordetella pertussis
ccgcgcgcacgaccaccag

SEQ ID NO: 2343464 - RNA, 20 nt, Bordetella pertussis
ccgcgcgcagcgaggccucg

SEQ ID NO: 2343465 - RNA, 20 nt, Bordetella pertussis
ccgcgcgcaucacgcuggcc

SEQ ID NO: 2343466 - RNA, 10 nt, Bordetella pertussis
ccgcgcgccg

SEQ ID NO: 2343467 - RNA, 11 nt, Bordetella pertussis
ccgcgcgccgc

SEQ ID NO: 2343468 - RNA, 14 nt, Bordetella pertussis
ccgcgcgccgcgcc

SEQ ID NO: 2343469 - RNA, 12 nt, Bordetella pertussis
ccgcgcgccgcu

SEQ ID NO: 2343470 - RNA, 13 nt, Bordetella pertussis
ccgcgcgccgcug

SEQ ID NO: 2343471 - RNA, 21 nt, Bordetella pertussis
ccgcgcgccgcuguggacgcc

SEQ ID NO: 2343472 - RNA, 18 nt, Bordetella pertussis
ccgcgcgccggcgccggc

SEQ ID NO: 2343473 - RNA, 13 nt, Bordetella pertussis
ccgcgcgccgggu

SEQ ID NO: 2343474 - RNA, 13 nt, Bordetella pertussis
ccgcgcgccucga

SEQ ID NO: 2343475 - RNA, 20 nt, Bordetella pertussis
ccgcgcgccucgaugauggc

SEQ ID NO: 2343476 - RNA, 20 nt, Bordetella pertussis
ccgcgcgccuuacuucuugc

SEQ ID NO: 2343477 - RNA, 17 nt, Bordetella pertussis
ccgcgcgcgagcugcgc

SEQ ID NO: 2343478 - RNA, 21 nt, Bordetella pertussis
ccgcgcgcgagcugcgcggcu

SEQ ID NO: 2343479 - RNA, 23 nt, Bordetella pertussis
ccgcgcgcgcagacgcgcucagg

SEQ ID NO: 2343480 - RNA, 14 nt, Bordetella pertussis
ccgcgcgcgccagg

SEQ ID NO: 2343481 - RNA, 15 nt, Bordetella pertussis
ccgcgcgcgccaggc

SEQ ID NO: 2343482 - RNA, 20 nt, Bordetella pertussis
ccgcgcgcgcccgggccguc

SEQ ID NO: 2343483 - RNA, 21 nt, Bordetella pertussis
ccgcgcgcgcccgggccgucu

SEQ ID NO: 2343484 - RNA, 22 nt, Bordetella pertussis
ccgcgcgcgcccgggccgucua

SEQ ID NO: 2343485 - RNA, 20 nt, Bordetella pertussis
ccgcgcgcggcaaugcgcgc

SEQ ID NO: 2343486 - RNA, 20 nt, Bordetella pertussis
ccgcgcgcggccccggcucc

SEQ ID NO: 2343487 - RNA, 15 nt, Bordetella pertussis
ccgcgcgcggccggc

SEQ ID NO: 2343488 - RNA, 16 nt, Bordetella pertussis
ccgcgcgcggccggca

SEQ ID NO: 2343489 - RNA, 19 nt, Bordetella pertussis
ccgcgcgcggccggcacca

SEQ ID NO: 2343490 - RNA, 17 nt, Bordetella pertussis
ccgcgcgcggccggcgc

SEQ ID NO: 2343491 - RNA, 20 nt, Bordetella pertussis
ccgcgcgcggccggcgcgcc

SEQ ID NO: 2343492 - RNA, 21 nt, Bordetella pertussis
ccgcgcgcggccggcgcgccg

SEQ ID NO: 2343493 - RNA, 17 nt, Bordetella pertussis
ccgcgcgcgggcgcccg

SEQ ID NO: 2343494 - RNA, 20 nt, Bordetella pertussis
ccgcgcgcguauggcggcgc

SEQ ID NO: 2343495 - RNA, 22 nt, Bordetella pertussis
ccgcgcgcguauggcggcgccg

SEQ ID NO: 2343496 - RNA, 18 nt, Bordetella pertussis
ccgcgcgcgucgccgcug

SEQ ID NO: 2343497 - RNA, 22 nt, Bordetella pertussis
ccgcgcgcuggcugugcccgcc

SEQ ID NO: 2343498 - RNA, 23 nt, Bordetella pertussis
ccgcgcgcuggcugugcccgccc

SEQ ID NO: 2343499 - RNA, 22 nt, Bordetella pertussis
ccgcgcgcuucaggcgccgcag

SEQ ID NO: 2343500 - RNA, 18 nt, Bordetella pertussis
ccgcgcgcuuucaggugg

SEQ ID NO: 2343501 - RNA, 16 nt, Bordetella pertussis
ccgcgcggccagcgcc

SEQ ID NO: 2343502 - RNA, 17 nt, Bordetella pertussis
ccgcgcggccagcgccg

SEQ ID NO: 2343503 - RNA, 19 nt, Bordetella pertussis
ccgcgcggccagcgccggc

SEQ ID NO: 2343504 - RNA, 13 nt, Bordetella pertussis
ccgcgcggccggg

SEQ ID NO: 2343505 - RNA, 23 nt, Bordetella pertussis
ccgcgcggccgggcucaggcugc

SEQ ID NO: 2343506 - RNA, 21 nt, Bordetella pertussis
ccgcgcggccgucaggcguug

SEQ ID NO: 2343507 - RNA, 18 nt, Bordetella pertussis
ccgcgcggcgccugccug

SEQ ID NO: 2343508 - RNA, 21 nt, Bordetella pertussis
ccgcgcgguacgcaccgccgc

SEQ ID NO: 2343509 - RNA, 23 nt, Bordetella pertussis
ccgcgcgguacgcaccgccgccg

SEQ ID NO: 2343510 - RNA, 20 nt, Bordetella pertussis
ccgcgcgguauugcgccacc

SEQ ID NO: 2343511 - RNA, 16 nt, Bordetella pertussis
ccgcgcgguggccgcc

SEQ ID NO: 2343512 - RNA, 17 nt, Bordetella pertussis
ccgcgcgguggccgccg

SEQ ID NO: 2343513 - RNA, 18 nt, Bordetella pertussis
ccgcgcgguggggcgcaa

SEQ ID NO: 2343514 - RNA, 23 nt, Bordetella pertussis
ccgcgcgguucgcauagcgccgg

SEQ ID NO: 2343515 - RNA, 15 nt, Bordetella pertussis
ccgcgcguacgcggc

SEQ ID NO: 2343516 - RNA, 16 nt, Bordetella pertussis
ccgcgcguaucggcgc

SEQ ID NO: 2343517 - RNA, 23 nt, Bordetella pertussis
ccgcgcguaucggcgcgagcgau

SEQ ID NO: 2343518 - RNA, 14 nt, Bordetella pertussis
ccgcgcucagcacc

SEQ ID NO: 2343519 - RNA, 15 nt, Bordetella pertussis
ccgcgcucagcacca

SEQ ID NO: 2343520 - RNA, 19 nt, Bordetella pertussis
ccgcgcucagcaccaggcc

SEQ ID NO: 2343521 - RNA, 21 nt, Bordetella pertussis
ccgcgcucagcaccaggccgc

SEQ ID NO: 2343522 - RNA, 22 nt, Bordetella pertussis
ccgcgcucagcaccaggccgcc

SEQ ID NO: 2343523 - RNA, 16 nt, Bordetella pertussis
ccgcgcucaggccgcu

SEQ ID NO: 2343524 - RNA, 19 nt, Bordetella pertussis
ccgcgcuccagggcgucgg

SEQ ID NO: 2343525 - RNA, 21 nt, Bordetella pertussis
ccgcgcuccagggcgucggcg

SEQ ID NO: 2343526 - RNA, 14 nt, Bordetella pertussis
ccgcgcucgcccag

SEQ ID NO: 2343527 - RNA, 22 nt, Bordetella pertussis
ccgcgcucgcccagccgccuga

SEQ ID NO: 2343528 - RNA, 15 nt, Bordetella pertussis
ccgcgcucgcgccag

SEQ ID NO: 2343529 - RNA, 16 nt, Bordetella pertussis
ccgcgcucgcgccagg

SEQ ID NO: 2343530 - RNA, 17 nt, Bordetella pertussis
ccgcgcucgcgccaggc

SEQ ID NO: 2343531 - RNA, 19 nt, Bordetella pertussis
ccgcgcucgcgccaggccc

SEQ ID NO: 2343532 - RNA, 17 nt, Bordetella pertussis
ccgcgcugauccuggcu

SEQ ID NO: 2343533 - RNA, 20 nt, Bordetella pertussis
ccgcgcugccgcugcaggcc

SEQ ID NO: 2343534 - RNA, 21 nt, Bordetella pertussis
ccgcgcugccgcugcaggccc

SEQ ID NO: 2343535 - RNA, 22 nt, Bordetella pertussis
ccgcgcugccgcugcaggcccu

SEQ ID NO: 2343536 - RNA, 24 nt, Bordetella pertussis
ccgcgcugccugaaaccgcaggca

SEQ ID NO: 2343537 - RNA, 14 nt, Bordetella pertussis
ccgcgcugcgcccg

SEQ ID NO: 2343538 - RNA, 15 nt, Bordetella pertussis
ccgcgcugcgcccgc

SEQ ID NO: 2343539 - RNA, 18 nt, Bordetella pertussis
ccgcgcugcggucagcug

SEQ ID NO: 2343540 - RNA, 17 nt, Bordetella pertussis
ccgcgcugcugcaggcc

SEQ ID NO: 2343541 - RNA, 21 nt, Bordetella pertussis
ccgcgcugcugccgucggcgu

SEQ ID NO: 2343542 - RNA, 14 nt, Bordetella pertussis
ccgcgcuggcgcag

SEQ ID NO: 2343543 - RNA, 15 nt, Bordetella pertussis
ccgcgcuggcgcagc

SEQ ID NO: 2343544 - RNA, 21 nt, Bordetella pertussis
ccgcgcuggcgcagcaggcgc

SEQ ID NO: 2343545 - RNA, 20 nt, Bordetella pertussis
ccgcgcuggcgcuggccgcc

SEQ ID NO: 2343546 - RNA, 23 nt, Bordetella pertussis
ccgcgcuggcgcuggccgcccgc

SEQ ID NO: 2343547 - RNA, 22 nt, Bordetella pertussis
ccgcgcuggcggcgcaggccgc

SEQ ID NO: 2343548 - RNA, 17 nt, Bordetella pertussis
ccgcgcugggaaacagc

SEQ ID NO: 2343549 - RNA, 20 nt, Bordetella pertussis
ccgcgcugggcgcugcugcu

SEQ ID NO: 2343550 - RNA, 18 nt, Bordetella pertussis
ccgcgcuucgucggcguc

SEQ ID NO: 2343551 - RNA, 19 nt, Bordetella pertussis
ccgcgcuucgucggcgucg

SEQ ID NO: 2343552 - RNA, 19 nt, Bordetella pertussis
ccgcggaagucgggcacca

SEQ ID NO: 2343553 - RNA, 14 nt, Bordetella pertussis
ccgcggacccaggc

SEQ ID NO: 2343554 - RNA, 19 nt, Bordetella pertussis
ccgcggacgaagccuaggc

SEQ ID NO: 2343555 - RNA, 19 nt, Bordetella pertussis
ccgcggacgccauggcggc

SEQ ID NO: 2343556 - RNA, 23 nt, Bordetella pertussis
ccgcggaggugucgccgcccaug

SEQ ID NO: 2343557 - RNA, 19 nt, Bordetella pertussis
ccgcggauugccguccugg

SEQ ID NO: 2343558 - RNA, 21 nt, Bordetella pertussis
ccgcggcaaauggggcggccg

SEQ ID NO: 2343559 - RNA, 20 nt, Bordetella pertussis
ccgcggcaagccgcggcggu

SEQ ID NO: 2343560 - RNA, 21 nt, Bordetella pertussis
ccgcggcagaucuccggaucc

SEQ ID NO: 2343561 - RNA, 17 nt, Bordetella pertussis
ccgcggcaggccccggc

SEQ ID NO: 2343562 - RNA, 18 nt, Bordetella pertussis
ccgcggcaggccccggcc

SEQ ID NO: 2343563 - RNA, 22 nt, Bordetella pertussis
ccgcggcaggccccggcccggc

SEQ ID NO: 2343564 - RNA, 15 nt, Bordetella pertussis
ccgcggccagccacg

SEQ ID NO: 2343565 - RNA, 18 nt, Bordetella pertussis
ccgcggccagccacgccg

SEQ ID NO: 2343566 - RNA, 19 nt, Bordetella pertussis
ccgcggccagcgccgcgcc

SEQ ID NO: 2343567 - RNA, 16 nt, Bordetella pertussis
ccgcggccagggugcc

SEQ ID NO: 2343568 - RNA, 18 nt, Bordetella pertussis
ccgcggcccagcgcggcg

SEQ ID NO: 2343569 - RNA, 14 nt, Bordetella pertussis
ccgcggcccgcccg

SEQ ID NO: 2343570 - RNA, 21 nt, Bordetella pertussis
ccgcggcccuugcgcgaaggc

SEQ ID NO: 2343571 - RNA, 23 nt, Bordetella pertussis
ccgcggcccuugcgcgaaggccg

SEQ ID NO: 2343572 - RNA, 13 nt, Bordetella pertussis
ccgcggccgcccc

SEQ ID NO: 2343573 - RNA, 21 nt, Bordetella pertussis
ccgcggccgcccccagcgcgc

SEQ ID NO: 2343574 - RNA, 14 nt, Bordetella pertussis
ccgcggccgcgcug

SEQ ID NO: 2343575 - RNA, 16 nt, Bordetella pertussis
ccgcggccggcacgcc

SEQ ID NO: 2343576 - RNA, 20 nt, Bordetella pertussis
ccgcggccggcacgcccagc

SEQ ID NO: 2343577 - RNA, 16 nt, Bordetella pertussis
ccgcggccggcggcgc

SEQ ID NO: 2343578 - RNA, 18 nt, Bordetella pertussis
ccgcggccggcggcgccg

SEQ ID NO: 2343579 - RNA, 17 nt, Bordetella pertussis
ccgcggccuucaccccg

SEQ ID NO: 2343580 - RNA, 19 nt, Bordetella pertussis
ccgcggccuucaccccgcc

SEQ ID NO: 2343581 - RNA, 13 nt, Bordetella pertussis
ccgcggcgaagcc

SEQ ID NO: 2343582 - RNA, 19 nt, Bordetella pertussis
ccgcggcgaugccggccag

SEQ ID NO: 2343583 - RNA, 21 nt, Bordetella pertussis
ccgcggcgaugccggccagca

SEQ ID NO: 2343584 - RNA, 19 nt, Bordetella pertussis
ccgcggcgcagguccaccg

SEQ ID NO: 2343585 - RNA, 21 nt, Bordetella pertussis
ccgcggcgcagguccaccgcc

SEQ ID NO: 2343586 - RNA, 23 nt, Bordetella pertussis
ccgcggcgcagguccaccgccac

SEQ ID NO: 2343587 - RNA, 17 nt, Bordetella pertussis
ccgcggcgcccagcugg

SEQ ID NO: 2343588 - RNA, 20 nt, Bordetella pertussis
ccgcggcgcccccgcggcgc

SEQ ID NO: 2343589 - RNA, 15 nt, Bordetella pertussis
ccgcggcgcccggug

SEQ ID NO: 2343590 - RNA, 18 nt, Bordetella pertussis
ccgcggcgcgcgcggcgc

SEQ ID NO: 2343591 - RNA, 22 nt, Bordetella pertussis
ccgcggcgcgcgcggcgccugg

SEQ ID NO: 2343592 - RNA, 17 nt, Bordetella pertussis
ccgcggcgcggcccgcc

SEQ ID NO: 2343593 - RNA, 23 nt, Bordetella pertussis
ccgcggcgcuggauggcucgggc

SEQ ID NO: 2343594 - RNA, 16 nt, Bordetella pertussis
ccgcggcggcccgguu

SEQ ID NO: 2343595 - RNA, 23 nt, Bordetella pertussis
ccgcggcggcccgguucaaccgg

SEQ ID NO: 2343596 - RNA, 16 nt, Bordetella pertussis
ccgcggcgggcucggc

SEQ ID NO: 2343597 - RNA, 20 nt, Bordetella pertussis
ccgcggcgggcucggcgccg

SEQ ID NO: 2343598 - RNA, 18 nt, Bordetella pertussis
ccgcggcgguuucggccg

SEQ ID NO: 2343599 - RNA, 19 nt, Bordetella pertussis
ccgcggcgguuucggccgg

SEQ ID NO: 2343600 - RNA, 15 nt, Bordetella pertussis
ccgcggcguccgcgc

SEQ ID NO: 2343601 - RNA, 17 nt, Bordetella pertussis
ccggcacgcccagccgc

SEQ ID NO: 2343602 - RNA, 12 nt, Bordetella pertussis
ccggcacgccga

SEQ ID NO: 2343603 - RNA, 14 nt, Bordetella pertussis
ccggcacgccggcg

SEQ ID NO: 2343604 - RNA, 15 nt, Bordetella pertussis
ccggcacgccggcgg

SEQ ID NO: 2343605 - RNA, 20 nt, Bordetella pertussis
ccggcacgcgccagcugacc

SEQ ID NO: 2343606 - RNA, 15 nt, Bordetella pertussis
ccggcacgcgccagg

SEQ ID NO: 2343607 - RNA, 16 nt, Bordetella pertussis
ccggcacgcgccaggc

SEQ ID NO: 2343608 - RNA, 13 nt, Bordetella pertussis
ccggcacgcgccg

SEQ ID NO: 2343609 - RNA, 22 nt, Bordetella pertussis
ccggcacgcgcgguucgccgug

SEQ ID NO: 2343610 - RNA, 22 nt, Bordetella pertussis
ccggcacgcugaucgccggcgc

SEQ ID NO: 2343611 - RNA, 18 nt, Bordetella pertussis
ccggcacggccggccagg

SEQ ID NO: 2343612 - RNA, 17 nt, Bordetella pertussis
ccggcacgguucagaac

SEQ ID NO: 2343613 - RNA, 21 nt, Bordetella pertussis
ccggcacgguucagaacgcgu

SEQ ID NO: 2343614 - RNA, 18 nt, Bordetella pertussis
ccggcacguaccaggcgc

SEQ ID NO: 2343615 - RNA, 23 nt, Bordetella pertussis
ccggcagaacagcggaucgccgg

SEQ ID NO: 2343616 - RNA, 15 nt, Bordetella pertussis
ccggcagcacccagc

SEQ ID NO: 2343617 - RNA, 12 nt, Bordetella pertussis
ccggcagcagca

SEQ ID NO: 2343618 - RNA, 17 nt, Bordetella pertussis
ccggcagccccagcgcc

SEQ ID NO: 2343619 - RNA, 21 nt, Bordetella pertussis
ccggcagccccagcgcccagg

SEQ ID NO: 2343620 - RNA, 23 nt, Bordetella pertussis
ccggcagcgcaaaacgcaugacc

SEQ ID NO: 2343621 - RNA, 13 nt, Bordetella pertussis
ccggcagcgccuu

SEQ ID NO: 2343622 - RNA, 15 nt, Bordetella pertussis
ccggcagcgcgaccg

SEQ ID NO: 2343623 - RNA, 19 nt, Bordetella pertussis
ccggcagcgcgaccggcgc

SEQ ID NO: 2343624 - RNA, 21 nt, Bordetella pertussis
ccggcagcgcgaccggcgcga

SEQ ID NO: 2343625 - RNA, 17 nt, Bordetella pertussis
ccggcagcggccagcgc

SEQ ID NO: 2343626 - RNA, 20 nt, Bordetella pertussis
ccggcagcggccagcgcggc

SEQ ID NO: 2343627 - RNA, 15 nt, Bordetella pertussis
ccggcagcggcgcca

SEQ ID NO: 2343628 - RNA, 22 nt, Bordetella pertussis
ccggcagcggcgccaugcgcac

SEQ ID NO: 2343629 - RNA, 23 nt, Bordetella pertussis
ccggcagcgucaauccgccgcca

SEQ ID NO: 2343630 - RNA, 13 nt, Bordetella pertussis
ccggcaggccgcg

SEQ ID NO: 2343631 - RNA, 14 nt, Bordetella pertussis
ccggcaggccgcgc

SEQ ID NO: 2343632 - RNA, 15 nt, Bordetella pertussis
ccggcaggccgcgcu

SEQ ID NO: 2343633 - RNA, 16 nt, Bordetella pertussis
ccggcaggccgcgcug

SEQ ID NO: 2343634 - RNA, 21 nt, Bordetella pertussis
ccggcaggccggccagcaagg

SEQ ID NO: 2343635 - RNA, 12 nt, Bordetella pertussis
ccggcaggcgcg

SEQ ID NO: 2343636 - RNA, 14 nt, Bordetella pertussis
ccggcaggcgcgcc

SEQ ID NO: 2343637 - RNA, 16 nt, Bordetella pertussis
ccggcagggccagcgc

SEQ ID NO: 2343638 - RNA, 15 nt, Bordetella pertussis
ccggcagggcggcca

SEQ ID NO: 2343639 - RNA, 19 nt, Bordetella pertussis
ccggcagggucucggccac

SEQ ID NO: 2343640 - RNA, 12 nt, Bordetella pertussis
ccggcaggguga

SEQ ID NO: 2343641 - RNA, 15 nt, Bordetella pertussis
ccggcagggugccca

SEQ ID NO: 2343642 - RNA, 17 nt, Bordetella pertussis
ccggcagggugcccagu

SEQ ID NO: 2343643 - RNA, 20 nt, Bordetella pertussis
ccggcagggugcccaguucg

SEQ ID NO: 2343644 - RNA, 21 nt, Bordetella pertussis
ccggcaggucgaugcccuccc

SEQ ID NO: 2343645 - RNA, 22 nt, Bordetella pertussis
ccggcaggucgaugcccuccca

SEQ ID NO: 2343646 - RNA, 23 nt, Bordetella pertussis
ccggcaggucgaugcccucccag

SEQ ID NO: 2343647 - RNA, 17 nt, Bordetella pertussis
ccggcauaggcggcgca

SEQ ID NO: 2343648 - RNA, 19 nt, Bordetella pertussis
ccggcaucaguucaggcug

SEQ ID NO: 2343649 - RNA, 14 nt, Bordetella pertussis
ccggcaucccugcu

SEQ ID NO: 2343650 - RNA, 14 nt, Bordetella pertussis
ccggcaucgcgcug

SEQ ID NO: 2343651 - RNA, 13 nt, Bordetella pertussis
ccggcaucggcgg

SEQ ID NO: 2343652 - RNA, 18 nt, Bordetella pertussis
ccggcaugaagcgcagca

SEQ ID NO: 2343653 - RNA, 15 nt, Bordetella pertussis
ccggcaugaccgcgg

SEQ ID NO: 2343654 - RNA, 19 nt, Bordetella pertussis
ccggcaugaccgcggacgc

SEQ ID NO: 2343655 - RNA, 18 nt, Bordetella pertussis
ccggcaugccguccacgc

SEQ ID NO: 2343656 - RNA, 20 nt, Bordetella pertussis
ccggcaugccguccacgccc

SEQ ID NO: 2343657 - RNA, 21 nt, Bordetella pertussis
ccggcaugccguccacgccca

SEQ ID NO: 2343658 - RNA, 22 nt, Bordetella pertussis
ccggcaugccguccacgcccag

SEQ ID NO: 2343659 - RNA, 21 nt, Bordetella pertussis
ccggcauggcagcagaucggc

SEQ ID NO: 2343660 - RNA, 20 nt, Bordetella pertussis
ccggcaugggcgugccgcgc

SEQ ID NO: 2343661 - RNA, 20 nt, Bordetella pertussis
ccggcaugguguaccgggcc

SEQ ID NO: 2343662 - RNA, 17 nt, Bordetella pertussis
ccggcauguugccgcug

SEQ ID NO: 2343663 - RNA, 15 nt, Bordetella pertussis
ccggcauugcccacc

SEQ ID NO: 2343664 - RNA, 18 nt, Bordetella pertussis
ccggcauugcccaccacg

SEQ ID NO: 2343665 - RNA, 21 nt, Bordetella pertussis
ccggcauuucgcugggcgcgc

SEQ ID NO: 2343666 - RNA, 22 nt, Bordetella pertussis
ccggccaacagcucgcgccagg

SEQ ID NO: 2343667 - RNA, 16 nt, Bordetella pertussis
ccggccaaggcaagca

SEQ ID NO: 2343668 - RNA, 13 nt, Bordetella pertussis
ccggccaccagcg

SEQ ID NO: 2343669 - RNA, 17 nt, Bordetella pertussis
ccggccaccagcggcgc

SEQ ID NO: 2343670 - RNA, 14 nt, Bordetella pertussis
ccggccaccgccug

SEQ ID NO: 2343671 - RNA, 18 nt, Bordetella pertussis
ccggccacgcgcugcagc

SEQ ID NO: 2343672 - RNA, 13 nt, Bordetella pertussis
ccggccacggccg

SEQ ID NO: 2343673 - RNA, 16 nt, Bordetella pertussis
ccggccacggccgggc

SEQ ID NO: 2343674 - RNA, 18 nt, Bordetella pertussis
ccggccacggccgggccu

SEQ ID NO: 2343675 - RNA, 23 nt, Bordetella pertussis
ccggccacguguggcaggccagc

SEQ ID NO: 2343676 - RNA, 11 nt, Bordetella pertussis
ccggccagcaa

SEQ ID NO: 2343677 - RNA, 15 nt, Bordetella pertussis
ccggccagcacgccg

SEQ ID NO: 2343678 - RNA, 13 nt, Bordetella pertussis
ccggccagcagcg

SEQ ID NO: 2343679 - RNA, 17 nt, Bordetella pertussis
ccggccagccauugccg

SEQ ID NO: 2343680 - RNA, 15 nt, Bordetella pertussis
ccggccagccugccc

SEQ ID NO: 2343681 - RNA, 11 nt, Bordetella pertussis
ccggccagcgc

SEQ ID NO: 2343682 - RNA, 18 nt, Bordetella pertussis
ccggccagcgccaccacc

SEQ ID NO: 2343683 - RNA, 21 nt, Bordetella pertussis
ccggccagcgccaccaccggc

SEQ ID NO: 2343684 - RNA, 20 nt, Bordetella pertussis
ccggccagcgccaguccgcg

SEQ ID NO: 2343685 - RNA, 21 nt, Bordetella pertussis
ccggccagcgccaguccgcgc

SEQ ID NO: 2343686 - RNA, 15 nt, Bordetella pertussis
ccggccagcgcggca

SEQ ID NO: 2343687 - RNA, 20 nt, Bordetella pertussis
ccggccagcgcggcaucggc

SEQ ID NO: 2343688 - RNA, 22 nt, Bordetella pertussis
ccggccagcuugagcaggcgcg

SEQ ID NO: 2343689 - RNA, 14 nt, Bordetella pertussis
ccggccaggaugag

SEQ ID NO: 2343690 - RNA, 10 nt, Bordetella pertussis
ccggccaggc

SEQ ID NO: 2343691 - RNA, 14 nt, Bordetella pertussis
ccggccaggcgccg

SEQ ID NO: 2343692 - RNA, 19 nt, Bordetella pertussis
ccggccaggcgccggcggu

SEQ ID NO: 2343693 - RNA, 18 nt, Bordetella pertussis
ccggccagggccaccacg

SEQ ID NO: 2343694 - RNA, 18 nt, Bordetella pertussis
ccggccagggccacgccg

SEQ ID NO: 2343695 - RNA, 21 nt, Bordetella pertussis
ccggccagggccacgccggcc

SEQ ID NO: 2343696 - RNA, 22 nt, Bordetella pertussis
ccggccagggccacgccggccg

SEQ ID NO: 2343697 - RNA, 21 nt, Bordetella pertussis
ccggccaggucggcggccagc

SEQ ID NO: 2343698 - RNA, 23 nt, Bordetella pertussis
ccggccaggucggcggccagcgc

SEQ ID NO: 2343699 - RNA, 14 nt, Bordetella pertussis
ccggccagucccag

SEQ ID NO: 2343700 - RNA, 21 nt, Bordetella pertussis
ccggccagucgcggugcaugg

SEQ ID NO: 2343701 - RNA, 13 nt, Bordetella pertussis
ccggccaucacgc

SEQ ID NO: 2343702 - RNA, 16 nt, Bordetella pertussis
ccggccaucacgccga

SEQ ID NO: 2343703 - RNA, 19 nt, Bordetella pertussis
ccggccaucgaagccagau

SEQ ID NO: 2343704 - RNA, 18 nt, Bordetella pertussis
ccggccauggcccuugcc

SEQ ID NO: 2343705 - RNA, 16 nt, Bordetella pertussis
ccggccauggccgcca

SEQ ID NO: 2343706 - RNA, 20 nt, Bordetella pertussis
ccggccauggcggccggcgu

SEQ ID NO: 2343707 - RNA, 16 nt, Bordetella pertussis
ccggcccaaggccccg

SEQ ID NO: 2343708 - RNA, 17 nt, Bordetella pertussis
ccggcccaaggccccgc

SEQ ID NO: 2343709 - RNA, 17 nt, Bordetella pertussis
ccggcccagcacgccgc

SEQ ID NO: 2343710 - RNA, 19 nt, Bordetella pertussis
ccggcccagcacgccgcgc

SEQ ID NO: 2343711 - RNA, 18 nt, Bordetella pertussis
ccggcccagcaugccgau

SEQ ID NO: 2343712 - RNA, 13 nt, Bordetella pertussis
ccggcccagcgcc

SEQ ID NO: 2343713 - RNA, 18 nt, Bordetella pertussis
ccggcccagcgccaucgg

SEQ ID NO: 2343714 - RNA, 21 nt, Bordetella pertussis
ccggcccaggauggcgccagc

SEQ ID NO: 2343715 - RNA, 14 nt, Bordetella pertussis
ccggcccaggccgg

SEQ ID NO: 2343716 - RNA, 13 nt, Bordetella pertussis
ccggcccaggcgc

SEQ ID NO: 2343717 - RNA, 15 nt, Bordetella pertussis
ccggcccaggcgcgc

SEQ ID NO: 2343718 - RNA, 22 nt, Bordetella pertussis
ccggcccaggcgcgcuggcgcu

SEQ ID NO: 2343719 - RNA, 17 nt, Bordetella pertussis
ccggcccaguccagggu

SEQ ID NO: 2343720 - RNA, 24 nt, Bordetella pertussis
ccggcccaguccaggguguccugg

SEQ ID NO: 2343721 - RNA, 22 nt, Bordetella pertussis
ccggcccaucuguacggccggc

SEQ ID NO: 2343722 - RNA, 17 nt, Bordetella pertussis
ccggccccaccuggcgg

SEQ ID NO: 2343723 - RNA, 15 nt, Bordetella pertussis
ccggccccaggccgg

SEQ ID NO: 2343724 - RNA, 16 nt, Bordetella pertussis
ccggccccaggccggg

SEQ ID NO: 2343725 - RNA, 13 nt, Bordetella pertussis
ccggcccgccacg

SEQ ID NO: 2343726 - RNA, 19 nt, Bordetella pertussis
ccggcccgccccacggcga

SEQ ID NO: 2343727 - RNA, 14 nt, Bordetella pertussis
ccggcccgcgcgcc

SEQ ID NO: 2343728 - RNA, 20 nt, Bordetella pertussis
ccggcccggaauaccgccag

SEQ ID NO: 2343729 - RNA, 22 nt, Bordetella pertussis
ccggcccggaauaccgccagcu

SEQ ID NO: 2343730 - RNA, 17 nt, Bordetella pertussis
ccggcccggugcagccg

SEQ ID NO: 2343731 - RNA, 22 nt, Bordetella pertussis
ccggcccguuggcaggccagca

SEQ ID NO: 2343732 - RNA, 17 nt, Bordetella pertussis
ccggcccugccgcccug

SEQ ID NO: 2343733 - RNA, 18 nt, Bordetella pertussis
ccggcccugccgcccugg

SEQ ID NO: 2343734 - RNA, 22 nt, Bordetella pertussis
ccggcccugccgcccuggcgca

SEQ ID NO: 2343735 - RNA, 16 nt, Bordetella pertussis
ccggccgaaaccgccg

SEQ ID NO: 2343736 - RNA, 17 nt, Bordetella pertussis
ccggccgaaaccgccgc

SEQ ID NO: 2343737 - RNA, 19 nt, Bordetella pertussis
ccggccgaaaccgccgcgg

SEQ ID NO: 2343738 - RNA, 14 nt, Bordetella pertussis
ccggccgacccgcg

SEQ ID NO: 2343739 - RNA, 15 nt, Bordetella pertussis
ccggccgaccggcgc

SEQ ID NO: 2343740 - RNA, 18 nt, Bordetella pertussis
ccggccgaccggcgcgcg

SEQ ID NO: 2343741 - RNA, 23 nt, Bordetella pertussis
ccggccgacggcgcuggcgagca

SEQ ID NO: 2343742 - RNA, 17 nt, Bordetella pertussis
ccggccgauagccgcgg

SEQ ID NO: 2343743 - RNA, 22 nt, Bordetella pertussis
ccggccgauagccgcggcgccg

SEQ ID NO: 2343744 - RNA, 20 nt, Bordetella pertussis
ccggccgaugacaucgccgc

SEQ ID NO: 2343745 - RNA, 18 nt, Bordetella pertussis
ccggccgcacgcggccgc

SEQ ID NO: 2343746 - RNA, 13 nt, Bordetella pertussis
ccggccgccagca

SEQ ID NO: 2343747 - RNA, 23 nt, Bordetella pertussis
ccggccgccagcaaggcgucggc

SEQ ID NO: 2343748 - RNA, 17 nt, Bordetella pertussis
ccggccgccagcauggc

SEQ ID NO: 2343749 - RNA, 18 nt, Bordetella pertussis
ccggccgccauggccggc

SEQ ID NO: 2343750 - RNA, 17 nt, Bordetella pertussis
ccggccgcccaggcgca

SEQ ID NO: 2343751 - RNA, 14 nt, Bordetella pertussis
ccggccgccgaacg

SEQ ID NO: 2343752 - RNA, 21 nt, Bordetella pertussis
ccggccgccgaacgaggcgcg

SEQ ID NO: 2343753 - RNA, 16 nt, Bordetella pertussis
ccggccgccgccggca

SEQ ID NO: 2343754 - RNA, 18 nt, Bordetella pertussis
ccggccgccucaccgcgc

SEQ ID NO: 2343755 - RNA, 20 nt, Bordetella pertussis
ccggccgccucaccgcgccg

SEQ ID NO: 2343756 - RNA, 14 nt, Bordetella pertussis
ccggccgccuccag

SEQ ID NO: 2343757 - RNA, 16 nt, Bordetella pertussis
ccggccgccuccaggc

SEQ ID NO: 2343758 - RNA, 14 nt, Bordetella pertussis
ccggccgcgccagc

SEQ ID NO: 2343759 - RNA, 15 nt, Bordetella pertussis
ccggccgcgcccaug

SEQ ID NO: 2343760 - RNA, 14 nt, Bordetella pertussis
ccggccgcgcccga

SEQ ID NO: 2343761 - RNA, 18 nt, Bordetella pertussis
ccggccgcgcgcgccagg

SEQ ID NO: 2343762 - RNA, 22 nt, Bordetella pertussis
ccggccgcgcgcgccaggccuu

SEQ ID NO: 2343763 - RNA, 22 nt, Bordetella pertussis
ccggccgcggggcuggccagcu

SEQ ID NO: 2343764 - RNA, 17 nt, Bordetella pertussis
ccggccgcguggccgcg

SEQ ID NO: 2343765 - RNA, 19 nt, Bordetella pertussis
ccggccgcguggccgcgcu

SEQ ID NO: 2343766 - RNA, 20 nt, Bordetella pertussis
ccggccggcaaggggccagc

SEQ ID NO: 2343767 - RNA, 21 nt, Bordetella pertussis
ccggccggcaaggggccagcc

SEQ ID NO: 2343768 - RNA, 14 nt, Bordetella pertussis
ccggccggcacggc

SEQ ID NO: 2343769 - RNA, 17 nt, Bordetella pertussis
ccggccggcacggccgg

SEQ ID NO: 2343770 - RNA, 19 nt, Bordetella pertussis
ccggccggcacggccggcc

SEQ ID NO: 2343771 - RNA, 22 nt, Bordetella pertussis
ccggccggcacggccggccagg

SEQ ID NO: 2343772 - RNA, 16 nt, Bordetella pertussis
ccggccggccgggcag

SEQ ID NO: 2343773 - RNA, 15 nt, Bordetella pertussis
ccggccggccuuccg

SEQ ID NO: 2343774 - RNA, 11 nt, Bordetella pertussis
ccggccgggcc

SEQ ID NO: 2343775 - RNA, 15 nt, Bordetella pertussis
ccggccgggccagcg

SEQ ID NO: 2343776 - RNA, 16 nt, Bordetella pertussis
ccggccgggccagcgc

SEQ ID NO: 2343777 - RNA, 23 nt, Bordetella pertussis
ccggccgggccagcgcgaucucg

SEQ ID NO: 2343778 - RNA, 14 nt, Bordetella pertussis
ccggccgggcgcgg

SEQ ID NO: 2343779 - RNA, 15 nt, Bordetella pertussis
ccggccgggcgcggc

SEQ ID NO: 2343780 - RNA, 17 nt, Bordetella pertussis
ccggccgggcgcggcgc

SEQ ID NO: 2343781 - RNA, 21 nt, Bordetella pertussis
ccggccggggucuugccgcgc

SEQ ID NO: 2343782 - RNA, 21 nt, Bordetella pertussis
ccggccggguugucgcccacc

SEQ ID NO: 2343783 - RNA, 17 nt, Bordetella pertussis
ccggccggugcaucggc

SEQ ID NO: 2343784 - RNA, 21 nt, Bordetella pertussis
ccggccgguggguguggccau

SEQ ID NO: 2343785 - RNA, 18 nt, Bordetella pertussis
ccggccguauggccguug

SEQ ID NO: 2343786 - RNA, 16 nt, Bordetella pertussis
ccggccgugccgcccg

SEQ ID NO: 2343787 - RNA, 17 nt, Bordetella pertussis
ccggccgugccgcccgg

SEQ ID NO: 2343788 - RNA, 16 nt, Bordetella pertussis
ccggccguuucaggcc

SEQ ID NO: 2343789 - RNA, 18 nt, Bordetella pertussis
ccggccguuucaggccug

SEQ ID NO: 2343790 - RNA, 19 nt, Bordetella pertussis
ccggccguuucaggccugc

SEQ ID NO: 2343791 - RNA, 22 nt, Bordetella pertussis
ccggccguuucaggccugcggc

SEQ ID NO: 2343792 - RNA, 19 nt, Bordetella pertussis
ccggccucaaccgcgcgua

SEQ ID NO: 2343793 - RNA, 14 nt, Bordetella pertussis
ccggccuccagcau

SEQ ID NO: 2343794 - RNA, 18 nt, Bordetella pertussis
ccggccuccagcaucgcc

SEQ ID NO: 2343795 - RNA, 19 nt, Bordetella pertussis
ccggccucccggaccagca

SEQ ID NO: 2343796 - RNA, 23 nt, Bordetella pertussis
ccggccucuucgucgccggcgcu

SEQ ID NO: 2343797 - RNA, 13 nt, Bordetella pertussis
ccggccugacgcg

SEQ ID NO: 2343798 - RNA, 22 nt, Bordetella pertussis
ccggccugcaaugcggccaggc

SEQ ID NO: 2343799 - RNA, 20 nt, Bordetella pertussis
ccggccugcaggcucuugac

SEQ ID NO: 2343800 - RNA, 17 nt, Bordetella pertussis
ccggccugcaggugccg

SEQ ID NO: 2343801 - RNA, 14 nt, Bordetella pertussis
ccggccugccggcg

SEQ ID NO: 2343802 - RNA, 15 nt, Bordetella pertussis
ccggccugccggcgc

SEQ ID NO: 2343803 - RNA, 20 nt, Bordetella pertussis
ccggccugcgccagcuccag

SEQ ID NO: 2343804 - RNA, 22 nt, Bordetella pertussis
ccggccugcgccagcuccagcc

SEQ ID NO: 2343805 - RNA, 18 nt, Bordetella pertussis
ccggccugcgccgggcgc

SEQ ID NO: 2343806 - RNA, 15 nt, Bordetella pertussis
ccggccugcgcgccg

SEQ ID NO: 2343807 - RNA, 16 nt, Bordetella pertussis
ccggccugcgcgccgg

SEQ ID NO: 2343808 - RNA, 17 nt, Bordetella pertussis
ccggccugcgcgccggg

SEQ ID NO: 2343809 - RNA, 19 nt, Bordetella pertussis
ccggccugcgggcgccgcg

SEQ ID NO: 2343810 - RNA, 20 nt, Bordetella pertussis
ccggccugcgggcgccgcgg

SEQ ID NO: 2343811 - RNA, 16 nt, Bordetella pertussis
ccggccugcgucgcca

SEQ ID NO: 2343812 - RNA, 19 nt, Bordetella pertussis
ccggccugcgucgccaccu

SEQ ID NO: 2343813 - RNA, 15 nt, Bordetella pertussis
ccggccugcugcagc

SEQ ID NO: 2343814 - RNA, 17 nt, Bordetella pertussis
ccggccugcuuggccgc

SEQ ID NO: 2343815 - RNA, 14 nt, Bordetella pertussis
ccggccuggcgcga

SEQ ID NO: 2343816 - RNA, 17 nt, Bordetella pertussis
ccggccuggcgcgacgc

SEQ ID NO: 2343817 - RNA, 14 nt, Bordetella pertussis
ccggccuggcgggc

SEQ ID NO: 2343818 - RNA, 17 nt, Bordetella pertussis
ccggccugggcggcggc

SEQ ID NO: 2343819 - RNA, 21 nt, Bordetella pertussis
ccggccuggggacgggcgcac

SEQ ID NO: 2343820 - RNA, 19 nt, Bordetella pertussis
ccggccuugcugaaccugc

SEQ ID NO: 2343821 - RNA, 16 nt, Bordetella pertussis
ccggcgaagccggcac

SEQ ID NO: 2343822 - RNA, 20 nt, Bordetella pertussis
ccggcgaaugccggccgaua

SEQ ID NO: 2343823 - RNA, 16 nt, Bordetella pertussis
ccggcgacaccgcggc

SEQ ID NO: 2343824 - RNA, 23 nt, Bordetella pertussis
ccggcgacaccgcggccuugccg

SEQ ID NO: 2343825 - RNA, 19 nt, Bordetella pertussis
ccggcgaccaccgauccga

SEQ ID NO: 2343826 - RNA, 13 nt, Bordetella pertussis
ccggcgacgccgc

SEQ ID NO: 2343827 - RNA, 14 nt, Bordetella pertussis
ccggcgacgccgcg

SEQ ID NO: 2343828 - RNA, 20 nt, Bordetella pertussis
ccggcgacgccgcggugcug

SEQ ID NO: 2343829 - RNA, 21 nt, Bordetella pertussis
ccggcgacgccgcggugcugg

SEQ ID NO: 2343830 - RNA, 19 nt, Bordetella pertussis
ccggcgacggcaucgauuu

SEQ ID NO: 2343831 - RNA, 15 nt, Bordetella pertussis
ccggcgacguggcgc

SEQ ID NO: 2343832 - RNA, 16 nt, Bordetella pertussis
ccggcgacguggugug

SEQ ID NO: 2343833 - RNA, 15 nt, Bordetella pertussis
ccggcgacuuccgcu

SEQ ID NO: 2343834 - RNA, 19 nt, Bordetella pertussis
ccggcgagaacgcggccgc

SEQ ID NO: 2343835 - RNA, 17 nt, Bordetella pertussis
ccggcgagacgucggcg

SEQ ID NO: 2343836 - RNA, 20 nt, Bordetella pertussis
ccggcgagacgucggcgaug

SEQ ID NO: 2343837 - RNA, 22 nt, Bordetella pertussis
ccggcgagacgucggcgauggc

SEQ ID NO: 2343838 - RNA, 24 nt, Bordetella pertussis
ccggcgagacgucggcgauggccc

SEQ ID NO: 2343839 - RNA, 15 nt, Bordetella pertussis
ccggcgagcauggcg

SEQ ID NO: 2343840 - RNA, 14 nt, Bordetella pertussis
ccggcgaggccgcc

SEQ ID NO: 2343841 - RNA, 16 nt, Bordetella pertussis
ccggcgauauggccag

SEQ ID NO: 2343842 - RNA, 18 nt, Bordetella pertussis
ccggcgauauggccaggg

SEQ ID NO: 2343843 - RNA, 18 nt, Bordetella pertussis
ccggcgaucacgccgaag

SEQ ID NO: 2343844 - RNA, 22 nt, Bordetella pertussis
ccggcgaugaagucgcggcccg

SEQ ID NO: 2343845 - RNA, 19 nt, Bordetella pertussis
ccggcgaugaucgccucgg

SEQ ID NO: 2343846 - RNA, 20 nt, Bordetella pertussis
ccggcgaugauggggucgcc

SEQ ID NO: 2343847 - RNA, 22 nt, Bordetella pertussis
ccggcgaugauggggucgccgg

SEQ ID NO: 2343848 - RNA, 23 nt, Bordetella pertussis
ccggcgaugauggggucgccggg

SEQ ID NO: 2343849 - RNA, 22 nt, Bordetella pertussis
ccggcgauggcguugcgcacca

SEQ ID NO: 2343850 - RNA, 13 nt, Bordetella pertussis
ccggcgcacgccc

SEQ ID NO: 2343851 - RNA, 14 nt, Bordetella pertussis
ccggcgcacgcccc

SEQ ID NO: 2343852 - RNA, 18 nt, Bordetella pertussis
ccggcgcacgccccgacg

SEQ ID NO: 2343853 - RNA, 19 nt, Bordetella pertussis
ccggcgcaguuccggcggg

SEQ ID NO: 2343854 - RNA, 22 nt, Bordetella pertussis
ccggcgcaguuccggcgggccg

SEQ ID NO: 2343855 - RNA, 12 nt, Bordetella pertussis
ccggcgcaugcu

SEQ ID NO: 2343856 - RNA, 20 nt, Bordetella pertussis
ccggcgccagcaugcgcgcg

SEQ ID NO: 2343857 - RNA, 14 nt, Bordetella pertussis
ccggcgccagccag

SEQ ID NO: 2343858 - RNA, 13 nt, Bordetella pertussis
ccggcgccagccg

SEQ ID NO: 2343859 - RNA, 17 nt, Bordetella pertussis
ccggcgccagccgcucc

SEQ ID NO: 2343860 - RNA, 16 nt, Bordetella pertussis
ccggcgcccccagcag

SEQ ID NO: 2343861 - RNA, 13 nt, Bordetella pertussis
ccggcgcccgccg

SEQ ID NO: 2343862 - RNA, 14 nt, Bordetella pertussis
ccggcgcccgccgc

SEQ ID NO: 2343863 - RNA, 16 nt, Bordetella pertussis
ccggcgcccgccgccg

SEQ ID NO: 2343864 - RNA, 17 nt, Bordetella pertussis
ccggcgcccgccgccgg

SEQ ID NO: 2343865 - RNA, 23 nt, Bordetella pertussis
ccggcgcccgccgccgggcgcgc

SEQ ID NO: 2343866 - RNA, 13 nt, Bordetella pertussis
ccggcgcccggca

SEQ ID NO: 2343867 - RNA, 18 nt, Bordetella pertussis
ccggcgcccggcagccga

SEQ ID NO: 2343868 - RNA, 21 nt, Bordetella pertussis
ccggcgcccucuuucgccgcg

SEQ ID NO: 2343869 - RNA, 15 nt, Bordetella pertussis
ccggcgccgacgcgc

SEQ ID NO: 2343870 - RNA, 18 nt, Bordetella pertussis
ccggcgccgacgcgcugg

SEQ ID NO: 2343871 - RNA, 12 nt, Bordetella pertussis
ccggcgccgccg

SEQ ID NO: 2343872 - RNA, 13 nt, Bordetella pertussis
ccggcgccgccgg

SEQ ID NO: 2343873 - RNA, 14 nt, Bordetella pertussis
ccggcgccgccggg

SEQ ID NO: 2343874 - RNA, 16 nt, Bordetella pertussis
ccggcgccgccggguu

SEQ ID NO: 2343875 - RNA, 18 nt, Bordetella pertussis
ccggcgccgccucaggcc

SEQ ID NO: 2343876 - RNA, 21 nt, Bordetella pertussis
ccggcgccgccucaggccggc

SEQ ID NO: 2343877 - RNA, 23 nt, Bordetella pertussis
ccggcgccgccucaggccggcgc

SEQ ID NO: 2343878 - RNA, 15 nt, Bordetella pertussis
ccggcgccgcgcgcu

SEQ ID NO: 2343879 - RNA, 17 nt, Bordetella pertussis
ccggcgccgcgcgcugg

SEQ ID NO: 2343880 - RNA, 16 nt, Bordetella pertussis
ccggcgccggcaaacc

SEQ ID NO: 2343881 - RNA, 18 nt, Bordetella pertussis
ccggcgccggcaaacccg

SEQ ID NO: 2343882 - RNA, 21 nt, Bordetella pertussis
ccggcgccggcaaacccggca

SEQ ID NO: 2343883 - RNA, 16 nt, Bordetella pertussis
ccggcgccggcgcgcc

SEQ ID NO: 2343884 - RNA, 18 nt, Bordetella pertussis
ccggcgccggcgcgccgc

SEQ ID NO: 2343885 - RNA, 12 nt, Bordetella pertussis
ccggcgccggcu

SEQ ID NO: 2343886 - RNA, 22 nt, Bordetella pertussis
ccggcgccgucuucgguggccc

SEQ ID NO: 2343887 - RNA, 20 nt, Bordetella pertussis
ccggcgccguuuucagcgca

SEQ ID NO: 2343888 - RNA, 12 nt, Bordetella pertussis
ccggcgccugcg

SEQ ID NO: 2343889 - RNA, 18 nt, Bordetella pertussis
ccggcgccugcggcaugg

SEQ ID NO: 2343890 - RNA, 14 nt, Bordetella pertussis
ccggcgccuggccc

SEQ ID NO: 2343891 - RNA, 14 nt, Bordetella pertussis
ccggcgccuggggc

SEQ ID NO: 2343892 - RNA, 17 nt, Bordetella pertussis
ccggcgccuggggcggg

SEQ ID NO: 2343893 - RNA, 20 nt, Bordetella pertussis
ccggcgcgaacaccggcagg

SEQ ID NO: 2343894 - RNA, 20 nt, Bordetella pertussis
ccggcgcgaaccccuccggc

SEQ ID NO: 2343895 - RNA, 23 nt, Bordetella pertussis
ccggcgcgaaccccuccggcguu

SEQ ID NO: 2343896 - RNA, 17 nt, Bordetella pertussis
ccggcgcgacaggcggu

SEQ ID NO: 2343897 - RNA, 16 nt, Bordetella pertussis
ccggcgcgaccgccuc

SEQ ID NO: 2343898 - RNA, 20 nt, Bordetella pertussis
ccggcgcgaguaucccuacc

SEQ ID NO: 2343899 - RNA, 20 nt, Bordetella pertussis
ccggcgcgauggucaccacc

SEQ ID NO: 2343900 - RNA, 19 nt, Bordetella pertussis
ccggcgcgcaaaccgacgc

SEQ ID NO: 2343901 - RNA, 15 nt, Bordetella pertussis
ccggcgcgcagcgcc

SEQ ID NO: 2343902 - RNA, 18 nt, Bordetella pertussis
ccggcgcgcagcgccugc

SEQ ID NO: 2343903 - RNA, 21 nt, Bordetella pertussis
ccggcgcgcagcgccugcagg

SEQ ID NO: 2343904 - RNA, 19 nt, Bordetella pertussis
ccggcgcgcauccgguggu

SEQ ID NO: 2343905 - RNA, 20 nt, Bordetella pertussis
ccggcgcgcauccgguggug

SEQ ID NO: 2343906 - RNA, 15 nt, Bordetella pertussis
ccggcgcgcaucguc

SEQ ID NO: 2343907 - RNA, 16 nt, Bordetella pertussis
ccggcgcgccaggcca

SEQ ID NO: 2343908 - RNA, 16 nt, Bordetella pertussis
ccggcgcgcccagggg

SEQ ID NO: 2343909 - RNA, 21 nt, Bordetella pertussis
ccggcgcgcccaggggccggc

SEQ ID NO: 2343910 - RNA, 18 nt, Bordetella pertussis
ccggcgcgcccuugccgu

SEQ ID NO: 2343911 - RNA, 15 nt, Bordetella pertussis
ccggcgcgccgcccg

SEQ ID NO: 2343912 - RNA, 13 nt, Bordetella pertussis
ccggcgcgccggc

SEQ ID NO: 2343913 - RNA, 14 nt, Bordetella pertussis
ccggcgcgccggcc

SEQ ID NO: 2343914 - RNA, 15 nt, Bordetella pertussis
ccggcgcgccggccc

SEQ ID NO: 2343915 - RNA, 19 nt, Bordetella pertussis
ccggcgcgccggcccaagg

SEQ ID NO: 2343916 - RNA, 17 nt, Bordetella pertussis
ccggcgcgccggccgcg

SEQ ID NO: 2343917 - RNA, 20 nt, Bordetella pertussis
ccggcgcgccgggccagacc

SEQ ID NO: 2343918 - RNA, 15 nt, Bordetella pertussis
ccggcgcgccucggc

SEQ ID NO: 2343919 - RNA, 15 nt, Bordetella pertussis
ccggcgcgccugccg

SEQ ID NO: 2343920 - RNA, 16 nt, Bordetella pertussis
ccggcgcgccuggcgc

SEQ ID NO: 2343921 - RNA, 18 nt, Bordetella pertussis
ccggcgcgccuggcgcgc

SEQ ID NO: 2343922 - RNA, 14 nt, Bordetella pertussis
ccggcgcgcgcagg

SEQ ID NO: 2343923 - RNA, 16 nt, Bordetella pertussis
ccggcgcgcgcaggcg

SEQ ID NO: 2343924 - RNA, 18 nt, Bordetella pertussis
ccggcgcgcgcaugcccg

SEQ ID NO: 2343925 - RNA, 20 nt, Bordetella pertussis
ccggcgcgcgcaugcccgac

SEQ ID NO: 2343926 - RNA, 23 nt, Bordetella pertussis
ccggcgcgcgcaugcccgaccgc

SEQ ID NO: 2343927 - RNA, 18 nt, Bordetella pertussis
ccggcgcgcgcgaccacg

SEQ ID NO: 2343928 - RNA, 18 nt, Bordetella pertussis
ccggcgcgcgcgcgccgc

SEQ ID NO: 2343929 - RNA, 22 nt, Bordetella pertussis
ccggcgcgcgcgcgccgcacgc

SEQ ID NO: 2343930 - RNA, 14 nt, Bordetella pertussis
ccggcgcgcgcgua

SEQ ID NO: 2343931 - RNA, 22 nt, Bordetella pertussis
ccggcgcgcggaugaucgcgca

SEQ ID NO: 2343932 - RNA, 14 nt, Bordetella pertussis
ccggcgggggcggg

SEQ ID NO: 2343933 - RNA, 14 nt, Bordetella pertussis
ccggcggucacgcc

SEQ ID NO: 2343934 - RNA, 16 nt, Bordetella pertussis
ccggcggucacgccga

SEQ ID NO: 2343935 - RNA, 17 nt, Bordetella pertussis
ccggcggucccgagcgc

SEQ ID NO: 2343936 - RNA, 16 nt, Bordetella pertussis
ccggcggucgcgcugg

SEQ ID NO: 2343937 - RNA, 13 nt, Bordetella pertussis
ccggcggugaccu

SEQ ID NO: 2343938 - RNA, 21 nt, Bordetella pertussis
ccggcggugaugacgucgucg

SEQ ID NO: 2343939 - RNA, 17 nt, Bordetella pertussis
ccggcguagcugcgccg

SEQ ID NO: 2343940 - RNA, 19 nt, Bordetella pertussis
ccggcguagcugcgccgca

SEQ ID NO: 2343941 - RNA, 17 nt, Bordetella pertussis
ccggcguauggcccgcc

SEQ ID NO: 2343942 - RNA, 21 nt, Bordetella pertussis
ccggcgucaccuugggaucgu

SEQ ID NO: 2343943 - RNA, 23 nt, Bordetella pertussis
ccggcgucaccuugggaucgucc

SEQ ID NO: 2343944 - RNA, 20 nt, Bordetella pertussis
ccggcgucacgcggccgggc

SEQ ID NO: 2343945 - RNA, 17 nt, Bordetella pertussis
ccggcguccacggcauc

SEQ ID NO: 2343946 - RNA, 19 nt, Bordetella pertussis
ccggcguccugcggcggca

SEQ ID NO: 2343947 - RNA, 23 nt, Bordetella pertussis
ccggcguccugcggcggcagcuu

SEQ ID NO: 2343948 - RNA, 15 nt, Bordetella pertussis
ccggcgucgcucagg

SEQ ID NO: 2343949 - RNA, 18 nt, Bordetella pertussis
ccggcgucuggagcggcc

SEQ ID NO: 2343950 - RNA, 17 nt, Bordetella pertussis
ccggcgugacgcgcggg

SEQ ID NO: 2343951 - RNA, 21 nt, Bordetella pertussis
ccggcgugacgcgcgggucca

SEQ ID NO: 2343952 - RNA, 17 nt, Bordetella pertussis
ccggcgugacgcugacc

SEQ ID NO: 2343953 - RNA, 19 nt, Bordetella pertussis
ccggcgugacguggcccac

SEQ ID NO: 2343954 - RNA, 19 nt, Bordetella pertussis
ccggcgugauggacgccgg

SEQ ID NO: 2343955 - RNA, 20 nt, Bordetella pertussis
ccggcgugauggacgccggg

SEQ ID NO: 2343956 - RNA, 18 nt, Bordetella pertussis
ccggcgugcagagcacca

SEQ ID NO: 2343957 - RNA, 15 nt, Bordetella pertussis
ccggcgugccaugga

SEQ ID NO: 2343958 - RNA, 14 nt, Bordetella pertussis
ccggcgugcgcugg

SEQ ID NO: 2343959 - RNA, 17 nt, Bordetella pertussis
ccggcgugcgcuggcug

SEQ ID NO: 2343960 - RNA, 21 nt, Bordetella pertussis
ccggcgugcgcuggcugggcc

SEQ ID NO: 2343961 - RNA, 12 nt, Bordetella pertussis
ccggcgugcugu

SEQ ID NO: 2343962 - RNA, 21 nt, Bordetella pertussis
ccggcgugcuguccgucucgg

SEQ ID NO: 2343963 - RNA, 21 nt, Bordetella pertussis
ccggcguggccugcccgucgg

SEQ ID NO: 2343964 - RNA, 15 nt, Bordetella pertussis
ccggcguggcgcgca

SEQ ID NO: 2343965 - RNA, 18 nt, Bordetella pertussis
ccggcgugguaucgcgcc

SEQ ID NO: 2343966 - RNA, 20 nt, Bordetella pertussis
ccggcgugguaucgcgccag

SEQ ID NO: 2343967 - RNA, 18 nt, Bordetella pertussis
ccggcguguccagcggcg

SEQ ID NO: 2343968 - RNA, 21 nt, Bordetella pertussis
ccggcguguccagcggcgcca

SEQ ID NO: 2343969 - RNA, 23 nt, Bordetella pertussis
ccggcguguccagcggcgccagc

SEQ ID NO: 2343970 - RNA, 19 nt, Bordetella pertussis
ccggcguguucagcgcgcg

SEQ ID NO: 2343971 - RNA, 16 nt, Bordetella pertussis
ccggcguucaccagga

SEQ ID NO: 2343972 - RNA, 24 nt, Bordetella pertussis
ccggcguucaccaggaagcgcgcc

SEQ ID NO: 2343973 - RNA, 17 nt, Bordetella pertussis
ccggcguucuggcgcag

SEQ ID NO: 2343974 - RNA, 20 nt, Bordetella pertussis
ccggcguucuggucagccgu

SEQ ID NO: 2343975 - RNA, 18 nt, Bordetella pertussis
ccggcguucuucagcgcg

SEQ ID NO: 2343976 - RNA, 18 nt, Bordetella pertussis
ccggcguugccgaagcgu

SEQ ID NO: 2343977 - RNA, 22 nt, Bordetella pertussis
ccggcguugccgaagcgucggc

SEQ ID NO: 2343978 - RNA, 23 nt, Bordetella pertussis
ccggcguugccgaagcgucggcc

SEQ ID NO: 2343979 - RNA, 15 nt, Bordetella pertussis
ccggcguuggccggg

SEQ ID NO: 2343980 - RNA, 18 nt, Bordetella pertussis
ccggcguuggccgggucg

SEQ ID NO: 2343981 - RNA, 21 nt, Bordetella pertussis
ccggcguuggccgggucgcgc

SEQ ID NO: 2343982 - RNA, 22 nt, Bordetella pertussis
ccggcguuggccgggucgcgca

SEQ ID NO: 2343983 - RNA, 17 nt, Bordetella pertussis
ccggcuacagcucgccg

SEQ ID NO: 2343984 - RNA, 20 nt, Bordetella pertussis
ccggcuacagcucgccggcg

SEQ ID NO: 2343985 - RNA, 22 nt, Bordetella pertussis
ccggcuacagcucgccggcgau

SEQ ID NO: 2343986 - RNA, 13 nt, Bordetella pertussis
ccggcuaccgcgc

SEQ ID NO: 2343987 - RNA, 15 nt, Bordetella pertussis
ccggcuaccgcgcca

SEQ ID NO: 2343988 - RNA, 13 nt, Bordetella pertussis
ccggcuacggcaa

SEQ ID NO: 2343989 - RNA, 16 nt, Bordetella pertussis
ccggcuauaccgggcu

SEQ ID NO: 2343990 - RNA, 12 nt, Bordetella pertussis
ccggcucagccc

SEQ ID NO: 2343991 - RNA, 16 nt, Bordetella pertussis
ccggcucaggccagcg

SEQ ID NO: 2343992 - RNA, 21 nt, Bordetella pertussis
ccggcucaggccagcgacccg

SEQ ID NO: 2343993 - RNA, 19 nt, Bordetella pertussis
ccggcucauucggcgcgcu

SEQ ID NO: 2343994 - RNA, 14 nt, Bordetella pertussis
ccggcuccaggccg

SEQ ID NO: 2343995 - RNA, 16 nt, Bordetella pertussis
ccggcuccaggccgcc

SEQ ID NO: 2343996 - RNA, 15 nt, Bordetella pertussis
ccggcucccgcgcca

SEQ ID NO: 2343997 - RNA, 18 nt, Bordetella pertussis
ccggcuccgauagcggcg

SEQ ID NO: 2343998 - RNA, 19 nt, Bordetella pertussis
ccggcuccgauagcggcgc

SEQ ID NO: 2343999 - RNA, 14 nt, Bordetella pertussis
ccggcuccggccgc

SEQ ID NO: 2344000 - RNA, 16 nt, Bordetella pertussis
ccggcucgaucgccgc

SEQ ID NO: 2344001 - RNA, 17 nt, Bordetella pertussis
ccggcucgaucgccgcc

SEQ ID NO: 2344002 - RNA, 18 nt, Bordetella pertussis
ccggcucgaucgccgccg

SEQ ID NO: 2344003 - RNA, 19 nt, Bordetella pertussis
ccggcucgaucgccgccgg

SEQ ID NO: 2344004 - RNA, 20 nt, Bordetella pertussis
ccggcucgaucgccgccggc

SEQ ID NO: 2344005 - RNA, 21 nt, Bordetella pertussis
ccggcucgaucgccgccggca

SEQ ID NO: 2344006 - RNA, 20 nt, Bordetella pertussis
ccggcucgcugucgugccgc

SEQ ID NO: 2344007 - RNA, 13 nt, Bordetella pertussis
ccggcucggaccu

SEQ ID NO: 2344008 - RNA, 12 nt, Bordetella pertussis
ccggcucuucca

SEQ ID NO: 2344009 - RNA, 16 nt, Bordetella pertussis
ccggcugcaagacgcc

SEQ ID NO: 2344010 - RNA, 23 nt, Bordetella pertussis
ccggcugcaagacgcccaggccc

SEQ ID NO: 2344011 - RNA, 22 nt, Bordetella pertussis
ccggcugcaccagcgcgccgcg

SEQ ID NO: 2344012 - RNA, 18 nt, Bordetella pertussis
ccggcugcaugcgcgaac

SEQ ID NO: 2344013 - RNA, 22 nt, Bordetella pertussis
ccggcugcaugcgcgaacgcgc

SEQ ID NO: 2344014 - RNA, 21 nt, Bordetella pertussis
ccggcugccgcggauugccgu

SEQ ID NO: 2344015 - RNA, 14 nt, Bordetella pertussis
ccggcugcgcgccg

SEQ ID NO: 2344016 - RNA, 17 nt, Bordetella pertussis
ccggcugcgcgccgacc

SEQ ID NO: 2344017 - RNA, 14 nt, Bordetella pertussis
ccggcugcgcgcgc

SEQ ID NO: 2344018 - RNA, 17 nt, Bordetella pertussis
ccggcugcgcgcgcagc

SEQ ID NO: 2344019 - RNA, 20 nt, Bordetella pertussis
ccggcugcgcgcgcagccag

SEQ ID NO: 2344020 - RNA, 19 nt, Bordetella pertussis
ccggcugcuugcccagcgg

SEQ ID NO: 2344021 - RNA, 18 nt, Bordetella pertussis
ccggcuggauggugccgc

SEQ ID NO: 2344022 - RNA, 23 nt, Bordetella pertussis
ccggcuggauggugccgccgccc

SEQ ID NO: 2344023 - RNA, 13 nt, Bordetella pertussis
ccggcuggcgcac

SEQ ID NO: 2344024 - RNA, 22 nt, Bordetella pertussis
ccggcugggcggccuuggccgc

SEQ ID NO: 2344025 - RNA, 13 nt, Bordetella pertussis
ccggcugggcguu

SEQ ID NO: 2344026 - RNA, 22 nt, Bordetella pertussis
ccggcuuccagcagcaugccgc

SEQ ID NO: 2344027 - RNA, 23 nt, Bordetella pertussis
ccggcuuccagcagcaugccgcg

SEQ ID NO: 2344028 - RNA, 15 nt, Bordetella pertussis
ccggcuucgucaugg

SEQ ID NO: 2344029 - RNA, 20 nt, Bordetella pertussis
ccggcuucugggucagcuuc

SEQ ID NO: 2344030 - RNA, 17 nt, Bordetella pertussis
ccggcuugcgcaagccg

SEQ ID NO: 2344031 - RNA, 22 nt, Bordetella pertussis
ccggcuugcgcaagccggccgc

SEQ ID NO: 2344032 - RNA, 21 nt, Bordetella pertussis
ccggcuugcgccagccacgcg

SEQ ID NO: 2344033 - RNA, 17 nt, Bordetella pertussis
ccggcuuggccucggcc

SEQ ID NO: 2344034 - RNA, 17 nt, Bordetella pertussis
ccggcuugggcgugccc

SEQ ID NO: 2344035 - RNA, 16 nt, Bordetella pertussis
ccggcuuggggcgcgc

SEQ ID NO: 2344036 - RNA, 19 nt, Bordetella pertussis
ccggcuuggggcgcgccgc

SEQ ID NO: 2344037 - RNA, 21 nt, Bordetella pertussis
ccggcuuggggcgcgccgcgg

SEQ ID NO: 2344038 - RNA, 16 nt, Bordetella pertussis
ccggcuuucagcgccg

SEQ ID NO: 2344039 - RNA, 17 nt, Bordetella pertussis
ccggcuuuggacaggcg

SEQ ID NO: 2344040 - RNA, 21 nt, Bordetella pertussis
ccggcuuuggacaggcgugcg

SEQ ID NO: 2344041 - RNA, 21 nt, Bordetella pertussis
ccgggaaaaagagccuguccc

SEQ ID NO: 2344042 - RNA, 14 nt, Bordetella pertussis
ccgggacaggcacc

SEQ ID NO: 2344043 - RNA, 22 nt, Bordetella pertussis
ccgggacaggcacccgcgcgca

SEQ ID NO: 2344044 - RNA, 13 nt, Bordetella pertussis
ccgggcuggaucc

SEQ ID NO: 2344045 - RNA, 19 nt, Bordetella pertussis
ccgggcuggccgccugcug

SEQ ID NO: 2344046 - RNA, 20 nt, Bordetella pertussis
ccgggcuggccgccugcugc

SEQ ID NO: 2344047 - RNA, 20 nt, Bordetella pertussis
ccgggcuggugcgccgugcc

SEQ ID NO: 2344048 - RNA, 18 nt, Bordetella pertussis
ccgggcuguccgccacca

SEQ ID NO: 2344049 - RNA, 18 nt, Bordetella pertussis
ccgggcuugcgcaccccg

SEQ ID NO: 2344050 - RNA, 21 nt, Bordetella pertussis
ccgggcuuucggucucgcgcg

SEQ ID NO: 2344051 - RNA, 23 nt, Bordetella pertussis
ccgggcuuuuuccuguucggcca

SEQ ID NO: 2344052 - RNA, 15 nt, Bordetella pertussis
ccggggaagccgccg

SEQ ID NO: 2344053 - RNA, 19 nt, Bordetella pertussis
ccggggaggccucgacgcu

SEQ ID NO: 2344054 - RNA, 19 nt, Bordetella pertussis
ccggggcacccaggcgggc

SEQ ID NO: 2344055 - RNA, 20 nt, Bordetella pertussis
ccggggcacccaggcgggcu

SEQ ID NO: 2344056 - RNA, 21 nt, Bordetella pertussis
ccggggcacccaggcgggcug

SEQ ID NO: 2344057 - RNA, 15 nt, Bordetella pertussis
ccggggccauggcag

SEQ ID NO: 2344058 - RNA, 21 nt, Bordetella pertussis
ccggggcccgcgggcgcccgg

SEQ ID NO: 2344059 - RNA, 13 nt, Bordetella pertussis
ccggggccgcccu

SEQ ID NO: 2344060 - RNA, 16 nt, Bordetella pertussis
ccggggccgcccugcc

SEQ ID NO: 2344061 - RNA, 15 nt, Bordetella pertussis
ccggggccgcccugg

SEQ ID NO: 2344062 - RNA, 16 nt, Bordetella pertussis
ccggggcgagcgcagc

SEQ ID NO: 2344063 - RNA, 18 nt, Bordetella pertussis
ccggggcgagcgcagccg

SEQ ID NO: 2344064 - RNA, 15 nt, Bordetella pertussis
ccggggcgcaccggc

SEQ ID NO: 2344065 - RNA, 16 nt, Bordetella pertussis
ccggggcgcaccggca

SEQ ID NO: 2344066 - RNA, 19 nt, Bordetella pertussis
ccggggcgcaccggcacgc

SEQ ID NO: 2344067 - RNA, 21 nt, Bordetella pertussis
ccggggcgcaccggcacgcgc

SEQ ID NO: 2344068 - RNA, 20 nt, Bordetella pertussis
ccggggcgccggugucggcc

SEQ ID NO: 2344069 - RNA, 23 nt, Bordetella pertussis
ccggggcggcggcgcccgcaugg

SEQ ID NO: 2344070 - RNA, 15 nt, Bordetella pertussis
ccggggcgggcgcgg

SEQ ID NO: 2344071 - RNA, 15 nt, Bordetella pertussis
ccggggcgucgucgc

SEQ ID NO: 2344072 - RNA, 14 nt, Bordetella pertussis
ccggggcguggccg

SEQ ID NO: 2344073 - RNA, 16 nt, Bordetella pertussis
ccggggggcgcacgcc

SEQ ID NO: 2344074 - RNA, 18 nt, Bordetella pertussis
ccggggggcgcacgccgc

SEQ ID NO: 2344075 - RNA, 14 nt, Bordetella pertussis
ccggggucagcgcc

SEQ ID NO: 2344076 - RNA, 22 nt, Bordetella pertussis
ccgggguccugaggccaggccg

SEQ ID NO: 2344077 - RNA, 18 nt, Bordetella pertussis
ccggggucuugccgcgca

SEQ ID NO: 2344078 - RNA, 19 nt, Bordetella pertussis
ccgggguugccaagauggc

SEQ ID NO: 2344079 - RNA, 19 nt, Bordetella pertussis
ccgggguugggaucgcgcc

SEQ ID NO: 2344080 - RNA, 21 nt, Bordetella pertussis
ccggguaauggcgcuccagcc

SEQ ID NO: 2344081 - RNA, 13 nt, Bordetella pertussis
ccggguacguggc

SEQ ID NO: 2344082 - RNA, 17 nt, Bordetella pertussis
ccggguccggccgcgca

SEQ ID NO: 2344083 - RNA, 12 nt, Bordetella pertussis
ccgggucgagcg

SEQ ID NO: 2344084 - RNA, 22 nt, Bordetella pertussis
ccgggucgcgcagcagggccug

SEQ ID NO: 2344085 - RNA, 14 nt, Bordetella pertussis
ccgggucgcggcac

SEQ ID NO: 2344086 - RNA, 20 nt, Bordetella pertussis
ccgggucgcugugcgcggcg

SEQ ID NO: 2344087 - RNA, 22 nt, Bordetella pertussis
ccgggucgcugugcgcggcgaa

SEQ ID NO: 2344088 - RNA, 23 nt, Bordetella pertussis
ccgggucgcugugcgcggcgaaa

SEQ ID NO: 2344089 - RNA, 13 nt, Bordetella pertussis
ccgggucgucggg

SEQ ID NO: 2344090 - RNA, 19 nt, Bordetella pertussis
ccgggucgucgggcggcgc

SEQ ID NO: 2344091 - RNA, 21 nt, Bordetella pertussis
ccgggucgucgggcggcgcga

SEQ ID NO: 2344092 - RNA, 19 nt, Bordetella pertussis
ccgggucuggccggccgcg

SEQ ID NO: 2344093 - RNA, 20 nt, Bordetella pertussis
ccgggucuggccggccgcgu

SEQ ID NO: 2344094 - RNA, 20 nt, Bordetella pertussis
ccgggugaaguugucgucgg

SEQ ID NO: 2344095 - RNA, 21 nt, Bordetella pertussis
ccgggugaaguugucgucggg

SEQ ID NO: 2344096 - RNA, 18 nt, Bordetella pertussis
ccgggugaucaguccgac

SEQ ID NO: 2344097 - RNA, 21 nt, Bordetella pertussis
ccgggugccuguccccgccgg

SEQ ID NO: 2344098 - RNA, 22 nt, Bordetella pertussis
ccgggugccuguccccgccggg

SEQ ID NO: 2344099 - RNA, 16 nt, Bordetella pertussis
ccggguggcgccaugu

SEQ ID NO: 2344100 - RNA, 18 nt, Bordetella pertussis
ccggguggguucgggcgu

SEQ ID NO: 2344101 - RNA, 18 nt, Bordetella pertussis
ccggguggucgcgcccgc

SEQ ID NO: 2344102 - RNA, 23 nt, Bordetella pertussis
ccggguggucgcgcccgccgugg

SEQ ID NO: 2344103 - RNA, 19 nt, Bordetella pertussis
ccggguguggggggucagg

SEQ ID NO: 2344104 - RNA, 21 nt, Bordetella pertussis
ccggguguggggggucaggcc

SEQ ID NO: 2344105 - RNA, 18 nt, Bordetella pertussis
ccggguguuccggcgcgc

SEQ ID NO: 2344106 - RNA, 19 nt, Bordetella pertussis
ccggguguuccggcgcgcg

SEQ ID NO: 2344107 - RNA, 22 nt, Bordetella pertussis
ccggguugcaggaugcgcggca

SEQ ID NO: 2344108 - RNA, 19 nt, Bordetella pertussis
ccggguugcccggcaggca

SEQ ID NO: 2344109 - RNA, 22 nt, Bordetella pertussis
ccggguuggcguccaggcgcgc

SEQ ID NO: 2344110 - RNA, 15 nt, Bordetella pertussis
ccggguuuccagccc

SEQ ID NO: 2344111 - RNA, 13 nt, Bordetella pertussis
ccggguuucggca

SEQ ID NO: 2344112 - RNA, 19 nt, Bordetella pertussis
ccggguuucucgacgcaau

SEQ ID NO: 2344113 - RNA, 20 nt, Bordetella pertussis
ccgguaaccgacgcagcgca

SEQ ID NO: 2344114 - RNA, 22 nt, Bordetella pertussis
ccgguaaggcgcuugcgcaggg

SEQ ID NO: 2344115 - RNA, 16 nt, Bordetella pertussis
ccgguacagccaggcc

SEQ ID NO: 2344116 - RNA, 15 nt, Bordetella pertussis
ccgguacgccugcac

SEQ ID NO: 2344117 - RNA, 12 nt, Bordetella pertussis
ccgguagcgcug

SEQ ID NO: 2344118 - RNA, 13 nt, Bordetella pertussis
ccgguagcgcugg

SEQ ID NO: 2344119 - RNA, 14 nt, Bordetella pertussis
ccgguagcgcuggg

SEQ ID NO: 2344120 - RNA, 16 nt, Bordetella pertussis
ccgguaggccacgcgc

SEQ ID NO: 2344121 - RNA, 22 nt, Bordetella pertussis
ccgguauccuggcgcggacauc

SEQ ID NO: 2344122 - RNA, 14 nt, Bordetella pertussis
ccgguaucgacgcg

SEQ ID NO: 2344123 - RNA, 17 nt, Bordetella pertussis
ccgguaucgacgcgcgu

SEQ ID NO: 2344124 - RNA, 16 nt, Bordetella pertussis
ccgguaucgcggcgca

SEQ ID NO: 2344125 - RNA, 14 nt, Bordetella pertussis
ccgguaugccugcc

SEQ ID NO: 2344126 - RNA, 19 nt, Bordetella pertussis
ccgguaugccugccagccc

SEQ ID NO: 2344127 - RNA, 21 nt, Bordetella pertussis
ccgguauuccucgacgauggc

SEQ ID NO: 2344128 - RNA, 23 nt, Bordetella pertussis
ccggucaaucuauacaacgcggu

SEQ ID NO: 2344129 - RNA, 14 nt, Bordetella pertussis
ccggucaccgccgc

SEQ ID NO: 2344130 - RNA, 21 nt, Bordetella pertussis
ccggucacgcugguggccacc

SEQ ID NO: 2344131 - RNA, 21 nt, Bordetella pertussis
ccggucacguacucgccgucg

SEQ ID NO: 2344132 - RNA, 19 nt, Bordetella pertussis
ccggucacugccgaaacgc

SEQ ID NO: 2344133 - RNA, 15 nt, Bordetella pertussis
ccggucagcccaggc

SEQ ID NO: 2344134 - RNA, 17 nt, Bordetella pertussis
ccggucagcccaggcgg

SEQ ID NO: 2344135 - RNA, 18 nt, Bordetella pertussis
ccggucagcccaggcggg

SEQ ID NO: 2344136 - RNA, 13 nt, Bordetella pertussis
ccggucaggaugc

SEQ ID NO: 2344137 - RNA, 24 nt, Bordetella pertussis
ccggucaggaugcgcgccaggcug

SEQ ID NO: 2344138 - RNA, 23 nt, Bordetella pertussis
ccggucaggcgucguuggccgcg

SEQ ID NO: 2344139 - RNA, 12 nt, Bordetella pertussis
ccggucaugaag

SEQ ID NO: 2344140 - RNA, 20 nt, Bordetella pertussis
ccggucaugcaccugcaggg

SEQ ID NO: 2344141 - RNA, 14 nt, Bordetella pertussis
ccgguccaggccga

SEQ ID NO: 2344142 - RNA, 20 nt, Bordetella pertussis
ccgguccgacgguagccggg

SEQ ID NO: 2344143 - RNA, 23 nt, Bordetella pertussis
ccggucgacccucagcccgcacc

SEQ ID NO: 2344144 - RNA, 19 nt, Bordetella pertussis
ccggucgaucagggcgcgg

SEQ ID NO: 2344145 - RNA, 15 nt, Bordetella pertussis
ccggucgccagcgau

SEQ ID NO: 2344146 - RNA, 15 nt, Bordetella pertussis
ccggucgcccgccgc

SEQ ID NO: 2344147 - RNA, 13 nt, Bordetella pertussis
ccggucgccgcgg

SEQ ID NO: 2344148 - RNA, 16 nt, Bordetella pertussis
ccggucgccgcgggca

SEQ ID NO: 2344149 - RNA, 14 nt, Bordetella pertussis
ccggucgcggcguu

SEQ ID NO: 2344150 - RNA, 15 nt, Bordetella pertussis
ccggucggcccaggu

SEQ ID NO: 2344151 - RNA, 22 nt, Bordetella pertussis
ccggucggcccaggucaucgcc

SEQ ID NO: 2344152 - RNA, 15 nt, Bordetella pertussis
ccggucggccgcucc

SEQ ID NO: 2344153 - RNA, 17 nt, Bordetella pertussis
ccggucggccgcuccgc

SEQ ID NO: 2344154 - RNA, 23 nt, Bordetella pertussis
ccggucggccggcagcggcgcca

SEQ ID NO: 2344155 - RNA, 22 nt, Bordetella pertussis
ccggucguccccaauacccgcc

SEQ ID NO: 2344156 - RNA, 16 nt, Bordetella pertussis
cccagcacgcgcgcca

SEQ ID NO: 2344157 - RNA, 17 nt, Bordetella pertussis
cccagcacgcgcgccag

SEQ ID NO: 2344158 - RNA, 20 nt, Bordetella pertussis
cccagcacgcgcgccagcug

SEQ ID NO: 2344159 - RNA, 18 nt, Bordetella pertussis
cccagcagauaccggcau

SEQ ID NO: 2344160 - RNA, 14 nt, Bordetella pertussis
cccagcagcacgcc

SEQ ID NO: 2344161 - RNA, 15 nt, Bordetella pertussis
cccagcagcacgccc

SEQ ID NO: 2344162 - RNA, 12 nt, Bordetella pertussis
cccagcagcagc

SEQ ID NO: 2344163 - RNA, 21 nt, Bordetella pertussis
cccagcagcagcgagcccgcc

SEQ ID NO: 2344164 - RNA, 13 nt, Bordetella pertussis
cccagcagcaugg

SEQ ID NO: 2344165 - RNA, 21 nt, Bordetella pertussis
cccagcagcauggcgggcgag

SEQ ID NO: 2344166 - RNA, 13 nt, Bordetella pertussis
cccagcagcgccg

SEQ ID NO: 2344167 - RNA, 13 nt, Bordetella pertussis
cccagcagcggca

SEQ ID NO: 2344168 - RNA, 15 nt, Bordetella pertussis
cccagcagcggcagc

SEQ ID NO: 2344169 - RNA, 16 nt, Bordetella pertussis
cccagcagcggcagca

SEQ ID NO: 2344170 - RNA, 18 nt, Bordetella pertussis
cccagcagcggcagcagc

SEQ ID NO: 2344171 - RNA, 13 nt, Bordetella pertussis
cccagcagcuccu

SEQ ID NO: 2344172 - RNA, 22 nt, Bordetella pertussis
cccagcagcuccucggccugcc

SEQ ID NO: 2344173 - RNA, 15 nt, Bordetella pertussis
cccagcagguccugc

SEQ ID NO: 2344174 - RNA, 21 nt, Bordetella pertussis
cccagcaucugccccagcuug

SEQ ID NO: 2344175 - RNA, 15 nt, Bordetella pertussis
cccagcaugccgaug

SEQ ID NO: 2344176 - RNA, 21 nt, Bordetella pertussis
cccagcauggucggcauggcc

SEQ ID NO: 2344177 - RNA, 20 nt, Bordetella pertussis
cccagcaugugcgcggcguu

SEQ ID NO: 2344178 - RNA, 18 nt, Bordetella pertussis
cccagccaaugccgcggu

SEQ ID NO: 2344179 - RNA, 14 nt, Bordetella pertussis
cccagccagcccug

SEQ ID NO: 2344180 - RNA, 16 nt, Bordetella pertussis
cccagccaggcgccag

SEQ ID NO: 2344181 - RNA, 16 nt, Bordetella pertussis
cccagccccgcggccg

SEQ ID NO: 2344182 - RNA, 18 nt, Bordetella pertussis
cccagccccgcggccgcg

SEQ ID NO: 2344183 - RNA, 22 nt, Bordetella pertussis
cccagcccgccuuugccgcugg

SEQ ID NO: 2344184 - RNA, 13 nt, Bordetella pertussis
cccagcccugccc

SEQ ID NO: 2344185 - RNA, 14 nt, Bordetella pertussis
cccagcccugcccg

SEQ ID NO: 2344186 - RNA, 15 nt, Bordetella pertussis
cccagcccugcccgc

SEQ ID NO: 2344187 - RNA, 16 nt, Bordetella pertussis
cccagccgcagcaggc

SEQ ID NO: 2344188 - RNA, 18 nt, Bordetella pertussis
cccagccgcagcaggcgc

SEQ ID NO: 2344189 - RNA, 14 nt, Bordetella pertussis
cccagccgcaugcc

SEQ ID NO: 2344190 - RNA, 13 nt, Bordetella pertussis
cccagccgccuga

SEQ ID NO: 2344191 - RNA, 13 nt, Bordetella pertussis
cccagccgcgcca

SEQ ID NO: 2344192 - RNA, 15 nt, Bordetella pertussis
cccagccgcgccagg

SEQ ID NO: 2344193 - RNA, 12 nt, Bordetella pertussis
cccagccgcucg

SEQ ID NO: 2344194 - RNA, 15 nt, Bordetella pertussis
cccagccgcucggcc

SEQ ID NO: 2344195 - RNA, 20 nt, Bordetella pertussis
cccagccgcucggccacgcg

SEQ ID NO: 2344196 - RNA, 19 nt, Bordetella pertussis
cccagccggacccgcgccg

SEQ ID NO: 2344197 - RNA, 20 nt, Bordetella pertussis
cccagccggacccgcgccgc

SEQ ID NO: 2344198 - RNA, 21 nt, Bordetella pertussis
cccagccggacccgcgccgca

SEQ ID NO: 2344199 - RNA, 14 nt, Bordetella pertussis
cccagccggcggca

SEQ ID NO: 2344200 - RNA, 17 nt, Bordetella pertussis
cccagccggcggcaugc

SEQ ID NO: 2344201 - RNA, 21 nt, Bordetella pertussis
cccagccggcggcaugcgcca

SEQ ID NO: 2344202 - RNA, 23 nt, Bordetella pertussis
cccagccggcggcaugcgccagc

SEQ ID NO: 2344203 - RNA, 13 nt, Bordetella pertussis
cccagccgucgcg

SEQ ID NO: 2344204 - RNA, 18 nt, Bordetella pertussis
cccagccgucgcgcugca

SEQ ID NO: 2344205 - RNA, 13 nt, Bordetella pertussis
cccagccugccgg

SEQ ID NO: 2344206 - RNA, 14 nt, Bordetella pertussis
cccagccugccggc

SEQ ID NO: 2344207 - RNA, 15 nt, Bordetella pertussis
cccagcgacgagggc

SEQ ID NO: 2344208 - RNA, 12 nt, Bordetella pertussis
cccagcgagccg

SEQ ID NO: 2344209 - RNA, 17 nt, Bordetella pertussis
cccagcgagccggccag

SEQ ID NO: 2344210 - RNA, 22 nt, Bordetella pertussis
cccagcgagccggccagcgcca

SEQ ID NO: 2344211 - RNA, 14 nt, Bordetella pertussis
cccagcgagcugcg

SEQ ID NO: 2344212 - RNA, 18 nt, Bordetella pertussis
cccagcgagcuggugaug

SEQ ID NO: 2344213 - RNA, 15 nt, Bordetella pertussis
cccagcgcacgcagc

SEQ ID NO: 2344214 - RNA, 20 nt, Bordetella pertussis
cccagcgcacgcagcgcuca

SEQ ID NO: 2344215 - RNA, 18 nt, Bordetella pertussis
cccagcgcauaggacgcc

SEQ ID NO: 2344216 - RNA, 22 nt, Bordetella pertussis
cccagcgcauaggacgccacca

SEQ ID NO: 2344217 - RNA, 23 nt, Bordetella pertussis
cccagcgcauaggacgccaccag

SEQ ID NO: 2344218 - RNA, 12 nt, Bordetella pertussis
cccagcgccagc

SEQ ID NO: 2344219 - RNA, 13 nt, Bordetella pertussis
cccagcgccagca

SEQ ID NO: 2344220 - RNA, 15 nt, Bordetella pertussis
cccagcgccagcagc

SEQ ID NO: 2344221 - RNA, 16 nt, Bordetella pertussis
cccagcgcccaggcga

SEQ ID NO: 2344222 - RNA, 17 nt, Bordetella pertussis
cccagcgcccaggcgau

SEQ ID NO: 2344223 - RNA, 12 nt, Bordetella pertussis
cccagcgccgcc

SEQ ID NO: 2344224 - RNA, 14 nt, Bordetella pertussis
cccagcgccgccau

SEQ ID NO: 2344225 - RNA, 14 nt, Bordetella pertussis
cccagcgccgccga

SEQ ID NO: 2344226 - RNA, 13 nt, Bordetella pertussis
cccagcgccgcga

SEQ ID NO: 2344227 - RNA, 18 nt, Bordetella pertussis
cccagcgcgaugucgccc

SEQ ID NO: 2344228 - RNA, 22 nt, Bordetella pertussis
cccagcgcgaugucgcccaugc

SEQ ID NO: 2344229 - RNA, 19 nt, Bordetella pertussis
cccagcgcgauucccuggc

SEQ ID NO: 2344230 - RNA, 12 nt, Bordetella pertussis
cccagcgcgccu

SEQ ID NO: 2344231 - RNA, 23 nt, Bordetella pertussis
cccagcgcgccugcccaggccag

SEQ ID NO: 2344232 - RNA, 18 nt, Bordetella pertussis
cccagcgcggcggccaug

SEQ ID NO: 2344233 - RNA, 22 nt, Bordetella pertussis
cccagcgcguccugcacguccu

SEQ ID NO: 2344234 - RNA, 17 nt, Bordetella pertussis
cccagcgcgucggccag

SEQ ID NO: 2344235 - RNA, 19 nt, Bordetella pertussis
cccagcgcgucggccagcg

SEQ ID NO: 2344236 - RNA, 19 nt, Bordetella pertussis
cccagcgcgugggccagca

SEQ ID NO: 2344237 - RNA, 14 nt, Bordetella pertussis
cccagcgcucgucc

SEQ ID NO: 2344238 - RNA, 17 nt, Bordetella pertussis
cccagcgcuugcacgcc

SEQ ID NO: 2344239 - RNA, 19 nt, Bordetella pertussis
cccagcgcuugcacgccau

SEQ ID NO: 2344240 - RNA, 20 nt, Bordetella pertussis
cccagcggcaggcuggccgg

SEQ ID NO: 2344241 - RNA, 14 nt, Bordetella pertussis
cccagcggcgcacc

SEQ ID NO: 2344242 - RNA, 15 nt, Bordetella pertussis
cccagcggcgcaccg

SEQ ID NO: 2344243 - RNA, 21 nt, Bordetella pertussis
cccagcggcgcaccgacagca

SEQ ID NO: 2344244 - RNA, 22 nt, Bordetella pertussis
cccagcggcgcaccgacagcaa

SEQ ID NO: 2344245 - RNA, 22 nt, Bordetella pertussis
cccagcggcuggccacuggccg

SEQ ID NO: 2344246 - RNA, 17 nt, Bordetella pertussis
cccagcggcuggcgcac

SEQ ID NO: 2344247 - RNA, 20 nt, Bordetella pertussis
cccagcggcuggcgcacgau

SEQ ID NO: 2344248 - RNA, 18 nt, Bordetella pertussis
cccagcggggacaggcac

SEQ ID NO: 2344249 - RNA, 20 nt, Bordetella pertussis
cccagcggggacaggcacac

SEQ ID NO: 2344250 - RNA, 23 nt, Bordetella pertussis
cccagcggggacaggcaccccuc

SEQ ID NO: 2344251 - RNA, 16 nt, Bordetella pertussis
ccgcuccaccagcacc

SEQ ID NO: 2344252 - RNA, 16 nt, Bordetella pertussis
ccgcuccagccaccac

SEQ ID NO: 2344253 - RNA, 17 nt, Bordetella pertussis
ccgcuccagccaccacu

SEQ ID NO: 2344254 - RNA, 15 nt, Bordetella pertussis
ccgcuccaggcggcc

SEQ ID NO: 2344255 - RNA, 17 nt, Bordetella pertussis
ccgcuccaggcggccag

SEQ ID NO: 2344256 - RNA, 21 nt, Bordetella pertussis
ccgcuccaggcggccaguucg

SEQ ID NO: 2344257 - RNA, 21 nt, Bordetella pertussis
ccgcuccauguaaaaacccgg

SEQ ID NO: 2344258 - RNA, 23 nt, Bordetella pertussis
ccgcuccauguaaaaacccggcc

SEQ ID NO: 2344259 - RNA, 14 nt, Bordetella pertussis
ccggaacaccagca

SEQ ID NO: 2344260 - RNA, 17 nt, Bordetella pertussis
ccggaacaccagcaagc

SEQ ID NO: 2344261 - RNA, 21 nt, Bordetella pertussis
ccggaacaccagcaagccggc

SEQ ID NO: 2344262 - RNA, 23 nt, Bordetella pertussis
ccggaacaccagcaagccggcgg

SEQ ID NO: 2344263 - RNA, 14 nt, Bordetella pertussis
ccggaacaggcgcc

SEQ ID NO: 2344264 - RNA, 22 nt, Bordetella pertussis
ccggaacauggcggugaaggcg

SEQ ID NO: 2344265 - RNA, 16 nt, Bordetella pertussis
ccggaaucaccgccgc

SEQ ID NO: 2344266 - RNA, 18 nt, Bordetella pertussis
ccggaaucaccgccgcga

SEQ ID NO: 2344267 - RNA, 14 nt, Bordetella pertussis
ccggaauccacagc

SEQ ID NO: 2344268 - RNA, 20 nt, Bordetella pertussis
ccggaauccuggcgacggcc

SEQ ID NO: 2344269 - RNA, 15 nt, Bordetella pertussis
ccggaaugcaccacg

SEQ ID NO: 2344270 - RNA, 15 nt, Bordetella pertussis
ccggacaacgcgcgc

SEQ ID NO: 2344271 - RNA, 17 nt, Bordetella pertussis
ccggacaacgcgcgcca

SEQ ID NO: 2344272 - RNA, 19 nt, Bordetella pertussis
ccggacaacgcgcgccacu

SEQ ID NO: 2344273 - RNA, 13 nt, Bordetella pertussis
ccggacagggccg

SEQ ID NO: 2344274 - RNA, 15 nt, Bordetella pertussis
ccggacagggccgcg

SEQ ID NO: 2344275 - RNA, 16 nt, Bordetella pertussis
ccggacagggccgcga

SEQ ID NO: 2344276 - RNA, 14 nt, Bordetella pertussis
ccggacccgcgccg

SEQ ID NO: 2344277 - RNA, 15 nt, Bordetella pertussis
ccggacccgcgccgc

SEQ ID NO: 2344278 - RNA, 14 nt, Bordetella pertussis
ccggaccugggcau

SEQ ID NO: 2344279 - RNA, 21 nt, Bordetella pertussis
ccggaccuugcgaggcccggc

SEQ ID NO: 2344280 - RNA, 20 nt, Bordetella pertussis
ccggacgcaaaaacgcccgg

SEQ ID NO: 2344281 - RNA, 21 nt, Bordetella pertussis
ccggacgcaaaaacgcccggc

SEQ ID NO: 2344282 - RNA, 23 nt, Bordetella pertussis
ccggacgcaaaaacgcccggcgc

SEQ ID NO: 2344283 - RNA, 20 nt, Bordetella pertussis
ccggacgcaaccggucggcc

SEQ ID NO: 2344284 - RNA, 23 nt, Bordetella pertussis
ccggacgcaaccggucggccggc

SEQ ID NO: 2344285 - RNA, 12 nt, Bordetella pertussis
ccggacgccgac

SEQ ID NO: 2344286 - RNA, 16 nt, Bordetella pertussis
ccggacgcggccggca

SEQ ID NO: 2344287 - RNA, 21 nt, Bordetella pertussis
ccggacggcgccuugacgcug

SEQ ID NO: 2344288 - RNA, 23 nt, Bordetella pertussis
ccggacggguaucgucgaccugg

SEQ ID NO: 2344289 - RNA, 20 nt, Bordetella pertussis
ccggacugaacgcguccagg

SEQ ID NO: 2344290 - RNA, 23 nt, Bordetella pertussis
ccggacugaacgcguccaggccc

SEQ ID NO: 2344291 - RNA, 22 nt, Bordetella pertussis
ccggacuggauauggcgccgca

SEQ ID NO: 2344292 - RNA, 23 nt, Bordetella pertussis
ccggacuggauauggcgccgcac

SEQ ID NO: 2344293 - RNA, 14 nt, Bordetella pertussis
ccggacuggcgcgc

SEQ ID NO: 2344294 - RNA, 15 nt, Bordetella pertussis
ccggacuggcgcgca

SEQ ID NO: 2344295 - RNA, 16 nt, Bordetella pertussis
ccggagcagucgcgca

SEQ ID NO: 2344296 - RNA, 17 nt, Bordetella pertussis
ccggagcccgucaggcg

SEQ ID NO: 2344297 - RNA, 23 nt, Bordetella pertussis
ccggagcggcucgccgcuccggc

SEQ ID NO: 2344298 - RNA, 23 nt, Bordetella pertussis
ccggagcugccgaaucggccccu

SEQ ID NO: 2344299 - RNA, 12 nt, Bordetella pertussis
ccggaggccgcc

SEQ ID NO: 2344300 - RNA, 13 nt, Bordetella pertussis
ccggaggccgccc

SEQ ID NO: 2344301 - RNA, 15 nt, Bordetella pertussis
ccggaggccgcccac

SEQ ID NO: 2344302 - RNA, 13 nt, Bordetella pertussis
ccggaggcgccgc

SEQ ID NO: 2344303 - RNA, 14 nt, Bordetella pertussis
ccggaggcgcgcag

SEQ ID NO: 2344304 - RNA, 17 nt, Bordetella pertussis
ccggauaccgccgccgc

SEQ ID NO: 2344305 - RNA, 23 nt, Bordetella pertussis
ccggauaccgccgccgcucgucc

SEQ ID NO: 2344306 - RNA, 21 nt, Bordetella pertussis
ccggauacugcacgcggucca

SEQ ID NO: 2344307 - RNA, 17 nt, Bordetella pertussis
ccggauauggccggcgc

SEQ ID NO: 2344308 - RNA, 14 nt, Bordetella pertussis
ccggaucagcgccu

SEQ ID NO: 2344309 - RNA, 18 nt, Bordetella pertussis
ccggaucauugggucugc

SEQ ID NO: 2344310 - RNA, 20 nt, Bordetella pertussis
ccggaucauugggucugcgc

SEQ ID NO: 2344311 - RNA, 14 nt, Bordetella pertussis
ccggauccagcugc

SEQ ID NO: 2344312 - RNA, 13 nt, Bordetella pertussis
ccggaucccaggc

SEQ ID NO: 2344313 - RNA, 15 nt, Bordetella pertussis
ccggaucccaggccg

SEQ ID NO: 2344314 - RNA, 16 nt, Bordetella pertussis
ccggauccugcggcgc

SEQ ID NO: 2344315 - RNA, 13 nt, Bordetella pertussis
ccggaucgagcgc

SEQ ID NO: 2344316 - RNA, 15 nt, Bordetella pertussis
ccggaucgcacacac

SEQ ID NO: 2344317 - RNA, 22 nt, Bordetella pertussis
ccggaugagcuacccccugacc

SEQ ID NO: 2344318 - RNA, 23 nt, Bordetella pertussis
ccggaugcacguagcgcagcacc

SEQ ID NO: 2344319 - RNA, 21 nt, Bordetella pertussis
ccggaugccgaacugucgcgc

SEQ ID NO: 2344320 - RNA, 22 nt, Bordetella pertussis
ccggaugccgaacugucgcgcc

SEQ ID NO: 2344321 - RNA, 14 nt, Bordetella pertussis
ccggaugcgcagga

SEQ ID NO: 2344322 - RNA, 14 nt, Bordetella pertussis
ccggaugcgcgugg

SEQ ID NO: 2344323 - RNA, 18 nt, Bordetella pertussis
ccggaugcgcguggcgcg

SEQ ID NO: 2344324 - RNA, 19 nt, Bordetella pertussis
ccggaugcgcguggcgcga

SEQ ID NO: 2344325 - RNA, 14 nt, Bordetella pertussis
ccggauggcgcgga

SEQ ID NO: 2344326 - RNA, 20 nt, Bordetella pertussis
ccggauggcuauaccgucgu

SEQ ID NO: 2344327 - RNA, 20 nt, Bordetella pertussis
ccggaugguagaugcgcgcg

SEQ ID NO: 2344328 - RNA, 21 nt, Bordetella pertussis
ccggauugcuugacgccgccg

SEQ ID NO: 2344329 - RNA, 16 nt, Bordetella pertussis
ccggauuggcgcugca

SEQ ID NO: 2344330 - RNA, 17 nt, Bordetella pertussis
ccggauuggcgcugcac

SEQ ID NO: 2344331 - RNA, 15 nt, Bordetella pertussis
ccggcaaacccggca

SEQ ID NO: 2344332 - RNA, 16 nt, Bordetella pertussis
ccggcaaacccggcaa

SEQ ID NO: 2344333 - RNA, 18 nt, Bordetella pertussis
ccggcaaacccggcaauc

SEQ ID NO: 2344334 - RNA, 17 nt, Bordetella pertussis
ccggcaaagaucaccug

SEQ ID NO: 2344335 - RNA, 20 nt, Bordetella pertussis
ccggcaaagaucaccugggc

SEQ ID NO: 2344336 - RNA, 19 nt, Bordetella pertussis
ccggcaacaucuccaccag

SEQ ID NO: 2344337 - RNA, 13 nt, Bordetella pertussis
ccggcaacccgcc

SEQ ID NO: 2344338 - RNA, 18 nt, Bordetella pertussis
ccggcaacccgcccacgc

SEQ ID NO: 2344339 - RNA, 11 nt, Bordetella pertussis
ccggcaagaug

SEQ ID NO: 2344340 - RNA, 20 nt, Bordetella pertussis
ccggcaagaugccggccugu

SEQ ID NO: 2344341 - RNA, 22 nt, Bordetella pertussis
ccggcaagcacgaacagguuga

SEQ ID NO: 2344342 - RNA, 20 nt, Bordetella pertussis
ccggcaagccuugcggcuug

SEQ ID NO: 2344343 - RNA, 17 nt, Bordetella pertussis
ccggcaagcgcucgccg

SEQ ID NO: 2344344 - RNA, 21 nt, Bordetella pertussis
ccggcaagcgcucgccggcgc

SEQ ID NO: 2344345 - RNA, 15 nt, Bordetella pertussis
ccggcaaggccgcga

SEQ ID NO: 2344346 - RNA, 19 nt, Bordetella pertussis
ccggcaaggccgcgaacgc

SEQ ID NO: 2344347 - RNA, 19 nt, Bordetella pertussis
ccggcaaggggccagccug

SEQ ID NO: 2344348 - RNA, 20 nt, Bordetella pertussis
ccggcaaggggccagccugg

SEQ ID NO: 2344349 - RNA, 15 nt, Bordetella pertussis
ccggcaaggucagca

SEQ ID NO: 2344350 - RNA, 20 nt, Bordetella pertussis
ccggcaaggugaucgaggcg

SEQ ID NO: 2344351 - RNA, 22 nt, Bordetella pertussis
ccggcaaggugaucgaggcguu

SEQ ID NO: 2344352 - RNA, 23 nt, Bordetella pertussis
ccggcaaucgaaaagcccgccga

SEQ ID NO: 2344353 - RNA, 17 nt, Bordetella pertussis
ccggcaccagcgccacg

SEQ ID NO: 2344354 - RNA, 20 nt, Bordetella pertussis
ccggcaccagcgccacgccc

SEQ ID NO: 2344355 - RNA, 21 nt, Bordetella pertussis
ccggcaccagcgccacgccca

SEQ ID NO: 2344356 - RNA, 15 nt, Bordetella pertussis
ccggcaccaggaucc

SEQ ID NO: 2344357 - RNA, 15 nt, Bordetella pertussis
ccggcaccaucgccg

SEQ ID NO: 2344358 - RNA, 20 nt, Bordetella pertussis
ccggcaccaucgccgccugc

SEQ ID NO: 2344359 - RNA, 17 nt, Bordetella pertussis
ccggcaccaugcgcacc

SEQ ID NO: 2344360 - RNA, 21 nt, Bordetella pertussis
ccggcaccaugcgcaccaggc

SEQ ID NO: 2344361 - RNA, 20 nt, Bordetella pertussis
ccggcacccgcuaccccggc

SEQ ID NO: 2344362 - RNA, 19 nt, Bordetella pertussis
ccggcacccggcucagccu

SEQ ID NO: 2344363 - RNA, 12 nt, Bordetella pertussis
ccggcaccuggg

SEQ ID NO: 2344364 - RNA, 13 nt, Bordetella pertussis
ccggcaccugggc

SEQ ID NO: 2344365 - RNA, 14 nt, Bordetella pertussis
ccggcaccugggcc

SEQ ID NO: 2344366 - RNA, 20 nt, Bordetella pertussis
ccggcaccuucuuccaggcg

SEQ ID NO: 2344367 - RNA, 21 nt, Bordetella pertussis
ccggcaccuucuuccaggcgc

SEQ ID NO: 2344368 - RNA, 18 nt, Bordetella pertussis
ccggcacgacgaucggcc

SEQ ID NO: 2344369 - RNA, 18 nt, Bordetella pertussis
ccggcacgacggccuccg

SEQ ID NO: 2344370 - RNA, 23 nt, Bordetella pertussis
ccggcacgacggccuccgcgccg

SEQ ID NO: 2344371 - RNA, 15 nt, Bordetella pertussis
ccggugggagccagu

SEQ ID NO: 2344372 - RNA, 23 nt, Bordetella pertussis
ccgguggguguggccaugcacca

SEQ ID NO: 2344373 - RNA, 20 nt, Bordetella pertussis
ccgguggugcccaucgcgcu

SEQ ID NO: 2344374 - RNA, 15 nt, Bordetella pertussis
ccgguggugcugcug

SEQ ID NO: 2344375 - RNA, 16 nt, Bordetella pertussis
ccgguggugcugcugg

SEQ ID NO: 2344376 - RNA, 16 nt, Bordetella pertussis
ccgguggugcugggcg

SEQ ID NO: 2344377 - RNA, 18 nt, Bordetella pertussis
ccgguggugucgaacagc

SEQ ID NO: 2344378 - RNA, 20 nt, Bordetella pertussis
ccggugucgccguggcgggu

SEQ ID NO: 2344379 - RNA, 17 nt, Bordetella pertussis
ccgguuccugcaaggcc

SEQ ID NO: 2344380 - RNA, 20 nt, Bordetella pertussis
ccgguucgcccaccaccagc

SEQ ID NO: 2344381 - RNA, 14 nt, Bordetella pertussis
ccgguucgccgucg

SEQ ID NO: 2344382 - RNA, 20 nt, Bordetella pertussis
ccgguucggcgcggcgcguu

SEQ ID NO: 2344383 - RNA, 20 nt, Bordetella pertussis
ccgguucgugccgggcagca

SEQ ID NO: 2344384 - RNA, 17 nt, Bordetella pertussis
ccgguugacgaucucgc

SEQ ID NO: 2344385 - RNA, 19 nt, Bordetella pertussis
ccgguugacgaucucgccc

SEQ ID NO: 2344386 - RNA, 17 nt, Bordetella pertussis
ccgguugcagcgcgcca

SEQ ID NO: 2344387 - RNA, 24 nt, Bordetella pertussis
ccgguugcagcgcgccaggcgcug

SEQ ID NO: 2344388 - RNA, 15 nt, Bordetella pertussis
ccgguugcgcgccga

SEQ ID NO: 2344389 - RNA, 12 nt, Bordetella pertussis
ccgguuggccag

SEQ ID NO: 2344390 - RNA, 14 nt, Bordetella pertussis
ccgguuggccagcu

SEQ ID NO: 2344391 - RNA, 19 nt, Bordetella pertussis
ccgguuggcgccuuccggc

SEQ ID NO: 2344392 - RNA, 21 nt, Bordetella pertussis
ccgguuggcgccuuccggcag

SEQ ID NO: 2344393 - RNA, 23 nt, Bordetella pertussis
ccgguuggcgccuuccggcagcg

SEQ ID NO: 2344394 - RNA, 16 nt, Bordetella pertussis
ccgguuggggucgcgc

SEQ ID NO: 2344395 - RNA, 17 nt, Bordetella pertussis
ccgguuuuuuugcgccg

SEQ ID NO: 2344396 - RNA, 20 nt, Bordetella pertussis
ccgguuuuuuugcgccgcua

SEQ ID NO: 2344397 - RNA, 13 nt, Bordetella pertussis
ccguaaccggcca

SEQ ID NO: 2344398 - RNA, 16 nt, Bordetella pertussis
ccguaaucggcgucgg

SEQ ID NO: 2344399 - RNA, 18 nt, Bordetella pertussis
ccguaaucggcgucggca

SEQ ID NO: 2344400 - RNA, 13 nt, Bordetella pertussis
ccguacagccgcg

SEQ ID NO: 2344401 - RNA, 15 nt, Bordetella pertussis
ccguacagggccgcg

SEQ ID NO: 2344402 - RNA, 14 nt, Bordetella pertussis
ccguaccccagcau

SEQ ID NO: 2344403 - RNA, 14 nt, Bordetella pertussis
ccguacccgcgccg

SEQ ID NO: 2344404 - RNA, 17 nt, Bordetella pertussis
ccguacgagugcaggcc

SEQ ID NO: 2344405 - RNA, 18 nt, Bordetella pertussis
ccguacgccacuuccuug

SEQ ID NO: 2344406 - RNA, 20 nt, Bordetella pertussis
ccguacgccacuuccuugcc

SEQ ID NO: 2344407 - RNA, 22 nt, Bordetella pertussis
ccguacgccacuuccuugccau

SEQ ID NO: 2344408 - RNA, 22 nt, Bordetella pertussis
ccguacuuggcgauggccgcca

SEQ ID NO: 2344409 - RNA, 19 nt, Bordetella pertussis
ccguagagggucuggcggc

SEQ ID NO: 2344410 - RNA, 23 nt, Bordetella pertussis
ccguagagggucuggcggccggu

SEQ ID NO: 2344411 - RNA, 15 nt, Bordetella pertussis
ccguagcgcaggcgc

SEQ ID NO: 2344412 - RNA, 17 nt, Bordetella pertussis
ccguagcgcgccagccg

SEQ ID NO: 2344413 - RNA, 21 nt, Bordetella pertussis
ccguagcgcguggccagcacg

SEQ ID NO: 2344414 - RNA, 14 nt, Bordetella pertussis
ccguaggacagccc

SEQ ID NO: 2344415 - RNA, 23 nt, Bordetella pertussis
ccguaggugcgcgccacauccug

SEQ ID NO: 2344416 - RNA, 19 nt, Bordetella pertussis
ccguaguccagcagcagcg

SEQ ID NO: 2344417 - RNA, 22 nt, Bordetella pertussis
ccguaucgcggccgagcuccuc

SEQ ID NO: 2344418 - RNA, 15 nt, Bordetella pertussis
ccguauggccguugg

SEQ ID NO: 2344419 - RNA, 21 nt, Bordetella pertussis
ccguauggccguuggccagcg

SEQ ID NO: 2344420 - RNA, 15 nt, Bordetella pertussis
ccgucaacagcaugg

SEQ ID NO: 2344421 - RNA, 20 nt, Bordetella pertussis
ccgucaacagcauggacgag

SEQ ID NO: 2344422 - RNA, 22 nt, Bordetella pertussis
ccgucaacagcauggacgagcu

SEQ ID NO: 2344423 - RNA, 15 nt, Bordetella pertussis
ccgucaacgcccagg

SEQ ID NO: 2344424 - RNA, 16 nt, Bordetella pertussis
ccgucaacgcccaggu

SEQ ID NO: 2344425 - RNA, 22 nt, Bordetella pertussis
ccgucaagcguucauggcgcau

SEQ ID NO: 2344426 - RNA, 18 nt, Bordetella pertussis
ccgucaccgccgccgcgc

SEQ ID NO: 2344427 - RNA, 14 nt, Bordetella pertussis
ccgucaccggcuac

SEQ ID NO: 2344428 - RNA, 14 nt, Bordetella pertussis
ccgucacgcgcugg

SEQ ID NO: 2344429 - RNA, 13 nt, Bordetella pertussis
ccgucacgcguga

SEQ ID NO: 2344430 - RNA, 19 nt, Bordetella pertussis
ccgucagcacggucggcgc

SEQ ID NO: 2344431 - RNA, 13 nt, Bordetella pertussis
ccgucagcggcgc

SEQ ID NO: 2344432 - RNA, 15 nt, Bordetella pertussis
ccgucagcggcgcgc

SEQ ID NO: 2344433 - RNA, 23 nt, Bordetella pertussis
ccgucagcggcgcgcccaccagg

SEQ ID NO: 2344434 - RNA, 19 nt, Bordetella pertussis
ccgucagcucgaucaggcg

SEQ ID NO: 2344435 - RNA, 20 nt, Bordetella pertussis
ccgucagcucgaucaggcgc

SEQ ID NO: 2344436 - RNA, 15 nt, Bordetella pertussis
ccgucaggaagcccg

SEQ ID NO: 2344437 - RNA, 17 nt, Bordetella pertussis
ccgucaggaucaggccg

SEQ ID NO: 2344438 - RNA, 16 nt, Bordetella pertussis
ccgucaggcggaugcg

SEQ ID NO: 2344439 - RNA, 15 nt, Bordetella pertussis
ccgucaggugcagcg

SEQ ID NO: 2344440 - RNA, 17 nt, Bordetella pertussis
ccgucaucgccgcggcg

SEQ ID NO: 2344441 - RNA, 19 nt, Bordetella pertussis
ccgucaucgggugcggcgc

SEQ ID NO: 2344442 - RNA, 21 nt, Bordetella pertussis
ccgucaucgggugcggcgccu

SEQ ID NO: 2344443 - RNA, 18 nt, Bordetella pertussis
ccgucaugaggccccugu

SEQ ID NO: 2344444 - RNA, 15 nt, Bordetella pertussis
ccgucauggcggucu

SEQ ID NO: 2344445 - RNA, 13 nt, Bordetella pertussis
ccguccacgccca

SEQ ID NO: 2344446 - RNA, 21 nt, Bordetella pertussis
ccguccacgcccagcgccggc

SEQ ID NO: 2344447 - RNA, 12 nt, Bordetella pertussis
ccguccacgccg

SEQ ID NO: 2344448 - RNA, 16 nt, Bordetella pertussis
ccguccacgccgcgcg

SEQ ID NO: 2344449 - RNA, 17 nt, Bordetella pertussis
ccguccacgccgcgcgc

SEQ ID NO: 2344450 - RNA, 14 nt, Bordetella pertussis
ccguccacggccug

SEQ ID NO: 2344451 - RNA, 20 nt, Bordetella pertussis
ccguccacggccugcgcgcc

SEQ ID NO: 2344452 - RNA, 21 nt, Bordetella pertussis
ccguccacggccugcgcgccg

SEQ ID NO: 2344453 - RNA, 22 nt, Bordetella pertussis
ccguccagcauuucucgggcgc

SEQ ID NO: 2344454 - RNA, 16 nt, Bordetella pertussis
ccguccagcgcggcgc

SEQ ID NO: 2344455 - RNA, 22 nt, Bordetella pertussis
ccguccaggaagcagcccagca

SEQ ID NO: 2344456 - RNA, 19 nt, Bordetella pertussis
ccguccaggcgccgcacgc

SEQ ID NO: 2344457 - RNA, 19 nt, Bordetella pertussis
ccguccagucccguggcgc

SEQ ID NO: 2344458 - RNA, 18 nt, Bordetella pertussis
ccgucccgacccccggcc

SEQ ID NO: 2344459 - RNA, 13 nt, Bordetella pertussis
ccguccgagcccg

SEQ ID NO: 2344460 - RNA, 15 nt, Bordetella pertussis
ccguccgccaggacg

SEQ ID NO: 2344461 - RNA, 16 nt, Bordetella pertussis
ccguccgccaggacgg

SEQ ID NO: 2344462 - RNA, 21 nt, Bordetella pertussis
ccguccgccaggacgggaaag

SEQ ID NO: 2344463 - RNA, 13 nt, Bordetella pertussis
ccguccgcgacgg

SEQ ID NO: 2344464 - RNA, 21 nt, Bordetella pertussis
ccguccgcgacgguccugcgc

SEQ ID NO: 2344465 - RNA, 12 nt, Bordetella pertussis
ccguccgggccg

SEQ ID NO: 2344466 - RNA, 13 nt, Bordetella pertussis
ccguccgggccgg

SEQ ID NO: 2344467 - RNA, 14 nt, Bordetella pertussis
ccguccucaggccc

SEQ ID NO: 2344468 - RNA, 17 nt, Bordetella pertussis
ccguccugcugcggcac

SEQ ID NO: 2344469 - RNA, 17 nt, Bordetella pertussis
ccguccuggccgucaag

SEQ ID NO: 2344470 - RNA, 19 nt, Bordetella pertussis
ccguccuuacuugcgcacg

SEQ ID NO: 2344471 - RNA, 18 nt, Bordetella pertussis
ccguccuugagcgccagc

SEQ ID NO: 2344472 - RNA, 23 nt, Bordetella pertussis
ccguccuugagggcgcgggccag

SEQ ID NO: 2344473 - RNA, 20 nt, Bordetella pertussis
ccguccuuggcguccggccc

SEQ ID NO: 2344474 - RNA, 16 nt, Bordetella pertussis
ccguccuugugccagg

SEQ ID NO: 2344475 - RNA, 16 nt, Bordetella pertussis
ccgucgaagccggcgc

SEQ ID NO: 2344476 - RNA, 15 nt, Bordetella pertussis
ccgucgaaggccgca

SEQ ID NO: 2344477 - RNA, 19 nt, Bordetella pertussis
ccgucgaccccgucgaccg

SEQ ID NO: 2344478 - RNA, 14 nt, Bordetella pertussis
ccgucgaccgacag

SEQ ID NO: 2344479 - RNA, 18 nt, Bordetella pertussis
ccgucgaccgcgaagcgc

SEQ ID NO: 2344480 - RNA, 21 nt, Bordetella pertussis
ccgucgaccgcgaagcgcgcc

SEQ ID NO: 2344481 - RNA, 16 nt, Bordetella pertussis
ccgucgagccgggcgc

SEQ ID NO: 2344482 - RNA, 18 nt, Bordetella pertussis
ccgucgagccgggcgccg

SEQ ID NO: 2344483 - RNA, 16 nt, Bordetella pertussis
ccgucgagcgcgaaau

SEQ ID NO: 2344484 - RNA, 14 nt, Bordetella pertussis
ccgucgagcgcggc

SEQ ID NO: 2344485 - RNA, 16 nt, Bordetella pertussis
ccgucgagcgcggcca

SEQ ID NO: 2344486 - RNA, 15 nt, Bordetella pertussis
ccucagcggccgcug

SEQ ID NO: 2344487 - RNA, 17 nt, Bordetella pertussis
ccucagcggccgcugcc

SEQ ID NO: 2344488 - RNA, 16 nt, Bordetella pertussis
ccucaggaugcccggg

SEQ ID NO: 2344489 - RNA, 19 nt, Bordetella pertussis
ccucaggcccgcggcgcca

SEQ ID NO: 2344490 - RNA, 21 nt, Bordetella pertussis
ccucauccccgcgugccuguc

SEQ ID NO: 2344491 - RNA, 23 nt, Bordetella pertussis
ccucaucgugcucgugcugggca

SEQ ID NO: 2344492 - RNA, 16 nt, Bordetella pertussis
ccucaugcgggacagg

SEQ ID NO: 2344493 - RNA, 19 nt, Bordetella pertussis
ccucaugcgggacaggcgc

SEQ ID NO: 2344494 - RNA, 15 nt, Bordetella pertussis
ccucauuggcgcgcu

SEQ ID NO: 2344495 - RNA, 17 nt, Bordetella pertussis
ccucauuggcgcgcuug

SEQ ID NO: 2344496 - RNA, 13 nt, Bordetella pertussis
ccuccaccgccag

SEQ ID NO: 2344497 - RNA, 15 nt, Bordetella pertussis
ccuccaccgccagcc

SEQ ID NO: 2344498 - RNA, 21 nt, Bordetella pertussis
ccuccagcagggacuugggca

SEQ ID NO: 2344499 - RNA, 18 nt, Bordetella pertussis
ccuccagcaucgccgcca

SEQ ID NO: 2344500 - RNA, 20 nt, Bordetella pertussis
ccuccaggaugagcgccugc

SEQ ID NO: 2344501 - RNA, 14 nt, Bordetella pertussis
ccuccaggcccagg

SEQ ID NO: 2344502 - RNA, 18 nt, Bordetella pertussis
ccuccaggcgcaagccug

SEQ ID NO: 2344503 - RNA, 20 nt, Bordetella pertussis
ccuccaucagcagcaccuuc

SEQ ID NO: 2344504 - RNA, 19 nt, Bordetella pertussis
ccucccacgaccugcaacc

SEQ ID NO: 2344505 - RNA, 20 nt, Bordetella pertussis
ccucccauugcgcggccagg

SEQ ID NO: 2344506 - RNA, 20 nt, Bordetella pertussis
ccuccccaggccagcugcgc

SEQ ID NO: 2344507 - RNA, 17 nt, Bordetella pertussis
ccucccugugggggaca

SEQ ID NO: 2344508 - RNA, 17 nt, Bordetella pertussis
ccuccgacaggcgccgc

SEQ ID NO: 2344509 - RNA, 19 nt, Bordetella pertussis
ccuccgacaggcgccgcaa

SEQ ID NO: 2344510 - RNA, 12 nt, Bordetella pertussis
ccuccgcgccga

SEQ ID NO: 2344511 - RNA, 22 nt, Bordetella pertussis
ccuccgcguugcgcugcccguc

SEQ ID NO: 2344512 - RNA, 17 nt, Bordetella pertussis
ccuccggcaggaucugc

SEQ ID NO: 2344513 - RNA, 15 nt, Bordetella pertussis
ccuccggcgccagca

SEQ ID NO: 2344514 - RNA, 18 nt, Bordetella pertussis
ccuccggcgccagcaugc

SEQ ID NO: 2344515 - RNA, 14 nt, Bordetella pertussis
ccuccggcgccgcc

SEQ ID NO: 2344516 - RNA, 15 nt, Bordetella pertussis
ccuccggcgccgccu

SEQ ID NO: 2344517 - RNA, 19 nt, Bordetella pertussis
ccuccgggucgcggcacga

SEQ ID NO: 2344518 - RNA, 17 nt, Bordetella pertussis
ccuccugucaugguuuc

SEQ ID NO: 2344519 - RNA, 14 nt, Bordetella pertussis
ccucgaacaggcca

SEQ ID NO: 2344520 - RNA, 21 nt, Bordetella pertussis
ccucgaacccgaacgcgugca

SEQ ID NO: 2344521 - RNA, 19 nt, Bordetella pertussis
ccucgaacgcauugcgcgu

SEQ ID NO: 2344522 - RNA, 15 nt, Bordetella pertussis
ccucgaagaccucgg

SEQ ID NO: 2344523 - RNA, 20 nt, Bordetella pertussis
ccucgaagaucaacaaggcg

SEQ ID NO: 2344524 - RNA, 20 nt, Bordetella pertussis
ccucgaagaucucgacgucg

SEQ ID NO: 2344525 - RNA, 15 nt, Bordetella pertussis
ccucgaccaggucca

SEQ ID NO: 2344526 - RNA, 20 nt, Bordetella pertussis
ccucgacccgaaggcgcggc

SEQ ID NO: 2344527 - RNA, 15 nt, Bordetella pertussis
ccucgacccgcgccu

SEQ ID NO: 2344528 - RNA, 16 nt, Bordetella pertussis
ccucgacccgcgccuc

SEQ ID NO: 2344529 - RNA, 13 nt, Bordetella pertussis
ccucgaccggcga

SEQ ID NO: 2344530 - RNA, 17 nt, Bordetella pertussis
ccucgacgaugcccugc

SEQ ID NO: 2344531 - RNA, 15 nt, Bordetella pertussis
ccucgacgauggcgg

SEQ ID NO: 2344532 - RNA, 18 nt, Bordetella pertussis
ccucgacgcccgggcggc

SEQ ID NO: 2344533 - RNA, 13 nt, Bordetella pertussis
ccucgacggccgc

SEQ ID NO: 2344534 - RNA, 14 nt, Bordetella pertussis
ccucgacggccgcc

SEQ ID NO: 2344535 - RNA, 21 nt, Bordetella pertussis
ccucgacgggauccucgcucu

SEQ ID NO: 2344536 - RNA, 14 nt, Bordetella pertussis
ccucgugcugcugc

SEQ ID NO: 2344537 - RNA, 15 nt, Bordetella pertussis
ccucgugcugcugca

SEQ ID NO: 2344538 - RNA, 20 nt, Bordetella pertussis
ccucgugcugcugcaggcgc

SEQ ID NO: 2344539 - RNA, 16 nt, Bordetella pertussis
ccucguucaugucgcg

SEQ ID NO: 2344540 - RNA, 14 nt, Bordetella pertussis
ccucguuggucagc

SEQ ID NO: 2344541 - RNA, 12 nt, Bordetella pertussis
ccucuacuggcu

SEQ ID NO: 2344542 - RNA, 19 nt, Bordetella pertussis
ccucuccacuggccuucuu

SEQ ID NO: 2344543 - RNA, 22 nt, Bordetella pertussis
ccucuccacuggccuucuucac

SEQ ID NO: 2344544 - RNA, 13 nt, Bordetella pertussis
ccucuucggcggc

SEQ ID NO: 2344545 - RNA, 16 nt, Bordetella pertussis
ccucuucggcggccag

SEQ ID NO: 2344546 - RNA, 19 nt, Bordetella pertussis
ccucuucguugucgcgcgc

SEQ ID NO: 2344547 - RNA, 16 nt, Bordetella pertussis
ccucuugcgugacccg

SEQ ID NO: 2344548 - RNA, 23 nt, Bordetella pertussis
ccucuugcgugacccggggcagg

SEQ ID NO: 2344549 - RNA, 17 nt, Bordetella pertussis
ccucuuuccccuccccu

SEQ ID NO: 2344550 - RNA, 17 nt, Bordetella pertussis
ccucuuucgccgcgcgc

SEQ ID NO: 2344551 - RNA, 18 nt, Bordetella pertussis
ccucuuucgccgcgcgcu

SEQ ID NO: 2344552 - RNA, 19 nt, Bordetella pertussis
ccugaacaccggcgcgccu

SEQ ID NO: 2344553 - RNA, 22 nt, Bordetella pertussis
ccugaacaccggcgcgccuggc

SEQ ID NO: 2344554 - RNA, 23 nt, Bordetella pertussis
ccugaacaccggcgcgccuggcg

SEQ ID NO: 2344555 - RNA, 20 nt, Bordetella pertussis
ccugaacgacgguacaccug

SEQ ID NO: 2344556 - RNA, 13 nt, Bordetella pertussis
ccugaacgccggg

SEQ ID NO: 2344557 - RNA, 14 nt, Bordetella pertussis
ccugaacgccgggc

SEQ ID NO: 2344558 - RNA, 14 nt, Bordetella pertussis
ccugaacguggcgu

SEQ ID NO: 2344559 - RNA, 16 nt, Bordetella pertussis
ccugaacuauggcgcg

SEQ ID NO: 2344560 - RNA, 19 nt, Bordetella pertussis
ccugaacuauggcgcgcgc

SEQ ID NO: 2344561 - RNA, 13 nt, Bordetella pertussis
ccugaaucgcccg

SEQ ID NO: 2344562 - RNA, 15 nt, Bordetella pertussis
ccugaaucgcccggg

SEQ ID NO: 2344563 - RNA, 15 nt, Bordetella pertussis
ccugacccccgaacu

SEQ ID NO: 2344564 - RNA, 22 nt, Bordetella pertussis
ccugaccggcggcgcucaucau

SEQ ID NO: 2344565 - RNA, 21 nt, Bordetella pertussis
ccugaccggcuauaccgggcu

SEQ ID NO: 2344566 - RNA, 16 nt, Bordetella pertussis
ccugaccguccauggc

SEQ ID NO: 2344567 - RNA, 13 nt, Bordetella pertussis
ccugacgccugcg

SEQ ID NO: 2344568 - RNA, 18 nt, Bordetella pertussis
ccugacgcgcaagcggcc

SEQ ID NO: 2344569 - RNA, 17 nt, Bordetella pertussis
ccugacgcucauccagg

SEQ ID NO: 2344570 - RNA, 22 nt, Bordetella pertussis
ccugacggccccguugucgccg

SEQ ID NO: 2344571 - RNA, 19 nt, Bordetella pertussis
ccugacgugcgccacagca

SEQ ID NO: 2344572 - RNA, 21 nt, Bordetella pertussis
ccugagcacaugcccggccac

SEQ ID NO: 2344573 - RNA, 23 nt, Bordetella pertussis
ccugagcacaugcccggccacca

SEQ ID NO: 2344574 - RNA, 17 nt, Bordetella pertussis
ccugagcaccgccgcgu

SEQ ID NO: 2344575 - RNA, 15 nt, Bordetella pertussis
ccugagcugccaggc

SEQ ID NO: 2344576 - RNA, 12 nt, Bordetella pertussis
ccugaggccagg

SEQ ID NO: 2344577 - RNA, 14 nt, Bordetella pertussis
ccugaggccaggcc

SEQ ID NO: 2344578 - RNA, 16 nt, Bordetella pertussis
ccugaggccaggccgg

SEQ ID NO: 2344579 - RNA, 18 nt, Bordetella pertussis
ccugaggccaggccggau

SEQ ID NO: 2344580 - RNA, 22 nt, Bordetella pertussis
ccugaucaaucugaucaucuuc

SEQ ID NO: 2344581 - RNA, 20 nt, Bordetella pertussis
ccugaucccggcgcuggccg

SEQ ID NO: 2344582 - RNA, 17 nt, Bordetella pertussis
ccugaucgaggagcugc

SEQ ID NO: 2344583 - RNA, 17 nt, Bordetella pertussis
ccugaucgcgcagcgcc

SEQ ID NO: 2344584 - RNA, 23 nt, Bordetella pertussis
ccugaucgcgcagcgccuggccg

SEQ ID NO: 2344585 - RNA, 16 nt, Bordetella pertussis
ccugaucucgcgcacc

SEQ ID NO: 2344586 - RNA, 17 nt, Bordetella pertussis
ccugaucucgcgcaccg

SEQ ID NO: 2344587 - RNA, 15 nt, Bordetella pertussis
ccugaugccuguccc

SEQ ID NO: 2344588 - RNA, 14 nt, Bordetella pertussis
ccugaugucggccu

SEQ ID NO: 2344589 - RNA, 15 nt, Bordetella pertussis
ccugauucacaggcc

SEQ ID NO: 2344590 - RNA, 17 nt, Bordetella pertussis
ccugauucacaggcccg

SEQ ID NO: 2344591 - RNA, 16 nt, Bordetella pertussis
ccugauucccaggccc

SEQ ID NO: 2344592 - RNA, 17 nt, Bordetella pertussis
ccugcaaaaaacaagcu

SEQ ID NO: 2344593 - RNA, 22 nt, Bordetella pertussis
ccugcaaaaaacaagcucgcgc

SEQ ID NO: 2344594 - RNA, 17 nt, Bordetella pertussis
ccugcaaccagcucagc

SEQ ID NO: 2344595 - RNA, 20 nt, Bordetella pertussis
ccugcaaccagcucagcuug

SEQ ID NO: 2344596 - RNA, 19 nt, Bordetella pertussis
ccugcaaccccaccggcaa

SEQ ID NO: 2344597 - RNA, 15 nt, Bordetella pertussis
ccugcaaggccggcg

SEQ ID NO: 2344598 - RNA, 16 nt, Bordetella pertussis
ccugcaaggccggcgg

SEQ ID NO: 2344599 - RNA, 20 nt, Bordetella pertussis
ccugcaaggccggcggcacg

SEQ ID NO: 2344600 - RNA, 23 nt, Bordetella pertussis
ccugcaaggccggcggcacgcug

SEQ ID NO: 2344601 - RNA, 16 nt, Bordetella pertussis
ccugcaaugcggccag

SEQ ID NO: 2344602 - RNA, 13 nt, Bordetella pertussis
ccugcaccgccgc

SEQ ID NO: 2344603 - RNA, 16 nt, Bordetella pertussis
ccugcaccgucacgcg

SEQ ID NO: 2344604 - RNA, 22 nt, Bordetella pertussis
ccugcaccucaggaugcccggg

SEQ ID NO: 2344605 - RNA, 22 nt, Bordetella pertussis
ccugcacgaagcggaugcgccg

SEQ ID NO: 2344606 - RNA, 18 nt, Bordetella pertussis
ccugcacgaccugcgcau

SEQ ID NO: 2344607 - RNA, 19 nt, Bordetella pertussis
ccugcacgauggcgccggc

SEQ ID NO: 2344608 - RNA, 22 nt, Bordetella pertussis
ccugcacgauggcgccggcuuc

SEQ ID NO: 2344609 - RNA, 23 nt, Bordetella pertussis
ccugcacgauggcgccggcuucg

SEQ ID NO: 2344610 - RNA, 12 nt, Bordetella pertussis
ccugcacgcgcg

SEQ ID NO: 2344611 - RNA, 14 nt, Bordetella pertussis
ccugcacgcgcgcg

SEQ ID NO: 2344612 - RNA, 15 nt, Bordetella pertussis
ccugcacgcucuuga

SEQ ID NO: 2344613 - RNA, 21 nt, Bordetella pertussis
ccugcacggugggcagcagca

SEQ ID NO: 2344614 - RNA, 22 nt, Bordetella pertussis
ccugcacggugggcagcagcac

SEQ ID NO: 2344615 - RNA, 13 nt, Bordetella pertussis
ccugcacguccca

SEQ ID NO: 2344616 - RNA, 21 nt, Bordetella pertussis
ccugcacgucccagucgccgc

SEQ ID NO: 2344617 - RNA, 22 nt, Bordetella pertussis
ccugcagaccagcaccggcacg

SEQ ID NO: 2344618 - RNA, 12 nt, Bordetella pertussis
ccugcagcacgc

SEQ ID NO: 2344619 - RNA, 17 nt, Bordetella pertussis
ccugcagcacgcuggcc

SEQ ID NO: 2344620 - RNA, 20 nt, Bordetella pertussis
ccugcagcacgcuggccuug

SEQ ID NO: 2344621 - RNA, 14 nt, Bordetella pertussis
ccugcagcacggcc

SEQ ID NO: 2344622 - RNA, 12 nt, Bordetella pertussis
ccugcagcagcg

SEQ ID NO: 2344623 - RNA, 14 nt, Bordetella pertussis
ccugcagcagcgcc

SEQ ID NO: 2344624 - RNA, 16 nt, Bordetella pertussis
ccugcagcagcgccuu

SEQ ID NO: 2344625 - RNA, 18 nt, Bordetella pertussis
ccugcagcagcguggccg

SEQ ID NO: 2344626 - RNA, 20 nt, Bordetella pertussis
ccugcagcagcguggccgcc

SEQ ID NO: 2344627 - RNA, 23 nt, Bordetella pertussis
ccugcagcagcguggccgccacc

SEQ ID NO: 2344628 - RNA, 18 nt, Bordetella pertussis
ccugcagcaggcgcacca

SEQ ID NO: 2344629 - RNA, 15 nt, Bordetella pertussis
ccugcagcaggucgg

SEQ ID NO: 2344630 - RNA, 13 nt, Bordetella pertussis
ccugcagcaugac

SEQ ID NO: 2344631 - RNA, 23 nt, Bordetella pertussis
ccugcagcaugaccgacaggcgg

SEQ ID NO: 2344632 - RNA, 23 nt, Bordetella pertussis
ccugcagccagaucucgcguccg

SEQ ID NO: 2344633 - RNA, 15 nt, Bordetella pertussis
ccugcagcgccgccu

SEQ ID NO: 2344634 - RNA, 12 nt, Bordetella pertussis
ccugcagcgcgc

SEQ ID NO: 2344635 - RNA, 13 nt, Bordetella pertussis
ccugcagcgcgcg

SEQ ID NO: 2344636 - RNA, 14 nt, Bordetella pertussis
ccugcagcgcgcgc

SEQ ID NO: 2344637 - RNA, 15 nt, Bordetella pertussis
ccugcagcgcgcgcg

SEQ ID NO: 2344638 - RNA, 12 nt, Bordetella pertussis
ccugcagcggcc

SEQ ID NO: 2344639 - RNA, 14 nt, Bordetella pertussis
ccugcagcgugcug

SEQ ID NO: 2344640 - RNA, 15 nt, Bordetella pertussis
ccugcagcgugcugc

SEQ ID NO: 2344641 - RNA, 20 nt, Bordetella pertussis
ccugcaggaagccugcgcgc

SEQ ID NO: 2344642 - RNA, 16 nt, Bordetella pertussis
ccugcaggaaggccgc

SEQ ID NO: 2344643 - RNA, 17 nt, Bordetella pertussis
ccugcaggaaggccgcc

SEQ ID NO: 2344644 - RNA, 18 nt, Bordetella pertussis
ccugcaggaaggccgccg

SEQ ID NO: 2344645 - RNA, 22 nt, Bordetella pertussis
ccugcaggaaggccgccgcgug

SEQ ID NO: 2344646 - RNA, 22 nt, Bordetella pertussis
ccugcaggaugggccguccggc

SEQ ID NO: 2344647 - RNA, 22 nt, Bordetella pertussis
ccugcaggcccaccggcaugcc

SEQ ID NO: 2344648 - RNA, 13 nt, Bordetella pertussis
ccugcaggcccag

SEQ ID NO: 2344649 - RNA, 22 nt, Bordetella pertussis
ccugcaggcccagcacgcgcgc

SEQ ID NO: 2344650 - RNA, 13 nt, Bordetella pertussis
ccugcaggcccgg

SEQ ID NO: 2344651 - RNA, 16 nt, Bordetella pertussis
ccugcaggcccggcgc

SEQ ID NO: 2344652 - RNA, 17 nt, Bordetella pertussis
ccugcaggcccggcgcg

SEQ ID NO: 2344653 - RNA, 20 nt, Bordetella pertussis
ccugcaggcccggcgcgacg

SEQ ID NO: 2344654 - RNA, 12 nt, Bordetella pertussis
ccugcaggccgc

SEQ ID NO: 2344655 - RNA, 13 nt, Bordetella pertussis
ccugcaggccgcc

SEQ ID NO: 2344656 - RNA, 16 nt, Bordetella pertussis
ccugcaggccgggcag

SEQ ID NO: 2344657 - RNA, 15 nt, Bordetella pertussis
ccugcaggcggcgca

SEQ ID NO: 2344658 - RNA, 18 nt, Bordetella pertussis
ccugcaggcggucgguga

SEQ ID NO: 2344659 - RNA, 23 nt, Bordetella pertussis
ccugcaggcucuugaccagcuug

SEQ ID NO: 2344660 - RNA, 14 nt, Bordetella pertussis
ccugcagggcaugg

SEQ ID NO: 2344661 - RNA, 21 nt, Bordetella pertussis
ccugcagggcaugggcccggg

SEQ ID NO: 2344662 - RNA, 12 nt, Bordetella pertussis
ccugcagggcgu

SEQ ID NO: 2344663 - RNA, 19 nt, Bordetella pertussis
ccugcagggucagcccgcc

SEQ ID NO: 2344664 - RNA, 22 nt, Bordetella pertussis
ccugcagggucagcccgccauc

SEQ ID NO: 2344665 - RNA, 18 nt, Bordetella pertussis
ccugcagguccugguaga

SEQ ID NO: 2344666 - RNA, 13 nt, Bordetella pertussis
ccugcaggucuuc

SEQ ID NO: 2344667 - RNA, 15 nt, Bordetella pertussis
ccugcaggugccgcc

SEQ ID NO: 2344668 - RNA, 16 nt, Bordetella pertussis
ccugcaggugccgccg

SEQ ID NO: 2344669 - RNA, 18 nt, Bordetella pertussis
ccugcaguucggccgcca

SEQ ID NO: 2344670 - RNA, 19 nt, Bordetella pertussis
ccugcaguucggccgccag

SEQ ID NO: 2344671 - RNA, 14 nt, Bordetella pertussis
ccugcauccggccc

SEQ ID NO: 2344672 - RNA, 17 nt, Bordetella pertussis
ccugcaucgccaugccg

SEQ ID NO: 2344673 - RNA, 16 nt, Bordetella pertussis
ccugcaugaccgccgc

SEQ ID NO: 2344674 - RNA, 20 nt, Bordetella pertussis
ccugcaugccauagucgcgc

SEQ ID NO: 2344675 - RNA, 16 nt, Bordetella pertussis
ccugcauguccagcgg

SEQ ID NO: 2344676 - RNA, 17 nt, Bordetella pertussis
ccugcauguccagcggc

SEQ ID NO: 2344677 - RNA, 15 nt, Bordetella pertussis
ccugccaagcgccgc

SEQ ID NO: 2344678 - RNA, 21 nt, Bordetella pertussis
ccugccaagcgccgcggccac

SEQ ID NO: 2344679 - RNA, 14 nt, Bordetella pertussis
ccugccaccagcgc

SEQ ID NO: 2344680 - RNA, 20 nt, Bordetella pertussis
ccugccaccagcgcgccagc

SEQ ID NO: 2344681 - RNA, 15 nt, Bordetella pertussis
ccugccacuccuggu

SEQ ID NO: 2344682 - RNA, 15 nt, Bordetella pertussis
ccugccacugcaucg

SEQ ID NO: 2344683 - RNA, 16 nt, Bordetella pertussis
ccugccagcccaccag

SEQ ID NO: 2344684 - RNA, 12 nt, Bordetella pertussis
ccugccaggcgc

SEQ ID NO: 2344685 - RNA, 13 nt, Bordetella pertussis
ccugccaggcgcc

SEQ ID NO: 2344686 - RNA, 22 nt, Bordetella pertussis
ccugccaguugccgccgccggc

SEQ ID NO: 2344687 - RNA, 14 nt, Bordetella pertussis
ccugccauccggcc

SEQ ID NO: 2344688 - RNA, 15 nt, Bordetella pertussis
ccugccauccggccg

SEQ ID NO: 2344689 - RNA, 16 nt, Bordetella pertussis
ccugccauccggccgc

SEQ ID NO: 2344690 - RNA, 22 nt, Bordetella pertussis
ccugccauucgucguagccgcc

SEQ ID NO: 2344691 - RNA, 19 nt, Bordetella pertussis
ccugccauugcgcggccug

SEQ ID NO: 2344692 - RNA, 21 nt, Bordetella pertussis
ccugcccaccgccgcccgcca

SEQ ID NO: 2344693 - RNA, 15 nt, Bordetella pertussis
ccugcccaggccagc

SEQ ID NO: 2344694 - RNA, 20 nt, Bordetella pertussis
ccugcccaggccagcgccgc

SEQ ID NO: 2344695 - RNA, 19 nt, Bordetella pertussis
ccugccccugcggggacag

SEQ ID NO: 2344696 - RNA, 19 nt, Bordetella pertussis
ccugcccgagaccgcccgc

SEQ ID NO: 2344697 - RNA, 16 nt, Bordetella pertussis
ccugcccgccuggucg

SEQ ID NO: 2344698 - RNA, 18 nt, Bordetella pertussis
ccugcccggcgagcaugg

SEQ ID NO: 2344699 - RNA, 15 nt, Bordetella pertussis
ccugcccgggcagca

SEQ ID NO: 2344700 - RNA, 22 nt, Bordetella pertussis
ccugcccgggcagcaccgcugc

SEQ ID NO: 2344701 - RNA, 12 nt, Bordetella pertussis
ccugcccgggcg

SEQ ID NO: 2344702 - RNA, 22 nt, Bordetella pertussis
ccugcccgucuauggccugcag

SEQ ID NO: 2344703 - RNA, 23 nt, Bordetella pertussis
ccugcccgucuauggccugcagg

SEQ ID NO: 2344704 - RNA, 21 nt, Bordetella pertussis
ccugcccguucacgcgcagcg

SEQ ID NO: 2344705 - RNA, 17 nt, Bordetella pertussis
ccugcccucgggcgaca

SEQ ID NO: 2344706 - RNA, 15 nt, Bordetella pertussis
ccugcccugcggcuu

SEQ ID NO: 2344707 - RNA, 23 nt, Bordetella pertussis
ccugcccugguggcagagggcga

SEQ ID NO: 2344708 - RNA, 16 nt, Bordetella pertussis
ccugccgagcgcugcg

SEQ ID NO: 2344709 - RNA, 22 nt, Bordetella pertussis
ccugccgaucaagagccuggag

SEQ ID NO: 2344710 - RNA, 19 nt, Bordetella pertussis
ccugccgaucgugcacgcc

SEQ ID NO: 2344711 - RNA, 23 nt, Bordetella pertussis
ccugccgaucgugcacgcccgcg

SEQ ID NO: 2344712 - RNA, 21 nt, Bordetella pertussis
ccugccgcacuucgggccacc

SEQ ID NO: 2344713 - RNA, 13 nt, Bordetella pertussis
ccugccgcauccc

SEQ ID NO: 2344714 - RNA, 19 nt, Bordetella pertussis
ccugccgcaucccgccccc

SEQ ID NO: 2344715 - RNA, 20 nt, Bordetella pertussis
ccugccgccaagggcgcgcc

SEQ ID NO: 2344716 - RNA, 21 nt, Bordetella pertussis
ccugccgccaagggcgcgcca

SEQ ID NO: 2344717 - RNA, 23 nt, Bordetella pertussis
ccugccgccaagggcgcgccagc

SEQ ID NO: 2344718 - RNA, 15 nt, Bordetella pertussis
ccugccgccugccag

SEQ ID NO: 2344719 - RNA, 12 nt, Bordetella pertussis
ccugccgcgccc

SEQ ID NO: 2344720 - RNA, 15 nt, Bordetella pertussis
ccugccgcgcccggc

SEQ ID NO: 2344721 - RNA, 13 nt, Bordetella pertussis
ccugccgcgccga

SEQ ID NO: 2344722 - RNA, 20 nt, Bordetella pertussis
ccugccgcgccgaccggccc

SEQ ID NO: 2344723 - RNA, 22 nt, Bordetella pertussis
ccugccgcgccgaccggcccca

SEQ ID NO: 2344724 - RNA, 20 nt, Bordetella pertussis
ccugccgcgcguacgcggcg

SEQ ID NO: 2344725 - RNA, 14 nt, Bordetella pertussis
ccugccgcggccgc

SEQ ID NO: 2344726 - RNA, 18 nt, Bordetella pertussis
ccugccgcggccgccccc

SEQ ID NO: 2344727 - RNA, 13 nt, Bordetella pertussis
ccugccggccggc

SEQ ID NO: 2344728 - RNA, 17 nt, Bordetella pertussis
ccugccggccuggcuca

SEQ ID NO: 2344729 - RNA, 20 nt, Bordetella pertussis
ccugccggcgcgcccagggg

SEQ ID NO: 2344730 - RNA, 19 nt, Bordetella pertussis
ccugccggcgcgccucggc

SEQ ID NO: 2344731 - RNA, 14 nt, Bordetella pertussis
ccugccggcggccu

SEQ ID NO: 2344732 - RNA, 18 nt, Bordetella pertussis
ccugccggggcacccagg

SEQ ID NO: 2344733 - RNA, 13 nt, Bordetella pertussis
ccugccgugcaga

SEQ ID NO: 2344734 - RNA, 16 nt, Bordetella pertussis
ccugccgugggacagg

SEQ ID NO: 2344735 - RNA, 19 nt, Bordetella pertussis
ccugccgugggacaggcac

SEQ ID NO: 2344736 - RNA, 21 nt, Bordetella pertussis
ccugccguuauauauagagga

SEQ ID NO: 2344737 - RNA, 16 nt, Bordetella pertussis
ccugccguucgcgcug

SEQ ID NO: 2344738 - RNA, 13 nt, Bordetella pertussis
ccugccugccgcc

SEQ ID NO: 2344739 - RNA, 16 nt, Bordetella pertussis
ccugcgaacccgccgc

SEQ ID NO: 2344740 - RNA, 17 nt, Bordetella pertussis
ccugcgaacccgccgcg

SEQ ID NO: 2344741 - RNA, 15 nt, Bordetella pertussis
ccugcgaacgcccgg

SEQ ID NO: 2344742 - RNA, 16 nt, Bordetella pertussis
ccugcgacagcaccgg

SEQ ID NO: 2344743 - RNA, 22 nt, Bordetella pertussis
ccugcgagagauagcccagcac

SEQ ID NO: 2344744 - RNA, 21 nt, Bordetella pertussis
ccugcgaucaguucggcaugg

SEQ ID NO: 2344745 - RNA, 14 nt, Bordetella pertussis
ccugcgaugccggc

SEQ ID NO: 2344746 - RNA, 16 nt, Bordetella pertussis
ccugcgaugccggcgu

SEQ ID NO: 2344747 - RNA, 18 nt, Bordetella pertussis
ccugcgcaauucuuccuc

SEQ ID NO: 2344748 - RNA, 19 nt, Bordetella pertussis
ccugcgcaccggccggccg

SEQ ID NO: 2344749 - RNA, 19 nt, Bordetella pertussis
ccugcgcaucgaucagcgc

SEQ ID NO: 2344750 - RNA, 15 nt, Bordetella pertussis
ccugcgccaccgcau

SEQ ID NO: 2344751 - RNA, 16 nt, Bordetella pertussis
ccugcgccaccgcaug

SEQ ID NO: 2344752 - RNA, 13 nt, Bordetella pertussis
ccugcgccaccug

SEQ ID NO: 2344753 - RNA, 20 nt, Bordetella pertussis
ccugcgccaccuggcgcccg

SEQ ID NO: 2344754 - RNA, 21 nt, Bordetella pertussis
ccugcgccaccuggcgcccgg

SEQ ID NO: 2344755 - RNA, 19 nt, Bordetella pertussis
ccugcgccacguccagcac

SEQ ID NO: 2344756 - RNA, 22 nt, Bordetella pertussis
ccugcgccacguccagcacggc

SEQ ID NO: 2344757 - RNA, 15 nt, Bordetella pertussis
ccugcgccagccgcg

SEQ ID NO: 2344758 - RNA, 16 nt, Bordetella pertussis
ccugcgccagccgcgc

SEQ ID NO: 2344759 - RNA, 17 nt, Bordetella pertussis
ccugcgccagccgcgcc

SEQ ID NO: 2344760 - RNA, 13 nt, Bordetella pertussis
ccugcgccagcgc

SEQ ID NO: 2344761 - RNA, 14 nt, Bordetella pertussis
ccugcgccagcgcc

SEQ ID NO: 2344762 - RNA, 15 nt, Bordetella pertussis
ccugcgccagcgccu

SEQ ID NO: 2344763 - RNA, 21 nt, Bordetella pertussis
ccugcgccagcgccucgcgcu

SEQ ID NO: 2344764 - RNA, 23 nt, Bordetella pertussis
ccugcgccagcgccucgcgcucg

SEQ ID NO: 2344765 - RNA, 21 nt, Bordetella pertussis
ccugcgccagcuccagccgca

SEQ ID NO: 2344766 - RNA, 14 nt, Bordetella pertussis
ccugcgccaggugc

SEQ ID NO: 2344767 - RNA, 17 nt, Bordetella pertussis
ccugcgccaggugcuug

SEQ ID NO: 2344768 - RNA, 15 nt, Bordetella pertussis
ccugcgccauggcgc

SEQ ID NO: 2344769 - RNA, 17 nt, Bordetella pertussis
ccugcgccauggcgcgc

SEQ ID NO: 2344770 - RNA, 12 nt, Bordetella pertussis
ccugcgccgccg

SEQ ID NO: 2344771 - RNA, 18 nt, Bordetella pertussis
ccugcgccgccgcgcgcu

SEQ ID NO: 2344772 - RNA, 17 nt, Bordetella pertussis
ccugcgccgcuuccggc

SEQ ID NO: 2344773 - RNA, 16 nt, Bordetella pertussis
ccugcgccgggcgcgg

SEQ ID NO: 2344774 - RNA, 21 nt, Bordetella pertussis
ccugcgccgggcgcggccagg

SEQ ID NO: 2344775 - RNA, 14 nt, Bordetella pertussis
ccugcgccgggucc

SEQ ID NO: 2344776 - RNA, 22 nt, Bordetella pertussis
ccugcgccggguccggccgcgc

SEQ ID NO: 2344777 - RNA, 20 nt, Bordetella pertussis
ccugcgccgucugcgccgcc

SEQ ID NO: 2344778 - RNA, 21 nt, Bordetella pertussis
ccugcgccgucugcgccgccg

SEQ ID NO: 2344779 - RNA, 11 nt, Bordetella pertussis
ccugcgcgaaa

SEQ ID NO: 2344780 - RNA, 18 nt, Bordetella pertussis
ccugcgcgaagcgcuggg

SEQ ID NO: 2344781 - RNA, 19 nt, Bordetella pertussis
ccugcgcgccgaccagguc

SEQ ID NO: 2344782 - RNA, 12 nt, Bordetella pertussis
ccugcgcgccgc

SEQ ID NO: 2344783 - RNA, 13 nt, Bordetella pertussis
ccugcgcgccgcc

SEQ ID NO: 2344784 - RNA, 15 nt, Bordetella pertussis
ccugcgcgccgccgg

SEQ ID NO: 2344785 - RNA, 15 nt, Bordetella pertussis
ccugcgcgccgccuc

SEQ ID NO: 2344786 - RNA, 16 nt, Bordetella pertussis
ccugcgcgccgccucg

SEQ ID NO: 2344787 - RNA, 15 nt, Bordetella pertussis
ccugcgcgccggguu

SEQ ID NO: 2344788 - RNA, 12 nt, Bordetella pertussis
ccugcgcgcgcu

SEQ ID NO: 2344789 - RNA, 14 nt, Bordetella pertussis
ccugcgcgcgcugg

SEQ ID NO: 2344790 - RNA, 15 nt, Bordetella pertussis
ccugcgcgcgcuggg

SEQ ID NO: 2344791 - RNA, 16 nt, Bordetella pertussis
ccugcgcguacguggc

SEQ ID NO: 2344792 - RNA, 18 nt, Bordetella pertussis
ccugcgcguacguggcgc

SEQ ID NO: 2344793 - RNA, 20 nt, Bordetella pertussis
ccugcgcugcauacgccgcu

SEQ ID NO: 2344794 - RNA, 21 nt, Bordetella pertussis
ccugcgcugcauacgccgcug

SEQ ID NO: 2344795 - RNA, 23 nt, Bordetella pertussis
ccugcggacccaguucggccgcc

SEQ ID NO: 2344796 - RNA, 17 nt, Bordetella pertussis
ccugcggcacgaucggc

SEQ ID NO: 2344797 - RNA, 15 nt, Bordetella pertussis
ccugcggcagcgacu

SEQ ID NO: 2344798 - RNA, 14 nt, Bordetella pertussis
ccugcggcaggccg

SEQ ID NO: 2344799 - RNA, 16 nt, Bordetella pertussis
ccugcggcaggccgca

SEQ ID NO: 2344800 - RNA, 17 nt, Bordetella pertussis
ccugcggcaggccgcag

SEQ ID NO: 2344801 - RNA, 22 nt, Bordetella pertussis
ccugcggcgauuucuacgccga

SEQ ID NO: 2344802 - RNA, 13 nt, Bordetella pertussis
ccugcggcgccag

SEQ ID NO: 2344803 - RNA, 19 nt, Bordetella pertussis
ccugcggcgccagcgccgc

SEQ ID NO: 2344804 - RNA, 13 nt, Bordetella pertussis
ccugcggcgcggc

SEQ ID NO: 2344805 - RNA, 15 nt, Bordetella pertussis
ccugcggcgcggcca

SEQ ID NO: 2344806 - RNA, 15 nt, Bordetella pertussis
ccugcggcgcggccg

SEQ ID NO: 2344807 - RNA, 23 nt, Bordetella pertussis
ccugcggcgcggccgacguggac

SEQ ID NO: 2344808 - RNA, 17 nt, Bordetella pertussis
ccugcggcggcagcuug

SEQ ID NO: 2344809 - RNA, 16 nt, Bordetella pertussis
ccugcggcgucaggcc

SEQ ID NO: 2344810 - RNA, 14 nt, Bordetella pertussis
ccugcggcucgagg

SEQ ID NO: 2344811 - RNA, 14 nt, Bordetella pertussis
ccugcgggcgccgc

SEQ ID NO: 2344812 - RNA, 23 nt, Bordetella pertussis
ccugcgggcugaugcaggccugc

SEQ ID NO: 2344813 - RNA, 19 nt, Bordetella pertussis
ccugcggggacaggcaccc

SEQ ID NO: 2344814 - RNA, 13 nt, Bordetella pertussis
ccugcggggucug

SEQ ID NO: 2344815 - RNA, 12 nt, Bordetella pertussis
ccugcgggugcg

SEQ ID NO: 2344816 - RNA, 19 nt, Bordetella pertussis
ccugcgggugcgccugcag

SEQ ID NO: 2344817 - RNA, 19 nt, Bordetella pertussis
ccugcgucaguugaagacg

SEQ ID NO: 2344818 - RNA, 15 nt, Bordetella pertussis
ccugcguccagccga

SEQ ID NO: 2344819 - RNA, 16 nt, Bordetella pertussis
ccugcguccagccgag

SEQ ID NO: 2344820 - RNA, 23 nt, Bordetella pertussis
ccugcguccagccgagccuggcg

SEQ ID NO: 2344821 - RNA, 14 nt, Bordetella pertussis
ccugcgucguugcc

SEQ ID NO: 2344822 - RNA, 15 nt, Bordetella pertussis
ccugcgucguugccc

SEQ ID NO: 2344823 - RNA, 14 nt, Bordetella pertussis
ccugcgucugcgug

SEQ ID NO: 2344824 - RNA, 12 nt, Bordetella pertussis
ccugcguggccu

SEQ ID NO: 2344825 - RNA, 21 nt, Bordetella pertussis
ccugcguggcgcagugggcca

SEQ ID NO: 2344826 - RNA, 16 nt, Bordetella pertussis
ccugcguggcgggccg

SEQ ID NO: 2344827 - RNA, 17 nt, Bordetella pertussis
ccugcguggcgggccgc

SEQ ID NO: 2344828 - RNA, 20 nt, Bordetella pertussis
ccugcguggcgggccgcgcc

SEQ ID NO: 2344829 - RNA, 22 nt, Bordetella pertussis
ccugcguggcgggccgcgccgc

SEQ ID NO: 2344830 - RNA, 17 nt, Bordetella pertussis
ccugcgugucaggcgga

SEQ ID NO: 2344831 - RNA, 22 nt, Bordetella pertussis
ccugcuaguacaccgucgcgcg

SEQ ID NO: 2344832 - RNA, 20 nt, Bordetella pertussis
ccugcucccacgaacgccac

SEQ ID NO: 2344833 - RNA, 16 nt, Bordetella pertussis
ccugcucgaccugcuc

SEQ ID NO: 2344834 - RNA, 12 nt, Bordetella pertussis
cgcccugacgcc

SEQ ID NO: 2344835 - RNA, 21 nt, Bordetella pertussis
cgcccugacgccugcgccggg

SEQ ID NO: 2344836 - RNA, 23 nt, Bordetella pertussis
cgcccugacgccugcgccggguc

SEQ ID NO: 2344837 - RNA, 15 nt, Bordetella pertussis
cgcccugcacgcgcg

SEQ ID NO: 2344838 - RNA, 23 nt, Bordetella pertussis
cgcccugcacgcgcgcgugcagg

SEQ ID NO: 2344839 - RNA, 20 nt, Bordetella pertussis
cgcccugcagggcaugggcc

SEQ ID NO: 2344840 - RNA, 22 nt, Bordetella pertussis
cgcccugcagggcaugggcccg

SEQ ID NO: 2344841 - RNA, 20 nt, Bordetella pertussis
cgcccugccauucggacacg

SEQ ID NO: 2344842 - RNA, 14 nt, Bordetella pertussis
cgcccugcccggcg

SEQ ID NO: 2344843 - RNA, 15 nt, Bordetella pertussis
cgcccugcccggcga

SEQ ID NO: 2344844 - RNA, 20 nt, Bordetella pertussis
cgcccugcccggcgagcaug

SEQ ID NO: 2344845 - RNA, 18 nt, Bordetella pertussis
cgcccugcgaacccgccg

SEQ ID NO: 2344846 - RNA, 21 nt, Bordetella pertussis
cgcccugcgcguacguggcgc

SEQ ID NO: 2344847 - RNA, 17 nt, Bordetella pertussis
cgcccugcugcccgccg

SEQ ID NO: 2344848 - RNA, 12 nt, Bordetella pertussis
cgcccugcuggc

SEQ ID NO: 2344849 - RNA, 16 nt, Bordetella pertussis
cgcccugcuggcgcag

SEQ ID NO: 2344850 - RNA, 18 nt, Bordetella pertussis
cgcccuggauggcggccg

SEQ ID NO: 2344851 - RNA, 20 nt, Bordetella pertussis
cgcccuggauggcggccgcc

SEQ ID NO: 2344852 - RNA, 14 nt, Bordetella pertussis
cgcccuggcagcug

SEQ ID NO: 2344853 - RNA, 16 nt, Bordetella pertussis
cgcccuggcagcuggc

SEQ ID NO: 2344854 - RNA, 22 nt, Bordetella pertussis
cgcccuggcagcuggcgcgggc

SEQ ID NO: 2344855 - RNA, 14 nt, Bordetella pertussis
cgcccuggccgcgc

SEQ ID NO: 2344856 - RNA, 23 nt, Bordetella pertussis
cgcccuggccguacauggccagg

SEQ ID NO: 2344857 - RNA, 12 nt, Bordetella pertussis
cgcccuggccuu

SEQ ID NO: 2344858 - RNA, 15 nt, Bordetella pertussis
cgcccuggcgcaggc

SEQ ID NO: 2344859 - RNA, 18 nt, Bordetella pertussis
cgcccuggcgcaggccgg

SEQ ID NO: 2344860 - RNA, 16 nt, Bordetella pertussis
cgcccuggcgcagggc

SEQ ID NO: 2344861 - RNA, 12 nt, Bordetella pertussis
cgcccuggcgcg

SEQ ID NO: 2344862 - RNA, 16 nt, Bordetella pertussis
cgcccuggcgcgaggc

SEQ ID NO: 2344863 - RNA, 22 nt, Bordetella pertussis
cgcccuggcgcgaggcggcgac

SEQ ID NO: 2344864 - RNA, 15 nt, Bordetella pertussis
cgcccuggcgcggcg

SEQ ID NO: 2344865 - RNA, 16 nt, Bordetella pertussis
cgcccuggcgcggcgg

SEQ ID NO: 2344866 - RNA, 15 nt, Bordetella pertussis
cgcccuggcggcggu

SEQ ID NO: 2344867 - RNA, 18 nt, Bordetella pertussis
cgcccuggcguggcgcgc

SEQ ID NO: 2344868 - RNA, 19 nt, Bordetella pertussis
cgcccuggcguggcgcgcg

SEQ ID NO: 2344869 - RNA, 17 nt, Bordetella pertussis
cgcccuggcugagcgac

SEQ ID NO: 2344870 - RNA, 16 nt, Bordetella pertussis
cgcccuggcuggcggc

SEQ ID NO: 2344871 - RNA, 17 nt, Bordetella pertussis
cgcccuggcuggcggcc

SEQ ID NO: 2344872 - RNA, 18 nt, Bordetella pertussis
cgcccuggcuggcggccc

SEQ ID NO: 2344873 - RNA, 23 nt, Bordetella pertussis
cgcccuggggcgcgguccggauc

SEQ ID NO: 2344874 - RNA, 17 nt, Bordetella pertussis
cgcccuggucaucgcca

SEQ ID NO: 2344875 - RNA, 20 nt, Bordetella pertussis
cgcccugucggugaugaucc

SEQ ID NO: 2344876 - RNA, 14 nt, Bordetella pertussis
cgcccuucaggcca

SEQ ID NO: 2344877 - RNA, 13 nt, Bordetella pertussis
cgcccuucaggua

SEQ ID NO: 2344878 - RNA, 22 nt, Bordetella pertussis
cgcccuugagcacggcgcggcu

SEQ ID NO: 2344879 - RNA, 19 nt, Bordetella pertussis
cgcccuugauggccucggc

SEQ ID NO: 2344880 - RNA, 23 nt, Bordetella pertussis
cgcccuugauggccucggcggcc

SEQ ID NO: 2344881 - RNA, 16 nt, Bordetella pertussis
cgcccuugccagggcc

SEQ ID NO: 2344882 - RNA, 18 nt, Bordetella pertussis
cgcccuugccagggccug

SEQ ID NO: 2344883 - RNA, 16 nt, Bordetella pertussis
cgcccuugcggcgagg

SEQ ID NO: 2344884 - RNA, 20 nt, Bordetella pertussis
cgcccuugggcucgucgacg

SEQ ID NO: 2344885 - RNA, 21 nt, Bordetella pertussis
cgccgaccgcacgauggcgcg

SEQ ID NO: 2344886 - RNA, 20 nt, Bordetella pertussis
cgccgaccggccccaccugg

SEQ ID NO: 2344887 - RNA, 15 nt, Bordetella pertussis
cgccgaccgggccga

SEQ ID NO: 2344888 - RNA, 22 nt, Bordetella pertussis
cgccgaccgggccgaccaggcc

SEQ ID NO: 2344889 - RNA, 20 nt, Bordetella pertussis
cgccgaccucggcaccgagg

SEQ ID NO: 2344890 - RNA, 23 nt, Bordetella pertussis
cgccgaccucggcaccgaggccg

SEQ ID NO: 2344891 - RNA, 17 nt, Bordetella pertussis
cgccgaccucgucgggc

SEQ ID NO: 2344892 - RNA, 14 nt, Bordetella pertussis
cgccgaccuggcgc

SEQ ID NO: 2344893 - RNA, 21 nt, Bordetella pertussis
cgccgacgaaagcggcaaagc

SEQ ID NO: 2344894 - RNA, 20 nt, Bordetella pertussis
cgccgacgaaaugccggcga

SEQ ID NO: 2344895 - RNA, 23 nt, Bordetella pertussis
cgccgacgaccgaaccgauccag

SEQ ID NO: 2344896 - RNA, 14 nt, Bordetella pertussis
cgccgacgaugacc

SEQ ID NO: 2344897 - RNA, 18 nt, Bordetella pertussis
cgccgacgaugccgccca

SEQ ID NO: 2344898 - RNA, 23 nt, Bordetella pertussis
cgccgacgaugccgcccacgcca

SEQ ID NO: 2344899 - RNA, 14 nt, Bordetella pertussis
cgccgacgaugcgg

SEQ ID NO: 2344900 - RNA, 17 nt, Bordetella pertussis
cgccgacgaugucgccg

SEQ ID NO: 2344901 - RNA, 21 nt, Bordetella pertussis
cgccgacgaugucgccgccgc

SEQ ID NO: 2344902 - RNA, 15 nt, Bordetella pertussis
cgccgacgccgccac

SEQ ID NO: 2344903 - RNA, 16 nt, Bordetella pertussis
cgccgacgccgccacg

SEQ ID NO: 2344904 - RNA, 19 nt, Bordetella pertussis
cgccgacgccgccacgcug

SEQ ID NO: 2344905 - RNA, 13 nt, Bordetella pertussis
cgccgacgcgccg

SEQ ID NO: 2344906 - RNA, 14 nt, Bordetella pertussis
cgccgacgcgcugg

SEQ ID NO: 2344907 - RNA, 19 nt, Bordetella pertussis
cgccgacggcauggccggc

SEQ ID NO: 2344908 - RNA, 21 nt, Bordetella pertussis
cgccgacggcauggccggcag

SEQ ID NO: 2344909 - RNA, 20 nt, Bordetella pertussis
cgccgacggcauggcggcca

SEQ ID NO: 2344910 - RNA, 15 nt, Bordetella pertussis
cgccgacggcgcccu

SEQ ID NO: 2344911 - RNA, 22 nt, Bordetella pertussis
cgccgacggcgcccugcagggc

SEQ ID NO: 2344912 - RNA, 17 nt, Bordetella pertussis
cgccgacggcggcgcgg

SEQ ID NO: 2344913 - RNA, 13 nt, Bordetella pertussis
cgccgacgggccg

SEQ ID NO: 2344914 - RNA, 14 nt, Bordetella pertussis
cgccgacgggccgg

SEQ ID NO: 2344915 - RNA, 15 nt, Bordetella pertussis
cgccgacgggccggu

SEQ ID NO: 2344916 - RNA, 18 nt, Bordetella pertussis
cgccgacguagucgcgcc

SEQ ID NO: 2344917 - RNA, 19 nt, Bordetella pertussis
cgccgacguagucgcgcca

SEQ ID NO: 2344918 - RNA, 20 nt, Bordetella pertussis
cgccgacguagucgcgccag

SEQ ID NO: 2344919 - RNA, 21 nt, Bordetella pertussis
cgccgacguagucgcgccagc

SEQ ID NO: 2344920 - RNA, 19 nt, Bordetella pertussis
cgccgacugggcuugccgg

SEQ ID NO: 2344921 - RNA, 20 nt, Bordetella pertussis
cgccgacugggugcgccuga

SEQ ID NO: 2344922 - RNA, 16 nt, Bordetella pertussis
cgccgacuucagacag

SEQ ID NO: 2344923 - RNA, 22 nt, Bordetella pertussis
cgccgacuuccugggugcgcca

SEQ ID NO: 2344924 - RNA, 21 nt, Bordetella pertussis
cgccgagaaauccagcgcgcc

SEQ ID NO: 2344925 - RNA, 22 nt, Bordetella pertussis
cgccgagaaauccagcgcgccc

SEQ ID NO: 2344926 - RNA, 21 nt, Bordetella pertussis
cgccgagaagauuucccagag

SEQ ID NO: 2344927 - RNA, 19 nt, Bordetella pertussis
cgccgagcagaucgccaac

SEQ ID NO: 2344928 - RNA, 12 nt, Bordetella pertussis
cgccgagcaggg

SEQ ID NO: 2344929 - RNA, 14 nt, Bordetella pertussis
cgccgagccgcugu

SEQ ID NO: 2344930 - RNA, 14 nt, Bordetella pertussis
cgccgagccgggcc

SEQ ID NO: 2344931 - RNA, 14 nt, Bordetella pertussis
cgccgagcgccagu

SEQ ID NO: 2344932 - RNA, 15 nt, Bordetella pertussis
cgccgagcggcaucu

SEQ ID NO: 2344933 - RNA, 14 nt, Bordetella pertussis
cgccgagcggggcc

SEQ ID NO: 2344934 - RNA, 15 nt, Bordetella pertussis
cgccgagcggggccg

SEQ ID NO: 2344935 - RNA, 18 nt, Bordetella pertussis
cgccgagcggggccgcgc

SEQ ID NO: 2344936 - RNA, 20 nt, Bordetella pertussis
cgccgaggaucuggccggcg

SEQ ID NO: 2344937 - RNA, 18 nt, Bordetella pertussis
cgccgaggcggugggcag

SEQ ID NO: 2344938 - RNA, 19 nt, Bordetella pertussis
cgccgaggcggugggcagg

SEQ ID NO: 2344939 - RNA, 16 nt, Bordetella pertussis
cgccgagggccgcgcg

SEQ ID NO: 2344940 - RNA, 17 nt, Bordetella pertussis
cgccgagggccgcgcga

SEQ ID NO: 2344941 - RNA, 13 nt, Bordetella pertussis
cgccgagucggcg

SEQ ID NO: 2344942 - RNA, 19 nt, Bordetella pertussis
cgccgagucggcgauggcg

SEQ ID NO: 2344943 - RNA, 20 nt, Bordetella pertussis
cgccgagucggcgauggcgc

SEQ ID NO: 2344944 - RNA, 22 nt, Bordetella pertussis
cgccgagucggcgauggcgcgc

SEQ ID NO: 2344945 - RNA, 17 nt, Bordetella pertussis
cgccgauaccacgcgcg

SEQ ID NO: 2344946 - RNA, 19 nt, Bordetella pertussis
cgccgauaccacgcgcggc

SEQ ID NO: 2344947 - RNA, 20 nt, Bordetella pertussis
cgccgauaccacgcgcggcg

SEQ ID NO: 2344948 - RNA, 17 nt, Bordetella pertussis
cgccgaucaccacgggc

SEQ ID NO: 2344949 - RNA, 21 nt, Bordetella pertussis
cgccgaucaccacgggcacga

SEQ ID NO: 2344950 - RNA, 16 nt, Bordetella pertussis
cgccgaucagcagguc

SEQ ID NO: 2344951 - RNA, 22 nt, Bordetella pertussis
ccugcucgcaggccugcugcag

SEQ ID NO: 2344952 - RNA, 22 nt, Bordetella pertussis
ccugcucgcccacauagcggcc

SEQ ID NO: 2344953 - RNA, 23 nt, Bordetella pertussis
ccugcucgcccacauagcggccg

SEQ ID NO: 2344954 - RNA, 21 nt, Bordetella pertussis
ccugcucgccggccagcgcgg

SEQ ID NO: 2344955 - RNA, 22 nt, Bordetella pertussis
ccugcucgccggccagcgcggu

SEQ ID NO: 2344956 - RNA, 14 nt, Bordetella pertussis
ccugcucgcgcagc

SEQ ID NO: 2344957 - RNA, 19 nt, Bordetella pertussis
ccugcucgggcgccucguc

SEQ ID NO: 2344958 - RNA, 12 nt, Bordetella pertussis
ccugcucgguga

SEQ ID NO: 2344959 - RNA, 20 nt, Bordetella pertussis
ccugcucggugcucuggccc

SEQ ID NO: 2344960 - RNA, 23 nt, Bordetella pertussis
ccugcucggugcucuggcccgcc

SEQ ID NO: 2344961 - RNA, 16 nt, Bordetella pertussis
ccugcucguagcuguc

SEQ ID NO: 2344962 - RNA, 19 nt, Bordetella pertussis
ccugcucgucgccaugcgg

SEQ ID NO: 2344963 - RNA, 22 nt, Bordetella pertussis
ccugcucgugcaucaucugggc

SEQ ID NO: 2344964 - RNA, 18 nt, Bordetella pertussis
ccugcugcagcacacgca

SEQ ID NO: 2344965 - RNA, 15 nt, Bordetella pertussis
ccugcugcccgccgc

SEQ ID NO: 2344966 - RNA, 17 nt, Bordetella pertussis
ccugcugcccgccgccg

SEQ ID NO: 2344967 - RNA, 16 nt, Bordetella pertussis
ccugcugcgccgucug

SEQ ID NO: 2344968 - RNA, 12 nt, Bordetella pertussis
ccugcugcgccu

SEQ ID NO: 2344969 - RNA, 17 nt, Bordetella pertussis
ccugcugcgccuggccg

SEQ ID NO: 2344970 - RNA, 21 nt, Bordetella pertussis
ccugcugcgccuggccgcgcu

SEQ ID NO: 2344971 - RNA, 13 nt, Bordetella pertussis
ccugcugcggcac

SEQ ID NO: 2344972 - RNA, 15 nt, Bordetella pertussis
ccugcugcggcacgg

SEQ ID NO: 2344973 - RNA, 14 nt, Bordetella pertussis
ccugcugcugcagc

SEQ ID NO: 2344974 - RNA, 18 nt, Bordetella pertussis
ccugcuggccaccgucgc

SEQ ID NO: 2344975 - RNA, 13 nt, Bordetella pertussis
ccugcuggccgcc

SEQ ID NO: 2344976 - RNA, 15 nt, Bordetella pertussis
ccugcuggccgccgg

SEQ ID NO: 2344977 - RNA, 19 nt, Bordetella pertussis
ccugcuggcgcgcaccauc

SEQ ID NO: 2344978 - RNA, 22 nt, Bordetella pertussis
ccugcuggcguuugcgcgcgcg

SEQ ID NO: 2344979 - RNA, 14 nt, Bordetella pertussis
ccugcugggccgcg

SEQ ID NO: 2344980 - RNA, 16 nt, Bordetella pertussis
ccugcugggccgcgcu

SEQ ID NO: 2344981 - RNA, 23 nt, Bordetella pertussis
ccugcugggguggagcgcggcgc

SEQ ID NO: 2344982 - RNA, 15 nt, Bordetella pertussis
ccugcuggucggcgu

SEQ ID NO: 2344983 - RNA, 22 nt, Bordetella pertussis
ccugcugucgcugggaugggua

SEQ ID NO: 2344984 - RNA, 14 nt, Bordetella pertussis
ccugcugugcccca

SEQ ID NO: 2344985 - RNA, 16 nt, Bordetella pertussis
ccugcuugaagacgcc

SEQ ID NO: 2344986 - RNA, 21 nt, Bordetella pertussis
ccugcuugcaggaagcgcacc

SEQ ID NO: 2344987 - RNA, 14 nt, Bordetella pertussis
ccugcuugcccagc

SEQ ID NO: 2344988 - RNA, 15 nt, Bordetella pertussis
ccugcuuggcagccu

SEQ ID NO: 2344989 - RNA, 17 nt, Bordetella pertussis
ccugcuuggcagccuug

SEQ ID NO: 2344990 - RNA, 15 nt, Bordetella pertussis
ccugcuuggccgcgu

SEQ ID NO: 2344991 - RNA, 13 nt, Bordetella pertussis
ccugcuuggcgcg

SEQ ID NO: 2344992 - RNA, 15 nt, Bordetella pertussis
ccugcuuggcgcgca

SEQ ID NO: 2344993 - RNA, 17 nt, Bordetella pertussis
ccugcuuggcgcgcagc

SEQ ID NO: 2344994 - RNA, 18 nt, Bordetella pertussis
ccugcuuggcgcgcagca

SEQ ID NO: 2344995 - RNA, 21 nt, Bordetella pertussis
ccugcuuggcgcgcagcagcg

SEQ ID NO: 2344996 - RNA, 23 nt, Bordetella pertussis
ccugcuuggcgcgcagcagcgca

SEQ ID NO: 2344997 - RNA, 21 nt, Bordetella pertussis
ccuggaacuugggaucggcca

SEQ ID NO: 2344998 - RNA, 12 nt, Bordetella pertussis
ccuggaagcugg

SEQ ID NO: 2344999 - RNA, 19 nt, Bordetella pertussis
ccuggaagcuggccagcgg

SEQ ID NO: 2345000 - RNA, 23 nt, Bordetella pertussis
ccuggaagugaugccgccggcgg

SEQ ID NO: 2345001 - RNA, 18 nt, Bordetella pertussis
ccuggacagugcccugac

SEQ ID NO: 2345002 - RNA, 20 nt, Bordetella pertussis
ccuggacagugcccugaccc

SEQ ID NO: 2345003 - RNA, 22 nt, Bordetella pertussis
ccuggaccugacccccgaacug

SEQ ID NO: 2345004 - RNA, 15 nt, Bordetella pertussis
ccuggaccugagcca

SEQ ID NO: 2345005 - RNA, 23 nt, Bordetella pertussis
ccuggacgaugcgcgaagcgccc

SEQ ID NO: 2345006 - RNA, 14 nt, Bordetella pertussis
ccuggacgggcugg

SEQ ID NO: 2345007 - RNA, 15 nt, Bordetella pertussis
ccuggacggggugcg

SEQ ID NO: 2345008 - RNA, 19 nt, Bordetella pertussis
ccuggacgucugagcgccg

SEQ ID NO: 2345009 - RNA, 21 nt, Bordetella pertussis
ccuggacgucugagcgccggg

SEQ ID NO: 2345010 - RNA, 21 nt, Bordetella pertussis
ccuggagacguagccgcugcc

SEQ ID NO: 2345011 - RNA, 22 nt, Bordetella pertussis
ccuggagcucgggugggccggc

SEQ ID NO: 2345012 - RNA, 14 nt, Bordetella pertussis
ccuggagcuuggcc

SEQ ID NO: 2345013 - RNA, 16 nt, Bordetella pertussis
ccuggagcuuggccgg

SEQ ID NO: 2345014 - RNA, 19 nt, Bordetella pertussis
ccuggaggccgagcgcgag

SEQ ID NO: 2345015 - RNA, 21 nt, Bordetella pertussis
ccuggaggccgagcgcgagca

SEQ ID NO: 2345016 - RNA, 22 nt, Bordetella pertussis
ccuggagucugcgugugccgcc

SEQ ID NO: 2345017 - RNA, 20 nt, Bordetella pertussis
ccuggaucacgugccagccg

SEQ ID NO: 2345018 - RNA, 22 nt, Bordetella pertussis
ccuggaucacgugccagccgaa

SEQ ID NO: 2345019 - RNA, 24 nt, Bordetella pertussis
ccuggaucaggaugggcgcggcgc

SEQ ID NO: 2345020 - RNA, 16 nt, Bordetella pertussis
ccuggaucagggugag

SEQ ID NO: 2345021 - RNA, 15 nt, Bordetella pertussis
ccuggauggcggccg

SEQ ID NO: 2345022 - RNA, 16 nt, Bordetella pertussis
ccuggauggcggccgc

SEQ ID NO: 2345023 - RNA, 18 nt, Bordetella pertussis
ccuggauggcggccgcca

SEQ ID NO: 2345024 - RNA, 20 nt, Bordetella pertussis
ccuggauggcggccgccagc

SEQ ID NO: 2345025 - RNA, 23 nt, Bordetella pertussis
ccuggauggcggccgccagcgcc

SEQ ID NO: 2345026 - RNA, 17 nt, Bordetella pertussis
ccuggaugugcgcgggc

SEQ ID NO: 2345027 - RNA, 19 nt, Bordetella pertussis
ccuggaugugcgcgggcgc

SEQ ID NO: 2345028 - RNA, 21 nt, Bordetella pertussis
ccuggaugugcgcgggcgcgg

SEQ ID NO: 2345029 - RNA, 22 nt, Bordetella pertussis
ccuggaugugcgcgggcgcggg

SEQ ID NO: 2345030 - RNA, 18 nt, Bordetella pertussis
ccuggcaaugcguggccg

SEQ ID NO: 2345031 - RNA, 20 nt, Bordetella pertussis
ccuggcaaugcguggccggc

SEQ ID NO: 2345032 - RNA, 21 nt, Bordetella pertussis
ccuggcaaugcguggccggcg

SEQ ID NO: 2345033 - RNA, 22 nt, Bordetella pertussis
ccuggcaaugcguggccggcgg

SEQ ID NO: 2345034 - RNA, 17 nt, Bordetella pertussis
ccuggcacgacguggcc

SEQ ID NO: 2345035 - RNA, 11 nt, Bordetella pertussis
ccuggcacgcu

SEQ ID NO: 2345036 - RNA, 19 nt, Bordetella pertussis
ccuggcagacguacuugau

SEQ ID NO: 2345037 - RNA, 18 nt, Bordetella pertussis
ccuggcagaugcgcgcca

SEQ ID NO: 2345038 - RNA, 19 nt, Bordetella pertussis
ccuggcagaugcgcgccag

SEQ ID NO: 2345039 - RNA, 20 nt, Bordetella pertussis
ccuggcagaugcgcgccagg

SEQ ID NO: 2345040 - RNA, 22 nt, Bordetella pertussis
ccuggcagaugcgcgccaggcg

SEQ ID NO: 2345041 - RNA, 23 nt, Bordetella pertussis
ccuggcagaugcgcgccaggcgc

SEQ ID NO: 2345042 - RNA, 22 nt, Bordetella pertussis
ccuggcagccgaugauggugaa

SEQ ID NO: 2345043 - RNA, 16 nt, Bordetella pertussis
ccuggcagucagccgu

SEQ ID NO: 2345044 - RNA, 22 nt, Bordetella pertussis
ccuggcaugugccaccgcccag

SEQ ID NO: 2345045 - RNA, 17 nt, Bordetella pertussis
ccuggccacaagcggcc

SEQ ID NO: 2345046 - RNA, 20 nt, Bordetella pertussis
ccuggccacaagcggcccca

SEQ ID NO: 2345047 - RNA, 21 nt, Bordetella pertussis
ccuggccacaagcggccccag

SEQ ID NO: 2345048 - RNA, 22 nt, Bordetella pertussis
ccuggccacaagcggccccagg

SEQ ID NO: 2345049 - RNA, 15 nt, Bordetella pertussis
ccuggccacgcugcu

SEQ ID NO: 2345050 - RNA, 14 nt, Bordetella pertussis
ccuggccagauagc

SEQ ID NO: 2345051 - RNA, 19 nt, Bordetella pertussis
ccuggccagauagcccagg

SEQ ID NO: 2345052 - RNA, 21 nt, Bordetella pertussis
ccuggccagauagcccaggcg

SEQ ID NO: 2345053 - RNA, 13 nt, Bordetella pertussis
ccuggccagcgug

SEQ ID NO: 2345054 - RNA, 22 nt, Bordetella pertussis
ccuggccauuccuuccgggccc

SEQ ID NO: 2345055 - RNA, 23 nt, Bordetella pertussis
ccuggcccacaucgucgcgcugg

SEQ ID NO: 2345056 - RNA, 14 nt, Bordetella pertussis
ccuggcccagcgca

SEQ ID NO: 2345057 - RNA, 14 nt, Bordetella pertussis
ccuggcccagcucc

SEQ ID NO: 2345058 - RNA, 23 nt, Bordetella pertussis
ccuggcccagcuccagcuggcgc

SEQ ID NO: 2345059 - RNA, 20 nt, Bordetella pertussis
ccuggcccaugaacaggcac

SEQ ID NO: 2345060 - RNA, 18 nt, Bordetella pertussis
ccuggccgaacgccgccg

SEQ ID NO: 2345061 - RNA, 21 nt, Bordetella pertussis
ccuggccgauuucgcgcgcca

SEQ ID NO: 2345062 - RNA, 14 nt, Bordetella pertussis
ccuggccgccgcgg

SEQ ID NO: 2345063 - RNA, 18 nt, Bordetella pertussis
ccuggccgccgcgggcgc

SEQ ID NO: 2345064 - RNA, 12 nt, Bordetella pertussis
ccuggccgcgcg

SEQ ID NO: 2345065 - RNA, 15 nt, Bordetella pertussis
ccuggccgcgcgccu

SEQ ID NO: 2345066 - RNA, 19 nt, Bordetella pertussis
ccuggccgcgcugaucacc

SEQ ID NO: 2345067 - RNA, 12 nt, Bordetella pertussis
ccuggccggcgc

SEQ ID NO: 2345068 - RNA, 14 nt, Bordetella pertussis
ccuggccggcgccg

SEQ ID NO: 2345069 - RNA, 14 nt, Bordetella pertussis
ccuggccgggacaa

SEQ ID NO: 2345070 - RNA, 22 nt, Bordetella pertussis
ccuggccgggacaaucgaagau

SEQ ID NO: 2345071 - RNA, 20 nt, Bordetella pertussis
ccuggccggggaagccgccg

SEQ ID NO: 2345072 - RNA, 14 nt, Bordetella pertussis
ccuggccugcgccg

SEQ ID NO: 2345073 - RNA, 14 nt, Bordetella pertussis
ccuggcgcaggccg

SEQ ID NO: 2345074 - RNA, 14 nt, Bordetella pertussis
ccuggcgcagggca

SEQ ID NO: 2345075 - RNA, 15 nt, Bordetella pertussis
ccuggcgcagggcau

SEQ ID NO: 2345076 - RNA, 18 nt, Bordetella pertussis
ccuggcgcccgacggcgc

SEQ ID NO: 2345077 - RNA, 14 nt, Bordetella pertussis
ccuggcgcccggcg

SEQ ID NO: 2345078 - RNA, 21 nt, Bordetella pertussis
ccuggcgcccggcggcgcgcu

SEQ ID NO: 2345079 - RNA, 18 nt, Bordetella pertussis
ccuggcgcgacgccugcg

SEQ ID NO: 2345080 - RNA, 12 nt, Bordetella pertussis
ccuggcgcgcca

SEQ ID NO: 2345081 - RNA, 13 nt, Bordetella pertussis
ccuggcgcgccag

SEQ ID NO: 2345082 - RNA, 15 nt, Bordetella pertussis
ccuggcgcgccagcu

SEQ ID NO: 2345083 - RNA, 16 nt, Bordetella pertussis
ccuggcgcgccagcuc

SEQ ID NO: 2345084 - RNA, 16 nt, Bordetella pertussis
ccuggcgcggcgccug

SEQ ID NO: 2345085 - RNA, 15 nt, Bordetella pertussis
ccuggcgcuccucgc

SEQ ID NO: 2345086 - RNA, 18 nt, Bordetella pertussis
ccuggcgcuccucgcgcg

SEQ ID NO: 2345087 - RNA, 23 nt, Bordetella pertussis
ccuggcgcuguuuccgggccugg

SEQ ID NO: 2345088 - RNA, 14 nt, Bordetella pertussis
ccuggcggacgaug

SEQ ID NO: 2345089 - RNA, 20 nt, Bordetella pertussis
ccuggcggacgauggccugu

SEQ ID NO: 2345090 - RNA, 12 nt, Bordetella pertussis
ccuggcggccgc

SEQ ID NO: 2345091 - RNA, 13 nt, Bordetella pertussis
ccuggcggccgcc

SEQ ID NO: 2345092 - RNA, 12 nt, Bordetella pertussis
cgaccuugcggc

SEQ ID NO: 2345093 - RNA, 14 nt, Bordetella pertussis
cgaccuugcggccg

SEQ ID NO: 2345094 - RNA, 16 nt, Bordetella pertussis
cgaccuugcggccgcg

SEQ ID NO: 2345095 - RNA, 22 nt, Bordetella pertussis
cgaccuugcuggaccgcgccug

SEQ ID NO: 2345096 - RNA, 15 nt, Bordetella pertussis
cgaccuuggcggccg

SEQ ID NO: 2345097 - RNA, 18 nt, Bordetella pertussis
cgaccuuggcggccgaca

SEQ ID NO: 2345098 - RNA, 19 nt, Bordetella pertussis
cgaccuuggcggccgacag

SEQ ID NO: 2345099 - RNA, 18 nt, Bordetella pertussis
cgacgaaacccgggccgu

SEQ ID NO: 2345100 - RNA, 18 nt, Bordetella pertussis
cgacgaaagcggcaaagc

SEQ ID NO: 2345101 - RNA, 18 nt, Bordetella pertussis
cgacgaaauagccgacca

SEQ ID NO: 2345102 - RNA, 19 nt, Bordetella pertussis
cgacgaaauagccgaccac

SEQ ID NO: 2345103 - RNA, 23 nt, Bordetella pertussis
cgacgaaauagccgaccacccgc

SEQ ID NO: 2345104 - RNA, 12 nt, Bordetella pertussis
cgacgaaaugcc

SEQ ID NO: 2345105 - RNA, 16 nt, Bordetella pertussis
cgacgaaaugccggcg

SEQ ID NO: 2345106 - RNA, 18 nt, Bordetella pertussis
cgacgaacacgcgcgccg

SEQ ID NO: 2345107 - RNA, 19 nt, Bordetella pertussis
cgacgaacacgcgcgccgc

SEQ ID NO: 2345108 - RNA, 20 nt, Bordetella pertussis
cgacgaacacgcgcgccgcg

SEQ ID NO: 2345109 - RNA, 19 nt, Bordetella pertussis
cgacgaagcccgugucggc

SEQ ID NO: 2345110 - RNA, 22 nt, Bordetella pertussis
cgacgaagcccgugucggcaac

SEQ ID NO: 2345111 - RNA, 17 nt, Bordetella pertussis
cgacgaaucggucacga

SEQ ID NO: 2345112 - RNA, 14 nt, Bordetella pertussis
cgacgacagcggcg

SEQ ID NO: 2345113 - RNA, 15 nt, Bordetella pertussis
cgacgacagcggcga

SEQ ID NO: 2345114 - RNA, 17 nt, Bordetella pertussis
cgacgacagcggcgagc

SEQ ID NO: 2345115 - RNA, 18 nt, Bordetella pertussis
cgacgaccccgccgugcc

SEQ ID NO: 2345116 - RNA, 17 nt, Bordetella pertussis
cgacgaccgaaccgauc

SEQ ID NO: 2345117 - RNA, 21 nt, Bordetella pertussis
cgacgaccgaaccgauccagc

SEQ ID NO: 2345118 - RNA, 16 nt, Bordetella pertussis
cgacgacggccggcgc

SEQ ID NO: 2345119 - RNA, 23 nt, Bordetella pertussis
cgacgacggccggcgcgugcugg

SEQ ID NO: 2345120 - RNA, 21 nt, Bordetella pertussis
cgacgacuacgcgcuggcgca

SEQ ID NO: 2345121 - RNA, 20 nt, Bordetella pertussis
cgacgagaguuucggcgacg

SEQ ID NO: 2345122 - RNA, 23 nt, Bordetella pertussis
cgacgagaguuucggcgacgacu

SEQ ID NO: 2345123 - RNA, 14 nt, Bordetella pertussis
cgacgagaucgcgc

SEQ ID NO: 2345124 - RNA, 17 nt, Bordetella pertussis
cgacgagaugccgauga

SEQ ID NO: 2345125 - RNA, 12 nt, Bordetella pertussis
cgacgagcgcac

SEQ ID NO: 2345126 - RNA, 16 nt, Bordetella pertussis
cgacgaggagccggcg

SEQ ID NO: 2345127 - RNA, 22 nt, Bordetella pertussis
cgacgaggccgaguagcggcgc

SEQ ID NO: 2345128 - RNA, 14 nt, Bordetella pertussis
cgacgaggcgcugu

SEQ ID NO: 2345129 - RNA, 19 nt, Bordetella pertussis
cgacgaggggguguucucc

SEQ ID NO: 2345130 - RNA, 21 nt, Bordetella pertussis
cgacgaggggguguucuccaa

SEQ ID NO: 2345131 - RNA, 17 nt, Bordetella pertussis
cgacgaucaggcccugg

SEQ ID NO: 2345132 - RNA, 15 nt, Bordetella pertussis
cgacgauccggcgac

SEQ ID NO: 2345133 - RNA, 18 nt, Bordetella pertussis
cgacgaucuccacccccg

SEQ ID NO: 2345134 - RNA, 18 nt, Bordetella pertussis
cgacgaucucgcggcugg

SEQ ID NO: 2345135 - RNA, 15 nt, Bordetella pertussis
cgacgaucugguccu

SEQ ID NO: 2345136 - RNA, 17 nt, Bordetella pertussis
cgacgaucugguccugg

SEQ ID NO: 2345137 - RNA, 17 nt, Bordetella pertussis
cgacgaugcccugcgcc

SEQ ID NO: 2345138 - RNA, 20 nt, Bordetella pertussis
cgacgaugcccugcgccagc

SEQ ID NO: 2345139 - RNA, 15 nt, Bordetella pertussis
cgacgaugccgccca

SEQ ID NO: 2345140 - RNA, 16 nt, Bordetella pertussis
cgacgaugccgcccac

SEQ ID NO: 2345141 - RNA, 19 nt, Bordetella pertussis
cgacgaugccgcccacgcc

SEQ ID NO: 2345142 - RNA, 15 nt, Bordetella pertussis
cgacgaugccgccgc

SEQ ID NO: 2345143 - RNA, 19 nt, Bordetella pertussis
cgacgaugccgccgccgac

SEQ ID NO: 2345144 - RNA, 19 nt, Bordetella pertussis
cgacgauggccggaucgua

SEQ ID NO: 2345145 - RNA, 23 nt, Bordetella pertussis
cgacgauggccggaucguagugc

SEQ ID NO: 2345146 - RNA, 15 nt, Bordetella pertussis
cgacgauggccgggg

SEQ ID NO: 2345147 - RNA, 13 nt, Bordetella pertussis
cgacgauggcggg

SEQ ID NO: 2345148 - RNA, 22 nt, Bordetella pertussis
cgacgauggcgggguuggccgc

SEQ ID NO: 2345149 - RNA, 20 nt, Bordetella pertussis
cgacgcaacagacccgggcc

SEQ ID NO: 2345150 - RNA, 14 nt, Bordetella pertussis
cgacgcaaucggcg

SEQ ID NO: 2345151 - RNA, 18 nt, Bordetella pertussis
cgacgcagcacggcuugc

SEQ ID NO: 2345152 - RNA, 16 nt, Bordetella pertussis
cgacgcagcagccgcu

SEQ ID NO: 2345153 - RNA, 14 nt, Bordetella pertussis
cgacgcaggcgccg

SEQ ID NO: 2345154 - RNA, 15 nt, Bordetella pertussis
cgacgcaggcgccgc

SEQ ID NO: 2345155 - RNA, 18 nt, Bordetella pertussis
cgacgcauauccaggcgg

SEQ ID NO: 2345156 - RNA, 21 nt, Bordetella pertussis
cgacgcauauccaggcggcgc

SEQ ID NO: 2345157 - RNA, 22 nt, Bordetella pertussis
cgacgcauauccaggcggcgcu

SEQ ID NO: 2345158 - RNA, 18 nt, Bordetella pertussis
cgacgcaugucagcgccu

SEQ ID NO: 2345159 - RNA, 16 nt, Bordetella pertussis
cgacgccagcgcgcca

SEQ ID NO: 2345160 - RNA, 13 nt, Bordetella pertussis
cgacgccaucucg

SEQ ID NO: 2345161 - RNA, 20 nt, Bordetella pertussis
cgacgcccaugcgaucggcc

SEQ ID NO: 2345162 - RNA, 13 nt, Bordetella pertussis
cgacgcccgggcg

SEQ ID NO: 2345163 - RNA, 15 nt, Bordetella pertussis
cgacgcccgggcggc

SEQ ID NO: 2345164 - RNA, 15 nt, Bordetella pertussis
cgacgcccuggccuu

SEQ ID NO: 2345165 - RNA, 13 nt, Bordetella pertussis
cgacgccgccacg

SEQ ID NO: 2345166 - RNA, 12 nt, Bordetella pertussis
cgacgccgcgcg

SEQ ID NO: 2345167 - RNA, 18 nt, Bordetella pertussis
cgacgccgcgcgcgacgc

SEQ ID NO: 2345168 - RNA, 18 nt, Bordetella pertussis
cgacgccggcucaggcca

SEQ ID NO: 2345169 - RNA, 20 nt, Bordetella pertussis
cgacgccggcucaggccagc

SEQ ID NO: 2345170 - RNA, 21 nt, Bordetella pertussis
cgacgccggcucaggccagcg

SEQ ID NO: 2345171 - RNA, 22 nt, Bordetella pertussis
cgacgccggcuuucagcgccga

SEQ ID NO: 2345172 - RNA, 17 nt, Bordetella pertussis
cgacgccguacugggca

SEQ ID NO: 2345173 - RNA, 18 nt, Bordetella pertussis
cgacgccguacugggcac

SEQ ID NO: 2345174 - RNA, 18 nt, Bordetella pertussis
cgacgccugcgccauggc

SEQ ID NO: 2345175 - RNA, 16 nt, Bordetella pertussis
cgacgccuggaccggc

SEQ ID NO: 2345176 - RNA, 17 nt, Bordetella pertussis
cgacgccuggaccggcu

SEQ ID NO: 2345177 - RNA, 22 nt, Bordetella pertussis
cgacgccuggaccggcuccggc

SEQ ID NO: 2345178 - RNA, 17 nt, Bordetella pertussis
cgacgccuuccuugaac

SEQ ID NO: 2345179 - RNA, 16 nt, Bordetella pertussis
cgacgcgacacgcagc

SEQ ID NO: 2345180 - RNA, 22 nt, Bordetella pertussis
cgacgcgacacgcagcaacggu

SEQ ID NO: 2345181 - RNA, 11 nt, Bordetella pertussis
cgacgcgacgc

SEQ ID NO: 2345182 - RNA, 19 nt, Bordetella pertussis
cgacgcgaggcagaagugg

SEQ ID NO: 2345183 - RNA, 17 nt, Bordetella pertussis
cgacgcgaugcccgcgc

SEQ ID NO: 2345184 - RNA, 18 nt, Bordetella pertussis
cgacgcgauguccagcuc

SEQ ID NO: 2345185 - RNA, 12 nt, Bordetella pertussis
cgacgcgcccgg

SEQ ID NO: 2345186 - RNA, 22 nt, Bordetella pertussis
cgacgcgcccucaguccagcug

SEQ ID NO: 2345187 - RNA, 17 nt, Bordetella pertussis
cgacgcgccgggccacg

SEQ ID NO: 2345188 - RNA, 11 nt, Bordetella pertussis
cgacgcgcgcc

SEQ ID NO: 2345189 - RNA, 16 nt, Bordetella pertussis
cgacgcgcgccggcgc

SEQ ID NO: 2345190 - RNA, 17 nt, Bordetella pertussis
cgacgcgcgccggcgcu

SEQ ID NO: 2345191 - RNA, 15 nt, Bordetella pertussis
cgacgcgcucgucga

SEQ ID NO: 2345192 - RNA, 20 nt, Bordetella pertussis
cgacgcgcuugacguccagc

SEQ ID NO: 2345193 - RNA, 19 nt, Bordetella pertussis
cgacgcggacuucgcccgg

SEQ ID NO: 2345194 - RNA, 12 nt, Bordetella pertussis
cgacgcggccag

SEQ ID NO: 2345195 - RNA, 13 nt, Bordetella pertussis
cgacgcggccagc

SEQ ID NO: 2345196 - RNA, 14 nt, Bordetella pertussis
cgacgcggccagcg

SEQ ID NO: 2345197 - RNA, 16 nt, Bordetella pertussis
cgacgcggccagcggc

SEQ ID NO: 2345198 - RNA, 19 nt, Bordetella pertussis
cgacgcggccagcggcgcu

SEQ ID NO: 2345199 - RNA, 14 nt, Bordetella pertussis
cgacgcggccgacc

SEQ ID NO: 2345200 - RNA, 12 nt, Bordetella pertussis
cgacgcggcggc

SEQ ID NO: 2345201 - RNA, 15 nt, Bordetella pertussis
cgacguugcgcgaca

SEQ ID NO: 2345202 - RNA, 17 nt, Bordetella pertussis
cgacguugcgcgacagg

SEQ ID NO: 2345203 - RNA, 20 nt, Bordetella pertussis
cgacguugcgcgacaggccc

SEQ ID NO: 2345204 - RNA, 23 nt, Bordetella pertussis
cgacguugcgcgacaggcccgcg

SEQ ID NO: 2345205 - RNA, 19 nt, Bordetella pertussis
cgacguugggcaugccgau

SEQ ID NO: 2345206 - RNA, 15 nt, Bordetella pertussis
cgacuacgcgcuggc

SEQ ID NO: 2345207 - RNA, 13 nt, Bordetella pertussis
cgacuccagcccg

SEQ ID NO: 2345208 - RNA, 12 nt, Bordetella pertussis
cgacucgaagaa

SEQ ID NO: 2345209 - RNA, 22 nt, Bordetella pertussis
cgacucgucgaccaccagcauc

SEQ ID NO: 2345210 - RNA, 17 nt, Bordetella pertussis
cgacucuuuuggagaug

SEQ ID NO: 2345211 - RNA, 21 nt, Bordetella pertussis
cgacugccccagcggcuggcg

SEQ ID NO: 2345212 - RNA, 16 nt, Bordetella pertussis
cgacugcgcauggucg

SEQ ID NO: 2345213 - RNA, 14 nt, Bordetella pertussis
cgacuggcccaggc

SEQ ID NO: 2345214 - RNA, 16 nt, Bordetella pertussis
cgacuggcccaggcgg

SEQ ID NO: 2345215 - RNA, 17 nt, Bordetella pertussis
cgacuggcccaggcggg

SEQ ID NO: 2345216 - RNA, 14 nt, Bordetella pertussis
cgacuucaccgagg

SEQ ID NO: 2345217 - RNA, 19 nt, Bordetella pertussis
cgacuucagacagacgcug

SEQ ID NO: 2345218 - RNA, 17 nt, Bordetella pertussis
cgacuucgccgaugacc

SEQ ID NO: 2345219 - RNA, 12 nt, Bordetella pertussis
cgacuucggccg

SEQ ID NO: 2345220 - RNA, 13 nt, Bordetella pertussis
cgacuucggcggc

SEQ ID NO: 2345221 - RNA, 20 nt, Bordetella pertussis
cgacuucggcggccaugccg

SEQ ID NO: 2345222 - RNA, 15 nt, Bordetella pertussis
cgacuucggcggccu

SEQ ID NO: 2345223 - RNA, 16 nt, Bordetella pertussis
cgacuucggcggccug

SEQ ID NO: 2345224 - RNA, 21 nt, Bordetella pertussis
cgacuucguccggcgcgucgc

SEQ ID NO: 2345225 - RNA, 17 nt, Bordetella pertussis
cgacuucuaccuggacg

SEQ ID NO: 2345226 - RNA, 19 nt, Bordetella pertussis
cgacuugaucagggccacg

SEQ ID NO: 2345227 - RNA, 16 nt, Bordetella pertussis
cgacuugucgcgcccg

SEQ ID NO: 2345228 - RNA, 17 nt, Bordetella pertussis
cgacuugucgcgcccga

SEQ ID NO: 2345229 - RNA, 22 nt, Bordetella pertussis
cgagaaaaucggcgaucgccug

SEQ ID NO: 2345230 - RNA, 15 nt, Bordetella pertussis
cgagaaaccagccgc

SEQ ID NO: 2345231 - RNA, 21 nt, Bordetella pertussis
cgagaaaccgauggugccggg

SEQ ID NO: 2345232 - RNA, 13 nt, Bordetella pertussis
cgagaagcaaccg

SEQ ID NO: 2345233 - RNA, 16 nt, Bordetella pertussis
cgagaagcggaugucc

SEQ ID NO: 2345234 - RNA, 23 nt, Bordetella pertussis
cgagaagggcuugaccagggcgg

SEQ ID NO: 2345235 - RNA, 19 nt, Bordetella pertussis
cgagaaguuggcgggcgcu

SEQ ID NO: 2345236 - RNA, 16 nt, Bordetella pertussis
cgagacaggcgcgcca

SEQ ID NO: 2345237 - RNA, 16 nt, Bordetella pertussis
cgagaccacgauggcc

SEQ ID NO: 2345238 - RNA, 14 nt, Bordetella pertussis
cgagaccagcagcg

SEQ ID NO: 2345239 - RNA, 19 nt, Bordetella pertussis
cgagaccaugacgucgacg

SEQ ID NO: 2345240 - RNA, 13 nt, Bordetella pertussis
cgagaccgggcgg

SEQ ID NO: 2345241 - RNA, 22 nt, Bordetella pertussis
cgagaccgggcgguacaggucg

SEQ ID NO: 2345242 - RNA, 20 nt, Bordetella pertussis
cgagaccguggaaaccgcgu

SEQ ID NO: 2345243 - RNA, 17 nt, Bordetella pertussis
cgagaccuugugcggca

SEQ ID NO: 2345244 - RNA, 19 nt, Bordetella pertussis
cgagaccuugugcggcagg

SEQ ID NO: 2345245 - RNA, 16 nt, Bordetella pertussis
cgagacgaaggcgccg

SEQ ID NO: 2345246 - RNA, 18 nt, Bordetella pertussis
cgagacgaaggcgccggc

SEQ ID NO: 2345247 - RNA, 20 nt, Bordetella pertussis
cgagacgaaggcgccggcca

SEQ ID NO: 2345248 - RNA, 22 nt, Bordetella pertussis
cgagacgaaggcgccggccagg

SEQ ID NO: 2345249 - RNA, 21 nt, Bordetella pertussis
cgagacgauggccgaaugccc

SEQ ID NO: 2345250 - RNA, 17 nt, Bordetella pertussis
cgagacgcgcucgcgcg

SEQ ID NO: 2345251 - RNA, 20 nt, Bordetella pertussis
cgagacgcugucgcgcccgg

SEQ ID NO: 2345252 - RNA, 21 nt, Bordetella pertussis
cgagacgcugucgcgcccggu

SEQ ID NO: 2345253 - RNA, 23 nt, Bordetella pertussis
cgagacgcugucgcgcccggucu

SEQ ID NO: 2345254 - RNA, 18 nt, Bordetella pertussis
cgagacggccgccgacgc

SEQ ID NO: 2345255 - RNA, 15 nt, Bordetella pertussis
cgagagauagcccag

SEQ ID NO: 2345256 - RNA, 17 nt, Bordetella pertussis
cgagagauagcccagca

SEQ ID NO: 2345257 - RNA, 19 nt, Bordetella pertussis
cgagagccugggcgcgcgc

SEQ ID NO: 2345258 - RNA, 20 nt, Bordetella pertussis
cgagagccugggcgcgcgcc

SEQ ID NO: 2345259 - RNA, 21 nt, Bordetella pertussis
cgagagccugggcgcgcgccc

SEQ ID NO: 2345260 - RNA, 22 nt, Bordetella pertussis
cgagagccugggcgcgcgccca

SEQ ID NO: 2345261 - RNA, 14 nt, Bordetella pertussis
cgagagcgccacgc

SEQ ID NO: 2345262 - RNA, 18 nt, Bordetella pertussis
cgagagcgccacgccagc

SEQ ID NO: 2345263 - RNA, 19 nt, Bordetella pertussis
cgagagcgccacgccagcg

SEQ ID NO: 2345264 - RNA, 23 nt, Bordetella pertussis
cgagagcugcgucuugagcaggu

SEQ ID NO: 2345265 - RNA, 15 nt, Bordetella pertussis
cgagauaggcggcca

SEQ ID NO: 2345266 - RNA, 18 nt, Bordetella pertussis
cgagauaggcggccaggc

SEQ ID NO: 2345267 - RNA, 20 nt, Bordetella pertussis
cgagauaggcggccaggcuc

SEQ ID NO: 2345268 - RNA, 16 nt, Bordetella pertussis
cgagaucagcaccgcg

SEQ ID NO: 2345269 - RNA, 18 nt, Bordetella pertussis
cgagaucagcaccgcgac

SEQ ID NO: 2345270 - RNA, 15 nt, Bordetella pertussis
cgagaucagccaccg

SEQ ID NO: 2345271 - RNA, 15 nt, Bordetella pertussis
cgagauccgccggcg

SEQ ID NO: 2345272 - RNA, 17 nt, Bordetella pertussis
cgagauccgccggcgau

SEQ ID NO: 2345273 - RNA, 17 nt, Bordetella pertussis
cgagaucgccuggggca

SEQ ID NO: 2345274 - RNA, 23 nt, Bordetella pertussis
cgagaucgcgccuaccggcgccg

SEQ ID NO: 2345275 - RNA, 15 nt, Bordetella pertussis
cgagaugcccgacgc

SEQ ID NO: 2345276 - RNA, 14 nt, Bordetella pertussis
cgagaugccgauga

SEQ ID NO: 2345277 - RNA, 14 nt, Bordetella pertussis
cgagaugccgucga

SEQ ID NO: 2345278 - RNA, 21 nt, Bordetella pertussis
cgagaugccgucgaaggccgc

SEQ ID NO: 2345279 - RNA, 24 nt, Bordetella pertussis
cgagauggccuuuuccaggcgugc

SEQ ID NO: 2345280 - RNA, 19 nt, Bordetella pertussis
cgagauggcgcaggcgcgc

SEQ ID NO: 2345281 - RNA, 14 nt, Bordetella pertussis
cgagauguccaugg

SEQ ID NO: 2345282 - RNA, 16 nt, Bordetella pertussis
cgagauugagcacgca

SEQ ID NO: 2345283 - RNA, 19 nt, Bordetella pertussis
cgagcaaaggacacgcgcg

SEQ ID NO: 2345284 - RNA, 20 nt, Bordetella pertussis
cgagcaauccgucaggcagc

SEQ ID NO: 2345285 - RNA, 17 nt, Bordetella pertussis
cgagcaccaugccgggg

SEQ ID NO: 2345286 - RNA, 16 nt, Bordetella pertussis
cgagcacccgcaggcg

SEQ ID NO: 2345287 - RNA, 17 nt, Bordetella pertussis
cgagcacccgcaggcgg

SEQ ID NO: 2345288 - RNA, 18 nt, Bordetella pertussis
cgagcacccgcaggcggc

SEQ ID NO: 2345289 - RNA, 17 nt, Bordetella pertussis
cgagcaccgugaccugc

SEQ ID NO: 2345290 - RNA, 20 nt, Bordetella pertussis
cgagcaccuugacggucacg

SEQ ID NO: 2345291 - RNA, 16 nt, Bordetella pertussis
cgagcacgcggcgcgg

SEQ ID NO: 2345292 - RNA, 18 nt, Bordetella pertussis
cgagcacggcguggcgcg

SEQ ID NO: 2345293 - RNA, 20 nt, Bordetella pertussis
cgagcacggcguggcgcgca

SEQ ID NO: 2345294 - RNA, 22 nt, Bordetella pertussis
cgagcacggcguggcgcgcaca

SEQ ID NO: 2345295 - RNA, 17 nt, Bordetella pertussis
cgagcacuucgagcgac

SEQ ID NO: 2345296 - RNA, 21 nt, Bordetella pertussis
cgagcacuucgagcgacggca

SEQ ID NO: 2345297 - RNA, 17 nt, Bordetella pertussis
cgagcagaugcgacugg

SEQ ID NO: 2345298 - RNA, 12 nt, Bordetella pertussis
cgagcaggcccg

SEQ ID NO: 2345299 - RNA, 12 nt, Bordetella pertussis
cgagcaggccgc

SEQ ID NO: 2345300 - RNA, 17 nt, Bordetella pertussis
cgagcaggccgccgccg

SEQ ID NO: 2345301 - RNA, 14 nt, Bordetella pertussis
cgagcaggccggcg

SEQ ID NO: 2345302 - RNA, 16 nt, Bordetella pertussis
cgagcaggcgcaggcc

SEQ ID NO: 2345303 - RNA, 23 nt, Bordetella pertussis
cgagcaggcgcaggccgcgcgca

SEQ ID NO: 2345304 - RNA, 20 nt, Bordetella pertussis
cgagcaggcgcgcggugacg

SEQ ID NO: 2345305 - RNA, 20 nt, Bordetella pertussis
cgagcagggggucgaucaug

SEQ ID NO: 2345306 - RNA, 20 nt, Bordetella pertussis
cgagcagguccauggccagu

SEQ ID NO: 2345307 - RNA, 16 nt, Bordetella pertussis
cgagcaucauggcgcg

SEQ ID NO: 2345308 - RNA, 15 nt, Bordetella pertussis
cgagcaucccggcgc

SEQ ID NO: 2345309 - RNA, 19 nt, Bordetella pertussis
cgagcaucccggcgcucag

SEQ ID NO: 2345310 - RNA, 23 nt, Bordetella pertussis
cgagcaucuggcgcauggccggc

SEQ ID NO: 2345311 - RNA, 13 nt, Bordetella pertussis
cgagcaugcgcag

SEQ ID NO: 2345312 - RNA, 21 nt, Bordetella pertussis
cgagcaugcgcagcgcgucgg

SEQ ID NO: 2345313 - RNA, 16 nt, Bordetella pertussis
ccgugaugcgcgccgc

SEQ ID NO: 2345314 - RNA, 20 nt, Bordetella pertussis
ccgugaugcgcgccgcucuu

SEQ ID NO: 2345315 - RNA, 14 nt, Bordetella pertussis
ccgugaugggcgca

SEQ ID NO: 2345316 - RNA, 19 nt, Bordetella pertussis
ccgugcagacggcggcugg

SEQ ID NO: 2345317 - RNA, 20 nt, Bordetella pertussis
ccgugcagacggcggcugga

SEQ ID NO: 2345318 - RNA, 16 nt, Bordetella pertussis
ccgugcaggcccgggc

SEQ ID NO: 2345319 - RNA, 16 nt, Bordetella pertussis
ccgugcaucggcacgg

SEQ ID NO: 2345320 - RNA, 22 nt, Bordetella pertussis
ccgugcaucggcacgggucagg

SEQ ID NO: 2345321 - RNA, 22 nt, Bordetella pertussis
ccgugccaguucacgguguugc

SEQ ID NO: 2345322 - RNA, 20 nt, Bordetella pertussis
ccgugcccgagggcgcgucg

SEQ ID NO: 2345323 - RNA, 12 nt, Bordetella pertussis
ccgugcccggcg

SEQ ID NO: 2345324 - RNA, 15 nt, Bordetella pertussis
ccgugcccggcgggc

SEQ ID NO: 2345325 - RNA, 18 nt, Bordetella pertussis
ccgugcccggcgggccgc

SEQ ID NO: 2345326 - RNA, 23 nt, Bordetella pertussis
ccgugccgcagaagaacaccgug

SEQ ID NO: 2345327 - RNA, 16 nt, Bordetella pertussis
ccgugccgcagauguc

SEQ ID NO: 2345328 - RNA, 13 nt, Bordetella pertussis
ccgugccgcccgg

SEQ ID NO: 2345329 - RNA, 14 nt, Bordetella pertussis
ccgugccgccgagg

SEQ ID NO: 2345330 - RNA, 19 nt, Bordetella pertussis
ccgugccgcgcgcaccggc

SEQ ID NO: 2345331 - RNA, 21 nt, Bordetella pertussis
ccgugccgcggcgcggcccgc

SEQ ID NO: 2345332 - RNA, 16 nt, Bordetella pertussis
ccgugccggccggacc

SEQ ID NO: 2345333 - RNA, 13 nt, Bordetella pertussis
ccgugccggcgua

SEQ ID NO: 2345334 - RNA, 13 nt, Bordetella pertussis
ccgugccucaacu

SEQ ID NO: 2345335 - RNA, 20 nt, Bordetella pertussis
ccgugccucaacuggccggc

SEQ ID NO: 2345336 - RNA, 22 nt, Bordetella pertussis
ccgugcgagcacggcguggcgc

SEQ ID NO: 2345337 - RNA, 16 nt, Bordetella pertussis
ccgugcgaggcgaaca

SEQ ID NO: 2345338 - RNA, 16 nt, Bordetella pertussis
ccgugcgcaacgcgcg

SEQ ID NO: 2345339 - RNA, 15 nt, Bordetella pertussis
ccgugcgccagcgcc

SEQ ID NO: 2345340 - RNA, 13 nt, Bordetella pertussis
ccgugcgcgcccg

SEQ ID NO: 2345341 - RNA, 15 nt, Bordetella pertussis
ccgugcgcggcgagc

SEQ ID NO: 2345342 - RNA, 16 nt, Bordetella pertussis
ccgugcgcgggcgcgg

SEQ ID NO: 2345343 - RNA, 23 nt, Bordetella pertussis
ccgugcgcgggcgcggcaggcgg

SEQ ID NO: 2345344 - RNA, 20 nt, Bordetella pertussis
ccgugcgcgguucaggcuug

SEQ ID NO: 2345345 - RNA, 16 nt, Bordetella pertussis
ccgugcggcgcgcacg

SEQ ID NO: 2345346 - RNA, 22 nt, Bordetella pertussis
ccgugcggcgcgcacgggcgag

SEQ ID NO: 2345347 - RNA, 18 nt, Bordetella pertussis
ccgugcggggaccggcac

SEQ ID NO: 2345348 - RNA, 18 nt, Bordetella pertussis
ccgugcgggugccugucc

SEQ ID NO: 2345349 - RNA, 20 nt, Bordetella pertussis
ccgugcgguucgucagggcc

SEQ ID NO: 2345350 - RNA, 18 nt, Bordetella pertussis
ccgugcgugugccugucc

SEQ ID NO: 2345351 - RNA, 19 nt, Bordetella pertussis
ccgugcuggccgacgcgcu

SEQ ID NO: 2345352 - RNA, 18 nt, Bordetella pertussis
ccgugcugggcggccagg

SEQ ID NO: 2345353 - RNA, 21 nt, Bordetella pertussis
ccgugcugguuguccaccacc

SEQ ID NO: 2345354 - RNA, 18 nt, Bordetella pertussis
ccgugcuguaccucagcc

SEQ ID NO: 2345355 - RNA, 22 nt, Bordetella pertussis
ccguggacgaauacgcuggcgc

SEQ ID NO: 2345356 - RNA, 22 nt, Bordetella pertussis
ccguggacgugcgcgaccgcgc

SEQ ID NO: 2345357 - RNA, 14 nt, Bordetella pertussis
ccguggaggcggcg

SEQ ID NO: 2345358 - RNA, 12 nt, Bordetella pertussis
ccguggcaugcc

SEQ ID NO: 2345359 - RNA, 13 nt, Bordetella pertussis
ccguggcaugcca

SEQ ID NO: 2345360 - RNA, 16 nt, Bordetella pertussis
ccguggccaagggcgc

SEQ ID NO: 2345361 - RNA, 20 nt, Bordetella pertussis
ccguggccaagggcgccgcg

SEQ ID NO: 2345362 - RNA, 16 nt, Bordetella pertussis
ccguggcccagccgca

SEQ ID NO: 2345363 - RNA, 17 nt, Bordetella pertussis
cgagcuccuggagucug

SEQ ID NO: 2345364 - RNA, 12 nt, Bordetella pertussis
cgagcucgucgg

SEQ ID NO: 2345365 - RNA, 22 nt, Bordetella pertussis
cgagcucgucggucagcucaag

SEQ ID NO: 2345366 - RNA, 14 nt, Bordetella pertussis
cgagcugcagcccg

SEQ ID NO: 2345367 - RNA, 14 nt, Bordetella pertussis
cgagcugccgccuu

SEQ ID NO: 2345368 - RNA, 16 nt, Bordetella pertussis
cgagcugcucgagcau

SEQ ID NO: 2345369 - RNA, 18 nt, Bordetella pertussis
cgagcugcucgagcaugc

SEQ ID NO: 2345370 - RNA, 21 nt, Bordetella pertussis
cgagcuggcccacgcccaugu

SEQ ID NO: 2345371 - RNA, 17 nt, Bordetella pertussis
cgagcuggcccugggcu

SEQ ID NO: 2345372 - RNA, 16 nt, Bordetella pertussis
cgagcuggcuggccag

SEQ ID NO: 2345373 - RNA, 17 nt, Bordetella pertussis
cgagcuggcuggccagc

SEQ ID NO: 2345374 - RNA, 20 nt, Bordetella pertussis
cgagcuggcuggccagcggg

SEQ ID NO: 2345375 - RNA, 19 nt, Bordetella pertussis
cgagcuggugauggugucg

SEQ ID NO: 2345376 - RNA, 22 nt, Bordetella pertussis
cgagcuggugauggugucgaag

SEQ ID NO: 2345377 - RNA, 20 nt, Bordetella pertussis
cgaggaaccagccgucggca

SEQ ID NO: 2345378 - RNA, 13 nt, Bordetella pertussis
cgaggaaggcccg

SEQ ID NO: 2345379 - RNA, 16 nt, Bordetella pertussis
cgaggacaaccaggaa

SEQ ID NO: 2345380 - RNA, 14 nt, Bordetella pertussis
cgaggacaggccag

SEQ ID NO: 2345381 - RNA, 11 nt, Bordetella pertussis
cgaggaccuga

SEQ ID NO: 2345382 - RNA, 19 nt, Bordetella pertussis
cgaggaccugaccaucgaa

SEQ ID NO: 2345383 - RNA, 20 nt, Bordetella pertussis
cgaggaccuguggcgcaccc

SEQ ID NO: 2345384 - RNA, 24 nt, Bordetella pertussis
cgaggacgaccaacucgaggcggc

SEQ ID NO: 2345385 - RNA, 23 nt, Bordetella pertussis
cgaggacgguacauacguggugg

SEQ ID NO: 2345386 - RNA, 14 nt, Bordetella pertussis
cgaggagcugcugu

SEQ ID NO: 2345387 - RNA, 19 nt, Bordetella pertussis
cgaggaggugcgccgcucg

SEQ ID NO: 2345388 - RNA, 21 nt, Bordetella pertussis
cgaggauauccaucuggcccg

SEQ ID NO: 2345389 - RNA, 16 nt, Bordetella pertussis
cgaggaucaaggcccg

SEQ ID NO: 2345390 - RNA, 18 nt, Bordetella pertussis
cgaggaucaaggcccgga

SEQ ID NO: 2345391 - RNA, 22 nt, Bordetella pertussis
cgaggaucaugucguccucggc

SEQ ID NO: 2345392 - RNA, 18 nt, Bordetella pertussis
cgaggaucuggccggcgc

SEQ ID NO: 2345393 - RNA, 15 nt, Bordetella pertussis
cgaggcaaucagccc

SEQ ID NO: 2345394 - RNA, 19 nt, Bordetella pertussis
cgaggcaaucagccccagg

SEQ ID NO: 2345395 - RNA, 23 nt, Bordetella pertussis
cgaggcaaucagccccaggcgcg

SEQ ID NO: 2345396 - RNA, 14 nt, Bordetella pertussis
cgaggcacaaggcc

SEQ ID NO: 2345397 - RNA, 23 nt, Bordetella pertussis
cgaggcagaaguggucgcgcagg

SEQ ID NO: 2345398 - RNA, 11 nt, Bordetella pertussis
cgaggccaggc

SEQ ID NO: 2345399 - RNA, 19 nt, Bordetella pertussis
cgaggccaggcugaccagc

SEQ ID NO: 2345400 - RNA, 11 nt, Bordetella pertussis
cgaggccaggu

SEQ ID NO: 2345401 - RNA, 21 nt, Bordetella pertussis
cgaggccagguugggugcgcc

SEQ ID NO: 2345402 - RNA, 16 nt, Bordetella pertussis
cgaggcccggccugcg

SEQ ID NO: 2345403 - RNA, 17 nt, Bordetella pertussis
cgaggccgaguggccgc

SEQ ID NO: 2345404 - RNA, 19 nt, Bordetella pertussis
cgaggccgcuucgugcggc

SEQ ID NO: 2345405 - RNA, 23 nt, Bordetella pertussis
cgaggccgcuucgugcggccgca

SEQ ID NO: 2345406 - RNA, 14 nt, Bordetella pertussis
cgaggccggcgucu

SEQ ID NO: 2345407 - RNA, 22 nt, Bordetella pertussis
cgaggccggcgucuggagcggc

SEQ ID NO: 2345408 - RNA, 22 nt, Bordetella pertussis
cgaggccucgugcugcugcagg

SEQ ID NO: 2345409 - RNA, 18 nt, Bordetella pertussis
cgaggcgaacaggcacag

SEQ ID NO: 2345410 - RNA, 19 nt, Bordetella pertussis
cgaggcgauggucggccgg

SEQ ID NO: 2345411 - RNA, 22 nt, Bordetella pertussis
cgaggcgcagcgcagcuucuau

SEQ ID NO: 2345412 - RNA, 15 nt, Bordetella pertussis
cgaggcgcaggccga

SEQ ID NO: 2345413 - RNA, 16 nt, Bordetella pertussis
cgaggcgcaggccgac

SEQ ID NO: 2345414 - RNA, 21 nt, Bordetella pertussis
cgaggcgcaguccagcgugga

SEQ ID NO: 2345415 - RNA, 23 nt, Bordetella pertussis
cgaggcgccccagagcaccgaga

SEQ ID NO: 2345416 - RNA, 12 nt, Bordetella pertussis
cgaggcgccgcc

SEQ ID NO: 2345417 - RNA, 14 nt, Bordetella pertussis
cgaggcgcgcagca

SEQ ID NO: 2345418 - RNA, 16 nt, Bordetella pertussis
cgaggcgcgcagcacg

SEQ ID NO: 2345419 - RNA, 18 nt, Bordetella pertussis
cgaggcgcgcagcacgcc

SEQ ID NO: 2345420 - RNA, 16 nt, Bordetella pertussis
cgaggcgcgggcgaug

SEQ ID NO: 2345421 - RNA, 12 nt, Bordetella pertussis
cgaggcgcugcc

SEQ ID NO: 2345422 - RNA, 14 nt, Bordetella pertussis
cgaggcgcuggccg

SEQ ID NO: 2345423 - RNA, 15 nt, Bordetella pertussis
cgaggcgcuggccgg

SEQ ID NO: 2345424 - RNA, 14 nt, Bordetella pertussis
cgaggcggcaagcg

SEQ ID NO: 2345425 - RNA, 14 nt, Bordetella pertussis
cgaggcggcgcagg

SEQ ID NO: 2345426 - RNA, 15 nt, Bordetella pertussis
cgaggcggcgcagga

SEQ ID NO: 2345427 - RNA, 15 nt, Bordetella pertussis
cgaggcggcggccgg

SEQ ID NO: 2345428 - RNA, 18 nt, Bordetella pertussis
cgaggcggcggccggggc

SEQ ID NO: 2345429 - RNA, 19 nt, Bordetella pertussis
cgaggcggcggccggggcc

SEQ ID NO: 2345430 - RNA, 18 nt, Bordetella pertussis
cgaggcggugggcagggc

SEQ ID NO: 2345431 - RNA, 17 nt, Bordetella pertussis
cgaggcugcgcgcgcca

SEQ ID NO: 2345432 - RNA, 18 nt, Bordetella pertussis
cgaggcugcgcgcgccag

SEQ ID NO: 2345433 - RNA, 20 nt, Bordetella pertussis
cgaggcuuuuuuucgccggg

SEQ ID NO: 2345434 - RNA, 21 nt, Bordetella pertussis
cgaggcuuuuuuucgccgggc

SEQ ID NO: 2345435 - RNA, 16 nt, Bordetella pertussis
cgagggacaccgcagg

SEQ ID NO: 2345436 - RNA, 14 nt, Bordetella pertussis
cgagggccgcgcga

SEQ ID NO: 2345437 - RNA, 12 nt, Bordetella pertussis
cgagggccgcgg

SEQ ID NO: 2345438 - RNA, 23 nt, Bordetella pertussis
cgagggccgcggcgagcucggca

SEQ ID NO: 2345439 - RNA, 16 nt, Bordetella pertussis
cgagggccggaacagc

SEQ ID NO: 2345440 - RNA, 23 nt, Bordetella pertussis
cgagggccggaacagcguccagc

SEQ ID NO: 2345441 - RNA, 18 nt, Bordetella pertussis
cgagggccggcgccagca

SEQ ID NO: 2345442 - RNA, 13 nt, Bordetella pertussis
cgagggcgcggcg

SEQ ID NO: 2345443 - RNA, 23 nt, Bordetella pertussis
cgagggcgcggcgccgcuggcca

SEQ ID NO: 2345444 - RNA, 15 nt, Bordetella pertussis
cgagggcgcgucgac

SEQ ID NO: 2345445 - RNA, 20 nt, Bordetella pertussis
cgagggcgucaucggcgcgc

SEQ ID NO: 2345446 - RNA, 20 nt, Bordetella pertussis
cgagggcgucguagcccucg

SEQ ID NO: 2345447 - RNA, 12 nt, Bordetella pertussis
cgagggcucgac

SEQ ID NO: 2345448 - RNA, 18 nt, Bordetella pertussis
cgagggcucgaccgccgc

SEQ ID NO: 2345449 - RNA, 20 nt, Bordetella pertussis
cgagggcucgaccgccgcca

SEQ ID NO: 2345450 - RNA, 17 nt, Bordetella pertussis
cgagggcugcccucgcc

SEQ ID NO: 2345451 - RNA, 22 nt, Bordetella pertussis
cgagggggcuuuuuugccuugg

SEQ ID NO: 2345452 - RNA, 14 nt, Bordetella pertussis
cgaggggguguucu

SEQ ID NO: 2345453 - RNA, 17 nt, Bordetella pertussis
cgagggucaggcgcgcu

SEQ ID NO: 2345454 - RNA, 17 nt, Bordetella pertussis
cgagguaagugggcugc

SEQ ID NO: 2345455 - RNA, 21 nt, Bordetella pertussis
cgagguaagugggcugcggcg

SEQ ID NO: 2345456 - RNA, 15 nt, Bordetella pertussis
cgagguagggcgcgg

SEQ ID NO: 2345457 - RNA, 17 nt, Bordetella pertussis
cgagguagggcgcggcc

SEQ ID NO: 2345458 - RNA, 18 nt, Bordetella pertussis
cgagguagggcgcggcca

SEQ ID NO: 2345459 - RNA, 22 nt, Bordetella pertussis
cgagguauuggccuugcccagg

SEQ ID NO: 2345460 - RNA, 22 nt, Bordetella pertussis
cgaggucagcaugaagcugccc

SEQ ID NO: 2345461 - RNA, 13 nt, Bordetella pertussis
cgaggucagcccg

SEQ ID NO: 2345462 - RNA, 14 nt, Bordetella pertussis
cgaggucagcccgg

SEQ ID NO: 2345463 - RNA, 16 nt, Bordetella pertussis
cgaggucagcccggcg

SEQ ID NO: 2345464 - RNA, 20 nt, Bordetella pertussis
cgaggucagcccggcggcca

SEQ ID NO: 2345465 - RNA, 16 nt, Bordetella pertussis
cgagguccugcucggu

SEQ ID NO: 2345466 - RNA, 16 nt, Bordetella pertussis
cgaggucggcggucca

SEQ ID NO: 2345467 - RNA, 20 nt, Bordetella pertussis
cgaggucuugccgaucggcg

SEQ ID NO: 2345468 - RNA, 23 nt, Bordetella pertussis
cgaggugcacgugggcacgccgg

SEQ ID NO: 2345469 - RNA, 19 nt, Bordetella pertussis
cgaggugcccaucaggccg

SEQ ID NO: 2345470 - RNA, 19 nt, Bordetella pertussis
cgaggugcccgcgaagcag

SEQ ID NO: 2345471 - RNA, 21 nt, Bordetella pertussis
cgaggugcccgcgaagcagcc

SEQ ID NO: 2345472 - RNA, 13 nt, Bordetella pertussis
cgaggugccggcg

SEQ ID NO: 2345473 - RNA, 17 nt, Bordetella pertussis
cgagguggaugcguucg

SEQ ID NO: 2345474 - RNA, 17 nt, Bordetella pertussis
cgaggugggcggcagca

SEQ ID NO: 2345475 - RNA, 20 nt, Bordetella pertussis
cgagguguagaacucggccg

SEQ ID NO: 2345476 - RNA, 15 nt, Bordetella pertussis
cgauagcgcuccagc

SEQ ID NO: 2345477 - RNA, 16 nt, Bordetella pertussis
cgauagcgcuccagcg

SEQ ID NO: 2345478 - RNA, 16 nt, Bordetella pertussis
cgauagcggcgccgcu

SEQ ID NO: 2345479 - RNA, 16 nt, Bordetella pertussis
cgauagcgggccugca

SEQ ID NO: 2345480 - RNA, 19 nt, Bordetella pertussis
cgauagcgggccugcagca

SEQ ID NO: 2345481 - RNA, 17 nt, Bordetella pertussis
cgauaggugcgcagccg

SEQ ID NO: 2345482 - RNA, 17 nt, Bordetella pertussis
cgauauccagguaggcg

SEQ ID NO: 2345483 - RNA, 18 nt, Bordetella pertussis
cgauauccaucggcgcgc

SEQ ID NO: 2345484 - RNA, 19 nt, Bordetella pertussis
cgauaucccgggcuccggu

SEQ ID NO: 2345485 - RNA, 22 nt, Bordetella pertussis
cgauaugcagccgcaccagcgc

SEQ ID NO: 2345486 - RNA, 13 nt, Bordetella pertussis
cgauaugggcggc

SEQ ID NO: 2345487 - RNA, 14 nt, Bordetella pertussis
cgauaugggcggcc

SEQ ID NO: 2345488 - RNA, 17 nt, Bordetella pertussis
cgauaugggcggccucg

SEQ ID NO: 2345489 - RNA, 17 nt, Bordetella pertussis
cgauauugaaggccgag

SEQ ID NO: 2345490 - RNA, 22 nt, Bordetella pertussis
cgauauuggcgucggccgccgu

SEQ ID NO: 2345491 - RNA, 20 nt, Bordetella pertussis
cgauauugguguugccggcc

SEQ ID NO: 2345492 - RNA, 23 nt, Bordetella pertussis
cgauauugguguugccggccagg

SEQ ID NO: 2345493 - RNA, 19 nt, Bordetella pertussis
cgaucaagggguggcuguc

SEQ ID NO: 2345494 - RNA, 15 nt, Bordetella pertussis
cgaucaccaccggca

SEQ ID NO: 2345495 - RNA, 20 nt, Bordetella pertussis
cgaucaccacgcccgcgccg

SEQ ID NO: 2345496 - RNA, 18 nt, Bordetella pertussis
cgaucaccacgggcacga

SEQ ID NO: 2345497 - RNA, 14 nt, Bordetella pertussis
cgaucaccgacagc

SEQ ID NO: 2345498 - RNA, 19 nt, Bordetella pertussis
cgaucaccgacagcgccag

SEQ ID NO: 2345499 - RNA, 20 nt, Bordetella pertussis
cgaucaccgacagcgccagc

SEQ ID NO: 2345500 - RNA, 18 nt, Bordetella pertussis
cgaucaccugcaggccca

SEQ ID NO: 2345501 - RNA, 19 nt, Bordetella pertussis
cgaucaccugcaggcccac

SEQ ID NO: 2345502 - RNA, 14 nt, Bordetella pertussis
cgaucacgaacagc

SEQ ID NO: 2345503 - RNA, 18 nt, Bordetella pertussis
cgaucacgaacagcgcca

SEQ ID NO: 2345504 - RNA, 20 nt, Bordetella pertussis
cgaucacgaagcccaguucg

SEQ ID NO: 2345505 - RNA, 13 nt, Bordetella pertussis
cgaucacggccaa

SEQ ID NO: 2345506 - RNA, 15 nt, Bordetella pertussis
cgaucacggcgcgcg

SEQ ID NO: 2345507 - RNA, 23 nt, Bordetella pertussis
cgaucacgggcuguucgcgcagc

SEQ ID NO: 2345508 - RNA, 16 nt, Bordetella pertussis
cgaucacgguggcgua

SEQ ID NO: 2345509 - RNA, 16 nt, Bordetella pertussis
cgaucagcaagggccc

SEQ ID NO: 2345510 - RNA, 20 nt, Bordetella pertussis
cgaucagcaagggccccagc

SEQ ID NO: 2345511 - RNA, 19 nt, Bordetella pertussis
cgaucagcaccacggcggc

SEQ ID NO: 2345512 - RNA, 23 nt, Bordetella pertussis
cgaucagcaccacggcggccagg

SEQ ID NO: 2345513 - RNA, 14 nt, Bordetella pertussis
cgaucagcaccgcg

SEQ ID NO: 2345514 - RNA, 15 nt, Bordetella pertussis
cgaucagcaccgcgg

SEQ ID NO: 2345515 - RNA, 21 nt, Bordetella pertussis
cgaucagcaggucggcgcggc

SEQ ID NO: 2345516 - RNA, 22 nt, Bordetella pertussis
cgaucagcgaaugcgacagcga

SEQ ID NO: 2345517 - RNA, 12 nt, Bordetella pertussis
cgaucagcgccc

SEQ ID NO: 2345518 - RNA, 13 nt, Bordetella pertussis
cgaucagcgccca

SEQ ID NO: 2345519 - RNA, 15 nt, Bordetella pertussis
cgaucagcgcccagg

SEQ ID NO: 2345520 - RNA, 14 nt, Bordetella pertussis
cgaucagcgcgccg

SEQ ID NO: 2345521 - RNA, 15 nt, Bordetella pertussis
cgaucagcgcgccgu

SEQ ID NO: 2345522 - RNA, 13 nt, Bordetella pertussis
cgaucagcgcggg

SEQ ID NO: 2345523 - RNA, 15 nt, Bordetella pertussis
cgaucagcgcgggcc

SEQ ID NO: 2345524 - RNA, 20 nt, Bordetella pertussis
cgaucagcggauugaccagc

SEQ ID NO: 2345525 - RNA, 23 nt, Bordetella pertussis
cgaucagcggauugaccagcgcg

SEQ ID NO: 2345526 - RNA, 16 nt, Bordetella pertussis
cgaucagcgggcuggc

SEQ ID NO: 2345527 - RNA, 19 nt, Bordetella pertussis
cgaucagcgggcuggccag

SEQ ID NO: 2345528 - RNA, 11 nt, Bordetella pertussis
cgaucagcugc

SEQ ID NO: 2345529 - RNA, 12 nt, Bordetella pertussis
cgaucaggcccu

SEQ ID NO: 2345530 - RNA, 19 nt, Bordetella pertussis
cgaucaggcccuggggccg

SEQ ID NO: 2345531 - RNA, 14 nt, Bordetella pertussis
cgaucaggccgccc

SEQ ID NO: 2345532 - RNA, 13 nt, Bordetella pertussis
cgaucuggcgcgc

SEQ ID NO: 2345533 - RNA, 17 nt, Bordetella pertussis
cgaucuggcgcgcgacc

SEQ ID NO: 2345534 - RNA, 20 nt, Bordetella pertussis
cgaucuggcgcgcgaccagg

SEQ ID NO: 2345535 - RNA, 12 nt, Bordetella pertussis
cgaucuggcuca

SEQ ID NO: 2345536 - RNA, 14 nt, Bordetella pertussis
cgaucugggccucg

SEQ ID NO: 2345537 - RNA, 18 nt, Bordetella pertussis
cgaucugguccugggccg

SEQ ID NO: 2345538 - RNA, 21 nt, Bordetella pertussis
cgaucugguccugggccguca

SEQ ID NO: 2345539 - RNA, 14 nt, Bordetella pertussis
cgaucugguuggcc

SEQ ID NO: 2345540 - RNA, 16 nt, Bordetella pertussis
cgaucugguuggccac

SEQ ID NO: 2345541 - RNA, 16 nt, Bordetella pertussis
cgaucuucagcaccag

SEQ ID NO: 2345542 - RNA, 16 nt, Bordetella pertussis
cgaucuucucgacggc

SEQ ID NO: 2345543 - RNA, 19 nt, Bordetella pertussis
cgaucuucucgccgcgcgu

SEQ ID NO: 2345544 - RNA, 16 nt, Bordetella pertussis
cgaucuucugggcggc

SEQ ID NO: 2345545 - RNA, 14 nt, Bordetella pertussis
cgaucuugccgcaa

SEQ ID NO: 2345546 - RNA, 14 nt, Bordetella pertussis
cgaucuugccggcc

SEQ ID NO: 2345547 - RNA, 23 nt, Bordetella pertussis
cgaugaacaagguacccgcgccg

SEQ ID NO: 2345548 - RNA, 15 nt, Bordetella pertussis
cgaugaagacgccgu

SEQ ID NO: 2345549 - RNA, 18 nt, Bordetella pertussis
cgaugaagaucaggcggc

SEQ ID NO: 2345550 - RNA, 18 nt, Bordetella pertussis
cgaugaagcccgagcggc

SEQ ID NO: 2345551 - RNA, 14 nt, Bordetella pertussis
cgaugaaggcgccg

SEQ ID NO: 2345552 - RNA, 17 nt, Bordetella pertussis
cgaugaaggcgccgacu

SEQ ID NO: 2345553 - RNA, 23 nt, Bordetella pertussis
cgaugaauuccagccaggccucg

SEQ ID NO: 2345554 - RNA, 14 nt, Bordetella pertussis
cgaugaauugcgcc

SEQ ID NO: 2345555 - RNA, 17 nt, Bordetella pertussis
cgaugaauugcgccacg

SEQ ID NO: 2345556 - RNA, 19 nt, Bordetella pertussis
cgaugacaucgccgcugcg

SEQ ID NO: 2345557 - RNA, 16 nt, Bordetella pertussis
cgaugaccagccagcc

SEQ ID NO: 2345558 - RNA, 19 nt, Bordetella pertussis
cgaugaccagccagccgcc

SEQ ID NO: 2345559 - RNA, 12 nt, Bordetella pertussis
cgaugaccagcg

SEQ ID NO: 2345560 - RNA, 16 nt, Bordetella pertussis
cgaugaccagcgccgg

SEQ ID NO: 2345561 - RNA, 17 nt, Bordetella pertussis
cgaugaccagcgccggc

SEQ ID NO: 2345562 - RNA, 18 nt, Bordetella pertussis
cgaugaccagcgccggcg

SEQ ID NO: 2345563 - RNA, 21 nt, Bordetella pertussis
cgaugaccagcgccggcgcau

SEQ ID NO: 2345564 - RNA, 20 nt, Bordetella pertussis
cgaugaccagggcgccgacc

SEQ ID NO: 2345565 - RNA, 13 nt, Bordetella pertussis
cgaugaccaucac

SEQ ID NO: 2345566 - RNA, 15 nt, Bordetella pertussis
cgaugaccggcaagc

SEQ ID NO: 2345567 - RNA, 21 nt, Bordetella pertussis
cgaugaccggcaagcgcucgc

SEQ ID NO: 2345568 - RNA, 15 nt, Bordetella pertussis
cgaugaccggccagg

SEQ ID NO: 2345569 - RNA, 16 nt, Bordetella pertussis
cgaugaccggccaggc

SEQ ID NO: 2345570 - RNA, 19 nt, Bordetella pertussis
cgaugaccggccaggcgcg

SEQ ID NO: 2345571 - RNA, 20 nt, Bordetella pertussis
cgaugaccggccaggcgcgg

SEQ ID NO: 2345572 - RNA, 18 nt, Bordetella pertussis
cgaugaccucgcgcugca

SEQ ID NO: 2345573 - RNA, 19 nt, Bordetella pertussis
cgaugaccucgcgcugcag

SEQ ID NO: 2345574 - RNA, 20 nt, Bordetella pertussis
cgaugaccucgcgcugcagc

SEQ ID NO: 2345575 - RNA, 21 nt, Bordetella pertussis
cgaugaccucgcgcugcagca

SEQ ID NO: 2345576 - RNA, 14 nt, Bordetella pertussis
cgaugaccugggcc

SEQ ID NO: 2345577 - RNA, 17 nt, Bordetella pertussis
cgaugaccugggccugg

SEQ ID NO: 2345578 - RNA, 22 nt, Bordetella pertussis
cgaugaccuugagaugccagcg

SEQ ID NO: 2345579 - RNA, 18 nt, Bordetella pertussis
cgaugacgcgccgcgccu

SEQ ID NO: 2345580 - RNA, 21 nt, Bordetella pertussis
cgaugacggcuucgaccacgc

SEQ ID NO: 2345581 - RNA, 22 nt, Bordetella pertussis
cgaugacggcuucgaccacgcg

SEQ ID NO: 2345582 - RNA, 18 nt, Bordetella pertussis
cgaugacggggcggcgcc

SEQ ID NO: 2345583 - RNA, 19 nt, Bordetella pertussis
cgaugacggggcggcgccu

SEQ ID NO: 2345584 - RNA, 18 nt, Bordetella pertussis
cgaugacgugucccccgg

SEQ ID NO: 2345585 - RNA, 17 nt, Bordetella pertussis
cgaugagcuggcgcagg

SEQ ID NO: 2345586 - RNA, 18 nt, Bordetella pertussis
cgaugagcuggcgcaggu

SEQ ID NO: 2345587 - RNA, 14 nt, Bordetella pertussis
cgaugaggccaggg

SEQ ID NO: 2345588 - RNA, 13 nt, Bordetella pertussis
cgaugaucgccuc

SEQ ID NO: 2345589 - RNA, 17 nt, Bordetella pertussis
cgaugaucgccucgggg

SEQ ID NO: 2345590 - RNA, 19 nt, Bordetella pertussis
cgaugaucgcgccgacgac

SEQ ID NO: 2345591 - RNA, 20 nt, Bordetella pertussis
cgaugaucgcgccgacgacc

SEQ ID NO: 2345592 - RNA, 21 nt, Bordetella pertussis
cgcaccaggucgcggugcgcc

SEQ ID NO: 2345593 - RNA, 15 nt, Bordetella pertussis
cgcaccagguuggcg

SEQ ID NO: 2345594 - RNA, 20 nt, Bordetella pertussis
cgcaccagguuggcgauggc

SEQ ID NO: 2345595 - RNA, 12 nt, Bordetella pertussis
cgcaccaguccc

SEQ ID NO: 2345596 - RNA, 19 nt, Bordetella pertussis
cgcaccagucccgcaccga

SEQ ID NO: 2345597 - RNA, 24 nt, Bordetella pertussis
cgcaccagucccgcaccgaccagc

SEQ ID NO: 2345598 - RNA, 16 nt, Bordetella pertussis
cgcaccaucgccgagc

SEQ ID NO: 2345599 - RNA, 18 nt, Bordetella pertussis
cgcaccaugccgauggcg

SEQ ID NO: 2345600 - RNA, 19 nt, Bordetella pertussis
cgcaccaugccgauggcgg

SEQ ID NO: 2345601 - RNA, 21 nt, Bordetella pertussis
cgcaccaugccgauggcggug

SEQ ID NO: 2345602 - RNA, 15 nt, Bordetella pertussis
cgcaccaugcgcagc

SEQ ID NO: 2345603 - RNA, 16 nt, Bordetella pertussis
cgcaccaugcgcagca

SEQ ID NO: 2345604 - RNA, 18 nt, Bordetella pertussis
cgcaccaugcggugcgcc

SEQ ID NO: 2345605 - RNA, 12 nt, Bordetella pertussis
cgcaccauggcg

SEQ ID NO: 2345606 - RNA, 15 nt, Bordetella pertussis
cgcaccauggcgccc

SEQ ID NO: 2345607 - RNA, 17 nt, Bordetella pertussis
cgcaccauggcgcccac

SEQ ID NO: 2345608 - RNA, 22 nt, Bordetella pertussis
cgcaccaugggcgucgucgccg

SEQ ID NO: 2345609 - RNA, 13 nt, Bordetella pertussis
cgcacccaggccc

SEQ ID NO: 2345610 - RNA, 20 nt, Bordetella pertussis
cgcaccccggccgacggcaa

SEQ ID NO: 2345611 - RNA, 16 nt, Bordetella pertussis
cgcacccgcaggccgu

SEQ ID NO: 2345612 - RNA, 14 nt, Bordetella pertussis
cgcacccgccugga

SEQ ID NO: 2345613 - RNA, 18 nt, Bordetella pertussis
cgcacccgguauccgcgc

SEQ ID NO: 2345614 - RNA, 21 nt, Bordetella pertussis
cgcacccguuccagcaugucc

SEQ ID NO: 2345615 - RNA, 17 nt, Bordetella pertussis
cgcacccugcaggccgg

SEQ ID NO: 2345616 - RNA, 13 nt, Bordetella pertussis
cgcaccgacacca

SEQ ID NO: 2345617 - RNA, 13 nt, Bordetella pertussis
cgcaccgaccagc

SEQ ID NO: 2345618 - RNA, 14 nt, Bordetella pertussis
cgcaccgaccagcg

SEQ ID NO: 2345619 - RNA, 15 nt, Bordetella pertussis
cgcaccgaccagcgc

SEQ ID NO: 2345620 - RNA, 15 nt, Bordetella pertussis
cgcaccgacggcagc

SEQ ID NO: 2345621 - RNA, 18 nt, Bordetella pertussis
cgcaccgacggcagcccc

SEQ ID NO: 2345622 - RNA, 21 nt, Bordetella pertussis
cgcaccgacggcagccccggg

SEQ ID NO: 2345623 - RNA, 19 nt, Bordetella pertussis
cgcaccgaggugccggcgg

SEQ ID NO: 2345624 - RNA, 17 nt, Bordetella pertussis
cgcaccgcgccagcgcc

SEQ ID NO: 2345625 - RNA, 22 nt, Bordetella pertussis
cgcaccgcgccagcgccggcgc

SEQ ID NO: 2345626 - RNA, 20 nt, Bordetella pertussis
cgcaccgcuucuucgucgcg

SEQ ID NO: 2345627 - RNA, 22 nt, Bordetella pertussis
cgcaccgcuucuucgucgcgcc

SEQ ID NO: 2345628 - RNA, 16 nt, Bordetella pertussis
cgcaccggaggcgccg

SEQ ID NO: 2345629 - RNA, 12 nt, Bordetella pertussis
cgcaccggccag

SEQ ID NO: 2345630 - RNA, 16 nt, Bordetella pertussis
cgcaccggccaggggc

SEQ ID NO: 2345631 - RNA, 12 nt, Bordetella pertussis
cgcaccggccgg

SEQ ID NO: 2345632 - RNA, 15 nt, Bordetella pertussis
cgcaccggccggccg

SEQ ID NO: 2345633 - RNA, 13 nt, Bordetella pertussis
cgcaccggcgugc

SEQ ID NO: 2345634 - RNA, 16 nt, Bordetella pertussis
cgcaccggcgugcgcu

SEQ ID NO: 2345635 - RNA, 19 nt, Bordetella pertussis
cgcaccggcgugcgcuggc

SEQ ID NO: 2345636 - RNA, 21 nt, Bordetella pertussis
cgcaccggcgugcgcuggcug

SEQ ID NO: 2345637 - RNA, 22 nt, Bordetella pertussis
cgcaccggcgugcgcuggcugg

SEQ ID NO: 2345638 - RNA, 20 nt, Bordetella pertussis
cgcaccggcuuggggcgcgc

SEQ ID NO: 2345639 - RNA, 22 nt, Bordetella pertussis
cgcaccggcuuggggcgcgccg

SEQ ID NO: 2345640 - RNA, 14 nt, Bordetella pertussis
cgcaccgggcggcc

SEQ ID NO: 2345641 - RNA, 18 nt, Bordetella pertussis
cgcaccgggcggcccggc

SEQ ID NO: 2345642 - RNA, 14 nt, Bordetella pertussis
cgcaccgucacgcg

SEQ ID NO: 2345643 - RNA, 19 nt, Bordetella pertussis
cgcaccgucgccagggcga

SEQ ID NO: 2345644 - RNA, 18 nt, Bordetella pertussis
cgcaccucguaaguggcg

SEQ ID NO: 2345645 - RNA, 20 nt, Bordetella pertussis
cgcaccucguaaguggcggc

SEQ ID NO: 2345646 - RNA, 18 nt, Bordetella pertussis
cgcaccugaacaccggcg

SEQ ID NO: 2345647 - RNA, 21 nt, Bordetella pertussis
cgcaccugaacaccggcgcgc

SEQ ID NO: 2345648 - RNA, 16 nt, Bordetella pertussis
cgcaccugcugcggca

SEQ ID NO: 2345649 - RNA, 20 nt, Bordetella pertussis
cgcaccugcugcggcacggc

SEQ ID NO: 2345650 - RNA, 21 nt, Bordetella pertussis
cgcaccugcugcggcacggcc

SEQ ID NO: 2345651 - RNA, 18 nt, Bordetella pertussis
cgcaccugggaggggccg

SEQ ID NO: 2345652 - RNA, 13 nt, Bordetella pertussis
cgcaccugggcgu

SEQ ID NO: 2345653 - RNA, 13 nt, Bordetella pertussis
cgcaccuggucca

SEQ ID NO: 2345654 - RNA, 16 nt, Bordetella pertussis
cgcaccugguccaugg

SEQ ID NO: 2345655 - RNA, 19 nt, Bordetella pertussis
cgcaccuguucggcggcgc

SEQ ID NO: 2345656 - RNA, 18 nt, Bordetella pertussis
cgcaccuugcccacgcca

SEQ ID NO: 2345657 - RNA, 15 nt, Bordetella pertussis
cgcaccuugccugca

SEQ ID NO: 2345658 - RNA, 15 nt, Bordetella pertussis
cgcaccuugucgcgc

SEQ ID NO: 2345659 - RNA, 18 nt, Bordetella pertussis
cgcaccuugucgcgcagc

SEQ ID NO: 2345660 - RNA, 21 nt, Bordetella pertussis
cgcaccuugucgcgcagcgcc

SEQ ID NO: 2345661 - RNA, 17 nt, Bordetella pertussis
cgcaccuuucugcugcu

SEQ ID NO: 2345662 - RNA, 19 nt, Bordetella pertussis
cgcaccuuucugcugcucg

SEQ ID NO: 2345663 - RNA, 12 nt, Bordetella pertussis
cgcacgaagcgg

SEQ ID NO: 2345664 - RNA, 14 nt, Bordetella pertussis
cgcacgaccaccag

SEQ ID NO: 2345665 - RNA, 16 nt, Bordetella pertussis
cgcacgaccaccagcg

SEQ ID NO: 2345666 - RNA, 16 nt, Bordetella pertussis
cgcacgaucgcgccgg

SEQ ID NO: 2345667 - RNA, 19 nt, Bordetella pertussis
cgcacgaucgcgccggccu

SEQ ID NO: 2345668 - RNA, 22 nt, Bordetella pertussis
cgcacgaucgcgccggccuggg

SEQ ID NO: 2345669 - RNA, 20 nt, Bordetella pertussis
cgcacgaugccgaccgagcc

SEQ ID NO: 2345670 - RNA, 13 nt, Bordetella pertussis
cgcacgauggcgc

SEQ ID NO: 2345671 - RNA, 19 nt, Bordetella pertussis
cgcacgauggggcagccau

SEQ ID NO: 2345672 - RNA, 19 nt, Bordetella pertussis
cgcacgauggggccgucgc

SEQ ID NO: 2345673 - RNA, 17 nt, Bordetella pertussis
cgcacgauuucacccag

SEQ ID NO: 2345674 - RNA, 13 nt, Bordetella pertussis
cgcacgcaccgcg

SEQ ID NO: 2345675 - RNA, 18 nt, Bordetella pertussis
cgcacgcaccgcgccagc

SEQ ID NO: 2345676 - RNA, 14 nt, Bordetella pertussis
cgcacgcagcgcuc

SEQ ID NO: 2345677 - RNA, 16 nt, Bordetella pertussis
cgcacgccccgacgcg

SEQ ID NO: 2345678 - RNA, 19 nt, Bordetella pertussis
cgcacgccggccugcgcca

SEQ ID NO: 2345679 - RNA, 21 nt, Bordetella pertussis
cgcacgccggccugcgccagc

SEQ ID NO: 2345680 - RNA, 13 nt, Bordetella pertussis
cgcacgccgggcg

SEQ ID NO: 2345681 - RNA, 19 nt, Bordetella pertussis
cgcacgccgggcgcggccg

SEQ ID NO: 2345682 - RNA, 18 nt, Bordetella pertussis
cgcacgccggucgccagc

SEQ ID NO: 2345683 - RNA, 13 nt, Bordetella pertussis
cgcacgcgcagca

SEQ ID NO: 2345684 - RNA, 14 nt, Bordetella pertussis
cgcacgcgcagcac

SEQ ID NO: 2345685 - RNA, 18 nt, Bordetella pertussis
cgcacgcgcggcagcgcc

SEQ ID NO: 2345686 - RNA, 19 nt, Bordetella pertussis
cgcacgcgcggcagcgccg

SEQ ID NO: 2345687 - RNA, 19 nt, Bordetella pertussis
cgcacgcgcucgggcagcu

SEQ ID NO: 2345688 - RNA, 16 nt, Bordetella pertussis
cgcacgcgcuugcucg

SEQ ID NO: 2345689 - RNA, 12 nt, Bordetella pertussis
cgcacgcggccg

SEQ ID NO: 2345690 - RNA, 14 nt, Bordetella pertussis
cgcacgcggccgcg

SEQ ID NO: 2345691 - RNA, 20 nt, Bordetella pertussis
cgcacgcggccgcgggccgc

SEQ ID NO: 2345692 - RNA, 23 nt, Bordetella pertussis
cgcacgcggccgcgggccgcugg

SEQ ID NO: 2345693 - RNA, 20 nt, Bordetella pertussis
cgcacgcggcuucgcccgga

SEQ ID NO: 2345694 - RNA, 18 nt, Bordetella pertussis
cgcacgcguucgggcggc

SEQ ID NO: 2345695 - RNA, 22 nt, Bordetella pertussis
cgcacgcguucgggcggcaggu

SEQ ID NO: 2345696 - RNA, 21 nt, Bordetella pertussis
cgcacgcucuacacggccgcc

SEQ ID NO: 2345697 - RNA, 15 nt, Bordetella pertussis
cgcacgcucugcacc

SEQ ID NO: 2345698 - RNA, 20 nt, Bordetella pertussis
cgcacgcuggcaucgucgcg

SEQ ID NO: 2345699 - RNA, 13 nt, Bordetella pertussis
cgcacgcugggcg

SEQ ID NO: 2345700 - RNA, 19 nt, Bordetella pertussis
cgcacgcugggcgaggcgc

SEQ ID NO: 2345701 - RNA, 22 nt, Bordetella pertussis
cgcacgcugggcgaggcgcugg

SEQ ID NO: 2345702 - RNA, 19 nt, Bordetella pertussis
cgcacgcugggcuacgacc

SEQ ID NO: 2345703 - RNA, 15 nt, Bordetella pertussis
cgcacggacagcccg

SEQ ID NO: 2345704 - RNA, 17 nt, Bordetella pertussis
cgcacggacagcccgcg

SEQ ID NO: 2345705 - RNA, 19 nt, Bordetella pertussis
cgcacggacagcccgcgcu

SEQ ID NO: 2345706 - RNA, 13 nt, Bordetella pertussis
cgcacggccguca

SEQ ID NO: 2345707 - RNA, 14 nt, Bordetella pertussis
cgcacggcgcccug

SEQ ID NO: 2345708 - RNA, 20 nt, Bordetella pertussis
cgcacggcggcgaucacgcc

SEQ ID NO: 2345709 - RNA, 20 nt, Bordetella pertussis
cgcacgggccgacggccucg

SEQ ID NO: 2345710 - RNA, 22 nt, Bordetella pertussis
cgcacgggccgacggccucggc

SEQ ID NO: 2345711 - RNA, 21 nt, Bordetella pertussis
cgcacgggcgaggcggggcug

SEQ ID NO: 2345712 - RNA, 22 nt, Bordetella pertussis
cgcacgggcgaggcggggcugg

SEQ ID NO: 2345713 - RNA, 15 nt, Bordetella pertussis
cgcacgggcgagggc

SEQ ID NO: 2345714 - RNA, 12 nt, Bordetella pertussis
cgcacgggcgcc

SEQ ID NO: 2345715 - RNA, 14 nt, Bordetella pertussis
cgcacgggcgccug

SEQ ID NO: 2345716 - RNA, 15 nt, Bordetella pertussis
cgcacgggcgccugu

SEQ ID NO: 2345717 - RNA, 15 nt, Bordetella pertussis
cgcacggggacaggc

SEQ ID NO: 2345718 - RNA, 19 nt, Bordetella pertussis
cgcacggggacaggcacgc

SEQ ID NO: 2345719 - RNA, 23 nt, Bordetella pertussis
cgcacggggacaggcacgcgccg

SEQ ID NO: 2345720 - RNA, 15 nt, Bordetella pertussis
cgcacggggacuggc

SEQ ID NO: 2345721 - RNA, 17 nt, Bordetella pertussis
cgcacggggacuggcac

SEQ ID NO: 2345722 - RNA, 21 nt, Bordetella pertussis
cgcacggggacuggcaccggc

SEQ ID NO: 2345723 - RNA, 23 nt, Bordetella pertussis
cgcacggggacuggcacgcgcug

SEQ ID NO: 2345724 - RNA, 16 nt, Bordetella pertussis
cgcacgugacgccggc

SEQ ID NO: 2345725 - RNA, 17 nt, Bordetella pertussis
cgcacgugacgccggcg

SEQ ID NO: 2345726 - RNA, 19 nt, Bordetella pertussis
cgcacgugacgccggcgaa

SEQ ID NO: 2345727 - RNA, 22 nt, Bordetella pertussis
cgcacguugagauccaggaacu

SEQ ID NO: 2345728 - RNA, 24 nt, Bordetella pertussis
cgcacuccguaaagaugcgcgccg

SEQ ID NO: 2345729 - RNA, 12 nt, Bordetella pertussis
cgcacucgaccg

SEQ ID NO: 2345730 - RNA, 22 nt, Bordetella pertussis
cgcacugagaaaggccgccacg

SEQ ID NO: 2345731 - RNA, 23 nt, Bordetella pertussis
cgcacugagaaaggccgccacga

SEQ ID NO: 2345732 - RNA, 19 nt, Bordetella pertussis
cgcacugagcuucgccccc

SEQ ID NO: 2345733 - RNA, 15 nt, Bordetella pertussis
cgcacugggugacgc

SEQ ID NO: 2345734 - RNA, 16 nt, Bordetella pertussis
cgcacuggguggccag

SEQ ID NO: 2345735 - RNA, 18 nt, Bordetella pertussis
cgcacuggguggccagcg

SEQ ID NO: 2345736 - RNA, 21 nt, Bordetella pertussis
cgcacuggguggccagcgccg

SEQ ID NO: 2345737 - RNA, 23 nt, Bordetella pertussis
cgcacuggguggccagcgccgcc

SEQ ID NO: 2345738 - RNA, 17 nt, Bordetella pertussis
cgcacuucgggccaccc

SEQ ID NO: 2345739 - RNA, 18 nt, Bordetella pertussis
cgcagaaaccgccacagc

SEQ ID NO: 2345740 - RNA, 19 nt, Bordetella pertussis
cgcagaaaccgccacagcg

SEQ ID NO: 2345741 - RNA, 24 nt, Bordetella pertussis
cgcagaaaccgccacagcgccgcg

SEQ ID NO: 2345742 - RNA, 15 nt, Bordetella pertussis
cgcagaagcagccgc

SEQ ID NO: 2345743 - RNA, 16 nt, Bordetella pertussis
cgcagaagcagccgcg

SEQ ID NO: 2345744 - RNA, 22 nt, Bordetella pertussis
cgcagaagcagccgcgcggccg

SEQ ID NO: 2345745 - RNA, 21 nt, Bordetella pertussis
cgcagaaggcgaacugggucu

SEQ ID NO: 2345746 - RNA, 13 nt, Bordetella pertussis
cgcagaccacgcc

SEQ ID NO: 2345747 - RNA, 16 nt, Bordetella pertussis
cgcagaccacgccggc

SEQ ID NO: 2345748 - RNA, 17 nt, Bordetella pertussis
cgcagaccacgccggcg

SEQ ID NO: 2345749 - RNA, 19 nt, Bordetella pertussis
cgcagaccacgccggcggu

SEQ ID NO: 2345750 - RNA, 16 nt, Bordetella pertussis
cgcagacuccaggagc

SEQ ID NO: 2345751 - RNA, 19 nt, Bordetella pertussis
cgcagauccucgaacaggc

SEQ ID NO: 2345752 - RNA, 21 nt, Bordetella pertussis
cgcagauccucgaacaggcca

SEQ ID NO: 2345753 - RNA, 14 nt, Bordetella pertussis
cgcagauggccagc

SEQ ID NO: 2345754 - RNA, 18 nt, Bordetella pertussis
cgcagauggccagcagcg

SEQ ID NO: 2345755 - RNA, 19 nt, Bordetella pertussis
cgcagauggccagcagcgc

SEQ ID NO: 2345756 - RNA, 13 nt, Bordetella pertussis
cgcagauggcggc

SEQ ID NO: 2345757 - RNA, 22 nt, Bordetella pertussis
cgcagauggcggcgaugccgcu

SEQ ID NO: 2345758 - RNA, 17 nt, Bordetella pertussis
cgcagaugggcggcgac

SEQ ID NO: 2345759 - RNA, 19 nt, Bordetella pertussis
cgcagaugggcggcgacga

SEQ ID NO: 2345760 - RNA, 16 nt, Bordetella pertussis
cgcagauugcgcucgg

SEQ ID NO: 2345761 - RNA, 20 nt, Bordetella pertussis
cgcagauugcgcucggucau

SEQ ID NO: 2345762 - RNA, 16 nt, Bordetella pertussis
cgcagauuuccagcgc

SEQ ID NO: 2345763 - RNA, 14 nt, Bordetella pertussis
cgcagcaacccgcc

SEQ ID NO: 2345764 - RNA, 15 nt, Bordetella pertussis
cgcagcaacccgccc

SEQ ID NO: 2345765 - RNA, 16 nt, Bordetella pertussis
cgcagcaacccgcccg

SEQ ID NO: 2345766 - RNA, 16 nt, Bordetella pertussis
cgcagcaagcugcugc

SEQ ID NO: 2345767 - RNA, 17 nt, Bordetella pertussis
cgcagcaagcugcugcu

SEQ ID NO: 2345768 - RNA, 18 nt, Bordetella pertussis
cgcagcaagcugcugcug

SEQ ID NO: 2345769 - RNA, 15 nt, Bordetella pertussis
cgcagcaaggcgcgc

SEQ ID NO: 2345770 - RNA, 17 nt, Bordetella pertussis
cgcagcaaggcgcgcca

SEQ ID NO: 2345771 - RNA, 20 nt, Bordetella pertussis
cgcagcaaggcgcgccaccg

SEQ ID NO: 2345772 - RNA, 18 nt, Bordetella pertussis
cgcagcaagucagcccgc

SEQ ID NO: 2345773 - RNA, 19 nt, Bordetella pertussis
cgcagcaagucagcccgcg

SEQ ID NO: 2345774 - RNA, 24 nt, Bordetella pertussis
cgcagcaagucagcccgcgucgcu

SEQ ID NO: 2345775 - RNA, 20 nt, Bordetella pertussis
cgcagcaauucaagccgcac

SEQ ID NO: 2345776 - RNA, 22 nt, Bordetella pertussis
cgcagcaauucaagccgcacca

SEQ ID NO: 2345777 - RNA, 18 nt, Bordetella pertussis
cgcagcaauugccccagc

SEQ ID NO: 2345778 - RNA, 14 nt, Bordetella pertussis
cgcagcaccacauc

SEQ ID NO: 2345779 - RNA, 19 nt, Bordetella pertussis
cgcagcaccacaucgccgg

SEQ ID NO: 2345780 - RNA, 11 nt, Bordetella pertussis
cgcagcaccag

SEQ ID NO: 2345781 - RNA, 13 nt, Bordetella pertussis
cgcagcaccaggc

SEQ ID NO: 2345782 - RNA, 22 nt, Bordetella pertussis
cgcagcaccaggcuuugcgcgc

SEQ ID NO: 2345783 - RNA, 23 nt, Bordetella pertussis
cgcagcaccaggcuuugcgcgcc

SEQ ID NO: 2345784 - RNA, 13 nt, Bordetella pertussis
cgcagcaccgcca

SEQ ID NO: 2345785 - RNA, 14 nt, Bordetella pertussis
cgcagcaccgccag

SEQ ID NO: 2345786 - RNA, 17 nt, Bordetella pertussis
cgcagcaccgccagcgc

SEQ ID NO: 2345787 - RNA, 12 nt, Bordetella pertussis
cgcagcaccgcg

SEQ ID NO: 2345788 - RNA, 18 nt, Bordetella pertussis
cgcagcaccgcgcgcacg

SEQ ID NO: 2345789 - RNA, 20 nt, Bordetella pertussis
cgcagcaccgcgcgcacgac

SEQ ID NO: 2345790 - RNA, 15 nt, Bordetella pertussis
cgcagcaccggcaga

SEQ ID NO: 2345791 - RNA, 14 nt, Bordetella pertussis
cgcagcaccggcgu

SEQ ID NO: 2345792 - RNA, 15 nt, Bordetella pertussis
cgcagcaccggcgug

SEQ ID NO: 2345793 - RNA, 22 nt, Bordetella pertussis
cgcagcaccggcgugagcgcca

SEQ ID NO: 2345794 - RNA, 16 nt, Bordetella pertussis
cgcagcaccucggcgu

SEQ ID NO: 2345795 - RNA, 18 nt, Bordetella pertussis
cgcagcaccucggggcgc

SEQ ID NO: 2345796 - RNA, 22 nt, Bordetella pertussis
cgcagcaccuugaccuggucgg

SEQ ID NO: 2345797 - RNA, 18 nt, Bordetella pertussis
cgcagcacgcccagaugg

SEQ ID NO: 2345798 - RNA, 15 nt, Bordetella pertussis
cgcagcacgcccgcg

SEQ ID NO: 2345799 - RNA, 16 nt, Bordetella pertussis
cgcagcacgcccgcgc

SEQ ID NO: 2345800 - RNA, 17 nt, Bordetella pertussis
cgcagcacgcccgcgcg

SEQ ID NO: 2345801 - RNA, 12 nt, Bordetella pertussis
cgcagcacgccg

SEQ ID NO: 2345802 - RNA, 17 nt, Bordetella pertussis
cgcagcacgccgcgcca

SEQ ID NO: 2345803 - RNA, 15 nt, Bordetella pertussis
cgcagcagacgcuuc

SEQ ID NO: 2345804 - RNA, 19 nt, Bordetella pertussis
cgcagcagacgcuucaggc

SEQ ID NO: 2345805 - RNA, 21 nt, Bordetella pertussis
cgcagcagacgcuucaggccg

SEQ ID NO: 2345806 - RNA, 20 nt, Bordetella pertussis
cgcagcagauugccgcgcgg

SEQ ID NO: 2345807 - RNA, 21 nt, Bordetella pertussis
cgcagcagauugccgcgcggc

SEQ ID NO: 2345808 - RNA, 14 nt, Bordetella pertussis
cgcagcagcagcgc

SEQ ID NO: 2345809 - RNA, 13 nt, Bordetella pertussis
cgcagcagccgcu

SEQ ID NO: 2345810 - RNA, 10 nt, Bordetella pertussis
cgcagcagcg

SEQ ID NO: 2345811 - RNA, 13 nt, Bordetella pertussis
cgcagcagcgaca

SEQ ID NO: 2345812 - RNA, 13 nt, Bordetella pertussis
cgcagcagcgccg

SEQ ID NO: 2345813 - RNA, 15 nt, Bordetella pertussis
cgcagcagcgccggc

SEQ ID NO: 2345814 - RNA, 13 nt, Bordetella pertussis
cgcagcagcgcgg

SEQ ID NO: 2345815 - RNA, 20 nt, Bordetella pertussis
cgcagcagcgcgguggccag

SEQ ID NO: 2345816 - RNA, 23 nt, Bordetella pertussis
cgcagcagcgcgguggccagcga

SEQ ID NO: 2345817 - RNA, 14 nt, Bordetella pertussis
cgcagcaggcccau

SEQ ID NO: 2345818 - RNA, 12 nt, Bordetella pertussis
cgcagcaggccg

SEQ ID NO: 2345819 - RNA, 13 nt, Bordetella pertussis
cgcagcaggccgc

SEQ ID NO: 2345820 - RNA, 15 nt, Bordetella pertussis
cgcagcaggccgcgc

SEQ ID NO: 2345821 - RNA, 22 nt, Bordetella pertussis
cgcagcaggccguugccgcugu

SEQ ID NO: 2345822 - RNA, 12 nt, Bordetella pertussis
cgcagcaggcgc

SEQ ID NO: 2345823 - RNA, 16 nt, Bordetella pertussis
cgcagcaggcgcgcgg

SEQ ID NO: 2345824 - RNA, 19 nt, Bordetella pertussis
cgcagcaggcgcgcggccu

SEQ ID NO: 2345825 - RNA, 21 nt, Bordetella pertussis
cgcagcaggcgcgcggccucg

SEQ ID NO: 2345826 - RNA, 13 nt, Bordetella pertussis
cgcagcaggcgcu

SEQ ID NO: 2345827 - RNA, 18 nt, Bordetella pertussis
cgcagcaggcgcucggcc

SEQ ID NO: 2345828 - RNA, 21 nt, Bordetella pertussis
cgcagcaggcgcucggccagc

SEQ ID NO: 2345829 - RNA, 18 nt, Bordetella pertussis
cgcagcagggcggcgguu

SEQ ID NO: 2345830 - RNA, 17 nt, Bordetella pertussis
cgcagcagguggaucga

SEQ ID NO: 2345831 - RNA, 23 nt, Bordetella pertussis
cgcagcaguucggucagcgcggc

SEQ ID NO: 2345832 - RNA, 19 nt, Bordetella pertussis
cgcagcaucuugcgccgcu

SEQ ID NO: 2345833 - RNA, 20 nt, Bordetella pertussis
cgcagcaucuugcgccgcug

SEQ ID NO: 2345834 - RNA, 21 nt, Bordetella pertussis
cgcagcaucuugcgccgcugc

SEQ ID NO: 2345835 - RNA, 21 nt, Bordetella pertussis
cgcagcaugagcugaugcucg

SEQ ID NO: 2345836 - RNA, 18 nt, Bordetella pertussis
cgcagcauggcgccagcu

SEQ ID NO: 2345837 - RNA, 19 nt, Bordetella pertussis
cgcagcauggcgccagcug

SEQ ID NO: 2345838 - RNA, 21 nt, Bordetella pertussis
cgcagcauuucggcgccgccg

SEQ ID NO: 2345839 - RNA, 20 nt, Bordetella pertussis
cgcagccacagcgcguggcc

SEQ ID NO: 2345840 - RNA, 12 nt, Bordetella pertussis
cgcagcccagcg

SEQ ID NO: 2345841 - RNA, 14 nt, Bordetella pertussis
cgcagcccagcgcg

SEQ ID NO: 2345842 - RNA, 15 nt, Bordetella pertussis
cgcagcccgcgcgcc

SEQ ID NO: 2345843 - RNA, 12 nt, Bordetella pertussis
cgcagcccggcg

SEQ ID NO: 2345844 - RNA, 14 nt, Bordetella pertussis
cgcagcccggcgug

SEQ ID NO: 2345845 - RNA, 17 nt, Bordetella pertussis
cgcagcccggcgugccc

SEQ ID NO: 2345846 - RNA, 18 nt, Bordetella pertussis
cgcagcccuucggagcca

SEQ ID NO: 2345847 - RNA, 15 nt, Bordetella pertussis
cgcagccgacaggcg

SEQ ID NO: 2345848 - RNA, 16 nt, Bordetella pertussis
cgcagccgacaggcgc

SEQ ID NO: 2345849 - RNA, 16 nt, Bordetella pertussis
cgcagccgccagcgcc

SEQ ID NO: 2345850 - RNA, 22 nt, Bordetella pertussis
cgcagccgccagcgccuggacc

SEQ ID NO: 2345851 - RNA, 14 nt, Bordetella pertussis
cgcagccgcccggc

SEQ ID NO: 2345852 - RNA, 15 nt, Bordetella pertussis
cgcagccgcccggca

SEQ ID NO: 2345853 - RNA, 14 nt, Bordetella pertussis
cgcagccgcuccag

SEQ ID NO: 2345854 - RNA, 15 nt, Bordetella pertussis
cgcagccgcuccagc

SEQ ID NO: 2345855 - RNA, 16 nt, Bordetella pertussis
cgcagccgcuccagcc

SEQ ID NO: 2345856 - RNA, 21 nt, Bordetella pertussis
cgcagccgcuccagccaccac

SEQ ID NO: 2345857 - RNA, 13 nt, Bordetella pertussis
cgcagccgcuuca

SEQ ID NO: 2345858 - RNA, 12 nt, Bordetella pertussis
cgcagccggccg

SEQ ID NO: 2345859 - RNA, 14 nt, Bordetella pertussis
cgcagccggccggu

SEQ ID NO: 2345860 - RNA, 14 nt, Bordetella pertussis
cgcagccggcugca

SEQ ID NO: 2345861 - RNA, 12 nt, Bordetella pertussis
cgcagccgggcu

SEQ ID NO: 2345862 - RNA, 16 nt, Bordetella pertussis
cgcagccgggcugccg

SEQ ID NO: 2345863 - RNA, 18 nt, Bordetella pertussis
cgcagccgggcugccggc

SEQ ID NO: 2345864 - RNA, 19 nt, Bordetella pertussis
cgcagccgggcugccggca

SEQ ID NO: 2345865 - RNA, 21 nt, Bordetella pertussis
cgcagccgggcugccggcagc

SEQ ID NO: 2345866 - RNA, 19 nt, Bordetella pertussis
cgcagcgaacggcccacgc

SEQ ID NO: 2345867 - RNA, 12 nt, Bordetella pertussis
cgcagcgacucg

SEQ ID NO: 2345868 - RNA, 16 nt, Bordetella pertussis
cgcagcgacucgaaca

SEQ ID NO: 2345869 - RNA, 23 nt, Bordetella pertussis
cgcagcgaggccucgugcugcug

SEQ ID NO: 2345870 - RNA, 21 nt, Bordetella pertussis
cgcagcgaguagacgcagccg

SEQ ID NO: 2345871 - RNA, 13 nt, Bordetella pertussis
cgcagcgcaccga

SEQ ID NO: 2345872 - RNA, 22 nt, Bordetella pertussis
cgcagcgcaccgacggcagccc

SEQ ID NO: 2345873 - RNA, 15 nt, Bordetella pertussis
cgcagcgcagcgcca

SEQ ID NO: 2345874 - RNA, 18 nt, Bordetella pertussis
cgcagcgcagcgccacgc

SEQ ID NO: 2345875 - RNA, 13 nt, Bordetella pertussis
cgcagcgccaccg

SEQ ID NO: 2345876 - RNA, 17 nt, Bordetella pertussis
cgcagcgcccaggcgaa

SEQ ID NO: 2345877 - RNA, 15 nt, Bordetella pertussis
cgcagcgccgcgauu

SEQ ID NO: 2345878 - RNA, 13 nt, Bordetella pertussis
cgcagcgccgcuu

SEQ ID NO: 2345879 - RNA, 15 nt, Bordetella pertussis
cgcagcgccgcuucc

SEQ ID NO: 2345880 - RNA, 14 nt, Bordetella pertussis
cgcagcgccugcag

SEQ ID NO: 2345881 - RNA, 18 nt, Bordetella pertussis
cgcagcgccugcaggcgg

SEQ ID NO: 2345882 - RNA, 19 nt, Bordetella pertussis
cgcagcgccugcaggcggu

SEQ ID NO: 2345883 - RNA, 12 nt, Bordetella pertussis
cgcagcgccugg

SEQ ID NO: 2345884 - RNA, 21 nt, Bordetella pertussis
cgcagcgccuggccgagcgcg

SEQ ID NO: 2345885 - RNA, 13 nt, Bordetella pertussis
cgcagcgcgaccg

SEQ ID NO: 2345886 - RNA, 14 nt, Bordetella pertussis
cgcagcgcgaccgg

SEQ ID NO: 2345887 - RNA, 12 nt, Bordetella pertussis
cgcagcgcgccg

SEQ ID NO: 2345888 - RNA, 17 nt, Bordetella pertussis
cgcagcgcgccggacau

SEQ ID NO: 2345889 - RNA, 14 nt, Bordetella pertussis
cgcagcgcggcacg

SEQ ID NO: 2345890 - RNA, 16 nt, Bordetella pertussis
cgcagcgcggcacgcu

SEQ ID NO: 2345891 - RNA, 18 nt, Bordetella pertussis
cgcagcgcggcacgcugc

SEQ ID NO: 2345892 - RNA, 14 nt, Bordetella pertussis
cgcagcgcggcguu

SEQ ID NO: 2345893 - RNA, 17 nt, Bordetella pertussis
cgcagcggaugccgccc

SEQ ID NO: 2345894 - RNA, 19 nt, Bordetella pertussis
cgcagcggaugccgcccgu

SEQ ID NO: 2345895 - RNA, 15 nt, Bordetella pertussis
cgcagcggcagcgca

SEQ ID NO: 2345896 - RNA, 16 nt, Bordetella pertussis
cgcagcggcaggcggc

SEQ ID NO: 2345897 - RNA, 15 nt, Bordetella pertussis
cgcagcggccaugga

SEQ ID NO: 2345898 - RNA, 13 nt, Bordetella pertussis
cgcagcggcggcg

SEQ ID NO: 2345899 - RNA, 14 nt, Bordetella pertussis
cgcagcggcggcgc

SEQ ID NO: 2345900 - RNA, 17 nt, Bordetella pertussis
cgcagcgggcccgucgc

SEQ ID NO: 2345901 - RNA, 18 nt, Bordetella pertussis
cgcagcgggcccgucgcg

SEQ ID NO: 2345902 - RNA, 17 nt, Bordetella pertussis
cgcagcggggacaggcg

SEQ ID NO: 2345903 - RNA, 20 nt, Bordetella pertussis
cgcagcggggacaggcgccc

SEQ ID NO: 2345904 - RNA, 15 nt, Bordetella pertussis
cgcagcgucgcggcg

SEQ ID NO: 2345905 - RNA, 18 nt, Bordetella pertussis
cgcagcgucgcggcgucg

SEQ ID NO: 2345906 - RNA, 17 nt, Bordetella pertussis
cgcagcgucucgcccac

SEQ ID NO: 2345907 - RNA, 23 nt, Bordetella pertussis
cgcagcgugaccgacaggccugg

SEQ ID NO: 2345908 - RNA, 24 nt, Bordetella pertussis
cgcagcgugaccgacaggccuggc

SEQ ID NO: 2345909 - RNA, 18 nt, Bordetella pertussis
cgcagcguuacgcgacca

SEQ ID NO: 2345910 - RNA, 20 nt, Bordetella pertussis
cgcagcguuucaccgcugga

SEQ ID NO: 2345911 - RNA, 16 nt, Bordetella pertussis
cgcagcucccccacgc

SEQ ID NO: 2345912 - RNA, 18 nt, Bordetella pertussis
cgcagcucccccacgccg

SEQ ID NO: 2345913 - RNA, 16 nt, Bordetella pertussis
cgcagcucguggcgcg

SEQ ID NO: 2345914 - RNA, 19 nt, Bordetella pertussis
cgcagcucguggcgcgccu

SEQ ID NO: 2345915 - RNA, 16 nt, Bordetella pertussis
cgcagcugccugagca

SEQ ID NO: 2345916 - RNA, 14 nt, Bordetella pertussis
cgaugccggccagc

SEQ ID NO: 2345917 - RNA, 18 nt, Bordetella pertussis
cgaugccggccagcagcg

SEQ ID NO: 2345918 - RNA, 14 nt, Bordetella pertussis
cgaugccggccucg

SEQ ID NO: 2345919 - RNA, 18 nt, Bordetella pertussis
cgaugccggccucggcca

SEQ ID NO: 2345920 - RNA, 19 nt, Bordetella pertussis
cgaugccggcguggcgcgc

SEQ ID NO: 2345921 - RNA, 20 nt, Bordetella pertussis
cgaugccggcguggcgcgca

SEQ ID NO: 2345922 - RNA, 14 nt, Bordetella pertussis
cgaugccgggcacg

SEQ ID NO: 2345923 - RNA, 17 nt, Bordetella pertussis
cgaugccguacuuggcg

SEQ ID NO: 2345924 - RNA, 12 nt, Bordetella pertussis
cgaugccgucga

SEQ ID NO: 2345925 - RNA, 18 nt, Bordetella pertussis
cgaugccgucgccgccca

SEQ ID NO: 2345926 - RNA, 19 nt, Bordetella pertussis
cgaugccgucgccgcccac

SEQ ID NO: 2345927 - RNA, 20 nt, Bordetella pertussis
cgaugcgcaccaugcgcagc

SEQ ID NO: 2345928 - RNA, 21 nt, Bordetella pertussis
cgaugcgcaccaugcgcagca

SEQ ID NO: 2345929 - RNA, 15 nt, Bordetella pertussis
cgaugcgcagcagca

SEQ ID NO: 2345930 - RNA, 20 nt, Bordetella pertussis
cgaugcgcagcagcagcgca

SEQ ID NO: 2345931 - RNA, 13 nt, Bordetella pertussis
cgaugcgccaggc

SEQ ID NO: 2345932 - RNA, 17 nt, Bordetella pertussis
cgaugcgccaggccucg

SEQ ID NO: 2345933 - RNA, 21 nt, Bordetella pertussis
cgaugcgccaggcgcucggcg

SEQ ID NO: 2345934 - RNA, 15 nt, Bordetella pertussis
cgaugcgccagucca

SEQ ID NO: 2345935 - RNA, 16 nt, Bordetella pertussis
cgaugcgccgcaccag

SEQ ID NO: 2345936 - RNA, 20 nt, Bordetella pertussis
cgaugcgccgcaccagcgcc

SEQ ID NO: 2345937 - RNA, 23 nt, Bordetella pertussis
cgaugcgccgcaccagcgccgac

SEQ ID NO: 2345938 - RNA, 22 nt, Bordetella pertussis
cgaugcgccgcgcuucgucggc

SEQ ID NO: 2345939 - RNA, 15 nt, Bordetella pertussis
cgaugcgcgaagcgc

SEQ ID NO: 2345940 - RNA, 15 nt, Bordetella pertussis
cgaugcgcgagcgcg

SEQ ID NO: 2345941 - RNA, 14 nt, Bordetella pertussis
cgaugcgcgccacg

SEQ ID NO: 2345942 - RNA, 15 nt, Bordetella pertussis
cgaugcgcgccacga

SEQ ID NO: 2345943 - RNA, 12 nt, Bordetella pertussis
cgaugcgcgcgu

SEQ ID NO: 2345944 - RNA, 13 nt, Bordetella pertussis
cgaugcgcgcgug

SEQ ID NO: 2345945 - RNA, 20 nt, Bordetella pertussis
cgaugcgcgcgugcagcgcc

SEQ ID NO: 2345946 - RNA, 23 nt, Bordetella pertussis
cgaugcgcgcgugcagcgccgcg

SEQ ID NO: 2345947 - RNA, 14 nt, Bordetella pertussis
cgaugcgcggcccg

SEQ ID NO: 2345948 - RNA, 15 nt, Bordetella pertussis
cgaugcgcggcccgg

SEQ ID NO: 2345949 - RNA, 16 nt, Bordetella pertussis
cgaugcgcggcccggc

SEQ ID NO: 2345950 - RNA, 17 nt, Bordetella pertussis
cgaugcgcggcccggcc

SEQ ID NO: 2345951 - RNA, 22 nt, Bordetella pertussis
cgaugcgcucgguccagacggg

SEQ ID NO: 2345952 - RNA, 19 nt, Bordetella pertussis
cgaugcgcugcuggaggcc

SEQ ID NO: 2345953 - RNA, 21 nt, Bordetella pertussis
cgaugcgcugcuggaggccgg

SEQ ID NO: 2345954 - RNA, 14 nt, Bordetella pertussis
cgaugcgcuugccg

SEQ ID NO: 2345955 - RNA, 20 nt, Bordetella pertussis
cgaugcgggccacgccggcc

SEQ ID NO: 2345956 - RNA, 18 nt, Bordetella pertussis
cgaugcggguacuggccg

SEQ ID NO: 2345957 - RNA, 20 nt, Bordetella pertussis
cgaugcggguacuggccgac

SEQ ID NO: 2345958 - RNA, 21 nt, Bordetella pertussis
cgaugcgguaccacgcgaaca

SEQ ID NO: 2345959 - RNA, 20 nt, Bordetella pertussis
cgaugcgguaggcccagcaa

SEQ ID NO: 2345960 - RNA, 15 nt, Bordetella pertussis
cgaugcggucggccg

SEQ ID NO: 2345961 - RNA, 21 nt, Bordetella pertussis
cgaugcggucggccgcgccgc

SEQ ID NO: 2345962 - RNA, 23 nt, Bordetella pertussis
cgaugcggucggccgcgccgccg

SEQ ID NO: 2345963 - RNA, 20 nt, Bordetella pertussis
cgaugcgguugagcacauug

SEQ ID NO: 2345964 - RNA, 15 nt, Bordetella pertussis
cgaugcgucaggggc

SEQ ID NO: 2345965 - RNA, 18 nt, Bordetella pertussis
cgaugcgucaggggcaug

SEQ ID NO: 2345966 - RNA, 18 nt, Bordetella pertussis
cgaugcguccgccgugca

SEQ ID NO: 2345967 - RNA, 19 nt, Bordetella pertussis
cgaugcguccgccgugcag

SEQ ID NO: 2345968 - RNA, 21 nt, Bordetella pertussis
cgaugcguccgccgugcaggc

SEQ ID NO: 2345969 - RNA, 15 nt, Bordetella pertussis
cgaugcguucgcccg

SEQ ID NO: 2345970 - RNA, 16 nt, Bordetella pertussis
cgaugcguucgcccgu

SEQ ID NO: 2345971 - RNA, 22 nt, Bordetella pertussis
cgaugcguucgcccgugccgca

SEQ ID NO: 2345972 - RNA, 15 nt, Bordetella pertussis
cgaugcucacgccca

SEQ ID NO: 2345973 - RNA, 19 nt, Bordetella pertussis
cgaugcucgccggcgccgc

SEQ ID NO: 2345974 - RNA, 13 nt, Bordetella pertussis
cgaugcuggcgcg

SEQ ID NO: 2345975 - RNA, 21 nt, Bordetella pertussis
cgaugcuggcgcggaccugcu

SEQ ID NO: 2345976 - RNA, 13 nt, Bordetella pertussis
cgaugcuggcggc

SEQ ID NO: 2345977 - RNA, 16 nt, Bordetella pertussis
cgaugcuuagcgcagc

SEQ ID NO: 2345978 - RNA, 18 nt, Bordetella pertussis
cgauggaaaugccgucca

SEQ ID NO: 2345979 - RNA, 19 nt, Bordetella pertussis
cgauggaacucguuggcca

SEQ ID NO: 2345980 - RNA, 21 nt, Bordetella pertussis
cgauggaacucguuggccagc

SEQ ID NO: 2345981 - RNA, 20 nt, Bordetella pertussis
cgauggaaucgucgaccagc

SEQ ID NO: 2345982 - RNA, 15 nt, Bordetella pertussis
cgauggagucgguca

SEQ ID NO: 2345983 - RNA, 21 nt, Bordetella pertussis
cgauggagucggucagccuga

SEQ ID NO: 2345984 - RNA, 16 nt, Bordetella pertussis
cgauggcacggcacgc

SEQ ID NO: 2345985 - RNA, 23 nt, Bordetella pertussis
cgauggcacggcacgccucgccg

SEQ ID NO: 2345986 - RNA, 14 nt, Bordetella pertussis
cgcaacgccgccgg

SEQ ID NO: 2345987 - RNA, 14 nt, Bordetella pertussis
cgcaacgccggccg

SEQ ID NO: 2345988 - RNA, 17 nt, Bordetella pertussis
cgcaacgccggccgcca

SEQ ID NO: 2345989 - RNA, 20 nt, Bordetella pertussis
cgcaacgccgggccgcgccg

SEQ ID NO: 2345990 - RNA, 23 nt, Bordetella pertussis
cgcaacgcgcgcgcgcacaggcg

SEQ ID NO: 2345991 - RNA, 14 nt, Bordetella pertussis
cgcaacgucgaaca

SEQ ID NO: 2345992 - RNA, 22 nt, Bordetella pertussis
cgcaagagcgugugucccggcg

SEQ ID NO: 2345993 - RNA, 18 nt, Bordetella pertussis
cgcaagauuucauggcgu

SEQ ID NO: 2345994 - RNA, 21 nt, Bordetella pertussis
cgcaagauuucauggcgucug

SEQ ID NO: 2345995 - RNA, 22 nt, Bordetella pertussis
cgcaagauuucauggcgucugc

SEQ ID NO: 2345996 - RNA, 22 nt, Bordetella pertussis
cgcaagcaagccccaggcaggc

SEQ ID NO: 2345997 - RNA, 19 nt, Bordetella pertussis
cgcaagcaccgccugcugc

SEQ ID NO: 2345998 - RNA, 15 nt, Bordetella pertussis
cgcaagcccaggcgg

SEQ ID NO: 2345999 - RNA, 18 nt, Bordetella pertussis
cgcaagcccaggcggccc

SEQ ID NO: 2346000 - RNA, 15 nt, Bordetella pertussis
cgcaagccgcccgcg

SEQ ID NO: 2346001 - RNA, 16 nt, Bordetella pertussis
cgcaagccgcccgcgg

SEQ ID NO: 2346002 - RNA, 18 nt, Bordetella pertussis
cgcaagccgcccgcggcg

SEQ ID NO: 2346003 - RNA, 15 nt, Bordetella pertussis
cgcaagccgccgccc

SEQ ID NO: 2346004 - RNA, 13 nt, Bordetella pertussis
cgcaagccggccg

SEQ ID NO: 2346005 - RNA, 15 nt, Bordetella pertussis
cgcaagccggccgcg

SEQ ID NO: 2346006 - RNA, 16 nt, Bordetella pertussis
cgcaagccggccgcgc

SEQ ID NO: 2346007 - RNA, 14 nt, Bordetella pertussis
cgcaagcuggccga

SEQ ID NO: 2346008 - RNA, 22 nt, Bordetella pertussis
cgcaagcuggccgaugucgccg

SEQ ID NO: 2346009 - RNA, 17 nt, Bordetella pertussis
cgcaagcuggcggcgcg

SEQ ID NO: 2346010 - RNA, 23 nt, Bordetella pertussis
cgcaagcuggcggcgcgcggcug

SEQ ID NO: 2346011 - RNA, 22 nt, Bordetella pertussis
cgcaaggacgcguccucggcca

SEQ ID NO: 2346012 - RNA, 14 nt, Bordetella pertussis
cgcaaggcaugcgc

SEQ ID NO: 2346013 - RNA, 19 nt, Bordetella pertussis
cgcaaggcaugcgccagcg

SEQ ID NO: 2346014 - RNA, 14 nt, Bordetella pertussis
cgcaaggcggcccg

SEQ ID NO: 2346015 - RNA, 16 nt, Bordetella pertussis
cgcaaggcggcccggc

SEQ ID NO: 2346016 - RNA, 17 nt, Bordetella pertussis
cgcaaggcggcccggcc

SEQ ID NO: 2346017 - RNA, 20 nt, Bordetella pertussis
cgcaaggcggcccggccgcc

SEQ ID NO: 2346018 - RNA, 20 nt, Bordetella pertussis
cgcaagggccccccggcgcg

SEQ ID NO: 2346019 - RNA, 18 nt, Bordetella pertussis
cgcaaggggccggcgccg

SEQ ID NO: 2346020 - RNA, 14 nt, Bordetella pertussis
cgcaagggggacug

SEQ ID NO: 2346021 - RNA, 22 nt, Bordetella pertussis
cgcaagggggacuggcaccggc

SEQ ID NO: 2346022 - RNA, 22 nt, Bordetella pertussis
cgcaaggguuguggccguggcg

SEQ ID NO: 2346023 - RNA, 23 nt, Bordetella pertussis
cgcaaggguuguggccguggcgg

SEQ ID NO: 2346024 - RNA, 19 nt, Bordetella pertussis
cgcaagugcuggcccgcca

SEQ ID NO: 2346025 - RNA, 22 nt, Bordetella pertussis
cgcaagugcuggcccgccagca

SEQ ID NO: 2346026 - RNA, 23 nt, Bordetella pertussis
cgcaagugcuggcccgccagcaa

SEQ ID NO: 2346027 - RNA, 23 nt, Bordetella pertussis
cgcaaguucaucaucgccgacgc

SEQ ID NO: 2346028 - RNA, 17 nt, Bordetella pertussis
cgcaaguucggcagcga

SEQ ID NO: 2346029 - RNA, 19 nt, Bordetella pertussis
cgcaauaccuucagcccgg

SEQ ID NO: 2346030 - RNA, 19 nt, Bordetella pertussis
cgcaauacgccgccggcgc

SEQ ID NO: 2346031 - RNA, 18 nt, Bordetella pertussis
cgcaauacgugcgcgacg

SEQ ID NO: 2346032 - RNA, 23 nt, Bordetella pertussis
cgcaauccccgcuuccugcugcg

SEQ ID NO: 2346033 - RNA, 19 nt, Bordetella pertussis
cgcaaucgacgaacaaggc

SEQ ID NO: 2346034 - RNA, 15 nt, Bordetella pertussis
cgcaauugcguggug

SEQ ID NO: 2346035 - RNA, 23 nt, Bordetella pertussis
cgcaauugcgugguggccuugcu

SEQ ID NO: 2346036 - RNA, 23 nt, Bordetella pertussis
cgcacaagggccccgcgaggggc

SEQ ID NO: 2346037 - RNA, 17 nt, Bordetella pertussis
cgcacaaucugcgucgc

SEQ ID NO: 2346038 - RNA, 13 nt, Bordetella pertussis
cgcacacaccgcg

SEQ ID NO: 2346039 - RNA, 15 nt, Bordetella pertussis
cgcacacauggcgca

SEQ ID NO: 2346040 - RNA, 18 nt, Bordetella pertussis
cgcacacgcgcugggcgu

SEQ ID NO: 2346041 - RNA, 15 nt, Bordetella pertussis
cgcacacuggccagc

SEQ ID NO: 2346042 - RNA, 14 nt, Bordetella pertussis
cgcacagcaccugg

SEQ ID NO: 2346043 - RNA, 14 nt, Bordetella pertussis
cgcacagcaugcgc

SEQ ID NO: 2346044 - RNA, 18 nt, Bordetella pertussis
cgcacagcauggccacca

SEQ ID NO: 2346045 - RNA, 20 nt, Bordetella pertussis
cgcacagcauggccaccagg

SEQ ID NO: 2346046 - RNA, 13 nt, Bordetella pertussis
cgcacagcgcgca

SEQ ID NO: 2346047 - RNA, 22 nt, Bordetella pertussis
cgcacagcgcgcaacuccagca

SEQ ID NO: 2346048 - RNA, 15 nt, Bordetella pertussis
cgcacagcgcggcga

SEQ ID NO: 2346049 - RNA, 19 nt, Bordetella pertussis
cgcacagcgcggcgaugcc

SEQ ID NO: 2346050 - RNA, 14 nt, Bordetella pertussis
cgcacagcguggcg

SEQ ID NO: 2346051 - RNA, 18 nt, Bordetella pertussis
cgcacaggcggcgccggc

SEQ ID NO: 2346052 - RNA, 22 nt, Bordetella pertussis
cgcacaguacuuguugcgugcc

SEQ ID NO: 2346053 - RNA, 22 nt, Bordetella pertussis
cgcacaguucgugcaccagccc

SEQ ID NO: 2346054 - RNA, 21 nt, Bordetella pertussis
cgcacaguugcaggccaugcu

SEQ ID NO: 2346055 - RNA, 22 nt, Bordetella pertussis
cgcacaguugcaggccaugcuc

SEQ ID NO: 2346056 - RNA, 19 nt, Bordetella pertussis
cgcacauacaaggcgcggc

SEQ ID NO: 2346057 - RNA, 19 nt, Bordetella pertussis
cgcacauccagccgaugcc

SEQ ID NO: 2346058 - RNA, 13 nt, Bordetella pertussis
cgcacaucgcccg

SEQ ID NO: 2346059 - RNA, 16 nt, Bordetella pertussis
cgcacaucgcccgugc

SEQ ID NO: 2346060 - RNA, 13 nt, Bordetella pertussis
cgcacaucgucga

SEQ ID NO: 2346061 - RNA, 17 nt, Bordetella pertussis
cgcacaugaugcccagc

SEQ ID NO: 2346062 - RNA, 18 nt, Bordetella pertussis
cgcacauuggaguagugg

SEQ ID NO: 2346063 - RNA, 20 nt, Bordetella pertussis
cgcaccaaucuugccaggcc

SEQ ID NO: 2346064 - RNA, 21 nt, Bordetella pertussis
cgcaccaaucuugccaggccc

SEQ ID NO: 2346065 - RNA, 18 nt, Bordetella pertussis
cgcaccaccagcaccgcc

SEQ ID NO: 2346066 - RNA, 13 nt, Bordetella pertussis
cgcaccaccgccg

SEQ ID NO: 2346067 - RNA, 13 nt, Bordetella pertussis
cgcaccaccuggc

SEQ ID NO: 2346068 - RNA, 14 nt, Bordetella pertussis
cgcaccaccuggcu

SEQ ID NO: 2346069 - RNA, 15 nt, Bordetella pertussis
cgcaccaccuggcug

SEQ ID NO: 2346070 - RNA, 15 nt, Bordetella pertussis
cgcaccagcccgccc

SEQ ID NO: 2346071 - RNA, 12 nt, Bordetella pertussis
cgcaccagccug

SEQ ID NO: 2346072 - RNA, 22 nt, Bordetella pertussis
cgcaccagccugaugcgcagac

SEQ ID NO: 2346073 - RNA, 24 nt, Bordetella pertussis
cgcagcugccugagcaccgccgcg

SEQ ID NO: 2346074 - RNA, 22 nt, Bordetella pertussis
cgcagcuggacuauggccugga

SEQ ID NO: 2346075 - RNA, 23 nt, Bordetella pertussis
cgcagcuguucagacugcugccg

SEQ ID NO: 2346076 - RNA, 18 nt, Bordetella pertussis
cgcagcuucuaucugccg

SEQ ID NO: 2346077 - RNA, 20 nt, Bordetella pertussis
cgcagcuucuaucugccgcg

SEQ ID NO: 2346078 - RNA, 21 nt, Bordetella pertussis
cgcagcuucuaucugccgcgc

SEQ ID NO: 2346079 - RNA, 23 nt, Bordetella pertussis
cgcagcuucuaucugccgcgcau

SEQ ID NO: 2346080 - RNA, 19 nt, Bordetella pertussis
cgcagcuucuucuuugccc

SEQ ID NO: 2346081 - RNA, 24 nt, Bordetella pertussis
cgcagcuucuucuuugcccuggcc

SEQ ID NO: 2346082 - RNA, 17 nt, Bordetella pertussis
cgcagcuugcccgcgcg

SEQ ID NO: 2346083 - RNA, 20 nt, Bordetella pertussis
cgcagcuugcccgcgcgcac

SEQ ID NO: 2346084 - RNA, 21 nt, Bordetella pertussis
cgcagcuugcccgcgcgcacg

SEQ ID NO: 2346085 - RNA, 14 nt, Bordetella pertussis
cgccacgcgggccg

SEQ ID NO: 2346086 - RNA, 19 nt, Bordetella pertussis
cgccacgcgggccggccgu

SEQ ID NO: 2346087 - RNA, 18 nt, Bordetella pertussis
cgccacgcgguccagccc

SEQ ID NO: 2346088 - RNA, 19 nt, Bordetella pertussis
cgccacgcgguccagcccc

SEQ ID NO: 2346089 - RNA, 14 nt, Bordetella pertussis
cgccacgcuggccg

SEQ ID NO: 2346090 - RNA, 24 nt, Bordetella pertussis
cgccacgcuggccgcgcuggcggc

SEQ ID NO: 2346091 - RNA, 23 nt, Bordetella pertussis
cgccacgcuguuuucggccgacu

SEQ ID NO: 2346092 - RNA, 21 nt, Bordetella pertussis
cgccacggcaggcgccugccc

SEQ ID NO: 2346093 - RNA, 13 nt, Bordetella pertussis
cgccacggcgccc

SEQ ID NO: 2346094 - RNA, 15 nt, Bordetella pertussis
cgccacggcgcccga

SEQ ID NO: 2346095 - RNA, 18 nt, Bordetella pertussis
cgccacggcgcccgaggc

SEQ ID NO: 2346096 - RNA, 13 nt, Bordetella pertussis
cgccacggcggug

SEQ ID NO: 2346097 - RNA, 23 nt, Bordetella pertussis
cgccacggcggugaucugcucgc

SEQ ID NO: 2346098 - RNA, 19 nt, Bordetella pertussis
cgccacggcgucgccggcc

SEQ ID NO: 2346099 - RNA, 20 nt, Bordetella pertussis
cgccacggcgucgccggcca

SEQ ID NO: 2346100 - RNA, 22 nt, Bordetella pertussis
cgccacggcgucgccggccagg

SEQ ID NO: 2346101 - RNA, 20 nt, Bordetella pertussis
cgccacggcuucgcccagcg

SEQ ID NO: 2346102 - RNA, 16 nt, Bordetella pertussis
cgccacgggcccgcgc

SEQ ID NO: 2346103 - RNA, 18 nt, Bordetella pertussis
cgccacgggcccgcgcag

SEQ ID NO: 2346104 - RNA, 19 nt, Bordetella pertussis
cgccacgggcgucaccggc

SEQ ID NO: 2346105 - RNA, 17 nt, Bordetella pertussis
cgccacggucgcgagcu

SEQ ID NO: 2346106 - RNA, 18 nt, Bordetella pertussis
cgccacggucgcgagcug

SEQ ID NO: 2346107 - RNA, 17 nt, Bordetella pertussis
cgccacggucugcacgc

SEQ ID NO: 2346108 - RNA, 19 nt, Bordetella pertussis
cgccacggucugcacgccg

SEQ ID NO: 2346109 - RNA, 23 nt, Bordetella pertussis
cgccacgucacggaucagccgcu

SEQ ID NO: 2346110 - RNA, 23 nt, Bordetella pertussis
cgccacguccagcacggccgcgg

SEQ ID NO: 2346111 - RNA, 24 nt, Bordetella pertussis
cgccacguccagcacggccgcggc

SEQ ID NO: 2346112 - RNA, 16 nt, Bordetella pertussis
cgccacgucgaccucg

SEQ ID NO: 2346113 - RNA, 22 nt, Bordetella pertussis
cgccacgucgaccucgagcacc

SEQ ID NO: 2346114 - RNA, 23 nt, Bordetella pertussis
cgccacgucgaccucgagcaccu

SEQ ID NO: 2346115 - RNA, 15 nt, Bordetella pertussis
cgccacgucgccggc

SEQ ID NO: 2346116 - RNA, 17 nt, Bordetella pertussis
cgccacgucgccggcgu

SEQ ID NO: 2346117 - RNA, 17 nt, Bordetella pertussis
cgccacgugcugcugga

SEQ ID NO: 2346118 - RNA, 16 nt, Bordetella pertussis
cgccacguugaagcgc

SEQ ID NO: 2346119 - RNA, 20 nt, Bordetella pertussis
cgccacguugaagcgcagcc

SEQ ID NO: 2346120 - RNA, 21 nt, Bordetella pertussis
cgccacguugaagcgcagcca

SEQ ID NO: 2346121 - RNA, 23 nt, Bordetella pertussis
cgccacguugaagcgcagccacg

SEQ ID NO: 2346122 - RNA, 13 nt, Bordetella pertussis
cgccacugccagg

SEQ ID NO: 2346123 - RNA, 14 nt, Bordetella pertussis
cgccacugccaggc

SEQ ID NO: 2346124 - RNA, 17 nt, Bordetella pertussis
cgccacugccaggcgcc

SEQ ID NO: 2346125 - RNA, 13 nt, Bordetella pertussis
cgccacuggccuu

SEQ ID NO: 2346126 - RNA, 18 nt, Bordetella pertussis
cgccacuucgccucggcg

SEQ ID NO: 2346127 - RNA, 21 nt, Bordetella pertussis
cgccacuucgccucggcgguu

SEQ ID NO: 2346128 - RNA, 15 nt, Bordetella pertussis
cgccacuugcaggcc

SEQ ID NO: 2346129 - RNA, 19 nt, Bordetella pertussis
cgccacuugcaggccgcga

SEQ ID NO: 2346130 - RNA, 16 nt, Bordetella pertussis
cgccagaaagcgcggc

SEQ ID NO: 2346131 - RNA, 19 nt, Bordetella pertussis
cgccagaaagcgcggccgg

SEQ ID NO: 2346132 - RNA, 22 nt, Bordetella pertussis
cgccagaaagcgcggccgggcu

SEQ ID NO: 2346133 - RNA, 19 nt, Bordetella pertussis
cgccagaacgacagcgaca

SEQ ID NO: 2346134 - RNA, 14 nt, Bordetella pertussis
cgccagaugcgccg

SEQ ID NO: 2346135 - RNA, 18 nt, Bordetella pertussis
cgccagaugcgccgcacg

SEQ ID NO: 2346136 - RNA, 18 nt, Bordetella pertussis
cgccagcaaggcggcaaa

SEQ ID NO: 2346137 - RNA, 13 nt, Bordetella pertussis
cgccagcaccggc

SEQ ID NO: 2346138 - RNA, 15 nt, Bordetella pertussis
cgccagcaccggcac

SEQ ID NO: 2346139 - RNA, 16 nt, Bordetella pertussis
cgccagcaccggcacg

SEQ ID NO: 2346140 - RNA, 20 nt, Bordetella pertussis
cgccagcaccggcacgcgcc

SEQ ID NO: 2346141 - RNA, 16 nt, Bordetella pertussis
cgccagcaccugcuug

SEQ ID NO: 2346142 - RNA, 12 nt, Bordetella pertussis
cgccagcacgaa

SEQ ID NO: 2346143 - RNA, 22 nt, Bordetella pertussis
cgccagcacgcgcagcuugccc

SEQ ID NO: 2346144 - RNA, 16 nt, Bordetella pertussis
cgccagcacgguggcg

SEQ ID NO: 2346145 - RNA, 19 nt, Bordetella pertussis
cgccagcacgguggcgccc

SEQ ID NO: 2346146 - RNA, 20 nt, Bordetella pertussis
cgccagcagaugauccggac

SEQ ID NO: 2346147 - RNA, 21 nt, Bordetella pertussis
cgccagcagcacgucguagcg

SEQ ID NO: 2346148 - RNA, 14 nt, Bordetella pertussis
cgccagcagcaggc

SEQ ID NO: 2346149 - RNA, 12 nt, Bordetella pertussis
cgccagcagcgc

SEQ ID NO: 2346150 - RNA, 14 nt, Bordetella pertussis
cgccagcagcgccg

SEQ ID NO: 2346151 - RNA, 15 nt, Bordetella pertussis
cgccagcagcgccgg

SEQ ID NO: 2346152 - RNA, 12 nt, Bordetella pertussis
cgccagcaggcc

SEQ ID NO: 2346153 - RNA, 14 nt, Bordetella pertussis
cgccagcaggcccu

SEQ ID NO: 2346154 - RNA, 23 nt, Bordetella pertussis
cgccagcaggcccugggcgaggu

SEQ ID NO: 2346155 - RNA, 19 nt, Bordetella pertussis
cgccagcagggucagcggc

SEQ ID NO: 2346156 - RNA, 22 nt, Bordetella pertussis
cgccagcaugaucaugccgcug

SEQ ID NO: 2346157 - RNA, 11 nt, Bordetella pertussis
cgccagcaugc

SEQ ID NO: 2346158 - RNA, 15 nt, Bordetella pertussis
cgccagcaugcgcgc

SEQ ID NO: 2346159 - RNA, 17 nt, Bordetella pertussis
cgccagcaugcgcgcgg

SEQ ID NO: 2346160 - RNA, 23 nt, Bordetella pertussis
cgccagcaugcgcgcggccucga

SEQ ID NO: 2346161 - RNA, 15 nt, Bordetella pertussis
cgccagcauggcggc

SEQ ID NO: 2346162 - RNA, 18 nt, Bordetella pertussis
cgccagcauggcggccag

SEQ ID NO: 2346163 - RNA, 20 nt, Bordetella pertussis
cgccagcauggcggccaggc

SEQ ID NO: 2346164 - RNA, 21 nt, Bordetella pertussis
cgccagcauggcggccaggcg

SEQ ID NO: 2346165 - RNA, 23 nt, Bordetella pertussis
cgccagcauggcggccaggcgcg

SEQ ID NO: 2346166 - RNA, 16 nt, Bordetella pertussis
cgccagcauggcgucg

SEQ ID NO: 2346167 - RNA, 20 nt, Bordetella pertussis
cgccagccaccccgucaucg

SEQ ID NO: 2346168 - RNA, 23 nt, Bordetella pertussis
cgccagccaccccgucaucgccg

SEQ ID NO: 2346169 - RNA, 15 nt, Bordetella pertussis
cgccagccacgcgcg

SEQ ID NO: 2346170 - RNA, 14 nt, Bordetella pertussis
cgccagccagcgca

SEQ ID NO: 2346171 - RNA, 15 nt, Bordetella pertussis
cgccagcccgacggc

SEQ ID NO: 2346172 - RNA, 16 nt, Bordetella pertussis
cgccagcccgacggcc

SEQ ID NO: 2346173 - RNA, 20 nt, Bordetella pertussis
cgccagcccgacggccagcg

SEQ ID NO: 2346174 - RNA, 21 nt, Bordetella pertussis
cgccagcccgacggccagcgc

SEQ ID NO: 2346175 - RNA, 23 nt, Bordetella pertussis
cgccagcccgacggccagcgcga

SEQ ID NO: 2346176 - RNA, 23 nt, Bordetella pertussis
cgccagcccgaggcacaaggccg

SEQ ID NO: 2346177 - RNA, 14 nt, Bordetella pertussis
cgccagcccgcccg

SEQ ID NO: 2346178 - RNA, 15 nt, Bordetella pertussis
cgccagcccgccgcu

SEQ ID NO: 2346179 - RNA, 14 nt, Bordetella pertussis
cgccagcccgccgg

SEQ ID NO: 2346180 - RNA, 15 nt, Bordetella pertussis
cgccagcccgccggc

SEQ ID NO: 2346181 - RNA, 17 nt, Bordetella pertussis
cgccagcccgccggcgc

SEQ ID NO: 2346182 - RNA, 19 nt, Bordetella pertussis
cgccagcccuugcuugccg

SEQ ID NO: 2346183 - RNA, 13 nt, Bordetella pertussis
cgccagccgcgcc

SEQ ID NO: 2346184 - RNA, 14 nt, Bordetella pertussis
cgccagccgcgcga

SEQ ID NO: 2346185 - RNA, 17 nt, Bordetella pertussis
cgccagccgcgcgaaca

SEQ ID NO: 2346186 - RNA, 13 nt, Bordetella pertussis
cgccagccgcucc

SEQ ID NO: 2346187 - RNA, 15 nt, Bordetella pertussis
cgccagccgcugcag

SEQ ID NO: 2346188 - RNA, 13 nt, Bordetella pertussis
cgccagccgcugg

SEQ ID NO: 2346189 - RNA, 17 nt, Bordetella pertussis
cgccagccgcuggcgcg

SEQ ID NO: 2346190 - RNA, 20 nt, Bordetella pertussis
cgccagccgcuggcgcgccg

SEQ ID NO: 2346191 - RNA, 23 nt, Bordetella pertussis
cgccagccgcuggcgcgccgccu

SEQ ID NO: 2346192 - RNA, 12 nt, Bordetella pertussis
cgccagccgcuu

SEQ ID NO: 2346193 - RNA, 13 nt, Bordetella pertussis
cgccagccgcuug

SEQ ID NO: 2346194 - RNA, 13 nt, Bordetella pertussis
cgccagccggccc

SEQ ID NO: 2346195 - RNA, 16 nt, Bordetella pertussis
cgccagccggcccagc

SEQ ID NO: 2346196 - RNA, 18 nt, Bordetella pertussis
cgccagccggcccagcac

SEQ ID NO: 2346197 - RNA, 14 nt, Bordetella pertussis
cgccagccggcccg

SEQ ID NO: 2346198 - RNA, 15 nt, Bordetella pertussis
cgccagccggcccga

SEQ ID NO: 2346199 - RNA, 19 nt, Bordetella pertussis
cgccagccguugcgccagc

SEQ ID NO: 2346200 - RNA, 22 nt, Bordetella pertussis
cgcauguccgccacgccggcca

SEQ ID NO: 2346201 - RNA, 16 nt, Bordetella pertussis
cgcauuagaucagaaa

SEQ ID NO: 2346202 - RNA, 15 nt, Bordetella pertussis
cgcauucgccggaca

SEQ ID NO: 2346203 - RNA, 22 nt, Bordetella pertussis
cgcauugaucgaucagccagcc

SEQ ID NO: 2346204 - RNA, 16 nt, Bordetella pertussis
cgcauugccgccgccc

SEQ ID NO: 2346205 - RNA, 13 nt, Bordetella pertussis
cgcauugccgucg

SEQ ID NO: 2346206 - RNA, 16 nt, Bordetella pertussis
cgcauugccgucggcc

SEQ ID NO: 2346207 - RNA, 14 nt, Bordetella pertussis
cgcauuggccgccg

SEQ ID NO: 2346208 - RNA, 17 nt, Bordetella pertussis
cgcauuggccgccgcca

SEQ ID NO: 2346209 - RNA, 13 nt, Bordetella pertussis
cgcauuucucggc

SEQ ID NO: 2346210 - RNA, 17 nt, Bordetella pertussis
cgcauuucucggccugg

SEQ ID NO: 2346211 - RNA, 20 nt, Bordetella pertussis
cgcauuucucggccugggcg

SEQ ID NO: 2346212 - RNA, 22 nt, Bordetella pertussis
cgccaaagaucaaaaaggcccu

SEQ ID NO: 2346213 - RNA, 16 nt, Bordetella pertussis
cgccaaagcgcagcgu

SEQ ID NO: 2346214 - RNA, 17 nt, Bordetella pertussis
cgccaacacgauccacg

SEQ ID NO: 2346215 - RNA, 22 nt, Bordetella pertussis
cgccaacacgauccacggccgg

SEQ ID NO: 2346216 - RNA, 23 nt, Bordetella pertussis
cgccaacacgauccacggccggc

SEQ ID NO: 2346217 - RNA, 19 nt, Bordetella pertussis
cgccaacccgccauccugg

SEQ ID NO: 2346218 - RNA, 21 nt, Bordetella pertussis
cgccaacccggccucagcggc

SEQ ID NO: 2346219 - RNA, 12 nt, Bordetella pertussis
cgccaacgccaa

SEQ ID NO: 2346220 - RNA, 13 nt, Bordetella pertussis
cgccaacgcggcg

SEQ ID NO: 2346221 - RNA, 14 nt, Bordetella pertussis
cgccaacgcggcgc

SEQ ID NO: 2346222 - RNA, 15 nt, Bordetella pertussis
cgccaacgcggcgcg

SEQ ID NO: 2346223 - RNA, 13 nt, Bordetella pertussis
cgccaacggugcc

SEQ ID NO: 2346224 - RNA, 19 nt, Bordetella pertussis
cgccaacgucggcagccag

SEQ ID NO: 2346225 - RNA, 17 nt, Bordetella pertussis
cgccaacucgcuccagc

SEQ ID NO: 2346226 - RNA, 15 nt, Bordetella pertussis
cgccaagaccgcggc

SEQ ID NO: 2346227 - RNA, 16 nt, Bordetella pertussis
cgccaagaccgcggcc

SEQ ID NO: 2346228 - RNA, 17 nt, Bordetella pertussis
cgccaagaccgcggccg

SEQ ID NO: 2346229 - RNA, 13 nt, Bordetella pertussis
cgccaagcagacc

SEQ ID NO: 2346230 - RNA, 15 nt, Bordetella pertussis
cgccaagcugcuggc

SEQ ID NO: 2346231 - RNA, 13 nt, Bordetella pertussis
cgccaaucggcgu

SEQ ID NO: 2346232 - RNA, 17 nt, Bordetella pertussis
cgccaaucugccgcuga

SEQ ID NO: 2346233 - RNA, 20 nt, Bordetella pertussis
cgccaauugcuugccugucc

SEQ ID NO: 2346234 - RNA, 15 nt, Bordetella pertussis
cgccacaaagccucc

SEQ ID NO: 2346235 - RNA, 16 nt, Bordetella pertussis
cgccacaccgcugcgg

SEQ ID NO: 2346236 - RNA, 13 nt, Bordetella pertussis
cgccacacgggcg

SEQ ID NO: 2346237 - RNA, 15 nt, Bordetella pertussis
cgccacagcaugacc

SEQ ID NO: 2346238 - RNA, 18 nt, Bordetella pertussis
cgccacagcaugaccucg

SEQ ID NO: 2346239 - RNA, 20 nt, Bordetella pertussis
cgccacagcaugaccucggc

SEQ ID NO: 2346240 - RNA, 22 nt, Bordetella pertussis
cgccacagcaugaccucggccu

SEQ ID NO: 2346241 - RNA, 23 nt, Bordetella pertussis
cgccacagcaugaccucggccug

SEQ ID NO: 2346242 - RNA, 13 nt, Bordetella pertussis
cgccacagcgcca

SEQ ID NO: 2346243 - RNA, 14 nt, Bordetella pertussis
cgccacagcgccgc

SEQ ID NO: 2346244 - RNA, 15 nt, Bordetella pertussis
cgccacagcgccgcg

SEQ ID NO: 2346245 - RNA, 22 nt, Bordetella pertussis
cgccacaggcugacgcccggcu

SEQ ID NO: 2346246 - RNA, 13 nt, Bordetella pertussis
cgccacagggccu

SEQ ID NO: 2346247 - RNA, 14 nt, Bordetella pertussis
cgccacagggccug

SEQ ID NO: 2346248 - RNA, 16 nt, Bordetella pertussis
cgccacagggccugac

SEQ ID NO: 2346249 - RNA, 18 nt, Bordetella pertussis
cgccacaggugcgcggcg

SEQ ID NO: 2346250 - RNA, 23 nt, Bordetella pertussis
cgccacaggugcgcggcgcgccg

SEQ ID NO: 2346251 - RNA, 19 nt, Bordetella pertussis
cgccacauccugcacggcg

SEQ ID NO: 2346252 - RNA, 17 nt, Bordetella pertussis
cgccaccaccggcacgc

SEQ ID NO: 2346253 - RNA, 20 nt, Bordetella pertussis
cgccaccaccucggccucgc

SEQ ID NO: 2346254 - RNA, 22 nt, Bordetella pertussis
cgccaccaccucggugccgugg

SEQ ID NO: 2346255 - RNA, 14 nt, Bordetella pertussis
cgccaccacggcgc

SEQ ID NO: 2346256 - RNA, 14 nt, Bordetella pertussis
cgccaccagcagcg

SEQ ID NO: 2346257 - RNA, 14 nt, Bordetella pertussis
cgccaccagcggcg

SEQ ID NO: 2346258 - RNA, 20 nt, Bordetella pertussis
cgccaccaggaacgccagca

SEQ ID NO: 2346259 - RNA, 17 nt, Bordetella pertussis
cgccaccagggcgcccg

SEQ ID NO: 2346260 - RNA, 18 nt, Bordetella pertussis
cgccaccagggcgcccgc

SEQ ID NO: 2346261 - RNA, 18 nt, Bordetella pertussis
cgccacccaggcggcagg

SEQ ID NO: 2346262 - RNA, 23 nt, Bordetella pertussis
cgccacccaggcggcaggcgccg

SEQ ID NO: 2346263 - RNA, 14 nt, Bordetella pertussis
cgccacccagggcu

SEQ ID NO: 2346264 - RNA, 13 nt, Bordetella pertussis
cgccaccccgccg

SEQ ID NO: 2346265 - RNA, 14 nt, Bordetella pertussis
cgccaccccgccgc

SEQ ID NO: 2346266 - RNA, 15 nt, Bordetella pertussis
cgccaccccgccgcu

SEQ ID NO: 2346267 - RNA, 12 nt, Bordetella pertussis
cgccaccgccca

SEQ ID NO: 2346268 - RNA, 23 nt, Bordetella pertussis
cgccaccgcccagaaugcggcgg

SEQ ID NO: 2346269 - RNA, 14 nt, Bordetella pertussis
cgccaccgcccccg

SEQ ID NO: 2346270 - RNA, 15 nt, Bordetella pertussis
cgccaccgcccccgc

SEQ ID NO: 2346271 - RNA, 17 nt, Bordetella pertussis
cgccaccgcccccgccg

SEQ ID NO: 2346272 - RNA, 13 nt, Bordetella pertussis
cgccaccgcgccg

SEQ ID NO: 2346273 - RNA, 16 nt, Bordetella pertussis
cgccaccgcgccgccc

SEQ ID NO: 2346274 - RNA, 21 nt, Bordetella pertussis
cgccaccggucgccguccagg

SEQ ID NO: 2346275 - RNA, 17 nt, Bordetella pertussis
cgccaccgugauggcgc

SEQ ID NO: 2346276 - RNA, 13 nt, Bordetella pertussis
cgccaccguggcc

SEQ ID NO: 2346277 - RNA, 18 nt, Bordetella pertussis
cgccaccguggccacggc

SEQ ID NO: 2346278 - RNA, 20 nt, Bordetella pertussis
cgccaccguggccacggccg

SEQ ID NO: 2346279 - RNA, 22 nt, Bordetella pertussis
cgccaccguggccacggccgcg

SEQ ID NO: 2346280 - RNA, 14 nt, Bordetella pertussis
cgccaccucggcgu

SEQ ID NO: 2346281 - RNA, 15 nt, Bordetella pertussis
cgccaccuggcgccc

SEQ ID NO: 2346282 - RNA, 16 nt, Bordetella pertussis
cgccaccuggcgcccg

SEQ ID NO: 2346283 - RNA, 18 nt, Bordetella pertussis
cgccaccuggcgcccggc

SEQ ID NO: 2346284 - RNA, 20 nt, Bordetella pertussis
cgccaccuggcgcccggcgg

SEQ ID NO: 2346285 - RNA, 16 nt, Bordetella pertussis
cgccaccugggccgcc

SEQ ID NO: 2346286 - RNA, 19 nt, Bordetella pertussis
cgccaccuucgccgcgcac

SEQ ID NO: 2346287 - RNA, 20 nt, Bordetella pertussis
cgccaccuucgccgcgcaca

SEQ ID NO: 2346288 - RNA, 20 nt, Bordetella pertussis
cgccacgacguagucggcgc

SEQ ID NO: 2346289 - RNA, 21 nt, Bordetella pertussis
cgccacgacguagucggcgcc

SEQ ID NO: 2346290 - RNA, 22 nt, Bordetella pertussis
cgccacgacguagucggcgccc

SEQ ID NO: 2346291 - RNA, 20 nt, Bordetella pertussis
cgccacgauguagccgaccc

SEQ ID NO: 2346292 - RNA, 16 nt, Bordetella pertussis
cgccacgccagcggcg

SEQ ID NO: 2346293 - RNA, 23 nt, Bordetella pertussis
cgccacgccagcggcgagcaauc

SEQ ID NO: 2346294 - RNA, 13 nt, Bordetella pertussis
cgccacgccauug

SEQ ID NO: 2346295 - RNA, 12 nt, Bordetella pertussis
cgccacgcccac

SEQ ID NO: 2346296 - RNA, 13 nt, Bordetella pertussis
cgccacgcccacu

SEQ ID NO: 2346297 - RNA, 14 nt, Bordetella pertussis
cgccacgcccaggc

SEQ ID NO: 2346298 - RNA, 18 nt, Bordetella pertussis
cgccacgcccaggccgcu

SEQ ID NO: 2346299 - RNA, 19 nt, Bordetella pertussis
cgccacgcccaggccgcuu

SEQ ID NO: 2346300 - RNA, 13 nt, Bordetella pertussis
cgccacgcccguc

SEQ ID NO: 2346301 - RNA, 15 nt, Bordetella pertussis
cgccacgcccguccc

SEQ ID NO: 2346302 - RNA, 18 nt, Bordetella pertussis
cgccacgcccgucucgcg

SEQ ID NO: 2346303 - RNA, 20 nt, Bordetella pertussis
cgccacgcccuggcagcugg

SEQ ID NO: 2346304 - RNA, 16 nt, Bordetella pertussis
cgccacgccggccacg

SEQ ID NO: 2346305 - RNA, 17 nt, Bordetella pertussis
cgccacgccggccacga

SEQ ID NO: 2346306 - RNA, 17 nt, Bordetella pertussis
cgccacgccggccagcu

SEQ ID NO: 2346307 - RNA, 23 nt, Bordetella pertussis
cgccacgccggccagcuugagca

SEQ ID NO: 2346308 - RNA, 19 nt, Bordetella pertussis
cgccacgccgucagcgaca

SEQ ID NO: 2346309 - RNA, 20 nt, Bordetella pertussis
cgccacgccuuguucgcgcg

SEQ ID NO: 2346310 - RNA, 21 nt, Bordetella pertussis
cgccagcgaaauacgcgacag

SEQ ID NO: 2346311 - RNA, 17 nt, Bordetella pertussis
cgccagcgccacgcccu

SEQ ID NO: 2346312 - RNA, 18 nt, Bordetella pertussis
cgccagcgccacgcgagc

SEQ ID NO: 2346313 - RNA, 22 nt, Bordetella pertussis
cgccagcgccaugaugucgcgc

SEQ ID NO: 2346314 - RNA, 13 nt, Bordetella pertussis
cgccagcgccccg

SEQ ID NO: 2346315 - RNA, 16 nt, Bordetella pertussis
cgccagcgccccggcg

SEQ ID NO: 2346316 - RNA, 15 nt, Bordetella pertussis
cgccagcgccgcgcg

SEQ ID NO: 2346317 - RNA, 17 nt, Bordetella pertussis
cgccagcgccgcgcgcg

SEQ ID NO: 2346318 - RNA, 15 nt, Bordetella pertussis
cgccagcgccgcguc

SEQ ID NO: 2346319 - RNA, 13 nt, Bordetella pertussis
cgccagcgccggg

SEQ ID NO: 2346320 - RNA, 20 nt, Bordetella pertussis
cgccagcgccggggucagcg

SEQ ID NO: 2346321 - RNA, 14 nt, Bordetella pertussis
cgccagcgccucca

SEQ ID NO: 2346322 - RNA, 23 nt, Bordetella pertussis
cgccagcgccuccaucagcagca

SEQ ID NO: 2346323 - RNA, 23 nt, Bordetella pertussis
cgccagcgccucgcgcucgagcg

SEQ ID NO: 2346324 - RNA, 14 nt, Bordetella pertussis
cgccagcgccugga

SEQ ID NO: 2346325 - RNA, 20 nt, Bordetella pertussis
cgccagcgccugggucaggu

SEQ ID NO: 2346326 - RNA, 22 nt, Bordetella pertussis
cgccagcgccugggucaggucg

SEQ ID NO: 2346327 - RNA, 23 nt, Bordetella pertussis
cgccagcgccugggucaggucgg

SEQ ID NO: 2346328 - RNA, 13 nt, Bordetella pertussis
cgccagcgcgcca

SEQ ID NO: 2346329 - RNA, 20 nt, Bordetella pertussis
cgccagcgcgccauggccgg

SEQ ID NO: 2346330 - RNA, 12 nt, Bordetella pertussis
cgccagcgcgcg

SEQ ID NO: 2346331 - RNA, 15 nt, Bordetella pertussis
cgccagcgcgcgcga

SEQ ID NO: 2346332 - RNA, 12 nt, Bordetella pertussis
cgccagcgcggc

SEQ ID NO: 2346333 - RNA, 14 nt, Bordetella pertussis
cgccagcgcggcca

SEQ ID NO: 2346334 - RNA, 19 nt, Bordetella pertussis
cgccagcgcggccagcgcg

SEQ ID NO: 2346335 - RNA, 13 nt, Bordetella pertussis
cgccagcgcggcg

SEQ ID NO: 2346336 - RNA, 14 nt, Bordetella pertussis
cgccagcgcggcgg

SEQ ID NO: 2346337 - RNA, 19 nt, Bordetella pertussis
cgccagcgcggcgggccgg

SEQ ID NO: 2346338 - RNA, 16 nt, Bordetella pertussis
cgccagcgcggcuugg

SEQ ID NO: 2346339 - RNA, 19 nt, Bordetella pertussis
cgccagcgcgucguccagc

SEQ ID NO: 2346340 - RNA, 17 nt, Bordetella pertussis
cgccagcgcuguccagg

SEQ ID NO: 2346341 - RNA, 18 nt, Bordetella pertussis
cgccagcgcuguccaggc

SEQ ID NO: 2346342 - RNA, 21 nt, Bordetella pertussis
cgccagcgcuguccaggccgg

SEQ ID NO: 2346343 - RNA, 19 nt, Bordetella pertussis
cgccagcgcuucgggcagc

SEQ ID NO: 2346344 - RNA, 23 nt, Bordetella pertussis
cgccagcgcuucgggcagcucgc

SEQ ID NO: 2346345 - RNA, 13 nt, Bordetella pertussis
cgccagcggcagc

SEQ ID NO: 2346346 - RNA, 15 nt, Bordetella pertussis
cgccagcggcagcgc

SEQ ID NO: 2346347 - RNA, 18 nt, Bordetella pertussis
cgccagcggcagcgcgca

SEQ ID NO: 2346348 - RNA, 19 nt, Bordetella pertussis
cgccagcggcagcgcgcag

SEQ ID NO: 2346349 - RNA, 20 nt, Bordetella pertussis
cgccagcggcauugcccagg

SEQ ID NO: 2346350 - RNA, 21 nt, Bordetella pertussis
cgccagcggcauugcccaggu

SEQ ID NO: 2346351 - RNA, 15 nt, Bordetella pertussis
cgccagcggcgagca

SEQ ID NO: 2346352 - RNA, 22 nt, Bordetella pertussis
cgccagcggcgagcaauccguc

SEQ ID NO: 2346353 - RNA, 11 nt, Bordetella pertussis
cgccagcggcu

SEQ ID NO: 2346354 - RNA, 14 nt, Bordetella pertussis
cgccagcggcuggc

SEQ ID NO: 2346355 - RNA, 18 nt, Bordetella pertussis
cgccagcggcuggcgccg

SEQ ID NO: 2346356 - RNA, 19 nt, Bordetella pertussis
cgccagcgggagccugucc

SEQ ID NO: 2346357 - RNA, 19 nt, Bordetella pertussis
cgccagcguaucgccgccg

SEQ ID NO: 2346358 - RNA, 13 nt, Bordetella pertussis
cgccagcguggcc

SEQ ID NO: 2346359 - RNA, 19 nt, Bordetella pertussis
cgccagcguucggccaccc

SEQ ID NO: 2346360 - RNA, 15 nt, Bordetella pertussis
cgccagcucgcgcag

SEQ ID NO: 2346361 - RNA, 16 nt, Bordetella pertussis
cgccagcucgcgcagc

SEQ ID NO: 2346362 - RNA, 21 nt, Bordetella pertussis
cgccagcucgcguugcaccgc

SEQ ID NO: 2346363 - RNA, 15 nt, Bordetella pertussis
cgccagcucggccug

SEQ ID NO: 2346364 - RNA, 17 nt, Bordetella pertussis
cgccagcucggccugcg

SEQ ID NO: 2346365 - RNA, 16 nt, Bordetella pertussis
cgccagcugaccucgc

SEQ ID NO: 2346366 - RNA, 22 nt, Bordetella pertussis
cgccagcugaccucgcccaggc

SEQ ID NO: 2346367 - RNA, 16 nt, Bordetella pertussis
cgccagcugcgcagcg

SEQ ID NO: 2346368 - RNA, 17 nt, Bordetella pertussis
cgccagcugcgcagcga

SEQ ID NO: 2346369 - RNA, 16 nt, Bordetella pertussis
cgccagcuggaccgcc

SEQ ID NO: 2346370 - RNA, 19 nt, Bordetella pertussis
cgccagcuggaccgccugg

SEQ ID NO: 2346371 - RNA, 20 nt, Bordetella pertussis
cgccagcuggaccgccuggc

SEQ ID NO: 2346372 - RNA, 12 nt, Bordetella pertussis
cgccagcugggc

SEQ ID NO: 2346373 - RNA, 13 nt, Bordetella pertussis
cgccagcugggcg

SEQ ID NO: 2346374 - RNA, 17 nt, Bordetella pertussis
cgccagcuugcgcgccu

SEQ ID NO: 2346375 - RNA, 20 nt, Bordetella pertussis
cgccagcuugcgcgccuugg

SEQ ID NO: 2346376 - RNA, 16 nt, Bordetella pertussis
cgccagcuuggccagg

SEQ ID NO: 2346377 - RNA, 17 nt, Bordetella pertussis
cgccagcuuggccaggc

SEQ ID NO: 2346378 - RNA, 13 nt, Bordetella pertussis
cgccaggaacagc

SEQ ID NO: 2346379 - RNA, 19 nt, Bordetella pertussis
cgccaggaacagcgccggc

SEQ ID NO: 2346380 - RNA, 23 nt, Bordetella pertussis
cgccaggaagaucggcccggcgc

SEQ ID NO: 2346381 - RNA, 17 nt, Bordetella pertussis
cgccaggaagccgugcg

SEQ ID NO: 2346382 - RNA, 17 nt, Bordetella pertussis
cgccaggaagcgcgccg

SEQ ID NO: 2346383 - RNA, 18 nt, Bordetella pertussis
cgccaggaagcgcgccgc

SEQ ID NO: 2346384 - RNA, 21 nt, Bordetella pertussis
cgccaggaagcgcgccgcgcg

SEQ ID NO: 2346385 - RNA, 16 nt, Bordetella pertussis
cgccaggaagcgggcc

SEQ ID NO: 2346386 - RNA, 19 nt, Bordetella pertussis
cgccaggaagcgggccugc

SEQ ID NO: 2346387 - RNA, 23 nt, Bordetella pertussis
cgccaggaagcgggccugccgcg

SEQ ID NO: 2346388 - RNA, 14 nt, Bordetella pertussis
cgccaggaccagga

SEQ ID NO: 2346389 - RNA, 20 nt, Bordetella pertussis
cgccaggacgggaaagcggc

SEQ ID NO: 2346390 - RNA, 17 nt, Bordetella pertussis
cgccaggacguccaggc

SEQ ID NO: 2346391 - RNA, 23 nt, Bordetella pertussis
cgccaggauggccacgaccacca

SEQ ID NO: 2346392 - RNA, 14 nt, Bordetella pertussis
cgccaggcauugaa

SEQ ID NO: 2346393 - RNA, 22 nt, Bordetella pertussis
cgccaggcauugaagcuggcgc

SEQ ID NO: 2346394 - RNA, 16 nt, Bordetella pertussis
cgccaggcccagggcc

SEQ ID NO: 2346395 - RNA, 15 nt, Bordetella pertussis
cgccaggccccgccg

SEQ ID NO: 2346396 - RNA, 17 nt, Bordetella pertussis
cgccaggccccgccggg

SEQ ID NO: 2346397 - RNA, 19 nt, Bordetella pertussis
cgccaggccccgccgggcc

SEQ ID NO: 2346398 - RNA, 20 nt, Bordetella pertussis
cgccaggccccgccgggccg

SEQ ID NO: 2346399 - RNA, 14 nt, Bordetella pertussis
cgccaggccgcgca

SEQ ID NO: 2346400 - RNA, 18 nt, Bordetella pertussis
cgccaggccgcgcagggc

SEQ ID NO: 2346401 - RNA, 12 nt, Bordetella pertussis
cgccaggccggc

SEQ ID NO: 2346402 - RNA, 14 nt, Bordetella pertussis
cgccaggccggcgg

SEQ ID NO: 2346403 - RNA, 16 nt, Bordetella pertussis
cgccaggccggcggcg

SEQ ID NO: 2346404 - RNA, 22 nt, Bordetella pertussis
cgccaggccuucgacguccagc

SEQ ID NO: 2346405 - RNA, 16 nt, Bordetella pertussis
cgccaggcgccgggcc

SEQ ID NO: 2346406 - RNA, 17 nt, Bordetella pertussis
cgccaggcgccgggccg

SEQ ID NO: 2346407 - RNA, 21 nt, Bordetella pertussis
cgccaggcgccgggccgcuag

SEQ ID NO: 2346408 - RNA, 19 nt, Bordetella pertussis
cgccaggcugaaugccgcc

SEQ ID NO: 2346409 - RNA, 20 nt, Bordetella pertussis
cgccaggcugaaugccgccg

SEQ ID NO: 2346410 - RNA, 19 nt, Bordetella pertussis
cgccaggcugucgucgucg

SEQ ID NO: 2346411 - RNA, 13 nt, Bordetella pertussis
cgccagggccagg

SEQ ID NO: 2346412 - RNA, 16 nt, Bordetella pertussis
cgccagggccaggccg

SEQ ID NO: 2346413 - RNA, 17 nt, Bordetella pertussis
cgccagggccaggccgc

SEQ ID NO: 2346414 - RNA, 20 nt, Bordetella pertussis
cgccagggccaggccgccgc

SEQ ID NO: 2346415 - RNA, 22 nt, Bordetella pertussis
cgccagggccauguggcgcagc

SEQ ID NO: 2346416 - RNA, 14 nt, Bordetella pertussis
cgccagggccccuc

SEQ ID NO: 2346417 - RNA, 20 nt, Bordetella pertussis
cgccagggccccuccggcgc

SEQ ID NO: 2346418 - RNA, 22 nt, Bordetella pertussis
cgccagggccccuccggcgccg

SEQ ID NO: 2346419 - RNA, 15 nt, Bordetella pertussis
cgccagggccgagcc

SEQ ID NO: 2346420 - RNA, 14 nt, Bordetella pertussis
cgccagggccgccg

SEQ ID NO: 2346421 - RNA, 15 nt, Bordetella pertussis
cgccagggccgccgc

SEQ ID NO: 2346422 - RNA, 19 nt, Bordetella pertussis
cgccagggccgccgcgccc

SEQ ID NO: 2346423 - RNA, 16 nt, Bordetella pertussis
cgccagggcgaugacc

SEQ ID NO: 2346424 - RNA, 13 nt, Bordetella pertussis
cgccagggcgccg

SEQ ID NO: 2346425 - RNA, 16 nt, Bordetella pertussis
cgccagggcgccgcgg

SEQ ID NO: 2346426 - RNA, 15 nt, Bordetella pertussis
cgccagggcgcggau

SEQ ID NO: 2346427 - RNA, 12 nt, Bordetella pertussis
cgccagggcggc

SEQ ID NO: 2346428 - RNA, 15 nt, Bordetella pertussis
cgccagggcggggcc

SEQ ID NO: 2346429 - RNA, 16 nt, Bordetella pertussis
cgccagggcggggccg

SEQ ID NO: 2346430 - RNA, 16 nt, Bordetella pertussis
cgccagggucugcugg

SEQ ID NO: 2346431 - RNA, 21 nt, Bordetella pertussis
cgccagggucugcuggucgcg

SEQ ID NO: 2346432 - RNA, 24 nt, Bordetella pertussis
cgccagggucugcuggucgcgggc

SEQ ID NO: 2346433 - RNA, 17 nt, Bordetella pertussis
cgccagguagcgggugg

SEQ ID NO: 2346434 - RNA, 16 nt, Bordetella pertussis
cgccagguaggccggc

SEQ ID NO: 2346435 - RNA, 19 nt, Bordetella pertussis
cgccagguaggccggcgcg

SEQ ID NO: 2346436 - RNA, 14 nt, Bordetella pertussis
cgccaggucgcgca

SEQ ID NO: 2346437 - RNA, 15 nt, Bordetella pertussis
cgccaggucgcgcac

SEQ ID NO: 2346438 - RNA, 16 nt, Bordetella pertussis
cgccaggucggccacc

SEQ ID NO: 2346439 - RNA, 18 nt, Bordetella pertussis
cgccaggucggccaccgc

SEQ ID NO: 2346440 - RNA, 20 nt, Bordetella pertussis
cgccaggucggccaccgccg

SEQ ID NO: 2346441 - RNA, 23 nt, Bordetella pertussis
cgccaggucggccaccgccgugg

SEQ ID NO: 2346442 - RNA, 19 nt, Bordetella pertussis
cgccaggucggccagccgg

SEQ ID NO: 2346443 - RNA, 21 nt, Bordetella pertussis
cgccaggucggccagccggcc

SEQ ID NO: 2346444 - RNA, 22 nt, Bordetella pertussis
cgccaggucggccagccggccg

SEQ ID NO: 2346445 - RNA, 14 nt, Bordetella pertussis
cgccaggugggcca

SEQ ID NO: 2346446 - RNA, 18 nt, Bordetella pertussis
cgccaggugggccaggua

SEQ ID NO: 2346447 - RNA, 20 nt, Bordetella pertussis
cgccagguugcgguaguuca

SEQ ID NO: 2346448 - RNA, 19 nt, Bordetella pertussis
cgccaguagcgccggcuug

SEQ ID NO: 2346449 - RNA, 17 nt, Bordetella pertussis
cgccaguccagcgcgcc

SEQ ID NO: 2346450 - RNA, 18 nt, Bordetella pertussis
cgccaguccagcgcgccg

SEQ ID NO: 2346451 - RNA, 23 nt, Bordetella pertussis
cgccaguccccaugcggggacug

SEQ ID NO: 2346452 - RNA, 19 nt, Bordetella pertussis
cgccaguccgcgcucgccc

SEQ ID NO: 2346453 - RNA, 15 nt, Bordetella pertussis
cgccagucgcgcagc

SEQ ID NO: 2346454 - RNA, 16 nt, Bordetella pertussis
cgccaguucaaggcgc

SEQ ID NO: 2346455 - RNA, 21 nt, Bordetella pertussis
cgccaguucgaguuccgcgac

SEQ ID NO: 2346456 - RNA, 16 nt, Bordetella pertussis
cgccaguugcgcaccg

SEQ ID NO: 2346457 - RNA, 13 nt, Bordetella pertussis
cgccaguugcggg

SEQ ID NO: 2346458 - RNA, 17 nt, Bordetella pertussis
cgccaguugcggggcgc

SEQ ID NO: 2346459 - RNA, 19 nt, Bordetella pertussis
cgccaguugcggggcgccc

SEQ ID NO: 2346460 - RNA, 20 nt, Bordetella pertussis
cgccaguugcggggcgccca

SEQ ID NO: 2346461 - RNA, 22 nt, Bordetella pertussis
cgccauaccgaucuacgacgcc

SEQ ID NO: 2346462 - RNA, 13 nt, Bordetella pertussis
cgccauacugcca

SEQ ID NO: 2346463 - RNA, 14 nt, Bordetella pertussis
cgccauagcugcgc

SEQ ID NO: 2346464 - RNA, 15 nt, Bordetella pertussis
cgccauaggcgcgca

SEQ ID NO: 2346465 - RNA, 24 nt, Bordetella pertussis
cgccauauugaugcagcacgucgg

SEQ ID NO: 2346466 - RNA, 22 nt, Bordetella pertussis
cgccaucacggugucgaugggc

SEQ ID NO: 2346467 - RNA, 18 nt, Bordetella pertussis
cgccaucauggcgucggc

SEQ ID NO: 2346468 - RNA, 20 nt, Bordetella pertussis
cgccaucauggcgucggcca

SEQ ID NO: 2346469 - RNA, 22 nt, Bordetella pertussis
cgccaucauggcgucggccacg

SEQ ID NO: 2346470 - RNA, 23 nt, Bordetella pertussis
cgccaucauggcgucggccacgu

SEQ ID NO: 2346471 - RNA, 15 nt, Bordetella pertussis
cgccauccagguacg

SEQ ID NO: 2346472 - RNA, 15 nt, Bordetella pertussis
cgccauccggcgcau

SEQ ID NO: 2346473 - RNA, 17 nt, Bordetella pertussis
cgccauccggcgcauga

SEQ ID NO: 2346474 - RNA, 20 nt, Bordetella pertussis
cgccauccugaacgccgcgc

SEQ ID NO: 2346475 - RNA, 17 nt, Bordetella pertussis
cgccauccuggccgccg

SEQ ID NO: 2346476 - RNA, 23 nt, Bordetella pertussis
cgccauccuggccgccgcgggcg

SEQ ID NO: 2346477 - RNA, 19 nt, Bordetella pertussis
cgccaucgacgcuugccgg

SEQ ID NO: 2346478 - RNA, 18 nt, Bordetella pertussis
cgccaucgacgggcggcu

SEQ ID NO: 2346479 - RNA, 13 nt, Bordetella pertussis
cgccaucgccagg

SEQ ID NO: 2346480 - RNA, 14 nt, Bordetella pertussis
cgccaucgccagga

SEQ ID NO: 2346481 - RNA, 21 nt, Bordetella pertussis
cgccaucgucguagcgccagc

SEQ ID NO: 2346482 - RNA, 22 nt, Bordetella pertussis
cgccaucuaccugucgggcggc

SEQ ID NO: 2346483 - RNA, 20 nt, Bordetella pertussis
cgccaucucaaccacgaaca

SEQ ID NO: 2346484 - RNA, 14 nt, Bordetella pertussis
cgccaucugcugcg

SEQ ID NO: 2346485 - RNA, 22 nt, Bordetella pertussis
cgccaucugcugcgagacgcgc

SEQ ID NO: 2346486 - RNA, 18 nt, Bordetella pertussis
cgccaucuugcaggcgcc

SEQ ID NO: 2346487 - RNA, 19 nt, Bordetella pertussis
cgccaucuugcaggcgcca

SEQ ID NO: 2346488 - RNA, 21 nt, Bordetella pertussis
cgccaugaacgcuugacggcc

SEQ ID NO: 2346489 - RNA, 22 nt, Bordetella pertussis
cgccaugaacgcuugacggcca

SEQ ID NO: 2346490 - RNA, 16 nt, Bordetella pertussis
cgccaugaacucgcgc

SEQ ID NO: 2346491 - RNA, 22 nt, Bordetella pertussis
cgccaugaacucgcgcucggcg

SEQ ID NO: 2346492 - RNA, 18 nt, Bordetella pertussis
cgccaugacaugcgggcc

SEQ ID NO: 2346493 - RNA, 14 nt, Bordetella pertussis
cgccaugacgcugg

SEQ ID NO: 2346494 - RNA, 12 nt, Bordetella pertussis
cgccaugagcgc

SEQ ID NO: 2346495 - RNA, 21 nt, Bordetella pertussis
cgccaugagcgcuugacggcc

SEQ ID NO: 2346496 - RNA, 22 nt, Bordetella pertussis
cgccaugaugucgcgcgccugc

SEQ ID NO: 2346497 - RNA, 15 nt, Bordetella pertussis
cgccaugcacgggcc

SEQ ID NO: 2346498 - RNA, 14 nt, Bordetella pertussis
cgccaugcagcugg

SEQ ID NO: 2346499 - RNA, 17 nt, Bordetella pertussis
cgccaugcagcuggaug

SEQ ID NO: 2346500 - RNA, 20 nt, Bordetella pertussis
cgccaugcagcuggauggcc

SEQ ID NO: 2346501 - RNA, 22 nt, Bordetella pertussis
cgccaugcagcuggauggccug

SEQ ID NO: 2346502 - RNA, 13 nt, Bordetella pertussis
cgccaugccgcgc

SEQ ID NO: 2346503 - RNA, 16 nt, Bordetella pertussis
cgccaugccgcgcccg

SEQ ID NO: 2346504 - RNA, 16 nt, Bordetella pertussis
cgccaugccggccccg

SEQ ID NO: 2346505 - RNA, 18 nt, Bordetella pertussis
cgccaugcgacagcccgg

SEQ ID NO: 2346506 - RNA, 14 nt, Bordetella pertussis
cgccaugcgcacca

SEQ ID NO: 2346507 - RNA, 17 nt, Bordetella pertussis
cgccaugcgcaccaccg

SEQ ID NO: 2346508 - RNA, 21 nt, Bordetella pertussis
cgccaugcgcaccaccgccga

SEQ ID NO: 2346509 - RNA, 16 nt, Bordetella pertussis
cgccaugcgcauggcc

SEQ ID NO: 2346510 - RNA, 22 nt, Bordetella pertussis
cgccaugcgcauggccagcgcg

SEQ ID NO: 2346511 - RNA, 16 nt, Bordetella pertussis
cgccaugcgccagcag

SEQ ID NO: 2346512 - RNA, 17 nt, Bordetella pertussis
cgccaugcgccagcagg

SEQ ID NO: 2346513 - RNA, 13 nt, Bordetella pertussis
cgccaugcgcccg

SEQ ID NO: 2346514 - RNA, 16 nt, Bordetella pertussis
cgccaugcgcccggcc

SEQ ID NO: 2346515 - RNA, 18 nt, Bordetella pertussis
cgccaugcgcccggccac

SEQ ID NO: 2346516 - RNA, 13 nt, Bordetella pertussis
cgccaugcggcgc

SEQ ID NO: 2346517 - RNA, 15 nt, Bordetella pertussis
cgccaugcggcgcca

SEQ ID NO: 2346518 - RNA, 15 nt, Bordetella pertussis
cgccaugcggcuggc

SEQ ID NO: 2346519 - RNA, 17 nt, Bordetella pertussis
cgccaugcucgcgcaca

SEQ ID NO: 2346520 - RNA, 19 nt, Bordetella pertussis
cgccaugcucgcgcacagc

SEQ ID NO: 2346521 - RNA, 21 nt, Bordetella pertussis
cgccaugcugccaaccgcgac

SEQ ID NO: 2346522 - RNA, 18 nt, Bordetella pertussis
cgccgaucagcaggucgg

SEQ ID NO: 2346523 - RNA, 24 nt, Bordetella pertussis
cgccgaucagcaggucggcgcggc

SEQ ID NO: 2346524 - RNA, 14 nt, Bordetella pertussis
cgccgauccagccc

SEQ ID NO: 2346525 - RNA, 15 nt, Bordetella pertussis
cgccgauccagccca

SEQ ID NO: 2346526 - RNA, 15 nt, Bordetella pertussis
cgccgauccggcgca

SEQ ID NO: 2346527 - RNA, 13 nt, Bordetella pertussis
cgccgaucgagca

SEQ ID NO: 2346528 - RNA, 14 nt, Bordetella pertussis
cgccgaucgagcag

SEQ ID NO: 2346529 - RNA, 18 nt, Bordetella pertussis
cgccgaucgagcaggccg

SEQ ID NO: 2346530 - RNA, 14 nt, Bordetella pertussis
cgccgaucgcggcu

SEQ ID NO: 2346531 - RNA, 14 nt, Bordetella pertussis
cgccgaugaccagc

SEQ ID NO: 2346532 - RNA, 15 nt, Bordetella pertussis
cgccgaugaccagca

SEQ ID NO: 2346533 - RNA, 17 nt, Bordetella pertussis
cgccgaugaccagcagc

SEQ ID NO: 2346534 - RNA, 21 nt, Bordetella pertussis
cgccgaugaccagcagcgccg

SEQ ID NO: 2346535 - RNA, 17 nt, Bordetella pertussis
cgccgaugaccagggcg

SEQ ID NO: 2346536 - RNA, 23 nt, Bordetella pertussis
cgccgaugaccagggcgccgacc

SEQ ID NO: 2346537 - RNA, 14 nt, Bordetella pertussis
cgccgaugcacagg

SEQ ID NO: 2346538 - RNA, 13 nt, Bordetella pertussis
cgccgaugccgcc

SEQ ID NO: 2346539 - RNA, 14 nt, Bordetella pertussis
cgccgaugccgcgc

SEQ ID NO: 2346540 - RNA, 18 nt, Bordetella pertussis
cgccgaugccgcgcaccu

SEQ ID NO: 2346541 - RNA, 20 nt, Bordetella pertussis
cgccgaugccgcgcaccugg

SEQ ID NO: 2346542 - RNA, 21 nt, Bordetella pertussis
cgccgaugccgcgcaccuggg

SEQ ID NO: 2346543 - RNA, 15 nt, Bordetella pertussis
cgccgaugcgccagg

SEQ ID NO: 2346544 - RNA, 20 nt, Bordetella pertussis
cgccgaugcgcucgguccag

SEQ ID NO: 2346545 - RNA, 20 nt, Bordetella pertussis
cgccgaugcggguacuggcc

SEQ ID NO: 2346546 - RNA, 21 nt, Bordetella pertussis
cgccgaugcggguacuggccg

SEQ ID NO: 2346547 - RNA, 22 nt, Bordetella pertussis
cgccgaugcggguacuggccga

SEQ ID NO: 2346548 - RNA, 13 nt, Bordetella pertussis
cgccgauggcgcc

SEQ ID NO: 2346549 - RNA, 15 nt, Bordetella pertussis
cgccgauggcgccac

SEQ ID NO: 2346550 - RNA, 15 nt, Bordetella pertussis
cgccgauggcgcgcg

SEQ ID NO: 2346551 - RNA, 18 nt, Bordetella pertussis
cgccgauggcgcgcggcu

SEQ ID NO: 2346552 - RNA, 19 nt, Bordetella pertussis
cgccgauggcgcgcggcug

SEQ ID NO: 2346553 - RNA, 15 nt, Bordetella pertussis
cgccgauggcgcggc

SEQ ID NO: 2346554 - RNA, 16 nt, Bordetella pertussis
cgccgauggcgcggcc

SEQ ID NO: 2346555 - RNA, 17 nt, Bordetella pertussis
cgccgauguaugacuug

SEQ ID NO: 2346556 - RNA, 14 nt, Bordetella pertussis
cgccgaugugcggc

SEQ ID NO: 2346557 - RNA, 17 nt, Bordetella pertussis
cgccgaugugcggcgug

SEQ ID NO: 2346558 - RNA, 19 nt, Bordetella pertussis
cgccgauguugaacagcug

SEQ ID NO: 2346559 - RNA, 20 nt, Bordetella pertussis
cgccgauguugaacagcugg

SEQ ID NO: 2346560 - RNA, 17 nt, Bordetella pertussis
cgccgauugaggccagc

SEQ ID NO: 2346561 - RNA, 20 nt, Bordetella pertussis
cgccgauuucgccgccgcca

SEQ ID NO: 2346562 - RNA, 16 nt, Bordetella pertussis
cgccgcaacaggcagc

SEQ ID NO: 2346563 - RNA, 18 nt, Bordetella pertussis
cgccgcaacaggcagcug

SEQ ID NO: 2346564 - RNA, 22 nt, Bordetella pertussis
cgccgcaacaggcagcugcgcg

SEQ ID NO: 2346565 - RNA, 14 nt, Bordetella pertussis
cgccgcaacgccgc

SEQ ID NO: 2346566 - RNA, 16 nt, Bordetella pertussis
cgccgcaacgccgccg

SEQ ID NO: 2346567 - RNA, 17 nt, Bordetella pertussis
cgccgcaacgccgggcc

SEQ ID NO: 2346568 - RNA, 19 nt, Bordetella pertussis
cgccgcaacgccgggccgc

SEQ ID NO: 2346569 - RNA, 16 nt, Bordetella pertussis
cgccgcaagacggcgu

SEQ ID NO: 2346570 - RNA, 20 nt, Bordetella pertussis
cgccgcaauagaucauccag

SEQ ID NO: 2346571 - RNA, 15 nt, Bordetella pertussis
cgccgcacagcgugg

SEQ ID NO: 2346572 - RNA, 17 nt, Bordetella pertussis
cgccgcaccagccugau

SEQ ID NO: 2346573 - RNA, 13 nt, Bordetella pertussis
cgccgcaccagcg

SEQ ID NO: 2346574 - RNA, 16 nt, Bordetella pertussis
cgccgcaccagcgccg

SEQ ID NO: 2346575 - RNA, 20 nt, Bordetella pertussis
cgccgcaccagcgccgacgg

SEQ ID NO: 2346576 - RNA, 17 nt, Bordetella pertussis
cgccgcaccagcggcga

SEQ ID NO: 2346577 - RNA, 14 nt, Bordetella pertussis
cgccgcaccaggcc

SEQ ID NO: 2346578 - RNA, 16 nt, Bordetella pertussis
cgccgcaccaggccgc

SEQ ID NO: 2346579 - RNA, 20 nt, Bordetella pertussis
cgccgcaccaggccgcggcg

SEQ ID NO: 2346580 - RNA, 17 nt, Bordetella pertussis
cgccgcacccgaugacg

SEQ ID NO: 2346581 - RNA, 12 nt, Bordetella pertussis
cgccgcacgccg

SEQ ID NO: 2346582 - RNA, 13 nt, Bordetella pertussis
cgccgcacgccgg

SEQ ID NO: 2346583 - RNA, 17 nt, Bordetella pertussis
cgccgcacgucggucga

SEQ ID NO: 2346584 - RNA, 20 nt, Bordetella pertussis
cgccgcagcaccucggcgug

SEQ ID NO: 2346585 - RNA, 21 nt, Bordetella pertussis
cgccgcagcaccucggcgugg

SEQ ID NO: 2346586 - RNA, 14 nt, Bordetella pertussis
cgccgcagccgcca

SEQ ID NO: 2346587 - RNA, 16 nt, Bordetella pertussis
cgccgcagcgucgcgg

SEQ ID NO: 2346588 - RNA, 19 nt, Bordetella pertussis
cgccgcagcgucgcggcgu

SEQ ID NO: 2346589 - RNA, 14 nt, Bordetella pertussis
cgccgcaggcuaug

SEQ ID NO: 2346590 - RNA, 20 nt, Bordetella pertussis
cgccgcagugcgcgcgcccc

SEQ ID NO: 2346591 - RNA, 19 nt, Bordetella pertussis
cgccgcaguuccaggcauu

SEQ ID NO: 2346592 - RNA, 21 nt, Bordetella pertussis
cgccgcauaccuuggcgccca

SEQ ID NO: 2346593 - RNA, 20 nt, Bordetella pertussis
cgccgcaucauguaaggcgc

SEQ ID NO: 2346594 - RNA, 21 nt, Bordetella pertussis
cgccgcaucauguaaggcgca

SEQ ID NO: 2346595 - RNA, 16 nt, Bordetella pertussis
cgccgcaugccgggcu

SEQ ID NO: 2346596 - RNA, 14 nt, Bordetella pertussis
cgccgcaugcggcg

SEQ ID NO: 2346597 - RNA, 16 nt, Bordetella pertussis
cgccgcaugcggcggc

SEQ ID NO: 2346598 - RNA, 17 nt, Bordetella pertussis
cgccgcaugcggcggcu

SEQ ID NO: 2346599 - RNA, 18 nt, Bordetella pertussis
cgccgcaugcggcggcug

SEQ ID NO: 2346600 - RNA, 14 nt, Bordetella pertussis
cgccgcaugggcgc

SEQ ID NO: 2346601 - RNA, 19 nt, Bordetella pertussis
cgccgcaugggcgcgcccg

SEQ ID NO: 2346602 - RNA, 21 nt, Bordetella pertussis
cgccgcauuuccucgaccagc

SEQ ID NO: 2346603 - RNA, 20 nt, Bordetella pertussis
cgccgccaccagggcgcccg

SEQ ID NO: 2346604 - RNA, 16 nt, Bordetella pertussis
cgccgccaccucggcg

SEQ ID NO: 2346605 - RNA, 23 nt, Bordetella pertussis
cgccgccaccucggcgucgcccg

SEQ ID NO: 2346606 - RNA, 16 nt, Bordetella pertussis
cgccgccacgcgcacg

SEQ ID NO: 2346607 - RNA, 20 nt, Bordetella pertussis
cgccgccacgcgcacggcca

SEQ ID NO: 2346608 - RNA, 22 nt, Bordetella pertussis
cgccgccacgcgcacggccagc

SEQ ID NO: 2346609 - RNA, 23 nt, Bordetella pertussis
cgccgccacgcgcacggccagca

SEQ ID NO: 2346610 - RNA, 14 nt, Bordetella pertussis
cgccgccacgcugg

SEQ ID NO: 2346611 - RNA, 18 nt, Bordetella pertussis
cgccgccacgcuggccgc

SEQ ID NO: 2346612 - RNA, 20 nt, Bordetella pertussis
cgccgccacgcuggccgcgc

SEQ ID NO: 2346613 - RNA, 14 nt, Bordetella pertussis
cgccgccagcacgc

SEQ ID NO: 2346614 - RNA, 16 nt, Bordetella pertussis
cgccgccagcacgcca

SEQ ID NO: 2346615 - RNA, 18 nt, Bordetella pertussis
cgccgccagcacgccauu

SEQ ID NO: 2346616 - RNA, 15 nt, Bordetella pertussis
cgccgccagcagcgc

SEQ ID NO: 2346617 - RNA, 16 nt, Bordetella pertussis
cgccgccagcagcgcc

SEQ ID NO: 2346618 - RNA, 14 nt, Bordetella pertussis
cgccgccagccgcu

SEQ ID NO: 2346619 - RNA, 15 nt, Bordetella pertussis
cgccgccagccgcug

SEQ ID NO: 2346620 - RNA, 15 nt, Bordetella pertussis
cgccgccagccugcu

SEQ ID NO: 2346621 - RNA, 13 nt, Bordetella pertussis
cgccgccagcgcg

SEQ ID NO: 2346622 - RNA, 14 nt, Bordetella pertussis
cgccgccagcgcgc

SEQ ID NO: 2346623 - RNA, 16 nt, Bordetella pertussis
cgccgccagcgcgccg

SEQ ID NO: 2346624 - RNA, 15 nt, Bordetella pertussis
cgccgccagcgcgcg

SEQ ID NO: 2346625 - RNA, 17 nt, Bordetella pertussis
cgccgccagcgcgcgcg

SEQ ID NO: 2346626 - RNA, 20 nt, Bordetella pertussis
cgccgccagcgcgcgcgagg

SEQ ID NO: 2346627 - RNA, 12 nt, Bordetella pertussis
cgccgccagcuu

SEQ ID NO: 2346628 - RNA, 17 nt, Bordetella pertussis
cgccgccaggccgucga

SEQ ID NO: 2346629 - RNA, 18 nt, Bordetella pertussis
cgccgccauagcugcgcc

SEQ ID NO: 2346630 - RNA, 22 nt, Bordetella pertussis
cgccgccauagcugcgccaauu

SEQ ID NO: 2346631 - RNA, 13 nt, Bordetella pertussis
cgccgccaugcca

SEQ ID NO: 2346632 - RNA, 20 nt, Bordetella pertussis
cgccgccauggcggcgccca

SEQ ID NO: 2346633 - RNA, 16 nt, Bordetella pertussis
cgccgccauggucgcg

SEQ ID NO: 2346634 - RNA, 21 nt, Bordetella pertussis
cgccgccauggucgcgaccac

SEQ ID NO: 2346635 - RNA, 19 nt, Bordetella pertussis
cgccgccauggugccgcgc

SEQ ID NO: 2346636 - RNA, 20 nt, Bordetella pertussis
cgccgccauggugccgcgca

SEQ ID NO: 2346637 - RNA, 14 nt, Bordetella pertussis
cgcccagccgcgcc

SEQ ID NO: 2346638 - RNA, 20 nt, Bordetella pertussis
cgcccagccgcgccaucacg

SEQ ID NO: 2346639 - RNA, 14 nt, Bordetella pertussis
cgcccagccggccg

SEQ ID NO: 2346640 - RNA, 16 nt, Bordetella pertussis
cgcccagccggccgau

SEQ ID NO: 2346641 - RNA, 19 nt, Bordetella pertussis
cgcccagccugccggcggc

SEQ ID NO: 2346642 - RNA, 20 nt, Bordetella pertussis
cgcccagccugccggcggcc

SEQ ID NO: 2346643 - RNA, 13 nt, Bordetella pertussis
cgcccagcgacga

SEQ ID NO: 2346644 - RNA, 17 nt, Bordetella pertussis
cgcccagcgacgagggc

SEQ ID NO: 2346645 - RNA, 20 nt, Bordetella pertussis
cgcccagcgacgagggcgcc

SEQ ID NO: 2346646 - RNA, 12 nt, Bordetella pertussis
cgcccagcgagc

SEQ ID NO: 2346647 - RNA, 14 nt, Bordetella pertussis
cgcccagcgagccg

SEQ ID NO: 2346648 - RNA, 15 nt, Bordetella pertussis
cgcccagcgagccgg

SEQ ID NO: 2346649 - RNA, 20 nt, Bordetella pertussis
cgcccagcgagccggccagc

SEQ ID NO: 2346650 - RNA, 22 nt, Bordetella pertussis
cgcccagcgcauaggacgccac

SEQ ID NO: 2346651 - RNA, 12 nt, Bordetella pertussis
cgcccagcgccg

SEQ ID NO: 2346652 - RNA, 16 nt, Bordetella pertussis
cgcccagcgccggcac

SEQ ID NO: 2346653 - RNA, 18 nt, Bordetella pertussis
cgcccagcgccggcacgc

SEQ ID NO: 2346654 - RNA, 14 nt, Bordetella pertussis
cgcccagcgccugc

SEQ ID NO: 2346655 - RNA, 11 nt, Bordetella pertussis
cgcccagcgcg

SEQ ID NO: 2346656 - RNA, 15 nt, Bordetella pertussis
cgcccagcgcggccu

SEQ ID NO: 2346657 - RNA, 14 nt, Bordetella pertussis
cgcccagcgcgucg

SEQ ID NO: 2346658 - RNA, 15 nt, Bordetella pertussis
cgcccagcgcgucgg

SEQ ID NO: 2346659 - RNA, 20 nt, Bordetella pertussis
cgcccagcgcgucggccagc

SEQ ID NO: 2346660 - RNA, 18 nt, Bordetella pertussis
cgcccagcgcgugggcca

SEQ ID NO: 2346661 - RNA, 21 nt, Bordetella pertussis
cgcccagcgcuugcacgccau

SEQ ID NO: 2346662 - RNA, 17 nt, Bordetella pertussis
cgcccagcggcaggcug

SEQ ID NO: 2346663 - RNA, 16 nt, Bordetella pertussis
cgcccagcggcgccga

SEQ ID NO: 2346664 - RNA, 17 nt, Bordetella pertussis
cgcccagcggcgccgac

SEQ ID NO: 2346665 - RNA, 12 nt, Bordetella pertussis
cgcccagcucca

SEQ ID NO: 2346666 - RNA, 18 nt, Bordetella pertussis
cgcccagcugcuucaugc

SEQ ID NO: 2346667 - RNA, 14 nt, Bordetella pertussis
cgcccagcugggcc

SEQ ID NO: 2346668 - RNA, 15 nt, Bordetella pertussis
cgcccagcugggcca

SEQ ID NO: 2346669 - RNA, 17 nt, Bordetella pertussis
cgcccagcuguccaagc

SEQ ID NO: 2346670 - RNA, 16 nt, Bordetella pertussis
cgcccgcggccagcca

SEQ ID NO: 2346671 - RNA, 21 nt, Bordetella pertussis
cgcccgcggccagccacgccg

SEQ ID NO: 2346672 - RNA, 12 nt, Bordetella pertussis
cgcccgcggccu

SEQ ID NO: 2346673 - RNA, 13 nt, Bordetella pertussis
cgcccgcggccug

SEQ ID NO: 2346674 - RNA, 15 nt, Bordetella pertussis
cgcccgcggccugca

SEQ ID NO: 2346675 - RNA, 19 nt, Bordetella pertussis
cgcccgcggccugcagacc

SEQ ID NO: 2346676 - RNA, 13 nt, Bordetella pertussis
cgcccgcggcgcc

SEQ ID NO: 2346677 - RNA, 22 nt, Bordetella pertussis
cgcccgcgggugauauuggcga

SEQ ID NO: 2346678 - RNA, 17 nt, Bordetella pertussis
cgcccgcguacagcccg

SEQ ID NO: 2346679 - RNA, 19 nt, Bordetella pertussis
cgcccgcgugcgugccgac

SEQ ID NO: 2346680 - RNA, 13 nt, Bordetella pertussis
cgcccgcuccacc

SEQ ID NO: 2346681 - RNA, 16 nt, Bordetella pertussis
cgcccgcuccaccagc

SEQ ID NO: 2346682 - RNA, 19 nt, Bordetella pertussis
cgcccgcuccaccagcacc

SEQ ID NO: 2346683 - RNA, 20 nt, Bordetella pertussis
cgcccgcuccaccagcaccg

SEQ ID NO: 2346684 - RNA, 15 nt, Bordetella pertussis
cgcccgcugaccggc

SEQ ID NO: 2346685 - RNA, 18 nt, Bordetella pertussis
cgcccgcugaccggccug

SEQ ID NO: 2346686 - RNA, 19 nt, Bordetella pertussis
cgcccgcugaccggccugg

SEQ ID NO: 2346687 - RNA, 20 nt, Bordetella pertussis
cgcccgcugaccggccuggu

SEQ ID NO: 2346688 - RNA, 20 nt, Bordetella pertussis
cgcccgcuucuuccuugcga

SEQ ID NO: 2346689 - RNA, 21 nt, Bordetella pertussis
cgcccgcuugcggccggcgcu

SEQ ID NO: 2346690 - RNA, 15 nt, Bordetella pertussis
cgcccgcuugggccg

SEQ ID NO: 2346691 - RNA, 16 nt, Bordetella pertussis
cgcccgcuugggccgc

SEQ ID NO: 2346692 - RNA, 19 nt, Bordetella pertussis
cgcccgcuugggccgcgcc

SEQ ID NO: 2346693 - RNA, 16 nt, Bordetella pertussis
cgcccggaugggcggc

SEQ ID NO: 2346694 - RNA, 17 nt, Bordetella pertussis
cgcccggaugggcggcc

SEQ ID NO: 2346695 - RNA, 18 nt, Bordetella pertussis
cgcccggaugggcggccu

SEQ ID NO: 2346696 - RNA, 20 nt, Bordetella pertussis
cgcccggcaggucgaugccc

SEQ ID NO: 2346697 - RNA, 19 nt, Bordetella pertussis
cgcccggcaugggcgugcc

SEQ ID NO: 2346698 - RNA, 23 nt, Bordetella pertussis
cgcccggcaugggcgugccgcgc

SEQ ID NO: 2346699 - RNA, 17 nt, Bordetella pertussis
cgcccggccaccgcguu

SEQ ID NO: 2346700 - RNA, 13 nt, Bordetella pertussis
cgcccggcccagg

SEQ ID NO: 2346701 - RNA, 17 nt, Bordetella pertussis
cgcccggcccaggccgg

SEQ ID NO: 2346702 - RNA, 12 nt, Bordetella pertussis
cgcccggccgcc

SEQ ID NO: 2346703 - RNA, 13 nt, Bordetella pertussis
cgcccggccgccu

SEQ ID NO: 2346704 - RNA, 14 nt, Bordetella pertussis
cgcccggccgccuc

SEQ ID NO: 2346705 - RNA, 21 nt, Bordetella pertussis
cgcccggccgccucaccgcgc

SEQ ID NO: 2346706 - RNA, 13 nt, Bordetella pertussis
cgcccggccggca

SEQ ID NO: 2346707 - RNA, 14 nt, Bordetella pertussis
cgcccggccggcac

SEQ ID NO: 2346708 - RNA, 17 nt, Bordetella pertussis
cgcccggccggcacggc

SEQ ID NO: 2346709 - RNA, 19 nt, Bordetella pertussis
cgcccggccggcacggccg

SEQ ID NO: 2346710 - RNA, 22 nt, Bordetella pertussis
cgcccggccggcacggccggcc

SEQ ID NO: 2346711 - RNA, 13 nt, Bordetella pertussis
cgcccggccggcc

SEQ ID NO: 2346712 - RNA, 18 nt, Bordetella pertussis
cgcccggccggcccgcgc

SEQ ID NO: 2346713 - RNA, 19 nt, Bordetella pertussis
cgcccggccugcgggcgcc

SEQ ID NO: 2346714 - RNA, 22 nt, Bordetella pertussis
cgccgccauggugccgcgcagg

SEQ ID NO: 2346715 - RNA, 14 nt, Bordetella pertussis
cgccgcccaccacc

SEQ ID NO: 2346716 - RNA, 15 nt, Bordetella pertussis
cgccgcccaccacca

SEQ ID NO: 2346717 - RNA, 17 nt, Bordetella pertussis
cgccgcccaccaccagc

SEQ ID NO: 2346718 - RNA, 14 nt, Bordetella pertussis
cgccgcccacgccg

SEQ ID NO: 2346719 - RNA, 18 nt, Bordetella pertussis
cgccgcccacgccgccug

SEQ ID NO: 2346720 - RNA, 15 nt, Bordetella pertussis
cgccgcccacggcga

SEQ ID NO: 2346721 - RNA, 14 nt, Bordetella pertussis
cgccgcccagccgg

SEQ ID NO: 2346722 - RNA, 18 nt, Bordetella pertussis
cgccgcccagccggccga

SEQ ID NO: 2346723 - RNA, 20 nt, Bordetella pertussis
cgccgcccagccggccgaug

SEQ ID NO: 2346724 - RNA, 12 nt, Bordetella pertussis
cgccgcccagcg

SEQ ID NO: 2346725 - RNA, 13 nt, Bordetella pertussis
cgccgcccagcgc

SEQ ID NO: 2346726 - RNA, 14 nt, Bordetella pertussis
cgccgcccagcgcg

SEQ ID NO: 2346727 - RNA, 15 nt, Bordetella pertussis
cgccgcccaugcgca

SEQ ID NO: 2346728 - RNA, 16 nt, Bordetella pertussis
cgccgcccaugcgcau

SEQ ID NO: 2346729 - RNA, 18 nt, Bordetella pertussis
cgccgcccccgcccagca

SEQ ID NO: 2346730 - RNA, 19 nt, Bordetella pertussis
cgccgcccccgcccagcau

SEQ ID NO: 2346731 - RNA, 20 nt, Bordetella pertussis
cgccgcccccgcccagcauc

SEQ ID NO: 2346732 - RNA, 13 nt, Bordetella pertussis
cgccgccccguca

SEQ ID NO: 2346733 - RNA, 16 nt, Bordetella pertussis
cgccgccccgucaucg

SEQ ID NO: 2346734 - RNA, 14 nt, Bordetella pertussis
cgccgcccgacagc

SEQ ID NO: 2346735 - RNA, 13 nt, Bordetella pertussis
cgccgcccgcacg

SEQ ID NO: 2346736 - RNA, 12 nt, Bordetella pertussis
cgccgcccgcag

SEQ ID NO: 2346737 - RNA, 14 nt, Bordetella pertussis
cgccgcccgcaggc

SEQ ID NO: 2346738 - RNA, 23 nt, Bordetella pertussis
cgccgcccgcaggcauugcgcca

SEQ ID NO: 2346739 - RNA, 13 nt, Bordetella pertussis
cgccgcccgcccg

SEQ ID NO: 2346740 - RNA, 20 nt, Bordetella pertussis
cgccgcccgcccgccgccug

SEQ ID NO: 2346741 - RNA, 18 nt, Bordetella pertussis
cgccgcccgcggccagcc

SEQ ID NO: 2346742 - RNA, 14 nt, Bordetella pertussis
cgccgcccggcaac

SEQ ID NO: 2346743 - RNA, 19 nt, Bordetella pertussis
cgccgcccggcaacccgcc

SEQ ID NO: 2346744 - RNA, 23 nt, Bordetella pertussis
cgccgcccggcaacccgcccacg

SEQ ID NO: 2346745 - RNA, 15 nt, Bordetella pertussis
cgccgcccggccggc

SEQ ID NO: 2346746 - RNA, 16 nt, Bordetella pertussis
cgccgcccgggccggc

SEQ ID NO: 2346747 - RNA, 19 nt, Bordetella pertussis
cgccgcccguccgggcggc

SEQ ID NO: 2346748 - RNA, 12 nt, Bordetella pertussis
cgccgcccugcu

SEQ ID NO: 2346749 - RNA, 14 nt, Bordetella pertussis
cgccgcccugcugc

SEQ ID NO: 2346750 - RNA, 16 nt, Bordetella pertussis
cgccgcccugcugccc

SEQ ID NO: 2346751 - RNA, 17 nt, Bordetella pertussis
cgccgcccuggccgcgc

SEQ ID NO: 2346752 - RNA, 11 nt, Bordetella pertussis
cgccgccgaac

SEQ ID NO: 2346753 - RNA, 22 nt, Bordetella pertussis
cgccgccgaacggggccgccuc

SEQ ID NO: 2346754 - RNA, 16 nt, Bordetella pertussis
cgccgccgaagccgcc

SEQ ID NO: 2346755 - RNA, 20 nt, Bordetella pertussis
cgccgccgaagccgccgccg

SEQ ID NO: 2346756 - RNA, 21 nt, Bordetella pertussis
cgccgccgaccucgucgggcu

SEQ ID NO: 2346757 - RNA, 19 nt, Bordetella pertussis
cgccgccgacggcauggcg

SEQ ID NO: 2346758 - RNA, 15 nt, Bordetella pertussis
cgccgccgauggcgc

SEQ ID NO: 2346759 - RNA, 17 nt, Bordetella pertussis
cgccgccgauggcgcca

SEQ ID NO: 2346760 - RNA, 20 nt, Bordetella pertussis
cgccgccgauggcgcgcggc

SEQ ID NO: 2346761 - RNA, 23 nt, Bordetella pertussis
cgccgccgauggcgcgcggcugg

SEQ ID NO: 2346762 - RNA, 15 nt, Bordetella pertussis
cgccgccgcagccgc

SEQ ID NO: 2346763 - RNA, 16 nt, Bordetella pertussis
cgccgccgcagccgcc

SEQ ID NO: 2346764 - RNA, 17 nt, Bordetella pertussis
cgccgccgcagccgcca

SEQ ID NO: 2346765 - RNA, 14 nt, Bordetella pertussis
cgccgccgccacca

SEQ ID NO: 2346766 - RNA, 14 nt, Bordetella pertussis
cgccgccgccagcc

SEQ ID NO: 2346767 - RNA, 12 nt, Bordetella pertussis
cgccgccgccau

SEQ ID NO: 2346768 - RNA, 14 nt, Bordetella pertussis
cgccgccgcccgca

SEQ ID NO: 2346769 - RNA, 15 nt, Bordetella pertussis
cgccgccgcccgcac

SEQ ID NO: 2346770 - RNA, 14 nt, Bordetella pertussis
cgccgccgcccgcc

SEQ ID NO: 2346771 - RNA, 17 nt, Bordetella pertussis
cgccgccgcccgcccgc

SEQ ID NO: 2346772 - RNA, 13 nt, Bordetella pertussis
cgccgccgcccgg

SEQ ID NO: 2346773 - RNA, 15 nt, Bordetella pertussis
cgccgccgcccuggc

SEQ ID NO: 2346774 - RNA, 15 nt, Bordetella pertussis
cgccgccgccgcggc

SEQ ID NO: 2346775 - RNA, 14 nt, Bordetella pertussis
cgccgccgccggca

SEQ ID NO: 2346776 - RNA, 15 nt, Bordetella pertussis
cgccgccgccggcaa

SEQ ID NO: 2346777 - RNA, 16 nt, Bordetella pertussis
cgccgccgccggucga

SEQ ID NO: 2346778 - RNA, 13 nt, Bordetella pertussis
cgccgccgcgcac

SEQ ID NO: 2346779 - RNA, 14 nt, Bordetella pertussis
cgccgccgcgcacc

SEQ ID NO: 2346780 - RNA, 13 nt, Bordetella pertussis
cgccgccgcgccg

SEQ ID NO: 2346781 - RNA, 17 nt, Bordetella pertussis
cgccgccgcgccgaacg

SEQ ID NO: 2346782 - RNA, 13 nt, Bordetella pertussis
cgccgccgcgcgc

SEQ ID NO: 2346783 - RNA, 16 nt, Bordetella pertussis
cgccgccgcgcgcggc

SEQ ID NO: 2346784 - RNA, 14 nt, Bordetella pertussis
cgccgccgcgcgcu

SEQ ID NO: 2346785 - RNA, 12 nt, Bordetella pertussis
cgccgccgcgcu

SEQ ID NO: 2346786 - RNA, 14 nt, Bordetella pertussis
cgccgccgcggccu

SEQ ID NO: 2346787 - RNA, 18 nt, Bordetella pertussis
cgccgccgcucguccccc

SEQ ID NO: 2346788 - RNA, 12 nt, Bordetella pertussis
cgccgccggcaa

SEQ ID NO: 2346789 - RNA, 14 nt, Bordetella pertussis
cgccgccggcacgu

SEQ ID NO: 2346790 - RNA, 23 nt, Bordetella pertussis
cgccgccggcagggccagcgcca

SEQ ID NO: 2346791 - RNA, 13 nt, Bordetella pertussis
cgccgccggccag

SEQ ID NO: 2346792 - RNA, 15 nt, Bordetella pertussis
cgccgccggccagcc

SEQ ID NO: 2346793 - RNA, 15 nt, Bordetella pertussis
cgccgccggccagcu

SEQ ID NO: 2346794 - RNA, 20 nt, Bordetella pertussis
cgccgccggccagcugcaug

SEQ ID NO: 2346795 - RNA, 22 nt, Bordetella pertussis
cgccgccggcccaggauggcgc

SEQ ID NO: 2346796 - RNA, 23 nt, Bordetella pertussis
cgccgccggcccaggauggcgcc

SEQ ID NO: 2346797 - RNA, 13 nt, Bordetella pertussis
cgccgccggcccg

SEQ ID NO: 2346798 - RNA, 15 nt, Bordetella pertussis
cgccgccggcccgcc

SEQ ID NO: 2346799 - RNA, 16 nt, Bordetella pertussis
cgccgccggcccgcca

SEQ ID NO: 2346800 - RNA, 19 nt, Bordetella pertussis
cgccgccggccugcugcag

SEQ ID NO: 2346801 - RNA, 13 nt, Bordetella pertussis
cgccgccggcgac

SEQ ID NO: 2346802 - RNA, 17 nt, Bordetella pertussis
cgccgccggcgcacccg

SEQ ID NO: 2346803 - RNA, 13 nt, Bordetella pertussis
cgccgccggcgcg

SEQ ID NO: 2346804 - RNA, 15 nt, Bordetella pertussis
cgccgccggcgcggu

SEQ ID NO: 2346805 - RNA, 13 nt, Bordetella pertussis
cgccgccggcggc

SEQ ID NO: 2346806 - RNA, 15 nt, Bordetella pertussis
cgccgccggcggccu

SEQ ID NO: 2346807 - RNA, 17 nt, Bordetella pertussis
cgccgccggcggccugg

SEQ ID NO: 2346808 - RNA, 22 nt, Bordetella pertussis
cgccgccggcggccuggaccug

SEQ ID NO: 2346809 - RNA, 12 nt, Bordetella pertussis
cgccgccgggcc

SEQ ID NO: 2346810 - RNA, 14 nt, Bordetella pertussis
cgccgccgggccug

SEQ ID NO: 2346811 - RNA, 15 nt, Bordetella pertussis
cgccgccgggccugc

SEQ ID NO: 2346812 - RNA, 19 nt, Bordetella pertussis
cgccgccgggccugcccgc

SEQ ID NO: 2346813 - RNA, 21 nt, Bordetella pertussis
cgccgccgggccugcccgcau

SEQ ID NO: 2346814 - RNA, 17 nt, Bordetella pertussis
cgccgccgggcgcgcgc

SEQ ID NO: 2346815 - RNA, 12 nt, Bordetella pertussis
cgccgccgggcu

SEQ ID NO: 2346816 - RNA, 14 nt, Bordetella pertussis
cgccgccgggcugg

SEQ ID NO: 2346817 - RNA, 22 nt, Bordetella pertussis
cgccgccggguuucucgacgca

SEQ ID NO: 2346818 - RNA, 15 nt, Bordetella pertussis
cgccgccggucaccg

SEQ ID NO: 2346819 - RNA, 17 nt, Bordetella pertussis
cgccgccguagccgcug

SEQ ID NO: 2346820 - RNA, 21 nt, Bordetella pertussis
cgccgccguaggacagcccca

SEQ ID NO: 2346821 - RNA, 16 nt, Bordetella pertussis
cgccgccgucaacgcc

SEQ ID NO: 2346822 - RNA, 16 nt, Bordetella pertussis
cgccgccgugacgcug

SEQ ID NO: 2346823 - RNA, 15 nt, Bordetella pertussis
cgccgccgugcgcgg

SEQ ID NO: 2346824 - RNA, 20 nt, Bordetella pertussis
cgccgccgugcgcgggcgcg

SEQ ID NO: 2346825 - RNA, 22 nt, Bordetella pertussis
cgccgccgugcgcgggcgcggc

SEQ ID NO: 2346826 - RNA, 18 nt, Bordetella pertussis
cgccgccguuuucgcccg

SEQ ID NO: 2346827 - RNA, 19 nt, Bordetella pertussis
cgccgccguuuucgcccgc

SEQ ID NO: 2346828 - RNA, 20 nt, Bordetella pertussis
cgccgccguuuucgcccgcc

SEQ ID NO: 2346829 - RNA, 21 nt, Bordetella pertussis
cgccgccguuuucgcccgccc

SEQ ID NO: 2346830 - RNA, 16 nt, Bordetella pertussis
cgccgccucagcccgc

SEQ ID NO: 2346831 - RNA, 16 nt, Bordetella pertussis
cgccgcggccuggccg

SEQ ID NO: 2346832 - RNA, 18 nt, Bordetella pertussis
cgccgcggcgaugccggc

SEQ ID NO: 2346833 - RNA, 21 nt, Bordetella pertussis
cgccgcggcgaugccggccag

SEQ ID NO: 2346834 - RNA, 12 nt, Bordetella pertussis
cgccgcggcgcu

SEQ ID NO: 2346835 - RNA, 13 nt, Bordetella pertussis
cgccgcggcgcuu

SEQ ID NO: 2346836 - RNA, 13 nt, Bordetella pertussis
cgccgcggcggcg

SEQ ID NO: 2346837 - RNA, 14 nt, Bordetella pertussis
cgccgcggcggcga

SEQ ID NO: 2346838 - RNA, 12 nt, Bordetella pertussis
cgccgcggcggg

SEQ ID NO: 2346839 - RNA, 22 nt, Bordetella pertussis
cgccgcggcguccgaauacgcc

SEQ ID NO: 2346840 - RNA, 15 nt, Bordetella pertussis
cgccgcggcuugccg

SEQ ID NO: 2346841 - RNA, 19 nt, Bordetella pertussis
cgccgcgggauucugcugc

SEQ ID NO: 2346842 - RNA, 12 nt, Bordetella pertussis
cgccgcgggccu

SEQ ID NO: 2346843 - RNA, 21 nt, Bordetella pertussis
cgccgcgggccuacuugccgg

SEQ ID NO: 2346844 - RNA, 22 nt, Bordetella pertussis
cgccgcgggccuacuugccggc

SEQ ID NO: 2346845 - RNA, 13 nt, Bordetella pertussis
cgccgcgggccug

SEQ ID NO: 2346846 - RNA, 14 nt, Bordetella pertussis
cgccgcgggccugc

SEQ ID NO: 2346847 - RNA, 15 nt, Bordetella pertussis
cgccgcgggccugcu

SEQ ID NO: 2346848 - RNA, 16 nt, Bordetella pertussis
cgccgcgggcgaagca

SEQ ID NO: 2346849 - RNA, 13 nt, Bordetella pertussis
cgccgcgggcgcc

SEQ ID NO: 2346850 - RNA, 15 nt, Bordetella pertussis
cgccgcgggcgccgc

SEQ ID NO: 2346851 - RNA, 22 nt, Bordetella pertussis
cgccgcgggcgccgcgcacgca

SEQ ID NO: 2346852 - RNA, 17 nt, Bordetella pertussis
cgccgcgggcggccacg

SEQ ID NO: 2346853 - RNA, 19 nt, Bordetella pertussis
cgccgcggggguggacgcc

SEQ ID NO: 2346854 - RNA, 20 nt, Bordetella pertussis
cgccgcggggguggacgcca

SEQ ID NO: 2346855 - RNA, 14 nt, Bordetella pertussis
cgccgcggugaugc

SEQ ID NO: 2346856 - RNA, 19 nt, Bordetella pertussis
cgccgcgucauggcgugcg

SEQ ID NO: 2346857 - RNA, 21 nt, Bordetella pertussis
cgccgcgucauggcgugcgcg

SEQ ID NO: 2346858 - RNA, 15 nt, Bordetella pertussis
cgccgcguccgcccg

SEQ ID NO: 2346859 - RNA, 16 nt, Bordetella pertussis
cgccgcguccgcccgc

SEQ ID NO: 2346860 - RNA, 17 nt, Bordetella pertussis
cgccgcguccggcgccc

SEQ ID NO: 2346861 - RNA, 17 nt, Bordetella pertussis
cgccgcguccucggccu

SEQ ID NO: 2346862 - RNA, 20 nt, Bordetella pertussis
cgccgcguccucggccuggc

SEQ ID NO: 2346863 - RNA, 14 nt, Bordetella pertussis
cgccgcgucgagcg

SEQ ID NO: 2346864 - RNA, 19 nt, Bordetella pertussis
cgccgcgucgagcgcgacg

SEQ ID NO: 2346865 - RNA, 17 nt, Bordetella pertussis
cgccgcgucgcuggccg

SEQ ID NO: 2346866 - RNA, 15 nt, Bordetella pertussis
cgccgcgucgguggc

SEQ ID NO: 2346867 - RNA, 17 nt, Bordetella pertussis
cgccgcgucgguggcca

SEQ ID NO: 2346868 - RNA, 21 nt, Bordetella pertussis
cgccgcgucgguggccagcca

SEQ ID NO: 2346869 - RNA, 21 nt, Bordetella pertussis
cgccgcgucuucggcgcggcg

SEQ ID NO: 2346870 - RNA, 14 nt, Bordetella pertussis
cgccgcgugcgccg

SEQ ID NO: 2346871 - RNA, 14 nt, Bordetella pertussis
cgccgcguggcggc

SEQ ID NO: 2346872 - RNA, 19 nt, Bordetella pertussis
cgccgcguggcggcgcagc

SEQ ID NO: 2346873 - RNA, 21 nt, Bordetella pertussis
cgccgcguggcggcgcagcgc

SEQ ID NO: 2346874 - RNA, 22 nt, Bordetella pertussis
cgccgcguggcggcgcagcgcc

SEQ ID NO: 2346875 - RNA, 23 nt, Bordetella pertussis
cgccgcguggcggcgcagcgccc

SEQ ID NO: 2346876 - RNA, 14 nt, Bordetella pertussis
cgccgcgugguggc

SEQ ID NO: 2346877 - RNA, 15 nt, Bordetella pertussis
cgccgcgugguggcg

SEQ ID NO: 2346878 - RNA, 17 nt, Bordetella pertussis
cgccgcgugguggcgca

SEQ ID NO: 2346879 - RNA, 18 nt, Bordetella pertussis
cgccgcgugguggcgcag

SEQ ID NO: 2346880 - RNA, 19 nt, Bordetella pertussis
cgccgcgugguggcgcaga

SEQ ID NO: 2346881 - RNA, 23 nt, Bordetella pertussis
cgccgcgugguggcgcagauggg

SEQ ID NO: 2346882 - RNA, 16 nt, Bordetella pertussis
cgccgcguucacgccg

SEQ ID NO: 2346883 - RNA, 20 nt, Bordetella pertussis
cgccgcguucacgccggcgc

SEQ ID NO: 2346884 - RNA, 16 nt, Bordetella pertussis
cgccgcuacagcguca

SEQ ID NO: 2346885 - RNA, 15 nt, Bordetella pertussis
cgccgcuacgcggcg

SEQ ID NO: 2346886 - RNA, 20 nt, Bordetella pertussis
cgccgcucagcgcggcgcgg

SEQ ID NO: 2346887 - RNA, 12 nt, Bordetella pertussis
cgccgcuccggc

SEQ ID NO: 2346888 - RNA, 12 nt, Bordetella pertussis
cgccgcucgacg

SEQ ID NO: 2346889 - RNA, 15 nt, Bordetella pertussis
cgccgcucgacgucg

SEQ ID NO: 2346890 - RNA, 16 nt, Bordetella pertussis
cgccgcucgacgucgc

SEQ ID NO: 2346891 - RNA, 18 nt, Bordetella pertussis
cgccgcucgacgucgccc

SEQ ID NO: 2346892 - RNA, 15 nt, Bordetella pertussis
cgccgcucguccccc

SEQ ID NO: 2346893 - RNA, 16 nt, Bordetella pertussis
cgccgcucgucccccu

SEQ ID NO: 2346894 - RNA, 13 nt, Bordetella pertussis
cgccgcucuuggc

SEQ ID NO: 2346895 - RNA, 15 nt, Bordetella pertussis
cgccgcugaugcugg

SEQ ID NO: 2346896 - RNA, 18 nt, Bordetella pertussis
cgccgcugaugcuggcau

SEQ ID NO: 2346897 - RNA, 13 nt, Bordetella pertussis
cgccgcugauggc

SEQ ID NO: 2346898 - RNA, 13 nt, Bordetella pertussis
cgccgcugcagcg

SEQ ID NO: 2346899 - RNA, 12 nt, Bordetella pertussis
cgccgcugccgg

SEQ ID NO: 2346900 - RNA, 13 nt, Bordetella pertussis
cgccgcugccggc

SEQ ID NO: 2346901 - RNA, 14 nt, Bordetella pertussis
cgccgcugccggcc

SEQ ID NO: 2346902 - RNA, 15 nt, Bordetella pertussis
cgccgcugccggccg

SEQ ID NO: 2346903 - RNA, 17 nt, Bordetella pertussis
cgccgcugccggccgac

SEQ ID NO: 2346904 - RNA, 15 nt, Bordetella pertussis
cgccgcugccgggcu

SEQ ID NO: 2346905 - RNA, 23 nt, Bordetella pertussis
cgccgcugcgaaaaagcccgcgc

SEQ ID NO: 2346906 - RNA, 14 nt, Bordetella pertussis
cgccgcugcgcagc

SEQ ID NO: 2346907 - RNA, 15 nt, Bordetella pertussis
cgccgcugcgcagca

SEQ ID NO: 2346908 - RNA, 19 nt, Bordetella pertussis
cgccgcuggacagauccag

SEQ ID NO: 2346909 - RNA, 22 nt, Bordetella pertussis
cgccgcuggacagauccagcgc

SEQ ID NO: 2346910 - RNA, 23 nt, Bordetella pertussis
cgccgcuggccacguugucgcgc

SEQ ID NO: 2346911 - RNA, 13 nt, Bordetella pertussis
cgccgcuggccag

SEQ ID NO: 2346912 - RNA, 13 nt, Bordetella pertussis
cgccgcuggcggc

SEQ ID NO: 2346913 - RNA, 18 nt, Bordetella pertussis
cgccgcuggcggccgcgg

SEQ ID NO: 2346914 - RNA, 20 nt, Bordetella pertussis
cgccgcuggcggccgcgggc

SEQ ID NO: 2346915 - RNA, 17 nt, Bordetella pertussis
cgccgcuggcguccagg

SEQ ID NO: 2346916 - RNA, 16 nt, Bordetella pertussis
cgccgcugucgaccuc

SEQ ID NO: 2346917 - RNA, 17 nt, Bordetella pertussis
cgccgcugucgaccucg

SEQ ID NO: 2346918 - RNA, 14 nt, Bordetella pertussis
cgccgcugucgcug

SEQ ID NO: 2346919 - RNA, 16 nt, Bordetella pertussis
cgccgcuguggacgcc

SEQ ID NO: 2346920 - RNA, 17 nt, Bordetella pertussis
cgccgcuguggacgccg

SEQ ID NO: 2346921 - RNA, 20 nt, Bordetella pertussis
cgccgcuguugcccaccagc

SEQ ID NO: 2346922 - RNA, 16 nt, Bordetella pertussis
cgccgcuuccaccguc

SEQ ID NO: 2346923 - RNA, 22 nt, Bordetella pertussis
cgccgcuuccggcaugaccgcg

SEQ ID NO: 2346924 - RNA, 22 nt, Bordetella pertussis
cgccgcuuucagcacauccgac

SEQ ID NO: 2346925 - RNA, 22 nt, Bordetella pertussis
cgccggacacguacaaccgcgc

SEQ ID NO: 2346926 - RNA, 14 nt, Bordetella pertussis
cgccggacagcugc

SEQ ID NO: 2346927 - RNA, 13 nt, Bordetella pertussis
cgccggaccaguc

SEQ ID NO: 2346928 - RNA, 23 nt, Bordetella pertussis
cgccggacgcaaaaacgcccggc

SEQ ID NO: 2346929 - RNA, 18 nt, Bordetella pertussis
cgccggacggcgccuuga

SEQ ID NO: 2346930 - RNA, 21 nt, Bordetella pertussis
cgccggacguagucgcacgcg

SEQ ID NO: 2346931 - RNA, 22 nt, Bordetella pertussis
cgccggacguagucgcacgcgg

SEQ ID NO: 2346932 - RNA, 17 nt, Bordetella pertussis
cgccggaggcgcgcagc

SEQ ID NO: 2346933 - RNA, 13 nt, Bordetella pertussis
cgccggaucggcc

SEQ ID NO: 2346934 - RNA, 15 nt, Bordetella pertussis
cgccggaucggccgg

SEQ ID NO: 2346935 - RNA, 17 nt, Bordetella pertussis
cgccggaucggccggca

SEQ ID NO: 2346936 - RNA, 14 nt, Bordetella pertussis
cgccggaugcgcgu

SEQ ID NO: 2346937 - RNA, 12 nt, Bordetella pertussis
cgccggcaaacc

SEQ ID NO: 2346938 - RNA, 14 nt, Bordetella pertussis
cgccggcaccagcg

SEQ ID NO: 2346939 - RNA, 15 nt, Bordetella pertussis
cgccggcaccagcgc

SEQ ID NO: 2346940 - RNA, 17 nt, Bordetella pertussis
cgccggcaccagcgcca

SEQ ID NO: 2346941 - RNA, 19 nt, Bordetella pertussis
cgccggcaccagcgccacg

SEQ ID NO: 2346942 - RNA, 14 nt, Bordetella pertussis
cgccggcacccggc

SEQ ID NO: 2346943 - RNA, 17 nt, Bordetella pertussis
cgccggcacgacgaucg

SEQ ID NO: 2346944 - RNA, 12 nt, Bordetella pertussis
cgccggcacgcg

SEQ ID NO: 2346945 - RNA, 14 nt, Bordetella pertussis
cgccggcacgcgcg

SEQ ID NO: 2346946 - RNA, 16 nt, Bordetella pertussis
cgccggcacgcgcggu

SEQ ID NO: 2346947 - RNA, 15 nt, Bordetella pertussis
cgccgccucaggccg

SEQ ID NO: 2346948 - RNA, 20 nt, Bordetella pertussis
cgccgccucaggccggcgcc

SEQ ID NO: 2346949 - RNA, 14 nt, Bordetella pertussis
cgccgccucgcgcu

SEQ ID NO: 2346950 - RNA, 14 nt, Bordetella pertussis
cgccgccucgggca

SEQ ID NO: 2346951 - RNA, 18 nt, Bordetella pertussis
cgccgccucgggcacggc

SEQ ID NO: 2346952 - RNA, 12 nt, Bordetella pertussis
cgccgccugcgc

SEQ ID NO: 2346953 - RNA, 13 nt, Bordetella pertussis
cgccgccugcgca

SEQ ID NO: 2346954 - RNA, 16 nt, Bordetella pertussis
cgccgccugcgcgaaa

SEQ ID NO: 2346955 - RNA, 13 nt, Bordetella pertussis
cgccgccugcggc

SEQ ID NO: 2346956 - RNA, 15 nt, Bordetella pertussis
cgccgccugcggcgc

SEQ ID NO: 2346957 - RNA, 14 nt, Bordetella pertussis
cgccgccuggcccg

SEQ ID NO: 2346958 - RNA, 17 nt, Bordetella pertussis
cgccgccuggcccgaac

SEQ ID NO: 2346959 - RNA, 22 nt, Bordetella pertussis
cgccgccuggcuuacaggccca

SEQ ID NO: 2346960 - RNA, 18 nt, Bordetella pertussis
cgccgccuuggacgcgcu

SEQ ID NO: 2346961 - RNA, 21 nt, Bordetella pertussis
cgccgcgacacaaggcggccg

SEQ ID NO: 2346962 - RNA, 23 nt, Bordetella pertussis
cgccgcgacacaaggcggccgcg

SEQ ID NO: 2346963 - RNA, 20 nt, Bordetella pertussis
cgccgcgaccaccagcacca

SEQ ID NO: 2346964 - RNA, 21 nt, Bordetella pertussis
cgccgcgaccaccagcaccau

SEQ ID NO: 2346965 - RNA, 12 nt, Bordetella pertussis
cgccgcgaccgg

SEQ ID NO: 2346966 - RNA, 14 nt, Bordetella pertussis
cgccgcgaccgggc

SEQ ID NO: 2346967 - RNA, 14 nt, Bordetella pertussis
cgccgcgagcgccg

SEQ ID NO: 2346968 - RNA, 15 nt, Bordetella pertussis
cgccgcgagcgccga

SEQ ID NO: 2346969 - RNA, 22 nt, Bordetella pertussis
cgccgcgaucagcgcggccgcu

SEQ ID NO: 2346970 - RNA, 14 nt, Bordetella pertussis
cgccgcgauggcgc

SEQ ID NO: 2346971 - RNA, 16 nt, Bordetella pertussis
cgccgcgauggcgccg

SEQ ID NO: 2346972 - RNA, 19 nt, Bordetella pertussis
cgccgcgauggcgccggcc

SEQ ID NO: 2346973 - RNA, 13 nt, Bordetella pertussis
cgccgcgauugca

SEQ ID NO: 2346974 - RNA, 17 nt, Bordetella pertussis
cgccgcgauugcaggug

SEQ ID NO: 2346975 - RNA, 14 nt, Bordetella pertussis
cgccgcgcacagcc

SEQ ID NO: 2346976 - RNA, 11 nt, Bordetella pertussis
cgccgcgcacg

SEQ ID NO: 2346977 - RNA, 15 nt, Bordetella pertussis
cgccgcgcacgaugg

SEQ ID NO: 2346978 - RNA, 23 nt, Bordetella pertussis
cgccgcgcacgauggggcagcca

SEQ ID NO: 2346979 - RNA, 13 nt, Bordetella pertussis
cgccgcgcacggg

SEQ ID NO: 2346980 - RNA, 15 nt, Bordetella pertussis
cgccgcgcacgggcg

SEQ ID NO: 2346981 - RNA, 17 nt, Bordetella pertussis
cgccgcgcacgggcgcc

SEQ ID NO: 2346982 - RNA, 20 nt, Bordetella pertussis
cgccgcgcagaaaccgccac

SEQ ID NO: 2346983 - RNA, 21 nt, Bordetella pertussis
cgccgcgcagaaaccgccaca

SEQ ID NO: 2346984 - RNA, 12 nt, Bordetella pertussis
cgccgcgcagcc

SEQ ID NO: 2346985 - RNA, 13 nt, Bordetella pertussis
cgccgcgccagcu

SEQ ID NO: 2346986 - RNA, 14 nt, Bordetella pertussis
cgccgcgccagcug

SEQ ID NO: 2346987 - RNA, 15 nt, Bordetella pertussis
cgccgcgccagcugc

SEQ ID NO: 2346988 - RNA, 16 nt, Bordetella pertussis
cgccgcgccaggcauu

SEQ ID NO: 2346989 - RNA, 13 nt, Bordetella pertussis
cgccgcgccaggu

SEQ ID NO: 2346990 - RNA, 16 nt, Bordetella pertussis
cgccgcgcccagcagc

SEQ ID NO: 2346991 - RNA, 18 nt, Bordetella pertussis
cgccgcgcccagcagcgc

SEQ ID NO: 2346992 - RNA, 20 nt, Bordetella pertussis
cgccgcgcccagcagcgcca

SEQ ID NO: 2346993 - RNA, 14 nt, Bordetella pertussis
cgccgcgcccagcc

SEQ ID NO: 2346994 - RNA, 15 nt, Bordetella pertussis
cgccgcgcccagccg

SEQ ID NO: 2346995 - RNA, 16 nt, Bordetella pertussis
cgccgcgcccagccgc

SEQ ID NO: 2346996 - RNA, 12 nt, Bordetella pertussis
cgccgcgcccca

SEQ ID NO: 2346997 - RNA, 12 nt, Bordetella pertussis
cgccgcgcccgc

SEQ ID NO: 2346998 - RNA, 15 nt, Bordetella pertussis
cgccgcgcccgcccc

SEQ ID NO: 2346999 - RNA, 17 nt, Bordetella pertussis
cgccgcgcccgcccccu

SEQ ID NO: 2347000 - RNA, 15 nt, Bordetella pertussis
cgccgcgcccgcggg

SEQ ID NO: 2347001 - RNA, 15 nt, Bordetella pertussis
cgccgcgcccggccg

SEQ ID NO: 2347002 - RNA, 17 nt, Bordetella pertussis
cgccgcgcccggccggc

SEQ ID NO: 2347003 - RNA, 19 nt, Bordetella pertussis
cgccgcgcccggccggccc

SEQ ID NO: 2347004 - RNA, 13 nt, Bordetella pertussis
cgccgcgcccugg

SEQ ID NO: 2347005 - RNA, 13 nt, Bordetella pertussis
cgccgcgccgaag

SEQ ID NO: 2347006 - RNA, 13 nt, Bordetella pertussis
cgccgcgccgccc

SEQ ID NO: 2347007 - RNA, 16 nt, Bordetella pertussis
cgccgcgccgccgccu

SEQ ID NO: 2347008 - RNA, 14 nt, Bordetella pertussis
cgccgcgccgcugg

SEQ ID NO: 2347009 - RNA, 15 nt, Bordetella pertussis
cgccgcgccgcuggc

SEQ ID NO: 2347010 - RNA, 14 nt, Bordetella pertussis
cgccgcgccggcgc

SEQ ID NO: 2347011 - RNA, 15 nt, Bordetella pertussis
cgccgcgccggcgcg

SEQ ID NO: 2347012 - RNA, 16 nt, Bordetella pertussis
cgccgcgccggucagg

SEQ ID NO: 2347013 - RNA, 13 nt, Bordetella pertussis
cgccgcgccggug

SEQ ID NO: 2347014 - RNA, 17 nt, Bordetella pertussis
cgccgcgccgguggcca

SEQ ID NO: 2347015 - RNA, 21 nt, Bordetella pertussis
cgccgcgccguacagggccgc

SEQ ID NO: 2347016 - RNA, 23 nt, Bordetella pertussis
cgccgcgccguacagggccgcga

SEQ ID NO: 2347017 - RNA, 21 nt, Bordetella pertussis
cgccgcgccuucgaggccggc

SEQ ID NO: 2347018 - RNA, 19 nt, Bordetella pertussis
cgccgcgcgacagccgcgc

SEQ ID NO: 2347019 - RNA, 23 nt, Bordetella pertussis
cgccgcgcgacagccgcgccagc

SEQ ID NO: 2347020 - RNA, 18 nt, Bordetella pertussis
cgccgcgcgcacggcgcc

SEQ ID NO: 2347021 - RNA, 11 nt, Bordetella pertussis
cgccgcgcgcc

SEQ ID NO: 2347022 - RNA, 12 nt, Bordetella pertussis
cgccgcgcgccg

SEQ ID NO: 2347023 - RNA, 18 nt, Bordetella pertussis
cgccgcgcgccgcggccu

SEQ ID NO: 2347024 - RNA, 14 nt, Bordetella pertussis
cgccgcgcgcgacg

SEQ ID NO: 2347025 - RNA, 16 nt, Bordetella pertussis
cgccgcgcgcgacgcg

SEQ ID NO: 2347026 - RNA, 14 nt, Bordetella pertussis
cgccgcgcgcggca

SEQ ID NO: 2347027 - RNA, 15 nt, Bordetella pertussis
cgccgcgcgcggccc

SEQ ID NO: 2347028 - RNA, 16 nt, Bordetella pertussis
cgccgcgcgcggcccc

SEQ ID NO: 2347029 - RNA, 19 nt, Bordetella pertussis
cgccgcgcgcggccccggc

SEQ ID NO: 2347030 - RNA, 20 nt, Bordetella pertussis
cgccgcgcgcgucgccgcug

SEQ ID NO: 2347031 - RNA, 21 nt, Bordetella pertussis
cgccgcgcgcgucgccgcugg

SEQ ID NO: 2347032 - RNA, 13 nt, Bordetella pertussis
cgccgcgcgcugg

SEQ ID NO: 2347033 - RNA, 22 nt, Bordetella pertussis
cgccgcgcggcgaggcguccag

SEQ ID NO: 2347034 - RNA, 13 nt, Bordetella pertussis
cgccgcgcggucg

SEQ ID NO: 2347035 - RNA, 18 nt, Bordetella pertussis
cgccgcgcggugcucggc

SEQ ID NO: 2347036 - RNA, 17 nt, Bordetella pertussis
cgccgcgcgugcugacg

SEQ ID NO: 2347037 - RNA, 17 nt, Bordetella pertussis
cgccgcgcucagcacca

SEQ ID NO: 2347038 - RNA, 17 nt, Bordetella pertussis
cgccgcgcucgcgccag

SEQ ID NO: 2347039 - RNA, 18 nt, Bordetella pertussis
cgccgcgcucgcgccagg

SEQ ID NO: 2347040 - RNA, 21 nt, Bordetella pertussis
cgccgcgcucgcgccaggccc

SEQ ID NO: 2347041 - RNA, 13 nt, Bordetella pertussis
cgccgcgcucggc

SEQ ID NO: 2347042 - RNA, 15 nt, Bordetella pertussis
cgccgcgcugccuga

SEQ ID NO: 2347043 - RNA, 14 nt, Bordetella pertussis
cgccgcgcugugcg

SEQ ID NO: 2347044 - RNA, 18 nt, Bordetella pertussis
cgccgcgcuucgucggcg

SEQ ID NO: 2347045 - RNA, 13 nt, Bordetella pertussis
cgccgcggaucgu

SEQ ID NO: 2347046 - RNA, 13 nt, Bordetella pertussis
cgccgcggcaggc

SEQ ID NO: 2347047 - RNA, 15 nt, Bordetella pertussis
cgccgcggcaggccc

SEQ ID NO: 2347048 - RNA, 18 nt, Bordetella pertussis
cgccgcggcaggccccgg

SEQ ID NO: 2347049 - RNA, 22 nt, Bordetella pertussis
cgccgcggcaggccccggcccg

SEQ ID NO: 2347050 - RNA, 23 nt, Bordetella pertussis
cgccgcggcaggccccggcccgg

SEQ ID NO: 2347051 - RNA, 14 nt, Bordetella pertussis
cgccgcggccacgc

SEQ ID NO: 2347052 - RNA, 14 nt, Bordetella pertussis
cgccgcggccagcg

SEQ ID NO: 2347053 - RNA, 17 nt, Bordetella pertussis
cgccgcggccagcgccg

SEQ ID NO: 2347054 - RNA, 21 nt, Bordetella pertussis
cgccgcggccagcgccgcgcc

SEQ ID NO: 2347055 - RNA, 22 nt, Bordetella pertussis
cgccgcggccagcgccgcgccg

SEQ ID NO: 2347056 - RNA, 14 nt, Bordetella pertussis
cgccgcggccggcg

SEQ ID NO: 2347057 - RNA, 15 nt, Bordetella pertussis
cgccgcggccggcgg

SEQ ID NO: 2347058 - RNA, 20 nt, Bordetella pertussis
cgccgcggccggcggcgccg

SEQ ID NO: 2347059 - RNA, 13 nt, Bordetella pertussis
cgccgcggccggg

SEQ ID NO: 2347060 - RNA, 17 nt, Bordetella pertussis
cgccgcggccucggccg

SEQ ID NO: 2347061 - RNA, 13 nt, Bordetella pertussis
cgccgcggccugg

SEQ ID NO: 2347062 - RNA, 14 nt, Bordetella pertussis
cgccgcggccuggc

SEQ ID NO: 2347063 - RNA, 15 nt, Bordetella pertussis
cgccgcggccuggcc

SEQ ID NO: 2347064 - RNA, 23 nt, Bordetella pertussis
cgccggcacgcugaucgccggcg

SEQ ID NO: 2347065 - RNA, 12 nt, Bordetella pertussis
cgccggcagcgc

SEQ ID NO: 2347066 - RNA, 13 nt, Bordetella pertussis
cgccggcagcgca

SEQ ID NO: 2347067 - RNA, 14 nt, Bordetella pertussis
cgccggcaggcgcg

SEQ ID NO: 2347068 - RNA, 19 nt, Bordetella pertussis
cgccggcaggcgcgccagc

SEQ ID NO: 2347069 - RNA, 21 nt, Bordetella pertussis
cgccggcaggcgcgccagccc

SEQ ID NO: 2347070 - RNA, 14 nt, Bordetella pertussis
cgccggcagggcca

SEQ ID NO: 2347071 - RNA, 18 nt, Bordetella pertussis
cgccggcagggccagcgc

SEQ ID NO: 2347072 - RNA, 22 nt, Bordetella pertussis
cgccggcagggccagcgccagc

SEQ ID NO: 2347073 - RNA, 23 nt, Bordetella pertussis
cgccggcagggccagcgccagca

SEQ ID NO: 2347074 - RNA, 16 nt, Bordetella pertussis
cgccggcagggcggcc

SEQ ID NO: 2347075 - RNA, 17 nt, Bordetella pertussis
cgccggcagggcggcca

SEQ ID NO: 2347076 - RNA, 19 nt, Bordetella pertussis
cgccggcagggcggccagg

SEQ ID NO: 2347077 - RNA, 23 nt, Bordetella pertussis
cgccggcagggcggccaggccgg

SEQ ID NO: 2347078 - RNA, 19 nt, Bordetella pertussis
cgccggcagggugcuguuc

SEQ ID NO: 2347079 - RNA, 15 nt, Bordetella pertussis
cgccggcagugccug

SEQ ID NO: 2347080 - RNA, 13 nt, Bordetella pertussis
cgccggcaucggc

SEQ ID NO: 2347081 - RNA, 17 nt, Bordetella pertussis
cgccggcaucggcggcu

SEQ ID NO: 2347082 - RNA, 20 nt, Bordetella pertussis
cgccggcaugaagcgcagca

SEQ ID NO: 2347083 - RNA, 18 nt, Bordetella pertussis
cgccggcauggccaaugc

SEQ ID NO: 2347084 - RNA, 19 nt, Bordetella pertussis
cgccggcauuucgcugggc

SEQ ID NO: 2347085 - RNA, 20 nt, Bordetella pertussis
cgccggcauuucgcugggcg

SEQ ID NO: 2347086 - RNA, 21 nt, Bordetella pertussis
cgccggcauuucgcugggcgc

SEQ ID NO: 2347087 - RNA, 14 nt, Bordetella pertussis
cgccggccaccagc

SEQ ID NO: 2347088 - RNA, 18 nt, Bordetella pertussis
cgccggccaccagcggcg

SEQ ID NO: 2347089 - RNA, 19 nt, Bordetella pertussis
cgccggccaccagcggcgc

SEQ ID NO: 2347090 - RNA, 22 nt, Bordetella pertussis
cgccggccaccagcggcgccgg

SEQ ID NO: 2347091 - RNA, 15 nt, Bordetella pertussis
cgccggccacgaacg

SEQ ID NO: 2347092 - RNA, 16 nt, Bordetella pertussis
cgccggccacgaacgg

SEQ ID NO: 2347093 - RNA, 14 nt, Bordetella pertussis
cgccggccagccug

SEQ ID NO: 2347094 - RNA, 15 nt, Bordetella pertussis
cgccggccagccugu

SEQ ID NO: 2347095 - RNA, 12 nt, Bordetella pertussis
cgccggccagcg

SEQ ID NO: 2347096 - RNA, 16 nt, Bordetella pertussis
cgccggccagcgccag

SEQ ID NO: 2347097 - RNA, 15 nt, Bordetella pertussis
cgccggccagcgcgc

SEQ ID NO: 2347098 - RNA, 17 nt, Bordetella pertussis
cgccggccagcgcggca

SEQ ID NO: 2347099 - RNA, 18 nt, Bordetella pertussis
cgccggccagcgcggcau

SEQ ID NO: 2347100 - RNA, 15 nt, Bordetella pertussis
cgccggccagcggca

SEQ ID NO: 2347101 - RNA, 17 nt, Bordetella pertussis
cgccggccagcggcagg

SEQ ID NO: 2347102 - RNA, 13 nt, Bordetella pertussis
cgccggccagcug

SEQ ID NO: 2347103 - RNA, 14 nt, Bordetella pertussis
cgccggccagcugc

SEQ ID NO: 2347104 - RNA, 21 nt, Bordetella pertussis
cgccggccagcugcaugcgca

SEQ ID NO: 2347105 - RNA, 22 nt, Bordetella pertussis
cgccggccagcugcaugcgcac

SEQ ID NO: 2347106 - RNA, 11 nt, Bordetella pertussis
cgccggccagg

SEQ ID NO: 2347107 - RNA, 15 nt, Bordetella pertussis
cgccggccaggauga

SEQ ID NO: 2347108 - RNA, 21 nt, Bordetella pertussis
cgccggccaggaugagggcga

SEQ ID NO: 2347109 - RNA, 12 nt, Bordetella pertussis
cgccggccaggc

SEQ ID NO: 2347110 - RNA, 14 nt, Bordetella pertussis
cgccggccaggccc

SEQ ID NO: 2347111 - RNA, 19 nt, Bordetella pertussis
cgccggccagggccaccac

SEQ ID NO: 2347112 - RNA, 22 nt, Bordetella pertussis
cgccggccagggccaccacgcc

SEQ ID NO: 2347113 - RNA, 23 nt, Bordetella pertussis
cgccggccagggcgaugcggcgg

SEQ ID NO: 2347114 - RNA, 20 nt, Bordetella pertussis
cgccggccaggucggcggcc

SEQ ID NO: 2347115 - RNA, 17 nt, Bordetella pertussis
cgccggccaguggcgcg

SEQ ID NO: 2347116 - RNA, 19 nt, Bordetella pertussis
cgccggccaguggcgcggc

SEQ ID NO: 2347117 - RNA, 13 nt, Bordetella pertussis
cgccggccaucac

SEQ ID NO: 2347118 - RNA, 16 nt, Bordetella pertussis
cgccggccaucacgcc

SEQ ID NO: 2347119 - RNA, 18 nt, Bordetella pertussis
cgccggccaucaggugca

SEQ ID NO: 2347120 - RNA, 18 nt, Bordetella pertussis
cgccggccauggcggccg

SEQ ID NO: 2347121 - RNA, 21 nt, Bordetella pertussis
cgccggcccaaggccccgcga

SEQ ID NO: 2347122 - RNA, 23 nt, Bordetella pertussis
cgccggcccaggauggcgccagc

SEQ ID NO: 2347123 - RNA, 18 nt, Bordetella pertussis
cgccggcccaggcgcgcu

SEQ ID NO: 2347124 - RNA, 21 nt, Bordetella pertussis
cgccggcccaggcgcgcuggc

SEQ ID NO: 2347125 - RNA, 11 nt, Bordetella pertussis
cgccggcccgc

SEQ ID NO: 2347126 - RNA, 23 nt, Bordetella pertussis
cgccggcccgccacgcgggccgg

SEQ ID NO: 2347127 - RNA, 17 nt, Bordetella pertussis
cgccggcccugccgccc

SEQ ID NO: 2347128 - RNA, 16 nt, Bordetella pertussis
cgccggccgacggcgc

SEQ ID NO: 2347129 - RNA, 20 nt, Bordetella pertussis
cgccggccgacggcgcuggc

SEQ ID NO: 2347130 - RNA, 22 nt, Bordetella pertussis
cgccggccgacggcgcuggcga

SEQ ID NO: 2347131 - RNA, 11 nt, Bordetella pertussis
cgccggccgcc

SEQ ID NO: 2347132 - RNA, 15 nt, Bordetella pertussis
cgccggccgccagca

SEQ ID NO: 2347133 - RNA, 19 nt, Bordetella pertussis
cgccggccgccauggccgg

SEQ ID NO: 2347134 - RNA, 14 nt, Bordetella pertussis
cgccggccgcccgc

SEQ ID NO: 2347135 - RNA, 14 nt, Bordetella pertussis
cgccggccgccugg

SEQ ID NO: 2347136 - RNA, 17 nt, Bordetella pertussis
cgccggccgccuggccc

SEQ ID NO: 2347137 - RNA, 14 nt, Bordetella pertussis
cgccggccgcgccc

SEQ ID NO: 2347138 - RNA, 13 nt, Bordetella pertussis
cgccggccgcgcg

SEQ ID NO: 2347139 - RNA, 15 nt, Bordetella pertussis
cgccggccgcgcgcg

SEQ ID NO: 2347140 - RNA, 20 nt, Bordetella pertussis
cgccggccgcgcgcgccaug

SEQ ID NO: 2347141 - RNA, 23 nt, Bordetella pertussis
cgccggccggggucuugccgcgc

SEQ ID NO: 2347142 - RNA, 12 nt, Bordetella pertussis
cgccggccggug

SEQ ID NO: 2347143 - RNA, 14 nt, Bordetella pertussis
cgccggccggugca

SEQ ID NO: 2347144 - RNA, 22 nt, Bordetella pertussis
cgccggccggugcaucggccgg

SEQ ID NO: 2347145 - RNA, 14 nt, Bordetella pertussis
cgccggccgguggg

SEQ ID NO: 2347146 - RNA, 15 nt, Bordetella pertussis
cgccggccuccagca

SEQ ID NO: 2347147 - RNA, 22 nt, Bordetella pertussis
cgccggccucuucgucgccggc

SEQ ID NO: 2347148 - RNA, 12 nt, Bordetella pertussis
cgccggccugac

SEQ ID NO: 2347149 - RNA, 15 nt, Bordetella pertussis
cgccggccugacgcg

SEQ ID NO: 2347150 - RNA, 16 nt, Bordetella pertussis
cgccggccugacgcgc

SEQ ID NO: 2347151 - RNA, 13 nt, Bordetella pertussis
cgccggccugcgc

SEQ ID NO: 2347152 - RNA, 15 nt, Bordetella pertussis
cgccggccugcgcca

SEQ ID NO: 2347153 - RNA, 18 nt, Bordetella pertussis
cgccggccugcgccagcu

SEQ ID NO: 2347154 - RNA, 22 nt, Bordetella pertussis
cgccggccugcucgccggccag

SEQ ID NO: 2347155 - RNA, 23 nt, Bordetella pertussis
cgccggccugcucgccggccagc

SEQ ID NO: 2347156 - RNA, 14 nt, Bordetella pertussis
cgccggccuggcgc

SEQ ID NO: 2347157 - RNA, 15 nt, Bordetella pertussis
cgccggccuggcgcg

SEQ ID NO: 2347158 - RNA, 23 nt, Bordetella pertussis
cgccggccuggcgcgacgccugc

SEQ ID NO: 2347159 - RNA, 16 nt, Bordetella pertussis
cgccggccuggcgcgc

SEQ ID NO: 2347160 - RNA, 15 nt, Bordetella pertussis
cgccggccugggcgg

SEQ ID NO: 2347161 - RNA, 14 nt, Bordetella pertussis
cgccggccuugcug

SEQ ID NO: 2347162 - RNA, 19 nt, Bordetella pertussis
cgccggcgaaugccggccg

SEQ ID NO: 2347163 - RNA, 20 nt, Bordetella pertussis
cgccggcgaaugccggccga

SEQ ID NO: 2347164 - RNA, 14 nt, Bordetella pertussis
cgccggcgacgccg

SEQ ID NO: 2347165 - RNA, 23 nt, Bordetella pertussis
cgccggcgagacgucggcgaugg

SEQ ID NO: 2347166 - RNA, 19 nt, Bordetella pertussis
cgccggcgauauggccagg

SEQ ID NO: 2347167 - RNA, 20 nt, Bordetella pertussis
cgccggcgauauggccaggg

SEQ ID NO: 2347168 - RNA, 14 nt, Bordetella pertussis
cgccggcgauggcg

SEQ ID NO: 2347169 - RNA, 16 nt, Bordetella pertussis
cgccggcgcaacgggc

SEQ ID NO: 2347170 - RNA, 19 nt, Bordetella pertussis
cgccggcgcaugagccggc

SEQ ID NO: 2347171 - RNA, 22 nt, Bordetella pertussis
cgccggcgcaugagccggcaga

SEQ ID NO: 2347172 - RNA, 13 nt, Bordetella pertussis
cgccggcgccccc

SEQ ID NO: 2347173 - RNA, 16 nt, Bordetella pertussis
cgccggcgcccccagc

SEQ ID NO: 2347174 - RNA, 14 nt, Bordetella pertussis
cgccggcgcccggc

SEQ ID NO: 2347175 - RNA, 14 nt, Bordetella pertussis
cgccggcgccgccc

SEQ ID NO: 2347176 - RNA, 15 nt, Bordetella pertussis
cgccggcgccggcga

SEQ ID NO: 2347177 - RNA, 16 nt, Bordetella pertussis
cgccggcgccggcgac

SEQ ID NO: 2347178 - RNA, 18 nt, Bordetella pertussis
cgccggcgccggcgacgc

SEQ ID NO: 2347179 - RNA, 19 nt, Bordetella pertussis
cgccggcgccuuggccugg

SEQ ID NO: 2347180 - RNA, 13 nt, Bordetella pertussis
cgccggcgcgcag

SEQ ID NO: 2347181 - RNA, 13 nt, Bordetella pertussis
cgccggcgcgccg

SEQ ID NO: 2347182 - RNA, 14 nt, Bordetella pertussis
cgccggcgcgccgc

SEQ ID NO: 2347183 - RNA, 15 nt, Bordetella pertussis
cgccggcgcgccgcc

SEQ ID NO: 2347184 - RNA, 16 nt, Bordetella pertussis
cgccggcgcgccgccc

SEQ ID NO: 2347185 - RNA, 18 nt, Bordetella pertussis
cgccggcgcgccgcccgc

SEQ ID NO: 2347186 - RNA, 18 nt, Bordetella pertussis
cgccggcgcgccggccgc

SEQ ID NO: 2347187 - RNA, 12 nt, Bordetella pertussis
cgccggcgcgcg

SEQ ID NO: 2347188 - RNA, 16 nt, Bordetella pertussis
cgccggcgcgcgaucu

SEQ ID NO: 2347189 - RNA, 19 nt, Bordetella pertussis
cgccggcgcgcgcgcgccg

SEQ ID NO: 2347190 - RNA, 20 nt, Bordetella pertussis
cgccggcgcgcgcgcgccgc

SEQ ID NO: 2347191 - RNA, 21 nt, Bordetella pertussis
cgccggcgcgcgcgcgccgca

SEQ ID NO: 2347192 - RNA, 22 nt, Bordetella pertussis
cgccggcgcgcggaugaucgcg

SEQ ID NO: 2347193 - RNA, 12 nt, Bordetella pertussis
cgccggcgcggc

SEQ ID NO: 2347194 - RNA, 23 nt, Bordetella pertussis
cgccggcgcgguggccaugcugg

SEQ ID NO: 2347195 - RNA, 22 nt, Bordetella pertussis
cgccggcgcguccacgccgugg

SEQ ID NO: 2347196 - RNA, 18 nt, Bordetella pertussis
cgccggcgcuacagggug

SEQ ID NO: 2347197 - RNA, 22 nt, Bordetella pertussis
cgccggcgcuacagggugccgc

SEQ ID NO: 2347198 - RNA, 17 nt, Bordetella pertussis
cgccggcgcucgcgcac

SEQ ID NO: 2347199 - RNA, 17 nt, Bordetella pertussis
cgccggcgcugcggucg

SEQ ID NO: 2347200 - RNA, 16 nt, Bordetella pertussis
cgccggcgcugcuguc

SEQ ID NO: 2347201 - RNA, 20 nt, Bordetella pertussis
cgccggcgcugcugucgcgc

SEQ ID NO: 2347202 - RNA, 21 nt, Bordetella pertussis
cgccggcgcugcugucgcgcg

SEQ ID NO: 2347203 - RNA, 20 nt, Bordetella pertussis
cgccggcggcaauaucggca

SEQ ID NO: 2347204 - RNA, 22 nt, Bordetella pertussis
cgccggcggcaauaucggcacc

SEQ ID NO: 2347205 - RNA, 13 nt, Bordetella pertussis
cgccggcggcacc

SEQ ID NO: 2347206 - RNA, 19 nt, Bordetella pertussis
cgccggcggcaccgcgcag

SEQ ID NO: 2347207 - RNA, 14 nt, Bordetella pertussis
cgccggcggccucc

SEQ ID NO: 2347208 - RNA, 15 nt, Bordetella pertussis
cgccggcggccuccg

SEQ ID NO: 2347209 - RNA, 18 nt, Bordetella pertussis
cgccggcggccuccgcgc

SEQ ID NO: 2347210 - RNA, 18 nt, Bordetella pertussis
cgccggcggccugcaggc

SEQ ID NO: 2347211 - RNA, 15 nt, Bordetella pertussis
cgccggcggccugga

SEQ ID NO: 2347212 - RNA, 22 nt, Bordetella pertussis
cgccggcggccuggaccugagc

SEQ ID NO: 2347213 - RNA, 15 nt, Bordetella pertussis
cgccggcggcgcacc

SEQ ID NO: 2347214 - RNA, 17 nt, Bordetella pertussis
cgccggcggcgcaccaa

SEQ ID NO: 2347215 - RNA, 14 nt, Bordetella pertussis
cgccggcggcgccg

SEQ ID NO: 2347216 - RNA, 17 nt, Bordetella pertussis
cgccggcggcgccggcc

SEQ ID NO: 2347217 - RNA, 13 nt, Bordetella pertussis
cgccggcggcgcg

SEQ ID NO: 2347218 - RNA, 14 nt, Bordetella pertussis
cgccggcggcgcgg

SEQ ID NO: 2347219 - RNA, 21 nt, Bordetella pertussis
cgccggcggcgcggaugaucu

SEQ ID NO: 2347220 - RNA, 13 nt, Bordetella pertussis
cgccggcggcgcu

SEQ ID NO: 2347221 - RNA, 15 nt, Bordetella pertussis
cgccggcggcgcugg

SEQ ID NO: 2347222 - RNA, 22 nt, Bordetella pertussis
cgccggcggcgugcgccugcug

SEQ ID NO: 2347223 - RNA, 14 nt, Bordetella pertussis
cgccggcggcgugg

SEQ ID NO: 2347224 - RNA, 16 nt, Bordetella pertussis
cgccggcggcguggcc

SEQ ID NO: 2347225 - RNA, 13 nt, Bordetella pertussis
cgccggcgggcag

SEQ ID NO: 2347226 - RNA, 15 nt, Bordetella pertussis
cgccggcgggcaggc

SEQ ID NO: 2347227 - RNA, 18 nt, Bordetella pertussis
cgccggcgggcaggcggg

SEQ ID NO: 2347228 - RNA, 22 nt, Bordetella pertussis
cgccggcgggcgcugccugccg

SEQ ID NO: 2347229 - RNA, 21 nt, Bordetella pertussis
cgccggcgguaagcguccgcg

SEQ ID NO: 2347230 - RNA, 14 nt, Bordetella pertussis
cgccggcggucacg

SEQ ID NO: 2347231 - RNA, 21 nt, Bordetella pertussis
cgccggcggucacgccgauga

SEQ ID NO: 2347232 - RNA, 17 nt, Bordetella pertussis
cgccggcgucacgcggc

SEQ ID NO: 2347233 - RNA, 20 nt, Bordetella pertussis
cgccggcgucacgcggccgg

SEQ ID NO: 2347234 - RNA, 22 nt, Bordetella pertussis
cgccggcgucacgcggccgggc

SEQ ID NO: 2347235 - RNA, 22 nt, Bordetella pertussis
cgccggcguccacggcaucggc

SEQ ID NO: 2347236 - RNA, 16 nt, Bordetella pertussis
cgccggcgucgcucag

SEQ ID NO: 2347237 - RNA, 15 nt, Bordetella pertussis
cgccggcuaccgcgc

SEQ ID NO: 2347238 - RNA, 16 nt, Bordetella pertussis
cgccggcucaggccag

SEQ ID NO: 2347239 - RNA, 18 nt, Bordetella pertussis
cgccggcucaggccagcg

SEQ ID NO: 2347240 - RNA, 20 nt, Bordetella pertussis
cgccggcucguacggcgucg

SEQ ID NO: 2347241 - RNA, 21 nt, Bordetella pertussis
cgccggcugaauuggcgccca

SEQ ID NO: 2347242 - RNA, 18 nt, Bordetella pertussis
cgccggcuggcaugcggc

SEQ ID NO: 2347243 - RNA, 17 nt, Bordetella pertussis
cgccggcugggcguucu

SEQ ID NO: 2347244 - RNA, 17 nt, Bordetella pertussis
cgccggcuucagccgca

SEQ ID NO: 2347245 - RNA, 19 nt, Bordetella pertussis
cgccggcuucagccgcaag

SEQ ID NO: 2347246 - RNA, 16 nt, Bordetella pertussis
cgccggcuuccagcag

SEQ ID NO: 2347247 - RNA, 20 nt, Bordetella pertussis
cgccggcuuccagcagcaug

SEQ ID NO: 2347248 - RNA, 21 nt, Bordetella pertussis
cgccggcuucgucauggucga

SEQ ID NO: 2347249 - RNA, 23 nt, Bordetella pertussis
cgccggcuucgucauggucgacc

SEQ ID NO: 2347250 - RNA, 15 nt, Bordetella pertussis
cgccggcuugcgcca

SEQ ID NO: 2347251 - RNA, 18 nt, Bordetella pertussis
cgccggcuugcgccagcc

SEQ ID NO: 2347252 - RNA, 22 nt, Bordetella pertussis
cgccggcuuucagcgccgagcg

SEQ ID NO: 2347253 - RNA, 23 nt, Bordetella pertussis
cgccggcuuucagcgccgagcgc

SEQ ID NO: 2347254 - RNA, 21 nt, Bordetella pertussis
cgccgggaaaaagagccuguc

SEQ ID NO: 2347255 - RNA, 23 nt, Bordetella pertussis
cgccgggacacacgcucuugcgc

SEQ ID NO: 2347256 - RNA, 17 nt, Bordetella pertussis
cgccgggacaggcaccc

SEQ ID NO: 2347257 - RNA, 19 nt, Bordetella pertussis
cgccgggacaggcacccgc

SEQ ID NO: 2347258 - RNA, 17 nt, Bordetella pertussis
cgccgggcagcccgcgc

SEQ ID NO: 2347259 - RNA, 19 nt, Bordetella pertussis
cgccgggcagcccgcgcac

SEQ ID NO: 2347260 - RNA, 22 nt, Bordetella pertussis
cgccgggcagcccgcgcacgcc

SEQ ID NO: 2347261 - RNA, 17 nt, Bordetella pertussis
cgccgggcagcgggccg

SEQ ID NO: 2347262 - RNA, 19 nt, Bordetella pertussis
cgccgggcagcgggccgca

SEQ ID NO: 2347263 - RNA, 15 nt, Bordetella pertussis
cgccgggccaaggug

SEQ ID NO: 2347264 - RNA, 19 nt, Bordetella pertussis
cgccgggccaaggugccug

SEQ ID NO: 2347265 - RNA, 21 nt, Bordetella pertussis
cgccgggccaaggugccuguc

SEQ ID NO: 2347266 - RNA, 22 nt, Bordetella pertussis
cgccgggcccggccacggccgg

SEQ ID NO: 2347267 - RNA, 13 nt, Bordetella pertussis
cgccgggccgcgc

SEQ ID NO: 2347268 - RNA, 14 nt, Bordetella pertussis
cgccgggccgcgcc

SEQ ID NO: 2347269 - RNA, 15 nt, Bordetella pertussis
cgccgggccgcgccc

SEQ ID NO: 2347270 - RNA, 16 nt, Bordetella pertussis
cgccgggccgcgccca

SEQ ID NO: 2347271 - RNA, 13 nt, Bordetella pertussis
cgccgggccgcua

SEQ ID NO: 2347272 - RNA, 13 nt, Bordetella pertussis
cgccgggccggcg

SEQ ID NO: 2347273 - RNA, 14 nt, Bordetella pertussis
cgccgggccggcgg

SEQ ID NO: 2347274 - RNA, 15 nt, Bordetella pertussis
cgccgggccggcggg

SEQ ID NO: 2347275 - RNA, 22 nt, Bordetella pertussis
cgccgggccgucgugcgccugg

SEQ ID NO: 2347276 - RNA, 15 nt, Bordetella pertussis
cgccgggccgugcgc

SEQ ID NO: 2347277 - RNA, 17 nt, Bordetella pertussis
cgccgggccuagcccgg

SEQ ID NO: 2347278 - RNA, 18 nt, Bordetella pertussis
cgccgggccuagcccggc

SEQ ID NO: 2347279 - RNA, 20 nt, Bordetella pertussis
cgccgggccuagcccggcgc

SEQ ID NO: 2347280 - RNA, 22 nt, Bordetella pertussis
cgccgggccuagcccggcgcca

SEQ ID NO: 2347281 - RNA, 15 nt, Bordetella pertussis
cgccgggccugcccg

SEQ ID NO: 2347282 - RNA, 22 nt, Bordetella pertussis
cgccgggccugcccgcauccga

SEQ ID NO: 2347283 - RNA, 22 nt, Bordetella pertussis
cgccgggcgaaccgguggccau

SEQ ID NO: 2347284 - RNA, 16 nt, Bordetella pertussis
cgccgggcgacggcgu

SEQ ID NO: 2347285 - RNA, 17 nt, Bordetella pertussis
cgccgggcgacggcgug

SEQ ID NO: 2347286 - RNA, 15 nt, Bordetella pertussis
cgccgggcgccgcgc

SEQ ID NO: 2347287 - RNA, 16 nt, Bordetella pertussis
cgccgggcgccgcgcc

SEQ ID NO: 2347288 - RNA, 17 nt, Bordetella pertussis
cgccgggcgccgcgccc

SEQ ID NO: 2347289 - RNA, 12 nt, Bordetella pertussis
cgccgggcgcgc

SEQ ID NO: 2347290 - RNA, 13 nt, Bordetella pertussis
cgccgggcgcgcc

SEQ ID NO: 2347291 - RNA, 16 nt, Bordetella pertussis
cgccgggcgcgccggc

SEQ ID NO: 2347292 - RNA, 20 nt, Bordetella pertussis
cgccgggcgcgcgccggcgg

SEQ ID NO: 2347293 - RNA, 18 nt, Bordetella pertussis
cgccuauugcgacgccgc

SEQ ID NO: 2347294 - RNA, 20 nt, Bordetella pertussis
cgccuauuuccagggcgucg

SEQ ID NO: 2347295 - RNA, 19 nt, Bordetella pertussis
cgccucaaccuucucgaug

SEQ ID NO: 2347296 - RNA, 14 nt, Bordetella pertussis
cgccucagcccgcg

SEQ ID NO: 2347297 - RNA, 20 nt, Bordetella pertussis
cgccucagcguuuccagggc

SEQ ID NO: 2347298 - RNA, 15 nt, Bordetella pertussis
cgccucaggccggaa

SEQ ID NO: 2347299 - RNA, 16 nt, Bordetella pertussis
cgccucaggccggcgc

SEQ ID NO: 2347300 - RNA, 17 nt, Bordetella pertussis
cgccucaggccggcgcc

SEQ ID NO: 2347301 - RNA, 18 nt, Bordetella pertussis
cgccucaggccggcgccu

SEQ ID NO: 2347302 - RNA, 20 nt, Bordetella pertussis
cgccucaggccggcgccugg

SEQ ID NO: 2347303 - RNA, 22 nt, Bordetella pertussis
cgccuccagcgcggcgggcggc

SEQ ID NO: 2347304 - RNA, 22 nt, Bordetella pertussis
cgccuccagcuccagcgcgccg

SEQ ID NO: 2347305 - RNA, 19 nt, Bordetella pertussis
cgccuccaggaugagcgcc

SEQ ID NO: 2347306 - RNA, 15 nt, Bordetella pertussis
cgccucccauugcgc

SEQ ID NO: 2347307 - RNA, 18 nt, Bordetella pertussis
cgccucccauugcgcggc

SEQ ID NO: 2347308 - RNA, 19 nt, Bordetella pertussis
cgccucccauugcgcggcc

SEQ ID NO: 2347309 - RNA, 20 nt, Bordetella pertussis
cgccucccauugcgcggcca

SEQ ID NO: 2347310 - RNA, 21 nt, Bordetella pertussis
cgccucccauugcgcggccag

SEQ ID NO: 2347311 - RNA, 22 nt, Bordetella pertussis
cgccuccccaggccagcugcgc

SEQ ID NO: 2347312 - RNA, 23 nt, Bordetella pertussis
cgccucgaagaucucgacgucgu

SEQ ID NO: 2347313 - RNA, 16 nt, Bordetella pertussis
cgccucgacgaugccc

SEQ ID NO: 2347314 - RNA, 13 nt, Bordetella pertussis
cgccucgacgccc

SEQ ID NO: 2347315 - RNA, 16 nt, Bordetella pertussis
cgccucgacgcccggg

SEQ ID NO: 2347316 - RNA, 17 nt, Bordetella pertussis
cgccucgaucgccaggu

SEQ ID NO: 2347317 - RNA, 20 nt, Bordetella pertussis
cgccucgaugauggcguccg

SEQ ID NO: 2347318 - RNA, 21 nt, Bordetella pertussis
cgccucgaugcccucgcgcac

SEQ ID NO: 2347319 - RNA, 22 nt, Bordetella pertussis
cgccucgaugcccucgcgcacg

SEQ ID NO: 2347320 - RNA, 23 nt, Bordetella pertussis
cgccucgaugcccucgcgcacgg

SEQ ID NO: 2347321 - RNA, 17 nt, Bordetella pertussis
cgccucgauugaccagc

SEQ ID NO: 2347322 - RNA, 12 nt, Bordetella pertussis
cgccucgccggc

SEQ ID NO: 2347323 - RNA, 14 nt, Bordetella pertussis
cgccucgcgacggc

SEQ ID NO: 2347324 - RNA, 15 nt, Bordetella pertussis
cgccucgcgacggcc

SEQ ID NO: 2347325 - RNA, 18 nt, Bordetella pertussis
cgccucgcgacggccucc

SEQ ID NO: 2347326 - RNA, 16 nt, Bordetella pertussis
cgccucgcgcuccagc

SEQ ID NO: 2347327 - RNA, 23 nt, Bordetella pertussis
cgccucgcgcuccaugggcgugg

SEQ ID NO: 2347328 - RNA, 13 nt, Bordetella pertussis
cgccucgcgcucg

SEQ ID NO: 2347329 - RNA, 20 nt, Bordetella pertussis
cgccucgcgcucgagcgcgg

SEQ ID NO: 2347330 - RNA, 22 nt, Bordetella pertussis
cgccucgcgcucgagcgcggcg

SEQ ID NO: 2347331 - RNA, 24 nt, Bordetella pertussis
cgccucggacgccuggcgcggccc

SEQ ID NO: 2347332 - RNA, 17 nt, Bordetella pertussis
cgccucggcggaugcga

SEQ ID NO: 2347333 - RNA, 14 nt, Bordetella pertussis
cgccucggcggcca

SEQ ID NO: 2347334 - RNA, 17 nt, Bordetella pertussis
cgccucggcggccagcg

SEQ ID NO: 2347335 - RNA, 18 nt, Bordetella pertussis
cgccucggcggccagcgc

SEQ ID NO: 2347336 - RNA, 17 nt, Bordetella pertussis
cgccucggcgguugccc

SEQ ID NO: 2347337 - RNA, 19 nt, Bordetella pertussis
cgccucggcgguugcccgc

SEQ ID NO: 2347338 - RNA, 19 nt, Bordetella pertussis
cgccucggcuugcgcggcg

SEQ ID NO: 2347339 - RNA, 18 nt, Bordetella pertussis
cgccucgggcacggccag

SEQ ID NO: 2347340 - RNA, 19 nt, Bordetella pertussis
cgccucgggcacggccagc

SEQ ID NO: 2347341 - RNA, 15 nt, Bordetella pertussis
cgccucgguccagcg

SEQ ID NO: 2347342 - RNA, 19 nt, Bordetella pertussis
cgccucguauucgcccgga

SEQ ID NO: 2347343 - RNA, 15 nt, Bordetella pertussis
cgccucgucgcgcaa

SEQ ID NO: 2347344 - RNA, 21 nt, Bordetella pertussis
cgccugacguucggggcgucg

SEQ ID NO: 2347345 - RNA, 22 nt, Bordetella pertussis
cgccugacguucggggcgucgc

SEQ ID NO: 2347346 - RNA, 22 nt, Bordetella pertussis
cgccugagcacaugcccggcca

SEQ ID NO: 2347347 - RNA, 23 nt, Bordetella pertussis
cgccugagcacaugcccggccac

SEQ ID NO: 2347348 - RNA, 16 nt, Bordetella pertussis
cgccugagcugccagg

SEQ ID NO: 2347349 - RNA, 17 nt, Bordetella pertussis
cgccugagcugccaggc

SEQ ID NO: 2347350 - RNA, 20 nt, Bordetella pertussis
cgccugcaaguccagcgugg

SEQ ID NO: 2347351 - RNA, 14 nt, Bordetella pertussis
cgccugcaccgccg

SEQ ID NO: 2347352 - RNA, 15 nt, Bordetella pertussis
cgccugcaccgccgc

SEQ ID NO: 2347353 - RNA, 16 nt, Bordetella pertussis
cgccugcaccgccgcg

SEQ ID NO: 2347354 - RNA, 18 nt, Bordetella pertussis
cgccugcaccgccgcgcg

SEQ ID NO: 2347355 - RNA, 22 nt, Bordetella pertussis
cgccugcaccgccgcgcggugc

SEQ ID NO: 2347356 - RNA, 23 nt, Bordetella pertussis
cgccugcagcacggccacggccg

SEQ ID NO: 2347357 - RNA, 16 nt, Bordetella pertussis
cgccugcagcagcgcc

SEQ ID NO: 2347358 - RNA, 15 nt, Bordetella pertussis
cgccugcagcagcgg

SEQ ID NO: 2347359 - RNA, 23 nt, Bordetella pertussis
cgccugcagcagcguggccgcca

SEQ ID NO: 2347360 - RNA, 14 nt, Bordetella pertussis
cgccugcagcgccg

SEQ ID NO: 2347361 - RNA, 23 nt, Bordetella pertussis
cgccugcaggaaauacucgagcc

SEQ ID NO: 2347362 - RNA, 13 nt, Bordetella pertussis
cgccugcaucacg

SEQ ID NO: 2347363 - RNA, 22 nt, Bordetella pertussis
cgccugcauccggcccagcgcc

SEQ ID NO: 2347364 - RNA, 18 nt, Bordetella pertussis
cgccugcauggugggcau

SEQ ID NO: 2347365 - RNA, 19 nt, Bordetella pertussis
cgccugcauguccagcggc

SEQ ID NO: 2347366 - RNA, 21 nt, Bordetella pertussis
cgccugccagaacagccgcga

SEQ ID NO: 2347367 - RNA, 19 nt, Bordetella pertussis
cgccugccaguucgaugcg

SEQ ID NO: 2347368 - RNA, 13 nt, Bordetella pertussis
cgccugcccaggc

SEQ ID NO: 2347369 - RNA, 15 nt, Bordetella pertussis
cgccugcccaggcca

SEQ ID NO: 2347370 - RNA, 17 nt, Bordetella pertussis
cgccugcccaggccagc

SEQ ID NO: 2347371 - RNA, 18 nt, Bordetella pertussis
cgccugcccaggccagcg

SEQ ID NO: 2347372 - RNA, 20 nt, Bordetella pertussis
cgccugcccaggccagcgcc

SEQ ID NO: 2347373 - RNA, 16 nt, Bordetella pertussis
cgccugccccgccggg

SEQ ID NO: 2347374 - RNA, 16 nt, Bordetella pertussis
cgccugccccgccugc

SEQ ID NO: 2347375 - RNA, 14 nt, Bordetella pertussis
cgccugccccggca

SEQ ID NO: 2347376 - RNA, 16 nt, Bordetella pertussis
cgccugccccggcaga

SEQ ID NO: 2347377 - RNA, 19 nt, Bordetella pertussis
cgccugcccgcaacgccgc

SEQ ID NO: 2347378 - RNA, 22 nt, Bordetella pertussis
cgccugcccgcaacgccgcccg

SEQ ID NO: 2347379 - RNA, 16 nt, Bordetella pertussis
cgccugcccgcacggg

SEQ ID NO: 2347380 - RNA, 22 nt, Bordetella pertussis
cgccugcccgcacgggccgacg

SEQ ID NO: 2347381 - RNA, 21 nt, Bordetella pertussis
cgccugccgaucgugcacgcc

SEQ ID NO: 2347382 - RNA, 18 nt, Bordetella pertussis
cgccugccgcaucccgcc

SEQ ID NO: 2347383 - RNA, 13 nt, Bordetella pertussis
cgccugccgcgcc

SEQ ID NO: 2347384 - RNA, 17 nt, Bordetella pertussis
cgccugccgcgcccggc

SEQ ID NO: 2347385 - RNA, 20 nt, Bordetella pertussis
cgccugccgcgcccggcggc

SEQ ID NO: 2347386 - RNA, 16 nt, Bordetella pertussis
cgccugccgcgugccc

SEQ ID NO: 2347387 - RNA, 21 nt, Bordetella pertussis
cgccugccgcgugcccgcguc

SEQ ID NO: 2347388 - RNA, 12 nt, Bordetella pertussis
cgccugccggcc

SEQ ID NO: 2347389 - RNA, 13 nt, Bordetella pertussis
cgccugccggccu

SEQ ID NO: 2347390 - RNA, 15 nt, Bordetella pertussis
cgccugccggccugg

SEQ ID NO: 2347391 - RNA, 16 nt, Bordetella pertussis
cgccugccugccgagc

SEQ ID NO: 2347392 - RNA, 22 nt, Bordetella pertussis
cgccugcgagagauagcccagc

SEQ ID NO: 2347393 - RNA, 23 nt, Bordetella pertussis
cgccugcgagagauagcccagca

SEQ ID NO: 2347394 - RNA, 15 nt, Bordetella pertussis
cgccugcgccaccug

SEQ ID NO: 2347395 - RNA, 19 nt, Bordetella pertussis
cgccugcgccaccuggcgc

SEQ ID NO: 2347396 - RNA, 17 nt, Bordetella pertussis
cgccugcgccacgucca

SEQ ID NO: 2347397 - RNA, 13 nt, Bordetella pertussis
cgccugcgccagc

SEQ ID NO: 2347398 - RNA, 14 nt, Bordetella pertussis
cgccugcgccagcc

SEQ ID NO: 2347399 - RNA, 15 nt, Bordetella pertussis
cgccugcgccagccg

SEQ ID NO: 2347400 - RNA, 17 nt, Bordetella pertussis
cgccugcgccagccgcg

SEQ ID NO: 2347401 - RNA, 15 nt, Bordetella pertussis
cgccugcgccaggug

SEQ ID NO: 2347402 - RNA, 21 nt, Bordetella pertussis
cgccugcgccauggcgcgcag

SEQ ID NO: 2347403 - RNA, 17 nt, Bordetella pertussis
cgccugcgccauguggc

SEQ ID NO: 2347404 - RNA, 15 nt, Bordetella pertussis
cgccugcgccgaggc

SEQ ID NO: 2347405 - RNA, 18 nt, Bordetella pertussis
cgccugcgccgaggcggg

SEQ ID NO: 2347406 - RNA, 23 nt, Bordetella pertussis
cgccugcgccgaggcgggcagca

SEQ ID NO: 2347407 - RNA, 13 nt, Bordetella pertussis
cgccgggcgcgcu

SEQ ID NO: 2347408 - RNA, 17 nt, Bordetella pertussis
cgccgggcgcgcugccc

SEQ ID NO: 2347409 - RNA, 20 nt, Bordetella pertussis
cgccgggcgcgcugcccagc

SEQ ID NO: 2347410 - RNA, 13 nt, Bordetella pertussis
cgccgggcgcggc

SEQ ID NO: 2347411 - RNA, 18 nt, Bordetella pertussis
cgccgggcgcggccaggc

SEQ ID NO: 2347412 - RNA, 21 nt, Bordetella pertussis
cgccgggcgcggcccggcguc

SEQ ID NO: 2347413 - RNA, 16 nt, Bordetella pertussis
cgccgggcgcggccgc

SEQ ID NO: 2347414 - RNA, 17 nt, Bordetella pertussis
cgccgggcgcggccgcc

SEQ ID NO: 2347415 - RNA, 14 nt, Bordetella pertussis
cgccgggcgcgugg

SEQ ID NO: 2347416 - RNA, 17 nt, Bordetella pertussis
cgccgggcgcguggccc

SEQ ID NO: 2347417 - RNA, 21 nt, Bordetella pertussis
cgccgggcgcguggcccgcgc

SEQ ID NO: 2347418 - RNA, 19 nt, Bordetella pertussis
cgccgggcggcgccgucga

SEQ ID NO: 2347419 - RNA, 16 nt, Bordetella pertussis
cgccgggcggcgcggg

SEQ ID NO: 2347420 - RNA, 22 nt, Bordetella pertussis
cgccgggcggcgcgggcggcua

SEQ ID NO: 2347421 - RNA, 17 nt, Bordetella pertussis
cgccgggcgucuguauc

SEQ ID NO: 2347422 - RNA, 19 nt, Bordetella pertussis
cgccgggcuggauccggcg

SEQ ID NO: 2347423 - RNA, 21 nt, Bordetella pertussis
cgccgggcuggauccggcgcu

SEQ ID NO: 2347424 - RNA, 23 nt, Bordetella pertussis
cgccgggcuggugcgccgugccc

SEQ ID NO: 2347425 - RNA, 20 nt, Bordetella pertussis
cgccgggcuguccgccacca

SEQ ID NO: 2347426 - RNA, 17 nt, Bordetella pertussis
cgccggggaggccucga

SEQ ID NO: 2347427 - RNA, 21 nt, Bordetella pertussis
cgccggggaggccucgacgcu

SEQ ID NO: 2347428 - RNA, 14 nt, Bordetella pertussis
cgccggggcaggcu

SEQ ID NO: 2347429 - RNA, 17 nt, Bordetella pertussis
cgccggggcgcaccggc

SEQ ID NO: 2347430 - RNA, 21 nt, Bordetella pertussis
cgccggggcgcaccggcacgc

SEQ ID NO: 2347431 - RNA, 15 nt, Bordetella pertussis
cgccggggcgccggu

SEQ ID NO: 2347432 - RNA, 18 nt, Bordetella pertussis
cgccggggcggcgcagca

SEQ ID NO: 2347433 - RNA, 13 nt, Bordetella pertussis
cgccggggcggcu

SEQ ID NO: 2347434 - RNA, 16 nt, Bordetella pertussis
cgccggggcguggccg

SEQ ID NO: 2347435 - RNA, 17 nt, Bordetella pertussis
cgccggggcguggccgc

SEQ ID NO: 2347436 - RNA, 18 nt, Bordetella pertussis
cgccggggcguggccgca

SEQ ID NO: 2347437 - RNA, 18 nt, Bordetella pertussis
cgccgggggcguugcggu

SEQ ID NO: 2347438 - RNA, 20 nt, Bordetella pertussis
cgccggggggcgcacgccgc

SEQ ID NO: 2347439 - RNA, 22 nt, Bordetella pertussis
cgccggggggcgcacgccgcgc

SEQ ID NO: 2347440 - RNA, 18 nt, Bordetella pertussis
cgccggggucagcgccgg

SEQ ID NO: 2347441 - RNA, 19 nt, Bordetella pertussis
cgccggggucagcgccggc

SEQ ID NO: 2347442 - RNA, 20 nt, Bordetella pertussis
cgccggggucagcgccggca

SEQ ID NO: 2347443 - RNA, 21 nt, Bordetella pertussis
cgccggggucagcgccggcac

SEQ ID NO: 2347444 - RNA, 24 nt, Bordetella pertussis
cgccggggucagcgccggcacgcu

SEQ ID NO: 2347445 - RNA, 15 nt, Bordetella pertussis
cgccggggugggagc

SEQ ID NO: 2347446 - RNA, 13 nt, Bordetella pertussis
cgccggguccggc

SEQ ID NO: 2347447 - RNA, 15 nt, Bordetella pertussis
cgccggguccggccg

SEQ ID NO: 2347448 - RNA, 16 nt, Bordetella pertussis
cgccggguccggccgc

SEQ ID NO: 2347449 - RNA, 17 nt, Bordetella pertussis
cgccggguccggccgcg

SEQ ID NO: 2347450 - RNA, 22 nt, Bordetella pertussis
cgccggguccggccgcgcaagg

SEQ ID NO: 2347451 - RNA, 16 nt, Bordetella pertussis
cgccgggucgaggucg

SEQ ID NO: 2347452 - RNA, 17 nt, Bordetella pertussis
cgccgggucgaggucga

SEQ ID NO: 2347453 - RNA, 16 nt, Bordetella pertussis
cgccgggucgccggug

SEQ ID NO: 2347454 - RNA, 21 nt, Bordetella pertussis
cgccgggucgcugugcgcggc

SEQ ID NO: 2347455 - RNA, 20 nt, Bordetella pertussis
cgccggguggguucgggcgu

SEQ ID NO: 2347456 - RNA, 18 nt, Bordetella pertussis
cgccggguguuccggcgc

SEQ ID NO: 2347457 - RNA, 22 nt, Bordetella pertussis
cgccggguugccgggauccacg

SEQ ID NO: 2347458 - RNA, 15 nt, Bordetella pertussis
cgccggguugcggcg

SEQ ID NO: 2347459 - RNA, 17 nt, Bordetella pertussis
cgccggguugcggcgga

SEQ ID NO: 2347460 - RNA, 19 nt, Bordetella pertussis
cgccggguugcggcggaca

SEQ ID NO: 2347461 - RNA, 15 nt, Bordetella pertussis
cgccggguuucucga

SEQ ID NO: 2347462 - RNA, 21 nt, Bordetella pertussis
cgccggguuuuuacaugccgc

SEQ ID NO: 2347463 - RNA, 16 nt, Bordetella pertussis
cgccgguagcgcuggg

SEQ ID NO: 2347464 - RNA, 21 nt, Bordetella pertussis
cgccgguagcgcugggcgcca

SEQ ID NO: 2347465 - RNA, 22 nt, Bordetella pertussis
cgccgguagcgcugggcgccag

SEQ ID NO: 2347466 - RNA, 16 nt, Bordetella pertussis
cgccggucaccgccgc

SEQ ID NO: 2347467 - RNA, 19 nt, Bordetella pertussis
cgccggucaccgccgccgc

SEQ ID NO: 2347468 - RNA, 15 nt, Bordetella pertussis
cgccggucacguacu

SEQ ID NO: 2347469 - RNA, 21 nt, Bordetella pertussis
cgccggucacugccgaaacgc

SEQ ID NO: 2347470 - RNA, 15 nt, Bordetella pertussis
cgccgguccagcgcc

SEQ ID NO: 2347471 - RNA, 16 nt, Bordetella pertussis
cgccgguccagcgccc

SEQ ID NO: 2347472 - RNA, 17 nt, Bordetella pertussis
cgccgguccagcgcccg

SEQ ID NO: 2347473 - RNA, 14 nt, Bordetella pertussis
cgccgguccgacgg

SEQ ID NO: 2347474 - RNA, 13 nt, Bordetella pertussis
cgccggucgccag

SEQ ID NO: 2347475 - RNA, 15 nt, Bordetella pertussis
cgccggucgccagcg

SEQ ID NO: 2347476 - RNA, 12 nt, Bordetella pertussis
cgccggucgccg

SEQ ID NO: 2347477 - RNA, 22 nt, Bordetella pertussis
cgccggucgccgcgggcaaagc

SEQ ID NO: 2347478 - RNA, 12 nt, Bordetella pertussis
cgccggucgcgg

SEQ ID NO: 2347479 - RNA, 13 nt, Bordetella pertussis
cgccggucgcggc

SEQ ID NO: 2347480 - RNA, 17 nt, Bordetella pertussis
cgccggucgcggcguug

SEQ ID NO: 2347481 - RNA, 13 nt, Bordetella pertussis
cgccggucggccg

SEQ ID NO: 2347482 - RNA, 15 nt, Bordetella pertussis
cgccggucggccgcu

SEQ ID NO: 2347483 - RNA, 17 nt, Bordetella pertussis
cgccggucggccgcucc

SEQ ID NO: 2347484 - RNA, 16 nt, Bordetella pertussis
cgccggucguggucga

SEQ ID NO: 2347485 - RNA, 14 nt, Bordetella pertussis
cgccggucugggcg

SEQ ID NO: 2347486 - RNA, 17 nt, Bordetella pertussis
cgccggucugggcgcgg

SEQ ID NO: 2347487 - RNA, 23 nt, Bordetella pertussis
cgccggucugggcgcggaacagc

SEQ ID NO: 2347488 - RNA, 15 nt, Bordetella pertussis
cgccggugaccgcca

SEQ ID NO: 2347489 - RNA, 19 nt, Bordetella pertussis
cgccggugaccgccagcag

SEQ ID NO: 2347490 - RNA, 18 nt, Bordetella pertussis
cgccggugauaugcgcca

SEQ ID NO: 2347491 - RNA, 23 nt, Bordetella pertussis
cgccggugauaugcgccaggccc

SEQ ID NO: 2347492 - RNA, 17 nt, Bordetella pertussis
cgccggugcaccaggcc

SEQ ID NO: 2347493 - RNA, 19 nt, Bordetella pertussis
cgccggugcaccaggccac

SEQ ID NO: 2347494 - RNA, 15 nt, Bordetella pertussis
cgccggugcgcggcg

SEQ ID NO: 2347495 - RNA, 19 nt, Bordetella pertussis
cgccggugcgcggcgcccc

SEQ ID NO: 2347496 - RNA, 14 nt, Bordetella pertussis
cgccgguggccagc

SEQ ID NO: 2347497 - RNA, 16 nt, Bordetella pertussis
cgccgguggccagcag

SEQ ID NO: 2347498 - RNA, 20 nt, Bordetella pertussis
cgccgguggccagcagcugu

SEQ ID NO: 2347499 - RNA, 13 nt, Bordetella pertussis
cgccggugggcag

SEQ ID NO: 2347500 - RNA, 19 nt, Bordetella pertussis
cgccgguguagcugcccgc

SEQ ID NO: 2347501 - RNA, 13 nt, Bordetella pertussis
cgccggugucggc

SEQ ID NO: 2347502 - RNA, 15 nt, Bordetella pertussis
cgccggugucggccc

SEQ ID NO: 2347503 - RNA, 20 nt, Bordetella pertussis
cgccggugucggggccgggc

SEQ ID NO: 2347504 - RNA, 15 nt, Bordetella pertussis
cgccgguucgacgcu

SEQ ID NO: 2347505 - RNA, 17 nt, Bordetella pertussis
cgccgguucgacgcuga

SEQ ID NO: 2347506 - RNA, 17 nt, Bordetella pertussis
cgccgguucggucgacg

SEQ ID NO: 2347507 - RNA, 18 nt, Bordetella pertussis
cgccgguucggucgacga

SEQ ID NO: 2347508 - RNA, 20 nt, Bordetella pertussis
cgccgguucggucgacgacg

SEQ ID NO: 2347509 - RNA, 21 nt, Bordetella pertussis
cgccgguucggucgacgacgg

SEQ ID NO: 2347510 - RNA, 17 nt, Bordetella pertussis
cgccguaaucggcgucg

SEQ ID NO: 2347511 - RNA, 14 nt, Bordetella pertussis
cgccguacagccgc

SEQ ID NO: 2347512 - RNA, 17 nt, Bordetella pertussis
cgccguacagccgcggc

SEQ ID NO: 2347513 - RNA, 18 nt, Bordetella pertussis
cgccguacagccgcggca

SEQ ID NO: 2347514 - RNA, 19 nt, Bordetella pertussis
cgccguacagccgcggcag

SEQ ID NO: 2347515 - RNA, 20 nt, Bordetella pertussis
cgccguacagccgcggcaga

SEQ ID NO: 2347516 - RNA, 16 nt, Bordetella pertussis
cgccguacagggccgc

SEQ ID NO: 2347517 - RNA, 18 nt, Bordetella pertussis
cgccguacagggccgcga

SEQ ID NO: 2347518 - RNA, 15 nt, Bordetella pertussis
cgccguaccccagca

SEQ ID NO: 2347519 - RNA, 14 nt, Bordetella pertussis
cgccguaccgggcg

SEQ ID NO: 2347520 - RNA, 22 nt, Bordetella pertussis
cgccguaccugcagcaggcgca

SEQ ID NO: 2347521 - RNA, 15 nt, Bordetella pertussis
cgccguacucgccgg

SEQ ID NO: 2347522 - RNA, 18 nt, Bordetella pertussis
cgccuucggcggcgaugg

SEQ ID NO: 2347523 - RNA, 16 nt, Bordetella pertussis
cgccuucgucgcgcac

SEQ ID NO: 2347524 - RNA, 19 nt, Bordetella pertussis
cgccuucgucgcgcacccg

SEQ ID NO: 2347525 - RNA, 23 nt, Bordetella pertussis
cgccuucuugaacagcucggccc

SEQ ID NO: 2347526 - RNA, 22 nt, Bordetella pertussis
cgccuugacgaucucggcguug

SEQ ID NO: 2347527 - RNA, 22 nt, Bordetella pertussis
cgccuugcccgggcuggccgcc

SEQ ID NO: 2347528 - RNA, 13 nt, Bordetella pertussis
cgccuugccgccg

SEQ ID NO: 2347529 - RNA, 20 nt, Bordetella pertussis
cgccuugccuugcgcggcca

SEQ ID NO: 2347530 - RNA, 13 nt, Bordetella pertussis
cgccuugcgcggc

SEQ ID NO: 2347531 - RNA, 14 nt, Bordetella pertussis
cgccuugcgcggcg

SEQ ID NO: 2347532 - RNA, 13 nt, Bordetella pertussis
cgccuuggcgcgc

SEQ ID NO: 2347533 - RNA, 15 nt, Bordetella pertussis
cgccuuggcgcgcag

SEQ ID NO: 2347534 - RNA, 16 nt, Bordetella pertussis
cgccuuggcgcgcaga

SEQ ID NO: 2347535 - RNA, 17 nt, Bordetella pertussis
cgccuuguucgcgcgcg

SEQ ID NO: 2347536 - RNA, 20 nt, Bordetella pertussis
cgccuuucccgcgccgagcg

SEQ ID NO: 2347537 - RNA, 15 nt, Bordetella pertussis
cgcgaaagcacgcca

SEQ ID NO: 2347538 - RNA, 22 nt, Bordetella pertussis
cgcgaaagcggcgugugcccag

SEQ ID NO: 2347539 - RNA, 19 nt, Bordetella pertussis
cgcgaaauccagcgcgccc

SEQ ID NO: 2347540 - RNA, 22 nt, Bordetella pertussis
cgcgaaaugcccagcgagcugg

SEQ ID NO: 2347541 - RNA, 19 nt, Bordetella pertussis
cgcgaacaacgggaucggc

SEQ ID NO: 2347542 - RNA, 18 nt, Bordetella pertussis
cgcgaacagauccacgcc

SEQ ID NO: 2347543 - RNA, 13 nt, Bordetella pertussis
cgcgaaccaggcc

SEQ ID NO: 2347544 - RNA, 14 nt, Bordetella pertussis
cgcgaaccaggcca

SEQ ID NO: 2347545 - RNA, 17 nt, Bordetella pertussis
cgcgaaccaggccaccg

SEQ ID NO: 2347546 - RNA, 16 nt, Bordetella pertussis
cgcgaaccccuccggc

SEQ ID NO: 2347547 - RNA, 17 nt, Bordetella pertussis
cgcgaaccccuccggcg

SEQ ID NO: 2347548 - RNA, 16 nt, Bordetella pertussis
cgcgaacgccugccag

SEQ ID NO: 2347549 - RNA, 13 nt, Bordetella pertussis
cgcgaacgcgccg

SEQ ID NO: 2347550 - RNA, 15 nt, Bordetella pertussis
cgcgaacgcgccggc

SEQ ID NO: 2347551 - RNA, 18 nt, Bordetella pertussis
cgcgaacgcgccggccca

SEQ ID NO: 2347552 - RNA, 16 nt, Bordetella pertussis
cgcgaacgcgcgccgg

SEQ ID NO: 2347553 - RNA, 17 nt, Bordetella pertussis
cgcgaacgcgcgccggc

SEQ ID NO: 2347554 - RNA, 19 nt, Bordetella pertussis
cgcgaacgcgcgccggcca

SEQ ID NO: 2347555 - RNA, 20 nt, Bordetella pertussis
cgcgaacgcgcgccggccag

SEQ ID NO: 2347556 - RNA, 21 nt, Bordetella pertussis
cgcgaacgcgcgccggccagc

SEQ ID NO: 2347557 - RNA, 23 nt, Bordetella pertussis
cgcgaacgcgcgccggccagcgg

SEQ ID NO: 2347558 - RNA, 12 nt, Bordetella pertussis
cgcgaacgcggc

SEQ ID NO: 2347559 - RNA, 13 nt, Bordetella pertussis
cgcgaacgcggcc

SEQ ID NO: 2347560 - RNA, 16 nt, Bordetella pertussis
cgcgaacgcggccaug

SEQ ID NO: 2347561 - RNA, 17 nt, Bordetella pertussis
cgcgaacggcaggugca

SEQ ID NO: 2347562 - RNA, 14 nt, Bordetella pertussis
cgcgaacgggcagc

SEQ ID NO: 2347563 - RNA, 23 nt, Bordetella pertussis
cgcgaacuuggccaugccaacgg

SEQ ID NO: 2347564 - RNA, 16 nt, Bordetella pertussis
cgcgaagaucccgccg

SEQ ID NO: 2347565 - RNA, 13 nt, Bordetella pertussis
cgcgaagccgccc

SEQ ID NO: 2347566 - RNA, 19 nt, Bordetella pertussis
cgcgaagcgcgccagcagc

SEQ ID NO: 2347567 - RNA, 20 nt, Bordetella pertussis
cgcgaagcgcgccagcagcg

SEQ ID NO: 2347568 - RNA, 13 nt, Bordetella pertussis
cgcgaagcgcugg

SEQ ID NO: 2347569 - RNA, 20 nt, Bordetella pertussis
cgcgaagcggaaacgcgcgc

SEQ ID NO: 2347570 - RNA, 21 nt, Bordetella pertussis
cgcgaagcggaaacgcgcgcg

SEQ ID NO: 2347571 - RNA, 22 nt, Bordetella pertussis
cgcgaagcggaaacgcgcgcgc

SEQ ID NO: 2347572 - RNA, 15 nt, Bordetella pertussis
cgcgaaggccgcccc

SEQ ID NO: 2347573 - RNA, 20 nt, Bordetella pertussis
cgcgaaguaccagcgcacgu

SEQ ID NO: 2347574 - RNA, 14 nt, Bordetella pertussis
cgcgaagugccugu

SEQ ID NO: 2347575 - RNA, 14 nt, Bordetella pertussis
cgcgaaguggccac

SEQ ID NO: 2347576 - RNA, 20 nt, Bordetella pertussis
cgcgaauuuuucuuccaguu

SEQ ID NO: 2347577 - RNA, 18 nt, Bordetella pertussis
cgcgacacaaggcggccg

SEQ ID NO: 2347578 - RNA, 14 nt, Bordetella pertussis
cgcgacaccgugcg

SEQ ID NO: 2347579 - RNA, 14 nt, Bordetella pertussis
cgcgacacgcagca

SEQ ID NO: 2347580 - RNA, 16 nt, Bordetella pertussis
cgcgacagcaggccgg

SEQ ID NO: 2347581 - RNA, 14 nt, Bordetella pertussis
cgcgacagccgcgc

SEQ ID NO: 2347582 - RNA, 19 nt, Bordetella pertussis
cgcgacagccgcgccagcg

SEQ ID NO: 2347583 - RNA, 21 nt, Bordetella pertussis
cgcgacagccgcgccagcgcc

SEQ ID NO: 2347584 - RNA, 13 nt, Bordetella pertussis
cgcgacagcgcug

SEQ ID NO: 2347585 - RNA, 19 nt, Bordetella pertussis
cgcgacaggcccgcggccg

SEQ ID NO: 2347586 - RNA, 19 nt, Bordetella pertussis
cgcgacaggcggugcgcgc

SEQ ID NO: 2347587 - RNA, 22 nt, Bordetella pertussis
cgcgacaggcggugcgcgcggc

SEQ ID NO: 2347588 - RNA, 23 nt, Bordetella pertussis
cgcgacaggcggugcgcgcggcc

SEQ ID NO: 2347589 - RNA, 20 nt, Bordetella pertussis
cgcgacaguucgccccccga

SEQ ID NO: 2347590 - RNA, 13 nt, Bordetella pertussis
cgcgaccaccagc

SEQ ID NO: 2347591 - RNA, 20 nt, Bordetella pertussis
cgcgaccaccagcaccaugc

SEQ ID NO: 2347592 - RNA, 16 nt, Bordetella pertussis
cgcgaccaccaggucg

SEQ ID NO: 2347593 - RNA, 14 nt, Bordetella pertussis
cgcgaccaccguga

SEQ ID NO: 2347594 - RNA, 23 nt, Bordetella pertussis
cgcgaccacgaccuuggcggccg

SEQ ID NO: 2347595 - RNA, 20 nt, Bordetella pertussis
cgcgaccacuggcagaccga

SEQ ID NO: 2347596 - RNA, 19 nt, Bordetella pertussis
cgcgaccagcuucugcgcc

SEQ ID NO: 2347597 - RNA, 20 nt, Bordetella pertussis
cgcgaccagcuucugcgccu

SEQ ID NO: 2347598 - RNA, 23 nt, Bordetella pertussis
cgcgaccagcuucugcgccugcu

SEQ ID NO: 2347599 - RNA, 15 nt, Bordetella pertussis
cgcgaccaggcugga

SEQ ID NO: 2347600 - RNA, 16 nt, Bordetella pertussis
cgcgaccaugcggccg

SEQ ID NO: 2347601 - RNA, 23 nt, Bordetella pertussis
cgcgacccagaacccggccggcg

SEQ ID NO: 2347602 - RNA, 19 nt, Bordetella pertussis
cgcgacccgauagccgcgc

SEQ ID NO: 2347603 - RNA, 14 nt, Bordetella pertussis
cgcgaccgccaagc

SEQ ID NO: 2347604 - RNA, 13 nt, Bordetella pertussis
cgcgaccgccgcc

SEQ ID NO: 2347605 - RNA, 14 nt, Bordetella pertussis
cgcgaccgccgccu

SEQ ID NO: 2347606 - RNA, 15 nt, Bordetella pertussis
cgcgaccgccgccuu

SEQ ID NO: 2347607 - RNA, 14 nt, Bordetella pertussis
cgcgaccgccucca

SEQ ID NO: 2347608 - RNA, 19 nt, Bordetella pertussis
cgcgaccgccuccagcgcg

SEQ ID NO: 2347609 - RNA, 22 nt, Bordetella pertussis
cgcgaccgccuccagcgcggcg

SEQ ID NO: 2347610 - RNA, 14 nt, Bordetella pertussis
cgcgaccgcgcggc

SEQ ID NO: 2347611 - RNA, 15 nt, Bordetella pertussis
cgcgaccgcgcggcg

SEQ ID NO: 2347612 - RNA, 14 nt, Bordetella pertussis
cgcgaccuccggca

SEQ ID NO: 2347613 - RNA, 16 nt, Bordetella pertussis
cgcgaccuccggcaac

SEQ ID NO: 2347614 - RNA, 22 nt, Bordetella pertussis
cgcgaccuccggcaacagcagg

SEQ ID NO: 2347615 - RNA, 17 nt, Bordetella pertussis
cgcgaccugcgcgaccg

SEQ ID NO: 2347616 - RNA, 21 nt, Bordetella pertussis
cgcgaccugcgcgaccgccgc

SEQ ID NO: 2347617 - RNA, 23 nt, Bordetella pertussis
cgcgaccugcgcgaccgccgcgg

SEQ ID NO: 2347618 - RNA, 17 nt, Bordetella pertussis
cgcgaccugcgggcgca

SEQ ID NO: 2347619 - RNA, 19 nt, Bordetella pertussis
cgcgaccugcgggcgcagc

SEQ ID NO: 2347620 - RNA, 13 nt, Bordetella pertussis
cgcgaccuugucu

SEQ ID NO: 2347621 - RNA, 12 nt, Bordetella pertussis
cgcgacgaagcc

SEQ ID NO: 2347622 - RNA, 15 nt, Bordetella pertussis
cgcgacgacagcggc

SEQ ID NO: 2347623 - RNA, 14 nt, Bordetella pertussis
cgcgacgaccccgc

SEQ ID NO: 2347624 - RNA, 14 nt, Bordetella pertussis
cgcgacgcccuggc

SEQ ID NO: 2347625 - RNA, 16 nt, Bordetella pertussis
cgcgacgcccuggccu

SEQ ID NO: 2347626 - RNA, 22 nt, Bordetella pertussis
cgcgacgcccuggccuucgacc

SEQ ID NO: 2347627 - RNA, 14 nt, Bordetella pertussis
cgcgacgccugcgc

SEQ ID NO: 2347628 - RNA, 15 nt, Bordetella pertussis
cgcgacgccugcgcc

SEQ ID NO: 2347629 - RNA, 21 nt, Bordetella pertussis
cgcgacgcgcccucaguccag

SEQ ID NO: 2347630 - RNA, 13 nt, Bordetella pertussis
cgcgacgcgccgg

SEQ ID NO: 2347631 - RNA, 14 nt, Bordetella pertussis
cgcgacgcgccugc

SEQ ID NO: 2347632 - RNA, 18 nt, Bordetella pertussis
cgcgacgcgggcggccga

SEQ ID NO: 2347633 - RNA, 17 nt, Bordetella pertussis
cgcgacgcuacagcguc

SEQ ID NO: 2347634 - RNA, 19 nt, Bordetella pertussis
cgcgacgcuguuggucagg

SEQ ID NO: 2347635 - RNA, 16 nt, Bordetella pertussis
cgcgacggccucccgc

SEQ ID NO: 2347636 - RNA, 17 nt, Bordetella pertussis
cgcgacggccucccgcc

SEQ ID NO: 2347637 - RNA, 12 nt, Bordetella pertussis
cgcgacggcgau

SEQ ID NO: 2347638 - RNA, 14 nt, Bordetella pertussis
cgcgacgggcaccg

SEQ ID NO: 2347639 - RNA, 14 nt, Bordetella pertussis
cgcgacgguccugc

SEQ ID NO: 2347640 - RNA, 20 nt, Bordetella pertussis
cgcgacgugucggccaccac

SEQ ID NO: 2347641 - RNA, 24 nt, Bordetella pertussis
cgcgacuucgccgaucgagcaggc

SEQ ID NO: 2347642 - RNA, 16 nt, Bordetella pertussis
cgcgagaaccaggcca

SEQ ID NO: 2347643 - RNA, 16 nt, Bordetella pertussis
cgcgagaauggcgcga

SEQ ID NO: 2347644 - RNA, 13 nt, Bordetella pertussis
cgcgagaccacga

SEQ ID NO: 2347645 - RNA, 15 nt, Bordetella pertussis
cgcgagaccagcgga

SEQ ID NO: 2347646 - RNA, 18 nt, Bordetella pertussis
cgcgagcagggcaucacc

SEQ ID NO: 2347647 - RNA, 16 nt, Bordetella pertussis
cgcgagcagucgacca

SEQ ID NO: 2347648 - RNA, 14 nt, Bordetella pertussis
cgcgagcaugcgca

SEQ ID NO: 2347649 - RNA, 15 nt, Bordetella pertussis
cgcgagcaugcgcag

SEQ ID NO: 2347650 - RNA, 16 nt, Bordetella pertussis
cgcgagcaugcgcagc

SEQ ID NO: 2347651 - RNA, 17 nt, Bordetella pertussis
cgcgagcaugcgcagcg

SEQ ID NO: 2347652 - RNA, 18 nt, Bordetella pertussis
cgcgagcaugcgcagcgc

SEQ ID NO: 2347653 - RNA, 19 nt, Bordetella pertussis
cgcgagcccaucagguggg

SEQ ID NO: 2347654 - RNA, 22 nt, Bordetella pertussis
cgcgagcccaucaggugggccg

SEQ ID NO: 2347655 - RNA, 23 nt, Bordetella pertussis
cgcgagcccgcgucagacgcgcu

SEQ ID NO: 2347656 - RNA, 17 nt, Bordetella pertussis
cgcgagccgcccacggg

SEQ ID NO: 2347657 - RNA, 15 nt, Bordetella pertussis
cgcgagcgaugcccu

SEQ ID NO: 2347658 - RNA, 20 nt, Bordetella pertussis
cgcgagcgaugcccuggaug

SEQ ID NO: 2347659 - RNA, 19 nt, Bordetella pertussis
cgcgagcgcaagcaccgcc

SEQ ID NO: 2347660 - RNA, 22 nt, Bordetella pertussis
cgcgagcgcacaggcggcgccg

SEQ ID NO: 2347661 - RNA, 15 nt, Bordetella pertussis
cgcgagcgccgggcg

SEQ ID NO: 2347662 - RNA, 23 nt, Bordetella pertussis
cgcgagcgccgggcgccgcgccc

SEQ ID NO: 2347663 - RNA, 16 nt, Bordetella pertussis
cgcgagcggccagccu

SEQ ID NO: 2347664 - RNA, 15 nt, Bordetella pertussis
cgcgagcggcggccg

SEQ ID NO: 2347665 - RNA, 23 nt, Bordetella pertussis
cgcgagcggcggccgcguccagc

SEQ ID NO: 2347666 - RNA, 11 nt, Bordetella pertussis
cgcgagcugcg

SEQ ID NO: 2347667 - RNA, 16 nt, Bordetella pertussis
cgcgagcugcgcgacc

SEQ ID NO: 2347668 - RNA, 15 nt, Bordetella pertussis
cgcgagcugcgcggc

SEQ ID NO: 2347669 - RNA, 18 nt, Bordetella pertussis
cgcgagcugcgcggcuuu

SEQ ID NO: 2347670 - RNA, 22 nt, Bordetella pertussis
cgcgagcuggucgaacgcuucc

SEQ ID NO: 2347671 - RNA, 18 nt, Bordetella pertussis
cgcgaggcgcaggccgac

SEQ ID NO: 2347672 - RNA, 14 nt, Bordetella pertussis
cgcgaggcggcggc

SEQ ID NO: 2347673 - RNA, 15 nt, Bordetella pertussis
cgcgaggcggcggcc

SEQ ID NO: 2347674 - RNA, 22 nt, Bordetella pertussis
cgcgaggcggcggccggggccg

SEQ ID NO: 2347675 - RNA, 15 nt, Bordetella pertussis
cgcgagggcaucagc

SEQ ID NO: 2347676 - RNA, 20 nt, Bordetella pertussis
cgcgagguauuggccuugcc

SEQ ID NO: 2347677 - RNA, 14 nt, Bordetella pertussis
cgcgaggugccgga

SEQ ID NO: 2347678 - RNA, 16 nt, Bordetella pertussis
cgcgaggugccggacg

SEQ ID NO: 2347679 - RNA, 17 nt, Bordetella pertussis
cgcgaggugccggacgc

SEQ ID NO: 2347680 - RNA, 19 nt, Bordetella pertussis
cgcgaggugccggacgccg

SEQ ID NO: 2347681 - RNA, 16 nt, Bordetella pertussis
cgcgaggugggcggca

SEQ ID NO: 2347682 - RNA, 23 nt, Bordetella pertussis
cgcgaggugggcggcagcaggcg

SEQ ID NO: 2347683 - RNA, 18 nt, Bordetella pertussis
cgcgauagauggccaggu

SEQ ID NO: 2347684 - RNA, 19 nt, Bordetella pertussis
cgcgauagauggccaggug

SEQ ID NO: 2347685 - RNA, 22 nt, Bordetella pertussis
cgcgauauccuugcgcucgccc

SEQ ID NO: 2347686 - RNA, 13 nt, Bordetella pertussis
cgcgaucaccgag

SEQ ID NO: 2347687 - RNA, 16 nt, Bordetella pertussis
cgcgaucagcgcggcc

SEQ ID NO: 2347688 - RNA, 17 nt, Bordetella pertussis
cgcgaucagcgcggccg

SEQ ID NO: 2347689 - RNA, 13 nt, Bordetella pertussis
cgcgauccggcgu

SEQ ID NO: 2347690 - RNA, 15 nt, Bordetella pertussis
cgcgauccggcgugg

SEQ ID NO: 2347691 - RNA, 18 nt, Bordetella pertussis
cgcgauccggugaucauc

SEQ ID NO: 2347692 - RNA, 16 nt, Bordetella pertussis
cgcgauccucgacccg

SEQ ID NO: 2347693 - RNA, 12 nt, Bordetella pertussis
cgcgauccuggg

SEQ ID NO: 2347694 - RNA, 15 nt, Bordetella pertussis
cgcgauccuggggca

SEQ ID NO: 2347695 - RNA, 18 nt, Bordetella pertussis
cgcgauccuucgcggccg

SEQ ID NO: 2347696 - RNA, 14 nt, Bordetella pertussis
cgcgaucgccagca

SEQ ID NO: 2347697 - RNA, 21 nt, Bordetella pertussis
cgcgaucgccagcaggcgcug

SEQ ID NO: 2347698 - RNA, 22 nt, Bordetella pertussis
cgcgaucgccagcaggcgcugg

SEQ ID NO: 2347699 - RNA, 13 nt, Bordetella pertussis
cgcgaucgccgca

SEQ ID NO: 2347700 - RNA, 22 nt, Bordetella pertussis
cgcgaucucagccaucaucauc

SEQ ID NO: 2347701 - RNA, 14 nt, Bordetella pertussis
cgcgaucucgcgca

SEQ ID NO: 2347702 - RNA, 17 nt, Bordetella pertussis
cgcgaucucgggcaggu

SEQ ID NO: 2347703 - RNA, 19 nt, Bordetella pertussis
cgcgaucucgggcaggucg

SEQ ID NO: 2347704 - RNA, 23 nt, Bordetella pertussis
cgcgaucucgggcaggucggcca

SEQ ID NO: 2347705 - RNA, 18 nt, Bordetella pertussis
cgcgaugagcuggcgcag

SEQ ID NO: 2347706 - RNA, 12 nt, Bordetella pertussis
cgcgaugcauga

SEQ ID NO: 2347707 - RNA, 14 nt, Bordetella pertussis
cgcgaugcaugaac

SEQ ID NO: 2347708 - RNA, 24 nt, Bordetella pertussis
cgcgaugcaugaaccgcagcgcca

SEQ ID NO: 2347709 - RNA, 15 nt, Bordetella pertussis
cgcgaugcccgcgca

SEQ ID NO: 2347710 - RNA, 18 nt, Bordetella pertussis
cgcgaugcccgcgcacca

SEQ ID NO: 2347711 - RNA, 22 nt, Bordetella pertussis
cgcgaugccgaucgccgacagg

SEQ ID NO: 2347712 - RNA, 14 nt, Bordetella pertussis
cgcgaugcgcagca

SEQ ID NO: 2347713 - RNA, 18 nt, Bordetella pertussis
cgcgaugcgccaggcgcu

SEQ ID NO: 2347714 - RNA, 23 nt, Bordetella pertussis
cgcgaugcgccaggcgcucggcg

SEQ ID NO: 2347715 - RNA, 22 nt, Bordetella pertussis
cgcgaugcgcgcgugcagcgcc

SEQ ID NO: 2347716 - RNA, 16 nt, Bordetella pertussis
cgcgaugcgcggcccg

SEQ ID NO: 2347717 - RNA, 19 nt, Bordetella pertussis
cgcgaugcgcggcccggcc

SEQ ID NO: 2347718 - RNA, 16 nt, Bordetella pertussis
cgcgaugcgggucugg

SEQ ID NO: 2347719 - RNA, 23 nt, Bordetella pertussis
cgcgaugcgguugagcacauuga

SEQ ID NO: 2347720 - RNA, 14 nt, Bordetella pertussis
cgcgaugcgucagg

SEQ ID NO: 2347721 - RNA, 22 nt, Bordetella pertussis
cgcgaugcgucaggggcaugcc

SEQ ID NO: 2347722 - RNA, 21 nt, Bordetella pertussis
cgcgauggcgccggccagcgc

SEQ ID NO: 2347723 - RNA, 13 nt, Bordetella pertussis
cgcgaugggccug

SEQ ID NO: 2347724 - RNA, 19 nt, Bordetella pertussis
cgcgaugggccugcccaug

SEQ ID NO: 2347725 - RNA, 17 nt, Bordetella pertussis
cgcgauggucaccaccc

SEQ ID NO: 2347726 - RNA, 19 nt, Bordetella pertussis
cgcgauggucaccacccgc

SEQ ID NO: 2347727 - RNA, 20 nt, Bordetella pertussis
cgcgauggucaccacccgca

SEQ ID NO: 2347728 - RNA, 14 nt, Bordetella pertussis
cgcgauguccagcu

SEQ ID NO: 2347729 - RNA, 16 nt, Bordetella pertussis
cgcgauguccagcucc

SEQ ID NO: 2347730 - RNA, 17 nt, Bordetella pertussis
cgcgauguccagcucca

SEQ ID NO: 2347731 - RNA, 21 nt, Bordetella pertussis
cgcgaugucgaauuccgggac

SEQ ID NO: 2347732 - RNA, 17 nt, Bordetella pertussis
cgcgaugucgcccaugc

SEQ ID NO: 2347733 - RNA, 20 nt, Bordetella pertussis
cgcgaugucgcccaugcuga

SEQ ID NO: 2347734 - RNA, 16 nt, Bordetella pertussis
cgcgaugucgcgcgcg

SEQ ID NO: 2347735 - RNA, 20 nt, Bordetella pertussis
cgcgaugucgcgcgcgcuca

SEQ ID NO: 2347736 - RNA, 18 nt, Bordetella pertussis
cgcgauguucaggccggc

SEQ ID NO: 2347737 - RNA, 13 nt, Bordetella pertussis
cgcgauguucgga

SEQ ID NO: 2347738 - RNA, 19 nt, Bordetella pertussis
cgcgauucccuggcgcgcc

SEQ ID NO: 2347739 - RNA, 22 nt, Bordetella pertussis
cgcgauucccuggcgcgccagc

SEQ ID NO: 2347740 - RNA, 23 nt, Bordetella pertussis
cgcgauucccuggcgcgccagcu

SEQ ID NO: 2347741 - RNA, 18 nt, Bordetella pertussis
cgcgauugaguucgcgcg

SEQ ID NO: 2347742 - RNA, 20 nt, Bordetella pertussis
cgcgauugaguucgcgcgcc

SEQ ID NO: 2347743 - RNA, 18 nt, Bordetella pertussis
cgcgauuuccuugcgccg

SEQ ID NO: 2347744 - RNA, 19 nt, Bordetella pertussis
cgcgauuuccuugcgccgc

SEQ ID NO: 2347745 - RNA, 20 nt, Bordetella pertussis
cgcgauuuccuugcgccgcc

SEQ ID NO: 2347746 - RNA, 21 nt, Bordetella pertussis
cgcgauuuccuugcgccgccc

SEQ ID NO: 2347747 - RNA, 17 nt, Bordetella pertussis
cgcgauuucguccgggg

SEQ ID NO: 2347748 - RNA, 18 nt, Bordetella pertussis
cgcgauuucguccggggu

SEQ ID NO: 2347749 - RNA, 20 nt, Bordetella pertussis
cgcgcaaaccgacgcggcca

SEQ ID NO: 2347750 - RNA, 22 nt, Bordetella pertussis
cgcgcaaaccgacgcggccagc

SEQ ID NO: 2347751 - RNA, 20 nt, Bordetella pertussis
agccagcgccugcgcggccu

SEQ ID NO: 2347752 - RNA, 19 nt, Bordetella pertussis
agccagcggcgcggcgcgc

SEQ ID NO: 2347753 - RNA, 18 nt, Bordetella pertussis
agccaggauuucauggca

SEQ ID NO: 2347754 - RNA, 23 nt, Bordetella pertussis
agccaggauuucauggcaucggc

SEQ ID NO: 2347755 - RNA, 12 nt, Bordetella pertussis
agccaggccgca

SEQ ID NO: 2347756 - RNA, 14 nt, Bordetella pertussis
agccaggcgccagc

SEQ ID NO: 2347757 - RNA, 15 nt, Bordetella pertussis
agccaggcgccagcg

SEQ ID NO: 2347758 - RNA, 19 nt, Bordetella pertussis
agccaggcgccagcggcau

SEQ ID NO: 2347759 - RNA, 13 nt, Bordetella pertussis
agccaggcggcgu

SEQ ID NO: 2347760 - RNA, 21 nt, Bordetella pertussis
agccaggcggcguaguucagc

SEQ ID NO: 2347761 - RNA, 17 nt, Bordetella pertussis
agccaggcgguggccuc

SEQ ID NO: 2347762 - RNA, 19 nt, Bordetella pertussis
agccagguaagcuggcgcu

SEQ ID NO: 2347763 - RNA, 14 nt, Bordetella pertussis
agccagguggacag

SEQ ID NO: 2347764 - RNA, 11 nt, Bordetella pertussis
agccagugccu

SEQ ID NO: 2347765 - RNA, 14 nt, Bordetella pertussis
agccagugccucag

SEQ ID NO: 2347766 - RNA, 15 nt, Bordetella pertussis
agccagugccucagg

SEQ ID NO: 2347767 - RNA, 15 nt, Bordetella pertussis
agccaucaucaucgu

SEQ ID NO: 2347768 - RNA, 21 nt, Bordetella pertussis
agccaucaucaucgucggcgc

SEQ ID NO: 2347769 - RNA, 18 nt, Bordetella pertussis
agccauccucgcccagcg

SEQ ID NO: 2347770 - RNA, 20 nt, Bordetella pertussis
agccaugccgucuggcggca

SEQ ID NO: 2347771 - RNA, 22 nt, Bordetella pertussis
agccaugccgucuggcggcagc

SEQ ID NO: 2347772 - RNA, 23 nt, Bordetella pertussis
agccaugccgucuggcggcagcu

SEQ ID NO: 2347773 - RNA, 15 nt, Bordetella pertussis
agccaugcggacgcc

SEQ ID NO: 2347774 - RNA, 20 nt, Bordetella pertussis
agccaugcggacgccagccc

SEQ ID NO: 2347775 - RNA, 21 nt, Bordetella pertussis
agccaugcggacgccagcccu

SEQ ID NO: 2347776 - RNA, 13 nt, Bordetella pertussis
agccauucggcca

SEQ ID NO: 2347777 - RNA, 14 nt, Bordetella pertussis
agccauucggccag

SEQ ID NO: 2347778 - RNA, 16 nt, Bordetella pertussis
agccauugcccacagc

SEQ ID NO: 2347779 - RNA, 21 nt, Bordetella pertussis
agccauugccgcacgaucgcg

SEQ ID NO: 2347780 - RNA, 14 nt, Bordetella pertussis
agcccacaagccgu

SEQ ID NO: 2347781 - RNA, 12 nt, Bordetella pertussis
agcccaccagcg

SEQ ID NO: 2347782 - RNA, 22 nt, Bordetella pertussis
agcccaccagcgccacgccggc

SEQ ID NO: 2347783 - RNA, 20 nt, Bordetella pertussis
agcccaccgcgaaccaggcc

SEQ ID NO: 2347784 - RNA, 19 nt, Bordetella pertussis
agcccaccgggccggccug

SEQ ID NO: 2347785 - RNA, 12 nt, Bordetella pertussis
agcccacguagg

SEQ ID NO: 2347786 - RNA, 22 nt, Bordetella pertussis
agcccacucacgcaaggccgac

SEQ ID NO: 2347787 - RNA, 20 nt, Bordetella pertussis
agcccagcaccacggcaucg

SEQ ID NO: 2347788 - RNA, 15 nt, Bordetella pertussis
agcccagcaccugca

SEQ ID NO: 2347789 - RNA, 20 nt, Bordetella pertussis
agcccagcaccugcaggccg

SEQ ID NO: 2347790 - RNA, 14 nt, Bordetella pertussis
agcccagcccgccu

SEQ ID NO: 2347791 - RNA, 20 nt, Bordetella pertussis
agcccagcgcgauucccugg

SEQ ID NO: 2347792 - RNA, 11 nt, Bordetella pertussis
agcccaggccc

SEQ ID NO: 2347793 - RNA, 21 nt, Bordetella pertussis
agcccaggccgccggcggcgu

SEQ ID NO: 2347794 - RNA, 15 nt, Bordetella pertussis
agcccaggcggccca

SEQ ID NO: 2347795 - RNA, 16 nt, Bordetella pertussis
agcccaggcggcccag

SEQ ID NO: 2347796 - RNA, 23 nt, Bordetella pertussis
agcccaggcgggcgugcugcagg

SEQ ID NO: 2347797 - RNA, 15 nt, Bordetella pertussis
agcccagguccagcg

SEQ ID NO: 2347798 - RNA, 17 nt, Bordetella pertussis
agcccagguccagcgcc

SEQ ID NO: 2347799 - RNA, 18 nt, Bordetella pertussis
agcccagguccagcgcca

SEQ ID NO: 2347800 - RNA, 20 nt, Bordetella pertussis
agcccagguccagcgccacg

SEQ ID NO: 2347801 - RNA, 19 nt, Bordetella pertussis
agcccagugucucgaccau

SEQ ID NO: 2347802 - RNA, 18 nt, Bordetella pertussis
agcccaguugcuggccca

SEQ ID NO: 2347803 - RNA, 15 nt, Bordetella pertussis
agcccaucagguggg

SEQ ID NO: 2347804 - RNA, 23 nt, Bordetella pertussis
agcccaucaggugggccgagccc

SEQ ID NO: 2347805 - RNA, 13 nt, Bordetella pertussis
agcccauggccag

SEQ ID NO: 2347806 - RNA, 16 nt, Bordetella pertussis
agcccauggccaggga

SEQ ID NO: 2347807 - RNA, 21 nt, Bordetella pertussis
agcccauggcguaggccucgc

SEQ ID NO: 2347808 - RNA, 16 nt, Bordetella pertussis
agcccauguucugguc

SEQ ID NO: 2347809 - RNA, 19 nt, Bordetella pertussis
agcccauguugaacugcag

SEQ ID NO: 2347810 - RNA, 22 nt, Bordetella pertussis
agcccauguugaacugcaggcc

SEQ ID NO: 2347811 - RNA, 12 nt, Bordetella pertussis
agccccaccuug

SEQ ID NO: 2347812 - RNA, 21 nt, Bordetella pertussis
agccccaccuugcccagcagc

SEQ ID NO: 2347813 - RNA, 12 nt, Bordetella pertussis
agccccagcagc

SEQ ID NO: 2347814 - RNA, 13 nt, Bordetella pertussis
agccccagcagca

SEQ ID NO: 2347815 - RNA, 17 nt, Bordetella pertussis
agccccagcagcacgcc

SEQ ID NO: 2347816 - RNA, 20 nt, Bordetella pertussis
agccccagcagcacgcccag

SEQ ID NO: 2347817 - RNA, 16 nt, Bordetella pertussis
agccccagcgccagcg

SEQ ID NO: 2347818 - RNA, 14 nt, Bordetella pertussis
agccccagcgccca

SEQ ID NO: 2347819 - RNA, 20 nt, Bordetella pertussis
agccccagcguccaggcggc

SEQ ID NO: 2347820 - RNA, 22 nt, Bordetella pertussis
agccccaggcaggcgggcccgc

SEQ ID NO: 2347821 - RNA, 23 nt, Bordetella pertussis
agccccaggcaggcgggcccgca

SEQ ID NO: 2347822 - RNA, 19 nt, Bordetella pertussis
agccccaggcgcguuucgg

SEQ ID NO: 2347823 - RNA, 20 nt, Bordetella pertussis
agccccccguaggcggccca

SEQ ID NO: 2347824 - RNA, 20 nt, Bordetella pertussis
agcccccgcgcugcgcccgc

SEQ ID NO: 2347825 - RNA, 19 nt, Bordetella pertussis
agcgcaugccgucgagcgc

SEQ ID NO: 2347826 - RNA, 15 nt, Bordetella pertussis
agcgcauugccgccg

SEQ ID NO: 2347827 - RNA, 17 nt, Bordetella pertussis
agcgcauugccgccgcc

SEQ ID NO: 2347828 - RNA, 13 nt, Bordetella pertussis
agcgcauugcggu

SEQ ID NO: 2347829 - RNA, 21 nt, Bordetella pertussis
agcgcauuggugagcacgcgc

SEQ ID NO: 2347830 - RNA, 23 nt, Bordetella pertussis
agcgcauuggugagcacgcgcac

SEQ ID NO: 2347831 - RNA, 20 nt, Bordetella pertussis
agcgccaccaccggcacgcc

SEQ ID NO: 2347832 - RNA, 14 nt, Bordetella pertussis
agcgccaccagcag

SEQ ID NO: 2347833 - RNA, 15 nt, Bordetella pertussis
agcgccaccagcagc

SEQ ID NO: 2347834 - RNA, 18 nt, Bordetella pertussis
agcgccaccagcagcgcc

SEQ ID NO: 2347835 - RNA, 20 nt, Bordetella pertussis
agcgccaccagcagcgccag

SEQ ID NO: 2347836 - RNA, 13 nt, Bordetella pertussis
agcgccaccggcu

SEQ ID NO: 2347837 - RNA, 14 nt, Bordetella pertussis
agcgccaccggcug

SEQ ID NO: 2347838 - RNA, 22 nt, Bordetella pertussis
agcgccaccguggccacggccg

SEQ ID NO: 2347839 - RNA, 16 nt, Bordetella pertussis
agcgccacgacgccgu

SEQ ID NO: 2347840 - RNA, 13 nt, Bordetella pertussis
agcgccacgccag

SEQ ID NO: 2347841 - RNA, 17 nt, Bordetella pertussis
agcgccacgccagcggc

SEQ ID NO: 2347842 - RNA, 19 nt, Bordetella pertussis
agcgccacgccagcggcga

SEQ ID NO: 2347843 - RNA, 18 nt, Bordetella pertussis
agcgccacgcccuggcgg

SEQ ID NO: 2347844 - RNA, 20 nt, Bordetella pertussis
agcgccacgcccuggcgguc

SEQ ID NO: 2347845 - RNA, 15 nt, Bordetella pertussis
agcgccacgccggcc

SEQ ID NO: 2347846 - RNA, 16 nt, Bordetella pertussis
agcgccacgccggcca

SEQ ID NO: 2347847 - RNA, 17 nt, Bordetella pertussis
agcgccacgccggccag

SEQ ID NO: 2347848 - RNA, 16 nt, Bordetella pertussis
agcgccacgcgagccc

SEQ ID NO: 2347849 - RNA, 18 nt, Bordetella pertussis
agcgccagaaagcgcggc

SEQ ID NO: 2347850 - RNA, 11 nt, Bordetella pertussis
agcgccagcac

SEQ ID NO: 2347851 - RNA, 13 nt, Bordetella pertussis
agcgccagcagca

SEQ ID NO: 2347852 - RNA, 23 nt, Bordetella pertussis
agcgccagcagcaggccguaacc

SEQ ID NO: 2347853 - RNA, 23 nt, Bordetella pertussis
agcgccagcagggucagcggccg

SEQ ID NO: 2347854 - RNA, 18 nt, Bordetella pertussis
agcgccagcgucaggcug

SEQ ID NO: 2347855 - RNA, 15 nt, Bordetella pertussis
agcgccagcguucgg

SEQ ID NO: 2347856 - RNA, 16 nt, Bordetella pertussis
agcgccaggaacagcg

SEQ ID NO: 2347857 - RNA, 21 nt, Bordetella pertussis
agcgccaggaacagcgccggc

SEQ ID NO: 2347858 - RNA, 11 nt, Bordetella pertussis
agcgccaggcc

SEQ ID NO: 2347859 - RNA, 14 nt, Bordetella pertussis
agcgccaggccgcg

SEQ ID NO: 2347860 - RNA, 17 nt, Bordetella pertussis
agcgccaggccgcgcag

SEQ ID NO: 2347861 - RNA, 11 nt, Bordetella pertussis
agcgccaggcu

SEQ ID NO: 2347862 - RNA, 14 nt, Bordetella pertussis
agcgccagggccag

SEQ ID NO: 2347863 - RNA, 18 nt, Bordetella pertussis
agcgccagggccaggccg

SEQ ID NO: 2347864 - RNA, 15 nt, Bordetella pertussis
agcgccagggccgcc

SEQ ID NO: 2347865 - RNA, 13 nt, Bordetella pertussis
agcgccagggccu

SEQ ID NO: 2347866 - RNA, 14 nt, Bordetella pertussis
agcgccaguccgcg

SEQ ID NO: 2347867 - RNA, 15 nt, Bordetella pertussis
agcgccaucgcgcgc

SEQ ID NO: 2347868 - RNA, 18 nt, Bordetella pertussis
agcgccaucggcauuucg

SEQ ID NO: 2347869 - RNA, 20 nt, Bordetella pertussis
agcgccaugaugucgcgcgc

SEQ ID NO: 2347870 - RNA, 21 nt, Bordetella pertussis
agcgccaugaugucgcgcgcc

SEQ ID NO: 2347871 - RNA, 23 nt, Bordetella pertussis
agcgccaugaugucgcgcgccug

SEQ ID NO: 2347872 - RNA, 17 nt, Bordetella pertussis
agcgcccaaucgggcag

SEQ ID NO: 2347873 - RNA, 14 nt, Bordetella pertussis
agcgcccaggccga

SEQ ID NO: 2347874 - RNA, 21 nt, Bordetella pertussis
agcgcccaggcgaugcccagc

SEQ ID NO: 2347875 - RNA, 19 nt, Bordetella pertussis
agcgccccgaucagcaagg

SEQ ID NO: 2347876 - RNA, 22 nt, Bordetella pertussis
agcgcccgccuucgcugacgcg

SEQ ID NO: 2347877 - RNA, 14 nt, Bordetella pertussis
agcgcccgcgccau

SEQ ID NO: 2347878 - RNA, 16 nt, Bordetella pertussis
agcgcccgcgccaucg

SEQ ID NO: 2347879 - RNA, 20 nt, Bordetella pertussis
agcgcccgcgccaucgcguc

SEQ ID NO: 2347880 - RNA, 22 nt, Bordetella pertussis
agcgcccgcgccaucgcgucga

SEQ ID NO: 2347881 - RNA, 16 nt, Bordetella pertussis
agcccggcccccagcc

SEQ ID NO: 2347882 - RNA, 12 nt, Bordetella pertussis
agcccggccgcc

SEQ ID NO: 2347883 - RNA, 18 nt, Bordetella pertussis
agcccggccgccagcaug

SEQ ID NO: 2347884 - RNA, 11 nt, Bordetella pertussis
agcccggcgcg

SEQ ID NO: 2347885 - RNA, 15 nt, Bordetella pertussis
agcccggcgcgaugg

SEQ ID NO: 2347886 - RNA, 16 nt, Bordetella pertussis
agcccggcgcgccacc

SEQ ID NO: 2347887 - RNA, 19 nt, Bordetella pertussis
agcccggcugcucguucug

SEQ ID NO: 2347888 - RNA, 20 nt, Bordetella pertussis
agcccggcuucgaucaugcc

SEQ ID NO: 2347889 - RNA, 20 nt, Bordetella pertussis
agcccgggaaacucgcgcag

SEQ ID NO: 2347890 - RNA, 14 nt, Bordetella pertussis
agcccguggcggga

SEQ ID NO: 2347891 - RNA, 17 nt, Bordetella pertussis
agcccgugggcggcgua

SEQ ID NO: 2347892 - RNA, 15 nt, Bordetella pertussis
agcccuacccugauc

SEQ ID NO: 2347893 - RNA, 22 nt, Bordetella pertussis
agcccucggucgucagcacgcc

SEQ ID NO: 2347894 - RNA, 17 nt, Bordetella pertussis
agcccucgucgcggccg

SEQ ID NO: 2347895 - RNA, 13 nt, Bordetella pertussis
agcccugcccgca

SEQ ID NO: 2347896 - RNA, 18 nt, Bordetella pertussis
agcccuggcgcugcagcg

SEQ ID NO: 2347897 - RNA, 18 nt, Bordetella pertussis
agcccuggcuuggccgaa

SEQ ID NO: 2347898 - RNA, 21 nt, Bordetella pertussis
agcccuucgacgcggcggccg

SEQ ID NO: 2347899 - RNA, 22 nt, Bordetella pertussis
agcccuugaucagcggcggcac

SEQ ID NO: 2347900 - RNA, 14 nt, Bordetella pertussis
agcccuuguggccg

SEQ ID NO: 2347901 - RNA, 16 nt, Bordetella pertussis
agcccuuguggccgcc

SEQ ID NO: 2347902 - RNA, 15 nt, Bordetella pertussis
agccgaacugggucu

SEQ ID NO: 2347903 - RNA, 18 nt, Bordetella pertussis
agccgaaguacacggcca

SEQ ID NO: 2347904 - RNA, 19 nt, Bordetella pertussis
agccgaaguacacggccag

SEQ ID NO: 2347905 - RNA, 23 nt, Bordetella pertussis
agccgaaguacacggccagcacg

SEQ ID NO: 2347906 - RNA, 15 nt, Bordetella pertussis
agccgaauccggcca

SEQ ID NO: 2347907 - RNA, 19 nt, Bordetella pertussis
agccgaauccggccagcac

SEQ ID NO: 2347908 - RNA, 19 nt, Bordetella pertussis
agccgacaggcgcgcaggc

SEQ ID NO: 2347909 - RNA, 23 nt, Bordetella pertussis
agccgacgggcggggugaucugc

SEQ ID NO: 2347910 - RNA, 12 nt, Bordetella pertussis
agccgagccugg

SEQ ID NO: 2347911 - RNA, 20 nt, Bordetella pertussis
agccgaucagccggccaugg

SEQ ID NO: 2347912 - RNA, 22 nt, Bordetella pertussis
agccgaucagccggccauggcc

SEQ ID NO: 2347913 - RNA, 15 nt, Bordetella pertussis
agccgaugcgccgcg

SEQ ID NO: 2347914 - RNA, 19 nt, Bordetella pertussis
agccgauggcauggggcag

SEQ ID NO: 2347915 - RNA, 19 nt, Bordetella pertussis
agccgaugucgaacagcug

SEQ ID NO: 2347916 - RNA, 18 nt, Bordetella pertussis
agccgcaagcuggcggcg

SEQ ID NO: 2347917 - RNA, 23 nt, Bordetella pertussis
agccgcaauaccuucagcccggc

SEQ ID NO: 2347918 - RNA, 15 nt, Bordetella pertussis
agccggcccagcacg

SEQ ID NO: 2347919 - RNA, 20 nt, Bordetella pertussis
agccggcccagcacgccgcg

SEQ ID NO: 2347920 - RNA, 19 nt, Bordetella pertussis
agccggcccguuggcaggc

SEQ ID NO: 2347921 - RNA, 20 nt, Bordetella pertussis
agccggccgaugacaucgcc

SEQ ID NO: 2347922 - RNA, 16 nt, Bordetella pertussis
agccggccgcgccgcg

SEQ ID NO: 2347923 - RNA, 15 nt, Bordetella pertussis
agccggccgcgcggc

SEQ ID NO: 2347924 - RNA, 13 nt, Bordetella pertussis
agccggccuccgg

SEQ ID NO: 2347925 - RNA, 18 nt, Bordetella pertussis
agccggccuccggggugc

SEQ ID NO: 2347926 - RNA, 14 nt, Bordetella pertussis
agccggcgccaucg

SEQ ID NO: 2347927 - RNA, 20 nt, Bordetella pertussis
agccggcgcgccauggucuc

SEQ ID NO: 2347928 - RNA, 16 nt, Bordetella pertussis
agccggcggccagcuu

SEQ ID NO: 2347929 - RNA, 15 nt, Bordetella pertussis
agccggcgggcggcu

SEQ ID NO: 2347930 - RNA, 22 nt, Bordetella pertussis
agccggcugcaagacgcccagg

SEQ ID NO: 2347931 - RNA, 23 nt, Bordetella pertussis
agccggcugcaagacgcccaggc

SEQ ID NO: 2347932 - RNA, 13 nt, Bordetella pertussis
agccgggcaccga

SEQ ID NO: 2347933 - RNA, 20 nt, Bordetella pertussis
agccgggcaccgagccgcag

SEQ ID NO: 2347934 - RNA, 18 nt, Bordetella pertussis
agccgggccacgcgcaca

SEQ ID NO: 2347935 - RNA, 15 nt, Bordetella pertussis
agccgggcgaucgcg

SEQ ID NO: 2347936 - RNA, 13 nt, Bordetella pertussis
agccgggcgccga

SEQ ID NO: 2347937 - RNA, 14 nt, Bordetella pertussis
agccgggcgccgau

SEQ ID NO: 2347938 - RNA, 22 nt, Bordetella pertussis
agccgggcgccgauccagccca

SEQ ID NO: 2347939 - RNA, 14 nt, Bordetella pertussis
agccgggcgccggc

SEQ ID NO: 2347940 - RNA, 13 nt, Bordetella pertussis
agccgggcggcca

SEQ ID NO: 2347941 - RNA, 19 nt, Bordetella pertussis
agccgggcugccggcagca

SEQ ID NO: 2347942 - RNA, 20 nt, Bordetella pertussis
agccgggcugccggcagcag

SEQ ID NO: 2347943 - RNA, 17 nt, Bordetella pertussis
agccggggcgagcgcag

SEQ ID NO: 2347944 - RNA, 21 nt, Bordetella pertussis
agccgggucuggccggccgcg

SEQ ID NO: 2347945 - RNA, 22 nt, Bordetella pertussis
agccggguggucgcgcccgccg

SEQ ID NO: 2347946 - RNA, 17 nt, Bordetella pertussis
agccgguacagccaggc

SEQ ID NO: 2347947 - RNA, 18 nt, Bordetella pertussis
agccgguacagccaggcc

SEQ ID NO: 2347948 - RNA, 19 nt, Bordetella pertussis
agccgguaucgcggcgcag

SEQ ID NO: 2347949 - RNA, 15 nt, Bordetella pertussis
agccgguccgccucg

SEQ ID NO: 2347950 - RNA, 18 nt, Bordetella pertussis
agccggugcgcagcacca

SEQ ID NO: 2347951 - RNA, 22 nt, Bordetella pertussis
agccggugcgcggcuugcagcg

SEQ ID NO: 2347952 - RNA, 18 nt, Bordetella pertussis
agccgguuggcgccuucc

SEQ ID NO: 2347953 - RNA, 21 nt, Bordetella pertussis
agccguccucgcgggccuggc

SEQ ID NO: 2347954 - RNA, 20 nt, Bordetella pertussis
agccguccuuggcgccggcg

SEQ ID NO: 2347955 - RNA, 21 nt, Bordetella pertussis
agccguccuuggcgccggcga

SEQ ID NO: 2347956 - RNA, 14 nt, Bordetella pertussis
agccgucgcgcugc

SEQ ID NO: 2347957 - RNA, 16 nt, Bordetella pertussis
agccgucgcgcugcaa

SEQ ID NO: 2347958 - RNA, 16 nt, Bordetella pertussis
agccgucgcgcugcag

SEQ ID NO: 2347959 - RNA, 14 nt, Bordetella pertussis
agccgucggcaugg

SEQ ID NO: 2347960 - RNA, 13 nt, Bordetella pertussis
agccgucggccac

SEQ ID NO: 2347961 - RNA, 14 nt, Bordetella pertussis
agccgugaccugcu

SEQ ID NO: 2347962 - RNA, 18 nt, Bordetella pertussis
agccgugcucgugcgcau

SEQ ID NO: 2347963 - RNA, 16 nt, Bordetella pertussis
agccguuaugcggacg

SEQ ID NO: 2347964 - RNA, 16 nt, Bordetella pertussis
agccguugcgccagcg

SEQ ID NO: 2347965 - RNA, 20 nt, Bordetella pertussis
agccguugcgccagcggcga

SEQ ID NO: 2347966 - RNA, 16 nt, Bordetella pertussis
agccuaggcugcagcc

SEQ ID NO: 2347967 - RNA, 19 nt, Bordetella pertussis
agccucacaugucacacga

SEQ ID NO: 2347968 - RNA, 20 nt, Bordetella pertussis
agccucauccccgcgugccu

SEQ ID NO: 2347969 - RNA, 16 nt, Bordetella pertussis
agccucgcccuugcgg

SEQ ID NO: 2347970 - RNA, 22 nt, Bordetella pertussis
agccucgcccuugcggcgaggc

SEQ ID NO: 2347971 - RNA, 20 nt, Bordetella pertussis
agccucguuggucagcaccu

SEQ ID NO: 2347972 - RNA, 21 nt, Bordetella pertussis
agccugacggcuacacccugc

SEQ ID NO: 2347973 - RNA, 15 nt, Bordetella pertussis
agccugccacaucga

SEQ ID NO: 2347974 - RNA, 15 nt, Bordetella pertussis
agccugcccgggcag

SEQ ID NO: 2347975 - RNA, 13 nt, Bordetella pertussis
agccugcccucgg

SEQ ID NO: 2347976 - RNA, 23 nt, Bordetella pertussis
agccugcccucgggcgacaggcg

SEQ ID NO: 2347977 - RNA, 14 nt, Bordetella pertussis
agccugccgcggcc

SEQ ID NO: 2347978 - RNA, 15 nt, Bordetella pertussis
agccugccgcggccg

SEQ ID NO: 2347979 - RNA, 12 nt, Bordetella pertussis
agccugccggcg

SEQ ID NO: 2347980 - RNA, 17 nt, Bordetella pertussis
agccugccggcgcgccc

SEQ ID NO: 2347981 - RNA, 15 nt, Bordetella pertussis
agccugccggcggcc

SEQ ID NO: 2347982 - RNA, 15 nt, Bordetella pertussis
agccugcuggugcug

SEQ ID NO: 2347983 - RNA, 17 nt, Bordetella pertussis
agccugcuggugcuggu

SEQ ID NO: 2347984 - RNA, 14 nt, Bordetella pertussis
agccuggcaaugcg

SEQ ID NO: 2347985 - RNA, 13 nt, Bordetella pertussis
agccuggcgccaa

SEQ ID NO: 2347986 - RNA, 23 nt, Bordetella pertussis
agccuggcgccaacccgccaucc

SEQ ID NO: 2347987 - RNA, 19 nt, Bordetella pertussis
agccugggccuguacugga

SEQ ID NO: 2347988 - RNA, 17 nt, Bordetella pertussis
agccugggcgcgcgccc

SEQ ID NO: 2347989 - RNA, 20 nt, Bordetella pertussis
agccugggcgcgcgcccagg

SEQ ID NO: 2347990 - RNA, 22 nt, Bordetella pertussis
agccugucccgacggggacagg

SEQ ID NO: 2347991 - RNA, 18 nt, Bordetella pertussis
agccugucccugcgggga

SEQ ID NO: 2347992 - RNA, 14 nt, Bordetella pertussis
agccugucguucgg

SEQ ID NO: 2347993 - RNA, 14 nt, Bordetella pertussis
agccuucggccggc

SEQ ID NO: 2347994 - RNA, 16 nt, Bordetella pertussis
agccuugcgcggccag

SEQ ID NO: 2347995 - RNA, 17 nt, Bordetella pertussis
agccuugcgcggccagc

SEQ ID NO: 2347996 - RNA, 20 nt, Bordetella pertussis
agccuugcgcggccagcacc

SEQ ID NO: 2347997 - RNA, 14 nt, Bordetella pertussis
agccuugcggcuug

SEQ ID NO: 2347998 - RNA, 18 nt, Bordetella pertussis
agccuuggucagcgaauc

SEQ ID NO: 2347999 - RNA, 20 nt, Bordetella pertussis
agccuuuccuccugccggcg

SEQ ID NO: 2348000 - RNA, 21 nt, Bordetella pertussis
agccuuuccuccugccggcgg

SEQ ID NO: 2348001 - RNA, 18 nt, Bordetella pertussis
agcgaaauggcggccucg

SEQ ID NO: 2348002 - RNA, 19 nt, Bordetella pertussis
agcgaaccgaauuccggcu

SEQ ID NO: 2348003 - RNA, 16 nt, Bordetella pertussis
agcgaaucguaggcgc

SEQ ID NO: 2348004 - RNA, 20 nt, Bordetella pertussis
agcgacacccgcggccaggg

SEQ ID NO: 2348005 - RNA, 14 nt, Bordetella pertussis
agcgacacggcggu

SEQ ID NO: 2348006 - RNA, 15 nt, Bordetella pertussis
agcgacagcacgguc

SEQ ID NO: 2348007 - RNA, 15 nt, Bordetella pertussis
agcgacagccaggcc

SEQ ID NO: 2348008 - RNA, 14 nt, Bordetella pertussis
agcgacccguggcc

SEQ ID NO: 2348009 - RNA, 17 nt, Bordetella pertussis
agcgacccguggcccgg

SEQ ID NO: 2348010 - RNA, 18 nt, Bordetella pertussis
agcgacccguggcccggg

SEQ ID NO: 2348011 - RNA, 22 nt, Bordetella pertussis
agcgaccgcggcgguccugcug

SEQ ID NO: 2348012 - RNA, 22 nt, Bordetella pertussis
agcgacgacuugaucagggcca

SEQ ID NO: 2348013 - RNA, 16 nt, Bordetella pertussis
agcgacgcgcgccggc

SEQ ID NO: 2348014 - RNA, 16 nt, Bordetella pertussis
agcgacggcagaugga

SEQ ID NO: 2348015 - RNA, 21 nt, Bordetella pertussis
agcgacggccccagcgccgcg

SEQ ID NO: 2348016 - RNA, 17 nt, Bordetella pertussis
agcgacuccggccgggc

SEQ ID NO: 2348017 - RNA, 18 nt, Bordetella pertussis
agcgacuccggccgggcc

SEQ ID NO: 2348018 - RNA, 22 nt, Bordetella pertussis
agcgacuccggccgggccagcg

SEQ ID NO: 2348019 - RNA, 21 nt, Bordetella pertussis
agcgacucgacgaacacgcgc

SEQ ID NO: 2348020 - RNA, 23 nt, Bordetella pertussis
agcgacuucuaccuggacggggu

SEQ ID NO: 2348021 - RNA, 20 nt, Bordetella pertussis
agcgcgccggccagggccac

SEQ ID NO: 2348022 - RNA, 13 nt, Bordetella pertussis
agcgcgccucgug

SEQ ID NO: 2348023 - RNA, 23 nt, Bordetella pertussis
agcgcgccucgugcgaggccacg

SEQ ID NO: 2348024 - RNA, 13 nt, Bordetella pertussis
agcgcgccugccc

SEQ ID NO: 2348025 - RNA, 20 nt, Bordetella pertussis
agcgcgcgauagauggccag

SEQ ID NO: 2348026 - RNA, 19 nt, Bordetella pertussis
agcgcgcgaucgccagcag

SEQ ID NO: 2348027 - RNA, 14 nt, Bordetella pertussis
agcgcgcgcagccg

SEQ ID NO: 2348028 - RNA, 16 nt, Bordetella pertussis
agcgcgcgcagccgcg

SEQ ID NO: 2348029 - RNA, 22 nt, Bordetella pertussis
agcgcgcgcagccgcgccaagg

SEQ ID NO: 2348030 - RNA, 17 nt, Bordetella pertussis
agcgcgcgccggccgac

SEQ ID NO: 2348031 - RNA, 18 nt, Bordetella pertussis
agcgcgcgcgaggcggcg

SEQ ID NO: 2348032 - RNA, 19 nt, Bordetella pertussis
agcgcgcgcgaggcggcgg

SEQ ID NO: 2348033 - RNA, 21 nt, Bordetella pertussis
agcgcgcgcgaggcggcggcc

SEQ ID NO: 2348034 - RNA, 14 nt, Bordetella pertussis
agcgcgcggccggc

SEQ ID NO: 2348035 - RNA, 16 nt, Bordetella pertussis
agcgcgcggccggccg

SEQ ID NO: 2348036 - RNA, 17 nt, Bordetella pertussis
agcgcgcggccggccgc

SEQ ID NO: 2348037 - RNA, 20 nt, Bordetella pertussis
agcgcgcggccggccgcgcc

SEQ ID NO: 2348038 - RNA, 13 nt, Bordetella pertussis
agcgcgcggccuc

SEQ ID NO: 2348039 - RNA, 19 nt, Bordetella pertussis
agcgcgcggugccgccugg

SEQ ID NO: 2348040 - RNA, 15 nt, Bordetella pertussis
agcgcggcacgcugc

SEQ ID NO: 2348041 - RNA, 21 nt, Bordetella pertussis
agcgcggcaucggccauggcg

SEQ ID NO: 2348042 - RNA, 16 nt, Bordetella pertussis
agcgcggcaugccgcu

SEQ ID NO: 2348043 - RNA, 18 nt, Bordetella pertussis
agcgcggcaugccgcugc

SEQ ID NO: 2348044 - RNA, 16 nt, Bordetella pertussis
agcgcggcaugcgcau

SEQ ID NO: 2348045 - RNA, 18 nt, Bordetella pertussis
agcgcggcaugcgcaugc

SEQ ID NO: 2348046 - RNA, 17 nt, Bordetella pertussis
agcgcggccacggccug

SEQ ID NO: 2348047 - RNA, 19 nt, Bordetella pertussis
agcgcggccacggccugcc

SEQ ID NO: 2348048 - RNA, 21 nt, Bordetella pertussis
agcgcggccacggccugcccg

SEQ ID NO: 2348049 - RNA, 14 nt, Bordetella pertussis
agcgcggccagcac

SEQ ID NO: 2348050 - RNA, 22 nt, Bordetella pertussis
agcgcggccagcaccggccgcc

SEQ ID NO: 2348051 - RNA, 13 nt, Bordetella pertussis
agcgcggccagcg

SEQ ID NO: 2348052 - RNA, 14 nt, Bordetella pertussis
agcgcggccagcgc

SEQ ID NO: 2348053 - RNA, 16 nt, Bordetella pertussis
agcgcggccagcgcgu

SEQ ID NO: 2348054 - RNA, 14 nt, Bordetella pertussis
agcgcggccaggcg

SEQ ID NO: 2348055 - RNA, 19 nt, Bordetella pertussis
agcgcggccaggcgcgugc

SEQ ID NO: 2348056 - RNA, 13 nt, Bordetella pertussis
agcgcggccaggu

SEQ ID NO: 2348057 - RNA, 15 nt, Bordetella pertussis
agcgcggccaggucg

SEQ ID NO: 2348058 - RNA, 17 nt, Bordetella pertussis
agcgcggcccgugccac

SEQ ID NO: 2348059 - RNA, 21 nt, Bordetella pertussis
agcgcggccggcaccaggauc

SEQ ID NO: 2348060 - RNA, 14 nt, Bordetella pertussis
agcgcggccgggcu

SEQ ID NO: 2348061 - RNA, 19 nt, Bordetella pertussis
agcgcggccgggucggccu

SEQ ID NO: 2348062 - RNA, 20 nt, Bordetella pertussis
agcgcggccgucaccgccgc

SEQ ID NO: 2348063 - RNA, 14 nt, Bordetella pertussis
agcgcggccucgcc

SEQ ID NO: 2348064 - RNA, 18 nt, Bordetella pertussis
agcgcggcgaaggcgcgg

SEQ ID NO: 2348065 - RNA, 23 nt, Bordetella pertussis
agcgcggcgaaggcgcggcugcg

SEQ ID NO: 2348066 - RNA, 21 nt, Bordetella pertussis
agcgcggcgauacgcgccgcc

SEQ ID NO: 2348067 - RNA, 22 nt, Bordetella pertussis
agcgcggcgauacgcgccgccu

SEQ ID NO: 2348068 - RNA, 17 nt, Bordetella pertussis
agcgcggcgcacagggc

SEQ ID NO: 2348069 - RNA, 18 nt, Bordetella pertussis
agcgcggcgccggccucc

SEQ ID NO: 2348070 - RNA, 22 nt, Bordetella pertussis
agcgcggcgccggccuccagca

SEQ ID NO: 2348071 - RNA, 15 nt, Bordetella pertussis
agcgcggcgcgcgau

SEQ ID NO: 2348072 - RNA, 15 nt, Bordetella pertussis
agcgcggcgcgcgcc

SEQ ID NO: 2348073 - RNA, 17 nt, Bordetella pertussis
agcgcggcgcgcgccag

SEQ ID NO: 2348074 - RNA, 19 nt, Bordetella pertussis
agcgcggcgcgcgccaggg

SEQ ID NO: 2348075 - RNA, 22 nt, Bordetella pertussis
agcgcggcgcgcgccagggcgc

SEQ ID NO: 2348076 - RNA, 22 nt, Bordetella pertussis
agcgcggcgcggccagcagcgc

SEQ ID NO: 2348077 - RNA, 21 nt, Bordetella pertussis
agcgcggcggacugcgccgca

SEQ ID NO: 2348078 - RNA, 14 nt, Bordetella pertussis
agcgcggcggcagc

SEQ ID NO: 2348079 - RNA, 14 nt, Bordetella pertussis
agcgcggcggcgac

SEQ ID NO: 2348080 - RNA, 23 nt, Bordetella pertussis
agcgcggcggcgaccggcgccgg

SEQ ID NO: 2348081 - RNA, 13 nt, Bordetella pertussis
agcgcggcggcgu

SEQ ID NO: 2348082 - RNA, 15 nt, Bordetella pertussis
agcgcggcggcguga

SEQ ID NO: 2348083 - RNA, 12 nt, Bordetella pertussis
agcgcggcgggc

SEQ ID NO: 2348084 - RNA, 15 nt, Bordetella pertussis
agcgcggcugcgggc

SEQ ID NO: 2348085 - RNA, 23 nt, Bordetella pertussis
agcgcggcuugguugucgcgcac

SEQ ID NO: 2348086 - RNA, 19 nt, Bordetella pertussis
agcgcgggaagcgcucgcg

SEQ ID NO: 2348087 - RNA, 19 nt, Bordetella pertussis
agcgcgggccacugcgccu

SEQ ID NO: 2348088 - RNA, 23 nt, Bordetella pertussis
agcgcgggccacugcgccugggc

SEQ ID NO: 2348089 - RNA, 15 nt, Bordetella pertussis
agcgcgggccgccgc

SEQ ID NO: 2348090 - RNA, 20 nt, Bordetella pertussis
agcgcgggccgccgcacagc

SEQ ID NO: 2348091 - RNA, 14 nt, Bordetella pertussis
agcgcgggcgcaca

SEQ ID NO: 2348092 - RNA, 16 nt, Bordetella pertussis
agcgcgguggccagcg

SEQ ID NO: 2348093 - RNA, 15 nt, Bordetella pertussis
agcgcgguggccgcu

SEQ ID NO: 2348094 - RNA, 17 nt, Bordetella pertussis
agcgcgguggccgcuuc

SEQ ID NO: 2348095 - RNA, 15 nt, Bordetella pertussis
agcgcgguguugcgg

SEQ ID NO: 2348096 - RNA, 19 nt, Bordetella pertussis
agcgcgguugacugcagcc

SEQ ID NO: 2348097 - RNA, 16 nt, Bordetella pertussis
agcgcgucgagcagcg

SEQ ID NO: 2348098 - RNA, 17 nt, Bordetella pertussis
agcgcgucgagcaggcc

SEQ ID NO: 2348099 - RNA, 19 nt, Bordetella pertussis
agcgcgucgagcaggccgg

SEQ ID NO: 2348100 - RNA, 22 nt, Bordetella pertussis
agcgcgucgagcaggccggcgu

SEQ ID NO: 2348101 - RNA, 19 nt, Bordetella pertussis
agcgcgucgauggagucgg

SEQ ID NO: 2348102 - RNA, 18 nt, Bordetella pertussis
agcgcgucgccgccauug

SEQ ID NO: 2348103 - RNA, 22 nt, Bordetella pertussis
agcgcgucgcguagcgcggccg

SEQ ID NO: 2348104 - RNA, 16 nt, Bordetella pertussis
agcgcgucggccagcg

SEQ ID NO: 2348105 - RNA, 21 nt, Bordetella pertussis
agcgcgucggccagcgccgcg

SEQ ID NO: 2348106 - RNA, 16 nt, Bordetella pertussis
agcgcgucggccaggc

SEQ ID NO: 2348107 - RNA, 13 nt, Bordetella pertussis
agcgcgucggcgc

SEQ ID NO: 2348108 - RNA, 15 nt, Bordetella pertussis
agcgcgucggcgccg

SEQ ID NO: 2348109 - RNA, 19 nt, Bordetella pertussis
agcgcgucggcgccgaugg

SEQ ID NO: 2348110 - RNA, 14 nt, Bordetella pertussis
agcgcgucggcgcg

SEQ ID NO: 2348111 - RNA, 17 nt, Bordetella pertussis
agcgcgugcagccagcg

SEQ ID NO: 2348112 - RNA, 20 nt, Bordetella pertussis
agcgcgugcagccagcggcc

SEQ ID NO: 2348113 - RNA, 15 nt, Bordetella pertussis
agcgcguggccagca

SEQ ID NO: 2348114 - RNA, 16 nt, Bordetella pertussis
agcgcguggccagcac

SEQ ID NO: 2348115 - RNA, 19 nt, Bordetella pertussis
agcgcguggccagcacggc

SEQ ID NO: 2348116 - RNA, 17 nt, Bordetella pertussis
agcgcguggccaucaac

SEQ ID NO: 2348117 - RNA, 21 nt, Bordetella pertussis
agcgcguggccggcgacggca

SEQ ID NO: 2348118 - RNA, 18 nt, Bordetella pertussis
agcgcgugggccagcaac

SEQ ID NO: 2348119 - RNA, 20 nt, Bordetella pertussis
agcgcgugggccagcaacug

SEQ ID NO: 2348120 - RNA, 17 nt, Bordetella pertussis
agcgcgugggccagucc

SEQ ID NO: 2348121 - RNA, 19 nt, Bordetella pertussis
agcgcgugucccagccggc

SEQ ID NO: 2348122 - RNA, 23 nt, Bordetella pertussis
agcgcgugucccagccggcggca

SEQ ID NO: 2348123 - RNA, 20 nt, Bordetella pertussis
agcgcgugugguuggcgcug

SEQ ID NO: 2348124 - RNA, 13 nt, Bordetella pertussis
agcgcuccagcgu

SEQ ID NO: 2348125 - RNA, 16 nt, Bordetella pertussis
agcgcucgccggcgcg

SEQ ID NO: 2348126 - RNA, 18 nt, Bordetella pertussis
agcgcucgccggcgcgca

SEQ ID NO: 2348127 - RNA, 21 nt, Bordetella pertussis
agcgcucgccggcgcgcaggc

SEQ ID NO: 2348128 - RNA, 13 nt, Bordetella pertussis
agcgcucggccac

SEQ ID NO: 2348129 - RNA, 16 nt, Bordetella pertussis
agcgcucggccacgcu

SEQ ID NO: 2348130 - RNA, 13 nt, Bordetella pertussis
agcgcucgggcuc

SEQ ID NO: 2348131 - RNA, 18 nt, Bordetella pertussis
agcgcucguccaugccgg

SEQ ID NO: 2348132 - RNA, 18 nt, Bordetella pertussis
agcgcucgucggggugga

SEQ ID NO: 2348133 - RNA, 23 nt, Bordetella pertussis
agcgcucuucgcgguacgcccag

SEQ ID NO: 2348134 - RNA, 14 nt, Bordetella pertussis
agcgcccuggcgug

SEQ ID NO: 2348135 - RNA, 23 nt, Bordetella pertussis
agcgccgaccgcacgauggcgcg

SEQ ID NO: 2348136 - RNA, 19 nt, Bordetella pertussis
agcgccgacggcauggccg

SEQ ID NO: 2348137 - RNA, 15 nt, Bordetella pertussis
agcgccgagcgccag

SEQ ID NO: 2348138 - RNA, 14 nt, Bordetella pertussis
agcgccgccacagg

SEQ ID NO: 2348139 - RNA, 17 nt, Bordetella pertussis
agcgccgccacaggcug

SEQ ID NO: 2348140 - RNA, 18 nt, Bordetella pertussis
agcgccgccacaggcuga

SEQ ID NO: 2348141 - RNA, 13 nt, Bordetella pertussis
agcgccgccaccu

SEQ ID NO: 2348142 - RNA, 21 nt, Bordetella pertussis
agcgccgccagcauggcggcc

SEQ ID NO: 2348143 - RNA, 14 nt, Bordetella pertussis
agcgccgccagccg

SEQ ID NO: 2348144 - RNA, 16 nt, Bordetella pertussis
agcgccgccagccgcu

SEQ ID NO: 2348145 - RNA, 22 nt, Bordetella pertussis
agcgccgccagccgcuggcgcg

SEQ ID NO: 2348146 - RNA, 14 nt, Bordetella pertussis
agcgccgccaggcc

SEQ ID NO: 2348147 - RNA, 16 nt, Bordetella pertussis
agcgccgccaggccgu

SEQ ID NO: 2348148 - RNA, 23 nt, Bordetella pertussis
agcgccgccaggccgucgagcac

SEQ ID NO: 2348149 - RNA, 19 nt, Bordetella pertussis
agcgccgccauggcggcgc

SEQ ID NO: 2348150 - RNA, 19 nt, Bordetella pertussis
agcgccgccgacggcaugg

SEQ ID NO: 2348151 - RNA, 14 nt, Bordetella pertussis
agcgccgccgccau

SEQ ID NO: 2348152 - RNA, 15 nt, Bordetella pertussis
agcgccgccgccaug

SEQ ID NO: 2348153 - RNA, 21 nt, Bordetella pertussis
agcgccgccuucaccggcccc

SEQ ID NO: 2348154 - RNA, 18 nt, Bordetella pertussis
agcgccgcgaacuggcgg

SEQ ID NO: 2348155 - RNA, 20 nt, Bordetella pertussis
agcgccgcgaacuggcgguu

SEQ ID NO: 2348156 - RNA, 20 nt, Bordetella pertussis
agcgccgcgagcgccgaacc

SEQ ID NO: 2348157 - RNA, 13 nt, Bordetella pertussis
agcgccgcgccag

SEQ ID NO: 2348158 - RNA, 14 nt, Bordetella pertussis
agcgccgcgccagg

SEQ ID NO: 2348159 - RNA, 22 nt, Bordetella pertussis
agcgccgcgccagguaggccgg

SEQ ID NO: 2348160 - RNA, 20 nt, Bordetella pertussis
agcgccgcgccgaaggcgug

SEQ ID NO: 2348161 - RNA, 13 nt, Bordetella pertussis
agcgccgcgccuc

SEQ ID NO: 2348162 - RNA, 15 nt, Bordetella pertussis
agcgccgcgccucgg

SEQ ID NO: 2348163 - RNA, 11 nt, Bordetella pertussis
agcgccgcgcg

SEQ ID NO: 2348164 - RNA, 16 nt, Bordetella pertussis
agcgccgcgcgcucgg

SEQ ID NO: 2348165 - RNA, 17 nt, Bordetella pertussis
agcgccgcgcgcucgga

SEQ ID NO: 2348166 - RNA, 14 nt, Bordetella pertussis
agcgccgcggccac

SEQ ID NO: 2348167 - RNA, 18 nt, Bordetella pertussis
agcgccgcggccacgccc

SEQ ID NO: 2348168 - RNA, 15 nt, Bordetella pertussis
agcgccgcggccggc

SEQ ID NO: 2348169 - RNA, 20 nt, Bordetella pertussis
agcgccgcggccggcggcgc

SEQ ID NO: 2348170 - RNA, 15 nt, Bordetella pertussis
agcgccggcacgcug

SEQ ID NO: 2348171 - RNA, 20 nt, Bordetella pertussis
agcgccggcagccccagcgc

SEQ ID NO: 2348172 - RNA, 14 nt, Bordetella pertussis
agcgccggcagcgc

SEQ ID NO: 2348173 - RNA, 15 nt, Bordetella pertussis
agcgccggcaggcgc

SEQ ID NO: 2348174 - RNA, 16 nt, Bordetella pertussis
agcgccggcaggcgcg

SEQ ID NO: 2348175 - RNA, 23 nt, Bordetella pertussis
agcgccggcaggcgcgccagccc

SEQ ID NO: 2348176 - RNA, 22 nt, Bordetella pertussis
agcgccggcaugaagcgcagca

SEQ ID NO: 2348177 - RNA, 12 nt, Bordetella pertussis
agcgccggcccg

SEQ ID NO: 2348178 - RNA, 12 nt, Bordetella pertussis
agcgccggcgca

SEQ ID NO: 2348179 - RNA, 15 nt, Bordetella pertussis
agcgccggcugggcg

SEQ ID NO: 2348180 - RNA, 20 nt, Bordetella pertussis
agcgccggcuugcgccagcc

SEQ ID NO: 2348181 - RNA, 21 nt, Bordetella pertussis
agcgccggcuugcgccagcca

SEQ ID NO: 2348182 - RNA, 15 nt, Bordetella pertussis
agcgccgggaucggc

SEQ ID NO: 2348183 - RNA, 13 nt, Bordetella pertussis
agcgccgggcgcc

SEQ ID NO: 2348184 - RNA, 15 nt, Bordetella pertussis
agcgccgggcgccgc

SEQ ID NO: 2348185 - RNA, 18 nt, Bordetella pertussis
agcgccgggcgccgcgcc

SEQ ID NO: 2348186 - RNA, 21 nt, Bordetella pertussis
agcgccgggcgccgcgcccca

SEQ ID NO: 2348187 - RNA, 14 nt, Bordetella pertussis
agcggcgugcggcc

SEQ ID NO: 2348188 - RNA, 18 nt, Bordetella pertussis
agcggcgugcggcccagc

SEQ ID NO: 2348189 - RNA, 15 nt, Bordetella pertussis
agcggcguggcggcc

SEQ ID NO: 2348190 - RNA, 20 nt, Bordetella pertussis
agcggcguggcggccaggcc

SEQ ID NO: 2348191 - RNA, 22 nt, Bordetella pertussis
agcggcguggcggccaggccgg

SEQ ID NO: 2348192 - RNA, 15 nt, Bordetella pertussis
agcggcguggggccg

SEQ ID NO: 2348193 - RNA, 21 nt, Bordetella pertussis
agcggcguggggccggccgcg

SEQ ID NO: 2348194 - RNA, 18 nt, Bordetella pertussis
agcggcgugugcccagca

SEQ ID NO: 2348195 - RNA, 21 nt, Bordetella pertussis
agcggcgugugcccagcacca

SEQ ID NO: 2348196 - RNA, 13 nt, Bordetella pertussis
agcggcucaggcg

SEQ ID NO: 2348197 - RNA, 15 nt, Bordetella pertussis
agcggcucaggcgcg

SEQ ID NO: 2348198 - RNA, 16 nt, Bordetella pertussis
agcggcucaggcgcgg

SEQ ID NO: 2348199 - RNA, 19 nt, Bordetella pertussis
agcggcucgagcggcagca

SEQ ID NO: 2348200 - RNA, 13 nt, Bordetella pertussis
agcggcucgccuc

SEQ ID NO: 2348201 - RNA, 19 nt, Bordetella pertussis
agcggcuggccacuggccg

SEQ ID NO: 2348202 - RNA, 21 nt, Bordetella pertussis
agcggcuggccacuggccgcg

SEQ ID NO: 2348203 - RNA, 22 nt, Bordetella pertussis
agcggcuggccacuggccgcgc

SEQ ID NO: 2348204 - RNA, 14 nt, Bordetella pertussis
agcggcuggcggug

SEQ ID NO: 2348205 - RNA, 22 nt, Bordetella pertussis
agcggcuggcggugcgugcgcc

SEQ ID NO: 2348206 - RNA, 18 nt, Bordetella pertussis
agcggcuucaugccggcg

SEQ ID NO: 2348207 - RNA, 22 nt, Bordetella pertussis
agcgggaauucugaacaagggc

SEQ ID NO: 2348208 - RNA, 20 nt, Bordetella pertussis
agcgggccagcgcggccagg

SEQ ID NO: 2348209 - RNA, 18 nt, Bordetella pertussis
agcgggcccgacagcgcc

SEQ ID NO: 2348210 - RNA, 19 nt, Bordetella pertussis
agcgggcccgucgcgccag

SEQ ID NO: 2348211 - RNA, 21 nt, Bordetella pertussis
agcgggcccgucgcgccaggc

SEQ ID NO: 2348212 - RNA, 23 nt, Bordetella pertussis
agcgggcccgucgcgccaggccg

SEQ ID NO: 2348213 - RNA, 16 nt, Bordetella pertussis
agcgggccgcagcaug

SEQ ID NO: 2348214 - RNA, 21 nt, Bordetella pertussis
agcgggccgcagcauggcgcc

SEQ ID NO: 2348215 - RNA, 22 nt, Bordetella pertussis
agcgggccgcagcauggcgcca

SEQ ID NO: 2348216 - RNA, 15 nt, Bordetella pertussis
agcgggccggucgcg

SEQ ID NO: 2348217 - RNA, 20 nt, Bordetella pertussis
agcgggcgcgcccggcgcgc

SEQ ID NO: 2348218 - RNA, 22 nt, Bordetella pertussis
agcgggcgcgcccggcgcgccu

SEQ ID NO: 2348219 - RNA, 15 nt, Bordetella pertussis
agcgggcuggccagc

SEQ ID NO: 2348220 - RNA, 17 nt, Bordetella pertussis
agcgggcuggggcaggc

SEQ ID NO: 2348221 - RNA, 13 nt, Bordetella pertussis
agcggggacaggc

SEQ ID NO: 2348222 - RNA, 15 nt, Bordetella pertussis
agcgggugaugcugc

SEQ ID NO: 2348223 - RNA, 15 nt, Bordetella pertussis
agcggguugcgcgcc

SEQ ID NO: 2348224 - RNA, 17 nt, Bordetella pertussis
agcggguugcgcgccag

SEQ ID NO: 2348225 - RNA, 19 nt, Bordetella pertussis
agcggguugcgcgccagcu

SEQ ID NO: 2348226 - RNA, 15 nt, Bordetella pertussis
agcgguagccggcgu

SEQ ID NO: 2348227 - RNA, 19 nt, Bordetella pertussis
agcgguaguccaucgcguc

SEQ ID NO: 2348228 - RNA, 16 nt, Bordetella pertussis
agcgguauucguugcc

SEQ ID NO: 2348229 - RNA, 17 nt, Bordetella pertussis
agcgguauucguugccg

SEQ ID NO: 2348230 - RNA, 13 nt, Bordetella pertussis
agcgguccagcug

SEQ ID NO: 2348231 - RNA, 15 nt, Bordetella pertussis
agcgguccagcugcg

SEQ ID NO: 2348232 - RNA, 22 nt, Bordetella pertussis
agcgguccagcugcgcgcgagc

SEQ ID NO: 2348233 - RNA, 20 nt, Bordetella pertussis
agcggucgauguccagcgcc

SEQ ID NO: 2348234 - RNA, 14 nt, Bordetella pertussis
agcggugcaggggc

SEQ ID NO: 2348235 - RNA, 20 nt, Bordetella pertussis
agcggugcaggggccgcacg

SEQ ID NO: 2348236 - RNA, 13 nt, Bordetella pertussis
agcgguggcggcc

SEQ ID NO: 2348237 - RNA, 15 nt, Bordetella pertussis
agcgguggcggccgu

SEQ ID NO: 2348238 - RNA, 13 nt, Bordetella pertussis
agcgguggcgggc

SEQ ID NO: 2348239 - RNA, 17 nt, Bordetella pertussis
agcgguggcgggccagc

SEQ ID NO: 2348240 - RNA, 20 nt, Bordetella pertussis
agcgguucgucggcgcucuu

SEQ ID NO: 2348241 - RNA, 22 nt, Bordetella pertussis
agcgguucgucggcgcucuugg

SEQ ID NO: 2348242 - RNA, 14 nt, Bordetella pertussis
agcgguugcgccag

SEQ ID NO: 2348243 - RNA, 17 nt, Bordetella pertussis
agcgguugcgccagcuu

SEQ ID NO: 2348244 - RNA, 18 nt, Bordetella pertussis
agcguacguaccaggccg

SEQ ID NO: 2348245 - RNA, 13 nt, Bordetella pertussis
agcguaucgccgc

SEQ ID NO: 2348246 - RNA, 22 nt, Bordetella pertussis
agcguauuccccuucucggccg

SEQ ID NO: 2348247 - RNA, 23 nt, Bordetella pertussis
agcguauuccccuucucggccgu

SEQ ID NO: 2348248 - RNA, 17 nt, Bordetella pertussis
agcgucaauccgccgcc

SEQ ID NO: 2348249 - RNA, 15 nt, Bordetella pertussis
agcgucaccagcagg

SEQ ID NO: 2348250 - RNA, 21 nt, Bordetella pertussis
agcgucaccagcaggcggccg

SEQ ID NO: 2348251 - RNA, 22 nt, Bordetella pertussis
agcgucacggcaagacggcgcu

SEQ ID NO: 2348252 - RNA, 18 nt, Bordetella pertussis
agcgucagcacaucgccc

SEQ ID NO: 2348253 - RNA, 15 nt, Bordetella pertussis
agcgucagcugggca

SEQ ID NO: 2348254 - RNA, 17 nt, Bordetella pertussis
agcgucagcugggcaug

SEQ ID NO: 2348255 - RNA, 14 nt, Bordetella pertussis
agcguccagccgcc

SEQ ID NO: 2348256 - RNA, 12 nt, Bordetella pertussis
agcguccaggcg

SEQ ID NO: 2348257 - RNA, 15 nt, Bordetella pertussis
agcguccaggcggcc

SEQ ID NO: 2348258 - RNA, 16 nt, Bordetella pertussis
agcguccaggcggcca

SEQ ID NO: 2348259 - RNA, 23 nt, Bordetella pertussis
agcguccaggcggccaucgccgc

SEQ ID NO: 2348260 - RNA, 13 nt, Bordetella pertussis
agcguccgcgcgc

SEQ ID NO: 2348261 - RNA, 15 nt, Bordetella pertussis
agcguccgcgcgccg

SEQ ID NO: 2348262 - RNA, 16 nt, Bordetella pertussis
agcguccgcgcgccgc

SEQ ID NO: 2348263 - RNA, 15 nt, Bordetella pertussis
agcgucgagcugacg

SEQ ID NO: 2348264 - RNA, 12 nt, Bordetella pertussis
agcgucggccug

SEQ ID NO: 2348265 - RNA, 14 nt, Bordetella pertussis
agcgucucgaucac

SEQ ID NO: 2348266 - RNA, 14 nt, Bordetella pertussis
agcgucucgcccac

SEQ ID NO: 2348267 - RNA, 14 nt, Bordetella pertussis
agcgucugcgcauc

SEQ ID NO: 2348268 - RNA, 13 nt, Bordetella pertussis
agcgucugcuggu

SEQ ID NO: 2348269 - RNA, 15 nt, Bordetella pertussis
agcgucugcugguac

SEQ ID NO: 2348270 - RNA, 16 nt, Bordetella pertussis
agcgugaagucggccg

SEQ ID NO: 2348271 - RNA, 17 nt, Bordetella pertussis
agcgugacggcggcgcg

SEQ ID NO: 2348272 - RNA, 16 nt, Bordetella pertussis
agcgugaugccgucga

SEQ ID NO: 2348273 - RNA, 20 nt, Bordetella pertussis
agcgugaugccgucgagcgc

SEQ ID NO: 2348274 - RNA, 21 nt, Bordetella pertussis
agcgugaugccgucgagcgcg

SEQ ID NO: 2348275 - RNA, 21 nt, Bordetella pertussis
agcgugaugcggucggccaca

SEQ ID NO: 2348276 - RNA, 15 nt, Bordetella pertussis
agcgugauggggccg

SEQ ID NO: 2348277 - RNA, 21 nt, Bordetella pertussis
agcgugauggggccgggcgcc

SEQ ID NO: 2348278 - RNA, 17 nt, Bordetella pertussis
agcgugccgccggcgcg

SEQ ID NO: 2348279 - RNA, 23 nt, Bordetella pertussis
agcgugccgccggcgcguugcgg

SEQ ID NO: 2348280 - RNA, 17 nt, Bordetella pertussis
agcgugccggugacgac

SEQ ID NO: 2348281 - RNA, 13 nt, Bordetella pertussis
agcgugcgccccg

SEQ ID NO: 2348282 - RNA, 14 nt, Bordetella pertussis
agcgugcgccccgc

SEQ ID NO: 2348283 - RNA, 17 nt, Bordetella pertussis
agcgugcgccccgccuc

SEQ ID NO: 2348284 - RNA, 19 nt, Bordetella pertussis
agcgugcgccccgccucga

SEQ ID NO: 2348285 - RNA, 22 nt, Bordetella pertussis
agcguggcgcggguggccggau

SEQ ID NO: 2348286 - RNA, 20 nt, Bordetella pertussis
agcguggggacgcgggccac

SEQ ID NO: 2348287 - RNA, 22 nt, Bordetella pertussis
agcguggggacgcgggccacgc

SEQ ID NO: 2348288 - RNA, 23 nt, Bordetella pertussis
agcguggggacgcgggccacgcg

SEQ ID NO: 2348289 - RNA, 19 nt, Bordetella pertussis
agcguggugggccacucga

SEQ ID NO: 2348290 - RNA, 17 nt, Bordetella pertussis
agcguguagagcaggcc

SEQ ID NO: 2348291 - RNA, 20 nt, Bordetella pertussis
agcguguagagcaggccgcc

SEQ ID NO: 2348292 - RNA, 15 nt, Bordetella pertussis
agcguguaggcggcc

SEQ ID NO: 2348293 - RNA, 17 nt, Bordetella pertussis
agcgugucgaacaccag

SEQ ID NO: 2348294 - RNA, 14 nt, Bordetella pertussis
agcgugucgccgac

SEQ ID NO: 2348295 - RNA, 17 nt, Bordetella pertussis
agcgugugucccggcgg

SEQ ID NO: 2348296 - RNA, 20 nt, Bordetella pertussis
agcgugugucccggcggggc

SEQ ID NO: 2348297 - RNA, 22 nt, Bordetella pertussis
agcgugugucccggcggggcag

SEQ ID NO: 2348298 - RNA, 13 nt, Bordetella pertussis
agcguucauggcg

SEQ ID NO: 2348299 - RNA, 20 nt, Bordetella pertussis
agcguucauggcguaugaca

SEQ ID NO: 2348300 - RNA, 13 nt, Bordetella pertussis
agcguuccagcag

SEQ ID NO: 2348301 - RNA, 21 nt, Bordetella pertussis
agcguucgauagguuuucuca

SEQ ID NO: 2348302 - RNA, 20 nt, Bordetella pertussis
agcuggaagcgcgccaggcg

SEQ ID NO: 2348303 - RNA, 19 nt, Bordetella pertussis
agcuggaccccuugcggcc

SEQ ID NO: 2348304 - RNA, 20 nt, Bordetella pertussis
agcuggaccccuugcggccg

SEQ ID NO: 2348305 - RNA, 22 nt, Bordetella pertussis
agcuggacuauggccuggaugu

SEQ ID NO: 2348306 - RNA, 16 nt, Bordetella pertussis
agcuggagaccggguu

SEQ ID NO: 2348307 - RNA, 22 nt, Bordetella pertussis
agcuggaucuggugaaacagca

SEQ ID NO: 2348308 - RNA, 12 nt, Bordetella pertussis
agcuggccagcg

SEQ ID NO: 2348309 - RNA, 14 nt, Bordetella pertussis
agcuggcccugggc

SEQ ID NO: 2348310 - RNA, 18 nt, Bordetella pertussis
agcuggccgaugucgccg

SEQ ID NO: 2348311 - RNA, 13 nt, Bordetella pertussis
agcuggccggcga

SEQ ID NO: 2348312 - RNA, 14 nt, Bordetella pertussis
agcuggccggcgac

SEQ ID NO: 2348313 - RNA, 16 nt, Bordetella pertussis
agcuggccggcgacuu

SEQ ID NO: 2348314 - RNA, 17 nt, Bordetella pertussis
agcuggcgcagcacgcc

SEQ ID NO: 2348315 - RNA, 13 nt, Bordetella pertussis
agcuggcgccggu

SEQ ID NO: 2348316 - RNA, 16 nt, Bordetella pertussis
agcuggcgcgggcggc

SEQ ID NO: 2348317 - RNA, 17 nt, Bordetella pertussis
agcuggcgcgggcggcc

SEQ ID NO: 2348318 - RNA, 18 nt, Bordetella pertussis
agcuggcgcgggcggccu

SEQ ID NO: 2348319 - RNA, 19 nt, Bordetella pertussis
agcuggcgcgggcggccua

SEQ ID NO: 2348320 - RNA, 19 nt, Bordetella pertussis
agcuggcgcguggccgcca

SEQ ID NO: 2348321 - RNA, 17 nt, Bordetella pertussis
agcuggcggcgcagcac

SEQ ID NO: 2348322 - RNA, 18 nt, Bordetella pertussis
agcuggcggcgcagcacc

SEQ ID NO: 2348323 - RNA, 21 nt, Bordetella pertussis
agcuggcggcgcagcaccagg

SEQ ID NO: 2348324 - RNA, 13 nt, Bordetella pertussis
agcuggcggcgcg

SEQ ID NO: 2348325 - RNA, 16 nt, Bordetella pertussis
agcuggcggcgcgcgg

SEQ ID NO: 2348326 - RNA, 18 nt, Bordetella pertussis
agcuggcggcgcgcggcu

SEQ ID NO: 2348327 - RNA, 15 nt, Bordetella pertussis
agcuggcggcgcgcu

SEQ ID NO: 2348328 - RNA, 22 nt, Bordetella pertussis
agcuggcguucgucgccuccca

SEQ ID NO: 2348329 - RNA, 15 nt, Bordetella pertussis
agcuggcuggccagc

SEQ ID NO: 2348330 - RNA, 16 nt, Bordetella pertussis
agcuggcuggccagcg

SEQ ID NO: 2348331 - RNA, 13 nt, Bordetella pertussis
agcugggcggcgu

SEQ ID NO: 2348332 - RNA, 23 nt, Bordetella pertussis
agcuggggcgucccggugaucgu

SEQ ID NO: 2348333 - RNA, 18 nt, Bordetella pertussis
agcugguccaccaccuuc

SEQ ID NO: 2348334 - RNA, 21 nt, Bordetella pertussis
agcuggugccgguugcgcgcc

SEQ ID NO: 2348335 - RNA, 17 nt, Bordetella pertussis
agcuguagcccuggcgc

SEQ ID NO: 2348336 - RNA, 22 nt, Bordetella pertussis
agcuguccacgccgaaguggcu

SEQ ID NO: 2348337 - RNA, 19 nt, Bordetella pertussis
agcuguccuucguggcgcc

SEQ ID NO: 2348338 - RNA, 14 nt, Bordetella pertussis
agcugucggcgcug

SEQ ID NO: 2348339 - RNA, 15 nt, Bordetella pertussis
agcugucggcgcugg

SEQ ID NO: 2348340 - RNA, 17 nt, Bordetella pertussis
agcugugguaggccgau

SEQ ID NO: 2348341 - RNA, 15 nt, Bordetella pertussis
agcuguuccugcucg

SEQ ID NO: 2348342 - RNA, 20 nt, Bordetella pertussis
agcuguugcagcggcuucau

SEQ ID NO: 2348343 - RNA, 21 nt, Bordetella pertussis
agcuucaucaccuucccgcuu

SEQ ID NO: 2348344 - RNA, 23 nt, Bordetella pertussis
agcuuccagaucgaccaggaccu

SEQ ID NO: 2348345 - RNA, 17 nt, Bordetella pertussis
agcuucuggaucaccgc

SEQ ID NO: 2348346 - RNA, 22 nt, Bordetella pertussis
agcuucuucuuugcccuggcca

SEQ ID NO: 2348347 - RNA, 23 nt, Bordetella pertussis
agcuucuucuuugcccuggccac

SEQ ID NO: 2348348 - RNA, 14 nt, Bordetella pertussis
agcuugaccgccag

SEQ ID NO: 2348349 - RNA, 18 nt, Bordetella pertussis
agcuugaccgccagcauc

SEQ ID NO: 2348350 - RNA, 20 nt, Bordetella pertussis
agcuugaccuugagcacgcu

SEQ ID NO: 2348351 - RNA, 19 nt, Bordetella pertussis
agcuugagcgaaugcgcgu

SEQ ID NO: 2348352 - RNA, 20 nt, Bordetella pertussis
agcuugaugccggcguucug

SEQ ID NO: 2348353 - RNA, 15 nt, Bordetella pertussis
agcuugcaggcgccu

SEQ ID NO: 2348354 - RNA, 15 nt, Bordetella pertussis
agcuugcccggcgug

SEQ ID NO: 2348355 - RNA, 17 nt, Bordetella pertussis
agcuugccgcccagguc

SEQ ID NO: 2348356 - RNA, 23 nt, Bordetella pertussis
agcuugccuuacgcgguccgcag

SEQ ID NO: 2348357 - RNA, 12 nt, Bordetella pertussis
agcuugcgcgcc

SEQ ID NO: 2348358 - RNA, 21 nt, Bordetella pertussis
agcuugcgcgcccccacgccg

SEQ ID NO: 2348359 - RNA, 23 nt, Bordetella pertussis
agcuugcgcgcccccacgccgcu

SEQ ID NO: 2348360 - RNA, 15 nt, Bordetella pertussis
agcuugcgcgccgca

SEQ ID NO: 2348361 - RNA, 16 nt, Bordetella pertussis
agcuugcgcuggcgcg

SEQ ID NO: 2348362 - RNA, 18 nt, Bordetella pertussis
agcuuggccaccacgccc

SEQ ID NO: 2348363 - RNA, 20 nt, Bordetella pertussis
agcuuggccaccacgcccau

SEQ ID NO: 2348364 - RNA, 21 nt, Bordetella pertussis
agcuuggccaggcugucccag

SEQ ID NO: 2348365 - RNA, 15 nt, Bordetella pertussis
agcuuggccggugcc

SEQ ID NO: 2348366 - RNA, 20 nt, Bordetella pertussis
agcuugggcauuucccagcc

SEQ ID NO: 2348367 - RNA, 15 nt, Bordetella pertussis
agcuugucggccgcg

SEQ ID NO: 2348368 - RNA, 16 nt, Bordetella pertussis
aggaaaccgaccugau

SEQ ID NO: 2348369 - RNA, 15 nt, Bordetella pertussis
aggaaagaggccagg

SEQ ID NO: 2348370 - RNA, 15 nt, Bordetella pertussis
aggaaagcgccgccg

SEQ ID NO: 2348371 - RNA, 15 nt, Bordetella pertussis
aggaaagcggccugu

SEQ ID NO: 2348372 - RNA, 20 nt, Bordetella pertussis
aggaacaccaccuccaccgc

SEQ ID NO: 2348373 - RNA, 21 nt, Bordetella pertussis
aggaacaccaccuccaccgcc

SEQ ID NO: 2348374 - RNA, 15 nt, Bordetella pertussis
aggaacagcaacgcc

SEQ ID NO: 2348375 - RNA, 17 nt, Bordetella pertussis
aggaacagcgccggcag

SEQ ID NO: 2348376 - RNA, 16 nt, Bordetella pertussis
aggaacaggccggccu

SEQ ID NO: 2348377 - RNA, 19 nt, Bordetella pertussis
aggaacauguccaccagcc

SEQ ID NO: 2348378 - RNA, 20 nt, Bordetella pertussis
aggaacauguucacgcccag

SEQ ID NO: 2348379 - RNA, 18 nt, Bordetella pertussis
aggaaccagccgucggca

SEQ ID NO: 2348380 - RNA, 13 nt, Bordetella pertussis
aggaacgccagca

SEQ ID NO: 2348381 - RNA, 15 nt, Bordetella pertussis
aggaacgccagcagc

SEQ ID NO: 2348382 - RNA, 16 nt, Bordetella pertussis
aggaacgccagcagca

SEQ ID NO: 2348383 - RNA, 13 nt, Bordetella pertussis
aggaacgccgcgc

SEQ ID NO: 2348384 - RNA, 15 nt, Bordetella pertussis
aggaacggcauggca

SEQ ID NO: 2348385 - RNA, 16 nt, Bordetella pertussis
aggaacggcauggcau

SEQ ID NO: 2348386 - RNA, 17 nt, Bordetella pertussis
aggaacuccggcggcgc

SEQ ID NO: 2348387 - RNA, 18 nt, Bordetella pertussis
aggaacucgcacacgcgc

SEQ ID NO: 2348388 - RNA, 24 nt, Bordetella pertussis
aggaacucgcacacgcgcugggcg

SEQ ID NO: 2348389 - RNA, 22 nt, Bordetella pertussis
aggaacuggacggcgcugggga

SEQ ID NO: 2348390 - RNA, 19 nt, Bordetella pertussis
aggaagagcuggcgcugcu

SEQ ID NO: 2348391 - RNA, 15 nt, Bordetella pertussis
aggaagcagcccagc

SEQ ID NO: 2348392 - RNA, 16 nt, Bordetella pertussis
aggaagcagcccagca

SEQ ID NO: 2348393 - RNA, 20 nt, Bordetella pertussis
aggaagcagcccagcacgac

SEQ ID NO: 2348394 - RNA, 14 nt, Bordetella pertussis
aggaagccugcgcg

SEQ ID NO: 2348395 - RNA, 16 nt, Bordetella pertussis
aggaagccugcgcgcg

SEQ ID NO: 2348396 - RNA, 15 nt, Bordetella pertussis
aggaagcgcgccgcg

SEQ ID NO: 2348397 - RNA, 15 nt, Bordetella pertussis
aggaagcggcgcacc

SEQ ID NO: 2348398 - RNA, 13 nt, Bordetella pertussis
aggaaggcccgcg

SEQ ID NO: 2348399 - RNA, 14 nt, Bordetella pertussis
aggaaggcccgcgu

SEQ ID NO: 2348400 - RNA, 19 nt, Bordetella pertussis
aggaaggccgccgcgugcg

SEQ ID NO: 2348401 - RNA, 20 nt, Bordetella pertussis
aggaaggccgccgcgugcgc

SEQ ID NO: 2348402 - RNA, 20 nt, Bordetella pertussis
aggaagggugcggcgccacu

SEQ ID NO: 2348403 - RNA, 22 nt, Bordetella pertussis
aggaaguccugguuggccucgc

SEQ ID NO: 2348404 - RNA, 23 nt, Bordetella pertussis
aggaagucggucagcucgucgcc

SEQ ID NO: 2348405 - RNA, 23 nt, Bordetella pertussis
aggaaguugcccaccgacaugac

SEQ ID NO: 2348406 - RNA, 17 nt, Bordetella pertussis
aggacaaggcgcgcgcc

SEQ ID NO: 2348407 - RNA, 15 nt, Bordetella pertussis
aggacacgcagcuga

SEQ ID NO: 2348408 - RNA, 13 nt, Bordetella pertussis
aaaccauggaagc

SEQ ID NO: 2348409 - RNA, 18 nt, Bordetella pertussis
aaaccucgaugaacgacc

SEQ ID NO: 2348410 - RNA, 15 nt, Bordetella pertussis
aaacgcacgauuuca

SEQ ID NO: 2348411 - RNA, 15 nt, Bordetella pertussis
aaacgcgcagcaccg

SEQ ID NO: 2348412 - RNA, 18 nt, Bordetella pertussis
aaacgcgcagcaccggcg

SEQ ID NO: 2348413 - RNA, 21 nt, Bordetella pertussis
aaacggauugccgccgcgcag

SEQ ID NO: 2348414 - RNA, 20 nt, Bordetella pertussis
aaacggccgggucccuggcc

SEQ ID NO: 2348415 - RNA, 13 nt, Bordetella pertussis
aaacggcggcagg

SEQ ID NO: 2348416 - RNA, 21 nt, Bordetella pertussis
aaacucaccgccgcccgcagg

SEQ ID NO: 2348417 - RNA, 21 nt, Bordetella pertussis
aaacugcacuugcgaacggcc

SEQ ID NO: 2348418 - RNA, 13 nt, Bordetella pertussis
aaagagccugucc

SEQ ID NO: 2348419 - RNA, 14 nt, Bordetella pertussis
aaagaggccaggcc

SEQ ID NO: 2348420 - RNA, 16 nt, Bordetella pertussis
aaagcaagacagcaag

SEQ ID NO: 2348421 - RNA, 19 nt, Bordetella pertussis
aaagcccgcgccaccaccg

SEQ ID NO: 2348422 - RNA, 18 nt, Bordetella pertussis
aaagccugacggcuacac

SEQ ID NO: 2348423 - RNA, 14 nt, Bordetella pertussis
aaagcgcccaggcc

SEQ ID NO: 2348424 - RNA, 19 nt, Bordetella pertussis
aaagcgcuucugccagacg

SEQ ID NO: 2348425 - RNA, 15 nt, Bordetella pertussis
aaagcguuccagcag

SEQ ID NO: 2348426 - RNA, 14 nt, Bordetella pertussis
aaaggacacgcgcg

SEQ ID NO: 2348427 - RNA, 14 nt, Bordetella pertussis
aaaggccagcggcg

SEQ ID NO: 2348428 - RNA, 23 nt, Bordetella pertussis
aaagggcgcaccaugcggugcgc

SEQ ID NO: 2348429 - RNA, 22 nt, Bordetella pertussis
aaagggcgcggauguggggguu

SEQ ID NO: 2348430 - RNA, 15 nt, Bordetella pertussis
aaagguccuggagac

SEQ ID NO: 2348431 - RNA, 13 nt, Bordetella pertussis
aaauacgcuggcu

SEQ ID NO: 2348432 - RNA, 13 nt, Bordetella pertussis
aaauagccaugcg

SEQ ID NO: 2348433 - RNA, 17 nt, Bordetella pertussis
aaauagccgaccgcgcg

SEQ ID NO: 2348434 - RNA, 17 nt, Bordetella pertussis
aaauaggaucccggcgc

SEQ ID NO: 2348435 - RNA, 18 nt, Bordetella pertussis
aaauauugggcuggucgg

SEQ ID NO: 2348436 - RNA, 16 nt, Bordetella pertussis
aaaucaacgaucuagg

SEQ ID NO: 2348437 - RNA, 14 nt, Bordetella pertussis
aaauccagcgcgcc

SEQ ID NO: 2348438 - RNA, 20 nt, Bordetella pertussis
aaaucuucugcgccacggcg

SEQ ID NO: 2348439 - RNA, 19 nt, Bordetella pertussis
aaaugccgaagcgcgcgug

SEQ ID NO: 2348440 - RNA, 15 nt, Bordetella pertussis
aaauggaugcgcgcc

SEQ ID NO: 2348441 - RNA, 17 nt, Bordetella pertussis
aaauggggcggccggga

SEQ ID NO: 2348442 - RNA, 16 nt, Bordetella pertussis
aaauuauuugguggag

SEQ ID NO: 2348443 - RNA, 13 nt, Bordetella pertussis
aaauucugcaaaa

SEQ ID NO: 2348444 - RNA, 15 nt, Bordetella pertussis
aaauucugcaaaagu

SEQ ID NO: 2348445 - RNA, 23 nt, Bordetella pertussis
aacaaggcgacggucgcaaacag

SEQ ID NO: 2348446 - RNA, 22 nt, Bordetella pertussis
aacaaggugaaauagccaugcg

SEQ ID NO: 2348447 - RNA, 17 nt, Bordetella pertussis
aacaccaccgagggccg

SEQ ID NO: 2348448 - RNA, 20 nt, Bordetella pertussis
aacaccaggguggcgccggc

SEQ ID NO: 2348449 - RNA, 20 nt, Bordetella pertussis
aacaccagguuuuccacagc

SEQ ID NO: 2348450 - RNA, 19 nt, Bordetella pertussis
aacaccggcaggccgcgcu

SEQ ID NO: 2348451 - RNA, 16 nt, Bordetella pertussis
aacacgaccagcaggc

SEQ ID NO: 2348452 - RNA, 20 nt, Bordetella pertussis
aacacgcgcgccgcgggcug

SEQ ID NO: 2348453 - RNA, 13 nt, Bordetella pertussis
aacacgcggugca

SEQ ID NO: 2348454 - RNA, 12 nt, Bordetella pertussis
aacacguccagc

SEQ ID NO: 2348455 - RNA, 21 nt, Bordetella pertussis
aacacuuucaucaaacgcggc

SEQ ID NO: 2348456 - RNA, 20 nt, Bordetella pertussis
aacagcaucagcggcagcac

SEQ ID NO: 2348457 - RNA, 17 nt, Bordetella pertussis
aacagcauggcggcgcc

SEQ ID NO: 2348458 - RNA, 16 nt, Bordetella pertussis
aacagccgccccagca

SEQ ID NO: 2348459 - RNA, 19 nt, Bordetella pertussis
aacagccgccccagcagca

SEQ ID NO: 2348460 - RNA, 20 nt, Bordetella pertussis
aacagccgccccagcagcag

SEQ ID NO: 2348461 - RNA, 23 nt, Bordetella pertussis
aacagccgcgagguauuggccuu

SEQ ID NO: 2348462 - RNA, 14 nt, Bordetella pertussis
aacagccuggucag

SEQ ID NO: 2348463 - RNA, 14 nt, Bordetella pertussis
aacagcgccaggcu

SEQ ID NO: 2348464 - RNA, 15 nt, Bordetella pertussis
aacagcgccggcagc

SEQ ID NO: 2348465 - RNA, 19 nt, Bordetella pertussis
aacagcgccugcauccggc

SEQ ID NO: 2348466 - RNA, 16 nt, Bordetella pertussis
aacagcguccagccgc

SEQ ID NO: 2348467 - RNA, 16 nt, Bordetella pertussis
aacagcuugcccggcg

SEQ ID NO: 2348468 - RNA, 11 nt, Bordetella pertussis
aacaggcaccg

SEQ ID NO: 2348469 - RNA, 22 nt, Bordetella pertussis
aacaggcacgacgcgaaccagg

SEQ ID NO: 2348470 - RNA, 15 nt, Bordetella pertussis
aacaggcagcugcgc

SEQ ID NO: 2348471 - RNA, 21 nt, Bordetella pertussis
aacaggcgcgccagccgcgcg

SEQ ID NO: 2348472 - RNA, 19 nt, Bordetella pertussis
aacaggcugguggcgucga

SEQ ID NO: 2348473 - RNA, 18 nt, Bordetella pertussis
aacaucaaugacauggcc

SEQ ID NO: 2348474 - RNA, 20 nt, Bordetella pertussis
aacaugacguucuccagcgc

SEQ ID NO: 2348475 - RNA, 21 nt, Bordetella pertussis
aacauguccaccagccggccg

SEQ ID NO: 2348476 - RNA, 19 nt, Bordetella pertussis
aacauguucacgcccagga

SEQ ID NO: 2348477 - RNA, 19 nt, Bordetella pertussis
aaccacaggguggcgccca

SEQ ID NO: 2348478 - RNA, 23 nt, Bordetella pertussis
aaccacccggccaucgaagccag

SEQ ID NO: 2348479 - RNA, 21 nt, Bordetella pertussis
aaccacccuucgcgcugcaga

SEQ ID NO: 2348480 - RNA, 17 nt, Bordetella pertussis
aaccacgaacacgauga

SEQ ID NO: 2348481 - RNA, 17 nt, Bordetella pertussis
aaccacgagcugcagcc

SEQ ID NO: 2348482 - RNA, 15 nt, Bordetella pertussis
aaccagaucaggucg

SEQ ID NO: 2348483 - RNA, 16 nt, Bordetella pertussis
aaccagccgccgccau

SEQ ID NO: 2348484 - RNA, 17 nt, Bordetella pertussis
aaccagcgcaccaccag

SEQ ID NO: 2348485 - RNA, 17 nt, Bordetella pertussis
aaccaggccgccagggc

SEQ ID NO: 2348486 - RNA, 13 nt, Bordetella pertussis
aaccaggccgggg

SEQ ID NO: 2348487 - RNA, 22 nt, Bordetella pertussis
aaccaggcugcccuggcccagg

SEQ ID NO: 2348488 - RNA, 17 nt, Bordetella pertussis
aacccacccccagcagc

SEQ ID NO: 2348489 - RNA, 18 nt, Bordetella pertussis
aacccacccccagcagca

SEQ ID NO: 2348490 - RNA, 19 nt, Bordetella pertussis
aacccagcagcggcagcag

SEQ ID NO: 2348491 - RNA, 12 nt, Bordetella pertussis
aaccccagcagc

SEQ ID NO: 2348492 - RNA, 19 nt, Bordetella pertussis
aaccccaggggacggcgca

SEQ ID NO: 2348493 - RNA, 16 nt, Bordetella pertussis
aaccccgagggcgcgg

SEQ ID NO: 2348494 - RNA, 14 nt, Bordetella pertussis
aaccccgccaggcg

SEQ ID NO: 2348495 - RNA, 18 nt, Bordetella pertussis
aaccccggcugcgcggcc

SEQ ID NO: 2348496 - RNA, 22 nt, Bordetella pertussis
aacccgaguccuugacgccgcc

SEQ ID NO: 2348497 - RNA, 20 nt, Bordetella pertussis
aacccgccauccuggccgcc

SEQ ID NO: 2348498 - RNA, 17 nt, Bordetella pertussis
aacccgcccacgcggcg

SEQ ID NO: 2348499 - RNA, 15 nt, Bordetella pertussis
aacccgcggcaguuc

SEQ ID NO: 2348500 - RNA, 14 nt, Bordetella pertussis
aacccgcugggcca

SEQ ID NO: 2348501 - RNA, 18 nt, Bordetella pertussis
aacccggcaaucccggcg

SEQ ID NO: 2348502 - RNA, 18 nt, Bordetella pertussis
aacccggcgaagccggca

SEQ ID NO: 2348503 - RNA, 17 nt, Bordetella pertussis
aacccgggccgucgccg

SEQ ID NO: 2348504 - RNA, 19 nt, Bordetella pertussis
aacccguuccccaucaucu

SEQ ID NO: 2348505 - RNA, 22 nt, Bordetella pertussis
aacccguuccccaucaucugcg

SEQ ID NO: 2348506 - RNA, 17 nt, Bordetella pertussis
aacccugccuccaggcg

SEQ ID NO: 2348507 - RNA, 16 nt, Bordetella pertussis
aacccuucgcgcagca

SEQ ID NO: 2348508 - RNA, 23 nt, Bordetella pertussis
aacccuuuuuacaugcagccgcc

SEQ ID NO: 2348509 - RNA, 17 nt, Bordetella pertussis
aaccgaaaugccgcagc

SEQ ID NO: 2348510 - RNA, 19 nt, Bordetella pertussis
aaccgaauuccggcucgga

SEQ ID NO: 2348511 - RNA, 12 nt, Bordetella pertussis
aaccgacgcggc

SEQ ID NO: 2348512 - RNA, 15 nt, Bordetella pertussis
aaccgauccagcccg

SEQ ID NO: 2348513 - RNA, 13 nt, Bordetella pertussis
aaccgauggugcc

SEQ ID NO: 2348514 - RNA, 18 nt, Bordetella pertussis
aaccgcaacgccagcagg

SEQ ID NO: 2348515 - RNA, 19 nt, Bordetella pertussis
aaccgcagaagcagccgcg

SEQ ID NO: 2348516 - RNA, 22 nt, Bordetella pertussis
aaccgcagaagcagccgcgcgg

SEQ ID NO: 2348517 - RNA, 19 nt, Bordetella pertussis
aaaaacggcggaaauucau

SEQ ID NO: 2348518 - RNA, 15 nt, Bordetella pertussis
aaaaagcccgcgcca

SEQ ID NO: 2348519 - RNA, 21 nt, Bordetella pertussis
aaaaccgcucguaucgcccug

SEQ ID NO: 2348520 - RNA, 16 nt, Bordetella pertussis
aaaagugaucaccgcc

SEQ ID NO: 2348521 - RNA, 20 nt, Bordetella pertussis
aaccgcaggcaagcugcugg

SEQ ID NO: 2348522 - RNA, 22 nt, Bordetella pertussis
aaccgcgacgcauauccaggcg

SEQ ID NO: 2348523 - RNA, 15 nt, Bordetella pertussis
aaccgcgcagccgcu

SEQ ID NO: 2348524 - RNA, 18 nt, Bordetella pertussis
aaccgcgcccuggggcgc

SEQ ID NO: 2348525 - RNA, 19 nt, Bordetella pertussis
aaccggaacaccagcaagc

SEQ ID NO: 2348526 - RNA, 22 nt, Bordetella pertussis
aaccggcaagccuugcggcuug

SEQ ID NO: 2348527 - RNA, 19 nt, Bordetella pertussis
aaccggcgcgcgcggccag

SEQ ID NO: 2348528 - RNA, 17 nt, Bordetella pertussis
aaccgggacaggcaccu

SEQ ID NO: 2348529 - RNA, 16 nt, Bordetella pertussis
aaccggucggccggca

SEQ ID NO: 2348530 - RNA, 22 nt, Bordetella pertussis
aaccggucggccggcagcggcg

SEQ ID NO: 2348531 - RNA, 22 nt, Bordetella pertussis
aaccgguggugcugcugggcgc

SEQ ID NO: 2348532 - RNA, 17 nt, Bordetella pertussis
aaccgucgaugaccagc

SEQ ID NO: 2348533 - RNA, 14 nt, Bordetella pertussis
aaccgucgccagcg

SEQ ID NO: 2348534 - RNA, 17 nt, Bordetella pertussis
aaccucgccgcgccagc

SEQ ID NO: 2348535 - RNA, 15 nt, Bordetella pertussis
aaccugcacgcgggc

SEQ ID NO: 2348536 - RNA, 19 nt, Bordetella pertussis
aaccugcuggccgccggcg

SEQ ID NO: 2348537 - RNA, 12 nt, Bordetella pertussis
aaccuggcgcgc

SEQ ID NO: 2348538 - RNA, 11 nt, Bordetella pertussis
aaccuggucaa

SEQ ID NO: 2348539 - RNA, 19 nt, Bordetella pertussis
aaccuuccuccgacaggcg

SEQ ID NO: 2348540 - RNA, 21 nt, Bordetella pertussis
aacgacagaccguagcgcagg

SEQ ID NO: 2348541 - RNA, 14 nt, Bordetella pertussis
aacgacagcgacac

SEQ ID NO: 2348542 - RNA, 19 nt, Bordetella pertussis
aacgacgcaggcgccgcac

SEQ ID NO: 2348543 - RNA, 12 nt, Bordetella pertussis
aacgacuuggcg

SEQ ID NO: 2348544 - RNA, 23 nt, Bordetella pertussis
aacgacuugggcaguucgcccgg

SEQ ID NO: 2348545 - RNA, 17 nt, Bordetella pertussis
aacgagccggccgcgcc

SEQ ID NO: 2348546 - RNA, 16 nt, Bordetella pertussis
aacgcaggcgccgccc

SEQ ID NO: 2348547 - RNA, 14 nt, Bordetella pertussis
aacgcauugcgcgu

SEQ ID NO: 2348548 - RNA, 19 nt, Bordetella pertussis
aacgcauugcgcguaucca

SEQ ID NO: 2348549 - RNA, 21 nt, Bordetella pertussis
aacgccaagcugcuggccggc

SEQ ID NO: 2348550 - RNA, 22 nt, Bordetella pertussis
aacgccaagcugcuggccggcc

SEQ ID NO: 2348551 - RNA, 13 nt, Bordetella pertussis
aacgccagcagca

SEQ ID NO: 2348552 - RNA, 12 nt, Bordetella pertussis
aacgccagcagg

SEQ ID NO: 2348553 - RNA, 19 nt, Bordetella pertussis
aacgccagcccgacggcca

SEQ ID NO: 2348554 - RNA, 21 nt, Bordetella pertussis
aacgcccagguugcggccgcc

SEQ ID NO: 2348555 - RNA, 22 nt, Bordetella pertussis
aacgcccagguugcggccgcca

SEQ ID NO: 2348556 - RNA, 14 nt, Bordetella pertussis
aacgcccggcgcgg

SEQ ID NO: 2348557 - RNA, 15 nt, Bordetella pertussis
aacgcccggcgcggu

SEQ ID NO: 2348558 - RNA, 13 nt, Bordetella pertussis
aacgcccugacga

SEQ ID NO: 2348559 - RNA, 22 nt, Bordetella pertussis
aacgccgccgcagccgccagcg

SEQ ID NO: 2348560 - RNA, 22 nt, Bordetella pertussis
aacgccgccggcagggccagcg

SEQ ID NO: 2348561 - RNA, 20 nt, Bordetella pertussis
aacgccgcgcucagcaccag

SEQ ID NO: 2348562 - RNA, 23 nt, Bordetella pertussis
aacgccggccauggcggccggcg

SEQ ID NO: 2348563 - RNA, 22 nt, Bordetella pertussis
aacgccggccgccauggccggc

SEQ ID NO: 2348564 - RNA, 13 nt, Bordetella pertussis
aacgccggcggca

SEQ ID NO: 2348565 - RNA, 12 nt, Bordetella pertussis
aacgccgggccg

SEQ ID NO: 2348566 - RNA, 21 nt, Bordetella pertussis
aacgccgggccgcgccgccua

SEQ ID NO: 2348567 - RNA, 17 nt, Bordetella pertussis
aacgccgggccgugcgc

SEQ ID NO: 2348568 - RNA, 17 nt, Bordetella pertussis
aacgccucgggcuugag

SEQ ID NO: 2348569 - RNA, 14 nt, Bordetella pertussis
aacgccugccagaa

SEQ ID NO: 2348570 - RNA, 22 nt, Bordetella pertussis
aacgcgauuuccuugcgccgcc

SEQ ID NO: 2348571 - RNA, 19 nt, Bordetella pertussis
aacgcgcagcgaacggccc

SEQ ID NO: 2348572 - RNA, 21 nt, Bordetella pertussis
aacgcgcagcgaacggcccac

SEQ ID NO: 2348573 - RNA, 14 nt, Bordetella pertussis
aacgcgccggccca

SEQ ID NO: 2348574 - RNA, 15 nt, Bordetella pertussis
aacgcgccggcccag

SEQ ID NO: 2348575 - RNA, 20 nt, Bordetella pertussis
aacgcgcgccggccagcggc

SEQ ID NO: 2348576 - RNA, 16 nt, Bordetella pertussis
aacgcgcgcgcccugc

SEQ ID NO: 2348577 - RNA, 17 nt, Bordetella pertussis
aacgcgcguccuuggcg

SEQ ID NO: 2348578 - RNA, 22 nt, Bordetella pertussis
aacgcgcguccuuggcggccuu

SEQ ID NO: 2348579 - RNA, 14 nt, Bordetella pertussis
aacgcggccaugcg

SEQ ID NO: 2348580 - RNA, 18 nt, Bordetella pertussis
aacgcggcgccgccggcg

SEQ ID NO: 2348581 - RNA, 23 nt, Bordetella pertussis
aacgcggcgccgccggcggccug

SEQ ID NO: 2348582 - RNA, 23 nt, Bordetella pertussis
aacgcggucgcauuggccgccgc

SEQ ID NO: 2348583 - RNA, 21 nt, Bordetella pertussis
aacgcgguggcguuggccugc

SEQ ID NO: 2348584 - RNA, 12 nt, Bordetella pertussis
aacgcgucgaug

SEQ ID NO: 2348585 - RNA, 17 nt, Bordetella pertussis
aacgcugcgcgaugcgc

SEQ ID NO: 2348586 - RNA, 17 nt, Bordetella pertussis
aacgcuuccugggccug

SEQ ID NO: 2348587 - RNA, 18 nt, Bordetella pertussis
aacgcuugacggccagga

SEQ ID NO: 2348588 - RNA, 16 nt, Bordetella pertussis
aacggauugccgccgc

SEQ ID NO: 2348589 - RNA, 15 nt, Bordetella pertussis
aacggcagcgcgcgc

SEQ ID NO: 2348590 - RNA, 14 nt, Bordetella pertussis
aacggccaagcagc

SEQ ID NO: 2348591 - RNA, 11 nt, Bordetella pertussis
aacggccacca

SEQ ID NO: 2348592 - RNA, 17 nt, Bordetella pertussis
aacggccaccagggccc

SEQ ID NO: 2348593 - RNA, 19 nt, Bordetella pertussis
aacggccagcgucagcgca

SEQ ID NO: 2348594 - RNA, 13 nt, Bordetella pertussis
aacggccgcccgg

SEQ ID NO: 2348595 - RNA, 17 nt, Bordetella pertussis
aacggccggucagccca

SEQ ID NO: 2348596 - RNA, 23 nt, Bordetella pertussis
aacggccuucggcggcgcgcugg

SEQ ID NO: 2348597 - RNA, 19 nt, Bordetella pertussis
aacggcgcggccugcucga

SEQ ID NO: 2348598 - RNA, 11 nt, Bordetella pertussis
aacggcgcggg

SEQ ID NO: 2348599 - RNA, 19 nt, Bordetella pertussis
aacggcggcaggccgcgcc

SEQ ID NO: 2348600 - RNA, 23 nt, Bordetella pertussis
aacggcgggcgcgcaggccucgc

SEQ ID NO: 2348601 - RNA, 20 nt, Bordetella pertussis
aacggcgugcugcggcugau

SEQ ID NO: 2348602 - RNA, 17 nt, Bordetella pertussis
aacggcuuggcgugcgc

SEQ ID NO: 2348603 - RNA, 13 nt, Bordetella pertussis
aacgggcggcguc

SEQ ID NO: 2348604 - RNA, 13 nt, Bordetella pertussis
aacgggggcaggc

SEQ ID NO: 2348605 - RNA, 17 nt, Bordetella pertussis
aacggggguugccagau

SEQ ID NO: 2348606 - RNA, 14 nt, Bordetella pertussis
aacggggucaucgc

SEQ ID NO: 2348607 - RNA, 17 nt, Bordetella pertussis
aacgugccgucgggcgc

SEQ ID NO: 2348608 - RNA, 21 nt, Bordetella pertussis
aacgugccgucgggcgccgca

SEQ ID NO: 2348609 - RNA, 15 nt, Bordetella pertussis
aacgugcgccaggca

SEQ ID NO: 2348610 - RNA, 20 nt, Bordetella pertussis
aacuccaggaaagcgccgcc

SEQ ID NO: 2348611 - RNA, 15 nt, Bordetella pertussis
aacucgaggcggcgc

SEQ ID NO: 2348612 - RNA, 13 nt, Bordetella pertussis
aacucgcgcucgg

SEQ ID NO: 2348613 - RNA, 15 nt, Bordetella pertussis
aacucggccagcagc

SEQ ID NO: 2348614 - RNA, 16 nt, Bordetella pertussis
aacucggccagcagcu

SEQ ID NO: 2348615 - RNA, 21 nt, Bordetella pertussis
aacucgggguggaacugggcu

SEQ ID NO: 2348616 - RNA, 22 nt, Bordetella pertussis
aacucgggguggaacugggcug

SEQ ID NO: 2348617 - RNA, 15 nt, Bordetella pertussis
aacucgguggcgguc

SEQ ID NO: 2348618 - RNA, 15 nt, Bordetella pertussis
aacugccggcgcggg

SEQ ID NO: 2348619 - RNA, 17 nt, Bordetella pertussis
aacugccggcgcgggcg

SEQ ID NO: 2348620 - RNA, 18 nt, Bordetella pertussis
aacugcuugcgcgugcgc

SEQ ID NO: 2348621 - RNA, 18 nt, Bordetella pertussis
aacuggccggccuggcgc

SEQ ID NO: 2348622 - RNA, 20 nt, Bordetella pertussis
aacuggccggccuggcgcgc

SEQ ID NO: 2348623 - RNA, 13 nt, Bordetella pertussis
aacugggacaggc

SEQ ID NO: 2348624 - RNA, 19 nt, Bordetella pertussis
aacugggcgccggccagga

SEQ ID NO: 2348625 - RNA, 12 nt, Bordetella pertussis
aacuggugcccg

SEQ ID NO: 2348626 - RNA, 18 nt, Bordetella pertussis
aacugucaauagguugua

SEQ ID NO: 2348627 - RNA, 18 nt, Bordetella pertussis
aacugucgcgccacggcu

SEQ ID NO: 2348628 - RNA, 20 nt, Bordetella pertussis
aacuuccccgcgugccuguc

SEQ ID NO: 2348629 - RNA, 13 nt, Bordetella pertussis
aacuuggcgcggu

SEQ ID NO: 2348630 - RNA, 17 nt, Bordetella pertussis
aacuugggaucggccag

SEQ ID NO: 2348631 - RNA, 18 nt, Bordetella pertussis
aagacaugcugcgacagc

SEQ ID NO: 2348632 - RNA, 22 nt, Bordetella pertussis
aagacauggcgcgcgccagcgg

SEQ ID NO: 2348633 - RNA, 19 nt, Bordetella pertussis
aagaccgcggccgcgcugg

SEQ ID NO: 2348634 - RNA, 14 nt, Bordetella pertussis
aaccucgccgcgcc

SEQ ID NO: 2348635 - RNA, 21 nt, Bordetella pertussis
aaccucgccgcgccagcugcg

SEQ ID NO: 2348636 - RNA, 23 nt, Bordetella pertussis
aaccugcuggccgccggcgcggu

SEQ ID NO: 2348637 - RNA, 15 nt, Bordetella pertussis
aaccugguuacucug

SEQ ID NO: 2348638 - RNA, 18 nt, Bordetella pertussis
aaccugguuacucuguuc

SEQ ID NO: 2348639 - RNA, 22 nt, Bordetella pertussis
aacgaagaacagccgcugcaga

SEQ ID NO: 2348640 - RNA, 17 nt, Bordetella pertussis
aacgaauaaucgccggu

SEQ ID NO: 2348641 - RNA, 15 nt, Bordetella pertussis
aacgacgcaggcgcc

SEQ ID NO: 2348642 - RNA, 18 nt, Bordetella pertussis
aacgacgcaggcgccgca

SEQ ID NO: 2348643 - RNA, 20 nt, Bordetella pertussis
aacgacuuggcgcaaaccac

SEQ ID NO: 2348644 - RNA, 18 nt, Bordetella pertussis
aacgaggacaaccaggaa

SEQ ID NO: 2348645 - RNA, 13 nt, Bordetella pertussis
aacgauucggucg

SEQ ID NO: 2348646 - RNA, 13 nt, Bordetella pertussis
aacgauucuuucc

SEQ ID NO: 2348647 - RNA, 22 nt, Bordetella pertussis
aacgauucuuuccuggccggcg

SEQ ID NO: 2348648 - RNA, 22 nt, Bordetella pertussis
aacgcaauugcgugguggccuu

SEQ ID NO: 2348649 - RNA, 15 nt, Bordetella pertussis
aacgcaugcgugcgc

SEQ ID NO: 2348650 - RNA, 16 nt, Bordetella pertussis
aacgccaagcugcugg

SEQ ID NO: 2348651 - RNA, 12 nt, Bordetella pertussis
aacgccagcagc

SEQ ID NO: 2348652 - RNA, 20 nt, Bordetella pertussis
aacgccagggucugcugguc

SEQ ID NO: 2348653 - RNA, 22 nt, Bordetella pertussis
aacgccagggucugcuggucgc

SEQ ID NO: 2348654 - RNA, 16 nt, Bordetella pertussis
aacgcccggcccaggc

SEQ ID NO: 2348655 - RNA, 12 nt, Bordetella pertussis
aacgccgcccgu

SEQ ID NO: 2348656 - RNA, 17 nt, Bordetella pertussis
aacgccgccggcagggc

SEQ ID NO: 2348657 - RNA, 16 nt, Bordetella pertussis
aacgccgcgcucagca

SEQ ID NO: 2348658 - RNA, 16 nt, Bordetella pertussis
aacgccggccauggcg

SEQ ID NO: 2348659 - RNA, 23 nt, Bordetella pertussis
aacgccggccgccauggccggcg

SEQ ID NO: 2348660 - RNA, 16 nt, Bordetella pertussis
aacgccgggccgcgcc

SEQ ID NO: 2348661 - RNA, 19 nt, Bordetella pertussis
aacgccgggccgcgccgcc

SEQ ID NO: 2348662 - RNA, 23 nt, Bordetella pertussis
aacgccgggccgugcgccgggcg

SEQ ID NO: 2348663 - RNA, 15 nt, Bordetella pertussis
aacgccugccagaac

SEQ ID NO: 2348664 - RNA, 14 nt, Bordetella pertussis
aacgcgacagcgcu

SEQ ID NO: 2348665 - RNA, 16 nt, Bordetella pertussis
aacgcgcgcaacaggu

SEQ ID NO: 2348666 - RNA, 15 nt, Bordetella pertussis
aacgcgcgccggcca

SEQ ID NO: 2348667 - RNA, 21 nt, Bordetella pertussis
aacgcgcgccggccagcggca

SEQ ID NO: 2348668 - RNA, 22 nt, Bordetella pertussis
aacgcgcgccggccagcggcag

SEQ ID NO: 2348669 - RNA, 13 nt, Bordetella pertussis
aacgcggccagcg

SEQ ID NO: 2348670 - RNA, 13 nt, Bordetella pertussis
aacgcggcgccgc

SEQ ID NO: 2348671 - RNA, 22 nt, Bordetella pertussis
aacgcggcgcgugcagaucugc

SEQ ID NO: 2348672 - RNA, 19 nt, Bordetella pertussis
aacgcggcguaccggucca

SEQ ID NO: 2348673 - RNA, 16 nt, Bordetella pertussis
aacgcgguggcguugg

SEQ ID NO: 2348674 - RNA, 20 nt, Bordetella pertussis
aacgcguaggucaggcccac

SEQ ID NO: 2348675 - RNA, 17 nt, Bordetella pertussis
aacgcguucaagucgcc

SEQ ID NO: 2348676 - RNA, 21 nt, Bordetella pertussis
aacgcugaugcgcgucaggcg

SEQ ID NO: 2348677 - RNA, 16 nt, Bordetella pertussis
aacgcuuccugggccu

SEQ ID NO: 2348678 - RNA, 17 nt, Bordetella pertussis
aacggcaagagccuggc

SEQ ID NO: 2348679 - RNA, 13 nt, Bordetella pertussis
aacggcagcagcg

SEQ ID NO: 2348680 - RNA, 17 nt, Bordetella pertussis
aacggcagcagcgcgcc

SEQ ID NO: 2348681 - RNA, 22 nt, Bordetella pertussis
aacggcagcuugucgaucgcca

SEQ ID NO: 2348682 - RNA, 15 nt, Bordetella pertussis
aacggccccgccagg

SEQ ID NO: 2348683 - RNA, 19 nt, Bordetella pertussis
aacggccccgccagggcgg

SEQ ID NO: 2348684 - RNA, 14 nt, Bordetella pertussis
aacggccgggcgcc

SEQ ID NO: 2348685 - RNA, 20 nt, Bordetella pertussis
aacggccggucagcccaggc

SEQ ID NO: 2348686 - RNA, 23 nt, Bordetella pertussis
aacggccggucagcccaggcggg

SEQ ID NO: 2348687 - RNA, 18 nt, Bordetella pertussis
aacggccuucggcggcgc

SEQ ID NO: 2348688 - RNA, 20 nt, Bordetella pertussis
aacggccuucggcggcgcgc

SEQ ID NO: 2348689 - RNA, 17 nt, Bordetella pertussis
aacggcgcgaaggugcg

SEQ ID NO: 2348690 - RNA, 19 nt, Bordetella pertussis
aacggcgcgggaauauccg

SEQ ID NO: 2348691 - RNA, 13 nt, Bordetella pertussis
aacggcggcaggc

SEQ ID NO: 2348692 - RNA, 12 nt, Bordetella pertussis
aacgggccggcc

SEQ ID NO: 2348693 - RNA, 14 nt, Bordetella pertussis
aacgggcggcgucg

SEQ ID NO: 2348694 - RNA, 15 nt, Bordetella pertussis
aacgggcggcgucgc

SEQ ID NO: 2348695 - RNA, 12 nt, Bordetella pertussis
aacgggcguggc

SEQ ID NO: 2348696 - RNA, 15 nt, Bordetella pertussis
aacggggacgggcgc

SEQ ID NO: 2348697 - RNA, 16 nt, Bordetella pertussis
aacggggacgggcgcc

SEQ ID NO: 2348698 - RNA, 19 nt, Bordetella pertussis
aacgggguggccggcgcgc

SEQ ID NO: 2348699 - RNA, 16 nt, Bordetella pertussis
aacgguaucgcgucgg

SEQ ID NO: 2348700 - RNA, 16 nt, Bordetella pertussis
aacggugagccggcca

SEQ ID NO: 2348701 - RNA, 18 nt, Bordetella pertussis
aacggugcgagaucucga

SEQ ID NO: 2348702 - RNA, 12 nt, Bordetella pertussis
aacgucggcagc

SEQ ID NO: 2348703 - RNA, 11 nt, Bordetella pertussis
aacgugcaggc

SEQ ID NO: 2348704 - RNA, 13 nt, Bordetella pertussis
aacgugcgccagg

SEQ ID NO: 2348705 - RNA, 12 nt, Bordetella pertussis
aacguggcgcgc

SEQ ID NO: 2348706 - RNA, 23 nt, Bordetella pertussis
aacguggcggcgauguggcgcgc

SEQ ID NO: 2348707 - RNA, 15 nt, Bordetella pertussis
aacguugcugcagcg

SEQ ID NO: 2348708 - RNA, 14 nt, Bordetella pertussis
aacucaccgccgcc

SEQ ID NO: 2348709 - RNA, 22 nt, Bordetella pertussis
aacuccaggaaagcgccgccgc

SEQ ID NO: 2348710 - RNA, 13 nt, Bordetella pertussis
aacucgaggcggc

SEQ ID NO: 2348711 - RNA, 20 nt, Bordetella pertussis
aacucgaggcggcgcaggau

SEQ ID NO: 2348712 - RNA, 16 nt, Bordetella pertussis
aacucgauccgggccu

SEQ ID NO: 2348713 - RNA, 16 nt, Bordetella pertussis
aacucgauggccucgg

SEQ ID NO: 2348714 - RNA, 22 nt, Bordetella pertussis
aacucgccagguccguguucga

SEQ ID NO: 2348715 - RNA, 22 nt, Bordetella pertussis
aacucggccaccuggucgucgg

SEQ ID NO: 2348716 - RNA, 17 nt, Bordetella pertussis
aacucggccagcagcuu

SEQ ID NO: 2348717 - RNA, 14 nt, Bordetella pertussis
aacugcaggccgcc

SEQ ID NO: 2348718 - RNA, 14 nt, Bordetella pertussis
aacugccggcgcgg

SEQ ID NO: 2348719 - RNA, 18 nt, Bordetella pertussis
aacugccggcgcgggcgc

SEQ ID NO: 2348720 - RNA, 23 nt, Bordetella pertussis
aacugccggcgcgggcgcaggcg

SEQ ID NO: 2348721 - RNA, 18 nt, Bordetella pertussis
aacugccugcagcgcgcg

SEQ ID NO: 2348722 - RNA, 16 nt, Bordetella pertussis
aacugcgagugggugu

SEQ ID NO: 2348723 - RNA, 21 nt, Bordetella pertussis
aacuggccgacgauggccgga

SEQ ID NO: 2348724 - RNA, 17 nt, Bordetella pertussis
aacuggcgggugcugca

SEQ ID NO: 2348725 - RNA, 23 nt, Bordetella pertussis
aacugggccaaccacgagcugca

SEQ ID NO: 2348726 - RNA, 22 nt, Bordetella pertussis
aacugggcgccggccaggauga

SEQ ID NO: 2348727 - RNA, 13 nt, Bordetella pertussis
aacugggcgucgu

SEQ ID NO: 2348728 - RNA, 14 nt, Bordetella pertussis
aacugucgcgccac

SEQ ID NO: 2348729 - RNA, 17 nt, Bordetella pertussis
aacuucaccgucgacuu

SEQ ID NO: 2348730 - RNA, 19 nt, Bordetella pertussis
aagaacaccguuuccaagc

SEQ ID NO: 2348731 - RNA, 16 nt, Bordetella pertussis
aagaagcccggcugcu

SEQ ID NO: 2348732 - RNA, 23 nt, Bordetella pertussis
aagaagccgggcucgcugaccua

SEQ ID NO: 2348733 - RNA, 17 nt, Bordetella pertussis
aagacauggcgcgcgcc

SEQ ID NO: 2348734 - RNA, 23 nt, Bordetella pertussis
aagacauggcgcgcgccagcggc

SEQ ID NO: 2348735 - RNA, 16 nt, Bordetella pertussis
aagacgaagucccagc

SEQ ID NO: 2348736 - RNA, 21 nt, Bordetella pertussis
aagacgcccaggcccaccgca

SEQ ID NO: 2348737 - RNA, 13 nt, Bordetella pertussis
aagacgcgcucgc

SEQ ID NO: 2348738 - RNA, 21 nt, Bordetella pertussis
aagacggcuugaccacggcca

SEQ ID NO: 2348739 - RNA, 20 nt, Bordetella pertussis
aagacuucgucaacgcccug

SEQ ID NO: 2348740 - RNA, 13 nt, Bordetella pertussis
aagagccuguccc

SEQ ID NO: 2348741 - RNA, 22 nt, Bordetella pertussis
aagagccugucccgacggggac

SEQ ID NO: 2348742 - RNA, 19 nt, Bordetella pertussis
aagaggagcugcacaaggu

SEQ ID NO: 2348743 - RNA, 16 nt, Bordetella pertussis
aagaucaccugggcca

SEQ ID NO: 2348744 - RNA, 22 nt, Bordetella pertussis
aagaucaggcggcugcccaccu

SEQ ID NO: 2348745 - RNA, 22 nt, Bordetella pertussis
aagauccgccauaugcgcgaag

SEQ ID NO: 2348746 - RNA, 22 nt, Bordetella pertussis
aagaucgcauuucucggccugg

SEQ ID NO: 2348747 - RNA, 15 nt, Bordetella pertussis
aagauguaccagccc

SEQ ID NO: 2348748 - RNA, 16 nt, Bordetella pertussis
aagcaacaaccgcgcc

SEQ ID NO: 2348749 - RNA, 18 nt, Bordetella pertussis
aagaccgugaucggcgca

SEQ ID NO: 2348750 - RNA, 12 nt, Bordetella pertussis
aagacgccuguc

SEQ ID NO: 2348751 - RNA, 23 nt, Bordetella pertussis
aagacgcggggacaggcacacca

SEQ ID NO: 2348752 - RNA, 22 nt, Bordetella pertussis
aagacggcguuucuacugggug

SEQ ID NO: 2348753 - RNA, 22 nt, Bordetella pertussis
aagacggcuugaccacggccag

SEQ ID NO: 2348754 - RNA, 20 nt, Bordetella pertussis
aagacgguaucugucccggc

SEQ ID NO: 2348755 - RNA, 13 nt, Bordetella pertussis
aagacguggcccg

SEQ ID NO: 2348756 - RNA, 14 nt, Bordetella pertussis
aagacguggcccgc

SEQ ID NO: 2348757 - RNA, 21 nt, Bordetella pertussis
aagacuuccgugccauacagc

SEQ ID NO: 2348758 - RNA, 22 nt, Bordetella pertussis
aagagccguacucgaucgccau

SEQ ID NO: 2348759 - RNA, 23 nt, Bordetella pertussis
aagagccuggagcucgggugggc

SEQ ID NO: 2348760 - RNA, 13 nt, Bordetella pertussis
aagaggccaggcc

SEQ ID NO: 2348761 - RNA, 14 nt, Bordetella pertussis
aagaggccaggccc

SEQ ID NO: 2348762 - RNA, 21 nt, Bordetella pertussis
aagagggcuuuuugccuuggg

SEQ ID NO: 2348763 - RNA, 21 nt, Bordetella pertussis
aagauccagcuucaucaccuu

SEQ ID NO: 2348764 - RNA, 20 nt, Bordetella pertussis
aagaugaaucgcaugcgguu

SEQ ID NO: 2348765 - RNA, 18 nt, Bordetella pertussis
aagauguaccagcccagc

SEQ ID NO: 2348766 - RNA, 13 nt, Bordetella pertussis
aagcacaagcgcg

SEQ ID NO: 2348767 - RNA, 16 nt, Bordetella pertussis
aagcacagaugcacca

SEQ ID NO: 2348768 - RNA, 21 nt, Bordetella pertussis
aagcaccagguugcauccggc

SEQ ID NO: 2348769 - RNA, 16 nt, Bordetella pertussis
aagcacgaacagguug

SEQ ID NO: 2348770 - RNA, 17 nt, Bordetella pertussis
aagcacgaacagguuga

SEQ ID NO: 2348771 - RNA, 22 nt, Bordetella pertussis
aagcagacccgcgcccagcugu

SEQ ID NO: 2348772 - RNA, 22 nt, Bordetella pertussis
aagcagaccuaccaggccgacg

SEQ ID NO: 2348773 - RNA, 20 nt, Bordetella pertussis
aagcagcccagcacgacgaa

SEQ ID NO: 2348774 - RNA, 13 nt, Bordetella pertussis
aagcagccgcgcu

SEQ ID NO: 2348775 - RNA, 12 nt, Bordetella pertussis
aagcagccggcc

SEQ ID NO: 2348776 - RNA, 18 nt, Bordetella pertussis
aagcagggcauguugcgc

SEQ ID NO: 2348777 - RNA, 17 nt, Bordetella pertussis
aagcaggugaugcgcgc

SEQ ID NO: 2348778 - RNA, 19 nt, Bordetella pertussis
aagccagauaaaggccgca

SEQ ID NO: 2348779 - RNA, 21 nt, Bordetella pertussis
aagccagauaaaggccgcaac

SEQ ID NO: 2348780 - RNA, 22 nt, Bordetella pertussis
aagccaucgacaagcgcuacga

SEQ ID NO: 2348781 - RNA, 15 nt, Bordetella pertussis
aagcccaccgggccg

SEQ ID NO: 2348782 - RNA, 18 nt, Bordetella pertussis
aagcccaccgggccggcc

SEQ ID NO: 2348783 - RNA, 20 nt, Bordetella pertussis
aagcccaguucgguguugag

SEQ ID NO: 2348784 - RNA, 12 nt, Bordetella pertussis
aagcccauggcg

SEQ ID NO: 2348785 - RNA, 21 nt, Bordetella pertussis
aagcccgagcggcgccagucg

SEQ ID NO: 2348786 - RNA, 14 nt, Bordetella pertussis
aagcccggcagggu

SEQ ID NO: 2348787 - RNA, 23 nt, Bordetella pertussis
aagccgauccgcgacgcccuggc

SEQ ID NO: 2348788 - RNA, 22 nt, Bordetella pertussis
aagccgaugucgaacagcugca

SEQ ID NO: 2348789 - RNA, 16 nt, Bordetella pertussis
aagccgcaccaugcgg

SEQ ID NO: 2348790 - RNA, 23 nt, Bordetella pertussis
aagccgcacgcccgccugcagca

SEQ ID NO: 2348791 - RNA, 15 nt, Bordetella pertussis
aagccgcagcggcag

SEQ ID NO: 2348792 - RNA, 15 nt, Bordetella pertussis
aagccgccgcccucg

SEQ ID NO: 2348793 - RNA, 12 nt, Bordetella pertussis
aagccgccggcg

SEQ ID NO: 2348794 - RNA, 16 nt, Bordetella pertussis
aagccgccggcgcgcg

SEQ ID NO: 2348795 - RNA, 14 nt, Bordetella pertussis
aagccggaaccgcg

SEQ ID NO: 2348796 - RNA, 14 nt, Bordetella pertussis
aagccggccgcgcc

SEQ ID NO: 2348797 - RNA, 17 nt, Bordetella pertussis
aagccggccgcgccgcg

SEQ ID NO: 2348798 - RNA, 22 nt, Bordetella pertussis
aagccggguugucgaucaucag

SEQ ID NO: 2348799 - RNA, 24 nt, Bordetella pertussis
aagccggucgacccucagcccgca

SEQ ID NO: 2348800 - RNA, 22 nt, Bordetella pertussis
aagccucacaugucacacgaag

SEQ ID NO: 2348801 - RNA, 15 nt, Bordetella pertussis
aagccuugcgcggcc

SEQ ID NO: 2348802 - RNA, 16 nt, Bordetella pertussis
aagccuugcgcggcca

SEQ ID NO: 2348803 - RNA, 19 nt, Bordetella pertussis
aagccuugcgcggccagca

SEQ ID NO: 2348804 - RNA, 13 nt, Bordetella pertussis
aagccuugcggcc

SEQ ID NO: 2348805 - RNA, 14 nt, Bordetella pertussis
aagcgaacagggcg

SEQ ID NO: 2348806 - RNA, 17 nt, Bordetella pertussis
aagcgcaagcccaggcg

SEQ ID NO: 2348807 - RNA, 22 nt, Bordetella pertussis
aagcgcaccaguuucucggcca

SEQ ID NO: 2348808 - RNA, 15 nt, Bordetella pertussis
aagcgcagcaccagg

SEQ ID NO: 2348809 - RNA, 13 nt, Bordetella pertussis
aagcgcaugucga

SEQ ID NO: 2348810 - RNA, 22 nt, Bordetella pertussis
aagcgcccaggccgaucagcgg

SEQ ID NO: 2348811 - RNA, 20 nt, Bordetella pertussis
aagcgcccuggcguggcgcg

SEQ ID NO: 2348812 - RNA, 18 nt, Bordetella pertussis
aagcgccgccacaggcug

SEQ ID NO: 2348813 - RNA, 21 nt, Bordetella pertussis
aagcgcgacaugacgaugguc

SEQ ID NO: 2348814 - RNA, 18 nt, Bordetella pertussis
aagcgcgccagcagcgcc

SEQ ID NO: 2348815 - RNA, 19 nt, Bordetella pertussis
aagcgcgccagcagcgccg

SEQ ID NO: 2348816 - RNA, 12 nt, Bordetella pertussis
aagcgcgccgcg

SEQ ID NO: 2348817 - RNA, 14 nt, Bordetella pertussis
aagcgcgccgcgcg

SEQ ID NO: 2348818 - RNA, 20 nt, Bordetella pertussis
aagcgcgcguccugcgccag

SEQ ID NO: 2348819 - RNA, 13 nt, Bordetella pertussis
aagcgcggccggg

SEQ ID NO: 2348820 - RNA, 21 nt, Bordetella pertussis
aagcgcggcugcgggccggcg

SEQ ID NO: 2348821 - RNA, 22 nt, Bordetella pertussis
aagcgcgucgagcaggccggcg

SEQ ID NO: 2348822 - RNA, 15 nt, Bordetella pertussis
aagcgcguggccggc

SEQ ID NO: 2348823 - RNA, 23 nt, Bordetella pertussis
aagcgcguggccggcgacggcau

SEQ ID NO: 2348824 - RNA, 21 nt, Bordetella pertussis
aagcgcgugucccagccggcg

SEQ ID NO: 2348825 - RNA, 15 nt, Bordetella pertussis
aagcgcucgccggcg

SEQ ID NO: 2348826 - RNA, 18 nt, Bordetella pertussis
aagcgcuggacgcccugg

SEQ ID NO: 2348827 - RNA, 15 nt, Bordetella pertussis
aagcgcuucugccag

SEQ ID NO: 2348828 - RNA, 12 nt, Bordetella pertussis
aagcggccggcc

SEQ ID NO: 2348829 - RNA, 22 nt, Bordetella pertussis
aagcggcgauccgccgcggcca

SEQ ID NO: 2348830 - RNA, 21 nt, Bordetella pertussis
aagcggcgcaccagcgaggcg

SEQ ID NO: 2348831 - RNA, 22 nt, Bordetella pertussis
aagcggcgcaccagcgaggcgg

SEQ ID NO: 2348832 - RNA, 19 nt, Bordetella pertussis
aagcggcguggggccggcc

SEQ ID NO: 2348833 - RNA, 23 nt, Bordetella pertussis
aagcggcgugugcccagcaccag

SEQ ID NO: 2348834 - RNA, 17 nt, Bordetella pertussis
aagcggcucaggcgcgg

SEQ ID NO: 2348835 - RNA, 18 nt, Bordetella pertussis
aagcggcucaggcgcgga

SEQ ID NO: 2348836 - RNA, 23 nt, Bordetella pertussis
aagcggcugcccuugcuguacuc

SEQ ID NO: 2348837 - RNA, 18 nt, Bordetella pertussis
aagcgggccugccgcgcg

SEQ ID NO: 2348838 - RNA, 21 nt, Bordetella pertussis
aagcggugcgcuggaauaugg

SEQ ID NO: 2348839 - RNA, 16 nt, Bordetella pertussis
aagcguccgcgcgccg

SEQ ID NO: 2348840 - RNA, 13 nt, Bordetella pertussis
aagcgucggccug

SEQ ID NO: 2348841 - RNA, 13 nt, Bordetella pertussis
aagcugacgaaac

SEQ ID NO: 2348842 - RNA, 11 nt, Bordetella pertussis
aagcugcggcc

SEQ ID NO: 2348843 - RNA, 17 nt, Bordetella pertussis
aagcugcggccggucug

SEQ ID NO: 2348844 - RNA, 19 nt, Bordetella pertussis
aagcugcugcuggaccugg

SEQ ID NO: 2348845 - RNA, 16 nt, Bordetella pertussis
aagcugcuggccggcc

SEQ ID NO: 2348846 - RNA, 15 nt, Bordetella pertussis
aagcugcuggcgcgc

SEQ ID NO: 2348847 - RNA, 21 nt, Bordetella pertussis
aagcugcuggcgcgccaggcg

SEQ ID NO: 2348848 - RNA, 21 nt, Bordetella pertussis
aagcuggagaagcgccgcgcc

SEQ ID NO: 2348849 - RNA, 19 nt, Bordetella pertussis
aagcuggccagcgguacgc

SEQ ID NO: 2348850 - RNA, 17 nt, Bordetella pertussis
aagcuggcgccggucug

SEQ ID NO: 2348851 - RNA, 17 nt, Bordetella pertussis
aagcuggcgcuuggcca

SEQ ID NO: 2348852 - RNA, 12 nt, Bordetella pertussis
aagcuggcggcg

SEQ ID NO: 2348853 - RNA, 23 nt, Bordetella pertussis
aaggaaaucgcggcgcugugcaa

SEQ ID NO: 2348854 - RNA, 22 nt, Bordetella pertussis
aaggagacaucaugcagaaaca

SEQ ID NO: 2348855 - RNA, 23 nt, Bordetella pertussis
aaggagcgagcgaugagcaauuu

SEQ ID NO: 2348856 - RNA, 16 nt, Bordetella pertussis
aaggcagcaccgccac

SEQ ID NO: 2348857 - RNA, 22 nt, Bordetella pertussis
aaggcagcaccucggacgagac

SEQ ID NO: 2348858 - RNA, 14 nt, Bordetella pertussis
aaggcagcaggcug

SEQ ID NO: 2348859 - RNA, 17 nt, Bordetella pertussis
aaggcaugcgccagcgc

SEQ ID NO: 2348860 - RNA, 21 nt, Bordetella pertussis
aaggccaugaucaggccgaac

SEQ ID NO: 2348861 - RNA, 14 nt, Bordetella pertussis
aaggcccgccgcgg

SEQ ID NO: 2348862 - RNA, 20 nt, Bordetella pertussis
aaggcccggauauggccggc

SEQ ID NO: 2348863 - RNA, 13 nt, Bordetella pertussis
aagcaagccccag

SEQ ID NO: 2348864 - RNA, 14 nt, Bordetella pertussis
aagcacaagcgcgu

SEQ ID NO: 2348865 - RNA, 13 nt, Bordetella pertussis
aagcacagaugca

SEQ ID NO: 2348866 - RNA, 22 nt, Bordetella pertussis
aagcaccgccugcugcgccugg

SEQ ID NO: 2348867 - RNA, 14 nt, Bordetella pertussis
aagcacgaacaggu

SEQ ID NO: 2348868 - RNA, 16 nt, Bordetella pertussis
aagcacugcaggccau

SEQ ID NO: 2348869 - RNA, 15 nt, Bordetella pertussis
aagcagacccgcgcc

SEQ ID NO: 2348870 - RNA, 20 nt, Bordetella pertussis
aagcagccggaaacggaaac

SEQ ID NO: 2348871 - RNA, 23 nt, Bordetella pertussis
aagcagggaugccgguucgggcg

SEQ ID NO: 2348872 - RNA, 18 nt, Bordetella pertussis
aagcaggugaugcgcgcg

SEQ ID NO: 2348873 - RNA, 13 nt, Bordetella pertussis
aagccaagcaggg

SEQ ID NO: 2348874 - RNA, 20 nt, Bordetella pertussis
aagccagcgccugcgcggcc

SEQ ID NO: 2348875 - RNA, 23 nt, Bordetella pertussis
aagccagcggcgcggcgcgcugg

SEQ ID NO: 2348876 - RNA, 21 nt, Bordetella pertussis
aagcccacaccaucaagauga

SEQ ID NO: 2348877 - RNA, 17 nt, Bordetella pertussis
aagcccaccgggccggc

SEQ ID NO: 2348878 - RNA, 21 nt, Bordetella pertussis
aagcccguggcgggaggaagg

SEQ ID NO: 2348879 - RNA, 18 nt, Bordetella pertussis
aagccgaguggcgggcca

SEQ ID NO: 2348880 - RNA, 21 nt, Bordetella pertussis
aagccgauccgcgacgcccug

SEQ ID NO: 2348881 - RNA, 18 nt, Bordetella pertussis
aagccgcccggccggcac

SEQ ID NO: 2348882 - RNA, 21 nt, Bordetella pertussis
aagccgccggcgcgcggauga

SEQ ID NO: 2348883 - RNA, 19 nt, Bordetella pertussis
aagccgcugcgcuggccgc

SEQ ID NO: 2348884 - RNA, 19 nt, Bordetella pertussis
aagccggaauccuggcgac

SEQ ID NO: 2348885 - RNA, 21 nt, Bordetella pertussis
aagccggaauccuggcgacgg

SEQ ID NO: 2348886 - RNA, 22 nt, Bordetella pertussis
aagccggcccguuggcaggcca

SEQ ID NO: 2348887 - RNA, 16 nt, Bordetella pertussis
aagccgggcgccggcg

SEQ ID NO: 2348888 - RNA, 20 nt, Bordetella pertussis
aagccgggcucgcugaccua

SEQ ID NO: 2348889 - RNA, 13 nt, Bordetella pertussis
aagccggggugcc

SEQ ID NO: 2348890 - RNA, 16 nt, Bordetella pertussis
aagccguacagcgaag

SEQ ID NO: 2348891 - RNA, 14 nt, Bordetella pertussis
aagccguccuugag

SEQ ID NO: 2348892 - RNA, 22 nt, Bordetella pertussis
aagccguccuugagggcgcggg

SEQ ID NO: 2348893 - RNA, 21 nt, Bordetella pertussis
aagccguccuuggcgccggcg

SEQ ID NO: 2348894 - RNA, 13 nt, Bordetella pertussis
aagccugcgcgcg

SEQ ID NO: 2348895 - RNA, 22 nt, Bordetella pertussis
aagccuugcgcggccagcaccg

SEQ ID NO: 2348896 - RNA, 20 nt, Bordetella pertussis
aagcgagugcgccccgccac

SEQ ID NO: 2348897 - RNA, 14 nt, Bordetella pertussis
aagcgcagcaccag

SEQ ID NO: 2348898 - RNA, 17 nt, Bordetella pertussis
aagcgccacagcgccau

SEQ ID NO: 2348899 - RNA, 11 nt, Bordetella pertussis
aagcgcccugg

SEQ ID NO: 2348900 - RNA, 16 nt, Bordetella pertussis
aagcgcccuggcgugg

SEQ ID NO: 2348901 - RNA, 13 nt, Bordetella pertussis
aagcgccggcccg

SEQ ID NO: 2348902 - RNA, 16 nt, Bordetella pertussis
aagcgcgccagcagcg

SEQ ID NO: 2348903 - RNA, 14 nt, Bordetella pertussis
aagcgcgccaggcg

SEQ ID NO: 2348904 - RNA, 19 nt, Bordetella pertussis
aagcgcggcugcgggccgg

SEQ ID NO: 2348905 - RNA, 16 nt, Bordetella pertussis
aagcgcgucgauggag

SEQ ID NO: 2348906 - RNA, 17 nt, Bordetella pertussis
aagcgcgucgauggagu

SEQ ID NO: 2348907 - RNA, 16 nt, Bordetella pertussis
aagcgcguggccggcg

SEQ ID NO: 2348908 - RNA, 16 nt, Bordetella pertussis
aagcgcgugucccagc

SEQ ID NO: 2348909 - RNA, 17 nt, Bordetella pertussis
aagcgcucgcgcaggcg

SEQ ID NO: 2348910 - RNA, 23 nt, Bordetella pertussis
aagcgcucggccacgcucacgcc

SEQ ID NO: 2348911 - RNA, 19 nt, Bordetella pertussis
aagcgcuggauggucacgc

SEQ ID NO: 2348912 - RNA, 18 nt, Bordetella pertussis
aagcgcuucugccagacg

SEQ ID NO: 2348913 - RNA, 17 nt, Bordetella pertussis
aagcggcaggcggcaga

SEQ ID NO: 2348914 - RNA, 17 nt, Bordetella pertussis
aagcggcguggggccgg

SEQ ID NO: 2348915 - RNA, 18 nt, Bordetella pertussis
aagcggcugcccuugcug

SEQ ID NO: 2348916 - RNA, 13 nt, Bordetella pertussis
aagcggucgaugu

SEQ ID NO: 2348917 - RNA, 21 nt, Bordetella pertussis
aagcggucgauguccagcgcc

SEQ ID NO: 2348918 - RNA, 17 nt, Bordetella pertussis
aagcgguggcggccguu

SEQ ID NO: 2348919 - RNA, 17 nt, Bordetella pertussis
aagcguacguaccaggc

SEQ ID NO: 2348920 - RNA, 21 nt, Bordetella pertussis
aagcguacguaccaggccguc

SEQ ID NO: 2348921 - RNA, 22 nt, Bordetella pertussis
aagcguacguaccaggccgucg

SEQ ID NO: 2348922 - RNA, 14 nt, Bordetella pertussis
aagcgucgauggcg

SEQ ID NO: 2348923 - RNA, 16 nt, Bordetella pertussis
aagcugcccagcaauu

SEQ ID NO: 2348924 - RNA, 12 nt, Bordetella pertussis
aagcugccggca

SEQ ID NO: 2348925 - RNA, 15 nt, Bordetella pertussis
aagcuggcggcgcgc

SEQ ID NO: 2348926 - RNA, 23 nt, Bordetella pertussis
aagcugucggacgagcaagccca

SEQ ID NO: 2348927 - RNA, 15 nt, Bordetella pertussis
aaggaaguggccgag

SEQ ID NO: 2348928 - RNA, 16 nt, Bordetella pertussis
aaggacaaggcgcgua

SEQ ID NO: 2348929 - RNA, 18 nt, Bordetella pertussis
aaggauuucaccuaccuc

SEQ ID NO: 2348930 - RNA, 13 nt, Bordetella pertussis
aaggcaagcagcg

SEQ ID NO: 2348931 - RNA, 23 nt, Bordetella pertussis
aaggcaagcagcgagagcgccac

SEQ ID NO: 2348932 - RNA, 15 nt, Bordetella pertussis
aaggcagccugucgu

SEQ ID NO: 2348933 - RNA, 16 nt, Bordetella pertussis
aaggcaugcgccagcg

SEQ ID NO: 2348934 - RNA, 17 nt, Bordetella pertussis
aaggcauuggcgccgcg

SEQ ID NO: 2348935 - RNA, 13 nt, Bordetella pertussis
aaggccacgcggg

SEQ ID NO: 2348936 - RNA, 15 nt, Bordetella pertussis
aaggccaugaucagg

SEQ ID NO: 2348937 - RNA, 13 nt, Bordetella pertussis
aaggccgaggcca

SEQ ID NO: 2348938 - RNA, 14 nt, Bordetella pertussis
aaggccgaggccag

SEQ ID NO: 2348939 - RNA, 16 nt, Bordetella pertussis
aaggccgccggacgca

SEQ ID NO: 2348940 - RNA, 21 nt, Bordetella pertussis
aaggccgcgaacgcgccggcc

SEQ ID NO: 2348941 - RNA, 15 nt, Bordetella pertussis
aaggccuuggccugg

SEQ ID NO: 2348942 - RNA, 23 nt, Bordetella pertussis
aaggcgaaaccggugaucagcag

SEQ ID NO: 2348943 - RNA, 22 nt, Bordetella pertussis
aaggcgaccggcaccugggccu

SEQ ID NO: 2348944 - RNA, 22 nt, Bordetella pertussis
aaggcgaucugcggcguggcgu

SEQ ID NO: 2348945 - RNA, 16 nt, Bordetella pertussis
aaggcgaugggcaccu

SEQ ID NO: 2348946 - RNA, 18 nt, Bordetella pertussis
aaggcgcccgggcugccg

SEQ ID NO: 2348947 - RNA, 21 nt, Bordetella pertussis
aaggcgccgacggcgcccugc

SEQ ID NO: 2348948 - RNA, 17 nt, Bordetella pertussis
aaggcgccggccaggcc

SEQ ID NO: 2348949 - RNA, 20 nt, Bordetella pertussis
aaggcgcgaguauucacgcc

SEQ ID NO: 2348950 - RNA, 17 nt, Bordetella pertussis
aaggcgcgcuccagcau

SEQ ID NO: 2348951 - RNA, 19 nt, Bordetella pertussis
aaggcggcccggccgccgc

SEQ ID NO: 2348952 - RNA, 16 nt, Bordetella pertussis
aaggcggccggcaggc

SEQ ID NO: 2348953 - RNA, 22 nt, Bordetella pertussis
aaggcgguguagaccaccagca

SEQ ID NO: 2348954 - RNA, 19 nt, Bordetella pertussis
aaggcgugcugaacgcgcg

SEQ ID NO: 2348955 - RNA, 17 nt, Bordetella pertussis
aaggcuucgucgaccag

SEQ ID NO: 2348956 - RNA, 22 nt, Bordetella pertussis
aaggcuucucgaccaggcgggc

SEQ ID NO: 2348957 - RNA, 14 nt, Bordetella pertussis
aaggcuuucugcuu

SEQ ID NO: 2348958 - RNA, 14 nt, Bordetella pertussis
aagggauagcgccg

SEQ ID NO: 2348959 - RNA, 12 nt, Bordetella pertussis
aagggcagcagc

SEQ ID NO: 2348960 - RNA, 20 nt, Bordetella pertussis
aagggcaggucgucgagccg

SEQ ID NO: 2348961 - RNA, 22 nt, Bordetella pertussis
aagggccugucacaccccacca

SEQ ID NO: 2348962 - RNA, 19 nt, Bordetella pertussis
aagggcggccaugccguca

SEQ ID NO: 2348963 - RNA, 18 nt, Bordetella pertussis
aagggcgucuucgccgac

SEQ ID NO: 2348964 - RNA, 20 nt, Bordetella pertussis
aagggcgucuucgccgacca

SEQ ID NO: 2348965 - RNA, 12 nt, Bordetella pertussis
aagggcgugcgc

SEQ ID NO: 2348966 - RNA, 16 nt, Bordetella pertussis
aagggcgugucucuuc

SEQ ID NO: 2348967 - RNA, 21 nt, Bordetella pertussis
aagggcuggccggccaacagc

SEQ ID NO: 2348968 - RNA, 13 nt, Bordetella pertussis
aaggggccagccu

SEQ ID NO: 2348969 - RNA, 22 nt, Bordetella pertussis
aaggggcgcauagcgaaagccg

SEQ ID NO: 2348970 - RNA, 12 nt, Bordetella pertussis
aaggggcucccc

SEQ ID NO: 2348971 - RNA, 16 nt, Bordetella pertussis
aaggggguucgcggaa

SEQ ID NO: 2348972 - RNA, 13 nt, Bordetella pertussis
aagggguggcugu

SEQ ID NO: 2348973 - RNA, 16 nt, Bordetella pertussis
aagggugcggcgccac

SEQ ID NO: 2348974 - RNA, 21 nt, Bordetella pertussis
aaggguugcaguucgccggcg

SEQ ID NO: 2348975 - RNA, 14 nt, Bordetella pertussis
aagguagccgauga

SEQ ID NO: 2348976 - RNA, 14 nt, Bordetella pertussis
aaggugccuguccc

SEQ ID NO: 2348977 - RNA, 22 nt, Bordetella pertussis
aaggugccuguccccgcgggga

SEQ ID NO: 2348978 - RNA, 17 nt, Bordetella pertussis
aagguuucguagccgcc

SEQ ID NO: 2348979 - RNA, 18 nt, Bordetella pertussis
aaguacacggccagcacg

SEQ ID NO: 2348980 - RNA, 17 nt, Bordetella pertussis
aaguaggcggccaggcc

SEQ ID NO: 2348981 - RNA, 19 nt, Bordetella pertussis
aaguagugcccccacgcug

SEQ ID NO: 2348982 - RNA, 22 nt, Bordetella pertussis
aaguagugcccccacgcugcgc

SEQ ID NO: 2348983 - RNA, 19 nt, Bordetella pertussis
aagucaucgauggccaggu

SEQ ID NO: 2348984 - RNA, 19 nt, Bordetella pertussis
aagucauguagcggccgcc

SEQ ID NO: 2348985 - RNA, 22 nt, Bordetella pertussis
aaguccagcguggugaugucgg

SEQ ID NO: 2348986 - RNA, 20 nt, Bordetella pertussis
aaguccugcaucgccaugcc

SEQ ID NO: 2348987 - RNA, 17 nt, Bordetella pertussis
aaguccuucagccgcug

SEQ ID NO: 2348988 - RNA, 22 nt, Bordetella pertussis
aagucggcccugucggccgaac

SEQ ID NO: 2348989 - RNA, 19 nt, Bordetella pertussis
aaguguggcgcaccgcgcu

SEQ ID NO: 2348990 - RNA, 13 nt, Bordetella pertussis
aaguucaucaucg

SEQ ID NO: 2348991 - RNA, 18 nt, Bordetella pertussis
aaguucggcagcgaggcg

SEQ ID NO: 2348992 - RNA, 14 nt, Bordetella pertussis
aaguugcucauggc

SEQ ID NO: 2348993 - RNA, 14 nt, Bordetella pertussis
aauacgucagagcc

SEQ ID NO: 2348994 - RNA, 14 nt, Bordetella pertussis
aauacuuguccgcc

SEQ ID NO: 2348995 - RNA, 22 nt, Bordetella pertussis
aauagccaugcggacgccagcc

SEQ ID NO: 2348996 - RNA, 15 nt, Bordetella pertussis
aaucaccgccgcgac

SEQ ID NO: 2348997 - RNA, 22 nt, Bordetella pertussis
aaucaccgccgcgaccgggccg

SEQ ID NO: 2348998 - RNA, 21 nt, Bordetella pertussis
aauccacagcuggugccgguu

SEQ ID NO: 2348999 - RNA, 13 nt, Bordetella pertussis
aauccagcgcgcc

SEQ ID NO: 2349000 - RNA, 21 nt, Bordetella pertussis
aauccagcgcgcccagaucga

SEQ ID NO: 2349001 - RNA, 23 nt, Bordetella pertussis
aaucccccgcgucggacgcgcgc

SEQ ID NO: 2349002 - RNA, 17 nt, Bordetella pertussis
aauccccgcuuccugcu

SEQ ID NO: 2349003 - RNA, 14 nt, Bordetella pertussis
aauccgccgccagc

SEQ ID NO: 2349004 - RNA, 21 nt, Bordetella pertussis
aauccgugguggggccgggcu

SEQ ID NO: 2349005 - RNA, 16 nt, Bordetella pertussis
aauccuggugccaguc

SEQ ID NO: 2349006 - RNA, 24 nt, Bordetella pertussis
aaucgacgaacaaggccggagcca

SEQ ID NO: 2349007 - RNA, 17 nt, Bordetella pertussis
aaucgauacgccgggcg

SEQ ID NO: 2349008 - RNA, 18 nt, Bordetella pertussis
aaucgaugaucacgcgcu

SEQ ID NO: 2349009 - RNA, 14 nt, Bordetella pertussis
aaucgaugaugugg

SEQ ID NO: 2349010 - RNA, 13 nt, Bordetella pertussis
aaucgcgcgccac

SEQ ID NO: 2349011 - RNA, 16 nt, Bordetella pertussis
aaucgcggcgcugugc

SEQ ID NO: 2349012 - RNA, 22 nt, Bordetella pertussis
aaucgcguucacguagaaauac

SEQ ID NO: 2349013 - RNA, 19 nt, Bordetella pertussis
aaucggcccguuccacagg

SEQ ID NO: 2349014 - RNA, 12 nt, Bordetella pertussis
aaucggcgucgg

SEQ ID NO: 2349015 - RNA, 19 nt, Bordetella pertussis
aaucggcgugcagcaagcc

SEQ ID NO: 2349016 - RNA, 22 nt, Bordetella pertussis
aaucgggcagcacgcgcaccag

SEQ ID NO: 2349017 - RNA, 23 nt, Bordetella pertussis
aaucgggcagcacgcgcaccagg

SEQ ID NO: 2349018 - RNA, 22 nt, Bordetella pertussis
aaucggucacgaucuggccgau

SEQ ID NO: 2349019 - RNA, 19 nt, Bordetella pertussis
aaucgugccggagauccgg

SEQ ID NO: 2349020 - RNA, 19 nt, Bordetella pertussis
aaucugccgcugaccggcg

SEQ ID NO: 2349021 - RNA, 17 nt, Bordetella pertussis
aaucugcgucgccuggu

SEQ ID NO: 2349022 - RNA, 20 nt, Bordetella pertussis
aaugcacgggcgcugcccag

SEQ ID NO: 2349023 - RNA, 13 nt, Bordetella pertussis
aaugccaggguga

SEQ ID NO: 2349024 - RNA, 17 nt, Bordetella pertussis
aaugcccaggaugcccu

SEQ ID NO: 2349025 - RNA, 19 nt, Bordetella pertussis
aaugccccacggguaccag

SEQ ID NO: 2349026 - RNA, 21 nt, Bordetella pertussis
aaugccgcccacgaucaccac

SEQ ID NO: 2349027 - RNA, 14 nt, Bordetella pertussis
aaugccgccgugau

SEQ ID NO: 2349028 - RNA, 20 nt, Bordetella pertussis
aaugccgccgugaugccgcc

SEQ ID NO: 2349029 - RNA, 21 nt, Bordetella pertussis
aaugccgccgugaugccgccc

SEQ ID NO: 2349030 - RNA, 23 nt, Bordetella pertussis
aaugccgccgugaugccgcccgc

SEQ ID NO: 2349031 - RNA, 14 nt, Bordetella pertussis
aaugccggccgaua

SEQ ID NO: 2349032 - RNA, 22 nt, Bordetella pertussis
aaugccggccgauagccgcggc

SEQ ID NO: 2349033 - RNA, 20 nt, Bordetella pertussis
aaugccggcgaauaugcccu

SEQ ID NO: 2349034 - RNA, 13 nt, Bordetella pertussis
aaugcgccgcgcc

SEQ ID NO: 2349035 - RNA, 14 nt, Bordetella pertussis
aaugcgccgcgcca

SEQ ID NO: 2349036 - RNA, 13 nt, Bordetella pertussis
aaugcgcgcgcgg

SEQ ID NO: 2349037 - RNA, 13 nt, Bordetella pertussis
aaugcggcggcgc

SEQ ID NO: 2349038 - RNA, 11 nt, Bordetella pertussis
aauggcgcggu

SEQ ID NO: 2349039 - RNA, 13 nt, Bordetella pertussis
aauggucggccuc

SEQ ID NO: 2349040 - RNA, 22 nt, Bordetella pertussis
aauggugcgguugcgaggcggc

SEQ ID NO: 2349041 - RNA, 16 nt, Bordetella pertussis
aauguauuuggcggcu

SEQ ID NO: 2349042 - RNA, 17 nt, Bordetella pertussis
aauguauuuggcggcuu

SEQ ID NO: 2349043 - RNA, 17 nt, Bordetella pertussis
aaugucaccgacgccag

SEQ ID NO: 2349044 - RNA, 18 nt, Bordetella pertussis
aaugucgagcgcgaugcc

SEQ ID NO: 2349045 - RNA, 17 nt, Bordetella pertussis
aaugucguugcacagca

SEQ ID NO: 2349046 - RNA, 17 nt, Bordetella pertussis
aauguugauccggucgc

SEQ ID NO: 2349047 - RNA, 19 nt, Bordetella pertussis
aauuaaugaaacugcaaaa

SEQ ID NO: 2349048 - RNA, 19 nt, Bordetella pertussis
aauucauccggaaacuggc

SEQ ID NO: 2349049 - RNA, 20 nt, Bordetella pertussis
aauuccugaacgccgggccg

SEQ ID NO: 2349050 - RNA, 14 nt, Bordetella pertussis
aauugccgccgcug

SEQ ID NO: 2349051 - RNA, 15 nt, Bordetella pertussis
aauugccgcgaggcg

SEQ ID NO: 2349052 - RNA, 17 nt, Bordetella pertussis
aauugcuugccuguccc

SEQ ID NO: 2349053 - RNA, 21 nt, Bordetella pertussis
aauugcuugccuguccccacu

SEQ ID NO: 2349054 - RNA, 22 nt, Bordetella pertussis
acaacaucaaugacauggccac

SEQ ID NO: 2349055 - RNA, 20 nt, Bordetella pertussis
acaacauuggguacgacggc

SEQ ID NO: 2349056 - RNA, 12 nt, Bordetella pertussis
acaaccuggcgc

SEQ ID NO: 2349057 - RNA, 15 nt, Bordetella pertussis
acaaccuggcgcgcg

SEQ ID NO: 2349058 - RNA, 20 nt, Bordetella pertussis
acaacgccgcguccgcccgc

SEQ ID NO: 2349059 - RNA, 15 nt, Bordetella pertussis
acaacgcgcgccacu

SEQ ID NO: 2349060 - RNA, 14 nt, Bordetella pertussis
acaacggcgugcug

SEQ ID NO: 2349061 - RNA, 14 nt, Bordetella pertussis
acaacgggaucggc

SEQ ID NO: 2349062 - RNA, 17 nt, Bordetella pertussis
acaagcgcguggccggc

SEQ ID NO: 2349063 - RNA, 16 nt, Bordetella pertussis
acaaggauggacuggc

SEQ ID NO: 2349064 - RNA, 19 nt, Bordetella pertussis
acaaggauggacuggccgc

SEQ ID NO: 2349065 - RNA, 17 nt, Bordetella pertussis
acaaggccggagccagg

SEQ ID NO: 2349066 - RNA, 19 nt, Bordetella pertussis
acaaggccggagccaggua

SEQ ID NO: 2349067 - RNA, 20 nt, Bordetella pertussis
acaaggcgcguaugacgcgc

SEQ ID NO: 2349068 - RNA, 20 nt, Bordetella pertussis
acaaggcggccgcgcccgca

SEQ ID NO: 2349069 - RNA, 19 nt, Bordetella pertussis
acaagguccaggcccggca

SEQ ID NO: 2349070 - RNA, 14 nt, Bordetella pertussis
acacaagaucgcau

SEQ ID NO: 2349071 - RNA, 14 nt, Bordetella pertussis
acacaaggcggccg

SEQ ID NO: 2349072 - RNA, 16 nt, Bordetella pertussis
acacaaggcggccgcg

SEQ ID NO: 2349073 - RNA, 19 nt, Bordetella pertussis
acaccaccuccaccgccag

SEQ ID NO: 2349074 - RNA, 13 nt, Bordetella pertussis
acaccagcgccag

SEQ ID NO: 2349075 - RNA, 14 nt, Bordetella pertussis
acaccagcgccagg

SEQ ID NO: 2349076 - RNA, 21 nt, Bordetella pertussis
acaccaggaagagcuggcgcu

SEQ ID NO: 2349077 - RNA, 23 nt, Bordetella pertussis
acaccaggaagagcuggcgcugc

SEQ ID NO: 2349078 - RNA, 16 nt, Bordetella pertussis
acaccaggguggcgcc

SEQ ID NO: 2349079 - RNA, 19 nt, Bordetella pertussis
acaccaggguggcgccggc

SEQ ID NO: 2349080 - RNA, 20 nt, Bordetella pertussis
acaccaggguggcgccggcc

SEQ ID NO: 2349081 - RNA, 21 nt, Bordetella pertussis
acaccagguugucggcgccac

SEQ ID NO: 2349082 - RNA, 19 nt, Bordetella pertussis
acaccaucaagaugaacgc

SEQ ID NO: 2349083 - RNA, 18 nt, Bordetella pertussis
acaccaucaaggccauga

SEQ ID NO: 2349084 - RNA, 16 nt, Bordetella pertussis
acaccaugauggccgc

SEQ ID NO: 2349085 - RNA, 21 nt, Bordetella pertussis
acaccaugauggccgcgcgca

SEQ ID NO: 2349086 - RNA, 15 nt, Bordetella pertussis
acacccggucggccc

SEQ ID NO: 2349087 - RNA, 13 nt, Bordetella pertussis
acaccgcaggugc

SEQ ID NO: 2349088 - RNA, 21 nt, Bordetella pertussis
acaccgcccgaaagguccugg

SEQ ID NO: 2349089 - RNA, 16 nt, Bordetella pertussis
acaccgccgcgccgcc

SEQ ID NO: 2349090 - RNA, 16 nt, Bordetella pertussis
acaccgcggccuugcc

SEQ ID NO: 2349091 - RNA, 17 nt, Bordetella pertussis
acaccggcgcgccuggc

SEQ ID NO: 2349092 - RNA, 21 nt, Bordetella pertussis
acaccggcgcgccuggcgcgc

SEQ ID NO: 2349093 - RNA, 12 nt, Bordetella pertussis
acaccggcgugc

SEQ ID NO: 2349094 - RNA, 17 nt, Bordetella pertussis
acaccggcgugcagagc

SEQ ID NO: 2349095 - RNA, 21 nt, Bordetella pertussis
acaccggcgugcagagcacca

SEQ ID NO: 2349096 - RNA, 18 nt, Bordetella pertussis
acaccgucacgcgcaagg

SEQ ID NO: 2349097 - RNA, 19 nt, Bordetella pertussis
acaccgugaaggugccgga

SEQ ID NO: 2349098 - RNA, 13 nt, Bordetella pertussis
acaccgugcuggc

SEQ ID NO: 2349099 - RNA, 14 nt, Bordetella pertussis
acaccgugcuggcc

SEQ ID NO: 2349100 - RNA, 23 nt, Bordetella pertussis
acaccguggcaugccaugcgcac

SEQ ID NO: 2349101 - RNA, 18 nt, Bordetella pertussis
acaccgugugaucgccga

SEQ ID NO: 2349102 - RNA, 22 nt, Bordetella pertussis
acaccguucccggugccagucc

SEQ ID NO: 2349103 - RNA, 18 nt, Bordetella pertussis
acaccguuuuggcaggcu

SEQ ID NO: 2349104 - RNA, 18 nt, Bordetella pertussis
acaccuuguuggcgccgg

SEQ ID NO: 2349105 - RNA, 20 nt, Bordetella pertussis
acaccuuguuggcgccggcc

SEQ ID NO: 2349106 - RNA, 16 nt, Bordetella pertussis
acacgaggaccgcgau

SEQ ID NO: 2349107 - RNA, 20 nt, Bordetella pertussis
acacgaggaccgcgaugcug

SEQ ID NO: 2349108 - RNA, 18 nt, Bordetella pertussis
acacgaucagcgcccagg

SEQ ID NO: 2349109 - RNA, 17 nt, Bordetella pertussis
acacgaucgucagcagc

SEQ ID NO: 2349110 - RNA, 15 nt, Bordetella pertussis
acacgaugaucgcgc

SEQ ID NO: 2349111 - RNA, 14 nt, Bordetella pertussis
acacgaugccucga

SEQ ID NO: 2349112 - RNA, 14 nt, Bordetella pertussis
acacgcccagcagg

SEQ ID NO: 2349113 - RNA, 18 nt, Bordetella pertussis
acacgccgcgcgaucgcc

SEQ ID NO: 2349114 - RNA, 18 nt, Bordetella pertussis
acacgcgcgacgccgugg

SEQ ID NO: 2349115 - RNA, 23 nt, Bordetella pertussis
acacgcgcgcaaugcgcggcgcu

SEQ ID NO: 2349116 - RNA, 20 nt, Bordetella pertussis
acacgcgguagguagcgcgc

SEQ ID NO: 2349117 - RNA, 23 nt, Bordetella pertussis
acacgcggugcaucucggcaucg

SEQ ID NO: 2349118 - RNA, 16 nt, Bordetella pertussis
acacgcuagggcgugg

SEQ ID NO: 2349119 - RNA, 16 nt, Bordetella pertussis
acacgcucuugcgcgc

SEQ ID NO: 2349120 - RNA, 16 nt, Bordetella pertussis
acacgcugaagcgccg

SEQ ID NO: 2349121 - RNA, 15 nt, Bordetella pertussis
acacgcuggacgacg

SEQ ID NO: 2349122 - RNA, 18 nt, Bordetella pertussis
acacgcuggcggacacgc

SEQ ID NO: 2349123 - RNA, 22 nt, Bordetella pertussis
acacgcuggcggacacgcccug

SEQ ID NO: 2349124 - RNA, 15 nt, Bordetella pertussis
acacggcaguaugac

SEQ ID NO: 2349125 - RNA, 13 nt, Bordetella pertussis
acacggccagcac

SEQ ID NO: 2349126 - RNA, 18 nt, Bordetella pertussis
acacggccgccaccuggg

SEQ ID NO: 2349127 - RNA, 17 nt, Bordetella pertussis
acacggcgcgggcgguc

SEQ ID NO: 2349128 - RNA, 17 nt, Bordetella pertussis
acacggcggugccgcgc

SEQ ID NO: 2349129 - RNA, 18 nt, Bordetella pertussis
acacggcggugccgcgca

SEQ ID NO: 2349130 - RNA, 18 nt, Bordetella pertussis
acacggucaaccacgcca

SEQ ID NO: 2349131 - RNA, 14 nt, Bordetella pertussis
acacggucagcaac

SEQ ID NO: 2349132 - RNA, 19 nt, Bordetella pertussis
acacggucagcaaccccag

SEQ ID NO: 2349133 - RNA, 20 nt, Bordetella pertussis
acacggucagcaaccccagc

SEQ ID NO: 2349134 - RNA, 13 nt, Bordetella pertussis
acacgguggcggu

SEQ ID NO: 2349135 - RNA, 22 nt, Bordetella pertussis
acacggugggcgacgcggcgua

SEQ ID NO: 2349136 - RNA, 18 nt, Bordetella pertussis
acacgucaucguggccgc

SEQ ID NO: 2349137 - RNA, 12 nt, Bordetella pertussis
acacguccagcg

SEQ ID NO: 2349138 - RNA, 13 nt, Bordetella pertussis
acacguccagcgc

SEQ ID NO: 2349139 - RNA, 15 nt, Bordetella pertussis
acacguccagcgccg

SEQ ID NO: 2349140 - RNA, 14 nt, Bordetella pertussis
acacgucgaucagc

SEQ ID NO: 2349141 - RNA, 18 nt, Bordetella pertussis
acacguuggggaaccgca

SEQ ID NO: 2349142 - RNA, 19 nt, Bordetella pertussis
acacguuggggaaccgcac

SEQ ID NO: 2349143 - RNA, 15 nt, Bordetella pertussis
acacuggccagcaag

SEQ ID NO: 2349144 - RNA, 22 nt, Bordetella pertussis
acacugucgccacgggcgucac

SEQ ID NO: 2349145 - RNA, 22 nt, Bordetella pertussis
acacuuucaucaaacgcggcgc

SEQ ID NO: 2349146 - RNA, 20 nt, Bordetella pertussis
acagacccgggccgcuggcc

SEQ ID NO: 2349147 - RNA, 22 nt, Bordetella pertussis
acagacgcugacugcggugccu

SEQ ID NO: 2349148 - RNA, 20 nt, Bordetella pertussis
acagauaccgccuuggccgu

SEQ ID NO: 2349149 - RNA, 17 nt, Bordetella pertussis
acagauagaacgagguc

SEQ ID NO: 2349150 - RNA, 13 nt, Bordetella pertussis
acagaucgccgcc

SEQ ID NO: 2349151 - RNA, 15 nt, Bordetella pertussis
acagaugggcggccu

SEQ ID NO: 2349152 - RNA, 16 nt, Bordetella pertussis
acagcacauggcgcgc

SEQ ID NO: 2349153 - RNA, 17 nt, Bordetella pertussis
acagcaccugguggcgc

SEQ ID NO: 2349154 - RNA, 21 nt, Bordetella pertussis
acagcaccugguggcgcuggc

SEQ ID NO: 2349155 - RNA, 20 nt, Bordetella pertussis
acagcacgcccgccagcagc

SEQ ID NO: 2349156 - RNA, 13 nt, Bordetella pertussis
acagcagcgcgcc

SEQ ID NO: 2349157 - RNA, 15 nt, Bordetella pertussis
acagcagcggcucga

SEQ ID NO: 2349158 - RNA, 21 nt, Bordetella pertussis
acagcagcggcucgagcggca

SEQ ID NO: 2349159 - RNA, 14 nt, Bordetella pertussis
acagcagggccagg

SEQ ID NO: 2349160 - RNA, 16 nt, Bordetella pertussis
acagcagggccaggcc

SEQ ID NO: 2349161 - RNA, 18 nt, Bordetella pertussis
acagcagggccaggccca

SEQ ID NO: 2349162 - RNA, 21 nt, Bordetella pertussis
acagcaggucggagucggcgc

SEQ ID NO: 2349163 - RNA, 15 nt, Bordetella pertussis
acagcaguucggccg

SEQ ID NO: 2349164 - RNA, 17 nt, Bordetella pertussis
acagcaguucggccggc

SEQ ID NO: 2349165 - RNA, 22 nt, Bordetella pertussis
acagcaguuucugcaccggcgc

SEQ ID NO: 2349166 - RNA, 16 nt, Bordetella pertussis
acagcaucagcggcag

SEQ ID NO: 2349167 - RNA, 18 nt, Bordetella pertussis
acagcaucagcggcagca

SEQ ID NO: 2349168 - RNA, 21 nt, Bordetella pertussis
acagcaugaccucggccugcg

SEQ ID NO: 2349169 - RNA, 13 nt, Bordetella pertussis
acagcauggcggc

SEQ ID NO: 2349170 - RNA, 22 nt, Bordetella pertussis
acagccaaguccgguauccugg

SEQ ID NO: 2349171 - RNA, 15 nt, Bordetella pertussis
acagccaggccagca

SEQ ID NO: 2349172 - RNA, 19 nt, Bordetella pertussis
acagccaggccagcgccag

SEQ ID NO: 2349173 - RNA, 18 nt, Bordetella pertussis
acagccauugcccacagc

SEQ ID NO: 2349174 - RNA, 19 nt, Bordetella pertussis
acagccauugcccacagca

SEQ ID NO: 2349175 - RNA, 20 nt, Bordetella pertussis
acagccauugcccacagcac

SEQ ID NO: 2349176 - RNA, 13 nt, Bordetella pertussis
acagccccagcag

SEQ ID NO: 2349177 - RNA, 20 nt, Bordetella pertussis
acagcccgcgcuggcgcagc

SEQ ID NO: 2349178 - RNA, 15 nt, Bordetella pertussis
acagcccggccccca

SEQ ID NO: 2349179 - RNA, 15 nt, Bordetella pertussis
acagccgcagccguc

SEQ ID NO: 2349180 - RNA, 20 nt, Bordetella pertussis
acagccgcagccgucgcgcu

SEQ ID NO: 2349181 - RNA, 17 nt, Bordetella pertussis
acagccgccccagcagc

SEQ ID NO: 2349182 - RNA, 18 nt, Bordetella pertussis
acagccgcgccagcgccu

SEQ ID NO: 2349183 - RNA, 18 nt, Bordetella pertussis
acagccuuuccuccugcc

SEQ ID NO: 2349184 - RNA, 20 nt, Bordetella pertussis
acagcgacaacagcuugccc

SEQ ID NO: 2349185 - RNA, 15 nt, Bordetella pertussis
acagcgacagccagg

SEQ ID NO: 2349186 - RNA, 23 nt, Bordetella pertussis
acagcgacagccaggccagcgcc

SEQ ID NO: 2349187 - RNA, 13 nt, Bordetella pertussis
acagcgccaggcu

SEQ ID NO: 2349188 - RNA, 16 nt, Bordetella pertussis
acagcgccaggcucca

SEQ ID NO: 2349189 - RNA, 16 nt, Bordetella pertussis
acagcgccaucgcgcg

SEQ ID NO: 2349190 - RNA, 23 nt, Bordetella pertussis
acagcgcccccagcacgguugcc

SEQ ID NO: 2349191 - RNA, 19 nt, Bordetella pertussis
acagcgccgaccgcacgau

SEQ ID NO: 2349192 - RNA, 16 nt, Bordetella pertussis
acagcgccgcggcguc

SEQ ID NO: 2349193 - RNA, 19 nt, Bordetella pertussis
acagcgccugcauccggcc

SEQ ID NO: 2349194 - RNA, 22 nt, Bordetella pertussis
acagcgccuggcggcuggucaa

SEQ ID NO: 2349195 - RNA, 11 nt, Bordetella pertussis
acagcgcgccc

SEQ ID NO: 2349196 - RNA, 18 nt, Bordetella pertussis
acagcgcgcccgaugccu

SEQ ID NO: 2349197 - RNA, 18 nt, Bordetella pertussis
acagcgcggcgaaggcgc

SEQ ID NO: 2349198 - RNA, 22 nt, Bordetella pertussis
acagcgcggcgaaggcgcggcu

SEQ ID NO: 2349199 - RNA, 20 nt, Bordetella pertussis
acagcgcucuauucggccaa

SEQ ID NO: 2349200 - RNA, 14 nt, Bordetella pertussis
acagcggagccgcg

SEQ ID NO: 2349201 - RNA, 14 nt, Bordetella pertussis
acagcggaucgccg

SEQ ID NO: 2349202 - RNA, 17 nt, Bordetella pertussis
acagcggcgagcgcggc

SEQ ID NO: 2349203 - RNA, 22 nt, Bordetella pertussis
acagcggcgcgagcgcacaggc

SEQ ID NO: 2349204 - RNA, 16 nt, Bordetella pertussis
acagcguccagccgcc

SEQ ID NO: 2349205 - RNA, 20 nt, Bordetella pertussis
acagcgugacggcggcgcgc

SEQ ID NO: 2349206 - RNA, 23 nt, Bordetella pertussis
acagcgugacggcggcgcgcgga

SEQ ID NO: 2349207 - RNA, 15 nt, Bordetella pertussis
acagcucgcgccagg

SEQ ID NO: 2349208 - RNA, 22 nt, Bordetella pertussis
acagcucguagaucuugccggc

SEQ ID NO: 2349209 - RNA, 22 nt, Bordetella pertussis
acagcugcgggaggcuuugggg

SEQ ID NO: 2349210 - RNA, 18 nt, Bordetella pertussis
acagcuggaagcgcgcca

SEQ ID NO: 2349211 - RNA, 22 nt, Bordetella pertussis
acagcuggugccgguugcgcgc

SEQ ID NO: 2349212 - RNA, 18 nt, Bordetella pertussis
acagcuugcccacgcgcu

SEQ ID NO: 2349213 - RNA, 19 nt, Bordetella pertussis
acagcuugcgcuggcgcgc

SEQ ID NO: 2349214 - RNA, 18 nt, Bordetella pertussis
acaggaacaggccggccu

SEQ ID NO: 2349215 - RNA, 14 nt, Bordetella pertussis
acaggacagccgcu

SEQ ID NO: 2349216 - RNA, 19 nt, Bordetella pertussis
acaggauggcgaucaggaa

SEQ ID NO: 2349217 - RNA, 14 nt, Bordetella pertussis
acaggcacacucug

SEQ ID NO: 2349218 - RNA, 19 nt, Bordetella pertussis
acaggcacacucugucgcg

SEQ ID NO: 2349219 - RNA, 21 nt, Bordetella pertussis
acaggcaccccgucguccguc

SEQ ID NO: 2349220 - RNA, 11 nt, Bordetella pertussis
acaggcacccg

SEQ ID NO: 2349221 - RNA, 17 nt, Bordetella pertussis
acaggcacccgcgcgca

SEQ ID NO: 2349222 - RNA, 16 nt, Bordetella pertussis
acaggcacccugcccc

SEQ ID NO: 2349223 - RNA, 17 nt, Bordetella pertussis
acaggcacccuugccgc

SEQ ID NO: 2349224 - RNA, 19 nt, Bordetella pertussis
acaggcaccgaacccugcc

SEQ ID NO: 2349225 - RNA, 21 nt, Bordetella pertussis
acaggcaccgaacgggcgugg

SEQ ID NO: 2349226 - RNA, 17 nt, Bordetella pertussis
acaggcaccucguucac

SEQ ID NO: 2349227 - RNA, 23 nt, Bordetella pertussis
acaggcacgacgcgaaccaggcc

SEQ ID NO: 2349228 - RNA, 23 nt, Bordetella pertussis
acaggcacuccggauaccgccgc

SEQ ID NO: 2349229 - RNA, 11 nt, Bordetella pertussis
acaggcagcgg

SEQ ID NO: 2349230 - RNA, 13 nt, Bordetella pertussis
acaggcagcugcg

SEQ ID NO: 2349231 - RNA, 12 nt, Bordetella pertussis
acaggcccagcc

SEQ ID NO: 2349232 - RNA, 16 nt, Bordetella pertussis
acaggcccagcgccag

SEQ ID NO: 2349233 - RNA, 17 nt, Bordetella pertussis
acaggcccagcgccagc

SEQ ID NO: 2349234 - RNA, 20 nt, Bordetella pertussis
acaggcccagcgccagcagc

SEQ ID NO: 2349235 - RNA, 21 nt, Bordetella pertussis
acaggcccaguacggccugca

SEQ ID NO: 2349236 - RNA, 22 nt, Bordetella pertussis
acaggcccaguacggccugcau

SEQ ID NO: 2349237 - RNA, 16 nt, Bordetella pertussis
acaggcccgcggccgc

SEQ ID NO: 2349238 - RNA, 22 nt, Bordetella pertussis
acaggccggcaagaugccggcc

SEQ ID NO: 2349239 - RNA, 20 nt, Bordetella pertussis
acaggccguuguccuggcgc

SEQ ID NO: 2349240 - RNA, 22 nt, Bordetella pertussis
acaggccuggcuuggcggccag

SEQ ID NO: 2349241 - RNA, 22 nt, Bordetella pertussis
acaggccuucguaaacaucgcg

SEQ ID NO: 2349242 - RNA, 14 nt, Bordetella pertussis
acaggcgcccgugc

SEQ ID NO: 2349243 - RNA, 12 nt, Bordetella pertussis
acaggcgccgca

SEQ ID NO: 2349244 - RNA, 12 nt, Bordetella pertussis
acaggcgccguc

SEQ ID NO: 2349245 - RNA, 18 nt, Bordetella pertussis
acaggcgcgcaggcgggc

SEQ ID NO: 2349246 - RNA, 12 nt, Bordetella pertussis
acaggcgcgcca

SEQ ID NO: 2349247 - RNA, 18 nt, Bordetella pertussis
acaggcgcgccagccgcg

SEQ ID NO: 2349248 - RNA, 21 nt, Bordetella pertussis
acaggcgcgccagccgcgcga

SEQ ID NO: 2349249 - RNA, 22 nt, Bordetella pertussis
acaggcgcuugcgcucggugug

SEQ ID NO: 2349250 - RNA, 12 nt, Bordetella pertussis
acaggcgugcgc

SEQ ID NO: 2349251 - RNA, 18 nt, Bordetella pertussis
acaggcucacgccuaccu

SEQ ID NO: 2349252 - RNA, 13 nt, Bordetella pertussis
acaggcugccguc

SEQ ID NO: 2349253 - RNA, 14 nt, Bordetella pertussis
acaggcugccgucg

SEQ ID NO: 2349254 - RNA, 21 nt, Bordetella pertussis
acaggcugccgucggccagcu

SEQ ID NO: 2349255 - RNA, 12 nt, Bordetella pertussis
acagggcgucgc

SEQ ID NO: 2349256 - RNA, 20 nt, Bordetella pertussis
acagggcgucgcgaugcgcc

SEQ ID NO: 2349257 - RNA, 13 nt, Bordetella pertussis
acaggggcaaggc

SEQ ID NO: 2349258 - RNA, 13 nt, Bordetella pertussis
acagggggacugg

SEQ ID NO: 2349259 - RNA, 19 nt, Bordetella pertussis
acagggggacuggcacccg

SEQ ID NO: 2349260 - RNA, 16 nt, Bordetella pertussis
acagggucaaggcgcg

SEQ ID NO: 2349261 - RNA, 19 nt, Bordetella pertussis
acagggucaaggcgcggcc

SEQ ID NO: 2349262 - RNA, 18 nt, Bordetella pertussis
acagggugccuguccccg

SEQ ID NO: 2349263 - RNA, 19 nt, Bordetella pertussis
acagguacccccagcggcg

SEQ ID NO: 2349264 - RNA, 15 nt, Bordetella pertussis
acagguaggcgccgg

SEQ ID NO: 2349265 - RNA, 13 nt, Bordetella pertussis
acaggucgccgaa

SEQ ID NO: 2349266 - RNA, 20 nt, Bordetella pertussis
acaggucggcgcccacgccg

SEQ ID NO: 2349267 - RNA, 21 nt, Bordetella pertussis
acaggucggcgcccacgccga

SEQ ID NO: 2349268 - RNA, 15 nt, Bordetella pertussis
acaggugcgcggcgc

SEQ ID NO: 2349269 - RNA, 18 nt, Bordetella pertussis
acaggugcgcggcgcgcc

SEQ ID NO: 2349270 - RNA, 13 nt, Bordetella pertussis
acaggugcugggu

SEQ ID NO: 2349271 - RNA, 19 nt, Bordetella pertussis
acaguacuuguugcgugcc

SEQ ID NO: 2349272 - RNA, 14 nt, Bordetella pertussis
acaguugcaggcca

SEQ ID NO: 2349273 - RNA, 19 nt, Bordetella pertussis
acaguuugucggcgaucuu

SEQ ID NO: 2349274 - RNA, 20 nt, Bordetella pertussis
acauacagcggagccgcgca

SEQ ID NO: 2349275 - RNA, 21 nt, Bordetella pertussis
acauacgugguggugcgggcc

SEQ ID NO: 2349276 - RNA, 19 nt, Bordetella pertussis
acauagcggccggcgcgcg

SEQ ID NO: 2349277 - RNA, 15 nt, Bordetella pertussis
acaucauccccagcg

SEQ ID NO: 2349278 - RNA, 16 nt, Bordetella pertussis
acaucauccccagcgc

SEQ ID NO: 2349279 - RNA, 19 nt, Bordetella pertussis
acaucauccccagcgccgc

SEQ ID NO: 2349280 - RNA, 23 nt, Bordetella pertussis
acaucaucgaccaccagcggcug

SEQ ID NO: 2349281 - RNA, 23 nt, Bordetella pertussis
acauccucgggcgacuccagccc

SEQ ID NO: 2349282 - RNA, 24 nt, Bordetella pertussis
acaucgccgcugcgcagcagcgcg

SEQ ID NO: 2349283 - RNA, 16 nt, Bordetella pertussis
acaucgccggcggcgu

SEQ ID NO: 2349284 - RNA, 13 nt, Bordetella pertussis
acaucggcagcga

SEQ ID NO: 2349285 - RNA, 17 nt, Bordetella pertussis
acaucggggucgaucgc

SEQ ID NO: 2349286 - RNA, 19 nt, Bordetella pertussis
acaucgucgcgcuggggca

SEQ ID NO: 2349287 - RNA, 16 nt, Bordetella pertussis
acaucgugcuguucgg

SEQ ID NO: 2349288 - RNA, 17 nt, Bordetella pertussis
acaucuguccugauuca

SEQ ID NO: 2349289 - RNA, 16 nt, Bordetella pertussis
acaugaccgcguccgc

SEQ ID NO: 2349290 - RNA, 18 nt, Bordetella pertussis
acaugaccgcguccgcga

SEQ ID NO: 2349291 - RNA, 20 nt, Bordetella pertussis
acaugacguucuccagcgcc

SEQ ID NO: 2349292 - RNA, 13 nt, Bordetella pertussis
acaugaugcccag

SEQ ID NO: 2349293 - RNA, 16 nt, Bordetella pertussis
acaugaugcccagcgc

SEQ ID NO: 2349294 - RNA, 19 nt, Bordetella pertussis
acaugaugcccagcgccag

SEQ ID NO: 2349295 - RNA, 22 nt, Bordetella pertussis
acaugaugcccagcgccagggc

SEQ ID NO: 2349296 - RNA, 19 nt, Bordetella pertussis
acaugcacgauauuggcgu

SEQ ID NO: 2349297 - RNA, 14 nt, Bordetella pertussis
acaugcccggccac

SEQ ID NO: 2349298 - RNA, 12 nt, Bordetella pertussis
acaugccgcgcg

SEQ ID NO: 2349299 - RNA, 15 nt, Bordetella pertussis
acaugccggacaagc

SEQ ID NO: 2349300 - RNA, 21 nt, Bordetella pertussis
acaugcugcgacagcagggcc

SEQ ID NO: 2349301 - RNA, 15 nt, Bordetella pertussis
acaugcuggcccagc

SEQ ID NO: 2349302 - RNA, 14 nt, Bordetella pertussis
acauggaaauccuu

SEQ ID NO: 2349303 - RNA, 18 nt, Bordetella pertussis
acauggccagguacaggc

SEQ ID NO: 2349304 - RNA, 14 nt, Bordetella pertussis
acauggcgcgccgg

SEQ ID NO: 2349305 - RNA, 17 nt, Bordetella pertussis
acauggcgcgcgccagc

SEQ ID NO: 2349306 - RNA, 22 nt, Bordetella pertussis
acauggcgcgcgccagcggcug

SEQ ID NO: 2349307 - RNA, 12 nt, Bordetella pertussis
acauggcggcga

SEQ ID NO: 2349308 - RNA, 14 nt, Bordetella pertussis
acauugcccagcac

SEQ ID NO: 2349309 - RNA, 18 nt, Bordetella pertussis
acauugucaagcagcgcc

SEQ ID NO: 2349310 - RNA, 22 nt, Bordetella pertussis
acauugucaagcagcgccggcu

SEQ ID NO: 2349311 - RNA, 22 nt, Bordetella pertussis
accaacccugccuccaggcgca

SEQ ID NO: 2349312 - RNA, 15 nt, Bordetella pertussis
accaacgcgaucuca

SEQ ID NO: 2349313 - RNA, 19 nt, Bordetella pertussis
accaacggggccgccaacg

SEQ ID NO: 2349314 - RNA, 18 nt, Bordetella pertussis
accaacucgaggcggcgc

SEQ ID NO: 2349315 - RNA, 16 nt, Bordetella pertussis
accaacugccugcagc

SEQ ID NO: 2349316 - RNA, 23 nt, Bordetella pertussis
accaacugccugcagcgcgcgcg

SEQ ID NO: 2349317 - RNA, 20 nt, Bordetella pertussis
accaagcgccacagcgccau

SEQ ID NO: 2349318 - RNA, 15 nt, Bordetella pertussis
accaauacaggaagc

SEQ ID NO: 2349319 - RNA, 22 nt, Bordetella pertussis
accaauacaggaagcgcuggcc

SEQ ID NO: 2349320 - RNA, 14 nt, Bordetella pertussis
accaauacgccgcc

SEQ ID NO: 2349321 - RNA, 21 nt, Bordetella pertussis
accacaaggauggacuggccg

SEQ ID NO: 2349322 - RNA, 17 nt, Bordetella pertussis
accaccagcaccaugcc

SEQ ID NO: 2349323 - RNA, 14 nt, Bordetella pertussis
accaccagcaccga

SEQ ID NO: 2349324 - RNA, 16 nt, Bordetella pertussis
accaccagcaggaugg

SEQ ID NO: 2349325 - RNA, 18 nt, Bordetella pertussis
accaccagcaucgcgccu

SEQ ID NO: 2349326 - RNA, 21 nt, Bordetella pertussis
accaccaggccggccagggcc

SEQ ID NO: 2349327 - RNA, 14 nt, Bordetella pertussis
accacccaggccca

SEQ ID NO: 2349328 - RNA, 17 nt, Bordetella pertussis
accacccgcgccaggaa

SEQ ID NO: 2349329 - RNA, 15 nt, Bordetella pertussis
accacccggccaucg

SEQ ID NO: 2349330 - RNA, 12 nt, Bordetella pertussis
accaccggcuug

SEQ ID NO: 2349331 - RNA, 13 nt, Bordetella pertussis
accaccgggaugc

SEQ ID NO: 2349332 - RNA, 14 nt, Bordetella pertussis
accaccuccaccgc

SEQ ID NO: 2349333 - RNA, 15 nt, Bordetella pertussis
accaccuccaccgcc

SEQ ID NO: 2349334 - RNA, 17 nt, Bordetella pertussis
accaccuccaccgccag

SEQ ID NO: 2349335 - RNA, 20 nt, Bordetella pertussis
accaccuccaccgccagccc

SEQ ID NO: 2349336 - RNA, 23 nt, Bordetella pertussis
accaccugcucggugagcggcac

SEQ ID NO: 2349337 - RNA, 20 nt, Bordetella pertussis
accaccuucagggcgccggc

SEQ ID NO: 2349338 - RNA, 14 nt, Bordetella pertussis
accacgaccuuggc

SEQ ID NO: 2349339 - RNA, 17 nt, Bordetella pertussis
accacgaccuuggcggc

SEQ ID NO: 2349340 - RNA, 21 nt, Bordetella pertussis
accacgaccuuggcggccgac

SEQ ID NO: 2349341 - RNA, 20 nt, Bordetella pertussis
accacgagcugcagcccggc

SEQ ID NO: 2349342 - RNA, 15 nt, Bordetella pertussis
accacgauggccggc

SEQ ID NO: 2349343 - RNA, 19 nt, Bordetella pertussis
accacgauggccggcgcga

SEQ ID NO: 2349344 - RNA, 18 nt, Bordetella pertussis
accacgcccaucugccag

SEQ ID NO: 2349345 - RNA, 16 nt, Bordetella pertussis
accacgcccgcgccgc

SEQ ID NO: 2349346 - RNA, 16 nt, Bordetella pertussis
accacgcccuggauca

SEQ ID NO: 2349347 - RNA, 13 nt, Bordetella pertussis
accacgccgccca

SEQ ID NO: 2349348 - RNA, 17 nt, Bordetella pertussis
accacgccgcccagcgc

SEQ ID NO: 2349349 - RNA, 15 nt, Bordetella pertussis
accacgccuucgagc

SEQ ID NO: 2349350 - RNA, 17 nt, Bordetella pertussis
accacgccuucgagcac

SEQ ID NO: 2349351 - RNA, 16 nt, Bordetella pertussis
accacgcgaugcgggu

SEQ ID NO: 2349352 - RNA, 20 nt, Bordetella pertussis
accacgcgcggcggcggauc

SEQ ID NO: 2349353 - RNA, 12 nt, Bordetella pertussis
accacgcggcgg

SEQ ID NO: 2349354 - RNA, 17 nt, Bordetella pertussis
accacgcgguugggcgg

SEQ ID NO: 2349355 - RNA, 23 nt, Bordetella pertussis
accacgcugggccagaccgcgcg

SEQ ID NO: 2349356 - RNA, 17 nt, Bordetella pertussis
accacggccagcagcac

SEQ ID NO: 2349357 - RNA, 14 nt, Bordetella pertussis
accacggcgcgccc

SEQ ID NO: 2349358 - RNA, 15 nt, Bordetella pertussis
accacggcggccagg

SEQ ID NO: 2349359 - RNA, 17 nt, Bordetella pertussis
accacgggcacgauggc

SEQ ID NO: 2349360 - RNA, 18 nt, Bordetella pertussis
accacgggcacgauggcc

SEQ ID NO: 2349361 - RNA, 22 nt, Bordetella pertussis
accacgggcucgcugaccggcg

SEQ ID NO: 2349362 - RNA, 18 nt, Bordetella pertussis
accacggucuggcgcgac

SEQ ID NO: 2349363 - RNA, 16 nt, Bordetella pertussis
accacgucgaucaggc

SEQ ID NO: 2349364 - RNA, 16 nt, Bordetella pertussis
accacguggucuggaa

SEQ ID NO: 2349365 - RNA, 18 nt, Bordetella pertussis
accacugcaaggcccgcc

SEQ ID NO: 2349366 - RNA, 22 nt, Bordetella pertussis
accacuggcagaccgagcgcgc

SEQ ID NO: 2349367 - RNA, 22 nt, Bordetella pertussis
accagacgguaauccaguugag

SEQ ID NO: 2349368 - RNA, 23 nt, Bordetella pertussis
accagacgguaauccaguugaga

SEQ ID NO: 2349369 - RNA, 16 nt, Bordetella pertussis
accagcaacgcgccgc

SEQ ID NO: 2349370 - RNA, 15 nt, Bordetella pertussis
accagcaagccggcg

SEQ ID NO: 2349371 - RNA, 13 nt, Bordetella pertussis
accagcaccagcg

SEQ ID NO: 2349372 - RNA, 22 nt, Bordetella pertussis
accagcaccaugccgaugccgc

SEQ ID NO: 2349373 - RNA, 14 nt, Bordetella pertussis
accagcaccgccac

SEQ ID NO: 2349374 - RNA, 17 nt, Bordetella pertussis
accagcaccgccacgcg

SEQ ID NO: 2349375 - RNA, 12 nt, Bordetella pertussis
accagcaccggc

SEQ ID NO: 2349376 - RNA, 22 nt, Bordetella pertussis
accagcagcacguucuugcccu

SEQ ID NO: 2349377 - RNA, 10 nt, Bordetella pertussis
accagcagcc

SEQ ID NO: 2349378 - RNA, 21 nt, Bordetella pertussis
accagcagcggguugcgcgcc

SEQ ID NO: 2349379 - RNA, 22 nt, Bordetella pertussis
accagcagcggguugcgcgcca

SEQ ID NO: 2349380 - RNA, 15 nt, Bordetella pertussis
accagcaggauggau

SEQ ID NO: 2349381 - RNA, 17 nt, Bordetella pertussis
accagcaggcccaccag

SEQ ID NO: 2349382 - RNA, 15 nt, Bordetella pertussis
accagcaggcggccg

SEQ ID NO: 2349383 - RNA, 19 nt, Bordetella pertussis
accagcaggcggccgacca

SEQ ID NO: 2349384 - RNA, 15 nt, Bordetella pertussis
accagcagguggcgc

SEQ ID NO: 2349385 - RNA, 13 nt, Bordetella pertussis
accagcauccuca

SEQ ID NO: 2349386 - RNA, 14 nt, Bordetella pertussis
accagcaugcgcgu

SEQ ID NO: 2349387 - RNA, 23 nt, Bordetella pertussis
accagcaugcgcgucuccagcgc

SEQ ID NO: 2349388 - RNA, 21 nt, Bordetella pertussis
accagccagccgccgcgcggc

SEQ ID NO: 2349389 - RNA, 18 nt, Bordetella pertussis
accagccauucgauggcg

SEQ ID NO: 2349390 - RNA, 13 nt, Bordetella pertussis
accagcccagccc

SEQ ID NO: 2349391 - RNA, 16 nt, Bordetella pertussis
accagcccgaugcgcc

SEQ ID NO: 2349392 - RNA, 13 nt, Bordetella pertussis
accagcccggcgc

SEQ ID NO: 2349393 - RNA, 17 nt, Bordetella pertussis
accagcccggcgcgaca

SEQ ID NO: 2349394 - RNA, 13 nt, Bordetella pertussis
accagccgccgcc

SEQ ID NO: 2349395 - RNA, 14 nt, Bordetella pertussis
accagccgccgcca

SEQ ID NO: 2349396 - RNA, 16 nt, Bordetella pertussis
accagccggccgccga

SEQ ID NO: 2349397 - RNA, 14 nt, Bordetella pertussis
accagcgaggcggc

SEQ ID NO: 2349398 - RNA, 21 nt, Bordetella pertussis
accagcgaguuguccuggccg

SEQ ID NO: 2349399 - RNA, 21 nt, Bordetella pertussis
accagcgcauugccgccgccc

SEQ ID NO: 2349400 - RNA, 23 nt, Bordetella pertussis
accagcgcauugccgccgcccug

SEQ ID NO: 2349401 - RNA, 22 nt, Bordetella pertussis
accagcgccaggaacagcgccg

SEQ ID NO: 2349402 - RNA, 23 nt, Bordetella pertussis
accagcgccaggaacagcgccgg

SEQ ID NO: 2349403 - RNA, 15 nt, Bordetella pertussis
accagcgccgacggc

SEQ ID NO: 2349404 - RNA, 14 nt, Bordetella pertussis
accagcgccugccg

SEQ ID NO: 2349405 - RNA, 14 nt, Bordetella pertussis
accagcgcgccagc

SEQ ID NO: 2349406 - RNA, 17 nt, Bordetella pertussis
accagcgcgccagcaga

SEQ ID NO: 2349407 - RNA, 19 nt, Bordetella pertussis
accagcgcgccgaucacca

SEQ ID NO: 2349408 - RNA, 21 nt, Bordetella pertussis
accagcgcgccgaucaccacg

SEQ ID NO: 2349409 - RNA, 16 nt, Bordetella pertussis
accagcgcgccgcgcg

SEQ ID NO: 2349410 - RNA, 15 nt, Bordetella pertussis
accagcgcggccagc

SEQ ID NO: 2349411 - RNA, 15 nt, Bordetella pertussis
accagcgcggccguc

SEQ ID NO: 2349412 - RNA, 22 nt, Bordetella pertussis
accagcgcggccgucaccgccg

SEQ ID NO: 2349413 - RNA, 22 nt, Bordetella pertussis
accagcggcgugcggcccagcc

SEQ ID NO: 2349414 - RNA, 22 nt, Bordetella pertussis
accagcggcguggcggccaggc

SEQ ID NO: 2349415 - RNA, 23 nt, Bordetella pertussis
accagcggcguggcggccaggcc

SEQ ID NO: 2349416 - RNA, 22 nt, Bordetella pertussis
accagcguguagagcaggccgc

SEQ ID NO: 2349417 - RNA, 13 nt, Bordetella pertussis
accagcucgacgc

SEQ ID NO: 2349418 - RNA, 16 nt, Bordetella pertussis
accagcucgacgccau

SEQ ID NO: 2349419 - RNA, 15 nt, Bordetella pertussis
accagcugcaccagg

SEQ ID NO: 2349420 - RNA, 16 nt, Bordetella pertussis
accagcugcaccaggc

SEQ ID NO: 2349421 - RNA, 23 nt, Bordetella pertussis
accagcuguaccgguagcccgcg

SEQ ID NO: 2349422 - RNA, 18 nt, Bordetella pertussis
accagcuugcgcgccgca

SEQ ID NO: 2349423 - RNA, 13 nt, Bordetella pertussis
accagcuuggccu

SEQ ID NO: 2349424 - RNA, 15 nt, Bordetella pertussis
accaggaacgccagc

SEQ ID NO: 2349425 - RNA, 18 nt, Bordetella pertussis
accaggaacgccagcagc

SEQ ID NO: 2349426 - RNA, 21 nt, Bordetella pertussis
accaggaagagcuggcgcugc

SEQ ID NO: 2349427 - RNA, 23 nt, Bordetella pertussis
accaggaaguugcccaccgacau

SEQ ID NO: 2349428 - RNA, 17 nt, Bordetella pertussis
accaggauccccagcac

SEQ ID NO: 2349429 - RNA, 14 nt, Bordetella pertussis
accaggcagccggc

SEQ ID NO: 2349430 - RNA, 23 nt, Bordetella pertussis
accaggcccacgacgaacaacac

SEQ ID NO: 2349431 - RNA, 13 nt, Bordetella pertussis
accaggcccauga

SEQ ID NO: 2349432 - RNA, 20 nt, Bordetella pertussis
accaggcccaugaaggcggc

SEQ ID NO: 2349433 - RNA, 18 nt, Bordetella pertussis
accaggcccgccacggcg

SEQ ID NO: 2349434 - RNA, 18 nt, Bordetella pertussis
accaggccgaacuucagc

SEQ ID NO: 2349435 - RNA, 21 nt, Bordetella pertussis
accaggccgacgaggcgcugu

SEQ ID NO: 2349436 - RNA, 22 nt, Bordetella pertussis
accaggccgccggccagcgcca

SEQ ID NO: 2349437 - RNA, 13 nt, Bordetella pertussis
accaggccggcca

SEQ ID NO: 2349438 - RNA, 15 nt, Bordetella pertussis
accaggccggccagg

SEQ ID NO: 2349439 - RNA, 17 nt, Bordetella pertussis
accaggccggccagggc

SEQ ID NO: 2349440 - RNA, 19 nt, Bordetella pertussis
accaggccggccagggcca

SEQ ID NO: 2349441 - RNA, 22 nt, Bordetella pertussis
accaggccggugcgcacauggc

SEQ ID NO: 2349442 - RNA, 18 nt, Bordetella pertussis
accaggccgucggccagg

SEQ ID NO: 2349443 - RNA, 23 nt, Bordetella pertussis
accaggccugccugauggcgcgu

SEQ ID NO: 2349444 - RNA, 19 nt, Bordetella pertussis
accaggccugcgggugcgc

SEQ ID NO: 2349445 - RNA, 21 nt, Bordetella pertussis
accaggcgcacggcggcauau

SEQ ID NO: 2349446 - RNA, 15 nt, Bordetella pertussis
accaggcgcgcgcca

SEQ ID NO: 2349447 - RNA, 17 nt, Bordetella pertussis
accaggcgcgcgccauc

SEQ ID NO: 2349448 - RNA, 20 nt, Bordetella pertussis
accaggcgcgcgccaucgac

SEQ ID NO: 2349449 - RNA, 21 nt, Bordetella pertussis
accaggcgcgcgccaucgacg

SEQ ID NO: 2349450 - RNA, 22 nt, Bordetella pertussis
accaggcgcgcgccaucgacgg

SEQ ID NO: 2349451 - RNA, 14 nt, Bordetella pertussis
accaggcgcucgcg

SEQ ID NO: 2349452 - RNA, 13 nt, Bordetella pertussis
accaggcgcugac

SEQ ID NO: 2349453 - RNA, 14 nt, Bordetella pertussis
accaggcuccggcu

SEQ ID NO: 2349454 - RNA, 21 nt, Bordetella pertussis
accaggcugcccuggcccagg

SEQ ID NO: 2349455 - RNA, 20 nt, Bordetella pertussis
accaggcugcgcgccggcgc

SEQ ID NO: 2349456 - RNA, 13 nt, Bordetella pertussis
accagggcccgga

SEQ ID NO: 2349457 - RNA, 23 nt, Bordetella pertussis
accagggcccggacgcggccggc

SEQ ID NO: 2349458 - RNA, 18 nt, Bordetella pertussis
accagggcgccgaccggg

SEQ ID NO: 2349459 - RNA, 20 nt, Bordetella pertussis
accagggcggugggcagcgc

SEQ ID NO: 2349460 - RNA, 17 nt, Bordetella pertussis
accaggggcggcgcggc

SEQ ID NO: 2349461 - RNA, 16 nt, Bordetella pertussis
accaggguggcgccgg

SEQ ID NO: 2349462 - RNA, 23 nt, Bordetella pertussis
accaggguggcgggcgccugcgg

SEQ ID NO: 2349463 - RNA, 17 nt, Bordetella pertussis
accaggguuuccucgcc

SEQ ID NO: 2349464 - RNA, 20 nt, Bordetella pertussis
accaggguuuccucgccgac

SEQ ID NO: 2349465 - RNA, 15 nt, Bordetella pertussis
accagguagggcagc

SEQ ID NO: 2349466 - RNA, 17 nt, Bordetella pertussis
accagguccuggcggcc

SEQ ID NO: 2349467 - RNA, 19 nt, Bordetella pertussis
accagguccuggcggccgc

SEQ ID NO: 2349468 - RNA, 21 nt, Bordetella pertussis
accagguccuggcggccgccc

SEQ ID NO: 2349469 - RNA, 23 nt, Bordetella pertussis
accaggucgccguacucgccggu

SEQ ID NO: 2349470 - RNA, 17 nt, Bordetella pertussis
accaggucgcggugcgc

SEQ ID NO: 2349471 - RNA, 16 nt, Bordetella pertussis
accaggucguacagcg

SEQ ID NO: 2349472 - RNA, 23 nt, Bordetella pertussis
accaggucguacagcgccugcgc

SEQ ID NO: 2349473 - RNA, 18 nt, Bordetella pertussis
accaggugcgggccgcuc

SEQ ID NO: 2349474 - RNA, 15 nt, Bordetella pertussis
accaggugggcgcgc

SEQ ID NO: 2349475 - RNA, 17 nt, Bordetella pertussis
accaggugggcgcgcuc

SEQ ID NO: 2349476 - RNA, 20 nt, Bordetella pertussis
accagguuuuccacagccag

SEQ ID NO: 2349477 - RNA, 23 nt, Bordetella pertussis
accagguuuuccacagccaggcc

SEQ ID NO: 2349478 - RNA, 19 nt, Bordetella pertussis
accaguagcacacgccgau

SEQ ID NO: 2349479 - RNA, 20 nt, Bordetella pertussis
accagucccgcaccgaccag

SEQ ID NO: 2349480 - RNA, 20 nt, Bordetella pertussis
accagugcaggggguggcgg

SEQ ID NO: 2349481 - RNA, 15 nt, Bordetella pertussis
accagugcgccggcg

SEQ ID NO: 2349482 - RNA, 19 nt, Bordetella pertussis
accagugcgccggcgcggc

SEQ ID NO: 2349483 - RNA, 23 nt, Bordetella pertussis
accagugcgccggcgcggcgguc

SEQ ID NO: 2349484 - RNA, 19 nt, Bordetella pertussis
accagugcgccggcggcgg

SEQ ID NO: 2349485 - RNA, 21 nt, Bordetella pertussis
accagugcgccggcggcgguc

SEQ ID NO: 2349486 - RNA, 17 nt, Bordetella pertussis
accaguucgcgcagcgc

SEQ ID NO: 2349487 - RNA, 19 nt, Bordetella pertussis
accaguuggcccuucuuca

SEQ ID NO: 2349488 - RNA, 17 nt, Bordetella pertussis
accaguuucucggccac

SEQ ID NO: 2349489 - RNA, 16 nt, Bordetella pertussis
accauccuaugagccc

SEQ ID NO: 2349490 - RNA, 21 nt, Bordetella pertussis
accaucgccgagccgcugucg

SEQ ID NO: 2349491 - RNA, 15 nt, Bordetella pertussis
accaucgccgccugc

SEQ ID NO: 2349492 - RNA, 15 nt, Bordetella pertussis
accaucguugccugg

SEQ ID NO: 2349493 - RNA, 11 nt, Bordetella pertussis
accaucuuguc

SEQ ID NO: 2349494 - RNA, 16 nt, Bordetella pertussis
accaugaccaugccgg

SEQ ID NO: 2349495 - RNA, 18 nt, Bordetella pertussis
accaugaccaugccggcc

SEQ ID NO: 2349496 - RNA, 22 nt, Bordetella pertussis
accaugccgacgaacugcgagu

SEQ ID NO: 2349497 - RNA, 13 nt, Bordetella pertussis
accaugccuugcg

SEQ ID NO: 2349498 - RNA, 21 nt, Bordetella pertussis
accaugcgcaccaggcgcucg

SEQ ID NO: 2349499 - RNA, 14 nt, Bordetella pertussis
accaugcggccguc

SEQ ID NO: 2349500 - RNA, 12 nt, Bordetella pertussis
accaugcggucg

SEQ ID NO: 2349501 - RNA, 21 nt, Bordetella pertussis
accauggcgcccacggccgca

SEQ ID NO: 2349502 - RNA, 16 nt, Bordetella pertussis
accaugucccuggcca

SEQ ID NO: 2349503 - RNA, 16 nt, Bordetella pertussis
accauucucgcccugc

SEQ ID NO: 2349504 - RNA, 21 nt, Bordetella pertussis
accauugcagggugucggcca

SEQ ID NO: 2349505 - RNA, 21 nt, Bordetella pertussis
accauuucgauuucggcggcc

SEQ ID NO: 2349506 - RNA, 17 nt, Bordetella pertussis
acccacagcagcgcgcc

SEQ ID NO: 2349507 - RNA, 20 nt, Bordetella pertussis
acccacagcagcgcgccgcc

SEQ ID NO: 2349508 - RNA, 19 nt, Bordetella pertussis
acccacagguuggccgcga

SEQ ID NO: 2349509 - RNA, 14 nt, Bordetella pertussis
acccacccccagca

SEQ ID NO: 2349510 - RNA, 15 nt, Bordetella pertussis
acccacccccagcag

SEQ ID NO: 2349511 - RNA, 16 nt, Bordetella pertussis
acccacccccagcagc

SEQ ID NO: 2349512 - RNA, 17 nt, Bordetella pertussis
acccacccccagcagca

SEQ ID NO: 2349513 - RNA, 18 nt, Bordetella pertussis
acccacccccagcagcau

SEQ ID NO: 2349514 - RNA, 16 nt, Bordetella pertussis
acccaccuggccacaa

SEQ ID NO: 2349515 - RNA, 18 nt, Bordetella pertussis
acccaccuggccacaagc

SEQ ID NO: 2349516 - RNA, 19 nt, Bordetella pertussis
acccacggcgauggccgac

SEQ ID NO: 2349517 - RNA, 16 nt, Bordetella pertussis
acccagaucgccuggg

SEQ ID NO: 2349518 - RNA, 16 nt, Bordetella pertussis
acccagcaccgagcug

SEQ ID NO: 2349519 - RNA, 21 nt, Bordetella pertussis
acccagcagcggcagcagcag

SEQ ID NO: 2349520 - RNA, 21 nt, Bordetella pertussis
acccagccggacccgcgccgc

SEQ ID NO: 2349521 - RNA, 17 nt, Bordetella pertussis
acccaggcccaguugac

SEQ ID NO: 2349522 - RNA, 16 nt, Bordetella pertussis
acccaggccggcgcca

SEQ ID NO: 2349523 - RNA, 21 nt, Bordetella pertussis
acccaggcgccgauccagggc

SEQ ID NO: 2349524 - RNA, 14 nt, Bordetella pertussis
acccaggcggcagg

SEQ ID NO: 2349525 - RNA, 18 nt, Bordetella pertussis
acccagggcuugacgcgc

SEQ ID NO: 2349526 - RNA, 20 nt, Bordetella pertussis
acccagggcuugacgcgcgu

SEQ ID NO: 2349527 - RNA, 14 nt, Bordetella pertussis
acccaggucgccgc

SEQ ID NO: 2349528 - RNA, 20 nt, Bordetella pertussis
acccaggucgccgccgcgcu

SEQ ID NO: 2349529 - RNA, 16 nt, Bordetella pertussis
acccaguucggccgcc

SEQ ID NO: 2349530 - RNA, 12 nt, Bordetella pertussis
acccaugcgggg

SEQ ID NO: 2349531 - RNA, 18 nt, Bordetella pertussis
acccaugcggggcggcgg

SEQ ID NO: 2349532 - RNA, 17 nt, Bordetella pertussis
accccaguuccagcacg

SEQ ID NO: 2349533 - RNA, 11 nt, Bordetella pertussis
acccccagcag

SEQ ID NO: 2349534 - RNA, 13 nt, Bordetella pertussis
acccccagcagca

SEQ ID NO: 2349535 - RNA, 14 nt, Bordetella pertussis
acccccagcagcau

SEQ ID NO: 2349536 - RNA, 16 nt, Bordetella pertussis
acccccagcggcgcac

SEQ ID NO: 2349537 - RNA, 21 nt, Bordetella pertussis
acccccgucagcacggucggc

SEQ ID NO: 2349538 - RNA, 20 nt, Bordetella pertussis
acccccugaccggcggcguc

SEQ ID NO: 2349539 - RNA, 13 nt, Bordetella pertussis
accccgagggcgc

SEQ ID NO: 2349540 - RNA, 21 nt, Bordetella pertussis
accccgagggcgcggcgccgc

SEQ ID NO: 2349541 - RNA, 19 nt, Bordetella pertussis
accccgccaccgcccccgc

SEQ ID NO: 2349542 - RNA, 21 nt, Bordetella pertussis
accccgccagguucgccuggc

SEQ ID NO: 2349543 - RNA, 17 nt, Bordetella pertussis
accccgcccggcggcgc

SEQ ID NO: 2349544 - RNA, 20 nt, Bordetella pertussis
accccgcccggcggcgcgcc

SEQ ID NO: 2349545 - RNA, 13 nt, Bordetella pertussis
accccggcgccgc

SEQ ID NO: 2349546 - RNA, 14 nt, Bordetella pertussis
accccggcgccgcg

SEQ ID NO: 2349547 - RNA, 13 nt, Bordetella pertussis
accccggcugcgc

SEQ ID NO: 2349548 - RNA, 18 nt, Bordetella pertussis
accccgguguaggcgggc

SEQ ID NO: 2349549 - RNA, 22 nt, Bordetella pertussis
accccgguguaggcgggcagcg

SEQ ID NO: 2349550 - RNA, 19 nt, Bordetella pertussis
accccggugucgccguggc

SEQ ID NO: 2349551 - RNA, 15 nt, Bordetella pertussis
accccgucaucgccg

SEQ ID NO: 2349552 - RNA, 20 nt, Bordetella pertussis
accccgucaugcgccaugaa

SEQ ID NO: 2349553 - RNA, 14 nt, Bordetella pertussis
accccgucgaccgc

SEQ ID NO: 2349554 - RNA, 14 nt, Bordetella pertussis
accccgucggcuca

SEQ ID NO: 2349555 - RNA, 20 nt, Bordetella pertussis
accccgucguccguccuggc

SEQ ID NO: 2349556 - RNA, 19 nt, Bordetella pertussis
accccguggucgccagcac

SEQ ID NO: 2349557 - RNA, 16 nt, Bordetella pertussis
accccguugcagccca

SEQ ID NO: 2349558 - RNA, 21 nt, Bordetella pertussis
accccguugcagcccagcgcg

SEQ ID NO: 2349559 - RNA, 19 nt, Bordetella pertussis
accccucauuggcgcgcuu

SEQ ID NO: 2349560 - RNA, 21 nt, Bordetella pertussis
accccucauuggcgcgcuuga

SEQ ID NO: 2349561 - RNA, 11 nt, Bordetella pertussis
accccuccggc

SEQ ID NO: 2349562 - RNA, 15 nt, Bordetella pertussis
accccugcgcugcau

SEQ ID NO: 2349563 - RNA, 18 nt, Bordetella pertussis
accccuugcggccgccga

SEQ ID NO: 2349564 - RNA, 17 nt, Bordetella pertussis
acccgaaggcgcggccg

SEQ ID NO: 2349565 - RNA, 19 nt, Bordetella pertussis
acccgaaggcgcggccggg

SEQ ID NO: 2349566 - RNA, 23 nt, Bordetella pertussis
acccgaaucucccggcgcccucu

SEQ ID NO: 2349567 - RNA, 23 nt, Bordetella pertussis
acccgagcccuggcuuggccgaa

SEQ ID NO: 2349568 - RNA, 23 nt, Bordetella pertussis
acccgaguccuugacgccgccga

SEQ ID NO: 2349569 - RNA, 23 nt, Bordetella pertussis
acccgauacgacacgccgcgcga

SEQ ID NO: 2349570 - RNA, 17 nt, Bordetella pertussis
acccgauagccgcgcgc

SEQ ID NO: 2349571 - RNA, 16 nt, Bordetella pertussis
acccgaugacggggcg

SEQ ID NO: 2349572 - RNA, 20 nt, Bordetella pertussis
acccgaugacggggcggcgc

SEQ ID NO: 2349573 - RNA, 14 nt, Bordetella pertussis
acccgaugcgccuc

SEQ ID NO: 2349574 - RNA, 18 nt, Bordetella pertussis
acccgaugcgccucggcg

SEQ ID NO: 2349575 - RNA, 16 nt, Bordetella pertussis
acccgcaaaaccgggc

SEQ ID NO: 2349576 - RNA, 19 nt, Bordetella pertussis
acccgcaaaccugaugccu

SEQ ID NO: 2349577 - RNA, 14 nt, Bordetella pertussis
acccgcaccgacgg

SEQ ID NO: 2349578 - RNA, 13 nt, Bordetella pertussis
acccgcacgccgg

SEQ ID NO: 2349579 - RNA, 14 nt, Bordetella pertussis
acccgcacgggcag

SEQ ID NO: 2349580 - RNA, 21 nt, Bordetella pertussis
acccgcacgggcagacgccau

SEQ ID NO: 2349581 - RNA, 13 nt, Bordetella pertussis
acccgcaggcggc

SEQ ID NO: 2349582 - RNA, 20 nt, Bordetella pertussis
acccgcaugguggcgcaggc

SEQ ID NO: 2349583 - RNA, 17 nt, Bordetella pertussis
acccgccauccuggccg

SEQ ID NO: 2349584 - RNA, 18 nt, Bordetella pertussis
acccgccauccuggccgc

SEQ ID NO: 2349585 - RNA, 15 nt, Bordetella pertussis
acccgcccacgcggc

SEQ ID NO: 2349586 - RNA, 17 nt, Bordetella pertussis
acccgcccacgcggcgc

SEQ ID NO: 2349587 - RNA, 19 nt, Bordetella pertussis
acccgcccacgcggcgcug

SEQ ID NO: 2349588 - RNA, 22 nt, Bordetella pertussis
acccgcccgaaccggcaucccu

SEQ ID NO: 2349589 - RNA, 15 nt, Bordetella pertussis
acccgcccggggcca

SEQ ID NO: 2349590 - RNA, 12 nt, Bordetella pertussis
acccgccgcacc

SEQ ID NO: 2349591 - RNA, 13 nt, Bordetella pertussis
acccgccgccggc

SEQ ID NO: 2349592 - RNA, 16 nt, Bordetella pertussis
acccgccgcgaucagc

SEQ ID NO: 2349593 - RNA, 18 nt, Bordetella pertussis
acccgccggccaucacgc

SEQ ID NO: 2349594 - RNA, 18 nt, Bordetella pertussis
acccgccgggcggcgccg

SEQ ID NO: 2349595 - RNA, 18 nt, Bordetella pertussis
acccgccuggacggcgag

SEQ ID NO: 2349596 - RNA, 15 nt, Bordetella pertussis
acccgcgccaggaac

SEQ ID NO: 2349597 - RNA, 20 nt, Bordetella pertussis
acccgcgcccagcuguccaa

SEQ ID NO: 2349598 - RNA, 13 nt, Bordetella pertussis
acccgcgccgucg

SEQ ID NO: 2349599 - RNA, 14 nt, Bordetella pertussis
acccgcgcgcagcg

SEQ ID NO: 2349600 - RNA, 15 nt, Bordetella pertussis
acccgcggcccuugc

SEQ ID NO: 2349601 - RNA, 16 nt, Bordetella pertussis
acccgcggcgcaugca

SEQ ID NO: 2349602 - RNA, 22 nt, Bordetella pertussis
acccgcggcgcaugcagccgca

SEQ ID NO: 2349603 - RNA, 17 nt, Bordetella pertussis
acccgcuaccccggcag

SEQ ID NO: 2349604 - RNA, 18 nt, Bordetella pertussis
acccgcuaccccggcagc

SEQ ID NO: 2349605 - RNA, 14 nt, Bordetella pertussis
acccgcucggccac

SEQ ID NO: 2349606 - RNA, 15 nt, Bordetella pertussis
acccgcucggccacg

SEQ ID NO: 2349607 - RNA, 17 nt, Bordetella pertussis
acccgcucggccacgcg

SEQ ID NO: 2349608 - RNA, 12 nt, Bordetella pertussis
acccgcugggcc

SEQ ID NO: 2349609 - RNA, 13 nt, Bordetella pertussis
acccgcugggcca

SEQ ID NO: 2349610 - RNA, 18 nt, Bordetella pertussis
acccgcugggccagcauc

SEQ ID NO: 2349611 - RNA, 21 nt, Bordetella pertussis
acccgcugggccagcaucggc

SEQ ID NO: 2349612 - RNA, 14 nt, Bordetella pertussis
acccgcuucgacgg

SEQ ID NO: 2349613 - RNA, 15 nt, Bordetella pertussis
acccgcuucgacggc

SEQ ID NO: 2349614 - RNA, 21 nt, Bordetella pertussis
acccgcuucgacggcuugcgc

SEQ ID NO: 2349615 - RNA, 13 nt, Bordetella pertussis
acccggagcugcc

SEQ ID NO: 2349616 - RNA, 12 nt, Bordetella pertussis
acccggccgcug

SEQ ID NO: 2349617 - RNA, 13 nt, Bordetella pertussis
acccggccggcgc

SEQ ID NO: 2349618 - RNA, 17 nt, Bordetella pertussis
acccggccggcgccggc

SEQ ID NO: 2349619 - RNA, 23 nt, Bordetella pertussis
acccggccggcgccggcaaaccc

SEQ ID NO: 2349620 - RNA, 17 nt, Bordetella pertussis
acccggccucagcggcc

SEQ ID NO: 2349621 - RNA, 23 nt, Bordetella pertussis
acccggccucagcggccgcugcc

SEQ ID NO: 2349622 - RNA, 16 nt, Bordetella pertussis
acccggccugcgcgcc

SEQ ID NO: 2349623 - RNA, 18 nt, Bordetella pertussis
acccggccugcgcgccgg

SEQ ID NO: 2349624 - RNA, 20 nt, Bordetella pertussis
acccggcgaggccgcccgcc

SEQ ID NO: 2349625 - RNA, 15 nt, Bordetella pertussis
acccggcgcaugcug

SEQ ID NO: 2349626 - RNA, 17 nt, Bordetella pertussis
acccgggcgggcgucuc

SEQ ID NO: 2349627 - RNA, 21 nt, Bordetella pertussis
acccggguacguggccccagg

SEQ ID NO: 2349628 - RNA, 15 nt, Bordetella pertussis
acccgguauccgcgc

SEQ ID NO: 2349629 - RNA, 19 nt, Bordetella pertussis
acccggucgaucagggcgc

SEQ ID NO: 2349630 - RNA, 23 nt, Bordetella pertussis
acccggucgaucagggcgcggac

SEQ ID NO: 2349631 - RNA, 18 nt, Bordetella pertussis
acccgucccugguccagc

SEQ ID NO: 2349632 - RNA, 20 nt, Bordetella pertussis
acccgucccugguccagcag

SEQ ID NO: 2349633 - RNA, 22 nt, Bordetella pertussis
acccgucccugguccagcagcg

SEQ ID NO: 2349634 - RNA, 23 nt, Bordetella pertussis
acccgucccugguccagcagcgu

SEQ ID NO: 2349635 - RNA, 20 nt, Bordetella pertussis
acccguccuuggcguccggc

SEQ ID NO: 2349636 - RNA, 14 nt, Bordetella pertussis
acccgucgacgcag

SEQ ID NO: 2349637 - RNA, 14 nt, Bordetella pertussis
acccguuccagcau

SEQ ID NO: 2349638 - RNA, 16 nt, Bordetella pertussis
acccguuccccaucau

SEQ ID NO: 2349639 - RNA, 22 nt, Bordetella pertussis
acccucagcccgcaccgcccgc

SEQ ID NO: 2349640 - RNA, 18 nt, Bordetella pertussis
acccucccacgaccugca

SEQ ID NO: 2349641 - RNA, 20 nt, Bordetella pertussis
acccucccacgaccugcaac

SEQ ID NO: 2349642 - RNA, 22 nt, Bordetella pertussis
acccuccucgcuuuaccagcug

SEQ ID NO: 2349643 - RNA, 21 nt, Bordetella pertussis
acccugaacucuucaaaacca

SEQ ID NO: 2349644 - RNA, 18 nt, Bordetella pertussis
acccugcaggccgggcag

SEQ ID NO: 2349645 - RNA, 22 nt, Bordetella pertussis
acccugcaggccgggcaguccu

SEQ ID NO: 2349646 - RNA, 16 nt, Bordetella pertussis
acccugcccggcaggg

SEQ ID NO: 2349647 - RNA, 19 nt, Bordetella pertussis
acccugccgugcagauggc

SEQ ID NO: 2349648 - RNA, 23 nt, Bordetella pertussis
accgccugcugcgccuggccgcg

SEQ ID NO: 2349649 - RNA, 17 nt, Bordetella pertussis
accgccugugccagcug

SEQ ID NO: 2349650 - RNA, 18 nt, Bordetella pertussis
accgccugugccagcugg

SEQ ID NO: 2349651 - RNA, 20 nt, Bordetella pertussis
accgccugugccagcuggcc

SEQ ID NO: 2349652 - RNA, 21 nt, Bordetella pertussis
accgccuuggccgucaagcgu

SEQ ID NO: 2349653 - RNA, 16 nt, Bordetella pertussis
accgcgaaccaggccu

SEQ ID NO: 2349654 - RNA, 20 nt, Bordetella pertussis
accgcgaaccggugcuggug

SEQ ID NO: 2349655 - RNA, 14 nt, Bordetella pertussis
accgcgaagcgcgc

SEQ ID NO: 2349656 - RNA, 16 nt, Bordetella pertussis
accgcgaagcgcgcca

SEQ ID NO: 2349657 - RNA, 17 nt, Bordetella pertussis
accgcgaagcgcgccag

SEQ ID NO: 2349658 - RNA, 23 nt, Bordetella pertussis
accgcgaccaugcggccgucgcc

SEQ ID NO: 2349659 - RNA, 17 nt, Bordetella pertussis
accgcgacgcauaucca

SEQ ID NO: 2349660 - RNA, 13 nt, Bordetella pertussis
accgcgacgcgcc

SEQ ID NO: 2349661 - RNA, 15 nt, Bordetella pertussis
accgcgaugcugcgc

SEQ ID NO: 2349662 - RNA, 16 nt, Bordetella pertussis
accgcgaugcugcgca

SEQ ID NO: 2349663 - RNA, 22 nt, Bordetella pertussis
accgcgcacaggucgccgaagg

SEQ ID NO: 2349664 - RNA, 15 nt, Bordetella pertussis
accgcgcagcccggc

SEQ ID NO: 2349665 - RNA, 15 nt, Bordetella pertussis
accgcgcagccgcuu

SEQ ID NO: 2349666 - RNA, 20 nt, Bordetella pertussis
accgcgccagcgccggcgcg

SEQ ID NO: 2349667 - RNA, 12 nt, Bordetella pertussis
accgcgccaucu

SEQ ID NO: 2349668 - RNA, 21 nt, Bordetella pertussis
accgcgcccuggggcgcgguc

SEQ ID NO: 2349669 - RNA, 13 nt, Bordetella pertussis
accgcgcgcacca

SEQ ID NO: 2349670 - RNA, 23 nt, Bordetella pertussis
accgcgcgcacgaccaccagcgc

SEQ ID NO: 2349671 - RNA, 11 nt, Bordetella pertussis
accgcgcgccg

SEQ ID NO: 2349672 - RNA, 13 nt, Bordetella pertussis
accgcgcggcgcu

SEQ ID NO: 2349673 - RNA, 15 nt, Bordetella pertussis
accgcgcggcgcugc

SEQ ID NO: 2349674 - RNA, 22 nt, Bordetella pertussis
accgcgcggcgcugcacgcggc

SEQ ID NO: 2349675 - RNA, 19 nt, Bordetella pertussis
accgcgcgguggccgccgc

SEQ ID NO: 2349676 - RNA, 17 nt, Bordetella pertussis
accgcgcguaucggcgc

SEQ ID NO: 2349677 - RNA, 15 nt, Bordetella pertussis
accgcggacgccaug

SEQ ID NO: 2349678 - RNA, 23 nt, Bordetella pertussis
accgcggacgccauggcggcggc

SEQ ID NO: 2349679 - RNA, 12 nt, Bordetella pertussis
accgcggcgcag

SEQ ID NO: 2349680 - RNA, 18 nt, Bordetella pertussis
accgcggcggaccacacg

SEQ ID NO: 2349681 - RNA, 12 nt, Bordetella pertussis
accgcggcgggc

SEQ ID NO: 2349682 - RNA, 19 nt, Bordetella pertussis
accgcggcgggcucggcgc

SEQ ID NO: 2349683 - RNA, 21 nt, Bordetella pertussis
accgcggcgggcucggcgccg

SEQ ID NO: 2349684 - RNA, 16 nt, Bordetella pertussis
accgcgggcgcgcgcc

SEQ ID NO: 2349685 - RNA, 17 nt, Bordetella pertussis
accgcgggcgcgcgccc

SEQ ID NO: 2349686 - RNA, 15 nt, Bordetella pertussis
accgcgguacgcggg

SEQ ID NO: 2349687 - RNA, 17 nt, Bordetella pertussis
accgcgguacgcgggca

SEQ ID NO: 2349688 - RNA, 17 nt, Bordetella pertussis
accgcggugccgcgcgc

SEQ ID NO: 2349689 - RNA, 18 nt, Bordetella pertussis
accgcggugccgcgcgcg

SEQ ID NO: 2349690 - RNA, 20 nt, Bordetella pertussis
accgcggugccgcgcgcggc

SEQ ID NO: 2349691 - RNA, 22 nt, Bordetella pertussis
accgcguaggccuucaccuugc

SEQ ID NO: 2349692 - RNA, 20 nt, Bordetella pertussis
accgcguaguugucggcgca

SEQ ID NO: 2349693 - RNA, 21 nt, Bordetella pertussis
accgcguaguugucggcgcag

SEQ ID NO: 2349694 - RNA, 20 nt, Bordetella pertussis
accgcgucauacacggcgcg

SEQ ID NO: 2349695 - RNA, 14 nt, Bordetella pertussis
accgcgucggccug

SEQ ID NO: 2349696 - RNA, 22 nt, Bordetella pertussis
accgcgucggccugccagccug

SEQ ID NO: 2349697 - RNA, 12 nt, Bordetella pertussis
accgcguggcgc

SEQ ID NO: 2349698 - RNA, 15 nt, Bordetella pertussis
accgcguggcgcugc

SEQ ID NO: 2349699 - RNA, 16 nt, Bordetella pertussis
accgcguugagcgccg

SEQ ID NO: 2349700 - RNA, 19 nt, Bordetella pertussis
accgcguugagcgccgacg

SEQ ID NO: 2349701 - RNA, 19 nt, Bordetella pertussis
accgcuauuuuucgacacc

SEQ ID NO: 2349702 - RNA, 19 nt, Bordetella pertussis
accgcucagcccuugacgc

SEQ ID NO: 2349703 - RNA, 14 nt, Bordetella pertussis
accgcucagcuugu

SEQ ID NO: 2349704 - RNA, 15 nt, Bordetella pertussis
accgcucgucaugau

SEQ ID NO: 2349705 - RNA, 16 nt, Bordetella pertussis
accgcuggccaggcuc

SEQ ID NO: 2349706 - RNA, 13 nt, Bordetella pertussis
accgcuucccugg

SEQ ID NO: 2349707 - RNA, 14 nt, Bordetella pertussis
accgcuuccgccac

SEQ ID NO: 2349708 - RNA, 15 nt, Bordetella pertussis
accgcuucggucagc

SEQ ID NO: 2349709 - RNA, 17 nt, Bordetella pertussis
accgcuucggucagcug

SEQ ID NO: 2349710 - RNA, 18 nt, Bordetella pertussis
accgcuucggucagcugc

SEQ ID NO: 2349711 - RNA, 21 nt, Bordetella pertussis
accgcuucuucgucgcgccag

SEQ ID NO: 2349712 - RNA, 16 nt, Bordetella pertussis
accggaacaccagcaa

SEQ ID NO: 2349713 - RNA, 19 nt, Bordetella pertussis
accggaaucaccgccgcga

SEQ ID NO: 2349714 - RNA, 13 nt, Bordetella pertussis
accggaccguucc

SEQ ID NO: 2349715 - RNA, 17 nt, Bordetella pertussis
accggauccugcggcgc

SEQ ID NO: 2349716 - RNA, 18 nt, Bordetella pertussis
accggauccugcggcgcg

SEQ ID NO: 2349717 - RNA, 18 nt, Bordetella pertussis
accggcaagccuugcggc

SEQ ID NO: 2349718 - RNA, 15 nt, Bordetella pertussis
accggcaaggccgcg

SEQ ID NO: 2349719 - RNA, 17 nt, Bordetella pertussis
accggcaaggccgcgaa

SEQ ID NO: 2349720 - RNA, 11 nt, Bordetella pertussis
accggcacccg

SEQ ID NO: 2349721 - RNA, 23 nt, Bordetella pertussis
accggcaccuucuuccaggcgcc

SEQ ID NO: 2349722 - RNA, 14 nt, Bordetella pertussis
accggcacgccggc

SEQ ID NO: 2349723 - RNA, 19 nt, Bordetella pertussis
accggcacgccggcggcgc

SEQ ID NO: 2349724 - RNA, 20 nt, Bordetella pertussis
accggcacgccggcggcgcu

SEQ ID NO: 2349725 - RNA, 13 nt, Bordetella pertussis
accggcacgcgcc

SEQ ID NO: 2349726 - RNA, 16 nt, Bordetella pertussis
accggcacgcgccagg

SEQ ID NO: 2349727 - RNA, 13 nt, Bordetella pertussis
accggcaggccgc

SEQ ID NO: 2349728 - RNA, 14 nt, Bordetella pertussis
accggcaggccgcg

SEQ ID NO: 2349729 - RNA, 14 nt, Bordetella pertussis
accggcaucccugc

SEQ ID NO: 2349730 - RNA, 17 nt, Bordetella pertussis
accggccaagcuccagg

SEQ ID NO: 2349731 - RNA, 16 nt, Bordetella pertussis
accggccaggcgcgga

SEQ ID NO: 2349732 - RNA, 22 nt, Bordetella pertussis
accggccaggggcgcuggucga

SEQ ID NO: 2349733 - RNA, 23 nt, Bordetella pertussis
accggccagucccaggaucaccg

SEQ ID NO: 2349734 - RNA, 19 nt, Bordetella pertussis
accggccagucgcggugca

SEQ ID NO: 2349735 - RNA, 14 nt, Bordetella pertussis
accggccccaccug

SEQ ID NO: 2349736 - RNA, 18 nt, Bordetella pertussis
accggccccaccuggcgg

SEQ ID NO: 2349737 - RNA, 21 nt, Bordetella pertussis
accggcccgcaccuugccugc

SEQ ID NO: 2349738 - RNA, 16 nt, Bordetella pertussis
accggccgacccgcgg

SEQ ID NO: 2349739 - RNA, 21 nt, Bordetella pertussis
accggccgccgcaugccgggc

SEQ ID NO: 2349740 - RNA, 22 nt, Bordetella pertussis
accggccgccgcaugccgggcu

SEQ ID NO: 2349741 - RNA, 22 nt, Bordetella pertussis
accggccuggucaugacgggcg

SEQ ID NO: 2349742 - RNA, 12 nt, Bordetella pertussis
accggcgccacg

SEQ ID NO: 2349743 - RNA, 15 nt, Bordetella pertussis
accggcgccacggcu

SEQ ID NO: 2349744 - RNA, 14 nt, Bordetella pertussis
accggcgccgacgc

SEQ ID NO: 2349745 - RNA, 19 nt, Bordetella pertussis
accggcgccgacgcgcugg

SEQ ID NO: 2349746 - RNA, 14 nt, Bordetella pertussis
accggcgccggcuc

SEQ ID NO: 2349747 - RNA, 15 nt, Bordetella pertussis
accggcgccggcucc

SEQ ID NO: 2349748 - RNA, 13 nt, Bordetella pertussis
accggcgccuggc

SEQ ID NO: 2349749 - RNA, 21 nt, Bordetella pertussis
accggcgcgaacaccggcagg

SEQ ID NO: 2349750 - RNA, 13 nt, Bordetella pertussis
accggcgcgcgca

SEQ ID NO: 2349751 - RNA, 21 nt, Bordetella pertussis
accggcgcgcgcaugcccgac

SEQ ID NO: 2349752 - RNA, 13 nt, Bordetella pertussis
accggcgcgcgcg

SEQ ID NO: 2349753 - RNA, 15 nt, Bordetella pertussis
accggcgcgcgcggc

SEQ ID NO: 2349754 - RNA, 17 nt, Bordetella pertussis
accggcgcgcgcggcca

SEQ ID NO: 2349755 - RNA, 14 nt, Bordetella pertussis
accggcggcacggc

SEQ ID NO: 2349756 - RNA, 20 nt, Bordetella pertussis
accggcggcacggccggccu

SEQ ID NO: 2349757 - RNA, 19 nt, Bordetella pertussis
accggcggcgcucaucauc

SEQ ID NO: 2349758 - RNA, 19 nt, Bordetella pertussis
accggcguauggcccgcca

SEQ ID NO: 2349759 - RNA, 20 nt, Bordetella pertussis
accggcguauggcccgccac

SEQ ID NO: 2349760 - RNA, 17 nt, Bordetella pertussis
accggcguccaugaaaa

SEQ ID NO: 2349761 - RNA, 18 nt, Bordetella pertussis
accugcgcaccggccggc

SEQ ID NO: 2349762 - RNA, 19 nt, Bordetella pertussis
accugcgcaccggccggcc

SEQ ID NO: 2349763 - RNA, 15 nt, Bordetella pertussis
accugcgcaugcgcc

SEQ ID NO: 2349764 - RNA, 17 nt, Bordetella pertussis
accugcgcaugcgccug

SEQ ID NO: 2349765 - RNA, 22 nt, Bordetella pertussis
accugcgcaugcgccuguccca

SEQ ID NO: 2349766 - RNA, 14 nt, Bordetella pertussis
accugcgccaggug

SEQ ID NO: 2349767 - RNA, 16 nt, Bordetella pertussis
accugcgccaggugcu

SEQ ID NO: 2349768 - RNA, 20 nt, Bordetella pertussis
accugcgcgaagcgcugggu

SEQ ID NO: 2349769 - RNA, 17 nt, Bordetella pertussis
accugcgcgaccgccgc

SEQ ID NO: 2349770 - RNA, 11 nt, Bordetella pertussis
accugcgcgcc

SEQ ID NO: 2349771 - RNA, 17 nt, Bordetella pertussis
accugcgcgccggcaug

SEQ ID NO: 2349772 - RNA, 13 nt, Bordetella pertussis
accugcgggccgc

SEQ ID NO: 2349773 - RNA, 15 nt, Bordetella pertussis
accugcgucugcacg

SEQ ID NO: 2349774 - RNA, 21 nt, Bordetella pertussis
accugcgucugcacgcugaac

SEQ ID NO: 2349775 - RNA, 10 nt, Bordetella pertussis
accugcucga

SEQ ID NO: 2349776 - RNA, 23 nt, Bordetella pertussis
accugcucgucgccaugcggcug

SEQ ID NO: 2349777 - RNA, 17 nt, Bordetella pertussis
accugcugcggcacggc

SEQ ID NO: 2349778 - RNA, 20 nt, Bordetella pertussis
accugcugcuugaccuuggc

SEQ ID NO: 2349779 - RNA, 14 nt, Bordetella pertussis
accugcuggccgcc

SEQ ID NO: 2349780 - RNA, 22 nt, Bordetella pertussis
accugcuggccgccggcgcggu

SEQ ID NO: 2349781 - RNA, 22 nt, Bordetella pertussis
accugcugguuuucggacgcag

SEQ ID NO: 2349782 - RNA, 22 nt, Bordetella pertussis
accugcuugacguagaugcggg

SEQ ID NO: 2349783 - RNA, 18 nt, Bordetella pertussis
accugcuugagcaccacg

SEQ ID NO: 2349784 - RNA, 18 nt, Bordetella pertussis
accugcuugcccagcaga

SEQ ID NO: 2349785 - RNA, 21 nt, Bordetella pertussis
aaggcccggauauggccggcg

SEQ ID NO: 2349786 - RNA, 15 nt, Bordetella pertussis
aaggccgagguggac

SEQ ID NO: 2349787 - RNA, 20 nt, Bordetella pertussis
aaggccgccgcgcccagcag

SEQ ID NO: 2349788 - RNA, 22 nt, Bordetella pertussis
aaggccgccgcgcccagcagcg

SEQ ID NO: 2349789 - RNA, 14 nt, Bordetella pertussis
aaggccgccggcca

SEQ ID NO: 2349790 - RNA, 15 nt, Bordetella pertussis
aaggccgccggccac

SEQ ID NO: 2349791 - RNA, 11 nt, Bordetella pertussis
aaggccgcgcc

SEQ ID NO: 2349792 - RNA, 23 nt, Bordetella pertussis
aaggccgcgccgcggcaagccgc

SEQ ID NO: 2349793 - RNA, 23 nt, Bordetella pertussis
aaggccggcggcacgcugcgcag

SEQ ID NO: 2349794 - RNA, 13 nt, Bordetella pertussis
aaggccugcugca

SEQ ID NO: 2349795 - RNA, 22 nt, Bordetella pertussis
aaggccuuggccugggccgaca

SEQ ID NO: 2349796 - RNA, 20 nt, Bordetella pertussis
aaggcgaacugggucugccc

SEQ ID NO: 2349797 - RNA, 13 nt, Bordetella pertussis
aaggcgagcgcgg

SEQ ID NO: 2349798 - RNA, 18 nt, Bordetella pertussis
aaggcgaucugcggcgug

SEQ ID NO: 2349799 - RNA, 14 nt, Bordetella pertussis
aaggcgcacaaccu

SEQ ID NO: 2349800 - RNA, 19 nt, Bordetella pertussis
aaggcgccgacggcgcccu

SEQ ID NO: 2349801 - RNA, 16 nt, Bordetella pertussis
aaggcgccggccaggc

SEQ ID NO: 2349802 - RNA, 13 nt, Bordetella pertussis
aaggcggccagca

SEQ ID NO: 2349803 - RNA, 22 nt, Bordetella pertussis
aaggcggcccggccgccgccgg

SEQ ID NO: 2349804 - RNA, 20 nt, Bordetella pertussis
aaggcggccgcgcccgcaac

SEQ ID NO: 2349805 - RNA, 12 nt, Bordetella pertussis
aaggcggccggc

SEQ ID NO: 2349806 - RNA, 20 nt, Bordetella pertussis
aaggcgggcuggucgcgccg

SEQ ID NO: 2349807 - RNA, 17 nt, Bordetella pertussis
aaggcgggugucccagc

SEQ ID NO: 2349808 - RNA, 12 nt, Bordetella pertussis
aaggcugcagcu

SEQ ID NO: 2349809 - RNA, 16 nt, Bordetella pertussis
aaggcugcagcuugcg

SEQ ID NO: 2349810 - RNA, 22 nt, Bordetella pertussis
aaggcugcagcuugcgcgccag

SEQ ID NO: 2349811 - RNA, 19 nt, Bordetella pertussis
aaggcuucgucgaccagca

SEQ ID NO: 2349812 - RNA, 19 nt, Bordetella pertussis
aaggcuucucgaccaggcg

SEQ ID NO: 2349813 - RNA, 20 nt, Bordetella pertussis
aaggcuucucgaccaggcgg

SEQ ID NO: 2349814 - RNA, 17 nt, Bordetella pertussis
aaggcuuucugcuugcc

SEQ ID NO: 2349815 - RNA, 13 nt, Bordetella pertussis
aagggcagcagca

SEQ ID NO: 2349816 - RNA, 14 nt, Bordetella pertussis
aagggccgacuaug

SEQ ID NO: 2349817 - RNA, 13 nt, Bordetella pertussis
aagggcgcgccag

SEQ ID NO: 2349818 - RNA, 22 nt, Bordetella pertussis
aagggcugcgugcgggacaggc

SEQ ID NO: 2349819 - RNA, 18 nt, Bordetella pertussis
aaggggccagccuggcgc

SEQ ID NO: 2349820 - RNA, 12 nt, Bordetella pertussis
aaggggccggcg

SEQ ID NO: 2349821 - RNA, 19 nt, Bordetella pertussis
aaggggcuguaccuggcga

SEQ ID NO: 2349822 - RNA, 16 nt, Bordetella pertussis
aagguacccgcgccgg

SEQ ID NO: 2349823 - RNA, 18 nt, Bordetella pertussis
aagguacccgcgccggcg

SEQ ID NO: 2349824 - RNA, 16 nt, Bordetella pertussis
aagguccacggcaugg

SEQ ID NO: 2349825 - RNA, 19 nt, Bordetella pertussis
aaggucggcacgacgcuga

SEQ ID NO: 2349826 - RNA, 23 nt, Bordetella pertussis
aaggucggcacgacgcugaugcc

SEQ ID NO: 2349827 - RNA, 19 nt, Bordetella pertussis
aaggugaaauagccaugcg

SEQ ID NO: 2349828 - RNA, 17 nt, Bordetella pertussis
aaggugccggacgcccu

SEQ ID NO: 2349829 - RNA, 17 nt, Bordetella pertussis
aaggugcgcagcaggug

SEQ ID NO: 2349830 - RNA, 16 nt, Bordetella pertussis
aaguaaucgcccggcg

SEQ ID NO: 2349831 - RNA, 15 nt, Bordetella pertussis
aaguacucgccggcg

SEQ ID NO: 2349832 - RNA, 16 nt, Bordetella pertussis
aaguaggcggccaggc

SEQ ID NO: 2349833 - RNA, 20 nt, Bordetella pertussis
aaguaguucggcgcgugcgg

SEQ ID NO: 2349834 - RNA, 16 nt, Bordetella pertussis
aagucgaaccacacga

SEQ ID NO: 2349835 - RNA, 18 nt, Bordetella pertussis
aagucgaguucggcgcgc

SEQ ID NO: 2349836 - RNA, 13 nt, Bordetella pertussis
aagucgggcacca

SEQ ID NO: 2349837 - RNA, 21 nt, Bordetella pertussis
aagucggucagcucgucgccg

SEQ ID NO: 2349838 - RNA, 20 nt, Bordetella pertussis
aagugaucaccgccauggcg

SEQ ID NO: 2349839 - RNA, 12 nt, Bordetella pertussis
aagugcccaggc

SEQ ID NO: 2349840 - RNA, 13 nt, Bordetella pertussis
aaguggcggcggg

SEQ ID NO: 2349841 - RNA, 14 nt, Bordetella pertussis
aagugggcauagcg

SEQ ID NO: 2349842 - RNA, 16 nt, Bordetella pertussis
aagugggcugcggcgu

SEQ ID NO: 2349843 - RNA, 18 nt, Bordetella pertussis
aagugggcugcggcgugg

SEQ ID NO: 2349844 - RNA, 13 nt, Bordetella pertussis
aaguggucgcgca

SEQ ID NO: 2349845 - RNA, 22 nt, Bordetella pertussis
aaguguggcgcaccgcgcuggg

SEQ ID NO: 2349846 - RNA, 22 nt, Bordetella pertussis
aauacaccuuguuggcgccggc

SEQ ID NO: 2349847 - RNA, 23 nt, Bordetella pertussis
aauaccccucauuggcgcgcuug

SEQ ID NO: 2349848 - RNA, 19 nt, Bordetella pertussis
aauaccuucagcccggcga

SEQ ID NO: 2349849 - RNA, 17 nt, Bordetella pertussis
aauacgaaacaggcgcc

SEQ ID NO: 2349850 - RNA, 23 nt, Bordetella pertussis
aauacgugcgcgacgcguagccg

SEQ ID NO: 2349851 - RNA, 23 nt, Bordetella pertussis
aauagcccgcggccaccaggcug

SEQ ID NO: 2349852 - RNA, 21 nt, Bordetella pertussis
aauagcccgugcgggccugca

SEQ ID NO: 2349853 - RNA, 16 nt, Bordetella pertussis
aauccacuugcggguc

SEQ ID NO: 2349854 - RNA, 16 nt, Bordetella pertussis
aauccagggccacgcc

SEQ ID NO: 2349855 - RNA, 11 nt, Bordetella pertussis
aaucccggcga

SEQ ID NO: 2349856 - RNA, 22 nt, Bordetella pertussis
aauccgcaacccagcagcggca

SEQ ID NO: 2349857 - RNA, 15 nt, Bordetella pertussis
aauccgccgccagca

SEQ ID NO: 2349858 - RNA, 18 nt, Bordetella pertussis
aauccgcgaagugccugu

SEQ ID NO: 2349859 - RNA, 19 nt, Bordetella pertussis
aauccggggugccuguccu

SEQ ID NO: 2349860 - RNA, 17 nt, Bordetella pertussis
aaucgaacuuggcgcgg

SEQ ID NO: 2349861 - RNA, 14 nt, Bordetella pertussis
aaucgacucggccg

SEQ ID NO: 2349862 - RNA, 16 nt, Bordetella pertussis
aaucgauacgccgggc

SEQ ID NO: 2349863 - RNA, 23 nt, Bordetella pertussis
aaucgaugaagaucaggcggcug

SEQ ID NO: 2349864 - RNA, 15 nt, Bordetella pertussis
aaucgcccggcgcca

SEQ ID NO: 2349865 - RNA, 14 nt, Bordetella pertussis
aaucgccgccggcg

SEQ ID NO: 2349866 - RNA, 22 nt, Bordetella pertussis
aaucggccccugcccugcggcu

SEQ ID NO: 2349867 - RNA, 17 nt, Bordetella pertussis
aaucgugccgucgauga

SEQ ID NO: 2349868 - RNA, 15 nt, Bordetella pertussis
aaucguucacgcccg

SEQ ID NO: 2349869 - RNA, 14 nt, Bordetella pertussis
aaucuugccaggcc

SEQ ID NO: 2349870 - RNA, 17 nt, Bordetella pertussis
aaugacgguggugucgg

SEQ ID NO: 2349871 - RNA, 12 nt, Bordetella pertussis
aaugaugcgcau

SEQ ID NO: 2349872 - RNA, 23 nt, Bordetella pertussis
aaugaugguggggcuggccgccg

SEQ ID NO: 2349873 - RNA, 19 nt, Bordetella pertussis
aaugccagggugaccuggc

SEQ ID NO: 2349874 - RNA, 14 nt, Bordetella pertussis
acgaccugcgcaug

SEQ ID NO: 2349875 - RNA, 12 nt, Bordetella pertussis
acgaccuugcug

SEQ ID NO: 2349876 - RNA, 15 nt, Bordetella pertussis
acgaccuugcuggac

SEQ ID NO: 2349877 - RNA, 15 nt, Bordetella pertussis
acgaccuuggcggcc

SEQ ID NO: 2349878 - RNA, 17 nt, Bordetella pertussis
acgacgaaacccgggcc

SEQ ID NO: 2349879 - RNA, 13 nt, Bordetella pertussis
acgacgacggccg

SEQ ID NO: 2349880 - RNA, 15 nt, Bordetella pertussis
acgacgacggccggc

SEQ ID NO: 2349881 - RNA, 22 nt, Bordetella pertussis
acgacgagaguuucggcgacga

SEQ ID NO: 2349882 - RNA, 22 nt, Bordetella pertussis
acgacgaucugguccugggccg

SEQ ID NO: 2349883 - RNA, 22 nt, Bordetella pertussis
acgacgccggcuuucagcgccg

SEQ ID NO: 2349884 - RNA, 12 nt, Bordetella pertussis
acgacgccgucg

SEQ ID NO: 2349885 - RNA, 16 nt, Bordetella pertussis
acgacgcgaaccaggc

SEQ ID NO: 2349886 - RNA, 14 nt, Bordetella pertussis
acgacgguacaccu

SEQ ID NO: 2349887 - RNA, 19 nt, Bordetella pertussis
acgacguagucggcgccca

SEQ ID NO: 2349888 - RNA, 13 nt, Bordetella pertussis
acgacgucuugcu

SEQ ID NO: 2349889 - RNA, 22 nt, Bordetella pertussis
acgacguggccuaccacgcaug

SEQ ID NO: 2349890 - RNA, 19 nt, Bordetella pertussis
acgagaacucgguggcggu

SEQ ID NO: 2349891 - RNA, 14 nt, Bordetella pertussis
acgagacaggcgcg

SEQ ID NO: 2349892 - RNA, 16 nt, Bordetella pertussis
acgagacaggcgcgcc

SEQ ID NO: 2349893 - RNA, 18 nt, Bordetella pertussis
acgagauguccauggccu

SEQ ID NO: 2349894 - RNA, 21 nt, Bordetella pertussis
acgagcaagcccacaccauca

SEQ ID NO: 2349895 - RNA, 19 nt, Bordetella pertussis
acgagcaguacacgcgcaa

SEQ ID NO: 2349896 - RNA, 14 nt, Bordetella pertussis
acgagccggccgcg

SEQ ID NO: 2349897 - RNA, 20 nt, Bordetella pertussis
acgagccggccgcgcccgag

SEQ ID NO: 2349898 - RNA, 13 nt, Bordetella pertussis
acgagcgcagcaa

SEQ ID NO: 2349899 - RNA, 16 nt, Bordetella pertussis
acgaggcauacaggcu

SEQ ID NO: 2349900 - RNA, 19 nt, Bordetella pertussis
acgaggccgaguagcggcg

SEQ ID NO: 2349901 - RNA, 21 nt, Bordetella pertussis
acgaggcgauggucggccgga

SEQ ID NO: 2349902 - RNA, 23 nt, Bordetella pertussis
acgaggcgcggucguagcggaug

SEQ ID NO: 2349903 - RNA, 16 nt, Bordetella pertussis
acgagggccggcgcca

SEQ ID NO: 2349904 - RNA, 17 nt, Bordetella pertussis
acgaggggguguucucc

SEQ ID NO: 2349905 - RNA, 18 nt, Bordetella pertussis
acgaggugccuguccccc

SEQ ID NO: 2349906 - RNA, 14 nt, Bordetella pertussis
acgaguaccgccgc

SEQ ID NO: 2349907 - RNA, 11 nt, Bordetella pertussis
acgagugcagg

SEQ ID NO: 2349908 - RNA, 15 nt, Bordetella pertussis
acgagugcaggcccg

SEQ ID NO: 2349909 - RNA, 16 nt, Bordetella pertussis
acgagugcaggcccga

SEQ ID NO: 2349910 - RNA, 15 nt, Bordetella pertussis
acgaguugcucggag

SEQ ID NO: 2349911 - RNA, 13 nt, Bordetella pertussis
acgauauccaggc

SEQ ID NO: 2349912 - RNA, 20 nt, Bordetella pertussis
acgaucaccacgcccgcgcc

SEQ ID NO: 2349913 - RNA, 13 nt, Bordetella pertussis
acgaucagcgccc

SEQ ID NO: 2349914 - RNA, 15 nt, Bordetella pertussis
acgaucaggcggcgc

SEQ ID NO: 2349915 - RNA, 15 nt, Bordetella pertussis
acgaucauccaggcc

SEQ ID NO: 2349916 - RNA, 22 nt, Bordetella pertussis
acgaucauggucaugcccuccu

SEQ ID NO: 2349917 - RNA, 16 nt, Bordetella pertussis
acgauccacggccggc

SEQ ID NO: 2349918 - RNA, 17 nt, Bordetella pertussis
acgauccacggccggcg

SEQ ID NO: 2349919 - RNA, 18 nt, Bordetella pertussis
acgauccacggccggcgc

SEQ ID NO: 2349920 - RNA, 20 nt, Bordetella pertussis
acgaucccgacgauccgcgg

SEQ ID NO: 2349921 - RNA, 23 nt, Bordetella pertussis
acgaucccgucauggcggcaggc

SEQ ID NO: 2349922 - RNA, 15 nt, Bordetella pertussis
acgaucgcgccggcc

SEQ ID NO: 2349923 - RNA, 16 nt, Bordetella pertussis
acgaucgcgccggccu

SEQ ID NO: 2349924 - RNA, 14 nt, Bordetella pertussis
acgaucgcggcgcu

SEQ ID NO: 2349925 - RNA, 20 nt, Bordetella pertussis
acgaucgcggcgcuggcgaa

SEQ ID NO: 2349926 - RNA, 20 nt, Bordetella pertussis
acgaucuccacccccgggcg

SEQ ID NO: 2349927 - RNA, 14 nt, Bordetella pertussis
acgaucuggcgcgc

SEQ ID NO: 2349928 - RNA, 22 nt, Bordetella pertussis
acgaucuggcgcgcgaccaggc

SEQ ID NO: 2349929 - RNA, 14 nt, Bordetella pertussis
acgaugcccagggc

SEQ ID NO: 2349930 - RNA, 20 nt, Bordetella pertussis
acgaugcccagggccgcgcc

SEQ ID NO: 2349931 - RNA, 22 nt, Bordetella pertussis
acgaugcccagggccgcgccgg

SEQ ID NO: 2349932 - RNA, 23 nt, Bordetella pertussis
acgaugccggucuccagcgcguc

SEQ ID NO: 2349933 - RNA, 14 nt, Bordetella pertussis
acgaugcguugcgc

SEQ ID NO: 2349934 - RNA, 14 nt, Bordetella pertussis
acgauggccgcgcc

SEQ ID NO: 2349935 - RNA, 14 nt, Bordetella pertussis
acgauggccggauc

SEQ ID NO: 2349936 - RNA, 14 nt, Bordetella pertussis
acgauggccggcgc

SEQ ID NO: 2349937 - RNA, 15 nt, Bordetella pertussis
acgauggccggggcg

SEQ ID NO: 2349938 - RNA, 21 nt, Bordetella pertussis
acgauggccggggcgucgucg

SEQ ID NO: 2349939 - RNA, 21 nt, Bordetella pertussis
acgauggccugugcggcccau

SEQ ID NO: 2349940 - RNA, 17 nt, Bordetella pertussis
acgauggcgcccacggc

SEQ ID NO: 2349941 - RNA, 13 nt, Bordetella pertussis
acgauggcgccgg

SEQ ID NO: 2349942 - RNA, 15 nt, Bordetella pertussis
acgauggcgccggcu

SEQ ID NO: 2349943 - RNA, 15 nt, Bordetella pertussis
acgauggggccgucg

SEQ ID NO: 2349944 - RNA, 14 nt, Bordetella pertussis
acgaugucgccgcc

SEQ ID NO: 2349945 - RNA, 18 nt, Bordetella pertussis
acgauuccgccuacuggc

SEQ ID NO: 2349946 - RNA, 22 nt, Bordetella pertussis
acgauuccgccuacuggcgcgc

SEQ ID NO: 2349947 - RNA, 23 nt, Bordetella pertussis
acgauuccgccuacuggcgcgcg

SEQ ID NO: 2349948 - RNA, 14 nt, Bordetella pertussis
acgauucggucgcc

SEQ ID NO: 2349949 - RNA, 19 nt, Bordetella pertussis
acgauucuuuccuggccgg

SEQ ID NO: 2349950 - RNA, 22 nt, Bordetella pertussis
acgauucuuuccuggccggcgc

SEQ ID NO: 2349951 - RNA, 19 nt, Bordetella pertussis
acgauugucgucgcgcgag

SEQ ID NO: 2349952 - RNA, 15 nt, Bordetella pertussis
acgauuucuucgccu

SEQ ID NO: 2349953 - RNA, 22 nt, Bordetella pertussis
acgcaaccggucggccggcagc

SEQ ID NO: 2349954 - RNA, 19 nt, Bordetella pertussis
acgcaauugcgugguggcc

SEQ ID NO: 2349955 - RNA, 16 nt, Bordetella pertussis
acgcacagcaugcgcu

SEQ ID NO: 2349956 - RNA, 15 nt, Bordetella pertussis
acgcaccaggcgcac

SEQ ID NO: 2349957 - RNA, 13 nt, Bordetella pertussis
acgcaccgccgcc

SEQ ID NO: 2349958 - RNA, 17 nt, Bordetella pertussis
acgcaccgccgccggcc

SEQ ID NO: 2349959 - RNA, 15 nt, Bordetella pertussis
acgcaccgcgccagc

SEQ ID NO: 2349960 - RNA, 18 nt, Bordetella pertussis
acgcaccuuucugcugcu

SEQ ID NO: 2349961 - RNA, 20 nt, Bordetella pertussis
acgcaccuuucugcugcucg

SEQ ID NO: 2349962 - RNA, 18 nt, Bordetella pertussis
acgcacgauuucacccag

SEQ ID NO: 2349963 - RNA, 20 nt, Bordetella pertussis
acgcacugagcuucgccccc

SEQ ID NO: 2349964 - RNA, 19 nt, Bordetella pertussis
acgcagacuccaggagcuc

SEQ ID NO: 2349965 - RNA, 21 nt, Bordetella pertussis
acgcagcaacggugagccggc

SEQ ID NO: 2349966 - RNA, 20 nt, Bordetella pertussis
acgcagcacggcuugcgcgc

SEQ ID NO: 2349967 - RNA, 21 nt, Bordetella pertussis
acgcagcccuucggagccagu

SEQ ID NO: 2349968 - RNA, 17 nt, Bordetella pertussis
acgcagccgcccggcag

SEQ ID NO: 2349969 - RNA, 15 nt, Bordetella pertussis
acgcagcgcaccgac

SEQ ID NO: 2349970 - RNA, 23 nt, Bordetella pertussis
acgcagcgcaggauuuccucgcc

SEQ ID NO: 2349971 - RNA, 23 nt, Bordetella pertussis
acgcagcgcucauguucgggcgc

SEQ ID NO: 2349972 - RNA, 12 nt, Bordetella pertussis
acgcagcuucuu

SEQ ID NO: 2349973 - RNA, 16 nt, Bordetella pertussis
acgcaggcccagccag

SEQ ID NO: 2349974 - RNA, 19 nt, Bordetella pertussis
acgcaggcccagccagccc

SEQ ID NO: 2349975 - RNA, 15 nt, Bordetella pertussis
acgcaggcgccgcac

SEQ ID NO: 2349976 - RNA, 22 nt, Bordetella pertussis
acgcaggcgccgccccgucauc

SEQ ID NO: 2349977 - RNA, 18 nt, Bordetella pertussis
acgcaggcgggcgccgcg

SEQ ID NO: 2349978 - RNA, 22 nt, Bordetella pertussis
acgcauagguaucggcccgcgc

SEQ ID NO: 2349979 - RNA, 23 nt, Bordetella pertussis
acgcauagguaucggcccgcgcc

SEQ ID NO: 2349980 - RNA, 16 nt, Bordetella pertussis
acgcaucggcgccggc

SEQ ID NO: 2349981 - RNA, 21 nt, Bordetella pertussis
acgcaugcgacaugagcugcg

SEQ ID NO: 2349982 - RNA, 22 nt, Bordetella pertussis
acgcaugcgacaugagcugcgc

SEQ ID NO: 2349983 - RNA, 17 nt, Bordetella pertussis
acgcauuugcagcggcg

SEQ ID NO: 2349984 - RNA, 18 nt, Bordetella pertussis
acgcauuugcagcggcgg

SEQ ID NO: 2349985 - RNA, 18 nt, Bordetella pertussis
acgccaagaccgcggccg

SEQ ID NO: 2349986 - RNA, 21 nt, Bordetella pertussis
acgccaagaccgcggccgcgc

SEQ ID NO: 2349987 - RNA, 20 nt, Bordetella pertussis
acgccgcugauggcggucac

SEQ ID NO: 2349988 - RNA, 17 nt, Bordetella pertussis
acgccgcugucgaccuc

SEQ ID NO: 2349989 - RNA, 14 nt, Bordetella pertussis
acgccggccagcuu

SEQ ID NO: 2349990 - RNA, 18 nt, Bordetella pertussis
acgccggccagcuugagc

SEQ ID NO: 2349991 - RNA, 23 nt, Bordetella pertussis
acgccggccaggucggcggccag

SEQ ID NO: 2349992 - RNA, 17 nt, Bordetella pertussis
acgccggccauggcggc

SEQ ID NO: 2349993 - RNA, 19 nt, Bordetella pertussis
acgccggccauggcggccg

SEQ ID NO: 2349994 - RNA, 21 nt, Bordetella pertussis
acgccggccauggcggccggc

SEQ ID NO: 2349995 - RNA, 12 nt, Bordetella pertussis
acgccggccgcc

SEQ ID NO: 2349996 - RNA, 15 nt, Bordetella pertussis
acgccggccgccaug

SEQ ID NO: 2349997 - RNA, 21 nt, Bordetella pertussis
acgccggccgccauggccggc

SEQ ID NO: 2349998 - RNA, 17 nt, Bordetella pertussis
acgccggccgccuggcc

SEQ ID NO: 2349999 - RNA, 14 nt, Bordetella pertussis
acgccggccugcgc

SEQ ID NO: 2350000 - RNA, 17 nt, Bordetella pertussis
acgccggccugcgccag

SEQ ID NO: 2350001 - RNA, 16 nt, Bordetella pertussis
acgccggcgaaugccg

SEQ ID NO: 2350002 - RNA, 13 nt, Bordetella pertussis
acgccggcgccgg

SEQ ID NO: 2350003 - RNA, 12 nt, Bordetella pertussis
acgccggcgcgc

SEQ ID NO: 2350004 - RNA, 13 nt, Bordetella pertussis
acgccggcgcgcc

SEQ ID NO: 2350005 - RNA, 15 nt, Bordetella pertussis
acgccggcgcgccgg

SEQ ID NO: 2350006 - RNA, 18 nt, Bordetella pertussis
acgccggcgcgccggccg

SEQ ID NO: 2350007 - RNA, 18 nt, Bordetella pertussis
acgccggcgcgccgggcc

SEQ ID NO: 2350008 - RNA, 13 nt, Bordetella pertussis
acgccggcggcac

SEQ ID NO: 2350009 - RNA, 13 nt, Bordetella pertussis
acgccggcggcca

SEQ ID NO: 2350010 - RNA, 19 nt, Bordetella pertussis
acgccggcggcccauucgc

SEQ ID NO: 2350011 - RNA, 14 nt, Bordetella pertussis
acgccggcggcgcu

SEQ ID NO: 2350012 - RNA, 13 nt, Bordetella pertussis
acgccggcggcgu

SEQ ID NO: 2350013 - RNA, 14 nt, Bordetella pertussis
acgccggcggcgug

SEQ ID NO: 2350014 - RNA, 19 nt, Bordetella pertussis
acgccggcggcgugcgccu

SEQ ID NO: 2350015 - RNA, 22 nt, Bordetella pertussis
acgccggcggcgugcgccugcu

SEQ ID NO: 2350016 - RNA, 17 nt, Bordetella pertussis
acgccggcgggcaggcg

SEQ ID NO: 2350017 - RNA, 14 nt, Bordetella pertussis
acgccggcggucac

SEQ ID NO: 2350018 - RNA, 17 nt, Bordetella pertussis
acgccggcucaggccag

SEQ ID NO: 2350019 - RNA, 18 nt, Bordetella pertussis
acgccggcucaggccagc

SEQ ID NO: 2350020 - RNA, 21 nt, Bordetella pertussis
acgccggcucaggccagcgac

SEQ ID NO: 2350021 - RNA, 18 nt, Bordetella pertussis
acgccgggccgugcgccg

SEQ ID NO: 2350022 - RNA, 23 nt, Bordetella pertussis
acgccgggcgcgcugcccagcca

SEQ ID NO: 2350023 - RNA, 14 nt, Bordetella pertussis
acgccgggcgcggc

SEQ ID NO: 2350024 - RNA, 19 nt, Bordetella pertussis
acgccgggcgcggcccggc

SEQ ID NO: 2350025 - RNA, 21 nt, Bordetella pertussis
acgccgggcgcggcccggcgu

SEQ ID NO: 2350026 - RNA, 16 nt, Bordetella pertussis
acgccggguugcggcg

SEQ ID NO: 2350027 - RNA, 20 nt, Bordetella pertussis
acgccggguugcggcggaca

SEQ ID NO: 2350028 - RNA, 15 nt, Bordetella pertussis
acgccgguguucucg

SEQ ID NO: 2350029 - RNA, 21 nt, Bordetella pertussis
acgccgguguucucgcuggug

SEQ ID NO: 2350030 - RNA, 21 nt, Bordetella pertussis
acgccgucagcgacaucgugc

SEQ ID NO: 2350031 - RNA, 15 nt, Bordetella pertussis
acgccgucgaccccg

SEQ ID NO: 2350032 - RNA, 19 nt, Bordetella pertussis
acgccgucgaccccgucga

SEQ ID NO: 2350033 - RNA, 15 nt, Bordetella pertussis
acgccgucgcggacc

SEQ ID NO: 2350034 - RNA, 21 nt, Bordetella pertussis
acgccgugcugaucgacaugc

SEQ ID NO: 2350035 - RNA, 15 nt, Bordetella pertussis
acgccguggcgcaag

SEQ ID NO: 2350036 - RNA, 18 nt, Bordetella pertussis
acgccguggcgcaaggca

SEQ ID NO: 2350037 - RNA, 19 nt, Bordetella pertussis
acgccguugcggcccgccg

SEQ ID NO: 2350038 - RNA, 14 nt, Bordetella pertussis
acgccucgggcgca

SEQ ID NO: 2350039 - RNA, 14 nt, Bordetella pertussis
acgccugcaccgcc

SEQ ID NO: 2350040 - RNA, 15 nt, Bordetella pertussis
acgccugcaccgccg

SEQ ID NO: 2350041 - RNA, 17 nt, Bordetella pertussis
acgccugcaccgccgcg

SEQ ID NO: 2350042 - RNA, 20 nt, Bordetella pertussis
acgccugccgcgcccggcgg

SEQ ID NO: 2350043 - RNA, 22 nt, Bordetella pertussis
acgccugccgcgcccggcggcc

SEQ ID NO: 2350044 - RNA, 22 nt, Bordetella pertussis
acgccugcgccggguccggccg

SEQ ID NO: 2350045 - RNA, 15 nt, Bordetella pertussis
acgccuggaccggcu

SEQ ID NO: 2350046 - RNA, 21 nt, Bordetella pertussis
acgccuggaccggcuccggcc

SEQ ID NO: 2350047 - RNA, 14 nt, Bordetella pertussis
acgccuggccgcgc

SEQ ID NO: 2350048 - RNA, 15 nt, Bordetella pertussis
acgccuggccgcgcu

SEQ ID NO: 2350049 - RNA, 13 nt, Bordetella pertussis
acgccuuccggcc

SEQ ID NO: 2350050 - RNA, 15 nt, Bordetella pertussis
acgccuuccggcccc

SEQ ID NO: 2350051 - RNA, 17 nt, Bordetella pertussis
acgccuuccggccccau

SEQ ID NO: 2350052 - RNA, 15 nt, Bordetella pertussis
acgccuuccuugaac

SEQ ID NO: 2350053 - RNA, 21 nt, Bordetella pertussis
acgccuuccuugaacugcgcg

SEQ ID NO: 2350054 - RNA, 16 nt, Bordetella pertussis
acgccuucgagcacca

SEQ ID NO: 2350055 - RNA, 21 nt, Bordetella pertussis
acgccuucgagcaccaugccg

SEQ ID NO: 2350056 - RNA, 15 nt, Bordetella pertussis
acgccuucggcgacu

SEQ ID NO: 2350057 - RNA, 20 nt, Bordetella pertussis
acgccuucggcgacuucggc

SEQ ID NO: 2350058 - RNA, 23 nt, Bordetella pertussis
acgccuucggcgacuucggcggc

SEQ ID NO: 2350059 - RNA, 18 nt, Bordetella pertussis
acgccuucggcgcgcgcc

SEQ ID NO: 2350060 - RNA, 21 nt, Bordetella pertussis
acgccuucggcgcgcgccggc

SEQ ID NO: 2350061 - RNA, 21 nt, Bordetella pertussis
acgccuugcccgggcuggccg

SEQ ID NO: 2350062 - RNA, 18 nt, Bordetella pertussis
acgccuugcucgaccagg

SEQ ID NO: 2350063 - RNA, 22 nt, Bordetella pertussis
acgccuuguucgcgcgcgguau

SEQ ID NO: 2350064 - RNA, 15 nt, Bordetella pertussis
acgcgaaccaggcca

SEQ ID NO: 2350065 - RNA, 16 nt, Bordetella pertussis
acgcgaaccccgccuu

SEQ ID NO: 2350066 - RNA, 12 nt, Bordetella pertussis
acgcgaacccga

SEQ ID NO: 2350067 - RNA, 21 nt, Bordetella pertussis
acgcgaacccgaucgcgaugg

SEQ ID NO: 2350068 - RNA, 19 nt, Bordetella pertussis
acgcgaagaucccgccgga

SEQ ID NO: 2350069 - RNA, 18 nt, Bordetella pertussis
acgcgacacgcagcaacg

SEQ ID NO: 2350070 - RNA, 13 nt, Bordetella pertussis
acgcgacagcgcu

SEQ ID NO: 2350071 - RNA, 14 nt, Bordetella pertussis
acgcgacagcgcug

SEQ ID NO: 2350072 - RNA, 24 nt, Bordetella pertussis
acgcgaccagcuucugcgccugcu

SEQ ID NO: 2350073 - RNA, 18 nt, Bordetella pertussis
acgcgacgcgacgcgggc

SEQ ID NO: 2350074 - RNA, 19 nt, Bordetella pertussis
acgcgacgcgggcggccga

SEQ ID NO: 2350075 - RNA, 21 nt, Bordetella pertussis
acgcgaggcagaaguggucgc

SEQ ID NO: 2350076 - RNA, 18 nt, Bordetella pertussis
acgcgaugcccgcgcacc

SEQ ID NO: 2350077 - RNA, 20 nt, Bordetella pertussis
acgcgaugcccgcgcaccag

SEQ ID NO: 2350078 - RNA, 23 nt, Bordetella pertussis
acgcgaugcccgcgcaccaggcg

SEQ ID NO: 2350079 - RNA, 19 nt, Bordetella pertussis
acgcgaugccgaucgccga

SEQ ID NO: 2350080 - RNA, 19 nt, Bordetella pertussis
acgcgauguccagcuccag

SEQ ID NO: 2350081 - RNA, 21 nt, Bordetella pertussis
acgcgauuuccuugcgccgcc

SEQ ID NO: 2350082 - RNA, 14 nt, Bordetella pertussis
acgcgcaacauggu

SEQ ID NO: 2350083 - RNA, 18 nt, Bordetella pertussis
acgcgcaagccgcuggau

SEQ ID NO: 2350084 - RNA, 14 nt, Bordetella pertussis
acgcgcaagcggcc

SEQ ID NO: 2350085 - RNA, 16 nt, Bordetella pertussis
acgcgcaagcggcccc

SEQ ID NO: 2350086 - RNA, 14 nt, Bordetella pertussis
acgcgcaaggcggg

SEQ ID NO: 2350087 - RNA, 15 nt, Bordetella pertussis
acgcgcaaggcgggc

SEQ ID NO: 2350088 - RNA, 22 nt, Bordetella pertussis
acgcgcaaggcgggcuggucgc

SEQ ID NO: 2350089 - RNA, 23 nt, Bordetella pertussis
acgcgcaccagcuuggccugcgg

SEQ ID NO: 2350090 - RNA, 17 nt, Bordetella pertussis
acgcgcaccaggccugc

SEQ ID NO: 2350091 - RNA, 18 nt, Bordetella pertussis
acgcgcaccaggccugcc

SEQ ID NO: 2350092 - RNA, 14 nt, Bordetella pertussis
acgcgcacggccag

SEQ ID NO: 2350093 - RNA, 18 nt, Bordetella pertussis
acgcgcagcacgcugcgc

SEQ ID NO: 2350094 - RNA, 20 nt, Bordetella pertussis
acgcgcagcgaacggcccac

SEQ ID NO: 2350095 - RNA, 16 nt, Bordetella pertussis
acgcgcagcggcaggc

SEQ ID NO: 2350096 - RNA, 13 nt, Bordetella pertussis
acgcgcagcgucu

SEQ ID NO: 2350097 - RNA, 23 nt, Bordetella pertussis
acgcgcagcuugcccgcgcgcac

SEQ ID NO: 2350098 - RNA, 17 nt, Bordetella pertussis
acgcgcaguccgcacag

SEQ ID NO: 2350099 - RNA, 12 nt, Bordetella pertussis
acgcgccaggcg

SEQ ID NO: 2350100 - RNA, 15 nt, Bordetella pertussis
acgcucauccaggcg

SEQ ID NO: 2350101 - RNA, 16 nt, Bordetella pertussis
acgcucauccaggcgc

SEQ ID NO: 2350102 - RNA, 17 nt, Bordetella pertussis
acgcucauccaggcgcg

SEQ ID NO: 2350103 - RNA, 23 nt, Bordetella pertussis
acgcucgagguaggcgggacugg

SEQ ID NO: 2350104 - RNA, 16 nt, Bordetella pertussis
acgcucgaugcgccag

SEQ ID NO: 2350105 - RNA, 17 nt, Bordetella pertussis
acgcucgaugcgccagu

SEQ ID NO: 2350106 - RNA, 23 nt, Bordetella pertussis
acgcucgaugcgccaguccagcg

SEQ ID NO: 2350107 - RNA, 17 nt, Bordetella pertussis
acgcucuacacggccgc

SEQ ID NO: 2350108 - RNA, 20 nt, Bordetella pertussis
acgcucuacacggccgccac

SEQ ID NO: 2350109 - RNA, 23 nt, Bordetella pertussis
acgcucuacacggccgccaccug

SEQ ID NO: 2350110 - RNA, 16 nt, Bordetella pertussis
acgcucuugagcgcgg

SEQ ID NO: 2350111 - RNA, 18 nt, Bordetella pertussis
acgcugacccuggccgaa

SEQ ID NO: 2350112 - RNA, 21 nt, Bordetella pertussis
acgcugacccuggccgaacgc

SEQ ID NO: 2350113 - RNA, 23 nt, Bordetella pertussis
acgcugaccgaagcgggcgagga

SEQ ID NO: 2350114 - RNA, 18 nt, Bordetella pertussis
acgcugaccgagggcgcg

SEQ ID NO: 2350115 - RNA, 17 nt, Bordetella pertussis
acgcugacugcggugcc

SEQ ID NO: 2350116 - RNA, 17 nt, Bordetella pertussis
acgcugaucgccggcgc

SEQ ID NO: 2350117 - RNA, 18 nt, Bordetella pertussis
acgcugaucgccggcgcc

SEQ ID NO: 2350118 - RNA, 14 nt, Bordetella pertussis
acgcugaucggccg

SEQ ID NO: 2350119 - RNA, 16 nt, Bordetella pertussis
acgcugaucggccgac

SEQ ID NO: 2350120 - RNA, 13 nt, Bordetella pertussis
acgcugaucucgg

SEQ ID NO: 2350121 - RNA, 14 nt, Bordetella pertussis
acgcugaugcgcgu

SEQ ID NO: 2350122 - RNA, 14 nt, Bordetella pertussis
acgcugauggccgc

SEQ ID NO: 2350123 - RNA, 14 nt, Bordetella pertussis
acgcugcgcaggcg

SEQ ID NO: 2350124 - RNA, 17 nt, Bordetella pertussis
acgcugcgcaggcgcgc

SEQ ID NO: 2350125 - RNA, 18 nt, Bordetella pertussis
acgcugcgcgaugcgcgc

SEQ ID NO: 2350126 - RNA, 16 nt, Bordetella pertussis
acgcugcgcggcggcu

SEQ ID NO: 2350127 - RNA, 13 nt, Bordetella pertussis
acgcugcucuugg

SEQ ID NO: 2350128 - RNA, 22 nt, Bordetella pertussis
acgcugcugauccucgccagcg

SEQ ID NO: 2350129 - RNA, 22 nt, Bordetella pertussis
acgcuggaaacuaaaucgcggc

SEQ ID NO: 2350130 - RNA, 13 nt, Bordetella pertussis
acgcuggccgcgc

SEQ ID NO: 2350131 - RNA, 14 nt, Bordetella pertussis
acgcuggccgcgcu

SEQ ID NO: 2350132 - RNA, 20 nt, Bordetella pertussis
acgcuggccgcgcuggcggc

SEQ ID NO: 2350133 - RNA, 15 nt, Bordetella pertussis
acgcuggcgcccgcc

SEQ ID NO: 2350134 - RNA, 11 nt, Bordetella pertussis
acgcuggcgcg

SEQ ID NO: 2350135 - RNA, 18 nt, Bordetella pertussis
acgcuggcuaucgccucg

SEQ ID NO: 2350136 - RNA, 20 nt, Bordetella pertussis
acgcuggcuucgucgccggc

SEQ ID NO: 2350137 - RNA, 21 nt, Bordetella pertussis
acgcuggcuucgucgccggcg

SEQ ID NO: 2350138 - RNA, 18 nt, Bordetella pertussis
acgcugggccagaccgcg

SEQ ID NO: 2350139 - RNA, 18 nt, Bordetella pertussis
acgcugggcgaggcgcug

SEQ ID NO: 2350140 - RNA, 19 nt, Bordetella pertussis
acgcugggcgaggcgcugg

SEQ ID NO: 2350141 - RNA, 22 nt, Bordetella pertussis
acgcugggcgaggcgcuggccg

SEQ ID NO: 2350142 - RNA, 17 nt, Bordetella pertussis
acgcugggcuacgaccc

SEQ ID NO: 2350143 - RNA, 23 nt, Bordetella pertussis
acgcuggucgagagccugggcgc

SEQ ID NO: 2350144 - RNA, 15 nt, Bordetella pertussis
acgcugguggccacc

SEQ ID NO: 2350145 - RNA, 15 nt, Bordetella pertussis
acgcuguaacaacac

SEQ ID NO: 2350146 - RNA, 16 nt, Bordetella pertussis
acgcuguaacaacacg

SEQ ID NO: 2350147 - RNA, 17 nt, Bordetella pertussis
acgcuguaacaacacgu

SEQ ID NO: 2350148 - RNA, 21 nt, Bordetella pertussis
acgcuguacugguaccaggcg

SEQ ID NO: 2350149 - RNA, 17 nt, Bordetella pertussis
acgcuguagaggcgcgg

SEQ ID NO: 2350150 - RNA, 16 nt, Bordetella pertussis
acgcugucgcgcccgg

SEQ ID NO: 2350151 - RNA, 16 nt, Bordetella pertussis
acgcuguucuucggca

SEQ ID NO: 2350152 - RNA, 16 nt, Bordetella pertussis
acgcuguuggucaggu

SEQ ID NO: 2350153 - RNA, 18 nt, Bordetella pertussis
acgcuguuuucggccgac

SEQ ID NO: 2350154 - RNA, 16 nt, Bordetella pertussis
acgcuuccugggccug

SEQ ID NO: 2350155 - RNA, 18 nt, Bordetella pertussis
acgcuuccugggccugcg

SEQ ID NO: 2350156 - RNA, 19 nt, Bordetella pertussis
acgcuuccugggccugcgg

SEQ ID NO: 2350157 - RNA, 21 nt, Bordetella pertussis
acgcuuccugggccugcggcg

SEQ ID NO: 2350158 - RNA, 15 nt, Bordetella pertussis
acgcuugacggccag

SEQ ID NO: 2350159 - RNA, 17 nt, Bordetella pertussis
acgcuugacggccagga

SEQ ID NO: 2350160 - RNA, 15 nt, Bordetella pertussis
acgcuugccgcaacc

SEQ ID NO: 2350161 - RNA, 22 nt, Bordetella pertussis
acgcuuugcgucuccacgccgc

SEQ ID NO: 2350162 - RNA, 16 nt, Bordetella pertussis
acggaaacgcccagcc

SEQ ID NO: 2350163 - RNA, 19 nt, Bordetella pertussis
acggaaacgcccagcccug

SEQ ID NO: 2350164 - RNA, 16 nt, Bordetella pertussis
acggaaguccugcauc

SEQ ID NO: 2350165 - RNA, 21 nt, Bordetella pertussis
acggaauagccuugcucgcgg

SEQ ID NO: 2350166 - RNA, 12 nt, Bordetella pertussis
acggacagcccg

SEQ ID NO: 2350167 - RNA, 20 nt, Bordetella pertussis
acggacagcccgcgcuggcg

SEQ ID NO: 2350168 - RNA, 22 nt, Bordetella pertussis
acggaccguuaucugcguuuuc

SEQ ID NO: 2350169 - RNA, 12 nt, Bordetella pertussis
acggacgagcgc

SEQ ID NO: 2350170 - RNA, 21 nt, Bordetella pertussis
acggaggcuuuguggcgucgg

SEQ ID NO: 2350171 - RNA, 19 nt, Bordetella pertussis
acggauaauugggcggcau

SEQ ID NO: 2350172 - RNA, 15 nt, Bordetella pertussis
acggaucagccgcuu

SEQ ID NO: 2350173 - RNA, 20 nt, Bordetella pertussis
acggaugccgucuuggcggg

SEQ ID NO: 2350174 - RNA, 17 nt, Bordetella pertussis
acggauggucgugcggc

SEQ ID NO: 2350175 - RNA, 22 nt, Bordetella pertussis
acggauggucgugcggcacgca

SEQ ID NO: 2350176 - RNA, 17 nt, Bordetella pertussis
acggauugccgccgcgc

SEQ ID NO: 2350177 - RNA, 18 nt, Bordetella pertussis
acggauugccgccgcgca

SEQ ID NO: 2350178 - RNA, 21 nt, Bordetella pertussis
acggauugccgccgcgcagcc

SEQ ID NO: 2350179 - RNA, 20 nt, Bordetella pertussis
acggcaagguccaggcgcgc

SEQ ID NO: 2350180 - RNA, 19 nt, Bordetella pertussis
acggcaagucgacgcugau

SEQ ID NO: 2350181 - RNA, 16 nt, Bordetella pertussis
acggcaaucuugccgc

SEQ ID NO: 2350182 - RNA, 16 nt, Bordetella pertussis
acggcaccagccgggc

SEQ ID NO: 2350183 - RNA, 14 nt, Bordetella pertussis
acggcacgccucgc

SEQ ID NO: 2350184 - RNA, 20 nt, Bordetella pertussis
acggcacgccucgccggccc

SEQ ID NO: 2350185 - RNA, 21 nt, Bordetella pertussis
acggcagaugaucuacgcgcg

SEQ ID NO: 2350186 - RNA, 13 nt, Bordetella pertussis
acggcagauggac

SEQ ID NO: 2350187 - RNA, 16 nt, Bordetella pertussis
acggcagcagcgcgcc

SEQ ID NO: 2350188 - RNA, 12 nt, Bordetella pertussis
acggcagccccg

SEQ ID NO: 2350189 - RNA, 13 nt, Bordetella pertussis
acggcagcgcgcg

SEQ ID NO: 2350190 - RNA, 12 nt, Bordetella pertussis
acggcagcuugu

SEQ ID NO: 2350191 - RNA, 22 nt, Bordetella pertussis
acggcagcuugucgaucgccac

SEQ ID NO: 2350192 - RNA, 16 nt, Bordetella pertussis
acggcaggcgccugcc

SEQ ID NO: 2350193 - RNA, 19 nt, Bordetella pertussis
acggcaggcgccugcccug

SEQ ID NO: 2350194 - RNA, 23 nt, Bordetella pertussis
acggcaguaugacugaccacucg

SEQ ID NO: 2350195 - RNA, 14 nt, Bordetella pertussis
acggcaucccgaca

SEQ ID NO: 2350196 - RNA, 22 nt, Bordetella pertussis
acggcaucgauuucucgcugcu

SEQ ID NO: 2350197 - RNA, 19 nt, Bordetella pertussis
acggcaucggccagcauac

SEQ ID NO: 2350198 - RNA, 18 nt, Bordetella pertussis
acggcaucuguccgcgcc

SEQ ID NO: 2350199 - RNA, 19 nt, Bordetella pertussis
acggcauggcggccagcuu

SEQ ID NO: 2350200 - RNA, 19 nt, Bordetella pertussis
acggccaagcagcgccugc

SEQ ID NO: 2350201 - RNA, 21 nt, Bordetella pertussis
acggccaagcagcgccugccg

SEQ ID NO: 2350202 - RNA, 22 nt, Bordetella pertussis
acggccaagcagcgccugccgc

SEQ ID NO: 2350203 - RNA, 16 nt, Bordetella pertussis
acggccaccagggccc

SEQ ID NO: 2350204 - RNA, 22 nt, Bordetella pertussis
acggccacgaucaucaggauga

SEQ ID NO: 2350205 - RNA, 15 nt, Bordetella pertussis
acggccacggccggc

SEQ ID NO: 2350206 - RNA, 17 nt, Bordetella pertussis
acggccacggccggcag

SEQ ID NO: 2350207 - RNA, 21 nt, Bordetella pertussis
acggccagcacguagaaagug

SEQ ID NO: 2350208 - RNA, 13 nt, Bordetella pertussis
acggccagcacuu

SEQ ID NO: 2350209 - RNA, 15 nt, Bordetella pertussis
acggccagcagcacg

SEQ ID NO: 2350210 - RNA, 23 nt, Bordetella pertussis
acggccagcagcacgaucgcggc

SEQ ID NO: 2350211 - RNA, 21 nt, Bordetella pertussis
acggccagcaucguaucgggc

SEQ ID NO: 2350212 - RNA, 22 nt, Bordetella pertussis
acggcgucgggcagcaggcgca

SEQ ID NO: 2350213 - RNA, 17 nt, Bordetella pertussis
acggcgucgggcaguug

SEQ ID NO: 2350214 - RNA, 18 nt, Bordetella pertussis
acggcgugcugcgcgugg

SEQ ID NO: 2350215 - RNA, 19 nt, Bordetella pertussis
acggcgugcugcggcugau

SEQ ID NO: 2350216 - RNA, 14 nt, Bordetella pertussis
acggcguggcgcgc

SEQ ID NO: 2350217 - RNA, 15 nt, Bordetella pertussis
acggcguggcgcgca

SEQ ID NO: 2350218 - RNA, 20 nt, Bordetella pertussis
acggcuggaaagaccugcgc

SEQ ID NO: 2350219 - RNA, 19 nt, Bordetella pertussis
acggcuggagauacuggcc

SEQ ID NO: 2350220 - RNA, 14 nt, Bordetella pertussis
acggcuggccgucg

SEQ ID NO: 2350221 - RNA, 15 nt, Bordetella pertussis
acggcuggcugggcg

SEQ ID NO: 2350222 - RNA, 19 nt, Bordetella pertussis
acggcuggcugggcgcgcc

SEQ ID NO: 2350223 - RNA, 22 nt, Bordetella pertussis
acggcuggcugggcgcgccgcu

SEQ ID NO: 2350224 - RNA, 23 nt, Bordetella pertussis
acggcuggguucaggccuguucg

SEQ ID NO: 2350225 - RNA, 19 nt, Bordetella pertussis
acggcuucgaccacgcggc

SEQ ID NO: 2350226 - RNA, 16 nt, Bordetella pertussis
acggcuucgcccagcg

SEQ ID NO: 2350227 - RNA, 19 nt, Bordetella pertussis
acggcuugaccacggccag

SEQ ID NO: 2350228 - RNA, 19 nt, Bordetella pertussis
acggcuugcgcauacgcgg

SEQ ID NO: 2350229 - RNA, 20 nt, Bordetella pertussis
acggcuugcgcauacgcggg

SEQ ID NO: 2350230 - RNA, 14 nt, Bordetella pertussis
acggcuugcgcgcc

SEQ ID NO: 2350231 - RNA, 16 nt, Bordetella pertussis
acggcuugcgcgccug

SEQ ID NO: 2350232 - RNA, 20 nt, Bordetella pertussis
acggcuugcgcguaggcgcg

SEQ ID NO: 2350233 - RNA, 19 nt, Bordetella pertussis
acggcuuggggggcgcggu

SEQ ID NO: 2350234 - RNA, 22 nt, Bordetella pertussis
acgggaauccgcugcgccgagg

SEQ ID NO: 2350235 - RNA, 19 nt, Bordetella pertussis
acgggaauggcggacacgc

SEQ ID NO: 2350236 - RNA, 16 nt, Bordetella pertussis
acgggauugccgucac

SEQ ID NO: 2350237 - RNA, 19 nt, Bordetella pertussis
acgggcacgauggccgcgc

SEQ ID NO: 2350238 - RNA, 15 nt, Bordetella pertussis
acgggcagacgccau

SEQ ID NO: 2350239 - RNA, 19 nt, Bordetella pertussis
acgggccgaugaagacgcc

SEQ ID NO: 2350240 - RNA, 24 nt, Bordetella pertussis
acgggccgaugaagacgccgucga

SEQ ID NO: 2350241 - RNA, 23 nt, Bordetella pertussis
acgggccgcaagcaagccccagg

SEQ ID NO: 2350242 - RNA, 16 nt, Bordetella pertussis
acgggccucgauggug

SEQ ID NO: 2350243 - RNA, 21 nt, Bordetella pertussis
acgggcgagggcugcccucgc

SEQ ID NO: 2350244 - RNA, 21 nt, Bordetella pertussis
acgggcgcacaguugcaggcc

SEQ ID NO: 2350245 - RNA, 11 nt, Bordetella pertussis
acgggcgccag

SEQ ID NO: 2350246 - RNA, 19 nt, Bordetella pertussis
acgggcgccagcagcgggc

SEQ ID NO: 2350247 - RNA, 15 nt, Bordetella pertussis
acgggcgccuguccc

SEQ ID NO: 2350248 - RNA, 17 nt, Bordetella pertussis
acgggcgccuguccccg

SEQ ID NO: 2350249 - RNA, 15 nt, Bordetella pertussis
acgggcgcggcgucg

SEQ ID NO: 2350250 - RNA, 21 nt, Bordetella pertussis
acgggcgcugcacgcagcgca

SEQ ID NO: 2350251 - RNA, 16 nt, Bordetella pertussis
acgggcgcugcccagg

SEQ ID NO: 2350252 - RNA, 17 nt, Bordetella pertussis
acgggcggcggcgcgcg

SEQ ID NO: 2350253 - RNA, 19 nt, Bordetella pertussis
acgggcggcggcgcgcgcg

SEQ ID NO: 2350254 - RNA, 21 nt, Bordetella pertussis
acgggcggcggcgcgcgcgcc

SEQ ID NO: 2350255 - RNA, 22 nt, Bordetella pertussis
acgggcggcgucgccgcgcacg

SEQ ID NO: 2350256 - RNA, 16 nt, Bordetella pertussis
acgggcggcugcuggc

SEQ ID NO: 2350257 - RNA, 17 nt, Bordetella pertussis
acgggcgucaccggcga

SEQ ID NO: 2350258 - RNA, 20 nt, Bordetella pertussis
acgggcguggcgcagggugc

SEQ ID NO: 2350259 - RNA, 15 nt, Bordetella pertussis
acgggcucgcugacc

SEQ ID NO: 2350260 - RNA, 14 nt, Bordetella pertussis
acgggcugauggcc

SEQ ID NO: 2350261 - RNA, 13 nt, Bordetella pertussis
acgggcugggccg

SEQ ID NO: 2350262 - RNA, 18 nt, Bordetella pertussis
acgggcugggccgaggcg

SEQ ID NO: 2350263 - RNA, 20 nt, Bordetella pertussis
acgggcugggccgaggcgcc

SEQ ID NO: 2350264 - RNA, 23 nt, Bordetella pertussis
acgggcugggccgaggcgccgcc

SEQ ID NO: 2350265 - RNA, 13 nt, Bordetella pertussis
acggggaacaggc

SEQ ID NO: 2350266 - RNA, 18 nt, Bordetella pertussis
acggggaacaggcgcgcc

SEQ ID NO: 2350267 - RNA, 20 nt, Bordetella pertussis
acggggaacaggcgcgccag

SEQ ID NO: 2350268 - RNA, 12 nt, Bordetella pertussis
acggggacaggc

SEQ ID NO: 2350269 - RNA, 16 nt, Bordetella pertussis
acggggacuggcaccg

SEQ ID NO: 2350270 - RNA, 19 nt, Bordetella pertussis
acggggacuggcacgcgcu

SEQ ID NO: 2350271 - RNA, 22 nt, Bordetella pertussis
acggggccgccaacgccaagcu

SEQ ID NO: 2350272 - RNA, 23 nt, Bordetella pertussis
acggggccgccaacgccaagcug

SEQ ID NO: 2350273 - RNA, 12 nt, Bordetella pertussis
acggggccgccu

SEQ ID NO: 2350274 - RNA, 14 nt, Bordetella pertussis
acggggccgccucg

SEQ ID NO: 2350275 - RNA, 23 nt, Bordetella pertussis
acggggccgccucggcggccagc

SEQ ID NO: 2350276 - RNA, 16 nt, Bordetella pertussis
acggggcggcgccugc

SEQ ID NO: 2350277 - RNA, 23 nt, Bordetella pertussis
acggggcugucgcgcgcaucgcc

SEQ ID NO: 2350278 - RNA, 14 nt, Bordetella pertussis
acgggguggccggc

SEQ ID NO: 2350279 - RNA, 16 nt, Bordetella pertussis
acgggguggccggcgc

SEQ ID NO: 2350280 - RNA, 19 nt, Bordetella pertussis
acgggguggccggcgcgcg

SEQ ID NO: 2350281 - RNA, 21 nt, Bordetella pertussis
acgggguggccggcgcgcggc

SEQ ID NO: 2350282 - RNA, 14 nt, Bordetella pertussis
acggguaccaggcu

SEQ ID NO: 2350283 - RNA, 14 nt, Bordetella pertussis
acggguaucgucga

SEQ ID NO: 2350284 - RNA, 21 nt, Bordetella pertussis
acgggucacccgccgcaccag

SEQ ID NO: 2350285 - RNA, 15 nt, Bordetella pertussis
acgggucaggcugcg

SEQ ID NO: 2350286 - RNA, 18 nt, Bordetella pertussis
acgggucaggcugcggcg

SEQ ID NO: 2350287 - RNA, 16 nt, Bordetella pertussis
acgggugaggcgacgg

SEQ ID NO: 2350288 - RNA, 18 nt, Bordetella pertussis
acggguggguggacagga

SEQ ID NO: 2350289 - RNA, 19 nt, Bordetella pertussis
acgguaagcaccagguugc

SEQ ID NO: 2350290 - RNA, 12 nt, Bordetella pertussis
acgguaggcgcg

SEQ ID NO: 2350291 - RNA, 13 nt, Bordetella pertussis
acgguaggcgcgu

SEQ ID NO: 2350292 - RNA, 19 nt, Bordetella pertussis
acgguaucucagcgcgccg

SEQ ID NO: 2350293 - RNA, 17 nt, Bordetella pertussis
acgguaucugucccggc

SEQ ID NO: 2350294 - RNA, 14 nt, Bordetella pertussis
acgguauugcacgg

SEQ ID NO: 2350295 - RNA, 22 nt, Bordetella pertussis
acgguauugcacggugccgcgc

SEQ ID NO: 2350296 - RNA, 20 nt, Bordetella pertussis
acggucagcaaccccagcag

SEQ ID NO: 2350297 - RNA, 22 nt, Bordetella pertussis
acggucagcaaccccagcagcg

SEQ ID NO: 2350298 - RNA, 24 nt, Bordetella pertussis
acggucagcaaccccagcagcgcc

SEQ ID NO: 2350299 - RNA, 18 nt, Bordetella pertussis
acggucaggggcaggcgc

SEQ ID NO: 2350300 - RNA, 23 nt, Bordetella pertussis
acggucaggggcaggcgcacgcc

SEQ ID NO: 2350301 - RNA, 17 nt, Bordetella pertussis
acgguccaggcggccgc

SEQ ID NO: 2350302 - RNA, 18 nt, Bordetella pertussis
acgguccaggcggccgcg

SEQ ID NO: 2350303 - RNA, 22 nt, Bordetella pertussis
acggucgaagaucuucggcaug

SEQ ID NO: 2350304 - RNA, 16 nt, Bordetella pertussis
acggucgccggcaugu

SEQ ID NO: 2350305 - RNA, 16 nt, Bordetella pertussis
acggucgcgagcugcg

SEQ ID NO: 2350306 - RNA, 21 nt, Bordetella pertussis
acggucgcgagcugcgcgacc

SEQ ID NO: 2350307 - RNA, 16 nt, Bordetella pertussis
acggucggcacgucgg

SEQ ID NO: 2350308 - RNA, 14 nt, Bordetella pertussis
acggucggcgcgua

SEQ ID NO: 2350309 - RNA, 21 nt, Bordetella pertussis
acggugaccggguggcugcgc

SEQ ID NO: 2350310 - RNA, 14 nt, Bordetella pertussis
acggugccgccgau

SEQ ID NO: 2350311 - RNA, 13 nt, Bordetella pertussis
acggugccggcca

SEQ ID NO: 2350312 - RNA, 19 nt, Bordetella pertussis
acggugccggccagccugc

SEQ ID NO: 2350313 - RNA, 17 nt, Bordetella pertussis
acggugcgagaucucga

SEQ ID NO: 2350314 - RNA, 21 nt, Bordetella pertussis
acggugcgcgccacggcgucg

SEQ ID NO: 2350315 - RNA, 23 nt, Bordetella pertussis
acggugcgcgccacggcgucgcc

SEQ ID NO: 2350316 - RNA, 21 nt, Bordetella pertussis
acgguggauucggacgccucg

SEQ ID NO: 2350317 - RNA, 17 nt, Bordetella pertussis
acgguggcgaaggccgc

SEQ ID NO: 2350318 - RNA, 18 nt, Bordetella pertussis
acgguggcgaaggccgcc

SEQ ID NO: 2350319 - RNA, 20 nt, Bordetella pertussis
acgguggcgcccggcggcgc

SEQ ID NO: 2350320 - RNA, 15 nt, Bordetella pertussis
acgguggcgccgucg

SEQ ID NO: 2350321 - RNA, 22 nt, Bordetella pertussis
acgguggcguaguagcccaggc

SEQ ID NO: 2350322 - RNA, 21 nt, Bordetella pertussis
acgguggcuggggcuggcaug

SEQ ID NO: 2350323 - RNA, 14 nt, Bordetella pertussis
acggugggcagcag

SEQ ID NO: 2350324 - RNA, 17 nt, Bordetella pertussis
acucgcgcucggccagc

SEQ ID NO: 2350325 - RNA, 19 nt, Bordetella pertussis
acucgcgcucggccagcgc

SEQ ID NO: 2350326 - RNA, 21 nt, Bordetella pertussis
acucgcgcucggccagcgcgc

SEQ ID NO: 2350327 - RNA, 15 nt, Bordetella pertussis
acucgcggucugguc

SEQ ID NO: 2350328 - RNA, 21 nt, Bordetella pertussis
acucgcggucuggucuggcaa

SEQ ID NO: 2350329 - RNA, 21 nt, Bordetella pertussis
acucgcucaacagcuugccca

SEQ ID NO: 2350330 - RNA, 13 nt, Bordetella pertussis
acucgcugcgcgg

SEQ ID NO: 2350331 - RNA, 20 nt, Bordetella pertussis
acucggaagacauggcgcgc

SEQ ID NO: 2350332 - RNA, 12 nt, Bordetella pertussis
acucggcaaacg

SEQ ID NO: 2350333 - RNA, 14 nt, Bordetella pertussis
acucggccaccugg

SEQ ID NO: 2350334 - RNA, 11 nt, Bordetella pertussis
acucggccagc

SEQ ID NO: 2350335 - RNA, 16 nt, Bordetella pertussis
acucggccagcagcuu

SEQ ID NO: 2350336 - RNA, 13 nt, Bordetella pertussis
acucggccagcgc

SEQ ID NO: 2350337 - RNA, 15 nt, Bordetella pertussis
acucggccagcgcgc

SEQ ID NO: 2350338 - RNA, 17 nt, Bordetella pertussis
acucggccagcgcgcgg

SEQ ID NO: 2350339 - RNA, 22 nt, Bordetella pertussis
acucggccaggccauggcgcga

SEQ ID NO: 2350340 - RNA, 22 nt, Bordetella pertussis
acucggccauggugccccaugc

SEQ ID NO: 2350341 - RNA, 13 nt, Bordetella pertussis
acucgggcaugcg

SEQ ID NO: 2350342 - RNA, 17 nt, Bordetella pertussis
acucgggcaugcgccug

SEQ ID NO: 2350343 - RNA, 18 nt, Bordetella pertussis
acucgggcaugcgccugc

SEQ ID NO: 2350344 - RNA, 18 nt, Bordetella pertussis
acucgggguggaacuggg

SEQ ID NO: 2350345 - RNA, 16 nt, Bordetella pertussis
acucgucgaccaccag

SEQ ID NO: 2350346 - RNA, 16 nt, Bordetella pertussis
acucguuggccagcgc

SEQ ID NO: 2350347 - RNA, 23 nt, Bordetella pertussis
acucguuggccagcgcgccuucg

SEQ ID NO: 2350348 - RNA, 13 nt, Bordetella pertussis
acucuaguucuau

SEQ ID NO: 2350349 - RNA, 16 nt, Bordetella pertussis
acucuaguucuauaua

SEQ ID NO: 2350350 - RNA, 19 nt, Bordetella pertussis
acucugccgugggacaggc

SEQ ID NO: 2350351 - RNA, 20 nt, Bordetella pertussis
acucugccgugggacaggca

SEQ ID NO: 2350352 - RNA, 18 nt, Bordetella pertussis
acucuguguugauccgcc

SEQ ID NO: 2350353 - RNA, 19 nt, Bordetella pertussis
acucuguucuaccugaucg

SEQ ID NO: 2350354 - RNA, 13 nt, Bordetella pertussis
acucuuccccguc

SEQ ID NO: 2350355 - RNA, 18 nt, Bordetella pertussis
acugaacgcguccaggcc

SEQ ID NO: 2350356 - RNA, 20 nt, Bordetella pertussis
acugaacgcguccaggcccu

SEQ ID NO: 2350357 - RNA, 23 nt, Bordetella pertussis
acugaacgcguccaggcccuggc

SEQ ID NO: 2350358 - RNA, 17 nt, Bordetella pertussis
acugagaaaggccgcca

SEQ ID NO: 2350359 - RNA, 21 nt, Bordetella pertussis
acugaucgccgccuucaucgu

SEQ ID NO: 2350360 - RNA, 15 nt, Bordetella pertussis
acugcaccugcucca

SEQ ID NO: 2350361 - RNA, 17 nt, Bordetella pertussis
acugcaggccgccggcc

SEQ ID NO: 2350362 - RNA, 18 nt, Bordetella pertussis
acugcaggccgccggccu

SEQ ID NO: 2350363 - RNA, 13 nt, Bordetella pertussis
acugcaucguggg

SEQ ID NO: 2350364 - RNA, 16 nt, Bordetella pertussis
acugccaguaggcgcc

SEQ ID NO: 2350365 - RNA, 19 nt, Bordetella pertussis
acugccaguaggcgcccca

SEQ ID NO: 2350366 - RNA, 22 nt, Bordetella pertussis
acugccaguaggcgccccaggc

SEQ ID NO: 2350367 - RNA, 11 nt, Bordetella pertussis
acugcccgcgc

SEQ ID NO: 2350368 - RNA, 19 nt, Bordetella pertussis
acugcccgucuuggcgugg

SEQ ID NO: 2350369 - RNA, 16 nt, Bordetella pertussis
acugcgagugggugua

SEQ ID NO: 2350370 - RNA, 22 nt, Bordetella pertussis
acugcgcaugggcgcaggccgc

SEQ ID NO: 2350371 - RNA, 13 nt, Bordetella pertussis
acugcggcgccug

SEQ ID NO: 2350372 - RNA, 17 nt, Bordetella pertussis
acugcggcgccugggcc

SEQ ID NO: 2350373 - RNA, 18 nt, Bordetella pertussis
acugcgugaaacgcucga

SEQ ID NO: 2350374 - RNA, 23 nt, Bordetella pertussis
acugcucgaccgcuucggucagc

SEQ ID NO: 2350375 - RNA, 14 nt, Bordetella pertussis
acugcugcaaggac

SEQ ID NO: 2350376 - RNA, 14 nt, Bordetella pertussis
acugcuugcgcgug

SEQ ID NO: 2350377 - RNA, 19 nt, Bordetella pertussis
acugcuugcgcgugcgcag

SEQ ID NO: 2350378 - RNA, 14 nt, Bordetella pertussis
acuggaucgccgau

SEQ ID NO: 2350379 - RNA, 17 nt, Bordetella pertussis
acuggauguacgucagc

SEQ ID NO: 2350380 - RNA, 20 nt, Bordetella pertussis
acuggcaacgggucgcgcag

SEQ ID NO: 2350381 - RNA, 17 nt, Bordetella pertussis
acuggcacccgcaagau

SEQ ID NO: 2350382 - RNA, 13 nt, Bordetella pertussis
acuggcaccggcc

SEQ ID NO: 2350383 - RNA, 17 nt, Bordetella pertussis
acuggcaccggccaagc

SEQ ID NO: 2350384 - RNA, 18 nt, Bordetella pertussis
acuggcaccggccaagcu

SEQ ID NO: 2350385 - RNA, 16 nt, Bordetella pertussis
acuggcaccugcaaga

SEQ ID NO: 2350386 - RNA, 12 nt, Bordetella pertussis
acuggccagcaa

SEQ ID NO: 2350387 - RNA, 19 nt, Bordetella pertussis
acuggccagcaagcgcucg

SEQ ID NO: 2350388 - RNA, 15 nt, Bordetella pertussis
acuggccgaugguca

SEQ ID NO: 2350389 - RNA, 15 nt, Bordetella pertussis
acuggccgcgacaua

SEQ ID NO: 2350390 - RNA, 14 nt, Bordetella pertussis
acuggccggccugg

SEQ ID NO: 2350391 - RNA, 20 nt, Bordetella pertussis
acuggccuucuucacguagc

SEQ ID NO: 2350392 - RNA, 19 nt, Bordetella pertussis
acuggccuugugcgccguc

SEQ ID NO: 2350393 - RNA, 21 nt, Bordetella pertussis
acuggcgagcacccgcaggcg

SEQ ID NO: 2350394 - RNA, 12 nt, Bordetella pertussis
acuggcgcgcgc

SEQ ID NO: 2350395 - RNA, 13 nt, Bordetella pertussis
acuggcgcgcgca

SEQ ID NO: 2350396 - RNA, 19 nt, Bordetella pertussis
acuggcgcgcgcaagccgc

SEQ ID NO: 2350397 - RNA, 20 nt, Bordetella pertussis
acuggcgcgcgcaagccgcc

SEQ ID NO: 2350398 - RNA, 22 nt, Bordetella pertussis
acuggcgcggcgcuacgccgcc

SEQ ID NO: 2350399 - RNA, 23 nt, Bordetella pertussis
acuggcgcggcgcuacgccgccg

SEQ ID NO: 2350400 - RNA, 18 nt, Bordetella pertussis
acuggcgcggcggccagg

SEQ ID NO: 2350401 - RNA, 19 nt, Bordetella pertussis
acuggcgcggcggccaggc

SEQ ID NO: 2350402 - RNA, 12 nt, Bordetella pertussis
acuggcgcugcc

SEQ ID NO: 2350403 - RNA, 19 nt, Bordetella pertussis
acuggcuaaaaggaaauau

SEQ ID NO: 2350404 - RNA, 20 nt, Bordetella pertussis
acuggcucccaccggugcgg

SEQ ID NO: 2350405 - RNA, 15 nt, Bordetella pertussis
acuggcuggucaggc

SEQ ID NO: 2350406 - RNA, 16 nt, Bordetella pertussis
acuggcuggucaggcg

SEQ ID NO: 2350407 - RNA, 14 nt, Bordetella pertussis
acugggacaggccc

SEQ ID NO: 2350408 - RNA, 22 nt, Bordetella pertussis
acugggccaaccacgagcugca

SEQ ID NO: 2350409 - RNA, 14 nt, Bordetella pertussis
acugggcgccggcc

SEQ ID NO: 2350410 - RNA, 16 nt, Bordetella pertussis
acugggcgccggccag

SEQ ID NO: 2350411 - RNA, 17 nt, Bordetella pertussis
acugggcgccggccagg

SEQ ID NO: 2350412 - RNA, 18 nt, Bordetella pertussis
acugggcgccggccagga

SEQ ID NO: 2350413 - RNA, 17 nt, Bordetella pertussis
acugggcuugccggugc

SEQ ID NO: 2350414 - RNA, 20 nt, Bordetella pertussis
acuggggcgcucgaaaaagc

SEQ ID NO: 2350415 - RNA, 14 nt, Bordetella pertussis
acugggggacuggc

SEQ ID NO: 2350416 - RNA, 19 nt, Bordetella pertussis
acugggggacuggcacccg

SEQ ID NO: 2350417 - RNA, 17 nt, Bordetella pertussis
acugggugcgccugacc

SEQ ID NO: 2350418 - RNA, 12 nt, Bordetella pertussis
acugggugcugg

SEQ ID NO: 2350419 - RNA, 20 nt, Bordetella pertussis
acuggguggccagcgccgcc

SEQ ID NO: 2350420 - RNA, 23 nt, Bordetella pertussis
acuggguggccagcgccgccagc

SEQ ID NO: 2350421 - RNA, 16 nt, Bordetella pertussis
acugucgcgccacggc

SEQ ID NO: 2350422 - RNA, 17 nt, Bordetella pertussis
acugucgcgccacggcu

SEQ ID NO: 2350423 - RNA, 15 nt, Bordetella pertussis
acuucaccgaggcgc

SEQ ID NO: 2350424 - RNA, 21 nt, Bordetella pertussis
acuuccggggagccugccccg

SEQ ID NO: 2350425 - RNA, 23 nt, Bordetella pertussis
acuuccucgaccagcccggccgc

SEQ ID NO: 2350426 - RNA, 18 nt, Bordetella pertussis
acuuccucgacccgcgcc

SEQ ID NO: 2350427 - RNA, 19 nt, Bordetella pertussis
acuuccugguacaccgcga

SEQ ID NO: 2350428 - RNA, 13 nt, Bordetella pertussis
acuuccugguggg

SEQ ID NO: 2350429 - RNA, 12 nt, Bordetella pertussis
acuuccuugcca

SEQ ID NO: 2350430 - RNA, 15 nt, Bordetella pertussis
acuucgacggcagca

SEQ ID NO: 2350431 - RNA, 14 nt, Bordetella pertussis
acuucggccgccag

SEQ ID NO: 2350432 - RNA, 21 nt, Bordetella pertussis
acuucggcggccugcuuggca

SEQ ID NO: 2350433 - RNA, 14 nt, Bordetella pertussis
acuucggucagcuu

SEQ ID NO: 2350434 - RNA, 16 nt, Bordetella pertussis
acuucggucagcuugc

SEQ ID NO: 2350435 - RNA, 15 nt, Bordetella pertussis
acuucguccggcgcg

SEQ ID NO: 2350436 - RNA, 16 nt, Bordetella pertussis
acuucgucgggcucgg

SEQ ID NO: 2350437 - RNA, 19 nt, Bordetella pertussis
agacuggcaccggccaagc

SEQ ID NO: 2350438 - RNA, 16 nt, Bordetella pertussis
agacuuccgugccaua

SEQ ID NO: 2350439 - RNA, 19 nt, Bordetella pertussis
agagaaucaugggcgacgc

SEQ ID NO: 2350440 - RNA, 19 nt, Bordetella pertussis
agagcaccgagaccgggcg

SEQ ID NO: 2350441 - RNA, 14 nt, Bordetella pertussis
agagcaggccgccc

SEQ ID NO: 2350442 - RNA, 12 nt, Bordetella pertussis
agagcaugcggc

SEQ ID NO: 2350443 - RNA, 15 nt, Bordetella pertussis
agagcaugcggcguc

SEQ ID NO: 2350444 - RNA, 20 nt, Bordetella pertussis
agagcaugcggcguccugcc

SEQ ID NO: 2350445 - RNA, 22 nt, Bordetella pertussis
agagccggccacgcgcugcagc

SEQ ID NO: 2350446 - RNA, 23 nt, Bordetella pertussis
agagccggccacgcgcugcagca

SEQ ID NO: 2350447 - RNA, 22 nt, Bordetella pertussis
agagccuggaagugaugccgcc

SEQ ID NO: 2350448 - RNA, 23 nt, Bordetella pertussis
agagccuggaagugaugccgccg

SEQ ID NO: 2350449 - RNA, 16 nt, Bordetella pertussis
agagccugggcgcgcg

SEQ ID NO: 2350450 - RNA, 15 nt, Bordetella pertussis
agagccuguccccgu

SEQ ID NO: 2350451 - RNA, 20 nt, Bordetella pertussis
agagccugucccgacgggga

SEQ ID NO: 2350452 - RNA, 23 nt, Bordetella pertussis
agagccugucccgacggggacag

SEQ ID NO: 2350453 - RNA, 16 nt, Bordetella pertussis
agagcgccacgccagc

SEQ ID NO: 2350454 - RNA, 20 nt, Bordetella pertussis
agagcgccacgccagcggcg

SEQ ID NO: 2350455 - RNA, 18 nt, Bordetella pertussis
agagcggcguggcgccga

SEQ ID NO: 2350456 - RNA, 12 nt, Bordetella pertussis
agagcuccagcc

SEQ ID NO: 2350457 - RNA, 14 nt, Bordetella pertussis
agagcugcggcgcg

SEQ ID NO: 2350458 - RNA, 17 nt, Bordetella pertussis
agagcugcggcgcggcg

SEQ ID NO: 2350459 - RNA, 18 nt, Bordetella pertussis
agagcugcggcgcggcgc

SEQ ID NO: 2350460 - RNA, 18 nt, Bordetella pertussis
agagcuggcgcugcucga

SEQ ID NO: 2350461 - RNA, 15 nt, Bordetella pertussis
agaggaacgccgcgc

SEQ ID NO: 2350462 - RNA, 14 nt, Bordetella pertussis
agaggccaggcccu

SEQ ID NO: 2350463 - RNA, 20 nt, Bordetella pertussis
agaggcgcggcucgccggcc

SEQ ID NO: 2350464 - RNA, 14 nt, Bordetella pertussis
agagggagcgacac

SEQ ID NO: 2350465 - RNA, 21 nt, Bordetella pertussis
agagggcggggcgugagcagg

SEQ ID NO: 2350466 - RNA, 20 nt, Bordetella pertussis
agagggcuuuuugccuuggg

SEQ ID NO: 2350467 - RNA, 16 nt, Bordetella pertussis
agagggucuggcggcc

SEQ ID NO: 2350468 - RNA, 14 nt, Bordetella pertussis
agagguugugcccc

SEQ ID NO: 2350469 - RNA, 21 nt, Bordetella pertussis
agaguucgcugcgaaacagca

SEQ ID NO: 2350470 - RNA, 22 nt, Bordetella pertussis
agaguucgcugcgaaacagcag

SEQ ID NO: 2350471 - RNA, 13 nt, Bordetella pertussis
agauaccggcaug

SEQ ID NO: 2350472 - RNA, 14 nt, Bordetella pertussis
agauaccggcaugg

SEQ ID NO: 2350473 - RNA, 21 nt, Bordetella pertussis
agauaccggcauggcagcaga

SEQ ID NO: 2350474 - RNA, 17 nt, Bordetella pertussis
agauaccgucuuggccg

SEQ ID NO: 2350475 - RNA, 18 nt, Bordetella pertussis
agauagaacgagguccgc

SEQ ID NO: 2350476 - RNA, 15 nt, Bordetella pertussis
agauagcccagcacc

SEQ ID NO: 2350477 - RNA, 16 nt, Bordetella pertussis
agauaggcggccaggc

SEQ ID NO: 2350478 - RNA, 16 nt, Bordetella pertussis
agauagucgcggaugc

SEQ ID NO: 2350479 - RNA, 21 nt, Bordetella pertussis
agauagucgcggaugcgcgcc

SEQ ID NO: 2350480 - RNA, 18 nt, Bordetella pertussis
agaucaacaaggcgacgg

SEQ ID NO: 2350481 - RNA, 21 nt, Bordetella pertussis
agaucagcgcgucggcgccga

SEQ ID NO: 2350482 - RNA, 21 nt, Bordetella pertussis
agaucagggugggcacgcgcg

SEQ ID NO: 2350483 - RNA, 20 nt, Bordetella pertussis
agaucaggucgaugccggcg

SEQ ID NO: 2350484 - RNA, 16 nt, Bordetella pertussis
agauccacgcccgcgc

SEQ ID NO: 2350485 - RNA, 13 nt, Bordetella pertussis
agauccagcgaga

SEQ ID NO: 2350486 - RNA, 15 nt, Bordetella pertussis
agaucccgccggacu

SEQ ID NO: 2350487 - RNA, 20 nt, Bordetella pertussis
agauccgcaaguucggcagc

SEQ ID NO: 2350488 - RNA, 13 nt, Bordetella pertussis
agauccgccggcg

SEQ ID NO: 2350489 - RNA, 19 nt, Bordetella pertussis
agauccgguaugccugcca

SEQ ID NO: 2350490 - RNA, 20 nt, Bordetella pertussis
agauccgguaugccugccag

SEQ ID NO: 2350491 - RNA, 22 nt, Bordetella pertussis
agaucgauaccgucgcgcucga

SEQ ID NO: 2350492 - RNA, 21 nt, Bordetella pertussis
agaucgcauuucucggccugg

SEQ ID NO: 2350493 - RNA, 23 nt, Bordetella pertussis
agaucgcauuucucggccugggc

SEQ ID NO: 2350494 - RNA, 21 nt, Bordetella pertussis
agaucgccaacgucggcagcc

SEQ ID NO: 2350495 - RNA, 23 nt, Bordetella pertussis
agaucgccgccgaagccgccgcc

SEQ ID NO: 2350496 - RNA, 14 nt, Bordetella pertussis
agaucgccgccgcc

SEQ ID NO: 2350497 - RNA, 15 nt, Bordetella pertussis
agaucgccuggggca

SEQ ID NO: 2350498 - RNA, 14 nt, Bordetella pertussis
agaucggcccggcg

SEQ ID NO: 2350499 - RNA, 18 nt, Bordetella pertussis
agaucggcccggcgccgg

SEQ ID NO: 2350500 - RNA, 19 nt, Bordetella pertussis
agaucggcccggcgccggu

SEQ ID NO: 2350501 - RNA, 19 nt, Bordetella pertussis
agaucggcgcuggccuggc

SEQ ID NO: 2350502 - RNA, 16 nt, Bordetella pertussis
agaucguccagcgacu

SEQ ID NO: 2350503 - RNA, 21 nt, Bordetella pertussis
agaucguugaucucgcccagc

SEQ ID NO: 2350504 - RNA, 14 nt, Bordetella pertussis
agaucuugccggcc

SEQ ID NO: 2350505 - RNA, 15 nt, Bordetella pertussis
agaucuugccggccg

SEQ ID NO: 2350506 - RNA, 20 nt, Bordetella pertussis
agaugaucuacgcgcgcgcc

SEQ ID NO: 2350507 - RNA, 23 nt, Bordetella pertussis
agaugccagcggcgcagccggcc

SEQ ID NO: 2350508 - RNA, 17 nt, Bordetella pertussis
agaugccguccuggccg

SEQ ID NO: 2350509 - RNA, 15 nt, Bordetella pertussis
agaugcgcagcaggc

SEQ ID NO: 2350510 - RNA, 14 nt, Bordetella pertussis
agaugcgcgccagg

SEQ ID NO: 2350511 - RNA, 15 nt, Bordetella pertussis
agaugcgcgccaggc

SEQ ID NO: 2350512 - RNA, 14 nt, Bordetella pertussis
agaugcgcgccgua

SEQ ID NO: 2350513 - RNA, 18 nt, Bordetella pertussis
agaugcgcggggccaggc

SEQ ID NO: 2350514 - RNA, 19 nt, Bordetella pertussis
agaugcgcggggccaggcg

SEQ ID NO: 2350515 - RNA, 16 nt, Bordetella pertussis
agaugcgggucggcgc

SEQ ID NO: 2350516 - RNA, 20 nt, Bordetella pertussis
agauggaaucauuggccagc

SEQ ID NO: 2350517 - RNA, 15 nt, Bordetella pertussis
agauggccagcagcg

SEQ ID NO: 2350518 - RNA, 18 nt, Bordetella pertussis
agauggccagcagcgccg

SEQ ID NO: 2350519 - RNA, 12 nt, Bordetella pertussis
agauggccaggu

SEQ ID NO: 2350520 - RNA, 22 nt, Bordetella pertussis
agauggccagguggcggcggca

SEQ ID NO: 2350521 - RNA, 14 nt, Bordetella pertussis
agauggcccagggc

SEQ ID NO: 2350522 - RNA, 13 nt, Bordetella pertussis
agauggccgccuu

SEQ ID NO: 2350523 - RNA, 14 nt, Bordetella pertussis
agauggccuuuucc

SEQ ID NO: 2350524 - RNA, 20 nt, Bordetella pertussis
agauggccuuuuccaggcgu

SEQ ID NO: 2350525 - RNA, 20 nt, Bordetella pertussis
agauggcgcaggcgcgcgcc

SEQ ID NO: 2350526 - RNA, 17 nt, Bordetella pertussis
agauggcguaggcggcc

SEQ ID NO: 2350527 - RNA, 19 nt, Bordetella pertussis
agauggcuuucuaucauca

SEQ ID NO: 2350528 - RNA, 14 nt, Bordetella pertussis
agaugggcaggccc

SEQ ID NO: 2350529 - RNA, 15 nt, Bordetella pertussis
agaugggcaggccca

SEQ ID NO: 2350530 - RNA, 13 nt, Bordetella pertussis
agaugggcggccu

SEQ ID NO: 2350531 - RNA, 13 nt, Bordetella pertussis
agaugggcggcga

SEQ ID NO: 2350532 - RNA, 23 nt, Bordetella pertussis
agauggggguggaaaugccggcg

SEQ ID NO: 2350533 - RNA, 22 nt, Bordetella pertussis
agauguaccagcccagcccgcc

SEQ ID NO: 2350534 - RNA, 18 nt, Bordetella pertussis
agauguccauggccugca

SEQ ID NO: 2350535 - RNA, 14 nt, Bordetella pertussis
agaugugcggcgug

SEQ ID NO: 2350536 - RNA, 13 nt, Bordetella pertussis
agauuaagacaga

SEQ ID NO: 2350537 - RNA, 15 nt, Bordetella pertussis
agauugaacugcugg

SEQ ID NO: 2350538 - RNA, 22 nt, Bordetella pertussis
agauugccgcgcggcgcguuca

SEQ ID NO: 2350539 - RNA, 15 nt, Bordetella pertussis
agauuguccagcggc

SEQ ID NO: 2350540 - RNA, 14 nt, Bordetella pertussis
agcaaacaggcugc

SEQ ID NO: 2350541 - RNA, 15 nt, Bordetella pertussis
agcaaccccagcagc

SEQ ID NO: 2350542 - RNA, 18 nt, Bordetella pertussis
agcaaccccagcagcgcc

SEQ ID NO: 2350543 - RNA, 20 nt, Bordetella pertussis
agcaaccggaacaccagcaa

SEQ ID NO: 2350544 - RNA, 22 nt, Bordetella pertussis
agcaaccggaacaccagcaagc

SEQ ID NO: 2350545 - RNA, 16 nt, Bordetella pertussis
agcaacgccacgcgcg

SEQ ID NO: 2350546 - RNA, 20 nt, Bordetella pertussis
agcaacgccacgcgcggauc

SEQ ID NO: 2350547 - RNA, 23 nt, Bordetella pertussis
agcaacgccacgcgcggaucggc

SEQ ID NO: 2350548 - RNA, 23 nt, Bordetella pertussis
agcaacucuuccccgucggcggc

SEQ ID NO: 2350549 - RNA, 16 nt, Bordetella pertussis
agcaagaaucggggcg

SEQ ID NO: 2350550 - RNA, 22 nt, Bordetella pertussis
agcacggcgcacaccaucagcu

SEQ ID NO: 2350551 - RNA, 23 nt, Bordetella pertussis
agcacggcgcacaccaucagcug

SEQ ID NO: 2350552 - RNA, 13 nt, Bordetella pertussis
agcacggcgcggc

SEQ ID NO: 2350553 - RNA, 15 nt, Bordetella pertussis
agcacggucggcgcg

SEQ ID NO: 2350554 - RNA, 13 nt, Bordetella pertussis
agcacgguggcgc

SEQ ID NO: 2350555 - RNA, 14 nt, Bordetella pertussis
agcacgguggcgcc

SEQ ID NO: 2350556 - RNA, 20 nt, Bordetella pertussis
agcacgguggcgcccggcgg

SEQ ID NO: 2350557 - RNA, 22 nt, Bordetella pertussis
agcacgguggcgcccggcggcg

SEQ ID NO: 2350558 - RNA, 19 nt, Bordetella pertussis
agcacgguugccacgguga

SEQ ID NO: 2350559 - RNA, 22 nt, Bordetella pertussis
agcacgguugccacggugaaga

SEQ ID NO: 2350560 - RNA, 18 nt, Bordetella pertussis
agcacguccaaugccagg

SEQ ID NO: 2350561 - RNA, 13 nt, Bordetella pertussis
agcacguccagcg

SEQ ID NO: 2350562 - RNA, 16 nt, Bordetella pertussis
agcacguccagcggcg

SEQ ID NO: 2350563 - RNA, 16 nt, Bordetella pertussis
agcacgucguagcgcu

SEQ ID NO: 2350564 - RNA, 23 nt, Bordetella pertussis
agcacgucguagcgcugcagcca

SEQ ID NO: 2350565 - RNA, 23 nt, Bordetella pertussis
agcacuaccugcgcuaugggggc

SEQ ID NO: 2350566 - RNA, 17 nt, Bordetella pertussis
agcacugcaggccaucg

SEQ ID NO: 2350567 - RNA, 22 nt, Bordetella pertussis
agcacugcaggccaucgcgguc

SEQ ID NO: 2350568 - RNA, 19 nt, Bordetella pertussis
agcagaaugccgcccacga

SEQ ID NO: 2350569 - RNA, 21 nt, Bordetella pertussis
agcagaauguauuggcccagu

SEQ ID NO: 2350570 - RNA, 15 nt, Bordetella pertussis
agcagacccuggcgc

SEQ ID NO: 2350571 - RNA, 13 nt, Bordetella pertussis
agcagauaccggc

SEQ ID NO: 2350572 - RNA, 19 nt, Bordetella pertussis
agcagauaccggcauggca

SEQ ID NO: 2350573 - RNA, 16 nt, Bordetella pertussis
agcagaucggcggccu

SEQ ID NO: 2350574 - RNA, 18 nt, Bordetella pertussis
agcagaugcaccggccag

SEQ ID NO: 2350575 - RNA, 15 nt, Bordetella pertussis
agcagauggccaucg

SEQ ID NO: 2350576 - RNA, 21 nt, Bordetella pertussis
agcagauucaugggcggcgag

SEQ ID NO: 2350577 - RNA, 20 nt, Bordetella pertussis
agcagauugccgcgcggcgc

SEQ ID NO: 2350578 - RNA, 23 nt, Bordetella pertussis
agcagcaauacggguaugcgcag

SEQ ID NO: 2350579 - RNA, 16 nt, Bordetella pertussis
agcagcaccugguccu

SEQ ID NO: 2350580 - RNA, 21 nt, Bordetella pertussis
agcagcacgaucgcggcgcug

SEQ ID NO: 2350581 - RNA, 13 nt, Bordetella pertussis
agcagcacgcaga

SEQ ID NO: 2350582 - RNA, 16 nt, Bordetella pertussis
agcagcacgcccagua

SEQ ID NO: 2350583 - RNA, 16 nt, Bordetella pertussis
agcagcacgcccaugg

SEQ ID NO: 2350584 - RNA, 14 nt, Bordetella pertussis
agcagcacggccac

SEQ ID NO: 2350585 - RNA, 23 nt, Bordetella pertussis
agcagcacggccacgaucaucag

SEQ ID NO: 2350586 - RNA, 14 nt, Bordetella pertussis
agcagcagcgagcc

SEQ ID NO: 2350587 - RNA, 16 nt, Bordetella pertussis
agcagcagcgcaucga

SEQ ID NO: 2350588 - RNA, 12 nt, Bordetella pertussis
agcagcagcggg

SEQ ID NO: 2350589 - RNA, 23 nt, Bordetella pertussis
agcagcaggaacaggcugcgcag

SEQ ID NO: 2350590 - RNA, 21 nt, Bordetella pertussis
agcagcaggcccuccggcgcc

SEQ ID NO: 2350591 - RNA, 13 nt, Bordetella pertussis
agcagcaggccgu

SEQ ID NO: 2350592 - RNA, 14 nt, Bordetella pertussis
agcagcaggccgua

SEQ ID NO: 2350593 - RNA, 14 nt, Bordetella pertussis
agcagcaugcggcc

SEQ ID NO: 2350594 - RNA, 15 nt, Bordetella pertussis
agcagcaugcggccc

SEQ ID NO: 2350595 - RNA, 17 nt, Bordetella pertussis
agcagcaugcggcccgc

SEQ ID NO: 2350596 - RNA, 17 nt, Bordetella pertussis
agcagcauuucgaugcg

SEQ ID NO: 2350597 - RNA, 21 nt, Bordetella pertussis
agcagccccagcguccaggcg

SEQ ID NO: 2350598 - RNA, 14 nt, Bordetella pertussis
agcagccgcgcggc

SEQ ID NO: 2350599 - RNA, 23 nt, Bordetella pertussis
agcagccggccaaggcaagcagc

SEQ ID NO: 2350600 - RNA, 15 nt, Bordetella pertussis
agcagcgagagcgcc

SEQ ID NO: 2350601 - RNA, 23 nt, Bordetella pertussis
agcagcgagcccgccaucgccag

SEQ ID NO: 2350602 - RNA, 12 nt, Bordetella pertussis
agcagcgcaucg

SEQ ID NO: 2350603 - RNA, 16 nt, Bordetella pertussis
agcagcgcaucgagcu

SEQ ID NO: 2350604 - RNA, 14 nt, Bordetella pertussis
agcagcgcaucgau

SEQ ID NO: 2350605 - RNA, 18 nt, Bordetella pertussis
agcagcgcaucgaucucg

SEQ ID NO: 2350606 - RNA, 18 nt, Bordetella pertussis
agcagcgccaccguggcc

SEQ ID NO: 2350607 - RNA, 22 nt, Bordetella pertussis
agcagcgccaccguggccacgg

SEQ ID NO: 2350608 - RNA, 20 nt, Bordetella pertussis
agcagcgccacgacgccguc

SEQ ID NO: 2350609 - RNA, 11 nt, Bordetella pertussis
agcagcgccag

SEQ ID NO: 2350610 - RNA, 14 nt, Bordetella pertussis
agcagcgccaggau

SEQ ID NO: 2350611 - RNA, 16 nt, Bordetella pertussis
agcagcgccaggauga

SEQ ID NO: 2350612 - RNA, 14 nt, Bordetella pertussis
agcagcgccagggc

SEQ ID NO: 2350613 - RNA, 15 nt, Bordetella pertussis
agcagcgccgccagc

SEQ ID NO: 2350614 - RNA, 18 nt, Bordetella pertussis
agcagcgccggcugggcg

SEQ ID NO: 2350615 - RNA, 13 nt, Bordetella pertussis
agcagcgccugcc

SEQ ID NO: 2350616 - RNA, 14 nt, Bordetella pertussis
agcagcgccugccg

SEQ ID NO: 2350617 - RNA, 14 nt, Bordetella pertussis
agcagcgcgguggc

SEQ ID NO: 2350618 - RNA, 17 nt, Bordetella pertussis
agcagcggcagcagcag

SEQ ID NO: 2350619 - RNA, 15 nt, Bordetella pertussis
agcagcgggcugggg

SEQ ID NO: 2350620 - RNA, 18 nt, Bordetella pertussis
agcagcggguugcgcgcc

SEQ ID NO: 2350621 - RNA, 23 nt, Bordetella pertussis
agcagcgugaugccgucgagcgc

SEQ ID NO: 2350622 - RNA, 11 nt, Bordetella pertussis
agcagcguggc

SEQ ID NO: 2350623 - RNA, 18 nt, Bordetella pertussis
agcagcguggccgccacc

SEQ ID NO: 2350624 - RNA, 23 nt, Bordetella pertussis
agcagcguggccgccaccagcgc

SEQ ID NO: 2350625 - RNA, 12 nt, Bordetella pertussis
agcagcucgcag

SEQ ID NO: 2350626 - RNA, 20 nt, Bordetella pertussis
agcagcucggccaccgccgu

SEQ ID NO: 2350627 - RNA, 23 nt, Bordetella pertussis
agcagcucggcgaucugcgcggc

SEQ ID NO: 2350628 - RNA, 14 nt, Bordetella pertussis
agcagcuggcgcag

SEQ ID NO: 2350629 - RNA, 15 nt, Bordetella pertussis
agcagcuggcgcagc

SEQ ID NO: 2350630 - RNA, 22 nt, Bordetella pertussis
agcagcuuggccacuucgccgg

SEQ ID NO: 2350631 - RNA, 23 nt, Bordetella pertussis
agcagcuuggccacuucgccggu

SEQ ID NO: 2350632 - RNA, 15 nt, Bordetella pertussis
agcaggaacaggcug

SEQ ID NO: 2350633 - RNA, 14 nt, Bordetella pertussis
agcaggcccaccag

SEQ ID NO: 2350634 - RNA, 15 nt, Bordetella pertussis
agcaggcccaccagg

SEQ ID NO: 2350635 - RNA, 19 nt, Bordetella pertussis
agcaggcccaccagggcca

SEQ ID NO: 2350636 - RNA, 22 nt, Bordetella pertussis
agcaggcccuccggcgccagca

SEQ ID NO: 2350637 - RNA, 16 nt, Bordetella pertussis
agcaggcccugggcga

SEQ ID NO: 2350638 - RNA, 16 nt, Bordetella pertussis
agcaggccgcccagcg

SEQ ID NO: 2350639 - RNA, 21 nt, Bordetella pertussis
agcaggccgccggggaggccu

SEQ ID NO: 2350640 - RNA, 13 nt, Bordetella pertussis
agcaggccgcgcg

SEQ ID NO: 2350641 - RNA, 18 nt, Bordetella pertussis
agcaggccgcgcgugcgg

SEQ ID NO: 2350642 - RNA, 15 nt, Bordetella pertussis
agcaggccggcggcg

SEQ ID NO: 2350643 - RNA, 16 nt, Bordetella pertussis
agcaggccggcggcga

SEQ ID NO: 2350644 - RNA, 18 nt, Bordetella pertussis
agcaggccgggucguucg

SEQ ID NO: 2350645 - RNA, 14 nt, Bordetella pertussis
agcaggccggucag

SEQ ID NO: 2350646 - RNA, 20 nt, Bordetella pertussis
agcaggccguaaccggccag

SEQ ID NO: 2350647 - RNA, 17 nt, Bordetella pertussis
agcaggccguugccgcu

SEQ ID NO: 2350648 - RNA, 16 nt, Bordetella pertussis
agcaggcgcaccagcg

SEQ ID NO: 2350649 - RNA, 14 nt, Bordetella pertussis
agcaggcgcaggcc

SEQ ID NO: 2350650 - RNA, 19 nt, Bordetella pertussis
agcaggcgcaggccgcgcg

SEQ ID NO: 2350651 - RNA, 21 nt, Bordetella pertussis
agcaggcgcaggccgcgcgca

SEQ ID NO: 2350652 - RNA, 22 nt, Bordetella pertussis
agcaggcgcaucagcuuggcca

SEQ ID NO: 2350653 - RNA, 13 nt, Bordetella pertussis
agcaggcgccugc

SEQ ID NO: 2350654 - RNA, 18 nt, Bordetella pertussis
agcaggcgcgcucaggcc

SEQ ID NO: 2350655 - RNA, 20 nt, Bordetella pertussis
agcaggcgcgcucaggccgc

SEQ ID NO: 2350656 - RNA, 15 nt, Bordetella pertussis
agcaggcgcgugcuc

SEQ ID NO: 2350657 - RNA, 13 nt, Bordetella pertussis
agcaggcgcucgg

SEQ ID NO: 2350658 - RNA, 18 nt, Bordetella pertussis
agcaggcgcucggccagc

SEQ ID NO: 2350659 - RNA, 16 nt, Bordetella pertussis
agcaggcgcucggcuu

SEQ ID NO: 2350660 - RNA, 15 nt, Bordetella pertussis
agcaggcgcugguaa

SEQ ID NO: 2350661 - RNA, 19 nt, Bordetella pertussis
agcaggcggccgaccagca

SEQ ID NO: 2350662 - RNA, 16 nt, Bordetella pertussis
agcaggcucagcgggc

SEQ ID NO: 2350663 - RNA, 18 nt, Bordetella pertussis
agccagguggcgaugccg

SEQ ID NO: 2350664 - RNA, 15 nt, Bordetella pertussis
agccaguacaggcug

SEQ ID NO: 2350665 - RNA, 16 nt, Bordetella pertussis
agccaguacaggcugc

SEQ ID NO: 2350666 - RNA, 20 nt, Bordetella pertussis
agccaguccccgcagggaca

SEQ ID NO: 2350667 - RNA, 17 nt, Bordetella pertussis
agccaguugggccaggg

SEQ ID NO: 2350668 - RNA, 13 nt, Bordetella pertussis
agccaucaucauc

SEQ ID NO: 2350669 - RNA, 17 nt, Bordetella pertussis
agccaucaucaucgucg

SEQ ID NO: 2350670 - RNA, 22 nt, Bordetella pertussis
agccaucaucaucgucggcgcc

SEQ ID NO: 2350671 - RNA, 22 nt, Bordetella pertussis
agccauccucgcccagcggcgc

SEQ ID NO: 2350672 - RNA, 17 nt, Bordetella pertussis
agccauucgauggcggc

SEQ ID NO: 2350673 - RNA, 19 nt, Bordetella pertussis
agccauucgauggcggcgc

SEQ ID NO: 2350674 - RNA, 20 nt, Bordetella pertussis
agccauucgauggcggcgcu

SEQ ID NO: 2350675 - RNA, 21 nt, Bordetella pertussis
agccauucgauggcggcgcug

SEQ ID NO: 2350676 - RNA, 21 nt, Bordetella pertussis
agccauugcccacagcacgga

SEQ ID NO: 2350677 - RNA, 13 nt, Bordetella pertussis
agccauugucggu

SEQ ID NO: 2350678 - RNA, 14 nt, Bordetella pertussis
agcccaccagcgcc

SEQ ID NO: 2350679 - RNA, 16 nt, Bordetella pertussis
agcccaccagcgccac

SEQ ID NO: 2350680 - RNA, 23 nt, Bordetella pertussis
agcccaccagcgccacgccggcc

SEQ ID NO: 2350681 - RNA, 15 nt, Bordetella pertussis
agcccaccgcgaacc

SEQ ID NO: 2350682 - RNA, 16 nt, Bordetella pertussis
agcccaccgggccggc

SEQ ID NO: 2350683 - RNA, 18 nt, Bordetella pertussis
agcccaccgggccggccu

SEQ ID NO: 2350684 - RNA, 20 nt, Bordetella pertussis
agcccaccgggccggccugc

SEQ ID NO: 2350685 - RNA, 22 nt, Bordetella pertussis
agcccaccgggccggccugcgu

SEQ ID NO: 2350686 - RNA, 19 nt, Bordetella pertussis
agcccacucacgcaaggcc

SEQ ID NO: 2350687 - RNA, 20 nt, Bordetella pertussis
agcccacucacgcaaggccg

SEQ ID NO: 2350688 - RNA, 18 nt, Bordetella pertussis
agcccagcaaggguucgg

SEQ ID NO: 2350689 - RNA, 17 nt, Bordetella pertussis
agcccagcaccacggca

SEQ ID NO: 2350690 - RNA, 12 nt, Bordetella pertussis
agcccagcaccu

SEQ ID NO: 2350691 - RNA, 22 nt, Bordetella pertussis
agcccagcaccugcaggccgcc

SEQ ID NO: 2350692 - RNA, 15 nt, Bordetella pertussis
agcccagcacgacga

SEQ ID NO: 2350693 - RNA, 20 nt, Bordetella pertussis
agcccaggcccacgccgcgu

SEQ ID NO: 2350694 - RNA, 13 nt, Bordetella pertussis
agcccaggccgcc

SEQ ID NO: 2350695 - RNA, 17 nt, Bordetella pertussis
agcccaggccgccggcg

SEQ ID NO: 2350696 - RNA, 20 nt, Bordetella pertussis
agcccaggccgccggcggcg

SEQ ID NO: 2350697 - RNA, 19 nt, Bordetella pertussis
agcccagguccagcgccac

SEQ ID NO: 2350698 - RNA, 21 nt, Bordetella pertussis
agcccaguugcuggcccagga

SEQ ID NO: 2350699 - RNA, 12 nt, Bordetella pertussis
agcccauggcca

SEQ ID NO: 2350700 - RNA, 12 nt, Bordetella pertussis
agcccauguucu

SEQ ID NO: 2350701 - RNA, 21 nt, Bordetella pertussis
agcccauguugaacugcaggc

SEQ ID NO: 2350702 - RNA, 23 nt, Bordetella pertussis
agcccauguugaacugcaggccg

SEQ ID NO: 2350703 - RNA, 15 nt, Bordetella pertussis
agccccaaugugcug

SEQ ID NO: 2350704 - RNA, 16 nt, Bordetella pertussis
agccccacgccgaccu

SEQ ID NO: 2350705 - RNA, 12 nt, Bordetella pertussis
agccccagcgcc

SEQ ID NO: 2350706 - RNA, 23 nt, Bordetella pertussis
agccccaggaacuugaacggcgc

SEQ ID NO: 2350707 - RNA, 14 nt, Bordetella pertussis
agccccaggcaggc

SEQ ID NO: 2350708 - RNA, 13 nt, Bordetella pertussis
agccccaggcgcg

SEQ ID NO: 2350709 - RNA, 23 nt, Bordetella pertussis
agccccccguaggcggcccaggc

SEQ ID NO: 2350710 - RNA, 12 nt, Bordetella pertussis
agcccccgcgcu

SEQ ID NO: 2350711 - RNA, 18 nt, Bordetella pertussis
agcccccgcgcugcgccc

SEQ ID NO: 2350712 - RNA, 19 nt, Bordetella pertussis
agcccccgcgcugcgcccg

SEQ ID NO: 2350713 - RNA, 15 nt, Bordetella pertussis
agccccgcggccgcg

SEQ ID NO: 2350714 - RNA, 22 nt, Bordetella pertussis
agccccguuucguaaggcugcg

SEQ ID NO: 2350715 - RNA, 21 nt, Bordetella pertussis
agccccugccaugccccaucc

SEQ ID NO: 2350716 - RNA, 18 nt, Bordetella pertussis
agcccgacgcgaggcaga

SEQ ID NO: 2350717 - RNA, 14 nt, Bordetella pertussis
agcccgacggccag

SEQ ID NO: 2350718 - RNA, 17 nt, Bordetella pertussis
agcccgagcggcgccag

SEQ ID NO: 2350719 - RNA, 18 nt, Bordetella pertussis
agcccgagcggcgccagu

SEQ ID NO: 2350720 - RNA, 17 nt, Bordetella pertussis
agcccgauaugcagccg

SEQ ID NO: 2350721 - RNA, 19 nt, Bordetella pertussis
agcccgauaugcagccgca

SEQ ID NO: 2350722 - RNA, 22 nt, Bordetella pertussis
agcccgauaugcagccgcacca

SEQ ID NO: 2350723 - RNA, 13 nt, Bordetella pertussis
agcccgaucgacg

SEQ ID NO: 2350724 - RNA, 18 nt, Bordetella pertussis
agcccgaucgacggccgc

SEQ ID NO: 2350725 - RNA, 17 nt, Bordetella pertussis
agcccgaugccgccaug

SEQ ID NO: 2350726 - RNA, 18 nt, Bordetella pertussis
agcccgaugcgccaggcc

SEQ ID NO: 2350727 - RNA, 21 nt, Bordetella pertussis
agcccgaugcgccaggccucg

SEQ ID NO: 2350728 - RNA, 23 nt, Bordetella pertussis
agcccgcacauacaaggcgcggc

SEQ ID NO: 2350729 - RNA, 12 nt, Bordetella pertussis
agcccgccaucg

SEQ ID NO: 2350730 - RNA, 15 nt, Bordetella pertussis
agcccgccaucgcgc

SEQ ID NO: 2350731 - RNA, 18 nt, Bordetella pertussis
agcccgcccgcgagcggc

SEQ ID NO: 2350732 - RNA, 21 nt, Bordetella pertussis
agcccgcccgcgagcggccag

SEQ ID NO: 2350733 - RNA, 16 nt, Bordetella pertussis
agcccgcccgcgccca

SEQ ID NO: 2350734 - RNA, 16 nt, Bordetella pertussis
agcccgccgagucggc

SEQ ID NO: 2350735 - RNA, 23 nt, Bordetella pertussis
agcccgccgauccacucggccag

SEQ ID NO: 2350736 - RNA, 15 nt, Bordetella pertussis
agcccgccuggcgcc

SEQ ID NO: 2350737 - RNA, 12 nt, Bordetella pertussis
agcccgcgccac

SEQ ID NO: 2350738 - RNA, 13 nt, Bordetella pertussis
agcccgcgccacc

SEQ ID NO: 2350739 - RNA, 16 nt, Bordetella pertussis
agcccgcgcgccugca

SEQ ID NO: 2350740 - RNA, 17 nt, Bordetella pertussis
agcccgcgcuggcgcag

SEQ ID NO: 2350741 - RNA, 11 nt, Bordetella pertussis
agcccgcggcc

SEQ ID NO: 2350742 - RNA, 14 nt, Bordetella pertussis
agcccgcggccacc

SEQ ID NO: 2350743 - RNA, 12 nt, Bordetella pertussis
agcccgcgucgg

SEQ ID NO: 2350744 - RNA, 12 nt, Bordetella pertussis
agcccgcguuca

SEQ ID NO: 2350745 - RNA, 19 nt, Bordetella pertussis
agcccgcugccgaauucgu

SEQ ID NO: 2350746 - RNA, 15 nt, Bordetella pertussis
agcccggcaccaugc

SEQ ID NO: 2350747 - RNA, 16 nt, Bordetella pertussis
agcccggcaccaugcg

SEQ ID NO: 2350748 - RNA, 17 nt, Bordetella pertussis
agcccggcaccaugcgc

SEQ ID NO: 2350749 - RNA, 15 nt, Bordetella pertussis
agcccggcacgucgg

SEQ ID NO: 2350750 - RNA, 15 nt, Bordetella pertussis
agcccggccagagcc

SEQ ID NO: 2350751 - RNA, 12 nt, Bordetella pertussis
agcccggcccca

SEQ ID NO: 2350752 - RNA, 15 nt, Bordetella pertussis
agcccggccccaggc

SEQ ID NO: 2350753 - RNA, 18 nt, Bordetella pertussis
agcccggcccccagccca

SEQ ID NO: 2350754 - RNA, 13 nt, Bordetella pertussis
agcccggccgcca

SEQ ID NO: 2350755 - RNA, 14 nt, Bordetella pertussis
agcccggccgccag

SEQ ID NO: 2350756 - RNA, 15 nt, Bordetella pertussis
agcccggccgccagc

SEQ ID NO: 2350757 - RNA, 23 nt, Bordetella pertussis
agcccggccgccagcauggcguc

SEQ ID NO: 2350758 - RNA, 13 nt, Bordetella pertussis
agcccggcgccac

SEQ ID NO: 2350759 - RNA, 15 nt, Bordetella pertussis
agcccggcgcgccac

SEQ ID NO: 2350760 - RNA, 17 nt, Bordetella pertussis
agcccggcgcgccaccc

SEQ ID NO: 2350761 - RNA, 17 nt, Bordetella pertussis
agcccggcgugcccagg

SEQ ID NO: 2350762 - RNA, 22 nt, Bordetella pertussis
agcccggcugcucguucugcgc

SEQ ID NO: 2350763 - RNA, 22 nt, Bordetella pertussis
agcccgggaaacucgcgcagcg

SEQ ID NO: 2350764 - RNA, 15 nt, Bordetella pertussis
agcccgucaggcgga

SEQ ID NO: 2350765 - RNA, 16 nt, Bordetella pertussis
agcccgucaggcggau

SEQ ID NO: 2350766 - RNA, 15 nt, Bordetella pertussis
agcccgugcgggccu

SEQ ID NO: 2350767 - RNA, 20 nt, Bordetella pertussis
agcccgugcgggccugcagu

SEQ ID NO: 2350768 - RNA, 11 nt, Bordetella pertussis
agcccguggcg

SEQ ID NO: 2350769 - RNA, 16 nt, Bordetella pertussis
agcccgugggcggcgu

SEQ ID NO: 2350770 - RNA, 18 nt, Bordetella pertussis
agcccgugggcggcguag

SEQ ID NO: 2350771 - RNA, 23 nt, Bordetella pertussis
agcccucgucgcggccguuggcg

SEQ ID NO: 2350772 - RNA, 17 nt, Bordetella pertussis
agcccugcguggcgcag

SEQ ID NO: 2350773 - RNA, 11 nt, Bordetella pertussis
agcccuggccc

SEQ ID NO: 2350774 - RNA, 12 nt, Bordetella pertussis
agcccuggcgcu

SEQ ID NO: 2350775 - RNA, 20 nt, Bordetella pertussis
agcccuucgacgcggcggcc

SEQ ID NO: 2350776 - RNA, 17 nt, Bordetella pertussis
agcccuugaucagcggc

SEQ ID NO: 2350777 - RNA, 18 nt, Bordetella pertussis
agccggagcagucgcgca

SEQ ID NO: 2350778 - RNA, 22 nt, Bordetella pertussis
agccggauugcuugacgccgcc

SEQ ID NO: 2350779 - RNA, 14 nt, Bordetella pertussis
agccggcacgccug

SEQ ID NO: 2350780 - RNA, 17 nt, Bordetella pertussis
agccggcagaucggcgc

SEQ ID NO: 2350781 - RNA, 20 nt, Bordetella pertussis
agccggcagaucggcgcugg

SEQ ID NO: 2350782 - RNA, 16 nt, Bordetella pertussis
agccggccagcgccac

SEQ ID NO: 2350783 - RNA, 17 nt, Bordetella pertussis
agccggccagcgccugg

SEQ ID NO: 2350784 - RNA, 19 nt, Bordetella pertussis
agccggccagcgccugggc

SEQ ID NO: 2350785 - RNA, 15 nt, Bordetella pertussis
agccggccauggccc

SEQ ID NO: 2350786 - RNA, 13 nt, Bordetella pertussis
agccggcccagca

SEQ ID NO: 2350787 - RNA, 23 nt, Bordetella pertussis
agccggcccagcacgccgcgcuc

SEQ ID NO: 2350788 - RNA, 16 nt, Bordetella pertussis
agccggccccgcaagg

SEQ ID NO: 2350789 - RNA, 20 nt, Bordetella pertussis
agccggcccguuggcaggcc

SEQ ID NO: 2350790 - RNA, 13 nt, Bordetella pertussis
agccggccgccga

SEQ ID NO: 2350791 - RNA, 20 nt, Bordetella pertussis
agccggccgcgccgcgccgg

SEQ ID NO: 2350792 - RNA, 12 nt, Bordetella pertussis
agccggcgccau

SEQ ID NO: 2350793 - RNA, 14 nt, Bordetella pertussis
agccggcgcgccau

SEQ ID NO: 2350794 - RNA, 15 nt, Bordetella pertussis
agccggcgcgccaug

SEQ ID NO: 2350795 - RNA, 15 nt, Bordetella pertussis
agccggcggcaugcg

SEQ ID NO: 2350796 - RNA, 21 nt, Bordetella pertussis
agccggcggcaugcgccagcc

SEQ ID NO: 2350797 - RNA, 13 nt, Bordetella pertussis
agccggcggccag

SEQ ID NO: 2350798 - RNA, 14 nt, Bordetella pertussis
agccggcggccagc

SEQ ID NO: 2350799 - RNA, 18 nt, Bordetella pertussis
agccggcggccagcuugu

SEQ ID NO: 2350800 - RNA, 22 nt, Bordetella pertussis
agccggcgggcggcugcccggg

SEQ ID NO: 2350801 - RNA, 16 nt, Bordetella pertussis
agccgggccacgcgca

SEQ ID NO: 2350802 - RNA, 20 nt, Bordetella pertussis
agccgggccaugcgggucag

SEQ ID NO: 2350803 - RNA, 22 nt, Bordetella pertussis
agccgggccaugcgggucaggc

SEQ ID NO: 2350804 - RNA, 17 nt, Bordetella pertussis
agccgggcgaucgcguc

SEQ ID NO: 2350805 - RNA, 13 nt, Bordetella pertussis
agccgggcgccgg

SEQ ID NO: 2350806 - RNA, 15 nt, Bordetella pertussis
agccgggcggccacg

SEQ ID NO: 2350807 - RNA, 17 nt, Bordetella pertussis
agccgggcggccacggc

SEQ ID NO: 2350808 - RNA, 13 nt, Bordetella pertussis
agccgggcggcga

SEQ ID NO: 2350809 - RNA, 15 nt, Bordetella pertussis
agccgggucuggccg

SEQ ID NO: 2350810 - RNA, 17 nt, Bordetella pertussis
agccgggucuggccggc

SEQ ID NO: 2350811 - RNA, 19 nt, Bordetella pertussis
agccgggucuggccggccg

SEQ ID NO: 2350812 - RNA, 17 nt, Bordetella pertussis
agccggguggucgcgcc

SEQ ID NO: 2350813 - RNA, 20 nt, Bordetella pertussis
agccgguacagccaggccag

SEQ ID NO: 2350814 - RNA, 18 nt, Bordetella pertussis
agccgguaucgcggcgca

SEQ ID NO: 2350815 - RNA, 20 nt, Bordetella pertussis
agccgguaucgcggcgcagg

SEQ ID NO: 2350816 - RNA, 21 nt, Bordetella pertussis
agccgguaucgcggcgcaggc

SEQ ID NO: 2350817 - RNA, 22 nt, Bordetella pertussis
agccgguaucgcggcgcaggcg

SEQ ID NO: 2350818 - RNA, 17 nt, Bordetella pertussis
agccgguccgccucgca

SEQ ID NO: 2350819 - RNA, 17 nt, Bordetella pertussis
agccggucuggucggcg

SEQ ID NO: 2350820 - RNA, 18 nt, Bordetella pertussis
agccggucuggucggcga

SEQ ID NO: 2350821 - RNA, 15 nt, Bordetella pertussis
agccggugccagucc

SEQ ID NO: 2350822 - RNA, 23 nt, Bordetella pertussis
agccggugcgcagcaccagcaug

SEQ ID NO: 2350823 - RNA, 14 nt, Bordetella pertussis
agccgguuggcgcc

SEQ ID NO: 2350824 - RNA, 20 nt, Bordetella pertussis
agccguaacaggacagccgc

SEQ ID NO: 2350825 - RNA, 18 nt, Bordetella pertussis
agccguccucgcgggccu

SEQ ID NO: 2350826 - RNA, 20 nt, Bordetella pertussis
agccguccuugagggcgcgg

SEQ ID NO: 2350827 - RNA, 13 nt, Bordetella pertussis
agccgucgcgcug

SEQ ID NO: 2350828 - RNA, 18 nt, Bordetella pertussis
agccgucggccacguccg

SEQ ID NO: 2350829 - RNA, 21 nt, Bordetella pertussis
agccgugaagaccaagaucaa

SEQ ID NO: 2350830 - RNA, 15 nt, Bordetella pertussis
agccgugccgcgcgc

SEQ ID NO: 2350831 - RNA, 16 nt, Bordetella pertussis
agccguucuggcagug

SEQ ID NO: 2350832 - RNA, 20 nt, Bordetella pertussis
agccguuggcgcccagcgcc

SEQ ID NO: 2350833 - RNA, 23 nt, Bordetella pertussis
agccguuggcgcccagcgccauc

SEQ ID NO: 2350834 - RNA, 15 nt, Bordetella pertussis
agccuaggcugcagc

SEQ ID NO: 2350835 - RNA, 17 nt, Bordetella pertussis
agccuaggcugcagcca

SEQ ID NO: 2350836 - RNA, 21 nt, Bordetella pertussis
agccuaggcugcagccaguug

SEQ ID NO: 2350837 - RNA, 22 nt, Bordetella pertussis
agccucacuccauagcgccgcu

SEQ ID NO: 2350838 - RNA, 16 nt, Bordetella pertussis
agccucgagguggcgc

SEQ ID NO: 2350839 - RNA, 20 nt, Bordetella pertussis
agccucgcccuugcggcgag

SEQ ID NO: 2350840 - RNA, 15 nt, Bordetella pertussis
agccucguuggucag

SEQ ID NO: 2350841 - RNA, 23 nt, Bordetella pertussis
agccucuuuugcuugggggcgug

SEQ ID NO: 2350842 - RNA, 19 nt, Bordetella pertussis
agccugauucccaggcccg

SEQ ID NO: 2350843 - RNA, 21 nt, Bordetella pertussis
agccugauucccaggcccggc

SEQ ID NO: 2350844 - RNA, 22 nt, Bordetella pertussis
agccugauucccaggcccggcc

SEQ ID NO: 2350845 - RNA, 21 nt, Bordetella pertussis
agccugccccgauacaaggug

SEQ ID NO: 2350846 - RNA, 14 nt, Bordetella pertussis
agccugcccgggca

SEQ ID NO: 2350847 - RNA, 18 nt, Bordetella pertussis
agccugcccgggcagcac

SEQ ID NO: 2350848 - RNA, 24 nt, Bordetella pertussis
agccugcccgggcagcaccgcugc

SEQ ID NO: 2350849 - RNA, 19 nt, Bordetella pertussis
agccugcccucgggcgaca

SEQ ID NO: 2350850 - RNA, 18 nt, Bordetella pertussis
agccugcccugguggcag

SEQ ID NO: 2350851 - RNA, 16 nt, Bordetella pertussis
agccugccgcggccgc

SEQ ID NO: 2350852 - RNA, 13 nt, Bordetella pertussis
agccugccggcgg

SEQ ID NO: 2350853 - RNA, 16 nt, Bordetella pertussis
agccugccggcggccu

SEQ ID NO: 2350854 - RNA, 17 nt, Bordetella pertussis
agccugccggcggccua

SEQ ID NO: 2350855 - RNA, 22 nt, Bordetella pertussis
agccugcuaguacaccgucgcg

SEQ ID NO: 2350856 - RNA, 22 nt, Bordetella pertussis
agccugcuuauaggcuuucaga

SEQ ID NO: 2350857 - RNA, 21 nt, Bordetella pertussis
agccuggaagugaugccgccg

SEQ ID NO: 2350858 - RNA, 23 nt, Bordetella pertussis
agccuggaagugaugccgccggc

SEQ ID NO: 2350859 - RNA, 18 nt, Bordetella pertussis
agccuggcaaugcguggc

SEQ ID NO: 2350860 - RNA, 22 nt, Bordetella pertussis
agccuggcaaugcguggccggc

SEQ ID NO: 2350861 - RNA, 14 nt, Bordetella pertussis
agccuggccuugcg

SEQ ID NO: 2350862 - RNA, 17 nt, Bordetella pertussis
agccuggccuugcgcuu

SEQ ID NO: 2350863 - RNA, 23 nt, Bordetella pertussis
agccuggcguagggcugcacgau

SEQ ID NO: 2350864 - RNA, 15 nt, Bordetella pertussis
agccugggccuguac

SEQ ID NO: 2350865 - RNA, 13 nt, Bordetella pertussis
agccugggcgcgc

SEQ ID NO: 2350866 - RNA, 15 nt, Bordetella pertussis
agccuggggcaggcg

SEQ ID NO: 2350867 - RNA, 15 nt, Bordetella pertussis
agccuggucagguug

SEQ ID NO: 2350868 - RNA, 20 nt, Bordetella pertussis
agccuguccccgccggggca

SEQ ID NO: 2350869 - RNA, 21 nt, Bordetella pertussis
agccuguccccgccggggcag

SEQ ID NO: 2350870 - RNA, 23 nt, Bordetella pertussis
agccuguccccgucgggacaggc

SEQ ID NO: 2350871 - RNA, 21 nt, Bordetella pertussis
agccugucccgacggggacag

SEQ ID NO: 2350872 - RNA, 15 nt, Bordetella pertussis
agccuucggccggcu

SEQ ID NO: 2350873 - RNA, 16 nt, Bordetella pertussis
agccuucggccggcug

SEQ ID NO: 2350874 - RNA, 18 nt, Bordetella pertussis
agccuucggccggcugcg

SEQ ID NO: 2350875 - RNA, 21 nt, Bordetella pertussis
agccuucuucugcaucggcau

SEQ ID NO: 2350876 - RNA, 15 nt, Bordetella pertussis
agccuugaaagaggc

SEQ ID NO: 2350877 - RNA, 14 nt, Bordetella pertussis
agccuugcgcggcc

SEQ ID NO: 2350878 - RNA, 18 nt, Bordetella pertussis
agccuugcggcccuugcg

SEQ ID NO: 2350879 - RNA, 17 nt, Bordetella pertussis
agccuugcuccggcgug

SEQ ID NO: 2350880 - RNA, 20 nt, Bordetella pertussis
agccuugcucgcggauuugc

SEQ ID NO: 2350881 - RNA, 14 nt, Bordetella pertussis
agccuuggcccacu

SEQ ID NO: 2350882 - RNA, 17 nt, Bordetella pertussis
agccuugucgcgggcag

SEQ ID NO: 2350883 - RNA, 19 nt, Bordetella pertussis
agccuugucgcgggcagug

SEQ ID NO: 2350884 - RNA, 16 nt, Bordetella pertussis
agccuuuccuccugcc

SEQ ID NO: 2350885 - RNA, 20 nt, Bordetella pertussis
agcgaaagcacggcgaugcu

SEQ ID NO: 2350886 - RNA, 15 nt, Bordetella pertussis
agcgaaauacgcgac

SEQ ID NO: 2350887 - RNA, 15 nt, Bordetella pertussis
agcgaaauggcggcc

SEQ ID NO: 2350888 - RNA, 16 nt, Bordetella pertussis
agcgaaauggcggccu

SEQ ID NO: 2350889 - RNA, 15 nt, Bordetella pertussis
agcgccaggccgcgc

SEQ ID NO: 2350890 - RNA, 16 nt, Bordetella pertussis
agcgccaggccgcgca

SEQ ID NO: 2350891 - RNA, 15 nt, Bordetella pertussis
agcgccaggcuccau

SEQ ID NO: 2350892 - RNA, 16 nt, Bordetella pertussis
agcgccagggccaggc

SEQ ID NO: 2350893 - RNA, 17 nt, Bordetella pertussis
agcgccagggccaggcc

SEQ ID NO: 2350894 - RNA, 20 nt, Bordetella pertussis
agcgccagggccaggccgcc

SEQ ID NO: 2350895 - RNA, 22 nt, Bordetella pertussis
agcgccagggccgccgcgccca

SEQ ID NO: 2350896 - RNA, 16 nt, Bordetella pertussis
agcgccagggccuccu

SEQ ID NO: 2350897 - RNA, 19 nt, Bordetella pertussis
agcgccaguccgcgcucgc

SEQ ID NO: 2350898 - RNA, 20 nt, Bordetella pertussis
agcgccaucaagagcaccgu

SEQ ID NO: 2350899 - RNA, 14 nt, Bordetella pertussis
agcgccccucgcgg

SEQ ID NO: 2350900 - RNA, 15 nt, Bordetella pertussis
agcgccccucgcgga

SEQ ID NO: 2350901 - RNA, 12 nt, Bordetella pertussis
agcgcccgccuu

SEQ ID NO: 2350902 - RNA, 18 nt, Bordetella pertussis
agcgcccgccuucgcuga

SEQ ID NO: 2350903 - RNA, 17 nt, Bordetella pertussis
agcgccgaagucggcuc

SEQ ID NO: 2350904 - RNA, 20 nt, Bordetella pertussis
agcgccgaccgcacgauggc

SEQ ID NO: 2350905 - RNA, 16 nt, Bordetella pertussis
agcgccgacggcaugg

SEQ ID NO: 2350906 - RNA, 22 nt, Bordetella pertussis
agcgccgacggcauggccggca

SEQ ID NO: 2350907 - RNA, 16 nt, Bordetella pertussis
agcgccgacgggccgg

SEQ ID NO: 2350908 - RNA, 17 nt, Bordetella pertussis
agcgccgcagcgucgcg

SEQ ID NO: 2350909 - RNA, 11 nt, Bordetella pertussis
agcgccgccac

SEQ ID NO: 2350910 - RNA, 14 nt, Bordetella pertussis
agcgccgccaccuc

SEQ ID NO: 2350911 - RNA, 23 nt, Bordetella pertussis
agcgccgccagccgcuggcgcgc

SEQ ID NO: 2350912 - RNA, 12 nt, Bordetella pertussis
agcgccgccagg

SEQ ID NO: 2350913 - RNA, 18 nt, Bordetella pertussis
agcgccgccaggccgucg

SEQ ID NO: 2350914 - RNA, 11 nt, Bordetella pertussis
agcgccgccau

SEQ ID NO: 2350915 - RNA, 22 nt, Bordetella pertussis
agcgccgccaucauggcgucgg

SEQ ID NO: 2350916 - RNA, 13 nt, Bordetella pertussis
agcgccgccaugg

SEQ ID NO: 2350917 - RNA, 15 nt, Bordetella pertussis
agcgccgccauggcg

SEQ ID NO: 2350918 - RNA, 17 nt, Bordetella pertussis
agcgccgccauggcggc

SEQ ID NO: 2350919 - RNA, 22 nt, Bordetella pertussis
agcgccgccauggcggcgccca

SEQ ID NO: 2350920 - RNA, 15 nt, Bordetella pertussis
agcgccgccgacggc

SEQ ID NO: 2350921 - RNA, 16 nt, Bordetella pertussis
agcgccgccgccaugg

SEQ ID NO: 2350922 - RNA, 14 nt, Bordetella pertussis
agcgccgccgccgg

SEQ ID NO: 2350923 - RNA, 15 nt, Bordetella pertussis
agcgccgccgccggu

SEQ ID NO: 2350924 - RNA, 20 nt, Bordetella pertussis
agcgccgccuucaccggccc

SEQ ID NO: 2350925 - RNA, 17 nt, Bordetella pertussis
agcgccgcgagcgccga

SEQ ID NO: 2350926 - RNA, 17 nt, Bordetella pertussis
agcgccgcgaugcgguu

SEQ ID NO: 2350927 - RNA, 11 nt, Bordetella pertussis
agcgccgcgcc

SEQ ID NO: 2350928 - RNA, 14 nt, Bordetella pertussis
agcgccgcgccucg

SEQ ID NO: 2350929 - RNA, 21 nt, Bordetella pertussis
agcgccgcgccucggacgccu

SEQ ID NO: 2350930 - RNA, 14 nt, Bordetella pertussis
agcgccgcgcgcgu

SEQ ID NO: 2350931 - RNA, 16 nt, Bordetella pertussis
agcgccgcgcgcgugc

SEQ ID NO: 2350932 - RNA, 14 nt, Bordetella pertussis
agcgccgcgcgcuc

SEQ ID NO: 2350933 - RNA, 13 nt, Bordetella pertussis
agcgccgcggccg

SEQ ID NO: 2350934 - RNA, 22 nt, Bordetella pertussis
agcgccgcggcguccgaauacg

SEQ ID NO: 2350935 - RNA, 13 nt, Bordetella pertussis
agcgccgcgucga

SEQ ID NO: 2350936 - RNA, 17 nt, Bordetella pertussis
agcgccgcgucgagcgc

SEQ ID NO: 2350937 - RNA, 18 nt, Bordetella pertussis
agcgccgcgucgagcgcg

SEQ ID NO: 2350938 - RNA, 21 nt, Bordetella pertussis
agcgccgcgugguggcgcaga

SEQ ID NO: 2350939 - RNA, 22 nt, Bordetella pertussis
agcgccgcucgacgucgcccug

SEQ ID NO: 2350940 - RNA, 23 nt, Bordetella pertussis
agcgccgcucgacgucgcccugg

SEQ ID NO: 2350941 - RNA, 18 nt, Bordetella pertussis
agcgccggcacgcugacc

SEQ ID NO: 2350942 - RNA, 13 nt, Bordetella pertussis
agcgccggcagcc

SEQ ID NO: 2350943 - RNA, 14 nt, Bordetella pertussis
agcgccggcagccc

SEQ ID NO: 2350944 - RNA, 18 nt, Bordetella pertussis
agcgccggcagccccagc

SEQ ID NO: 2350945 - RNA, 22 nt, Bordetella pertussis
agcgccggcagccccagcgccc

SEQ ID NO: 2350946 - RNA, 14 nt, Bordetella pertussis
agcgccggcaggcg

SEQ ID NO: 2350947 - RNA, 20 nt, Bordetella pertussis
agcgccggcaggcgcgccag

SEQ ID NO: 2350948 - RNA, 11 nt, Bordetella pertussis
agcgccggccc

SEQ ID NO: 2350949 - RNA, 14 nt, Bordetella pertussis
agcgccggcccgcc

SEQ ID NO: 2350950 - RNA, 17 nt, Bordetella pertussis
agcgccggcccgccucg

SEQ ID NO: 2350951 - RNA, 13 nt, Bordetella pertussis
agcgccggcgcau

SEQ ID NO: 2350952 - RNA, 21 nt, Bordetella pertussis
agcgccggcgcaugagccggc

SEQ ID NO: 2350953 - RNA, 12 nt, Bordetella pertussis
agcgccggcgcg

SEQ ID NO: 2350954 - RNA, 13 nt, Bordetella pertussis
agcgccggcgcgc

SEQ ID NO: 2350955 - RNA, 16 nt, Bordetella pertussis
agcgccggcgcgcgcu

SEQ ID NO: 2350956 - RNA, 16 nt, Bordetella pertussis
agcgccggcugggcgu

SEQ ID NO: 2350957 - RNA, 19 nt, Bordetella pertussis
agcgccgggcgccgcgccc

SEQ ID NO: 2350958 - RNA, 15 nt, Bordetella pertussis
agcgccggggcgugg

SEQ ID NO: 2350959 - RNA, 15 nt, Bordetella pertussis
agcgccggggggcgc

SEQ ID NO: 2350960 - RNA, 22 nt, Bordetella pertussis
agcgccggggggcgcacgccgc

SEQ ID NO: 2350961 - RNA, 18 nt, Bordetella pertussis
agcgccgguucgacgcug

SEQ ID NO: 2350962 - RNA, 21 nt, Bordetella pertussis
agcgccgguucgacgcugauc

SEQ ID NO: 2350963 - RNA, 16 nt, Bordetella pertussis
agcgccgucagcagcg

SEQ ID NO: 2350964 - RNA, 19 nt, Bordetella pertussis
agcgccgucagcagcgcgg

SEQ ID NO: 2350965 - RNA, 20 nt, Bordetella pertussis
agcgccgucagcagcgcggc

SEQ ID NO: 2350966 - RNA, 22 nt, Bordetella pertussis
agcgccgucagcagcgcggcgc

SEQ ID NO: 2350967 - RNA, 19 nt, Bordetella pertussis
agcgccgucucgugccccg

SEQ ID NO: 2350968 - RNA, 23 nt, Bordetella pertussis
agcgccuccaucagcagcaccuu

SEQ ID NO: 2350969 - RNA, 17 nt, Bordetella pertussis
agcgccucgcaucggcc

SEQ ID NO: 2350970 - RNA, 18 nt, Bordetella pertussis
agcgccucgcaucggccu

SEQ ID NO: 2350971 - RNA, 20 nt, Bordetella pertussis
agcgccucgcaucggccugc

SEQ ID NO: 2350972 - RNA, 21 nt, Bordetella pertussis
agcgccucgcaucggccugca

SEQ ID NO: 2350973 - RNA, 19 nt, Bordetella pertussis
agcgccucgcgcuccaugg

SEQ ID NO: 2350974 - RNA, 20 nt, Bordetella pertussis
agcgccucgcgcucgagcgc

SEQ ID NO: 2350975 - RNA, 20 nt, Bordetella pertussis
agcgccucgucgcgcaacgc

SEQ ID NO: 2350976 - RNA, 13 nt, Bordetella pertussis
agcgccugcagcg

SEQ ID NO: 2350977 - RNA, 14 nt, Bordetella pertussis
agcgccugcaggcg

SEQ ID NO: 2350978 - RNA, 13 nt, Bordetella pertussis
agcgccugcaggu

SEQ ID NO: 2350979 - RNA, 19 nt, Bordetella pertussis
agcgccugcauccggccca

SEQ ID NO: 2350980 - RNA, 20 nt, Bordetella pertussis
agcgccugcauccggcccag

SEQ ID NO: 2350981 - RNA, 20 nt, Bordetella pertussis
agcgccugccgaucgugcac

SEQ ID NO: 2350982 - RNA, 13 nt, Bordetella pertussis
agcgccugcgcgg

SEQ ID NO: 2350983 - RNA, 16 nt, Bordetella pertussis
agcgccugcgcggccu

SEQ ID NO: 2350984 - RNA, 14 nt, Bordetella pertussis
agcgccuggaccug

SEQ ID NO: 2350985 - RNA, 17 nt, Bordetella pertussis
agcgccuggaccuggac

SEQ ID NO: 2350986 - RNA, 18 nt, Bordetella pertussis
agcgccuggccgagcgcg

SEQ ID NO: 2350987 - RNA, 20 nt, Bordetella pertussis
agcgccuggccgagcgcggc

SEQ ID NO: 2350988 - RNA, 14 nt, Bordetella pertussis
agcgccuggcgggc

SEQ ID NO: 2350989 - RNA, 12 nt, Bordetella pertussis
agcgccugggcg

SEQ ID NO: 2350990 - RNA, 17 nt, Bordetella pertussis
agcgccugggcggccac

SEQ ID NO: 2350991 - RNA, 20 nt, Bordetella pertussis
agcgccugggcggccacgua

SEQ ID NO: 2350992 - RNA, 15 nt, Bordetella pertussis
agcgccuugccgccg

SEQ ID NO: 2350993 - RNA, 15 nt, Bordetella pertussis
agcgccuugcggcgc

SEQ ID NO: 2350994 - RNA, 19 nt, Bordetella pertussis
agcgcgaaaacccgcggca

SEQ ID NO: 2350995 - RNA, 22 nt, Bordetella pertussis
agcgcgaaaugguguacagccg

SEQ ID NO: 2350996 - RNA, 16 nt, Bordetella pertussis
agcgcgaacgccugcc

SEQ ID NO: 2350997 - RNA, 16 nt, Bordetella pertussis
agcgcgaacggcgggc

SEQ ID NO: 2350998 - RNA, 13 nt, Bordetella pertussis
agcgcgacagcac

SEQ ID NO: 2350999 - RNA, 18 nt, Bordetella pertussis
agcgcgacagcaccaacu

SEQ ID NO: 2351000 - RNA, 18 nt, Bordetella pertussis
agcgcgacgaagccggaa

SEQ ID NO: 2351001 - RNA, 12 nt, Bordetella pertussis
agcgcgacgcgc

SEQ ID NO: 2351002 - RNA, 14 nt, Bordetella pertussis
agcgcgacggccuc

SEQ ID NO: 2351003 - RNA, 22 nt, Bordetella pertussis
agcgcguccaggugcggcggcg

SEQ ID NO: 2351004 - RNA, 23 nt, Bordetella pertussis
agcgcguccaggugcggcggcga

SEQ ID NO: 2351005 - RNA, 14 nt, Bordetella pertussis
agcgcgucgagcag

SEQ ID NO: 2351006 - RNA, 20 nt, Bordetella pertussis
agcgcgucgagcagcgcauc

SEQ ID NO: 2351007 - RNA, 18 nt, Bordetella pertussis
agcgcgucgagcaggccg

SEQ ID NO: 2351008 - RNA, 20 nt, Bordetella pertussis
agcgcgucgagcaggccggc

SEQ ID NO: 2351009 - RNA, 15 nt, Bordetella pertussis
agcgcgucgcacugg

SEQ ID NO: 2351010 - RNA, 14 nt, Bordetella pertussis
agcgcgucgccgcc

SEQ ID NO: 2351011 - RNA, 20 nt, Bordetella pertussis
agcgcgucgcguagcgcggc

SEQ ID NO: 2351012 - RNA, 12 nt, Bordetella pertussis
agcgcgucggcc

SEQ ID NO: 2351013 - RNA, 14 nt, Bordetella pertussis
agcgcgucggccag

SEQ ID NO: 2351014 - RNA, 17 nt, Bordetella pertussis
agcgcgucggccaggcg

SEQ ID NO: 2351015 - RNA, 19 nt, Bordetella pertussis
agcgcgucggccaggcgcc

SEQ ID NO: 2351016 - RNA, 21 nt, Bordetella pertussis
agcgcgucggccaggcgccag

SEQ ID NO: 2351017 - RNA, 14 nt, Bordetella pertussis
agcgcgucggcgcc

SEQ ID NO: 2351018 - RNA, 15 nt, Bordetella pertussis
agcgcgucggcgcgg

SEQ ID NO: 2351019 - RNA, 18 nt, Bordetella pertussis
agcgcgucguccagcgug

SEQ ID NO: 2351020 - RNA, 19 nt, Bordetella pertussis
agcgcguggaaccgccgcu

SEQ ID NO: 2351021 - RNA, 17 nt, Bordetella pertussis
agcgcguggccagcacg

SEQ ID NO: 2351022 - RNA, 15 nt, Bordetella pertussis
agcgcguggccauca

SEQ ID NO: 2351023 - RNA, 16 nt, Bordetella pertussis
agcgcguggccggcga

SEQ ID NO: 2351024 - RNA, 22 nt, Bordetella pertussis
agcgcguggccggcgacggcau

SEQ ID NO: 2351025 - RNA, 16 nt, Bordetella pertussis
agcgcgugggccagca

SEQ ID NO: 2351026 - RNA, 18 nt, Bordetella pertussis
agcgcgugucccagccgg

SEQ ID NO: 2351027 - RNA, 20 nt, Bordetella pertussis
agcgcucauguucgggcgcg

SEQ ID NO: 2351028 - RNA, 12 nt, Bordetella pertussis
agcgcuccagcg

SEQ ID NO: 2351029 - RNA, 18 nt, Bordetella pertussis
agcgcuccagcgucaugg

SEQ ID NO: 2351030 - RNA, 22 nt, Bordetella pertussis
agcgcuccagcgucauggccug

SEQ ID NO: 2351031 - RNA, 15 nt, Bordetella pertussis
agcgcucccgccaac

SEQ ID NO: 2351032 - RNA, 15 nt, Bordetella pertussis
agcgcucgccggcgc

SEQ ID NO: 2351033 - RNA, 14 nt, Bordetella pertussis
agcgcucgcgcagg

SEQ ID NO: 2351034 - RNA, 15 nt, Bordetella pertussis
agcgcucgcgcaggc

SEQ ID NO: 2351035 - RNA, 16 nt, Bordetella pertussis
agcgcucgcgcaggcg

SEQ ID NO: 2351036 - RNA, 15 nt, Bordetella pertussis
agcgcucggccacgc

SEQ ID NO: 2351037 - RNA, 18 nt, Bordetella pertussis
agcgcucgggcucgcgcg

SEQ ID NO: 2351038 - RNA, 19 nt, Bordetella pertussis
agcgcucguccaugccggc

SEQ ID NO: 2351039 - RNA, 21 nt, Bordetella pertussis
agcgcucgucgggguggaugu

SEQ ID NO: 2351040 - RNA, 14 nt, Bordetella pertussis
agcgcucuucgcgg

SEQ ID NO: 2351041 - RNA, 18 nt, Bordetella pertussis
agcgcugcaugccccaac

SEQ ID NO: 2351042 - RNA, 13 nt, Bordetella pertussis
agcgcugcgccaa

SEQ ID NO: 2351043 - RNA, 12 nt, Bordetella pertussis
agcgcugcgccg

SEQ ID NO: 2351044 - RNA, 20 nt, Bordetella pertussis
agcgcugcgccgcggcgcug

SEQ ID NO: 2351045 - RNA, 22 nt, Bordetella pertussis
agcgcuggaacguuugcggacg

SEQ ID NO: 2351046 - RNA, 17 nt, Bordetella pertussis
agcgcuggacgcccugg

SEQ ID NO: 2351047 - RNA, 21 nt, Bordetella pertussis
agcgcuggacgcccuggcgca

SEQ ID NO: 2351048 - RNA, 22 nt, Bordetella pertussis
agcgcuggacgcccuggcgcag

SEQ ID NO: 2351049 - RNA, 12 nt, Bordetella pertussis
agcgcuggaugg

SEQ ID NO: 2351050 - RNA, 20 nt, Bordetella pertussis
agcgcuggcccgucaugggc

SEQ ID NO: 2351051 - RNA, 19 nt, Bordetella pertussis
agcgcugggcgccagcagc

SEQ ID NO: 2351052 - RNA, 13 nt, Bordetella pertussis
agcgcugguucga

SEQ ID NO: 2351053 - RNA, 17 nt, Bordetella pertussis
agcgcugguucgaccug

SEQ ID NO: 2351054 - RNA, 18 nt, Bordetella pertussis
agcgcugguucgaccuga

SEQ ID NO: 2351055 - RNA, 15 nt, Bordetella pertussis
agcgcuguccaggcc

SEQ ID NO: 2351056 - RNA, 16 nt, Bordetella pertussis
agcgcuguccaggccg

SEQ ID NO: 2351057 - RNA, 17 nt, Bordetella pertussis
agcgcuguccaggccgg

SEQ ID NO: 2351058 - RNA, 21 nt, Bordetella pertussis
agcgcuucgugcagcgcgugg

SEQ ID NO: 2351059 - RNA, 15 nt, Bordetella pertussis
agcgcuugacggcca

SEQ ID NO: 2351060 - RNA, 17 nt, Bordetella pertussis
agcgcuugcacgccaua

SEQ ID NO: 2351061 - RNA, 18 nt, Bordetella pertussis
agcgcuugcacgccauag

SEQ ID NO: 2351062 - RNA, 17 nt, Bordetella pertussis
agcgcuugccugacgug

SEQ ID NO: 2351063 - RNA, 20 nt, Bordetella pertussis
agcgcuugccugacgugcgc

SEQ ID NO: 2351064 - RNA, 23 nt, Bordetella pertussis
agcgcuugccugacgugcgccac

SEQ ID NO: 2351065 - RNA, 24 nt, Bordetella pertussis
agcgcuugccugacgugcgccaca

SEQ ID NO: 2351066 - RNA, 15 nt, Bordetella pertussis
agcggaaacgcgcgc

SEQ ID NO: 2351067 - RNA, 19 nt, Bordetella pertussis
agcggaaacgcgcgcgccc

SEQ ID NO: 2351068 - RNA, 22 nt, Bordetella pertussis
agcggaaguauucgcgcggcga

SEQ ID NO: 2351069 - RNA, 13 nt, Bordetella pertussis
agcggacggcgcg

SEQ ID NO: 2351070 - RNA, 18 nt, Bordetella pertussis
aauuggcggcgaucucgc

SEQ ID NO: 2351071 - RNA, 21 nt, Bordetella pertussis
aauugggcugguaggggaugc

SEQ ID NO: 2351072 - RNA, 16 nt, Bordetella pertussis
aauuugaacagccgcc

SEQ ID NO: 2351073 - RNA, 15 nt, Bordetella pertussis
acaacaagccgggcg

SEQ ID NO: 2351074 - RNA, 22 nt, Bordetella pertussis
acaacauuggguacgacggccg

SEQ ID NO: 2351075 - RNA, 14 nt, Bordetella pertussis
acaaccaggaaaac

SEQ ID NO: 2351076 - RNA, 14 nt, Bordetella pertussis
acaaccuggcgcgc

SEQ ID NO: 2351077 - RNA, 17 nt, Bordetella pertussis
acaagccgggcgccggc

SEQ ID NO: 2351078 - RNA, 15 nt, Bordetella pertussis
acaagcgcacgcugg

SEQ ID NO: 2351079 - RNA, 17 nt, Bordetella pertussis
acaagcgcacgcugggc

SEQ ID NO: 2351080 - RNA, 19 nt, Bordetella pertussis
acaagcgcgaaauggugua

SEQ ID NO: 2351081 - RNA, 12 nt, Bordetella pertussis
acaaggcgcgcg

SEQ ID NO: 2351082 - RNA, 22 nt, Bordetella pertussis
acaaggcggccgcgcccgcaac

SEQ ID NO: 2351083 - RNA, 14 nt, Bordetella pertussis
acaauugaugcggg

SEQ ID NO: 2351084 - RNA, 17 nt, Bordetella pertussis
acacaauugaugcgggu

SEQ ID NO: 2351085 - RNA, 18 nt, Bordetella pertussis
acaccaggguggcgccgg

SEQ ID NO: 2351086 - RNA, 21 nt, Bordetella pertussis
acaccaggguggcgccggcca

SEQ ID NO: 2351087 - RNA, 22 nt, Bordetella pertussis
acaccaucaacgggccgcuggu

SEQ ID NO: 2351088 - RNA, 23 nt, Bordetella pertussis
acaccaucaagaugaacgcgauc

SEQ ID NO: 2351089 - RNA, 17 nt, Bordetella pertussis
acaccccggucagcagg

SEQ ID NO: 2351090 - RNA, 14 nt, Bordetella pertussis
acacccgcggccag

SEQ ID NO: 2351091 - RNA, 13 nt, Bordetella pertussis
acaccggcaggcc

SEQ ID NO: 2351092 - RNA, 22 nt, Bordetella pertussis
acaccggcgugcagagcaccac

SEQ ID NO: 2351093 - RNA, 15 nt, Bordetella pertussis
acaccggcuuggccu

SEQ ID NO: 2351094 - RNA, 19 nt, Bordetella pertussis
acaccgucacgcgcaaggc

SEQ ID NO: 2351095 - RNA, 22 nt, Bordetella pertussis
acaccgucacgcgcaaggcggg

SEQ ID NO: 2351096 - RNA, 14 nt, Bordetella pertussis
acaccgucgcgcgc

SEQ ID NO: 2351097 - RNA, 15 nt, Bordetella pertussis
acaccgugcuggccg

SEQ ID NO: 2351098 - RNA, 17 nt, Bordetella pertussis
acaccgugcuggccgac

SEQ ID NO: 2351099 - RNA, 20 nt, Bordetella pertussis
acaccguucccggugccagu

SEQ ID NO: 2351100 - RNA, 17 nt, Bordetella pertussis
acaccguuuuggcaggc

SEQ ID NO: 2351101 - RNA, 19 nt, Bordetella pertussis
acaccguuuuggcaggcug

SEQ ID NO: 2351102 - RNA, 21 nt, Bordetella pertussis
acaccuacauccuggaugugc

SEQ ID NO: 2351103 - RNA, 21 nt, Bordetella pertussis
acaccuuguuggcgccggccg

SEQ ID NO: 2351104 - RNA, 13 nt, Bordetella pertussis
acacgaccagcag

SEQ ID NO: 2351105 - RNA, 14 nt, Bordetella pertussis
acacgaccagcagg

SEQ ID NO: 2351106 - RNA, 16 nt, Bordetella pertussis
acacgaccagcaggcc

SEQ ID NO: 2351107 - RNA, 14 nt, Bordetella pertussis
acacgacgaaggug

SEQ ID NO: 2351108 - RNA, 18 nt, Bordetella pertussis
acacgauccacggccggc

SEQ ID NO: 2351109 - RNA, 19 nt, Bordetella pertussis
acacgcauuugcagcggcg

SEQ ID NO: 2351110 - RNA, 23 nt, Bordetella pertussis
acacgcauuugcagcggcggcac

SEQ ID NO: 2351111 - RNA, 20 nt, Bordetella pertussis
acacgccacuacacucugcc

SEQ ID NO: 2351112 - RNA, 12 nt, Bordetella pertussis
acacgcccagca

SEQ ID NO: 2351113 - RNA, 15 nt, Bordetella pertussis
acacgcccagcaggc

SEQ ID NO: 2351114 - RNA, 17 nt, Bordetella pertussis
acacgcccaugauggug

SEQ ID NO: 2351115 - RNA, 21 nt, Bordetella pertussis
acacgccgauugaggccagca

SEQ ID NO: 2351116 - RNA, 19 nt, Bordetella pertussis
agcgucggcguaaggccgc

SEQ ID NO: 2351117 - RNA, 20 nt, Bordetella pertussis
agcgucggcguaaggccgcc

SEQ ID NO: 2351118 - RNA, 22 nt, Bordetella pertussis
agcgucggcguaaggccgccgg

SEQ ID NO: 2351119 - RNA, 19 nt, Bordetella pertussis
agcgucggcuuccaucagg

SEQ ID NO: 2351120 - RNA, 16 nt, Bordetella pertussis
agcgucucgggcuggg

SEQ ID NO: 2351121 - RNA, 22 nt, Bordetella pertussis
agcgucugcgcaucgaugcggc

SEQ ID NO: 2351122 - RNA, 18 nt, Bordetella pertussis
agcgucugcugguacagc

SEQ ID NO: 2351123 - RNA, 18 nt, Bordetella pertussis
agcgugaagucggccggc

SEQ ID NO: 2351124 - RNA, 18 nt, Bordetella pertussis
agcgugaccgacaggccu

SEQ ID NO: 2351125 - RNA, 22 nt, Bordetella pertussis
agcgugaccgacaggccuggcu

SEQ ID NO: 2351126 - RNA, 16 nt, Bordetella pertussis
agcgugacggcggcgc

SEQ ID NO: 2351127 - RNA, 15 nt, Bordetella pertussis
agcgugccgccggcg

SEQ ID NO: 2351128 - RNA, 16 nt, Bordetella pertussis
agcgugccgccggcgc

SEQ ID NO: 2351129 - RNA, 15 nt, Bordetella pertussis
agcgugccgggaugc

SEQ ID NO: 2351130 - RNA, 22 nt, Bordetella pertussis
agcgugccgggaugcugcucgg

SEQ ID NO: 2351131 - RNA, 24 nt, Bordetella pertussis
agcgugccgggaugcugcucggcc

SEQ ID NO: 2351132 - RNA, 17 nt, Bordetella pertussis
agcguggagcugcucac

SEQ ID NO: 2351133 - RNA, 17 nt, Bordetella pertussis
agcguggccaccaggcg

SEQ ID NO: 2351134 - RNA, 20 nt, Bordetella pertussis
agcguggccaccaggcgcgc

SEQ ID NO: 2351135 - RNA, 23 nt, Bordetella pertussis
agcguggccgaggugcccaucag

SEQ ID NO: 2351136 - RNA, 14 nt, Bordetella pertussis
agcguggccgccac

SEQ ID NO: 2351137 - RNA, 20 nt, Bordetella pertussis
agcguggccgccaccagcgc

SEQ ID NO: 2351138 - RNA, 12 nt, Bordetella pertussis
agcguggcggcg

SEQ ID NO: 2351139 - RNA, 21 nt, Bordetella pertussis
agcguggcgguguuggcgucc

SEQ ID NO: 2351140 - RNA, 17 nt, Bordetella pertussis
agcgugggcucgaugcg

SEQ ID NO: 2351141 - RNA, 16 nt, Bordetella pertussis
agcguguagagcaggc

SEQ ID NO: 2351142 - RNA, 16 nt, Bordetella pertussis
agcguguaggcggccg

SEQ ID NO: 2351143 - RNA, 18 nt, Bordetella pertussis
agcguguaggcggccggc

SEQ ID NO: 2351144 - RNA, 19 nt, Bordetella pertussis
agcgugucgaacaccaggu

SEQ ID NO: 2351145 - RNA, 13 nt, Bordetella pertussis
agcgugugcagga

SEQ ID NO: 2351146 - RNA, 21 nt, Bordetella pertussis
agcguuccagcagaucgcggc

SEQ ID NO: 2351147 - RNA, 15 nt, Bordetella pertussis
agcguucgccgucga

SEQ ID NO: 2351148 - RNA, 20 nt, Bordetella pertussis
agcguucgcgcuugcggccg

SEQ ID NO: 2351149 - RNA, 14 nt, Bordetella pertussis
agcguucggccacc

SEQ ID NO: 2351150 - RNA, 16 nt, Bordetella pertussis
agcguuggcggccggc

SEQ ID NO: 2351151 - RNA, 19 nt, Bordetella pertussis
agcguuggcggccggccag

SEQ ID NO: 2351152 - RNA, 23 nt, Bordetella pertussis
agcguuggcggccggccagccau

SEQ ID NO: 2351153 - RNA, 17 nt, Bordetella pertussis
agcguuuccagggcgcg

SEQ ID NO: 2351154 - RNA, 18 nt, Bordetella pertussis
agcguuuccagggcgcgc

SEQ ID NO: 2351155 - RNA, 23 nt, Bordetella pertussis
agcuacccccugaccggcggcgu

SEQ ID NO: 2351156 - RNA, 12 nt, Bordetella pertussis
agcucagcagcg

SEQ ID NO: 2351157 - RNA, 14 nt, Bordetella pertussis
agcucagcagcgcc

SEQ ID NO: 2351158 - RNA, 15 nt, Bordetella pertussis
agcucauggcacagc

SEQ ID NO: 2351159 - RNA, 20 nt, Bordetella pertussis
agcucauggcacagcgcggc

SEQ ID NO: 2351160 - RNA, 23 nt, Bordetella pertussis
agcuccaccccgguguaggcggg

SEQ ID NO: 2351161 - RNA, 14 nt, Bordetella pertussis
agcuccacgcacac

SEQ ID NO: 2351162 - RNA, 13 nt, Bordetella pertussis
agcuccagccgca

SEQ ID NO: 2351163 - RNA, 22 nt, Bordetella pertussis
agcuccagcgcuucgugcagcg

SEQ ID NO: 2351164 - RNA, 13 nt, Bordetella pertussis
agcuccagcuggc

SEQ ID NO: 2351165 - RNA, 19 nt, Bordetella pertussis
agcuccagcuggcgcacca

SEQ ID NO: 2351166 - RNA, 20 nt, Bordetella pertussis
agcuccaggaaaaccuccuc

SEQ ID NO: 2351167 - RNA, 21 nt, Bordetella pertussis
agcuccaggaaaaccuccucc

SEQ ID NO: 2351168 - RNA, 15 nt, Bordetella pertussis
agcucccccacgccg

SEQ ID NO: 2351169 - RNA, 13 nt, Bordetella pertussis
agcuccggcggca

SEQ ID NO: 2351170 - RNA, 14 nt, Bordetella pertussis
agcuccggcggcag

SEQ ID NO: 2351171 - RNA, 16 nt, Bordetella pertussis
agcuccggcggcagcg

SEQ ID NO: 2351172 - RNA, 22 nt, Bordetella pertussis
agcuccucggccugccggcgcg

SEQ ID NO: 2351173 - RNA, 15 nt, Bordetella pertussis
agcuccugcucgauc

SEQ ID NO: 2351174 - RNA, 22 nt, Bordetella pertussis
agcuccugcucgauccgggcac

SEQ ID NO: 2351175 - RNA, 13 nt, Bordetella pertussis
agcuccuugacca

SEQ ID NO: 2351176 - RNA, 17 nt, Bordetella pertussis
agcuccuugaccaguuc

SEQ ID NO: 2351177 - RNA, 22 nt, Bordetella pertussis
agcucgaccacggcggcuucgg

SEQ ID NO: 2351178 - RNA, 20 nt, Bordetella pertussis
agcucgaccgucagcaugcc

SEQ ID NO: 2351179 - RNA, 13 nt, Bordetella pertussis
agcucgacgccau

SEQ ID NO: 2351180 - RNA, 15 nt, Bordetella pertussis
agcucgacgccaucu

SEQ ID NO: 2351181 - RNA, 22 nt, Bordetella pertussis
agcucgacgccaucucgcgcgc

SEQ ID NO: 2351182 - RNA, 23 nt, Bordetella pertussis
agcucgacgccaucucgcgcgcu

SEQ ID NO: 2351183 - RNA, 14 nt, Bordetella pertussis
agcucgauggcuuc

SEQ ID NO: 2351184 - RNA, 20 nt, Bordetella pertussis
agcucgauggcuucgcgcac

SEQ ID NO: 2351185 - RNA, 21 nt, Bordetella pertussis
agcucgauggcuucgcgcaca

SEQ ID NO: 2351186 - RNA, 22 nt, Bordetella pertussis
agcucgauggcuucgcgcacau

SEQ ID NO: 2351187 - RNA, 13 nt, Bordetella pertussis
agcucgccggcga

SEQ ID NO: 2351188 - RNA, 17 nt, Bordetella pertussis
agcucgccuucgcgauc

SEQ ID NO: 2351189 - RNA, 12 nt, Bordetella pertussis
agcucgcgccag

SEQ ID NO: 2351190 - RNA, 18 nt, Bordetella pertussis
agcucgcgccagggcccc

SEQ ID NO: 2351191 - RNA, 21 nt, Bordetella pertussis
agcucgcgccagggccccucc

SEQ ID NO: 2351192 - RNA, 16 nt, Bordetella pertussis
agcucgcgcgcuucga

SEQ ID NO: 2351193 - RNA, 22 nt, Bordetella pertussis
agcucgcgcugcgcgccgccgc

SEQ ID NO: 2351194 - RNA, 13 nt, Bordetella pertussis
agcucgcggcccu

SEQ ID NO: 2351195 - RNA, 23 nt, Bordetella pertussis
agcucgcguccgcucaugccggc

SEQ ID NO: 2351196 - RNA, 22 nt, Bordetella pertussis
agcucgcguugcaccgcgucgg

SEQ ID NO: 2351197 - RNA, 12 nt, Bordetella pertussis
agcucggcaugg

SEQ ID NO: 2351198 - RNA, 15 nt, Bordetella pertussis
agcucggccaaggca

SEQ ID NO: 2351199 - RNA, 22 nt, Bordetella pertussis
agcucggcccauugcggcaccu

SEQ ID NO: 2351200 - RNA, 17 nt, Bordetella pertussis
agcucggcgaagccgca

SEQ ID NO: 2351201 - RNA, 19 nt, Bordetella pertussis
agcucggcgaagccgcagc

SEQ ID NO: 2351202 - RNA, 16 nt, Bordetella pertussis
agcucggcgaccaggc

SEQ ID NO: 2351203 - RNA, 16 nt, Bordetella pertussis
agcucggcgaucugcg

SEQ ID NO: 2351204 - RNA, 15 nt, Bordetella pertussis
agcucggcggccgcc

SEQ ID NO: 2351205 - RNA, 16 nt, Bordetella pertussis
agcucggcggccgccu

SEQ ID NO: 2351206 - RNA, 18 nt, Bordetella pertussis
agcucggcggccgccugc

SEQ ID NO: 2351207 - RNA, 20 nt, Bordetella pertussis
agcucggugcagcccagcac

SEQ ID NO: 2351208 - RNA, 22 nt, Bordetella pertussis
agcucguagaucuugccggccg

SEQ ID NO: 2351209 - RNA, 14 nt, Bordetella pertussis
agcucgucgccgcu

SEQ ID NO: 2351210 - RNA, 20 nt, Bordetella pertussis
agcucgucgccgcuggacag

SEQ ID NO: 2351211 - RNA, 20 nt, Bordetella pertussis
agcucgucggucagcucaag

SEQ ID NO: 2351212 - RNA, 18 nt, Bordetella pertussis
agcucguggcgcgccucc

SEQ ID NO: 2351213 - RNA, 19 nt, Bordetella pertussis
agcucguguagggccuggc

SEQ ID NO: 2351214 - RNA, 22 nt, Bordetella pertussis
agcucguguagggccuggcgua

SEQ ID NO: 2351215 - RNA, 16 nt, Bordetella pertussis
agcucguugaccugcu

SEQ ID NO: 2351216 - RNA, 19 nt, Bordetella pertussis
agcucuaugucgccggcca

SEQ ID NO: 2351217 - RNA, 20 nt, Bordetella pertussis
agcucuaugucgccggccag

SEQ ID NO: 2351218 - RNA, 22 nt, Bordetella pertussis
agcucucgaagaagcagccgcg

SEQ ID NO: 2351219 - RNA, 16 nt, Bordetella pertussis
agcucugguccaggcg

SEQ ID NO: 2351220 - RNA, 20 nt, Bordetella pertussis
agcucugguccaggcggugc

SEQ ID NO: 2351221 - RNA, 22 nt, Bordetella pertussis
agcucugguccaggcggugcgu

SEQ ID NO: 2351222 - RNA, 21 nt, Bordetella pertussis
agcucuuucuguaccagcaug

SEQ ID NO: 2351223 - RNA, 22 nt, Bordetella pertussis
agcucuuucuguaccagcaugu

SEQ ID NO: 2351224 - RNA, 14 nt, Bordetella pertussis
agcugaugcucgcc

SEQ ID NO: 2351225 - RNA, 20 nt, Bordetella pertussis
agcugcacaagguccguuuc

SEQ ID NO: 2351226 - RNA, 16 nt, Bordetella pertussis
agcugcacccacacuu

SEQ ID NO: 2351227 - RNA, 22 nt, Bordetella pertussis
agcugcaguaugcaaccggcac

SEQ ID NO: 2351228 - RNA, 16 nt, Bordetella pertussis
aggaagcgcgccgcgc

SEQ ID NO: 2351229 - RNA, 19 nt, Bordetella pertussis
aggaagcgcgccgcgcgca

SEQ ID NO: 2351230 - RNA, 18 nt, Bordetella pertussis
aggaagcgcuggcccguc

SEQ ID NO: 2351231 - RNA, 13 nt, Bordetella pertussis
aggaaggcccggu

SEQ ID NO: 2351232 - RNA, 19 nt, Bordetella pertussis
aggaaguccugguuggccu

SEQ ID NO: 2351233 - RNA, 14 nt, Bordetella pertussis
aggaagucggucag

SEQ ID NO: 2351234 - RNA, 19 nt, Bordetella pertussis
aggaaguggccgagcgcac

SEQ ID NO: 2351235 - RNA, 17 nt, Bordetella pertussis
aggaauccuggugccag

SEQ ID NO: 2351236 - RNA, 19 nt, Bordetella pertussis
aggaauuccucgcggcugu

SEQ ID NO: 2351237 - RNA, 14 nt, Bordetella pertussis
aggacaaggcgcgc

SEQ ID NO: 2351238 - RNA, 21 nt, Bordetella pertussis
aggacaaggcgcguaugacgc

SEQ ID NO: 2351239 - RNA, 17 nt, Bordetella pertussis
aggacaccaugauggcc

SEQ ID NO: 2351240 - RNA, 21 nt, Bordetella pertussis
aggacaccaugauggccgcgc

SEQ ID NO: 2351241 - RNA, 12 nt, Bordetella pertussis
aggacacgcagc

SEQ ID NO: 2351242 - RNA, 13 nt, Bordetella pertussis
aggaccccgaagc

SEQ ID NO: 2351243 - RNA, 20 nt, Bordetella pertussis
aggaccgaggugccagccug

SEQ ID NO: 2351244 - RNA, 20 nt, Bordetella pertussis
aggaccgcgaugcugcgcaa

SEQ ID NO: 2351245 - RNA, 23 nt, Bordetella pertussis
aggaccgcgccgccgcgcccugg

SEQ ID NO: 2351246 - RNA, 14 nt, Bordetella pertussis
aggaccucgcgccg

SEQ ID NO: 2351247 - RNA, 18 nt, Bordetella pertussis
aggaccucgcgccgguca

SEQ ID NO: 2351248 - RNA, 13 nt, Bordetella pertussis
aggaccugcuggc

SEQ ID NO: 2351249 - RNA, 18 nt, Bordetella pertussis
aggaccuguggcgcaccc

SEQ ID NO: 2351250 - RNA, 20 nt, Bordetella pertussis
aggacgaacaggccgccgua

SEQ ID NO: 2351251 - RNA, 22 nt, Bordetella pertussis
aggacgaccaacucgaggcggc

SEQ ID NO: 2351252 - RNA, 11 nt, Bordetella pertussis
aggacgacgau

SEQ ID NO: 2351253 - RNA, 15 nt, Bordetella pertussis
aggacgagcggguga

SEQ ID NO: 2351254 - RNA, 17 nt, Bordetella pertussis
aggacgaucccggccac

SEQ ID NO: 2351255 - RNA, 22 nt, Bordetella pertussis
aggacgccaccagugcgccggc

SEQ ID NO: 2351256 - RNA, 23 nt, Bordetella pertussis
aggacgccgaccucggcaccgag

SEQ ID NO: 2351257 - RNA, 11 nt, Bordetella pertussis
aggacgccggc

SEQ ID NO: 2351258 - RNA, 12 nt, Bordetella pertussis
aggacgccggcg

SEQ ID NO: 2351259 - RNA, 13 nt, Bordetella pertussis
aggacgccggcgc

SEQ ID NO: 2351260 - RNA, 14 nt, Bordetella pertussis
aggacgccggcgcc

SEQ ID NO: 2351261 - RNA, 16 nt, Bordetella pertussis
aggacgccggcgccgg

SEQ ID NO: 2351262 - RNA, 16 nt, Bordetella pertussis
aggacgcguccucggc

SEQ ID NO: 2351263 - RNA, 20 nt, Bordetella pertussis
aggacgcguccucggccagc

SEQ ID NO: 2351264 - RNA, 15 nt, Bordetella pertussis
aggacggcagcaccg

SEQ ID NO: 2351265 - RNA, 13 nt, Bordetella pertussis
aggacggcgccgu

SEQ ID NO: 2351266 - RNA, 14 nt, Bordetella pertussis
aggacggcgccguc

SEQ ID NO: 2351267 - RNA, 21 nt, Bordetella pertussis
aggacggcgccguccgcaucg

SEQ ID NO: 2351268 - RNA, 20 nt, Bordetella pertussis
aggacggggaacaggcgcgc

SEQ ID NO: 2351269 - RNA, 16 nt, Bordetella pertussis
aggacguuuugcggga

SEQ ID NO: 2351270 - RNA, 22 nt, Bordetella pertussis
aggacuaagaugaaucgcaugc

SEQ ID NO: 2351271 - RNA, 21 nt, Bordetella pertussis
aggagacggucaccgcgccca

SEQ ID NO: 2351272 - RNA, 17 nt, Bordetella pertussis
aggagcaacuggggcgc

SEQ ID NO: 2351273 - RNA, 15 nt, Bordetella pertussis
aggagccggcgggcg

SEQ ID NO: 2351274 - RNA, 15 nt, Bordetella pertussis
aggagccuguccccg

SEQ ID NO: 2351275 - RNA, 22 nt, Bordetella pertussis
aggaggaacaggaugcgcaugg

SEQ ID NO: 2351276 - RNA, 20 nt, Bordetella pertussis
aggaggauaagccgugaaga

SEQ ID NO: 2351277 - RNA, 15 nt, Bordetella pertussis
aggaggugcgccgcu

SEQ ID NO: 2351278 - RNA, 23 nt, Bordetella pertussis
aggagguggcuggugccaguccc

SEQ ID NO: 2351279 - RNA, 18 nt, Bordetella pertussis
aggauacgugcugcagga

SEQ ID NO: 2351280 - RNA, 13 nt, Bordetella pertussis
aggauaucggcca

SEQ ID NO: 2351281 - RNA, 15 nt, Bordetella pertussis
aggaucaaggcccgg

SEQ ID NO: 2351282 - RNA, 18 nt, Bordetella pertussis
aggaucaccgccgcgccg

SEQ ID NO: 2351283 - RNA, 20 nt, Bordetella pertussis
aggaucaccgccgcgccgcu

SEQ ID NO: 2351284 - RNA, 23 nt, Bordetella pertussis
aggaucaggaagacuuccgugcc

SEQ ID NO: 2351285 - RNA, 19 nt, Bordetella pertussis
aggaucaggccggcgaugg

SEQ ID NO: 2351286 - RNA, 20 nt, Bordetella pertussis
aggauccagccaccaugucc

SEQ ID NO: 2351287 - RNA, 14 nt, Bordetella pertussis
aggaucccggcgcc

SEQ ID NO: 2351288 - RNA, 22 nt, Bordetella pertussis
aggaucccuacgaguaccgccg

SEQ ID NO: 2351289 - RNA, 16 nt, Bordetella pertussis
aggaucgcggccagcc

SEQ ID NO: 2351290 - RNA, 16 nt, Bordetella pertussis
aggaucuggccggcgc

SEQ ID NO: 2351291 - RNA, 17 nt, Bordetella pertussis
aggaucuggccggcgcu

SEQ ID NO: 2351292 - RNA, 11 nt, Bordetella pertussis
aggaugaugag

SEQ ID NO: 2351293 - RNA, 15 nt, Bordetella pertussis
aggaugaugcagcac

SEQ ID NO: 2351294 - RNA, 11 nt, Bordetella pertussis
aggaugcccuu

SEQ ID NO: 2351295 - RNA, 19 nt, Bordetella pertussis
aggaugcccuuggcggcga

SEQ ID NO: 2351296 - RNA, 18 nt, Bordetella pertussis
aggaugcgcaccggccag

SEQ ID NO: 2351297 - RNA, 15 nt, Bordetella pertussis
aggaugcgcgccagg

SEQ ID NO: 2351298 - RNA, 13 nt, Bordetella pertussis
aggauggacuggc

SEQ ID NO: 2351299 - RNA, 13 nt, Bordetella pertussis
aggauggcgaggu

SEQ ID NO: 2351300 - RNA, 12 nt, Bordetella pertussis
aggauggcgucg

SEQ ID NO: 2351301 - RNA, 18 nt, Bordetella pertussis
aggauggcgucgaccgcc

SEQ ID NO: 2351302 - RNA, 14 nt, Bordetella pertussis
aggaugggcagcuc

SEQ ID NO: 2351303 - RNA, 16 nt, Bordetella pertussis
aggaugggcgcggcgc

SEQ ID NO: 2351304 - RNA, 22 nt, Bordetella pertussis
aggauguccacggucgccggca

SEQ ID NO: 2351305 - RNA, 23 nt, Bordetella pertussis
aggauguucaugaccgccgcgcc

SEQ ID NO: 2351306 - RNA, 21 nt, Bordetella pertussis
aggauuccugcgaggacaggg

SEQ ID NO: 2351307 - RNA, 23 nt, Bordetella pertussis
aggauuccugcgaggacaggggc

SEQ ID NO: 2351308 - RNA, 16 nt, Bordetella pertussis
aggauuucaccuaccu

SEQ ID NO: 2351309 - RNA, 14 nt, Bordetella pertussis
aggcaaagcgcagc

SEQ ID NO: 2351310 - RNA, 15 nt, Bordetella pertussis
aggcaaaggcccagg

SEQ ID NO: 2351311 - RNA, 18 nt, Bordetella pertussis
aggcaagcugcuggcgcg

SEQ ID NO: 2351312 - RNA, 22 nt, Bordetella pertussis
aggcaagcugcuggcgcgccag

SEQ ID NO: 2351313 - RNA, 14 nt, Bordetella pertussis
aggcaaucagcccg

SEQ ID NO: 2351314 - RNA, 21 nt, Bordetella pertussis
aggcaaucgaugaucacgcgc

SEQ ID NO: 2351315 - RNA, 14 nt, Bordetella pertussis
aggcacaaggccga

SEQ ID NO: 2351316 - RNA, 15 nt, Bordetella pertussis
aggcacaccacgcga

SEQ ID NO: 2351317 - RNA, 22 nt, Bordetella pertussis
aggcacaccggucuacgccaug

SEQ ID NO: 2351318 - RNA, 19 nt, Bordetella pertussis
aggcacaccgugccgcaga

SEQ ID NO: 2351319 - RNA, 20 nt, Bordetella pertussis
aggcacaccgugccgcagau

SEQ ID NO: 2351320 - RNA, 20 nt, Bordetella pertussis
aggcacaggaacagccugcc

SEQ ID NO: 2351321 - RNA, 23 nt, Bordetella pertussis
aggcacauugccguacgccaucg

SEQ ID NO: 2351322 - RNA, 20 nt, Bordetella pertussis
aggcacccagggguuacagc

SEQ ID NO: 2351323 - RNA, 18 nt, Bordetella pertussis
aggcacccccgaccgagc

SEQ ID NO: 2351324 - RNA, 21 nt, Bordetella pertussis
aggcacccccgaccgagccac

SEQ ID NO: 2351325 - RNA, 15 nt, Bordetella pertussis
aggcaccccggcgcc

SEQ ID NO: 2351326 - RNA, 21 nt, Bordetella pertussis
aggcaccccgucaugcgccau

SEQ ID NO: 2351327 - RNA, 15 nt, Bordetella pertussis
aggcaccccgucguc

SEQ ID NO: 2351328 - RNA, 23 nt, Bordetella pertussis
aggcacccgcacgggcagacgcc

SEQ ID NO: 2351329 - RNA, 14 nt, Bordetella pertussis
aggcacccgcgcgc

SEQ ID NO: 2351330 - RNA, 14 nt, Bordetella pertussis
aggcacccugcccc

SEQ ID NO: 2351331 - RNA, 23 nt, Bordetella pertussis
aggcacccugccgugggacaggc

SEQ ID NO: 2351332 - RNA, 13 nt, Bordetella pertussis
aggcacccuugcc

SEQ ID NO: 2351333 - RNA, 21 nt, Bordetella pertussis
aggcaccugcgaccgagccac

SEQ ID NO: 2351334 - RNA, 21 nt, Bordetella pertussis
aggcaccugcggugucccucg

SEQ ID NO: 2351335 - RNA, 22 nt, Bordetella pertussis
aggcacgacgcgaaccaggcca

SEQ ID NO: 2351336 - RNA, 14 nt, Bordetella pertussis
aggcacgccggggu

SEQ ID NO: 2351337 - RNA, 19 nt, Bordetella pertussis
aggcacuccggauaccgcc

SEQ ID NO: 2351338 - RNA, 21 nt, Bordetella pertussis
aggcacuccggauaccgccgc

SEQ ID NO: 2351339 - RNA, 13 nt, Bordetella pertussis
aggcacuggcgcg

SEQ ID NO: 2351340 - RNA, 16 nt, Bordetella pertussis
aggcacuggcgcggcg

SEQ ID NO: 2351341 - RNA, 17 nt, Bordetella pertussis
aggcagacgaugcccag

SEQ ID NO: 2351342 - RNA, 23 nt, Bordetella pertussis
aggcagcaaccggaacaccagca

SEQ ID NO: 2351343 - RNA, 18 nt, Bordetella pertussis
aggcagcaggcugccgcc

SEQ ID NO: 2351344 - RNA, 22 nt, Bordetella pertussis
aggcagcaggcugccgccggcg

SEQ ID NO: 2351345 - RNA, 12 nt, Bordetella pertussis
aggcagccggcc

SEQ ID NO: 2351346 - RNA, 13 nt, Bordetella pertussis
aggcagccggccc

SEQ ID NO: 2351347 - RNA, 17 nt, Bordetella pertussis
aggcagcgcggccggca

SEQ ID NO: 2351348 - RNA, 13 nt, Bordetella pertussis
aggcagcggccgc

SEQ ID NO: 2351349 - RNA, 15 nt, Bordetella pertussis
aggcagcggccgcgc

SEQ ID NO: 2351350 - RNA, 16 nt, Bordetella pertussis
aggcagcggccgcgcg

SEQ ID NO: 2351351 - RNA, 13 nt, Bordetella pertussis
aggcaggcgcgcc

SEQ ID NO: 2351352 - RNA, 21 nt, Bordetella pertussis
aggcaggcgcgccgggccggc

SEQ ID NO: 2351353 - RNA, 20 nt, Bordetella pertussis
aggcaggcgggcccgcaucg

SEQ ID NO: 2351354 - RNA, 20 nt, Bordetella pertussis
aggcaggggcuccaggaaca

SEQ ID NO: 2351355 - RNA, 16 nt, Bordetella pertussis
aggcaguuggcggcgc

SEQ ID NO: 2351356 - RNA, 18 nt, Bordetella pertussis
aggcaguuggcggcgcag

SEQ ID NO: 2351357 - RNA, 23 nt, Bordetella pertussis
aggcaguuggcggcgcagccgcc

SEQ ID NO: 2351358 - RNA, 19 nt, Bordetella pertussis
aggcauacaggcuguggcc

SEQ ID NO: 2351359 - RNA, 21 nt, Bordetella pertussis
aggcauacaggcuguggccgc

SEQ ID NO: 2351360 - RNA, 15 nt, Bordetella pertussis
aggcaucgaccagcg

SEQ ID NO: 2351361 - RNA, 17 nt, Bordetella pertussis
aggcaucgaccagcgca

SEQ ID NO: 2351362 - RNA, 19 nt, Bordetella pertussis
aggcaucgaccagcgcacg

SEQ ID NO: 2351363 - RNA, 15 nt, Bordetella pertussis
aggcaugcgccagcg

SEQ ID NO: 2351364 - RNA, 23 nt, Bordetella pertussis
aggcauucgaacaacagcgccug

SEQ ID NO: 2351365 - RNA, 20 nt, Bordetella pertussis
aggcauucgugaugccccag

SEQ ID NO: 2351366 - RNA, 21 nt, Bordetella pertussis
aggcauucgugaugccccagg

SEQ ID NO: 2351367 - RNA, 19 nt, Bordetella pertussis
aggcauugaagcuggcgcc

SEQ ID NO: 2351368 - RNA, 17 nt, Bordetella pertussis
aggcauuggcgccgcgc

SEQ ID NO: 2351369 - RNA, 18 nt, Bordetella pertussis
aggccaaaaaaaaccggc

SEQ ID NO: 2351370 - RNA, 23 nt, Bordetella pertussis
aggccaccccguugcagcccagc

SEQ ID NO: 2351371 - RNA, 21 nt, Bordetella pertussis
aggccaccgcggugccgcgcg

SEQ ID NO: 2351372 - RNA, 19 nt, Bordetella pertussis
aggccacgaugauggaggc

SEQ ID NO: 2351373 - RNA, 16 nt, Bordetella pertussis
aggccagcacgccggc

SEQ ID NO: 2351374 - RNA, 17 nt, Bordetella pertussis
aggccagcacgccggcc

SEQ ID NO: 2351375 - RNA, 12 nt, Bordetella pertussis
aggccagcagcu

SEQ ID NO: 2351376 - RNA, 18 nt, Bordetella pertussis
aggccagcagcucggcca

SEQ ID NO: 2351377 - RNA, 14 nt, Bordetella pertussis
aggccagcccgcgc

SEQ ID NO: 2351378 - RNA, 16 nt, Bordetella pertussis
aggccagcccgcgcgc

SEQ ID NO: 2351379 - RNA, 12 nt, Bordetella pertussis
aggccagcggcg

SEQ ID NO: 2351380 - RNA, 16 nt, Bordetella pertussis
aggccagcgugcccag

SEQ ID NO: 2351381 - RNA, 18 nt, Bordetella pertussis
aggccagcgugcccagcg

SEQ ID NO: 2351382 - RNA, 16 nt, Bordetella pertussis
aggccaggaagcggcg

SEQ ID NO: 2351383 - RNA, 15 nt, Bordetella pertussis
aggccaggcccucgc

SEQ ID NO: 2351384 - RNA, 14 nt, Bordetella pertussis
aggccaggcucagc

SEQ ID NO: 2351385 - RNA, 14 nt, Bordetella pertussis
aggccaggcugacc

SEQ ID NO: 2351386 - RNA, 19 nt, Bordetella pertussis
aggccagggagugcgagga

SEQ ID NO: 2351387 - RNA, 19 nt, Bordetella pertussis
aggccagugccuggacgcg

SEQ ID NO: 2351388 - RNA, 19 nt, Bordetella pertussis
aggccaguuccgugcgcgc

SEQ ID NO: 2351389 - RNA, 12 nt, Bordetella pertussis
aggccaucggcg

SEQ ID NO: 2351390 - RNA, 23 nt, Bordetella pertussis
aggccaucggcgccaagcggcag

SEQ ID NO: 2351391 - RNA, 18 nt, Bordetella pertussis
aggccaugaucaggccga

SEQ ID NO: 2351392 - RNA, 20 nt, Bordetella pertussis
aggcccacaaugccccacgg

SEQ ID NO: 2351393 - RNA, 15 nt, Bordetella pertussis
aggcccaccggcaug

SEQ ID NO: 2351394 - RNA, 14 nt, Bordetella pertussis
aggcccagccagcg

SEQ ID NO: 2351395 - RNA, 17 nt, Bordetella pertussis
aggcccagcccgccgau

SEQ ID NO: 2351396 - RNA, 16 nt, Bordetella pertussis
aggcccagcgccagca

SEQ ID NO: 2351397 - RNA, 14 nt, Bordetella pertussis
aggcccagcgcgcc

SEQ ID NO: 2351398 - RNA, 16 nt, Bordetella pertussis
aggcccagcgcgccau

SEQ ID NO: 2351399 - RNA, 23 nt, Bordetella pertussis
aggcccagcgcgccauacugcca

SEQ ID NO: 2351400 - RNA, 22 nt, Bordetella pertussis
aggcccagcuugaacaggcagu

SEQ ID NO: 2351401 - RNA, 20 nt, Bordetella pertussis
aggcccaggcgacccagcac

SEQ ID NO: 2351402 - RNA, 16 nt, Bordetella pertussis
aggcccagggccaggu

SEQ ID NO: 2351403 - RNA, 22 nt, Bordetella pertussis
aggcccagggcgaugcgguacc

SEQ ID NO: 2351404 - RNA, 20 nt, Bordetella pertussis
aggcccaguucggcgcgcgu

SEQ ID NO: 2351405 - RNA, 21 nt, Bordetella pertussis
aggcccauaugccgccggccu

SEQ ID NO: 2351406 - RNA, 15 nt, Bordetella pertussis
aggcccaugaaggcg

SEQ ID NO: 2351407 - RNA, 17 nt, Bordetella pertussis
aggcccaugccgcggac

SEQ ID NO: 2351408 - RNA, 20 nt, Bordetella pertussis
aggccccgccgggccgcgcc

SEQ ID NO: 2351409 - RNA, 23 nt, Bordetella pertussis
aggccccgccgggccgcgcccac

SEQ ID NO: 2351410 - RNA, 15 nt, Bordetella pertussis
aggccccgcgaccca

SEQ ID NO: 2351411 - RNA, 23 nt, Bordetella pertussis
aggcccgaaacgcgcagcaccgg

SEQ ID NO: 2351412 - RNA, 15 nt, Bordetella pertussis
aggcccgacaggauc

SEQ ID NO: 2351413 - RNA, 12 nt, Bordetella pertussis
aggcccgcccgg

SEQ ID NO: 2351414 - RNA, 15 nt, Bordetella pertussis
aggcccgcccggggu

SEQ ID NO: 2351415 - RNA, 17 nt, Bordetella pertussis
aggcccgcccgggguug

SEQ ID NO: 2351416 - RNA, 18 nt, Bordetella pertussis
aggcccgccgcggcaggc

SEQ ID NO: 2351417 - RNA, 19 nt, Bordetella pertussis
aggcccgcgcggccagcgc

SEQ ID NO: 2351418 - RNA, 15 nt, Bordetella pertussis
aggcccgcggccgcg

SEQ ID NO: 2351419 - RNA, 15 nt, Bordetella pertussis
aggcccgcggcgcca

SEQ ID NO: 2351420 - RNA, 16 nt, Bordetella pertussis
aggcccgcggcgccag

SEQ ID NO: 2351421 - RNA, 19 nt, Bordetella pertussis
aggcccgcggcgccagcgc

SEQ ID NO: 2351422 - RNA, 21 nt, Bordetella pertussis
aggcccgcggcgccagcgcuu

SEQ ID NO: 2351423 - RNA, 13 nt, Bordetella pertussis
aggcccggccgca

SEQ ID NO: 2351424 - RNA, 17 nt, Bordetella pertussis
aggcccggccgcagggc

SEQ ID NO: 2351425 - RNA, 12 nt, Bordetella pertussis
aggcccggcgcg

SEQ ID NO: 2351426 - RNA, 14 nt, Bordetella pertussis
aggcccgggcgccu

SEQ ID NO: 2351427 - RNA, 18 nt, Bordetella pertussis
aggcccgggcgccugcgc

SEQ ID NO: 2351428 - RNA, 18 nt, Bordetella pertussis
aggcccgugcuccagaac

SEQ ID NO: 2351429 - RNA, 14 nt, Bordetella pertussis
aggcccugccgccu

SEQ ID NO: 2351430 - RNA, 23 nt, Bordetella pertussis
aggcccugcgcguugagcagcau

SEQ ID NO: 2351431 - RNA, 12 nt, Bordetella pertussis
aggcccuggcgg

SEQ ID NO: 2351432 - RNA, 15 nt, Bordetella pertussis
aggcccuggcggcgc

SEQ ID NO: 2351433 - RNA, 20 nt, Bordetella pertussis
aggcccuggcuggccagccg

SEQ ID NO: 2351434 - RNA, 17 nt, Bordetella pertussis
aggcccuugaucaggcg

SEQ ID NO: 2351435 - RNA, 18 nt, Bordetella pertussis
aggccgaaauggcggcgg

SEQ ID NO: 2351436 - RNA, 10 nt, Bordetella pertussis
aggccgaacc

SEQ ID NO: 2351437 - RNA, 16 nt, Bordetella pertussis
aggccgaaccacagca

SEQ ID NO: 2351438 - RNA, 20 nt, Bordetella pertussis
aggccgaacuucagcccggg

SEQ ID NO: 2351439 - RNA, 17 nt, Bordetella pertussis
aggccgaauugccgccg

SEQ ID NO: 2351440 - RNA, 15 nt, Bordetella pertussis
aggccgaccaugugg

SEQ ID NO: 2351441 - RNA, 15 nt, Bordetella pertussis
aggccgacuggauga

SEQ ID NO: 2351442 - RNA, 19 nt, Bordetella pertussis
aggccgagccauugucggu

SEQ ID NO: 2351443 - RNA, 13 nt, Bordetella pertussis
aggccgagcgcga

SEQ ID NO: 2351444 - RNA, 15 nt, Bordetella pertussis
aggccgagcgcgagc

SEQ ID NO: 2351445 - RNA, 13 nt, Bordetella pertussis
aggccgaggccag

SEQ ID NO: 2351446 - RNA, 15 nt, Bordetella pertussis
aggccgaggccaggu

SEQ ID NO: 2351447 - RNA, 18 nt, Bordetella pertussis
aggccgaguagcggcgca

SEQ ID NO: 2351448 - RNA, 15 nt, Bordetella pertussis
aggccgaguggccgc

SEQ ID NO: 2351449 - RNA, 17 nt, Bordetella pertussis
aggccgauagcguucga

SEQ ID NO: 2351450 - RNA, 16 nt, Bordetella pertussis
aggccgauauugcggu

SEQ ID NO: 2351451 - RNA, 14 nt, Bordetella pertussis
aggccgaucagcac

SEQ ID NO: 2351452 - RNA, 18 nt, Bordetella pertussis
aggccgaucagcgacagc

SEQ ID NO: 2351453 - RNA, 16 nt, Bordetella pertussis
aggccgaugaauugcg

SEQ ID NO: 2351454 - RNA, 18 nt, Bordetella pertussis
aggcgaaccuggcggggu

SEQ ID NO: 2351455 - RNA, 15 nt, Bordetella pertussis
aggcgaauccgcaac

SEQ ID NO: 2351456 - RNA, 19 nt, Bordetella pertussis
aggcgaccggcaccugggc

SEQ ID NO: 2351457 - RNA, 15 nt, Bordetella pertussis
aggcgagcaggucca

SEQ ID NO: 2351458 - RNA, 19 nt, Bordetella pertussis
aggcgagcagguccauggc

SEQ ID NO: 2351459 - RNA, 14 nt, Bordetella pertussis
aggcgagcgccgcg

SEQ ID NO: 2351460 - RNA, 23 nt, Bordetella pertussis
aggcgagcgccgcgcuccagggc

SEQ ID NO: 2351461 - RNA, 13 nt, Bordetella pertussis
aggcgaggcuggc

SEQ ID NO: 2351462 - RNA, 22 nt, Bordetella pertussis
aggcgaggcuggcgcccacgca

SEQ ID NO: 2351463 - RNA, 14 nt, Bordetella pertussis
aggcgauccaggcc

SEQ ID NO: 2351464 - RNA, 15 nt, Bordetella pertussis
aggcgauccaggcca

SEQ ID NO: 2351465 - RNA, 16 nt, Bordetella pertussis
aggcgauccaggccac

SEQ ID NO: 2351466 - RNA, 14 nt, Bordetella pertussis
aggcgaucugcggc

SEQ ID NO: 2351467 - RNA, 18 nt, Bordetella pertussis
aggcgaugcccagcgccg

SEQ ID NO: 2351468 - RNA, 23 nt, Bordetella pertussis
aggcgauggccgggagcggccag

SEQ ID NO: 2351469 - RNA, 23 nt, Bordetella pertussis
aggcgaugggcaccugcuugagc

SEQ ID NO: 2351470 - RNA, 17 nt, Bordetella pertussis
aggcgcaccagcgcgcc

SEQ ID NO: 2351471 - RNA, 21 nt, Bordetella pertussis
aggcgcaccucguaaguggcg

SEQ ID NO: 2351472 - RNA, 18 nt, Bordetella pertussis
aggcgcagcaggccagga

SEQ ID NO: 2351473 - RNA, 14 nt, Bordetella pertussis
aggcgcagccgcgc

SEQ ID NO: 2351474 - RNA, 14 nt, Bordetella pertussis
aggcgcagcgcggc

SEQ ID NO: 2351475 - RNA, 16 nt, Bordetella pertussis
aggcgcagcgcggcac

SEQ ID NO: 2351476 - RNA, 18 nt, Bordetella pertussis
aggcgcagcggcggcgcg

SEQ ID NO: 2351477 - RNA, 19 nt, Bordetella pertussis
aggcgcagcggcggcgcgg

SEQ ID NO: 2351478 - RNA, 14 nt, Bordetella pertussis
aggcgcaggccgac

SEQ ID NO: 2351479 - RNA, 15 nt, Bordetella pertussis
aggcgcaggccgcgc

SEQ ID NO: 2351480 - RNA, 18 nt, Bordetella pertussis
aggcgcaggccgcgcgca

SEQ ID NO: 2351481 - RNA, 19 nt, Bordetella pertussis
aggcgcaggcgcgagacga

SEQ ID NO: 2351482 - RNA, 19 nt, Bordetella pertussis
aggcgcaguaucuggugcg

SEQ ID NO: 2351483 - RNA, 19 nt, Bordetella pertussis
aggcgcaucgacagcgcgc

SEQ ID NO: 2351484 - RNA, 20 nt, Bordetella pertussis
aggcgcaucgacagcgcgcc

SEQ ID NO: 2351485 - RNA, 21 nt, Bordetella pertussis
aggcgcaucgacagcgcgccc

SEQ ID NO: 2351486 - RNA, 23 nt, Bordetella pertussis
aggcgcauggugagggccacgcg

SEQ ID NO: 2351487 - RNA, 16 nt, Bordetella pertussis
aggcgcauucgcgccu

SEQ ID NO: 2351488 - RNA, 18 nt, Bordetella pertussis
aggcgcauucgcgccuga

SEQ ID NO: 2351489 - RNA, 19 nt, Bordetella pertussis
aggcgcauucgcgccugag

SEQ ID NO: 2351490 - RNA, 21 nt, Bordetella pertussis
aggcgcauucgcgccugagcu

SEQ ID NO: 2351491 - RNA, 19 nt, Bordetella pertussis
aggcgccagaugcgccgca

SEQ ID NO: 2351492 - RNA, 20 nt, Bordetella pertussis
aggcgccagaugcgccgcac

SEQ ID NO: 2351493 - RNA, 12 nt, Bordetella pertussis
aggcgccccagg

SEQ ID NO: 2351494 - RNA, 15 nt, Bordetella pertussis
aggcgcccgccacca

SEQ ID NO: 2351495 - RNA, 14 nt, Bordetella pertussis
aggcgcccggcgug

SEQ ID NO: 2351496 - RNA, 16 nt, Bordetella pertussis
aggcgcccggcgugac

SEQ ID NO: 2351497 - RNA, 14 nt, Bordetella pertussis
aggcgccgacggcg

SEQ ID NO: 2351498 - RNA, 15 nt, Bordetella pertussis
aggcgccgcaacagg

SEQ ID NO: 2351499 - RNA, 18 nt, Bordetella pertussis
aggcgccgcaacaggcag

SEQ ID NO: 2351500 - RNA, 12 nt, Bordetella pertussis
aggcgccgcaga

SEQ ID NO: 2351501 - RNA, 18 nt, Bordetella pertussis
aggcgccgccccgucauc

SEQ ID NO: 2351502 - RNA, 12 nt, Bordetella pertussis
aggcgccgccgc

SEQ ID NO: 2351503 - RNA, 16 nt, Bordetella pertussis
aggcgccgccgcccgg

SEQ ID NO: 2351504 - RNA, 18 nt, Bordetella pertussis
aggcgccgccgcccggca

SEQ ID NO: 2351505 - RNA, 20 nt, Bordetella pertussis
aggcgccgccgcccggcaac

SEQ ID NO: 2351506 - RNA, 21 nt, Bordetella pertussis
aggcgccgccgugcgcgggcg

SEQ ID NO: 2351507 - RNA, 12 nt, Bordetella pertussis
aggcgccgcgcc

SEQ ID NO: 2351508 - RNA, 19 nt, Bordetella pertussis
aggcgccgcgcccguccac

SEQ ID NO: 2351509 - RNA, 21 nt, Bordetella pertussis
aggcgccgcgcccguccacgg

SEQ ID NO: 2351510 - RNA, 22 nt, Bordetella pertussis
aggcgccgcggaggcgaaauac

SEQ ID NO: 2351511 - RNA, 19 nt, Bordetella pertussis
aggcgccgcguccggcgcc

SEQ ID NO: 2351512 - RNA, 13 nt, Bordetella pertussis
aggcgccggccag

SEQ ID NO: 2351513 - RNA, 14 nt, Bordetella pertussis
aggcgccggccagg

SEQ ID NO: 2351514 - RNA, 16 nt, Bordetella pertussis
aggcgccggccaggcc

SEQ ID NO: 2351515 - RNA, 22 nt, Bordetella pertussis
aggcgccggcgccgggcagccc

SEQ ID NO: 2351516 - RNA, 22 nt, Bordetella pertussis
aggcgccggcuggcaugcggcg

SEQ ID NO: 2351517 - RNA, 21 nt, Bordetella pertussis
aggcgccgggccgcuaggccu

SEQ ID NO: 2351518 - RNA, 20 nt, Bordetella pertussis
aggcgccgguccagcgcccg

SEQ ID NO: 2351519 - RNA, 22 nt, Bordetella pertussis
aggcgccgguccagcgcccgaa

SEQ ID NO: 2351520 - RNA, 12 nt, Bordetella pertussis
aggcgccgucga

SEQ ID NO: 2351521 - RNA, 19 nt, Bordetella pertussis
aggcgccucgcgacggccu

SEQ ID NO: 2351522 - RNA, 23 nt, Bordetella pertussis
aggcgccugagccgauacaggcg

SEQ ID NO: 2351523 - RNA, 19 nt, Bordetella pertussis
aggcgccuucggcgcggcg

SEQ ID NO: 2351524 - RNA, 14 nt, Bordetella pertussis
aggcgcgagcgccg

SEQ ID NO: 2351525 - RNA, 18 nt, Bordetella pertussis
aggcgcgagcgccgggcg

SEQ ID NO: 2351526 - RNA, 20 nt, Bordetella pertussis
aggcgcgagguggcgcucgc

SEQ ID NO: 2351527 - RNA, 16 nt, Bordetella pertussis
aggcgcgcaagguggc

SEQ ID NO: 2351528 - RNA, 17 nt, Bordetella pertussis
aggcgcgcaccagcccg

SEQ ID NO: 2351529 - RNA, 21 nt, Bordetella pertussis
aggcgcgcaccagcccgcccg

SEQ ID NO: 2351530 - RNA, 17 nt, Bordetella pertussis
aggcgcgcagcacgccg

SEQ ID NO: 2351531 - RNA, 22 nt, Bordetella pertussis
aggcgcgcaucgcgcggcaugg

SEQ ID NO: 2351532 - RNA, 14 nt, Bordetella pertussis
aggcgcgccaccgg

SEQ ID NO: 2351533 - RNA, 13 nt, Bordetella pertussis
aggcgcgccagcc

SEQ ID NO: 2351534 - RNA, 18 nt, Bordetella pertussis
aggcgcgccagcccgccg

SEQ ID NO: 2351535 - RNA, 16 nt, Bordetella pertussis
aggcgcgccagccgcg

SEQ ID NO: 2351536 - RNA, 18 nt, Bordetella pertussis
aggcgcgccagccgcgcg

SEQ ID NO: 2351537 - RNA, 16 nt, Bordetella pertussis
aggcgcgccagccgcu

SEQ ID NO: 2351538 - RNA, 16 nt, Bordetella pertussis
aggcgcgccgcgaugg

SEQ ID NO: 2351539 - RNA, 19 nt, Bordetella pertussis
aggcgcgccgggccggcgg

SEQ ID NO: 2351540 - RNA, 15 nt, Bordetella pertussis
aggcgcgcgccaucg

SEQ ID NO: 2351541 - RNA, 11 nt, Bordetella pertussis
aggcgcgcgcg

SEQ ID NO: 2351542 - RNA, 13 nt, Bordetella pertussis
aggcgcgcggccu

SEQ ID NO: 2351543 - RNA, 13 nt, Bordetella pertussis
aggcgcgcgguga

SEQ ID NO: 2351544 - RNA, 22 nt, Bordetella pertussis
aggcgcgcucaggccgccggcg

SEQ ID NO: 2351545 - RNA, 22 nt, Bordetella pertussis
aggcgcggcgccggcgcgucac

SEQ ID NO: 2351546 - RNA, 18 nt, Bordetella pertussis
aggcgcggcucgccggcc

SEQ ID NO: 2351547 - RNA, 22 nt, Bordetella pertussis
aggcgcgggcagcaccggggca

SEQ ID NO: 2351548 - RNA, 16 nt, Bordetella pertussis
aggcgcgguccaccuc

SEQ ID NO: 2351549 - RNA, 17 nt, Bordetella pertussis
aggcgcgugcgcaggcg

SEQ ID NO: 2351550 - RNA, 19 nt, Bordetella pertussis
aggcgcgugcgcaggcgcg

SEQ ID NO: 2351551 - RNA, 18 nt, Bordetella pertussis
aggcgcguggccacggcg

SEQ ID NO: 2351552 - RNA, 22 nt, Bordetella pertussis
aggcgcguggccacggcgucga

SEQ ID NO: 2351553 - RNA, 15 nt, Bordetella pertussis
aggcgcucaagggcc

SEQ ID NO: 2351554 - RNA, 14 nt, Bordetella pertussis
aggcgcuccagcac

SEQ ID NO: 2351555 - RNA, 17 nt, Bordetella pertussis
aggcgcuccauggcgcc

SEQ ID NO: 2351556 - RNA, 22 nt, Bordetella pertussis
aggcgcuccauggcgccggcgg

SEQ ID NO: 2351557 - RNA, 20 nt, Bordetella pertussis
aggcgcucgaggcgcuggcg

SEQ ID NO: 2351558 - RNA, 23 nt, Bordetella pertussis
aggcgcucgaucggauagcggug

SEQ ID NO: 2351559 - RNA, 21 nt, Bordetella pertussis
aggcgcucgcccucgcgccac

SEQ ID NO: 2351560 - RNA, 23 nt, Bordetella pertussis
aggcgcucgcccucgcgccacca

SEQ ID NO: 2351561 - RNA, 16 nt, Bordetella pertussis
aggcgcucgcgcgcca

SEQ ID NO: 2351562 - RNA, 19 nt, Bordetella pertussis
aggcgcucgcgcgccagca

SEQ ID NO: 2351563 - RNA, 14 nt, Bordetella pertussis
aggcgcucgcgcug

SEQ ID NO: 2351564 - RNA, 16 nt, Bordetella pertussis
aggcgcucggccagcg

SEQ ID NO: 2351565 - RNA, 12 nt, Bordetella pertussis
aggcgcugcgcg

SEQ ID NO: 2351566 - RNA, 19 nt, Bordetella pertussis
aggcgcugcgcgaaacggc

SEQ ID NO: 2351567 - RNA, 15 nt, Bordetella pertussis
aggcugaucacccac

SEQ ID NO: 2351568 - RNA, 19 nt, Bordetella pertussis
aggcugaucacccacagca

SEQ ID NO: 2351569 - RNA, 17 nt, Bordetella pertussis
aggcugcagcuugcgcg

SEQ ID NO: 2351570 - RNA, 19 nt, Bordetella pertussis
aggcugcagcuugcgcgcc

SEQ ID NO: 2351571 - RNA, 21 nt, Bordetella pertussis
aggcugcagcuugcgcgccag

SEQ ID NO: 2351572 - RNA, 19 nt, Bordetella pertussis
aggcugcccuggcccaggc

SEQ ID NO: 2351573 - RNA, 19 nt, Bordetella pertussis
aggcugccgccggcgauga

SEQ ID NO: 2351574 - RNA, 12 nt, Bordetella pertussis
aggcugccggcg

SEQ ID NO: 2351575 - RNA, 17 nt, Bordetella pertussis
aggcugccgucggccag

SEQ ID NO: 2351576 - RNA, 22 nt, Bordetella pertussis
aggcugccgucgucguccaggc

SEQ ID NO: 2351577 - RNA, 16 nt, Bordetella pertussis
aggcugcgcaggcgcc

SEQ ID NO: 2351578 - RNA, 18 nt, Bordetella pertussis
aggcugcgcaggcgccgc

SEQ ID NO: 2351579 - RNA, 16 nt, Bordetella pertussis
aggcugcgcgccggcg

SEQ ID NO: 2351580 - RNA, 22 nt, Bordetella pertussis
aggcugcgcgccggcgccuugg

SEQ ID NO: 2351581 - RNA, 14 nt, Bordetella pertussis
aggcugcgcgcgcc

SEQ ID NO: 2351582 - RNA, 16 nt, Bordetella pertussis
aggcugcgcgcgccag

SEQ ID NO: 2351583 - RNA, 18 nt, Bordetella pertussis
aggcugcgcgcgccagcg

SEQ ID NO: 2351584 - RNA, 19 nt, Bordetella pertussis
aggcugcgcgcgccagcgc

SEQ ID NO: 2351585 - RNA, 21 nt, Bordetella pertussis
aggcugcgcgcgccagcgccu

SEQ ID NO: 2351586 - RNA, 22 nt, Bordetella pertussis
aggcugcgcgucggcaggugca

SEQ ID NO: 2351587 - RNA, 14 nt, Bordetella pertussis
aggcugcugugccu

SEQ ID NO: 2351588 - RNA, 22 nt, Bordetella pertussis
aggcugcugugccugccaagcg

SEQ ID NO: 2351589 - RNA, 17 nt, Bordetella pertussis
aggcuggaagucagccg

SEQ ID NO: 2351590 - RNA, 17 nt, Bordetella pertussis
aggcuggagucgggcug

SEQ ID NO: 2351591 - RNA, 13 nt, Bordetella pertussis
aggcuggccggcg

SEQ ID NO: 2351592 - RNA, 13 nt, Bordetella pertussis
aggcuggcgcggu

SEQ ID NO: 2351593 - RNA, 23 nt, Bordetella pertussis
aggcugggagagccggccacgcg

SEQ ID NO: 2351594 - RNA, 17 nt, Bordetella pertussis
aggcugggcgaaacggc

SEQ ID NO: 2351595 - RNA, 22 nt, Bordetella pertussis
aggcugggcgaaacggccagcg

SEQ ID NO: 2351596 - RNA, 20 nt, Bordetella pertussis
aggcuggggccgagcgugcc

SEQ ID NO: 2351597 - RNA, 21 nt, Bordetella pertussis
aggcuggggccgagcgugccg

SEQ ID NO: 2351598 - RNA, 20 nt, Bordetella pertussis
aggcugucgucgucggcacc

SEQ ID NO: 2351599 - RNA, 14 nt, Bordetella pertussis
aggcuguggccgcg

SEQ ID NO: 2351600 - RNA, 15 nt, Bordetella pertussis
aggcuucgcccgcca

SEQ ID NO: 2351601 - RNA, 18 nt, Bordetella pertussis
aggcuucgucgaccagca

SEQ ID NO: 2351602 - RNA, 21 nt, Bordetella pertussis
aggcuucucgaccaggcgggc

SEQ ID NO: 2351603 - RNA, 19 nt, Bordetella pertussis
aggcuugcagcaacgcggc

SEQ ID NO: 2351604 - RNA, 21 nt, Bordetella pertussis
aggcuuucgaagccgccccac

SEQ ID NO: 2351605 - RNA, 23 nt, Bordetella pertussis
aggcuuucgcaauacgucgcgac

SEQ ID NO: 2351606 - RNA, 20 nt, Bordetella pertussis
aggcuuucgcacagccgggg

SEQ ID NO: 2351607 - RNA, 22 nt, Bordetella pertussis
aggcuuucgcacagccggggcg

SEQ ID NO: 2351608 - RNA, 23 nt, Bordetella pertussis
aggcuuugucguugauggggccg

SEQ ID NO: 2351609 - RNA, 19 nt, Bordetella pertussis
agggaaaacagcgcgggcg

SEQ ID NO: 2351610 - RNA, 14 nt, Bordetella pertussis
agggacaggcaccc

SEQ ID NO: 2351611 - RNA, 23 nt, Bordetella pertussis
agggacaggcaccccggcgccgc

SEQ ID NO: 2351612 - RNA, 19 nt, Bordetella pertussis
agggacgggccagccccgg

SEQ ID NO: 2351613 - RNA, 13 nt, Bordetella pertussis
agggagccguucu

SEQ ID NO: 2351614 - RNA, 16 nt, Bordetella pertussis
agggcaagcgcgucga

SEQ ID NO: 2351615 - RNA, 19 nt, Bordetella pertussis
agggcacaucggccacccg

SEQ ID NO: 2351616 - RNA, 22 nt, Bordetella pertussis
agggcagauugaugcccaugcg

SEQ ID NO: 2351617 - RNA, 17 nt, Bordetella pertussis
agggcagcucgcguccg

SEQ ID NO: 2351618 - RNA, 22 nt, Bordetella pertussis
agggcagcucgcguccgcucau

SEQ ID NO: 2351619 - RNA, 13 nt, Bordetella pertussis
agggcagggcgcc

SEQ ID NO: 2351620 - RNA, 23 nt, Bordetella pertussis
agggcaggucgucgagccgggcc

SEQ ID NO: 2351621 - RNA, 13 nt, Bordetella pertussis
agggcaugggccc

SEQ ID NO: 2351622 - RNA, 14 nt, Bordetella pertussis
agggccacgcccac

SEQ ID NO: 2351623 - RNA, 14 nt, Bordetella pertussis
agggccacgccggc

SEQ ID NO: 2351624 - RNA, 23 nt, Bordetella pertussis
agggccacgcgcuugcgcgccac

SEQ ID NO: 2351625 - RNA, 12 nt, Bordetella pertussis
agggccagcgcc

SEQ ID NO: 2351626 - RNA, 14 nt, Bordetella pertussis
agggccagcgccag

SEQ ID NO: 2351627 - RNA, 20 nt, Bordetella pertussis
agggccagcuugacguccag

SEQ ID NO: 2351628 - RNA, 11 nt, Bordetella pertussis
agggccaggcc

SEQ ID NO: 2351629 - RNA, 19 nt, Bordetella pertussis
agggccagguaaugaucgc

SEQ ID NO: 2351630 - RNA, 15 nt, Bordetella pertussis
agggccagucguuca

SEQ ID NO: 2351631 - RNA, 20 nt, Bordetella pertussis
agggccauggcagggcgccg

SEQ ID NO: 2351632 - RNA, 12 nt, Bordetella pertussis
agggccauucuc

SEQ ID NO: 2351633 - RNA, 12 nt, Bordetella pertussis
agggcccagcug

SEQ ID NO: 2351634 - RNA, 14 nt, Bordetella pertussis
agggcccagcugca

SEQ ID NO: 2351635 - RNA, 15 nt, Bordetella pertussis
agggcccagcugcag

SEQ ID NO: 2351636 - RNA, 23 nt, Bordetella pertussis
agggccgaucccuugugcgcgcc

SEQ ID NO: 2351637 - RNA, 15 nt, Bordetella pertussis
agggccgcagcaauu

SEQ ID NO: 2351638 - RNA, 12 nt, Bordetella pertussis
agggccgccagg

SEQ ID NO: 2351639 - RNA, 18 nt, Bordetella pertussis
agggccgccagggcggcu

SEQ ID NO: 2351640 - RNA, 14 nt, Bordetella pertussis
agggccgcccaguc

SEQ ID NO: 2351641 - RNA, 21 nt, Bordetella pertussis
agggccgcccagucguccagc

SEQ ID NO: 2351642 - RNA, 19 nt, Bordetella pertussis
agggccgcgagcaugcgca

SEQ ID NO: 2351643 - RNA, 11 nt, Bordetella pertussis
agggccgcgcg

SEQ ID NO: 2351644 - RNA, 14 nt, Bordetella pertussis
agggccgcgcgauc

SEQ ID NO: 2351645 - RNA, 13 nt, Bordetella pertussis
agggccgcggcga

SEQ ID NO: 2351646 - RNA, 15 nt, Bordetella pertussis
agggccggacuggcg

SEQ ID NO: 2351647 - RNA, 20 nt, Bordetella pertussis
agggccggacuggcgcgcac

SEQ ID NO: 2351648 - RNA, 12 nt, Bordetella pertussis
agggccggcgcc

SEQ ID NO: 2351649 - RNA, 16 nt, Bordetella pertussis
agggccggcgccagca

SEQ ID NO: 2351650 - RNA, 13 nt, Bordetella pertussis
agggccuccugca

SEQ ID NO: 2351651 - RNA, 15 nt, Bordetella pertussis
agggccucgcgggcc

SEQ ID NO: 2351652 - RNA, 22 nt, Bordetella pertussis
agggccucgcgggccuuggcca

SEQ ID NO: 2351653 - RNA, 15 nt, Bordetella pertussis
agggccugcgggccg

SEQ ID NO: 2351654 - RNA, 18 nt, Bordetella pertussis
agggccuggaagcuggcc

SEQ ID NO: 2351655 - RNA, 16 nt, Bordetella pertussis
agggccuggcacaucg

SEQ ID NO: 2351656 - RNA, 14 nt, Bordetella pertussis
agggccuggucagc

SEQ ID NO: 2351657 - RNA, 18 nt, Bordetella pertussis
agggccuggucagcgccg

SEQ ID NO: 2351658 - RNA, 19 nt, Bordetella pertussis
agggccuggucagcgccga

SEQ ID NO: 2351659 - RNA, 16 nt, Bordetella pertussis
agggcgaacggggugg

SEQ ID NO: 2351660 - RNA, 21 nt, Bordetella pertussis
agggcgaacgggguggccggc

SEQ ID NO: 2351661 - RNA, 19 nt, Bordetella pertussis
agggcgaacguggccugcu

SEQ ID NO: 2351662 - RNA, 17 nt, Bordetella pertussis
agggcgaagcgcgccuc

SEQ ID NO: 2351663 - RNA, 12 nt, Bordetella pertussis
agggcgacggcg

SEQ ID NO: 2351664 - RNA, 16 nt, Bordetella pertussis
agggcgacggcggcgu

SEQ ID NO: 2351665 - RNA, 19 nt, Bordetella pertussis
agggcgacugcagcaggcu

SEQ ID NO: 2351666 - RNA, 18 nt, Bordetella pertussis
agggcgaucagcaccgcg

SEQ ID NO: 2351667 - RNA, 17 nt, Bordetella pertussis
agggcgaucuugccggc

SEQ ID NO: 2351668 - RNA, 19 nt, Bordetella pertussis
agggcgaugcggcggccga

SEQ ID NO: 2351669 - RNA, 14 nt, Bordetella pertussis
agggcgauggcgcg

SEQ ID NO: 2351670 - RNA, 18 nt, Bordetella pertussis
agggcgcaacgccggccg

SEQ ID NO: 2351671 - RNA, 21 nt, Bordetella pertussis
agggcgccgacgaugccgccc

SEQ ID NO: 2351672 - RNA, 13 nt, Bordetella pertussis
agggcgccgcgcg

SEQ ID NO: 2351673 - RNA, 17 nt, Bordetella pertussis
agggcgccgcgcggucg

SEQ ID NO: 2351674 - RNA, 16 nt, Bordetella pertussis
agggcgccgggcggau

SEQ ID NO: 2351675 - RNA, 23 nt, Bordetella pertussis
agggcgccgggcggaucgccgaa

SEQ ID NO: 2351676 - RNA, 18 nt, Bordetella pertussis
agggcgcgacgccagcgc

SEQ ID NO: 2351677 - RNA, 23 nt, Bordetella pertussis
agggcgcgacgccagcgcgccau

SEQ ID NO: 2351678 - RNA, 14 nt, Bordetella pertussis
agggcgcgcagcag

SEQ ID NO: 2351679 - RNA, 12 nt, Bordetella pertussis
agggcgcgccag

SEQ ID NO: 2351680 - RNA, 16 nt, Bordetella pertussis
aggucagcgccuugcc

SEQ ID NO: 2351681 - RNA, 12 nt, Bordetella pertussis
aggucaggccca

SEQ ID NO: 2351682 - RNA, 16 nt, Bordetella pertussis
aggucaucgccaggcg

SEQ ID NO: 2351683 - RNA, 19 nt, Bordetella pertussis
aggucaucgccaggcgcgu

SEQ ID NO: 2351684 - RNA, 23 nt, Bordetella pertussis
aggucaugcagaacagggugccg

SEQ ID NO: 2351685 - RNA, 17 nt, Bordetella pertussis
agguccaguacaccagg

SEQ ID NO: 2351686 - RNA, 19 nt, Bordetella pertussis
agguccgccggcacgcgcg

SEQ ID NO: 2351687 - RNA, 18 nt, Bordetella pertussis
agguccggucgcgcgugc

SEQ ID NO: 2351688 - RNA, 17 nt, Bordetella pertussis
agguccugcgccagcuu

SEQ ID NO: 2351689 - RNA, 12 nt, Bordetella pertussis
agguccuggaga

SEQ ID NO: 2351690 - RNA, 15 nt, Bordetella pertussis
agguccuggcggccg

SEQ ID NO: 2351691 - RNA, 15 nt, Bordetella pertussis
aggucgaacaggcug

SEQ ID NO: 2351692 - RNA, 13 nt, Bordetella pertussis
aggucgccagcag

SEQ ID NO: 2351693 - RNA, 17 nt, Bordetella pertussis
aggucgccagcaggccc

SEQ ID NO: 2351694 - RNA, 20 nt, Bordetella pertussis
aggucgccguucuggcugcg

SEQ ID NO: 2351695 - RNA, 12 nt, Bordetella pertussis
aggucgcgcgua

SEQ ID NO: 2351696 - RNA, 21 nt, Bordetella pertussis
aggucgcggugcgccacgaug

SEQ ID NO: 2351697 - RNA, 18 nt, Bordetella pertussis
aggucgcugcccagcaug

SEQ ID NO: 2351698 - RNA, 23 nt, Bordetella pertussis
aggucgcuucgguggcgcgcaac

SEQ ID NO: 2351699 - RNA, 16 nt, Bordetella pertussis
aggucggacgcgccgg

SEQ ID NO: 2351700 - RNA, 19 nt, Bordetella pertussis
aggucggacgcgccgggcg

SEQ ID NO: 2351701 - RNA, 13 nt, Bordetella pertussis
aggucggccaccg

SEQ ID NO: 2351702 - RNA, 12 nt, Bordetella pertussis
aggucggccagc

SEQ ID NO: 2351703 - RNA, 13 nt, Bordetella pertussis
aggucggccagcc

SEQ ID NO: 2351704 - RNA, 16 nt, Bordetella pertussis
aggucggcgcggggca

SEQ ID NO: 2351705 - RNA, 19 nt, Bordetella pertussis
aggucggcgcggggcaccg

SEQ ID NO: 2351706 - RNA, 15 nt, Bordetella pertussis
aggucggcggccagc

SEQ ID NO: 2351707 - RNA, 17 nt, Bordetella pertussis
aggucggcggccagcgc

SEQ ID NO: 2351708 - RNA, 19 nt, Bordetella pertussis
aggucgggauaguccagca

SEQ ID NO: 2351709 - RNA, 21 nt, Bordetella pertussis
aggucguagaccgccgcgccc

SEQ ID NO: 2351710 - RNA, 20 nt, Bordetella pertussis
aggucgucgagccgggccac

SEQ ID NO: 2351711 - RNA, 17 nt, Bordetella pertussis
aggucguggcccagccg

SEQ ID NO: 2351712 - RNA, 22 nt, Bordetella pertussis
aggucguuguggcaggcgucgg

SEQ ID NO: 2351713 - RNA, 14 nt, Bordetella pertussis
aggucugcacgagg

SEQ ID NO: 2351714 - RNA, 19 nt, Bordetella pertussis
aggugaacgacagcgacac

SEQ ID NO: 2351715 - RNA, 22 nt, Bordetella pertussis
aggugaugcgcgcggccagcgc

SEQ ID NO: 2351716 - RNA, 20 nt, Bordetella pertussis
aggugcacgugggcacgccg

SEQ ID NO: 2351717 - RNA, 23 nt, Bordetella pertussis
aggugcacgugggcacgccggcc

SEQ ID NO: 2351718 - RNA, 15 nt, Bordetella pertussis
aggugcaggguuggc

SEQ ID NO: 2351719 - RNA, 19 nt, Bordetella pertussis
aggugcaggguuggcgcgc

SEQ ID NO: 2351720 - RNA, 17 nt, Bordetella pertussis
aggugcccgcgaagcag

SEQ ID NO: 2351721 - RNA, 19 nt, Bordetella pertussis
aggugcccgcgaagcagcc

SEQ ID NO: 2351722 - RNA, 21 nt, Bordetella pertussis
aggugcccgcgaagcagccgg

SEQ ID NO: 2351723 - RNA, 14 nt, Bordetella pertussis
aggugccgccggcg

SEQ ID NO: 2351724 - RNA, 15 nt, Bordetella pertussis
aggugccgccggcgc

SEQ ID NO: 2351725 - RNA, 20 nt, Bordetella pertussis
aggugccggcggugaugacg

SEQ ID NO: 2351726 - RNA, 21 nt, Bordetella pertussis
aggugccguccggcaccucga

SEQ ID NO: 2351727 - RNA, 13 nt, Bordetella pertussis
aggugccuguccc

SEQ ID NO: 2351728 - RNA, 14 nt, Bordetella pertussis
aggugccuguccca

SEQ ID NO: 2351729 - RNA, 16 nt, Bordetella pertussis
aggugccuguccccac

SEQ ID NO: 2351730 - RNA, 17 nt, Bordetella pertussis
aggugccuguccccacg

SEQ ID NO: 2351731 - RNA, 19 nt, Bordetella pertussis
aggugccuguccccacggg

SEQ ID NO: 2351732 - RNA, 20 nt, Bordetella pertussis
aggugccuguccccccaugg

SEQ ID NO: 2351733 - RNA, 21 nt, Bordetella pertussis
aggugccuguccccccauggg

SEQ ID NO: 2351734 - RNA, 20 nt, Bordetella pertussis
aggugccuguccccgcgggg

SEQ ID NO: 2351735 - RNA, 22 nt, Bordetella pertussis
aggugccuguccccgcggggac

SEQ ID NO: 2351736 - RNA, 19 nt, Bordetella pertussis
aggugcgcagccgggcugc

SEQ ID NO: 2351737 - RNA, 14 nt, Bordetella pertussis
aggugcgccgcucg

SEQ ID NO: 2351738 - RNA, 15 nt, Bordetella pertussis
aggugcggccgcagc

SEQ ID NO: 2351739 - RNA, 15 nt, Bordetella pertussis
aggugcgucacgcac

SEQ ID NO: 2351740 - RNA, 21 nt, Bordetella pertussis
aggugcuuggcggucugggcg

SEQ ID NO: 2351741 - RNA, 21 nt, Bordetella pertussis
agguggcauagaugccgaaca

SEQ ID NO: 2351742 - RNA, 21 nt, Bordetella pertussis
agguggcccgcaccgggcggc

SEQ ID NO: 2351743 - RNA, 22 nt, Bordetella pertussis
agguggcccgcaccgggcggcc

SEQ ID NO: 2351744 - RNA, 22 nt, Bordetella pertussis
agguggcgcauucgccggacac

SEQ ID NO: 2351745 - RNA, 19 nt, Bordetella pertussis
agguggcggacaggcccuc

SEQ ID NO: 2351746 - RNA, 21 nt, Bordetella pertussis
agguggcggacaggcccucgg

SEQ ID NO: 2351747 - RNA, 13 nt, Bordetella pertussis
aggugggccaggu

SEQ ID NO: 2351748 - RNA, 14 nt, Bordetella pertussis
aggugggccaggua

SEQ ID NO: 2351749 - RNA, 21 nt, Bordetella pertussis
aggugggccgagcccgcgucg

SEQ ID NO: 2351750 - RNA, 23 nt, Bordetella pertussis
aggugggcgaaccgcggcgcagg

SEQ ID NO: 2351751 - RNA, 14 nt, Bordetella pertussis
aggugggcgcgcuc

SEQ ID NO: 2351752 - RNA, 15 nt, Bordetella pertussis
aggugggcggcagca

SEQ ID NO: 2351753 - RNA, 13 nt, Bordetella pertussis
agguggucagcau

SEQ ID NO: 2351754 - RNA, 22 nt, Bordetella pertussis
aggugucgccccccaugccgga

SEQ ID NO: 2351755 - RNA, 13 nt, Bordetella pertussis
aggugugccagcc

SEQ ID NO: 2351756 - RNA, 16 nt, Bordetella pertussis
agguguugaccacgcc

SEQ ID NO: 2351757 - RNA, 16 nt, Bordetella pertussis
agguucggagcacgga

SEQ ID NO: 2351758 - RNA, 20 nt, Bordetella pertussis
agguucucgauguggcgcug

SEQ ID NO: 2351759 - RNA, 22 nt, Bordetella pertussis
agguucugcgcguccuggcgcg

SEQ ID NO: 2351760 - RNA, 14 nt, Bordetella pertussis
agguugaaggccgc

SEQ ID NO: 2351761 - RNA, 15 nt, Bordetella pertussis
agguugaaggccgcg

SEQ ID NO: 2351762 - RNA, 15 nt, Bordetella pertussis
agguugaaguugcuc

SEQ ID NO: 2351763 - RNA, 22 nt, Bordetella pertussis
agguugaaguugcucggcggca

SEQ ID NO: 2351764 - RNA, 16 nt, Bordetella pertussis
agguugagucuggaga

SEQ ID NO: 2351765 - RNA, 16 nt, Bordetella pertussis
agguugcaggccaggc

SEQ ID NO: 2351766 - RNA, 17 nt, Bordetella pertussis
agguugcaggccaggcu

SEQ ID NO: 2351767 - RNA, 15 nt, Bordetella pertussis
agguugcccgcccga

SEQ ID NO: 2351768 - RNA, 14 nt, Bordetella pertussis
agguugcgccggcu

SEQ ID NO: 2351769 - RNA, 13 nt, Bordetella pertussis
agguugcggccgc

SEQ ID NO: 2351770 - RNA, 15 nt, Bordetella pertussis
agguugcggccgcca

SEQ ID NO: 2351771 - RNA, 16 nt, Bordetella pertussis
agguugcggccgccac

SEQ ID NO: 2351772 - RNA, 24 nt, Bordetella pertussis
agguugcgguaguucagcagcgcc

SEQ ID NO: 2351773 - RNA, 20 nt, Bordetella pertussis
agguugcuuucggcgacuuc

SEQ ID NO: 2351774 - RNA, 17 nt, Bordetella pertussis
agguugugccccuugcc

SEQ ID NO: 2351775 - RNA, 20 nt, Bordetella pertussis
agguugugccccuugcccaa

SEQ ID NO: 2351776 - RNA, 20 nt, Bordetella pertussis
agguuuuccacagccaggcc

SEQ ID NO: 2351777 - RNA, 23 nt, Bordetella pertussis
aguaaucgcgcgccaccgccaga

SEQ ID NO: 2351778 - RNA, 23 nt, Bordetella pertussis
aguacaccggcgugcagagcacc

SEQ ID NO: 2351779 - RNA, 14 nt, Bordetella pertussis
aguacacggccagc

SEQ ID NO: 2351780 - RNA, 17 nt, Bordetella pertussis
aguacacggccagcacg

SEQ ID NO: 2351781 - RNA, 12 nt, Bordetella pertussis
aguacagcagca

SEQ ID NO: 2351782 - RNA, 17 nt, Bordetella pertussis
aguacagcagcagcacg

SEQ ID NO: 2351783 - RNA, 14 nt, Bordetella pertussis
aguacagcuugaga

SEQ ID NO: 2351784 - RNA, 19 nt, Bordetella pertussis
aguacauauucacagccau

SEQ ID NO: 2351785 - RNA, 15 nt, Bordetella pertussis
aguacucgccggcgc

SEQ ID NO: 2351786 - RNA, 19 nt, Bordetella pertussis
aguagaacucgccaggucc

SEQ ID NO: 2351787 - RNA, 18 nt, Bordetella pertussis
aguagaaguaggcggcca

SEQ ID NO: 2351788 - RNA, 21 nt, Bordetella pertussis
aguagaaguaggcggccaggc

SEQ ID NO: 2351789 - RNA, 22 nt, Bordetella pertussis
aguagaaguaggcggccaggcc

SEQ ID NO: 2351790 - RNA, 19 nt, Bordetella pertussis
aguagccgaauccggccag

SEQ ID NO: 2351791 - RNA, 20 nt, Bordetella pertussis
aguagccgaauccggccagc

SEQ ID NO: 2351792 - RNA, 22 nt, Bordetella pertussis
aguaggccacugcguccuugag

SEQ ID NO: 2351793 - RNA, 23 nt, Bordetella pertussis
aguucgucccagggggucagggc

SEQ ID NO: 2351794 - RNA, 21 nt, Bordetella pertussis
aguucgucgucgccaccgccc

SEQ ID NO: 2351795 - RNA, 20 nt, Bordetella pertussis
aguucgucgucggucggcuu

SEQ ID NO: 2351796 - RNA, 22 nt, Bordetella pertussis
aguucgucgucggucggcuuga

SEQ ID NO: 2351797 - RNA, 17 nt, Bordetella pertussis
aguucugguagguguga

SEQ ID NO: 2351798 - RNA, 14 nt, Bordetella pertussis
aguucuucuuggcc

SEQ ID NO: 2351799 - RNA, 16 nt, Bordetella pertussis
aguucuucuuggccag

SEQ ID NO: 2351800 - RNA, 16 nt, Bordetella pertussis
aguugaaucggcgcga

SEQ ID NO: 2351801 - RNA, 20 nt, Bordetella pertussis
aguugacccauaccagcccg

SEQ ID NO: 2351802 - RNA, 23 nt, Bordetella pertussis
aguugacccauaccagcccggcg

SEQ ID NO: 2351803 - RNA, 14 nt, Bordetella pertussis
aguugacgccggcg

SEQ ID NO: 2351804 - RNA, 21 nt, Bordetella pertussis
aguugacgccggcggcgugcg

SEQ ID NO: 2351805 - RNA, 17 nt, Bordetella pertussis
aguugcaccagugcgcc

SEQ ID NO: 2351806 - RNA, 23 nt, Bordetella pertussis
aguugcaccagugcgccggcgcg

SEQ ID NO: 2351807 - RNA, 13 nt, Bordetella pertussis
aguugcgccacgg

SEQ ID NO: 2351808 - RNA, 14 nt, Bordetella pertussis
aguugcgccccgcc

SEQ ID NO: 2351809 - RNA, 15 nt, Bordetella pertussis
aguugcgcggugcgg

SEQ ID NO: 2351810 - RNA, 15 nt, Bordetella pertussis
aguugcgggcgcacc

SEQ ID NO: 2351811 - RNA, 23 nt, Bordetella pertussis
aguugcggggcgcccagcgcguc

SEQ ID NO: 2351812 - RNA, 20 nt, Bordetella pertussis
aguugcgggucgucccagcg

SEQ ID NO: 2351813 - RNA, 19 nt, Bordetella pertussis
aguugcucauggcggcacg

SEQ ID NO: 2351814 - RNA, 19 nt, Bordetella pertussis
aguugcucggagcccagug

SEQ ID NO: 2351815 - RNA, 14 nt, Bordetella pertussis
aguugcuggcggcc

SEQ ID NO: 2351816 - RNA, 19 nt, Bordetella pertussis
aguugcuggcggccgugcc

SEQ ID NO: 2351817 - RNA, 19 nt, Bordetella pertussis
aguuggcagaguggcagga

SEQ ID NO: 2351818 - RNA, 12 nt, Bordetella pertussis
aguuggccaggg

SEQ ID NO: 2351819 - RNA, 16 nt, Bordetella pertussis
aguuggcccuucuuca

SEQ ID NO: 2351820 - RNA, 19 nt, Bordetella pertussis
aguuggcggcgcagccgcc

SEQ ID NO: 2351821 - RNA, 13 nt, Bordetella pertussis
aguugggccaggg

SEQ ID NO: 2351822 - RNA, 15 nt, Bordetella pertussis
aguugggcgccuugc

SEQ ID NO: 2351823 - RNA, 16 nt, Bordetella pertussis
aguugggcgcgcccag

SEQ ID NO: 2351824 - RNA, 22 nt, Bordetella pertussis
aguuguagguccaguacaccag

SEQ ID NO: 2351825 - RNA, 14 nt, Bordetella pertussis
aguugucgccauac

SEQ ID NO: 2351826 - RNA, 18 nt, Bordetella pertussis
aguuucugcaccggcgcc

SEQ ID NO: 2351827 - RNA, 22 nt, Bordetella pertussis
aguuuggcgaaggcgucggcca

SEQ ID NO: 2351828 - RNA, 18 nt, Bordetella pertussis
auaacgccacuugcaggc

SEQ ID NO: 2351829 - RNA, 18 nt, Bordetella pertussis
auaaggcuucucgaccag

SEQ ID NO: 2351830 - RNA, 20 nt, Bordetella pertussis
auaaggcuucucgaccaggc

SEQ ID NO: 2351831 - RNA, 15 nt, Bordetella pertussis
auaagucugcgccuu

SEQ ID NO: 2351832 - RNA, 15 nt, Bordetella pertussis
auacaaggcgcggca

SEQ ID NO: 2351833 - RNA, 20 nt, Bordetella pertussis
auacaaggcgcggcaaaaug

SEQ ID NO: 2351834 - RNA, 17 nt, Bordetella pertussis
auacaggcuguggccgc

SEQ ID NO: 2351835 - RNA, 14 nt, Bordetella pertussis
auacagggcggugc

SEQ ID NO: 2351836 - RNA, 18 nt, Bordetella pertussis
auacaugaguucuggcau

SEQ ID NO: 2351837 - RNA, 17 nt, Bordetella pertussis
auacccgcuucgacggc

SEQ ID NO: 2351838 - RNA, 23 nt, Bordetella pertussis
auaccgaaucgaacuuggcgcgg

SEQ ID NO: 2351839 - RNA, 17 nt, Bordetella pertussis
auaccgccgccgcucgu

SEQ ID NO: 2351840 - RNA, 12 nt, Bordetella pertussis
auaccgcgcaca

SEQ ID NO: 2351841 - RNA, 21 nt, Bordetella pertussis
auaccgcgcacaggucgccga

SEQ ID NO: 2351842 - RNA, 16 nt, Bordetella pertussis
auaccgcuggccaggc

SEQ ID NO: 2351843 - RNA, 21 nt, Bordetella pertussis
auaccggccgcggguggccgc

SEQ ID NO: 2351844 - RNA, 15 nt, Bordetella pertussis
auaccgggcugguca

SEQ ID NO: 2351845 - RNA, 15 nt, Bordetella pertussis
auaccgucuuggccg

SEQ ID NO: 2351846 - RNA, 17 nt, Bordetella pertussis
auaccgucuuggccguc

SEQ ID NO: 2351847 - RNA, 19 nt, Bordetella pertussis
auaccucgauggcgguggu

SEQ ID NO: 2351848 - RNA, 15 nt, Bordetella pertussis
auaccuuggcgccca

SEQ ID NO: 2351849 - RNA, 12 nt, Bordetella pertussis
auacgccgugcu

SEQ ID NO: 2351850 - RNA, 11 nt, Bordetella pertussis
auacgcgcgcg

SEQ ID NO: 2351851 - RNA, 15 nt, Bordetella pertussis
auacgcgugcgcggc

SEQ ID NO: 2351852 - RNA, 14 nt, Bordetella pertussis
auacgcuggcgcgu

SEQ ID NO: 2351853 - RNA, 19 nt, Bordetella pertussis
auacguccuuuggcgucga

SEQ ID NO: 2351854 - RNA, 20 nt, Bordetella pertussis
auacgucgcagcacgcccag

SEQ ID NO: 2351855 - RNA, 23 nt, Bordetella pertussis
auacuggccgauggucagcaugu

SEQ ID NO: 2351856 - RNA, 21 nt, Bordetella pertussis
auacuugcgcagcgcggcguu

SEQ ID NO: 2351857 - RNA, 14 nt, Bordetella pertussis
auagacccuccucg

SEQ ID NO: 2351858 - RNA, 14 nt, Bordetella pertussis
auagacgccgaccg

SEQ ID NO: 2351859 - RNA, 16 nt, Bordetella pertussis
auagaguucggcgcgg

SEQ ID NO: 2351860 - RNA, 19 nt, Bordetella pertussis
auagaucauccagguggcg

SEQ ID NO: 2351861 - RNA, 20 nt, Bordetella pertussis
auagaugcgcggggccaggc

SEQ ID NO: 2351862 - RNA, 21 nt, Bordetella pertussis
auagcccagcaccugcaggcc

SEQ ID NO: 2351863 - RNA, 20 nt, Bordetella pertussis
auagcccgcggccaccaggc

SEQ ID NO: 2351864 - RNA, 16 nt, Bordetella pertussis
auagcccuugaucagc

SEQ ID NO: 2351865 - RNA, 11 nt, Bordetella pertussis
auagccgcgcg

SEQ ID NO: 2351866 - RNA, 18 nt, Bordetella pertussis
auagcgcaugaugcugcc

SEQ ID NO: 2351867 - RNA, 14 nt, Bordetella pertussis
auagcgcccgccuu

SEQ ID NO: 2351868 - RNA, 20 nt, Bordetella pertussis
auagcggccggcgcgcgcga

SEQ ID NO: 2351869 - RNA, 19 nt, Bordetella pertussis
auagcgggccugcagcaug

SEQ ID NO: 2351870 - RNA, 21 nt, Bordetella pertussis
auagcgggccugcagcaugac

SEQ ID NO: 2351871 - RNA, 19 nt, Bordetella pertussis
auaggaucccggcgccagc

SEQ ID NO: 2351872 - RNA, 20 nt, Bordetella pertussis
auaggccucggccaccuggc

SEQ ID NO: 2351873 - RNA, 15 nt, Bordetella pertussis
auaggcgaagcgcgg

SEQ ID NO: 2351874 - RNA, 17 nt, Bordetella pertussis
auaggcggcgcaggcca

SEQ ID NO: 2351875 - RNA, 20 nt, Bordetella pertussis
auagguuguauucguccagg

SEQ ID NO: 2351876 - RNA, 21 nt, Bordetella pertussis
auagguuguauucguccaggu

SEQ ID NO: 2351877 - RNA, 21 nt, Bordetella pertussis
auagguuguauuuguccaggu

SEQ ID NO: 2351878 - RNA, 19 nt, Bordetella pertussis
auauagccggucuggucgg

SEQ ID NO: 2351879 - RNA, 22 nt, Bordetella pertussis
auauccagguaggcggcgcgcc

SEQ ID NO: 2351880 - RNA, 13 nt, Bordetella pertussis
auaucccauggga

SEQ ID NO: 2351881 - RNA, 20 nt, Bordetella pertussis
auaucccugcggcagcgacu

SEQ ID NO: 2351882 - RNA, 16 nt, Bordetella pertussis
auauccuugcgcucgc

SEQ ID NO: 2351883 - RNA, 15 nt, Bordetella pertussis
auaucgacggcgccu

SEQ ID NO: 2351884 - RNA, 17 nt, Bordetella pertussis
auaucgcgaaagcggcg

SEQ ID NO: 2351885 - RNA, 20 nt, Bordetella pertussis
auaucggcacccgcauggug

SEQ ID NO: 2351886 - RNA, 22 nt, Bordetella pertussis
auaugcgagacgaaggcgccgg

SEQ ID NO: 2351887 - RNA, 15 nt, Bordetella pertussis
auauggagccaggcg

SEQ ID NO: 2351888 - RNA, 19 nt, Bordetella pertussis
auauggagccaggcggcgu

SEQ ID NO: 2351889 - RNA, 20 nt, Bordetella pertussis
auauggagccaggcggcgua

SEQ ID NO: 2351890 - RNA, 13 nt, Bordetella pertussis
auauggccagggu

SEQ ID NO: 2351891 - RNA, 16 nt, Bordetella pertussis
auauggccggcgcgcu

SEQ ID NO: 2351892 - RNA, 13 nt, Bordetella pertussis
auauggcgccgca

SEQ ID NO: 2351893 - RNA, 17 nt, Bordetella pertussis
auaugggcgagcaggcc

SEQ ID NO: 2351894 - RNA, 21 nt, Bordetella pertussis
auaugggcggccucggccagc

SEQ ID NO: 2351895 - RNA, 21 nt, Bordetella pertussis
auauuggcgaacgugcgcgcc

SEQ ID NO: 2351896 - RNA, 22 nt, Bordetella pertussis
auauugggggucagcgccgacu

SEQ ID NO: 2351897 - RNA, 20 nt, Bordetella pertussis
aucaacgugcgccaggcaaa

SEQ ID NO: 2351898 - RNA, 14 nt, Bordetella pertussis
aucaacuuccagcg

SEQ ID NO: 2351899 - RNA, 15 nt, Bordetella pertussis
aucaacuuccagcgc

SEQ ID NO: 2351900 - RNA, 14 nt, Bordetella pertussis
aucaagagccugga

SEQ ID NO: 2351901 - RNA, 18 nt, Bordetella pertussis
aucaagcggcccgcgccc

SEQ ID NO: 2351902 - RNA, 13 nt, Bordetella pertussis
aucaaggcccgga

SEQ ID NO: 2351903 - RNA, 18 nt, Bordetella pertussis
aucaaucugaucaucuuc

SEQ ID NO: 2351904 - RNA, 19 nt, Bordetella pertussis
aucaaucugaucaucuucg

SEQ ID NO: 2351905 - RNA, 21 nt, Bordetella pertussis
aucaaugacauggccacggcc

SEQ ID NO: 2351906 - RNA, 20 nt, Bordetella pertussis
auccagcggacgggccaggc

SEQ ID NO: 2351907 - RNA, 16 nt, Bordetella pertussis
auccagcucggcgaug

SEQ ID NO: 2351908 - RNA, 17 nt, Bordetella pertussis
auccagcucggcgaugc

SEQ ID NO: 2351909 - RNA, 11 nt, Bordetella pertussis
auccagcugcg

SEQ ID NO: 2351910 - RNA, 15 nt, Bordetella pertussis
auccaggccaccgcg

SEQ ID NO: 2351911 - RNA, 21 nt, Bordetella pertussis
auccaggccgugagcgccgcc

SEQ ID NO: 2351912 - RNA, 18 nt, Bordetella pertussis
auccagggccgccagcac

SEQ ID NO: 2351913 - RNA, 19 nt, Bordetella pertussis
auccagggccgccagcacc

SEQ ID NO: 2351914 - RNA, 20 nt, Bordetella pertussis
auccaggucuacccgcgcga

SEQ ID NO: 2351915 - RNA, 22 nt, Bordetella pertussis
auccaguugagaaugcccagga

SEQ ID NO: 2351916 - RNA, 23 nt, Bordetella pertussis
auccaguugagaaugcccaggau

SEQ ID NO: 2351917 - RNA, 12 nt, Bordetella pertussis
auccaucggcgc

SEQ ID NO: 2351918 - RNA, 17 nt, Bordetella pertussis
auccaucggcgcgcgcu

SEQ ID NO: 2351919 - RNA, 15 nt, Bordetella pertussis
auccauguggccagc

SEQ ID NO: 2351920 - RNA, 14 nt, Bordetella pertussis
aucccaccaucucc

SEQ ID NO: 2351921 - RNA, 19 nt, Bordetella pertussis
auccccaaguacacgguca

SEQ ID NO: 2351922 - RNA, 15 nt, Bordetella pertussis
auccccagcgccgcc

SEQ ID NO: 2351923 - RNA, 17 nt, Bordetella pertussis
aucccgacgauccgcgg

SEQ ID NO: 2351924 - RNA, 23 nt, Bordetella pertussis
aucccgcccccgccgcacgggcg

SEQ ID NO: 2351925 - RNA, 15 nt, Bordetella pertussis
aucccgcgccuauca

SEQ ID NO: 2351926 - RNA, 13 nt, Bordetella pertussis
aucccggccaggc

SEQ ID NO: 2351927 - RNA, 14 nt, Bordetella pertussis
aucccggccaggcg

SEQ ID NO: 2351928 - RNA, 18 nt, Bordetella pertussis
aucccggccaggcgccgg

SEQ ID NO: 2351929 - RNA, 12 nt, Bordetella pertussis
aucccggcgaca

SEQ ID NO: 2351930 - RNA, 15 nt, Bordetella pertussis
aucccggcgacaccg

SEQ ID NO: 2351931 - RNA, 18 nt, Bordetella pertussis
aucccggcgacaccgcgg

SEQ ID NO: 2351932 - RNA, 21 nt, Bordetella pertussis
aucccggcgacaccgcggccu

SEQ ID NO: 2351933 - RNA, 16 nt, Bordetella pertussis
aucccggcgcuggccg

SEQ ID NO: 2351934 - RNA, 18 nt, Bordetella pertussis
aucccgucauggcggcag

SEQ ID NO: 2351935 - RNA, 16 nt, Bordetella pertussis
aucccuaccgccuugc

SEQ ID NO: 2351936 - RNA, 15 nt, Bordetella pertussis
aucccugaucccggc

SEQ ID NO: 2351937 - RNA, 20 nt, Bordetella pertussis
aucccugaucccggcgcugg

SEQ ID NO: 2351938 - RNA, 18 nt, Bordetella pertussis
aucccuugugcgcgccaa

SEQ ID NO: 2351939 - RNA, 15 nt, Bordetella pertussis
auccgacgcguucgc

SEQ ID NO: 2351940 - RNA, 18 nt, Bordetella pertussis
auccgaugaugcccagga

SEQ ID NO: 2351941 - RNA, 15 nt, Bordetella pertussis
auccgccgcggccag

SEQ ID NO: 2351942 - RNA, 23 nt, Bordetella pertussis
auccgccguugcucgcgcgcagu

SEQ ID NO: 2351943 - RNA, 22 nt, Bordetella pertussis
auccgcgaagugccuguccccg

SEQ ID NO: 2351944 - RNA, 12 nt, Bordetella pertussis
auccgcgcauga

SEQ ID NO: 2351945 - RNA, 14 nt, Bordetella pertussis
auccgcgccaggau

SEQ ID NO: 2351946 - RNA, 15 nt, Bordetella pertussis
auccgcgcugcugcc

SEQ ID NO: 2351947 - RNA, 18 nt, Bordetella pertussis
auccgcgcugcugccguc

SEQ ID NO: 2351948 - RNA, 16 nt, Bordetella pertussis
auccgcggguucggcg

SEQ ID NO: 2351949 - RNA, 23 nt, Bordetella pertussis
auccggacugaacgcguccaggc

SEQ ID NO: 2351950 - RNA, 14 nt, Bordetella pertussis
auccggcagcagca

SEQ ID NO: 2351951 - RNA, 14 nt, Bordetella pertussis
auccggccacgcau

SEQ ID NO: 2351952 - RNA, 21 nt, Bordetella pertussis
auccggcccagcgccaucggc

SEQ ID NO: 2351953 - RNA, 21 nt, Bordetella pertussis
auccggcccggugcagccgcc

SEQ ID NO: 2351954 - RNA, 20 nt, Bordetella pertussis
auccggccgcacgcggccgc

SEQ ID NO: 2351955 - RNA, 21 nt, Bordetella pertussis
auccggccgcacgcggccgcg

SEQ ID NO: 2351956 - RNA, 23 nt, Bordetella pertussis
auccggcgcacgccccgacgcgg

SEQ ID NO: 2351957 - RNA, 18 nt, Bordetella pertussis
auccggcgcaugauggcc

SEQ ID NO: 2351958 - RNA, 21 nt, Bordetella pertussis
auccggcgcaugauggccggc

SEQ ID NO: 2351959 - RNA, 23 nt, Bordetella pertussis
auccggcgcaugauggccggccu

SEQ ID NO: 2351960 - RNA, 21 nt, Bordetella pertussis
auccggcgugguaucgcgcca

SEQ ID NO: 2351961 - RNA, 13 nt, Bordetella pertussis
auccgggcccggu

SEQ ID NO: 2351962 - RNA, 14 nt, Bordetella pertussis
auccgggcccgguu

SEQ ID NO: 2351963 - RNA, 13 nt, Bordetella pertussis
auccgggccuggc

SEQ ID NO: 2351964 - RNA, 17 nt, Bordetella pertussis
auccgggcgcugcgccg

SEQ ID NO: 2351965 - RNA, 18 nt, Bordetella pertussis
auccgguaugccugccag

SEQ ID NO: 2351966 - RNA, 12 nt, Bordetella pertussis
auccggugauca

SEQ ID NO: 2351967 - RNA, 20 nt, Bordetella pertussis
auccggugauuucggcgcau

SEQ ID NO: 2351968 - RNA, 18 nt, Bordetella pertussis
auccguaguccagcagca

SEQ ID NO: 2351969 - RNA, 17 nt, Bordetella pertussis
auccucgcccagcggcg

SEQ ID NO: 2351970 - RNA, 22 nt, Bordetella pertussis
auccucgcccagcggcgccgac

SEQ ID NO: 2351971 - RNA, 16 nt, Bordetella pertussis
auccucgcugccggcg

SEQ ID NO: 2351972 - RNA, 22 nt, Bordetella pertussis
auccucgggcgacuccagcccg

SEQ ID NO: 2351973 - RNA, 18 nt, Bordetella pertussis
auccugaccaucaucaac

SEQ ID NO: 2351974 - RNA, 16 nt, Bordetella pertussis
auccugaugucggccu

SEQ ID NO: 2351975 - RNA, 13 nt, Bordetella pertussis
auccugcggcgcg

SEQ ID NO: 2351976 - RNA, 15 nt, Bordetella pertussis
auccuggcauugagc

SEQ ID NO: 2351977 - RNA, 14 nt, Bordetella pertussis
auccuggccgccgc

SEQ ID NO: 2351978 - RNA, 13 nt, Bordetella pertussis
auccuggcgcgga

SEQ ID NO: 2351979 - RNA, 15 nt, Bordetella pertussis
auccuggcgcggaca

SEQ ID NO: 2351980 - RNA, 21 nt, Bordetella pertussis
auccuggcucugaucgcgcug

SEQ ID NO: 2351981 - RNA, 22 nt, Bordetella pertussis
auccuggcucugaucgcgcugg

SEQ ID NO: 2351982 - RNA, 21 nt, Bordetella pertussis
auccuggucgaacguggcggc

SEQ ID NO: 2351983 - RNA, 18 nt, Bordetella pertussis
auccuguucgugauccug

SEQ ID NO: 2351984 - RNA, 20 nt, Bordetella pertussis
auccuucacgaaccgcagaa

SEQ ID NO: 2351985 - RNA, 17 nt, Bordetella pertussis
auccuucagguuccagg

SEQ ID NO: 2351986 - RNA, 23 nt, Bordetella pertussis
auccuugacgaauuucucggcca

SEQ ID NO: 2351987 - RNA, 20 nt, Bordetella pertussis
auccuugcgcucgcccagca

SEQ ID NO: 2351988 - RNA, 21 nt, Bordetella pertussis
auccuugcgcucgcccagcac

SEQ ID NO: 2351989 - RNA, 22 nt, Bordetella pertussis
aucgaacgacucgucgaccacc

SEQ ID NO: 2351990 - RNA, 16 nt, Bordetella pertussis
aucgaacgcggccaga

SEQ ID NO: 2351991 - RNA, 16 nt, Bordetella pertussis
aucgaacuuggcgcgg

SEQ ID NO: 2351992 - RNA, 17 nt, Bordetella pertussis
aucgaaggcgaccggca

SEQ ID NO: 2351993 - RNA, 22 nt, Bordetella pertussis
aucgaauggucggccucggcga

SEQ ID NO: 2351994 - RNA, 15 nt, Bordetella pertussis
aucgacaacaagccg

SEQ ID NO: 2351995 - RNA, 16 nt, Bordetella pertussis
aucgacaggaacagca

SEQ ID NO: 2351996 - RNA, 19 nt, Bordetella pertussis
aucgacaugcccgccggca

SEQ ID NO: 2351997 - RNA, 14 nt, Bordetella pertussis
aucgaccaccagcg

SEQ ID NO: 2351998 - RNA, 20 nt, Bordetella pertussis
aucgacccaggccggcgcca

SEQ ID NO: 2351999 - RNA, 13 nt, Bordetella pertussis
aucgacgcggcga

SEQ ID NO: 2352000 - RNA, 18 nt, Bordetella pertussis
aucgacgcuugccggcga

SEQ ID NO: 2352001 - RNA, 16 nt, Bordetella pertussis
aucgacgggcggcugc

SEQ ID NO: 2352002 - RNA, 14 nt, Bordetella pertussis
aucgacucggccga

SEQ ID NO: 2352003 - RNA, 18 nt, Bordetella pertussis
aucgagaaaccagccgcc

SEQ ID NO: 2352004 - RNA, 22 nt, Bordetella pertussis
aucgagaaaccagccgccgcca

SEQ ID NO: 2352005 - RNA, 15 nt, Bordetella pertussis
aucgagcaggccgcc

SEQ ID NO: 2352006 - RNA, 17 nt, Bordetella pertussis
aucgagcaggccgccgg

SEQ ID NO: 2352007 - RNA, 17 nt, Bordetella pertussis
aucgagcgcgguggccg

SEQ ID NO: 2352008 - RNA, 22 nt, Bordetella pertussis
aucgagcuggcccacgcccaug

SEQ ID NO: 2352009 - RNA, 16 nt, Bordetella pertussis
aucgaggaaggcccgc

SEQ ID NO: 2352010 - RNA, 17 nt, Bordetella pertussis
aucgaggcaaucagccc

SEQ ID NO: 2352011 - RNA, 19 nt, Bordetella pertussis
aucgagguuuccgccaugc

SEQ ID NO: 2352012 - RNA, 14 nt, Bordetella pertussis
aucgaguaggccgg

SEQ ID NO: 2352013 - RNA, 20 nt, Bordetella pertussis
aucgaguaggccggcacguc

SEQ ID NO: 2352014 - RNA, 17 nt, Bordetella pertussis
aucgauacgccgggcgc

SEQ ID NO: 2352015 - RNA, 23 nt, Bordetella pertussis
aucgauacgccgggcgcguggcc

SEQ ID NO: 2352016 - RNA, 17 nt, Bordetella pertussis
aucgauaugggcggccu

SEQ ID NO: 2352017 - RNA, 16 nt, Bordetella pertussis
aucgaucagccagccg

SEQ ID NO: 2352018 - RNA, 21 nt, Bordetella pertussis
aucgaucaguaucucggcgcc

SEQ ID NO: 2352019 - RNA, 14 nt, Bordetella pertussis
aucggcgucagcgc

SEQ ID NO: 2352020 - RNA, 13 nt, Bordetella pertussis
aucggcgucggca

SEQ ID NO: 2352021 - RNA, 23 nt, Bordetella pertussis
aucggcucgagcaagggccagac

SEQ ID NO: 2352022 - RNA, 21 nt, Bordetella pertussis
aucggcuugccgcgcggcgua

SEQ ID NO: 2352023 - RNA, 17 nt, Bordetella pertussis
aucgggagccucuggaa

SEQ ID NO: 2352024 - RNA, 20 nt, Bordetella pertussis
aucgggcaacaaggccacga

SEQ ID NO: 2352025 - RNA, 13 nt, Bordetella pertussis
aucgggcagcacg

SEQ ID NO: 2352026 - RNA, 22 nt, Bordetella pertussis
aucgggcagcacgcgcaccagg

SEQ ID NO: 2352027 - RNA, 14 nt, Bordetella pertussis
aucgggcagcuugg

SEQ ID NO: 2352028 - RNA, 12 nt, Bordetella pertussis
aucgggcugcgg

SEQ ID NO: 2352029 - RNA, 21 nt, Bordetella pertussis
aucggggggugcgaggcgaac

SEQ ID NO: 2352030 - RNA, 16 nt, Bordetella pertussis
aucggggucgaucgca

SEQ ID NO: 2352031 - RNA, 17 nt, Bordetella pertussis
aucgggguggcgccguu

SEQ ID NO: 2352032 - RNA, 20 nt, Bordetella pertussis
aucgggguuccacagcgccg

SEQ ID NO: 2352033 - RNA, 20 nt, Bordetella pertussis
aucggugcggccgguggcga

SEQ ID NO: 2352034 - RNA, 14 nt, Bordetella pertussis
aucguaggcgcugu

SEQ ID NO: 2352035 - RNA, 19 nt, Bordetella pertussis
aucguaggcgcuguuggcc

SEQ ID NO: 2352036 - RNA, 15 nt, Bordetella pertussis
aucgucagcagcacg

SEQ ID NO: 2352037 - RNA, 17 nt, Bordetella pertussis
aucgucagcagcacgcc

SEQ ID NO: 2352038 - RNA, 18 nt, Bordetella pertussis
aucgucaggcaggcgcgc

SEQ ID NO: 2352039 - RNA, 15 nt, Bordetella pertussis
aucgucaucaccaag

SEQ ID NO: 2352040 - RNA, 23 nt, Bordetella pertussis
aucgucgacaccaaccugcuggc

SEQ ID NO: 2352041 - RNA, 20 nt, Bordetella pertussis
aucgucgacguccuggugga

SEQ ID NO: 2352042 - RNA, 14 nt, Bordetella pertussis
aucgucgcgcugcg

SEQ ID NO: 2352043 - RNA, 23 nt, Bordetella pertussis
aucgucgcgcugcgacagcagca

SEQ ID NO: 2352044 - RNA, 17 nt, Bordetella pertussis
aucgucgcgcuggggca

SEQ ID NO: 2352045 - RNA, 16 nt, Bordetella pertussis
aucgucgcugcggccg

SEQ ID NO: 2352046 - RNA, 16 nt, Bordetella pertussis
aucgucggacaacgcc

SEQ ID NO: 2352047 - RNA, 20 nt, Bordetella pertussis
aucgucggcaaccgucgcca

SEQ ID NO: 2352048 - RNA, 10 nt, Bordetella pertussis
aucgucggcg

SEQ ID NO: 2352049 - RNA, 13 nt, Bordetella pertussis
aucgucggcgcca

SEQ ID NO: 2352050 - RNA, 15 nt, Bordetella pertussis
aucgucggcgccaug

SEQ ID NO: 2352051 - RNA, 14 nt, Bordetella pertussis
aucgucuugaccag

SEQ ID NO: 2352052 - RNA, 23 nt, Bordetella pertussis
aucgugcacgcccgcggcgccca

SEQ ID NO: 2352053 - RNA, 13 nt, Bordetella pertussis
aucgugccgggga

SEQ ID NO: 2352054 - RNA, 23 nt, Bordetella pertussis
aucgugccggggaucaccagccc

SEQ ID NO: 2352055 - RNA, 18 nt, Bordetella pertussis
aucgugcucgugcugggc

SEQ ID NO: 2352056 - RNA, 20 nt, Bordetella pertussis
aucgugcuguucggcgaccg

SEQ ID NO: 2352057 - RNA, 14 nt, Bordetella pertussis
aucguggccgcgca

SEQ ID NO: 2352058 - RNA, 14 nt, Bordetella pertussis
aucguggcuggcga

SEQ ID NO: 2352059 - RNA, 18 nt, Bordetella pertussis
aucguuacagcuccuuga

SEQ ID NO: 2352060 - RNA, 22 nt, Bordetella pertussis
aucguucccuacccgccgggcg

SEQ ID NO: 2352061 - RNA, 14 nt, Bordetella pertussis
aucguugucgcgcc

SEQ ID NO: 2352062 - RNA, 14 nt, Bordetella pertussis
aucucaaccacgaa

SEQ ID NO: 2352063 - RNA, 16 nt, Bordetella pertussis
aucucagccaucauca

SEQ ID NO: 2352064 - RNA, 19 nt, Bordetella pertussis
aucuccacccccgggcgca

SEQ ID NO: 2352065 - RNA, 16 nt, Bordetella pertussis
aucuccacgaaggcga

SEQ ID NO: 2352066 - RNA, 21 nt, Bordetella pertussis
aucuccacgaaggcgaucugc

SEQ ID NO: 2352067 - RNA, 11 nt, Bordetella pertussis
aucuccaggau

SEQ ID NO: 2352068 - RNA, 21 nt, Bordetella pertussis
aucucccgcaggcccacaaug

SEQ ID NO: 2352069 - RNA, 13 nt, Bordetella pertussis
aucucccggcgcc

SEQ ID NO: 2352070 - RNA, 14 nt, Bordetella pertussis
aucucccggcgccc

SEQ ID NO: 2352071 - RNA, 15 nt, Bordetella pertussis
aucuccggauccagc

SEQ ID NO: 2352072 - RNA, 19 nt, Bordetella pertussis
aucuccggauccagccgcu

SEQ ID NO: 2352073 - RNA, 16 nt, Bordetella pertussis
aucuccggcgccuggc

SEQ ID NO: 2352074 - RNA, 16 nt, Bordetella pertussis
aucucgcccugcucgc

SEQ ID NO: 2352075 - RNA, 19 nt, Bordetella pertussis
aucucggccagcagcgccu

SEQ ID NO: 2352076 - RNA, 19 nt, Bordetella pertussis
aucucgggauaggccucgg

SEQ ID NO: 2352077 - RNA, 19 nt, Bordetella pertussis
aucucgggcaggucggcca

SEQ ID NO: 2352078 - RNA, 20 nt, Bordetella pertussis
aucucgggcaggucggccag

SEQ ID NO: 2352079 - RNA, 17 nt, Bordetella pertussis
aucucgucgaccgccuc

SEQ ID NO: 2352080 - RNA, 13 nt, Bordetella pertussis
aucugaucaucuu

SEQ ID NO: 2352081 - RNA, 22 nt, Bordetella pertussis
aucugcacccccuuggcuucgg

SEQ ID NO: 2352082 - RNA, 14 nt, Bordetella pertussis
aucugcaugccgac

SEQ ID NO: 2352083 - RNA, 20 nt, Bordetella pertussis
aucugcauguacucggccag

SEQ ID NO: 2352084 - RNA, 14 nt, Bordetella pertussis
aucugccgcgcauu

SEQ ID NO: 2352085 - RNA, 21 nt, Bordetella pertussis
aucugcgagccuucggccggc

SEQ ID NO: 2352086 - RNA, 19 nt, Bordetella pertussis
aucugcggaaacagauuga

SEQ ID NO: 2352087 - RNA, 12 nt, Bordetella pertussis
aucugcggcacg

SEQ ID NO: 2352088 - RNA, 13 nt, Bordetella pertussis
aucugcggcgugg

SEQ ID NO: 2352089 - RNA, 16 nt, Bordetella pertussis
aucugcgucgccuggu

SEQ ID NO: 2352090 - RNA, 12 nt, Bordetella pertussis
aucugcuugccg

SEQ ID NO: 2352091 - RNA, 23 nt, Bordetella pertussis
aucuggcaaucgggguggcgccg

SEQ ID NO: 2352092 - RNA, 20 nt, Bordetella pertussis
aucuggccgauggccucgcu

SEQ ID NO: 2352093 - RNA, 13 nt, Bordetella pertussis
aucuggccugucu

SEQ ID NO: 2352094 - RNA, 19 nt, Bordetella pertussis
aucuggccugucugguggc

SEQ ID NO: 2352095 - RNA, 18 nt, Bordetella pertussis
aucuggcgcauggccggc

SEQ ID NO: 2352096 - RNA, 14 nt, Bordetella pertussis
aucuggcgcgcgac

SEQ ID NO: 2352097 - RNA, 19 nt, Bordetella pertussis
aucuggcgcgcgaccaggc

SEQ ID NO: 2352098 - RNA, 21 nt, Bordetella pertussis
aucuggcgcgucaggccgggc

SEQ ID NO: 2352099 - RNA, 18 nt, Bordetella pertussis
aucugggccucggccagc

SEQ ID NO: 2352100 - RNA, 19 nt, Bordetella pertussis
aucugggcgucgaaggcgg

SEQ ID NO: 2352101 - RNA, 19 nt, Bordetella pertussis
aucugguagugcaggccgc

SEQ ID NO: 2352102 - RNA, 21 nt, Bordetella pertussis
aucugguagugcaggccgcgc

SEQ ID NO: 2352103 - RNA, 19 nt, Bordetella pertussis
aucugguccacggcggcgg

SEQ ID NO: 2352104 - RNA, 17 nt, Bordetella pertussis
aucugguccugggccgu

SEQ ID NO: 2352105 - RNA, 22 nt, Bordetella pertussis
aucuguccccgcggggacaggc

SEQ ID NO: 2352106 - RNA, 23 nt, Bordetella pertussis
aucuguccccgcggggacaggca

SEQ ID NO: 2352107 - RNA, 19 nt, Bordetella pertussis
aucuguucggcgccgggcg

SEQ ID NO: 2352108 - RNA, 18 nt, Bordetella pertussis
aucuucgugcuggccauc

SEQ ID NO: 2352109 - RNA, 16 nt, Bordetella pertussis
aucuucugcgccacgg

SEQ ID NO: 2352110 - RNA, 15 nt, Bordetella pertussis
aucuugaugccgccc

SEQ ID NO: 2352111 - RNA, 16 nt, Bordetella pertussis
aucuugaugcggccgu

SEQ ID NO: 2352112 - RNA, 17 nt, Bordetella pertussis
aucuugccaggcccggc

SEQ ID NO: 2352113 - RNA, 17 nt, Bordetella pertussis
aucuugccgaccgcguc

SEQ ID NO: 2352114 - RNA, 22 nt, Bordetella pertussis
aucuugccgaugcggcgcaugc

SEQ ID NO: 2352115 - RNA, 16 nt, Bordetella pertussis
aucuugccggccuggc

SEQ ID NO: 2352116 - RNA, 18 nt, Bordetella pertussis
aucuugccggccuguucu

SEQ ID NO: 2352117 - RNA, 19 nt, Bordetella pertussis
aucuugccggccuguucuu

SEQ ID NO: 2352118 - RNA, 14 nt, Bordetella pertussis
aucuuggccgccac

SEQ ID NO: 2352119 - RNA, 14 nt, Bordetella pertussis
aucuuggccuguuc

SEQ ID NO: 2352120 - RNA, 22 nt, Bordetella pertussis
aucuuggugcgcgccaggucgc

SEQ ID NO: 2352121 - RNA, 20 nt, Bordetella pertussis
augaaaaaccccgccaggcg

SEQ ID NO: 2352122 - RNA, 18 nt, Bordetella pertussis
augaaaaagggcgcacca

SEQ ID NO: 2352123 - RNA, 22 nt, Bordetella pertussis
augaaaauuauuugguggaggu

SEQ ID NO: 2352124 - RNA, 19 nt, Bordetella pertussis
augaaacgaucggcgaagg

SEQ ID NO: 2352125 - RNA, 15 nt, Bordetella pertussis
augaaacugcaaaau

SEQ ID NO: 2352126 - RNA, 21 nt, Bordetella pertussis
augaaaugcuggucgcgcacc

SEQ ID NO: 2352127 - RNA, 18 nt, Bordetella pertussis
augaacacuugacggcca

SEQ ID NO: 2352128 - RNA, 20 nt, Bordetella pertussis
augaacagcuugcuguccag

SEQ ID NO: 2352129 - RNA, 17 nt, Bordetella pertussis
augaacgaccagcacga

SEQ ID NO: 2352130 - RNA, 21 nt, Bordetella pertussis
augaacgcuugacggccagga

SEQ ID NO: 2352131 - RNA, 19 nt, Bordetella pertussis
augaacggcagcgcgcgcg

SEQ ID NO: 2352132 - RNA, 12 nt, Bordetella pertussis
augccaaggauc

SEQ ID NO: 2352133 - RNA, 22 nt, Bordetella pertussis
augccaaucaugcgcugcuggc

SEQ ID NO: 2352134 - RNA, 22 nt, Bordetella pertussis
augccagggugaccuggcgcgc

SEQ ID NO: 2352135 - RNA, 19 nt, Bordetella pertussis
augccaguuguaguggugu

SEQ ID NO: 2352136 - RNA, 15 nt, Bordetella pertussis
augccaugccgggca

SEQ ID NO: 2352137 - RNA, 21 nt, Bordetella pertussis
augccauggacgagggccggc

SEQ ID NO: 2352138 - RNA, 13 nt, Bordetella pertussis
augcccaccagcc

SEQ ID NO: 2352139 - RNA, 16 nt, Bordetella pertussis
augcccaccagccgcc

SEQ ID NO: 2352140 - RNA, 20 nt, Bordetella pertussis
augcccaccagccgcccggc

SEQ ID NO: 2352141 - RNA, 14 nt, Bordetella pertussis
augcccagcccggc

SEQ ID NO: 2352142 - RNA, 14 nt, Bordetella pertussis
augcccagcgccag

SEQ ID NO: 2352143 - RNA, 17 nt, Bordetella pertussis
augcccagcgccgccga

SEQ ID NO: 2352144 - RNA, 14 nt, Bordetella pertussis
augcccaggcccgc

SEQ ID NO: 2352145 - RNA, 18 nt, Bordetella pertussis
augcccaggcccgccagg

SEQ ID NO: 2352146 - RNA, 13 nt, Bordetella pertussis
augcccaggucgu

SEQ ID NO: 2352147 - RNA, 18 nt, Bordetella pertussis
augcccaugccgccaugc

SEQ ID NO: 2352148 - RNA, 21 nt, Bordetella pertussis
augcccauggggugcuccugc

SEQ ID NO: 2352149 - RNA, 22 nt, Bordetella pertussis
augcccauuuccaccacgcggu

SEQ ID NO: 2352150 - RNA, 13 nt, Bordetella pertussis
augccccagucca

SEQ ID NO: 2352151 - RNA, 16 nt, Bordetella pertussis
augccccaguccaggc

SEQ ID NO: 2352152 - RNA, 20 nt, Bordetella pertussis
augccccaguccaggccggc

SEQ ID NO: 2352153 - RNA, 16 nt, Bordetella pertussis
augccccauccagcgg

SEQ ID NO: 2352154 - RNA, 15 nt, Bordetella pertussis
augccccgcccgcgu

SEQ ID NO: 2352155 - RNA, 15 nt, Bordetella pertussis
augccccuccggguc

SEQ ID NO: 2352156 - RNA, 17 nt, Bordetella pertussis
augcccgaggcggcgcg

SEQ ID NO: 2352157 - RNA, 20 nt, Bordetella pertussis
augcccgcgcaccaggcgcg

SEQ ID NO: 2352158 - RNA, 23 nt, Bordetella pertussis
augcccucccagaaacuggcgcu

SEQ ID NO: 2352159 - RNA, 15 nt, Bordetella pertussis
augcccuccucggcc

SEQ ID NO: 2352160 - RNA, 14 nt, Bordetella pertussis
augcccucgcgcac

SEQ ID NO: 2352161 - RNA, 20 nt, Bordetella pertussis
augcccucuucggcggccag

SEQ ID NO: 2352162 - RNA, 21 nt, Bordetella pertussis
augcccucuucggcggccagc

SEQ ID NO: 2352163 - RNA, 16 nt, Bordetella pertussis
augcccuggauggccu

SEQ ID NO: 2352164 - RNA, 15 nt, Bordetella pertussis
augcccuucggcaug

SEQ ID NO: 2352165 - RNA, 12 nt, Bordetella pertussis
augccgaacagc

SEQ ID NO: 2352166 - RNA, 14 nt, Bordetella pertussis
augccgaacagcau

SEQ ID NO: 2352167 - RNA, 22 nt, Bordetella pertussis
augccgaacagcauggcggcgc

SEQ ID NO: 2352168 - RNA, 15 nt, Bordetella pertussis
augccgaacagccag

SEQ ID NO: 2352169 - RNA, 19 nt, Bordetella pertussis
augccgaacagccagggca

SEQ ID NO: 2352170 - RNA, 20 nt, Bordetella pertussis
augccgaacucgcgcucggc

SEQ ID NO: 2352171 - RNA, 18 nt, Bordetella pertussis
augccgaacugucgcgcc

SEQ ID NO: 2352172 - RNA, 20 nt, Bordetella pertussis
augccgaacugucgcgccac

SEQ ID NO: 2352173 - RNA, 22 nt, Bordetella pertussis
augccgaacugucgcgccacgg

SEQ ID NO: 2352174 - RNA, 15 nt, Bordetella pertussis
augccgaagcgcgcg

SEQ ID NO: 2352175 - RNA, 17 nt, Bordetella pertussis
augccgaccaccagcac

SEQ ID NO: 2352176 - RNA, 13 nt, Bordetella pertussis
augccgaccaggc

SEQ ID NO: 2352177 - RNA, 19 nt, Bordetella pertussis
augccgaccgaagaggagc

SEQ ID NO: 2352178 - RNA, 23 nt, Bordetella pertussis
augccgauacgucgcagcacgcc

SEQ ID NO: 2352179 - RNA, 15 nt, Bordetella pertussis
augccgauggcggug

SEQ ID NO: 2352180 - RNA, 19 nt, Bordetella pertussis
augccgauguggcgguucc

SEQ ID NO: 2352181 - RNA, 22 nt, Bordetella pertussis
augccgauugugcaugacggcc

SEQ ID NO: 2352182 - RNA, 17 nt, Bordetella pertussis
augccgcagauggccag

SEQ ID NO: 2352183 - RNA, 19 nt, Bordetella pertussis
augccgcagauggccagca

SEQ ID NO: 2352184 - RNA, 24 nt, Bordetella pertussis
augccgcagauggccagcagcgcc

SEQ ID NO: 2352185 - RNA, 23 nt, Bordetella pertussis
augccgcagauuuccagcgcguc

SEQ ID NO: 2352186 - RNA, 21 nt, Bordetella pertussis
augccgcagcaccacaucgcc

SEQ ID NO: 2352187 - RNA, 22 nt, Bordetella pertussis
augccgccaucauccuggucga

SEQ ID NO: 2352188 - RNA, 17 nt, Bordetella pertussis
augccgcccacgaucac

SEQ ID NO: 2352189 - RNA, 18 nt, Bordetella pertussis
augccgcccacgccaugg

SEQ ID NO: 2352190 - RNA, 13 nt, Bordetella pertussis
augccgcccagca

SEQ ID NO: 2352191 - RNA, 22 nt, Bordetella pertussis
augccgcccagcaugcgcgcga

SEQ ID NO: 2352192 - RNA, 19 nt, Bordetella pertussis
augccgcccaugccgccgg

SEQ ID NO: 2352193 - RNA, 22 nt, Bordetella pertussis
augccgcccaugccgccgggca

SEQ ID NO: 2352194 - RNA, 11 nt, Bordetella pertussis
augccgcccgc

SEQ ID NO: 2352195 - RNA, 23 nt, Bordetella pertussis
augccgcccgcaugcagguccug

SEQ ID NO: 2352196 - RNA, 15 nt, Bordetella pertussis
augccgcccgccaug

SEQ ID NO: 2352197 - RNA, 21 nt, Bordetella pertussis
augccgccgaaccagcgcacc

SEQ ID NO: 2352198 - RNA, 20 nt, Bordetella pertussis
augccgccgugaugccgccc

SEQ ID NO: 2352199 - RNA, 18 nt, Bordetella pertussis
augccgccuucgagcugg

SEQ ID NO: 2352200 - RNA, 18 nt, Bordetella pertussis
augccgcgcaccugggcg

SEQ ID NO: 2352201 - RNA, 22 nt, Bordetella pertussis
augccgcgcaccugggcgucga

SEQ ID NO: 2352202 - RNA, 13 nt, Bordetella pertussis
augccgcggcaug

SEQ ID NO: 2352203 - RNA, 16 nt, Bordetella pertussis
augccgcuggcgaugg

SEQ ID NO: 2352204 - RNA, 17 nt, Bordetella pertussis
augccgcuggcgauggc

SEQ ID NO: 2352205 - RNA, 14 nt, Bordetella pertussis
augccggaaaucac

SEQ ID NO: 2352206 - RNA, 15 nt, Bordetella pertussis
augccggaacaggcg

SEQ ID NO: 2352207 - RNA, 18 nt, Bordetella pertussis
augccggcaagcacgaac

SEQ ID NO: 2352208 - RNA, 15 nt, Bordetella pertussis
augccggccagcagc

SEQ ID NO: 2352209 - RNA, 16 nt, Bordetella pertussis
augccggccagcagcg

SEQ ID NO: 2352210 - RNA, 18 nt, Bordetella pertussis
augccggccaugcucagc

SEQ ID NO: 2352211 - RNA, 19 nt, Bordetella pertussis
augccggccaugcucagca

SEQ ID NO: 2352212 - RNA, 22 nt, Bordetella pertussis
augccggccaugcucagcagca

SEQ ID NO: 2352213 - RNA, 15 nt, Bordetella pertussis
augccggccucggcc

SEQ ID NO: 2352214 - RNA, 16 nt, Bordetella pertussis
augccggccucggcca

SEQ ID NO: 2352215 - RNA, 17 nt, Bordetella pertussis
augccggccucggccau

SEQ ID NO: 2352216 - RNA, 20 nt, Bordetella pertussis
augccggcgaugaugggguc

SEQ ID NO: 2352217 - RNA, 16 nt, Bordetella pertussis
augccggcguggcgcg

SEQ ID NO: 2352218 - RNA, 18 nt, Bordetella pertussis
augccggcguugaaggcg

SEQ ID NO: 2352219 - RNA, 12 nt, Bordetella pertussis
augccgggcaag

SEQ ID NO: 2352220 - RNA, 19 nt, Bordetella pertussis
augccgggcaagcagaugg

SEQ ID NO: 2352221 - RNA, 17 nt, Bordetella pertussis
augccggguugcaggau

SEQ ID NO: 2352222 - RNA, 19 nt, Bordetella pertussis
augccggucuccagcgcgu

SEQ ID NO: 2352223 - RNA, 17 nt, Bordetella pertussis
augccguacuuggcgau

SEQ ID NO: 2352224 - RNA, 20 nt, Bordetella pertussis
augccguacuuggcgauggc

SEQ ID NO: 2352225 - RNA, 14 nt, Bordetella pertussis
augccguaggcgcc

SEQ ID NO: 2352226 - RNA, 16 nt, Bordetella pertussis
augccguaggcgccgg

SEQ ID NO: 2352227 - RNA, 17 nt, Bordetella pertussis
augccguaggcgccggc

SEQ ID NO: 2352228 - RNA, 18 nt, Bordetella pertussis
augccguaggcgccggcc

SEQ ID NO: 2352229 - RNA, 15 nt, Bordetella pertussis
augccgucaccggcu

SEQ ID NO: 2352230 - RNA, 19 nt, Bordetella pertussis
augccguccacgcccagcg

SEQ ID NO: 2352231 - RNA, 21 nt, Bordetella pertussis
augccguccacgcccagcgcc

SEQ ID NO: 2352232 - RNA, 22 nt, Bordetella pertussis
augccguccaggaagcagccca

SEQ ID NO: 2352233 - RNA, 17 nt, Bordetella pertussis
augccgucgaaggccgc

SEQ ID NO: 2352234 - RNA, 20 nt, Bordetella pertussis
augccgucgaaggccgcaac

SEQ ID NO: 2352235 - RNA, 20 nt, Bordetella pertussis
augccgucgagcgcggccag

SEQ ID NO: 2352236 - RNA, 16 nt, Bordetella pertussis
augccgucgcgcucgg

SEQ ID NO: 2352237 - RNA, 13 nt, Bordetella pertussis
augccgucggcga

SEQ ID NO: 2352238 - RNA, 16 nt, Bordetella pertussis
augccgucuuggcggg

SEQ ID NO: 2352239 - RNA, 17 nt, Bordetella pertussis
augccgucuuggcgggc

SEQ ID NO: 2352240 - RNA, 23 nt, Bordetella pertussis
augccgucuuggcgggcuagcug

SEQ ID NO: 2352241 - RNA, 18 nt, Bordetella pertussis
augccguggacgugcgcg

SEQ ID NO: 2352242 - RNA, 16 nt, Bordetella pertussis
augccucgaagcggcu

SEQ ID NO: 2352243 - RNA, 17 nt, Bordetella pertussis
augccuugcgcgacagc

SEQ ID NO: 2352244 - RNA, 16 nt, Bordetella pertussis
augcggguuggcaguc

SEQ ID NO: 2352245 - RNA, 16 nt, Bordetella pertussis
augcgguaccacgcga

SEQ ID NO: 2352246 - RNA, 21 nt, Bordetella pertussis
augcgguacugcggcgccugg

SEQ ID NO: 2352247 - RNA, 22 nt, Bordetella pertussis
augcggucggccgcgccgccgc

SEQ ID NO: 2352248 - RNA, 17 nt, Bordetella pertussis
augcgguuuuugaggac

SEQ ID NO: 2352249 - RNA, 17 nt, Bordetella pertussis
augcgucaggggcaugc

SEQ ID NO: 2352250 - RNA, 13 nt, Bordetella pertussis
augcguccgccgu

SEQ ID NO: 2352251 - RNA, 20 nt, Bordetella pertussis
augcguccgccgugcaggcc

SEQ ID NO: 2352252 - RNA, 19 nt, Bordetella pertussis
augcgucgaacggccgggc

SEQ ID NO: 2352253 - RNA, 20 nt, Bordetella pertussis
augcgucgaacggccgggcg

SEQ ID NO: 2352254 - RNA, 17 nt, Bordetella pertussis
augcgugaagcccaugg

SEQ ID NO: 2352255 - RNA, 19 nt, Bordetella pertussis
augcgugcgcaucagcgca

SEQ ID NO: 2352256 - RNA, 13 nt, Bordetella pertussis
augcguggccggc

SEQ ID NO: 2352257 - RNA, 19 nt, Bordetella pertussis
augcguggccggcgggggc

SEQ ID NO: 2352258 - RNA, 20 nt, Bordetella pertussis
augcgugguacggcgaagcc

SEQ ID NO: 2352259 - RNA, 17 nt, Bordetella pertussis
augcguguuccagcgcc

SEQ ID NO: 2352260 - RNA, 19 nt, Bordetella pertussis
augcguucgaaagccagcg

SEQ ID NO: 2352261 - RNA, 23 nt, Bordetella pertussis
augcguucgcccgugccgcagaa

SEQ ID NO: 2352262 - RNA, 14 nt, Bordetella pertussis
augcguucggccag

SEQ ID NO: 2352263 - RNA, 15 nt, Bordetella pertussis
augcguucggccagc

SEQ ID NO: 2352264 - RNA, 19 nt, Bordetella pertussis
augcucacgcccaguccca

SEQ ID NO: 2352265 - RNA, 22 nt, Bordetella pertussis
augcucgauaugcagcaccgga

SEQ ID NO: 2352266 - RNA, 17 nt, Bordetella pertussis
augcucgccggcgccgc

SEQ ID NO: 2352267 - RNA, 18 nt, Bordetella pertussis
augcucgcgcacagcgcg

SEQ ID NO: 2352268 - RNA, 18 nt, Bordetella pertussis
augcucguccaucgccug

SEQ ID NO: 2352269 - RNA, 20 nt, Bordetella pertussis
augcucuggcacaccagcgc

SEQ ID NO: 2352270 - RNA, 23 nt, Bordetella pertussis
augcucuggcacaccagcgccag

SEQ ID NO: 2352271 - RNA, 20 nt, Bordetella pertussis
augcugaauugcgggccggc

SEQ ID NO: 2352272 - RNA, 13 nt, Bordetella pertussis
augcugauccugg

SEQ ID NO: 2352273 - RNA, 18 nt, Bordetella pertussis
augcugcagcugcuugcc

SEQ ID NO: 2352274 - RNA, 14 nt, Bordetella pertussis
augcugccgggcau

SEQ ID NO: 2352275 - RNA, 13 nt, Bordetella pertussis
augcugcgacagc

SEQ ID NO: 2352276 - RNA, 23 nt, Bordetella pertussis
augcugcgacagcagggccaggc

SEQ ID NO: 2352277 - RNA, 20 nt, Bordetella pertussis
augcugcguaggcaggggcu

SEQ ID NO: 2352278 - RNA, 19 nt, Bordetella pertussis
augcuggcauugacgacgc

SEQ ID NO: 2352279 - RNA, 15 nt, Bordetella pertussis
augcuggcccagcug

SEQ ID NO: 2352280 - RNA, 16 nt, Bordetella pertussis
augcuggcccagcugg

SEQ ID NO: 2352281 - RNA, 21 nt, Bordetella pertussis
augcuggcccagcugggcggc

SEQ ID NO: 2352282 - RNA, 15 nt, Bordetella pertussis
augcuggcgcggacc

SEQ ID NO: 2352283 - RNA, 21 nt, Bordetella pertussis
augcuggcgcggaccugcucg

SEQ ID NO: 2352284 - RNA, 11 nt, Bordetella pertussis
augcugggcgg

SEQ ID NO: 2352285 - RNA, 16 nt, Bordetella pertussis
augcugggcgggcugg

SEQ ID NO: 2352286 - RNA, 17 nt, Bordetella pertussis
augcugggcgggcuggu

SEQ ID NO: 2352287 - RNA, 15 nt, Bordetella pertussis
augcuggucagccug

SEQ ID NO: 2352288 - RNA, 24 nt, Bordetella pertussis
augcuggucagccugggcgccugg

SEQ ID NO: 2352289 - RNA, 14 nt, Bordetella pertussis
augcuggucgcgca

SEQ ID NO: 2352290 - RNA, 13 nt, Bordetella pertussis
augcuggugugaa

SEQ ID NO: 2352291 - RNA, 15 nt, Bordetella pertussis
augcuugccauaggc

SEQ ID NO: 2352292 - RNA, 18 nt, Bordetella pertussis
augcuugccauaggccag

SEQ ID NO: 2352293 - RNA, 19 nt, Bordetella pertussis
augcuugccauaggccagc

SEQ ID NO: 2352294 - RNA, 18 nt, Bordetella pertussis
augcuugcuugccagcuc

SEQ ID NO: 2352295 - RNA, 15 nt, Bordetella pertussis
auggaauacgccgau

SEQ ID NO: 2352296 - RNA, 13 nt, Bordetella pertussis
auggaccgccgcc

SEQ ID NO: 2352297 - RNA, 19 nt, Bordetella pertussis
auggacgagggccggcgcc

SEQ ID NO: 2352298 - RNA, 14 nt, Bordetella pertussis
auggacgccgccgc

SEQ ID NO: 2352299 - RNA, 12 nt, Bordetella pertussis
auggacgccggg

SEQ ID NO: 2352300 - RNA, 20 nt, Bordetella pertussis
auggacgcguucucgcgcuu

SEQ ID NO: 2352301 - RNA, 16 nt, Bordetella pertussis
auggagccaggcggcg

SEQ ID NO: 2352302 - RNA, 17 nt, Bordetella pertussis
auggaggggcgcaggca

SEQ ID NO: 2352303 - RNA, 18 nt, Bordetella pertussis
auggagucggucagccug

SEQ ID NO: 2352304 - RNA, 18 nt, Bordetella pertussis
auggaguucagcagcucg

SEQ ID NO: 2352305 - RNA, 19 nt, Bordetella pertussis
auggaugcgcgccccgucg

SEQ ID NO: 2352306 - RNA, 14 nt, Bordetella pertussis
auggauucgcgccg

SEQ ID NO: 2352307 - RNA, 15 nt, Bordetella pertussis
auggauuucgaccgc

SEQ ID NO: 2352308 - RNA, 16 nt, Bordetella pertussis
auggcacggcacgccu

SEQ ID NO: 2352309 - RNA, 21 nt, Bordetella pertussis
auggcagcacaagggccccuc

SEQ ID NO: 2352310 - RNA, 21 nt, Bordetella pertussis
auggcagcagaucggcggccu

SEQ ID NO: 2352311 - RNA, 15 nt, Bordetella pertussis
auggcagggcgccgc

SEQ ID NO: 2352312 - RNA, 16 nt, Bordetella pertussis
auggcagggcgccgcg

SEQ ID NO: 2352313 - RNA, 19 nt, Bordetella pertussis
auggcagggcgccgcgcgg

SEQ ID NO: 2352314 - RNA, 14 nt, Bordetella pertussis
auggcauggggcag

SEQ ID NO: 2352315 - RNA, 19 nt, Bordetella pertussis
auggcauggggcaggcgca

SEQ ID NO: 2352316 - RNA, 18 nt, Bordetella pertussis
auggccagcacauacgcc

SEQ ID NO: 2352317 - RNA, 23 nt, Bordetella pertussis
auggccagcacauacgccgccga

SEQ ID NO: 2352318 - RNA, 19 nt, Bordetella pertussis
auggccagcagcgccgcca

SEQ ID NO: 2352319 - RNA, 14 nt, Bordetella pertussis
auggccagccgcuu

SEQ ID NO: 2352320 - RNA, 22 nt, Bordetella pertussis
auggccagguacaggccgccgg

SEQ ID NO: 2352321 - RNA, 18 nt, Bordetella pertussis
auggccagguggcggcgg

SEQ ID NO: 2352322 - RNA, 21 nt, Bordetella pertussis
auggccaucgcgguccugacc

SEQ ID NO: 2352323 - RNA, 21 nt, Bordetella pertussis
auggcccagggcagcggccag

SEQ ID NO: 2352324 - RNA, 23 nt, Bordetella pertussis
auggccgaaucguucacgcccga

SEQ ID NO: 2352325 - RNA, 19 nt, Bordetella pertussis
auggccgaaugcccgcccu

SEQ ID NO: 2352326 - RNA, 20 nt, Bordetella pertussis
auggccgaaugcccgcccuu

SEQ ID NO: 2352327 - RNA, 21 nt, Bordetella pertussis
auggccgacagcgucgagcug

SEQ ID NO: 2352328 - RNA, 17 nt, Bordetella pertussis
auggccgccagcggcug

SEQ ID NO: 2352329 - RNA, 18 nt, Bordetella pertussis
auggccgccagcggcugg

SEQ ID NO: 2352330 - RNA, 14 nt, Bordetella pertussis
auggccgcccagca

SEQ ID NO: 2352331 - RNA, 15 nt, Bordetella pertussis
auggccgcccagcau

SEQ ID NO: 2352332 - RNA, 21 nt, Bordetella pertussis
auggccgccuuuucgcagcgg

SEQ ID NO: 2352333 - RNA, 14 nt, Bordetella pertussis
auggccgcgcccag

SEQ ID NO: 2352334 - RNA, 22 nt, Bordetella pertussis
auggccgcgcccagcgcggccu

SEQ ID NO: 2352335 - RNA, 22 nt, Bordetella pertussis
auggccgcgcgcagcgaggccu

SEQ ID NO: 2352336 - RNA, 16 nt, Bordetella pertussis
auggccggcgcgaacc

SEQ ID NO: 2352337 - RNA, 18 nt, Bordetella pertussis
auggccggcguguucagc

SEQ ID NO: 2352338 - RNA, 18 nt, Bordetella pertussis
auggccgggccguggcga

SEQ ID NO: 2352339 - RNA, 16 nt, Bordetella pertussis
auggccgugcgcccga

SEQ ID NO: 2352340 - RNA, 17 nt, Bordetella pertussis
auggccgugcgcccgac

SEQ ID NO: 2352341 - RNA, 20 nt, Bordetella pertussis
auggccguggcgugcaggcc

SEQ ID NO: 2352342 - RNA, 18 nt, Bordetella pertussis
auggccguuggccagcgc

SEQ ID NO: 2352343 - RNA, 16 nt, Bordetella pertussis
auggccucgcugccag

SEQ ID NO: 2352344 - RNA, 19 nt, Bordetella pertussis
auggccucggcauggcgcg

SEQ ID NO: 2352345 - RNA, 16 nt, Bordetella pertussis
auggccucggcggccu

SEQ ID NO: 2352346 - RNA, 17 nt, Bordetella pertussis
auggccugcuuggcgcg

SEQ ID NO: 2352347 - RNA, 13 nt, Bordetella pertussis
auggccuggaugu

SEQ ID NO: 2352348 - RNA, 22 nt, Bordetella pertussis
auggccuggaugugcaggccga

SEQ ID NO: 2352349 - RNA, 16 nt, Bordetella pertussis
auggccuggcccagcu

SEQ ID NO: 2352350 - RNA, 23 nt, Bordetella pertussis
auggccuggcccagcuccagcug

SEQ ID NO: 2352351 - RNA, 14 nt, Bordetella pertussis
auggccugggugcg

SEQ ID NO: 2352352 - RNA, 21 nt, Bordetella pertussis
auggccuuggaguagccgcuc

SEQ ID NO: 2352353 - RNA, 21 nt, Bordetella pertussis
auggcgaucgaacgcggccag

SEQ ID NO: 2352354 - RNA, 20 nt, Bordetella pertussis
auggcgaucuucugggcggc

SEQ ID NO: 2352355 - RNA, 15 nt, Bordetella pertussis
auggcgcaggcgcgc

SEQ ID NO: 2352356 - RNA, 21 nt, Bordetella pertussis
auggugcuccgacggcuggag

SEQ ID NO: 2352357 - RNA, 14 nt, Bordetella pertussis
auggugggcaugac

SEQ ID NO: 2352358 - RNA, 19 nt, Bordetella pertussis
augguggggcuggccgccg

SEQ ID NO: 2352359 - RNA, 16 nt, Bordetella pertussis
augguguacagccgcc

SEQ ID NO: 2352360 - RNA, 19 nt, Bordetella pertussis
auguaaaaacccggccugc

SEQ ID NO: 2352361 - RNA, 15 nt, Bordetella pertussis
auguacagcgguucg

SEQ ID NO: 2352362 - RNA, 17 nt, Bordetella pertussis
auguagaacgccagggu

SEQ ID NO: 2352363 - RNA, 13 nt, Bordetella pertussis
auguaggccaggu

SEQ ID NO: 2352364 - RNA, 14 nt, Bordetella pertussis
auguaggcgccgcg

SEQ ID NO: 2352365 - RNA, 16 nt, Bordetella pertussis
auguaguagccgccgc

SEQ ID NO: 2352366 - RNA, 20 nt, Bordetella pertussis
auguaguucacccagguauc

SEQ ID NO: 2352367 - RNA, 21 nt, Bordetella pertussis
auguaugacuugaccgcaugc

SEQ ID NO: 2352368 - RNA, 20 nt, Bordetella pertussis
auguauucaucacgggcgcc

SEQ ID NO: 2352369 - RNA, 15 nt, Bordetella pertussis
auguccaccagccgg

SEQ ID NO: 2352370 - RNA, 19 nt, Bordetella pertussis
auguccaccauccugcccc

SEQ ID NO: 2352371 - RNA, 16 nt, Bordetella pertussis
auguccacgaaggcgc

SEQ ID NO: 2352372 - RNA, 19 nt, Bordetella pertussis
auguccacgaaggcgccga

SEQ ID NO: 2352373 - RNA, 18 nt, Bordetella pertussis
auguccacggucgccggc

SEQ ID NO: 2352374 - RNA, 17 nt, Bordetella pertussis
auguccauggccugcag

SEQ ID NO: 2352375 - RNA, 14 nt, Bordetella pertussis
augucccuggccau

SEQ ID NO: 2352376 - RNA, 13 nt, Bordetella pertussis
auguccggcgcga

SEQ ID NO: 2352377 - RNA, 19 nt, Bordetella pertussis
auguccggggcgcuugcca

SEQ ID NO: 2352378 - RNA, 16 nt, Bordetella pertussis
auguccguaucgcggc

SEQ ID NO: 2352379 - RNA, 20 nt, Bordetella pertussis
auguccguaucgcggccgag

SEQ ID NO: 2352380 - RNA, 12 nt, Bordetella pertussis
auguccugcagg

SEQ ID NO: 2352381 - RNA, 15 nt, Bordetella pertussis
auguccugcaggccc

SEQ ID NO: 2352382 - RNA, 16 nt, Bordetella pertussis
augucgaacagcugca

SEQ ID NO: 2352383 - RNA, 20 nt, Bordetella pertussis
augucgacgaucucgcggcu

SEQ ID NO: 2352384 - RNA, 23 nt, Bordetella pertussis
augucgaggaccugaccgugcau

SEQ ID NO: 2352385 - RNA, 19 nt, Bordetella pertussis
augucgcaggccgcggcca

SEQ ID NO: 2352386 - RNA, 21 nt, Bordetella pertussis
augucgcaggccgcggccagg

SEQ ID NO: 2352387 - RNA, 22 nt, Bordetella pertussis
augucgcaggccgcggccaggc

SEQ ID NO: 2352388 - RNA, 23 nt, Bordetella pertussis
augucgcaggccgcggccaggcc

SEQ ID NO: 2352389 - RNA, 16 nt, Bordetella pertussis
augucgcccaugcuga

SEQ ID NO: 2352390 - RNA, 13 nt, Bordetella pertussis
augucgccgccgc

SEQ ID NO: 2352391 - RNA, 13 nt, Bordetella pertussis
augucgccggcca

SEQ ID NO: 2352392 - RNA, 15 nt, Bordetella pertussis
augucgcgcgccugc

SEQ ID NO: 2352393 - RNA, 14 nt, Bordetella pertussis
augucgcggcccac

SEQ ID NO: 2352394 - RNA, 21 nt, Bordetella pertussis
augucgcggcccacggccagc

SEQ ID NO: 2352395 - RNA, 16 nt, Bordetella pertussis
augucgcgggcccgcu

SEQ ID NO: 2352396 - RNA, 19 nt, Bordetella pertussis
augucggugaaggccacgc

SEQ ID NO: 2352397 - RNA, 19 nt, Bordetella pertussis
augucgucaucccuugagc

SEQ ID NO: 2352398 - RNA, 20 nt, Bordetella pertussis
augucgugaucgccagcgcc

SEQ ID NO: 2352399 - RNA, 16 nt, Bordetella pertussis
augucguugcacagca

SEQ ID NO: 2352400 - RNA, 17 nt, Bordetella pertussis
augucguugcacagcac

SEQ ID NO: 2352401 - RNA, 22 nt, Bordetella pertussis
augugcagcgcacgguccaggc

SEQ ID NO: 2352402 - RNA, 16 nt, Bordetella pertussis
augugcaggccgagga

SEQ ID NO: 2352403 - RNA, 17 nt, Bordetella pertussis
augugcgagagcuccag

SEQ ID NO: 2352404 - RNA, 14 nt, Bordetella pertussis
augugcgccgcgcc

SEQ ID NO: 2352405 - RNA, 16 nt, Bordetella pertussis
augugcgccgcgccgu

SEQ ID NO: 2352406 - RNA, 13 nt, Bordetella pertussis
augugcgcgggcg

SEQ ID NO: 2352407 - RNA, 12 nt, Bordetella pertussis
augugcggcgug

SEQ ID NO: 2352408 - RNA, 15 nt, Bordetella pertussis
augugcguugccagc

SEQ ID NO: 2352409 - RNA, 16 nt, Bordetella pertussis
augugcguugccagcc

SEQ ID NO: 2352410 - RNA, 22 nt, Bordetella pertussis
auguggccgucgucaucgccau

SEQ ID NO: 2352411 - RNA, 17 nt, Bordetella pertussis
auguggccuaccgcuau

SEQ ID NO: 2352412 - RNA, 15 nt, Bordetella pertussis
auguggcgacgccca

SEQ ID NO: 2352413 - RNA, 23 nt, Bordetella pertussis
auguggcgacgcccagccugccg

SEQ ID NO: 2352414 - RNA, 15 nt, Bordetella pertussis
auguggcgcagcguu

SEQ ID NO: 2352415 - RNA, 18 nt, Bordetella pertussis
auguggggacaggcaccc

SEQ ID NO: 2352416 - RNA, 21 nt, Bordetella pertussis
auguggggguuguggcggguc

SEQ ID NO: 2352417 - RNA, 18 nt, Bordetella pertussis
augugguagccgccgucg

SEQ ID NO: 2352418 - RNA, 15 nt, Bordetella pertussis
auguggucggcgccg

SEQ ID NO: 2352419 - RNA, 21 nt, Bordetella pertussis
auguggucggcgccgaggcgg

SEQ ID NO: 2352420 - RNA, 23 nt, Bordetella pertussis
auguggucggcgccgaggcgguc

SEQ ID NO: 2352421 - RNA, 23 nt, Bordetella pertussis
auguucagcuucagccugggccu

SEQ ID NO: 2352422 - RNA, 19 nt, Bordetella pertussis
auguucaggccggcccgcc

SEQ ID NO: 2352423 - RNA, 14 nt, Bordetella pertussis
auguugaacugcag

SEQ ID NO: 2352424 - RNA, 22 nt, Bordetella pertussis
auguugaacugcaggccgccgg

SEQ ID NO: 2352425 - RNA, 23 nt, Bordetella pertussis
auguugauccggucgcccgccgc

SEQ ID NO: 2352426 - RNA, 18 nt, Bordetella pertussis
auguuguuggccgccagc

SEQ ID NO: 2352427 - RNA, 18 nt, Bordetella pertussis
auuaaugaaacugcaaaa

SEQ ID NO: 2352428 - RNA, 17 nt, Bordetella pertussis
auuacccauggcaccga

SEQ ID NO: 2352429 - RNA, 20 nt, Bordetella pertussis
auuaugccgcccgcaaggac

SEQ ID NO: 2352430 - RNA, 18 nt, Bordetella pertussis
auuaugcguggccgccgg

SEQ ID NO: 2352431 - RNA, 20 nt, Bordetella pertussis
auucacagccauugcccaca

SEQ ID NO: 2352432 - RNA, 14 nt, Bordetella pertussis
auucacaggcccgc

SEQ ID NO: 2352433 - RNA, 12 nt, Bordetella pertussis
auucacgccgcg

SEQ ID NO: 2352434 - RNA, 15 nt, Bordetella pertussis
auuccaguugcgcgc

SEQ ID NO: 2352435 - RNA, 14 nt, Bordetella pertussis
auuccaucuugccg

SEQ ID NO: 2352436 - RNA, 15 nt, Bordetella pertussis
auucccaggcccggc

SEQ ID NO: 2352437 - RNA, 20 nt, Bordetella pertussis
auucccuggcgcgccagcuc

SEQ ID NO: 2352438 - RNA, 17 nt, Bordetella pertussis
auuccgccccccugcau

SEQ ID NO: 2352439 - RNA, 18 nt, Bordetella pertussis
auuccgccgucagcucga

SEQ ID NO: 2352440 - RNA, 15 nt, Bordetella pertussis
auuccgccuacuggc

SEQ ID NO: 2352441 - RNA, 22 nt, Bordetella pertussis
auuccggggucaauccgcccgu

SEQ ID NO: 2352442 - RNA, 14 nt, Bordetella pertussis
auuccucgccgccc

SEQ ID NO: 2352443 - RNA, 20 nt, Bordetella pertussis
auuccucgccgcccagccgg

SEQ ID NO: 2352444 - RNA, 19 nt, Bordetella pertussis
auuccucgcggcuguccug

SEQ ID NO: 2352445 - RNA, 16 nt, Bordetella pertussis
auuccugaacgccggg

SEQ ID NO: 2352446 - RNA, 18 nt, Bordetella pertussis
auuccugaacgccgggcc

SEQ ID NO: 2352447 - RNA, 12 nt, Bordetella pertussis
auuccugcuggu

SEQ ID NO: 2352448 - RNA, 17 nt, Bordetella pertussis
auuccuuucaccggcac

SEQ ID NO: 2352449 - RNA, 18 nt, Bordetella pertussis
auucgaacaacagcgccu

SEQ ID NO: 2352450 - RNA, 13 nt, Bordetella pertussis
auucgagcaggcg

SEQ ID NO: 2352451 - RNA, 15 nt, Bordetella pertussis
auucgauggcggcgc

SEQ ID NO: 2352452 - RNA, 18 nt, Bordetella pertussis
auucgauggcggcgcugg

SEQ ID NO: 2352453 - RNA, 19 nt, Bordetella pertussis
auucgcagauuuuguggag

SEQ ID NO: 2352454 - RNA, 16 nt, Bordetella pertussis
auucgccggucggccg

SEQ ID NO: 2352455 - RNA, 13 nt, Bordetella pertussis
auucgcgcaccga

SEQ ID NO: 2352456 - RNA, 10 nt, Bordetella pertussis
auucgcgccu

SEQ ID NO: 2352457 - RNA, 20 nt, Bordetella pertussis
auucgcggugcaagcggccg

SEQ ID NO: 2352458 - RNA, 13 nt, Bordetella pertussis
auucgcugcuggc

SEQ ID NO: 2352459 - RNA, 19 nt, Bordetella pertussis
auucggacgccucgccggu

SEQ ID NO: 2352460 - RNA, 20 nt, Bordetella pertussis
auucggugccuguucccgcc

SEQ ID NO: 2352461 - RNA, 14 nt, Bordetella pertussis
auucgguggcgcgc

SEQ ID NO: 2352462 - RNA, 19 nt, Bordetella pertussis
auucguugaucuggccguc

SEQ ID NO: 2352463 - RNA, 12 nt, Bordetella pertussis
auucugcaaaag

SEQ ID NO: 2352464 - RNA, 19 nt, Bordetella pertussis
auucuggugcagcggcucg

SEQ ID NO: 2352465 - RNA, 20 nt, Bordetella pertussis
auucuuuccuggccggcgcc

SEQ ID NO: 2352466 - RNA, 13 nt, Bordetella pertussis
auugaccagcacc

SEQ ID NO: 2352467 - RNA, 17 nt, Bordetella pertussis
auugaccagcaccagcg

SEQ ID NO: 2352468 - RNA, 12 nt, Bordetella pertussis
auugagggcgua

SEQ ID NO: 2352469 - RNA, 20 nt, Bordetella pertussis
caaccacgagcugcagcccg

SEQ ID NO: 2352470 - RNA, 22 nt, Bordetella pertussis
caaccacgagcugcagcccggc

SEQ ID NO: 2352471 - RNA, 23 nt, Bordetella pertussis
caaccaggaaaaccggcgccugg

SEQ ID NO: 2352472 - RNA, 15 nt, Bordetella pertussis
caaccagggagccgu

SEQ ID NO: 2352473 - RNA, 15 nt, Bordetella pertussis
caaccagggccgcca

SEQ ID NO: 2352474 - RNA, 19 nt, Bordetella pertussis
caaccaggggcggcgcggc

SEQ ID NO: 2352475 - RNA, 21 nt, Bordetella pertussis
caaccaggggcggcgcggcgc

SEQ ID NO: 2352476 - RNA, 15 nt, Bordetella pertussis
caacccacccccagc

SEQ ID NO: 2352477 - RNA, 13 nt, Bordetella pertussis
caacccagcagcg

SEQ ID NO: 2352478 - RNA, 15 nt, Bordetella pertussis
caacccagcagcggc

SEQ ID NO: 2352479 - RNA, 19 nt, Bordetella pertussis
caacccagcagcggcagca

SEQ ID NO: 2352480 - RNA, 17 nt, Bordetella pertussis
caaccccgagggcgcgg

SEQ ID NO: 2352481 - RNA, 18 nt, Bordetella pertussis
caaccccgagggcgcggc

SEQ ID NO: 2352482 - RNA, 20 nt, Bordetella pertussis
caaccccgagggcgcggcgc

SEQ ID NO: 2352483 - RNA, 18 nt, Bordetella pertussis
caacccgccauccuggcc

SEQ ID NO: 2352484 - RNA, 20 nt, Bordetella pertussis
caacccgcccggggccaugg

SEQ ID NO: 2352485 - RNA, 21 nt, Bordetella pertussis
caacccggccucagcggccgc

SEQ ID NO: 2352486 - RNA, 22 nt, Bordetella pertussis
caacccggccucagcggccgcu

SEQ ID NO: 2352487 - RNA, 19 nt, Bordetella pertussis
caacccggcgaggccgccc

SEQ ID NO: 2352488 - RNA, 19 nt, Bordetella pertussis
caacccguuccccaucauc

SEQ ID NO: 2352489 - RNA, 20 nt, Bordetella pertussis
caacccguuccccaucaucu

SEQ ID NO: 2352490 - RNA, 16 nt, Bordetella pertussis
caacccucgcacggcc

SEQ ID NO: 2352491 - RNA, 17 nt, Bordetella pertussis
caacccugccuccaggc

SEQ ID NO: 2352492 - RNA, 20 nt, Bordetella pertussis
caacccugccuccaggcgca

SEQ ID NO: 2352493 - RNA, 14 nt, Bordetella pertussis
caaccgcggcgaca

SEQ ID NO: 2352494 - RNA, 13 nt, Bordetella pertussis
caaccggaacacc

SEQ ID NO: 2352495 - RNA, 21 nt, Bordetella pertussis
caaccggcccgaagguuuccu

SEQ ID NO: 2352496 - RNA, 19 nt, Bordetella pertussis
caaccggcguucuggcgca

SEQ ID NO: 2352497 - RNA, 15 nt, Bordetella pertussis
caaccggucggccgg

SEQ ID NO: 2352498 - RNA, 17 nt, Bordetella pertussis
caaccggucggccggca

SEQ ID NO: 2352499 - RNA, 13 nt, Bordetella pertussis
caaccgucgguga

SEQ ID NO: 2352500 - RNA, 20 nt, Bordetella pertussis
caaccgucggugaugcucug

SEQ ID NO: 2352501 - RNA, 21 nt, Bordetella pertussis
caaccgucggugaugcucugc

SEQ ID NO: 2352502 - RNA, 13 nt, Bordetella pertussis
caaccucgacgcg

SEQ ID NO: 2352503 - RNA, 18 nt, Bordetella pertussis
caaccucgccgcgccagc

SEQ ID NO: 2352504 - RNA, 23 nt, Bordetella pertussis
caaccugcuggccaccgucgcca

SEQ ID NO: 2352505 - RNA, 14 nt, Bordetella pertussis
caaccuggcgcgcg

SEQ ID NO: 2352506 - RNA, 19 nt, Bordetella pertussis
caaccugguauccggcgca

SEQ ID NO: 2352507 - RNA, 17 nt, Bordetella pertussis
caaccuggucaagggcg

SEQ ID NO: 2352508 - RNA, 21 nt, Bordetella pertussis
caacgacgcaggcgccgcacc

SEQ ID NO: 2352509 - RNA, 21 nt, Bordetella pertussis
caacgcaggcgccgccccguc

SEQ ID NO: 2352510 - RNA, 23 nt, Bordetella pertussis
caacgcaugcgcgaucucguggc

SEQ ID NO: 2352511 - RNA, 16 nt, Bordetella pertussis
caacgccaagcugcug

SEQ ID NO: 2352512 - RNA, 14 nt, Bordetella pertussis
caacgccacgcgcg

SEQ ID NO: 2352513 - RNA, 16 nt, Bordetella pertussis
caacgccacgcgcgga

SEQ ID NO: 2352514 - RNA, 16 nt, Bordetella pertussis
caacgccagcaggcga

SEQ ID NO: 2352515 - RNA, 21 nt, Bordetella pertussis
caacgcccagguugcggccgc

SEQ ID NO: 2352516 - RNA, 22 nt, Bordetella pertussis
caacgcccagguugcggccgcc

SEQ ID NO: 2352517 - RNA, 17 nt, Bordetella pertussis
caacgcccugacgacca

SEQ ID NO: 2352518 - RNA, 22 nt, Bordetella pertussis
caacgccgcccguccgggcggc

SEQ ID NO: 2352519 - RNA, 14 nt, Bordetella pertussis
caacgccgccggca

SEQ ID NO: 2352520 - RNA, 17 nt, Bordetella pertussis
caacgccgccggcaggg

SEQ ID NO: 2352521 - RNA, 19 nt, Bordetella pertussis
caacgccgccggcagggcc

SEQ ID NO: 2352522 - RNA, 19 nt, Bordetella pertussis
caacgccggccauggcggc

SEQ ID NO: 2352523 - RNA, 16 nt, Bordetella pertussis
caacgccggccgccau

SEQ ID NO: 2352524 - RNA, 12 nt, Bordetella pertussis
caacgccggcgg

SEQ ID NO: 2352525 - RNA, 13 nt, Bordetella pertussis
caacgccggcggc

SEQ ID NO: 2352526 - RNA, 22 nt, Bordetella pertussis
caacgccgggccgcgccgccua

SEQ ID NO: 2352527 - RNA, 13 nt, Bordetella pertussis
caacgcgcgcgcg

SEQ ID NO: 2352528 - RNA, 17 nt, Bordetella pertussis
caacgcgcgcgcgcaca

SEQ ID NO: 2352529 - RNA, 16 nt, Bordetella pertussis
caacgcggccagcgga

SEQ ID NO: 2352530 - RNA, 15 nt, Bordetella pertussis
caacgcggcgcgugc

SEQ ID NO: 2352531 - RNA, 12 nt, Bordetella pertussis
caacggccacca

SEQ ID NO: 2352532 - RNA, 17 nt, Bordetella pertussis
caacggccaccagggcc

SEQ ID NO: 2352533 - RNA, 14 nt, Bordetella pertussis
caacggcgugcugc

SEQ ID NO: 2352534 - RNA, 17 nt, Bordetella pertussis
caacggcgugcugcggc

SEQ ID NO: 2352535 - RNA, 22 nt, Bordetella pertussis
caacggcuggcugggcgcgccg

SEQ ID NO: 2352536 - RNA, 23 nt, Bordetella pertussis
caacggcuggcugggcgcgccgc

SEQ ID NO: 2352537 - RNA, 15 nt, Bordetella pertussis
caacgggauccggca

SEQ ID NO: 2352538 - RNA, 18 nt, Bordetella pertussis
caacgggauccggcagca

SEQ ID NO: 2352539 - RNA, 14 nt, Bordetella pertussis
caacgggccgcugg

SEQ ID NO: 2352540 - RNA, 19 nt, Bordetella pertussis
caacgggccggccgccggc

SEQ ID NO: 2352541 - RNA, 22 nt, Bordetella pertussis
caacgggccggccgccggcggc

SEQ ID NO: 2352542 - RNA, 18 nt, Bordetella pertussis
caacggggacgggcgccc

SEQ ID NO: 2352543 - RNA, 16 nt, Bordetella pertussis
caacggugagccggcc

SEQ ID NO: 2352544 - RNA, 20 nt, Bordetella pertussis
caacgugcgccaggcaaagg

SEQ ID NO: 2352545 - RNA, 15 nt, Bordetella pertussis
caacguugcugcagc

SEQ ID NO: 2352546 - RNA, 16 nt, Bordetella pertussis
caacguugcugcagcg

SEQ ID NO: 2352547 - RNA, 13 nt, Bordetella pertussis
caacucggccacc

SEQ ID NO: 2352548 - RNA, 19 nt, Bordetella pertussis
caacugccugcagcgcgcg

SEQ ID NO: 2352549 - RNA, 13 nt, Bordetella pertussis
caacugcgcgaau

SEQ ID NO: 2352550 - RNA, 19 nt, Bordetella pertussis
caacuggccggccuggcgc

SEQ ID NO: 2352551 - RNA, 21 nt, Bordetella pertussis
caacuggccggccuggcgcgc

SEQ ID NO: 2352552 - RNA, 16 nt, Bordetella pertussis
caacuggggcgcucga

SEQ ID NO: 2352553 - RNA, 18 nt, Bordetella pertussis
caacugguagugcggcgc

SEQ ID NO: 2352554 - RNA, 15 nt, Bordetella pertussis
caacuucagccagcg

SEQ ID NO: 2352555 - RNA, 15 nt, Bordetella pertussis
caacuuccagcgccc

SEQ ID NO: 2352556 - RNA, 18 nt, Bordetella pertussis
caacuuccagcgcccgcg

SEQ ID NO: 2352557 - RNA, 12 nt, Bordetella pertussis
caagacagcaag

SEQ ID NO: 2352558 - RNA, 15 nt, Bordetella pertussis
caagacaggccgcua

SEQ ID NO: 2352559 - RNA, 16 nt, Bordetella pertussis
caagaccgcggccgcg

SEQ ID NO: 2352560 - RNA, 23 nt, Bordetella pertussis
caagaccgcggccgcgcuggcgc

SEQ ID NO: 2352561 - RNA, 14 nt, Bordetella pertussis
caagacgcccaggc

SEQ ID NO: 2352562 - RNA, 22 nt, Bordetella pertussis
caagacgcccaggcccaccgca

SEQ ID NO: 2352563 - RNA, 18 nt, Bordetella pertussis
caagacgcggcagggcca

SEQ ID NO: 2352564 - RNA, 20 nt, Bordetella pertussis
caagacggcgcucggccucg

SEQ ID NO: 2352565 - RNA, 13 nt, Bordetella pertussis
caagacgguaucu

SEQ ID NO: 2352566 - RNA, 15 nt, Bordetella pertussis
caagagccuggagcu

SEQ ID NO: 2352567 - RNA, 12 nt, Bordetella pertussis
caagauccagcu

SEQ ID NO: 2352568 - RNA, 21 nt, Bordetella pertussis
caagaucgcauuucucggccu

SEQ ID NO: 2352569 - RNA, 20 nt, Bordetella pertussis
caagaucgccggcuacggca

SEQ ID NO: 2352570 - RNA, 22 nt, Bordetella pertussis
caagauggcccagggcagcggc

SEQ ID NO: 2352571 - RNA, 14 nt, Bordetella pertussis
caagcaagccccag

SEQ ID NO: 2352572 - RNA, 14 nt, Bordetella pertussis
caagcaccgccugc

SEQ ID NO: 2352573 - RNA, 18 nt, Bordetella pertussis
caagcacgaacagguuga

SEQ ID NO: 2352574 - RNA, 24 nt, Bordetella pertussis
caagcagaaaggaugcccgcgggc

SEQ ID NO: 2352575 - RNA, 19 nt, Bordetella pertussis
caagcagacccgcgcccag

SEQ ID NO: 2352576 - RNA, 23 nt, Bordetella pertussis
caagcagacccgcgcccagcugu

SEQ ID NO: 2352577 - RNA, 15 nt, Bordetella pertussis
caagcagauggccau

SEQ ID NO: 2352578 - RNA, 19 nt, Bordetella pertussis
caagcagcgagagcgccac

SEQ ID NO: 2352579 - RNA, 16 nt, Bordetella pertussis
caagcagcgccugccg

SEQ ID NO: 2352580 - RNA, 20 nt, Bordetella pertussis
caagcagggcauguugcgcg

SEQ ID NO: 2352581 - RNA, 20 nt, Bordetella pertussis
caagcauuugcgcgacggcg

SEQ ID NO: 2352582 - RNA, 20 nt, Bordetella pertussis
caaucuugccaggcccggcg

SEQ ID NO: 2352583 - RNA, 23 nt, Bordetella pertussis
caaucuugccaggcccggcgcgc

SEQ ID NO: 2352584 - RNA, 15 nt, Bordetella pertussis
caaugaaaaagccgc

SEQ ID NO: 2352585 - RNA, 17 nt, Bordetella pertussis
caaugacgacgccggcu

SEQ ID NO: 2352586 - RNA, 17 nt, Bordetella pertussis
caaugccaaucaugcgc

SEQ ID NO: 2352587 - RNA, 15 nt, Bordetella pertussis
caaugccagucgccg

SEQ ID NO: 2352588 - RNA, 17 nt, Bordetella pertussis
caaugccagucgccgcg

SEQ ID NO: 2352589 - RNA, 19 nt, Bordetella pertussis
caaugccauuggugcgcac

SEQ ID NO: 2352590 - RNA, 19 nt, Bordetella pertussis
caaugcccaguucguccca

SEQ ID NO: 2352591 - RNA, 12 nt, Bordetella pertussis
caaugccccacg

SEQ ID NO: 2352592 - RNA, 15 nt, Bordetella pertussis
caaugcgcgcgcggu

SEQ ID NO: 2352593 - RNA, 12 nt, Bordetella pertussis
caaugcgcggcg

SEQ ID NO: 2352594 - RNA, 20 nt, Bordetella pertussis
caaugcgcggcgcucagagc

SEQ ID NO: 2352595 - RNA, 15 nt, Bordetella pertussis
caaugcguggccggc

SEQ ID NO: 2352596 - RNA, 12 nt, Bordetella pertussis
caauggccgcgg

SEQ ID NO: 2352597 - RNA, 12 nt, Bordetella pertussis
caaugguccagc

SEQ ID NO: 2352598 - RNA, 15 nt, Bordetella pertussis
caaugugcugacggu

SEQ ID NO: 2352599 - RNA, 17 nt, Bordetella pertussis
caauucgagcaggcgca

SEQ ID NO: 2352600 - RNA, 20 nt, Bordetella pertussis
caauucgagcaggcgcaggc

SEQ ID NO: 2352601 - RNA, 19 nt, Bordetella pertussis
caauugccggaucagcgcc

SEQ ID NO: 2352602 - RNA, 13 nt, Bordetella pertussis
caauugcgcggcc

SEQ ID NO: 2352603 - RNA, 17 nt, Bordetella pertussis
caauugcgcggccaugc

SEQ ID NO: 2352604 - RNA, 15 nt, Bordetella pertussis
caauugcgugguggc

SEQ ID NO: 2352605 - RNA, 18 nt, Bordetella pertussis
caauugcgugguggccuu

SEQ ID NO: 2352606 - RNA, 21 nt, Bordetella pertussis
caauugcuugccuguccccac

SEQ ID NO: 2352607 - RNA, 21 nt, Bordetella pertussis
caauuggccgcccuggcgcga

SEQ ID NO: 2352608 - RNA, 23 nt, Bordetella pertussis
caauuuuguugauggcgauggcu

SEQ ID NO: 2352609 - RNA, 15 nt, Bordetella pertussis
cacaaagacggcuug

SEQ ID NO: 2352610 - RNA, 17 nt, Bordetella pertussis
cacaaagacggcuugac

SEQ ID NO: 2352611 - RNA, 23 nt, Bordetella pertussis
cacaaagcggguugcggcagcgc

SEQ ID NO: 2352612 - RNA, 24 nt, Bordetella pertussis
cacaaagcggguugcggcagcgcc

SEQ ID NO: 2352613 - RNA, 15 nt, Bordetella pertussis
cacaaccuggcgcgc

SEQ ID NO: 2352614 - RNA, 16 nt, Bordetella pertussis
cacaaccuggcgcgcg

SEQ ID NO: 2352615 - RNA, 14 nt, Bordetella pertussis
cacaagaucgcauu

SEQ ID NO: 2352616 - RNA, 18 nt, Bordetella pertussis
cacaagccguacagcgaa

SEQ ID NO: 2352617 - RNA, 16 nt, Bordetella pertussis
cacaagcgcguggccg

SEQ ID NO: 2352618 - RNA, 14 nt, Bordetella pertussis
cacaagcggcccca

SEQ ID NO: 2352619 - RNA, 15 nt, Bordetella pertussis
cacaagcggccccag

SEQ ID NO: 2352620 - RNA, 20 nt, Bordetella pertussis
cacaaggauggacuggccgc

SEQ ID NO: 2352621 - RNA, 12 nt, Bordetella pertussis
cacaaggcggcc

SEQ ID NO: 2352622 - RNA, 15 nt, Bordetella pertussis
cacaaggcggccgcg

SEQ ID NO: 2352623 - RNA, 16 nt, Bordetella pertussis
cacaaggcggccgcgc

SEQ ID NO: 2352624 - RNA, 20 nt, Bordetella pertussis
cacaaggcggccgcgcccgc

SEQ ID NO: 2352625 - RNA, 14 nt, Bordetella pertussis
cacaagggccccgc

SEQ ID NO: 2352626 - RNA, 14 nt, Bordetella pertussis
cacaaugccccacg

SEQ ID NO: 2352627 - RNA, 16 nt, Bordetella pertussis
cacaccacgcgaugcg

SEQ ID NO: 2352628 - RNA, 13 nt, Bordetella pertussis
cacaccagcgcca

SEQ ID NO: 2352629 - RNA, 16 nt, Bordetella pertussis
cacaccaucagcugga

SEQ ID NO: 2352630 - RNA, 21 nt, Bordetella pertussis
cacaccguggcaugccaugcg

SEQ ID NO: 2352631 - RNA, 16 nt, Bordetella pertussis
cacacgaucagcgccc

SEQ ID NO: 2352632 - RNA, 22 nt, Bordetella pertussis
cacacgaucgucagcagcacgc

SEQ ID NO: 2352633 - RNA, 19 nt, Bordetella pertussis
cacacgcauuugcagcggc

SEQ ID NO: 2352634 - RNA, 15 nt, Bordetella pertussis
cacacgccuucggcg

SEQ ID NO: 2352635 - RNA, 15 nt, Bordetella pertussis
cacacgcgcugggcg

SEQ ID NO: 2352636 - RNA, 17 nt, Bordetella pertussis
cacacggucagcaaccc

SEQ ID NO: 2352637 - RNA, 21 nt, Bordetella pertussis
cacacggucagcaaccccagc

SEQ ID NO: 2352638 - RNA, 22 nt, Bordetella pertussis
cacacggucagcaaccccagca

SEQ ID NO: 2352639 - RNA, 19 nt, Bordetella pertussis
cacacugucgccacgggcg

SEQ ID NO: 2352640 - RNA, 16 nt, Bordetella pertussis
cacagcaacucuuccc

SEQ ID NO: 2352641 - RNA, 12 nt, Bordetella pertussis
cacagcaccugg

SEQ ID NO: 2352642 - RNA, 19 nt, Bordetella pertussis
cacagcagcgcgccgccga

SEQ ID NO: 2352643 - RNA, 23 nt, Bordetella pertussis
cacagcagcgcgccgccgauguu

SEQ ID NO: 2352644 - RNA, 21 nt, Bordetella pertussis
cacagcaugaccucggccugc

SEQ ID NO: 2352645 - RNA, 20 nt, Bordetella pertussis
cacagcaugcgcuggucgcg

SEQ ID NO: 2352646 - RNA, 13 nt, Bordetella pertussis
cacagccacugcg

SEQ ID NO: 2352647 - RNA, 21 nt, Bordetella pertussis
cacagccacugcggcccgagc

SEQ ID NO: 2352648 - RNA, 12 nt, Bordetella pertussis
cacagccaggcc

SEQ ID NO: 2352649 - RNA, 14 nt, Bordetella pertussis
cacagccaggccga

SEQ ID NO: 2352650 - RNA, 19 nt, Bordetella pertussis
cacagccauugcccacagc

SEQ ID NO: 2352651 - RNA, 20 nt, Bordetella pertussis
cacagccauugcccacagca

SEQ ID NO: 2352652 - RNA, 21 nt, Bordetella pertussis
cacagcccgaucgacggccgc

SEQ ID NO: 2352653 - RNA, 13 nt, Bordetella pertussis
cacagccgcagcc

SEQ ID NO: 2352654 - RNA, 22 nt, Bordetella pertussis
cacagccggggcgagcgcagcc

SEQ ID NO: 2352655 - RNA, 18 nt, Bordetella pertussis
cacagcgcgcaacuccag

SEQ ID NO: 2352656 - RNA, 12 nt, Bordetella pertussis
cacagcggcgcg

SEQ ID NO: 2352657 - RNA, 13 nt, Bordetella pertussis
cacagcggcgcga

SEQ ID NO: 2352658 - RNA, 20 nt, Bordetella pertussis
cacagcggcgcgagcgcaca

SEQ ID NO: 2352659 - RNA, 22 nt, Bordetella pertussis
cacagcggcgcgagcgcacagg

SEQ ID NO: 2352660 - RNA, 15 nt, Bordetella pertussis
cacagcgucccagcc

SEQ ID NO: 2352661 - RNA, 22 nt, Bordetella pertussis
cacagcgugacggcggcgcgcg

SEQ ID NO: 2352662 - RNA, 18 nt, Bordetella pertussis
cacagcguggcgaagucg

SEQ ID NO: 2352663 - RNA, 19 nt, Bordetella pertussis
cacagcguggcgaagucga

SEQ ID NO: 2352664 - RNA, 14 nt, Bordetella pertussis
cacaggaacagccu

SEQ ID NO: 2352665 - RNA, 16 nt, Bordetella pertussis
cacaggaacagccugc

SEQ ID NO: 2352666 - RNA, 18 nt, Bordetella pertussis
cacaggaacagccugccc

SEQ ID NO: 2352667 - RNA, 19 nt, Bordetella pertussis
cacaggaacagccugcccu

SEQ ID NO: 2352668 - RNA, 14 nt, Bordetella pertussis
cacaggaacaggcc

SEQ ID NO: 2352669 - RNA, 21 nt, Bordetella pertussis
cacaggaacaggccggccugg

SEQ ID NO: 2352670 - RNA, 22 nt, Bordetella pertussis
cacaggaacaggccggccuggg

SEQ ID NO: 2352671 - RNA, 16 nt, Bordetella pertussis
cacaggcccaugccgc

SEQ ID NO: 2352672 - RNA, 16 nt, Bordetella pertussis
cacaggcccgcgcggc

SEQ ID NO: 2352673 - RNA, 17 nt, Bordetella pertussis
cacaggcccgcgcggcc

SEQ ID NO: 2352674 - RNA, 18 nt, Bordetella pertussis
cacaggcccgcgcggcca

SEQ ID NO: 2352675 - RNA, 22 nt, Bordetella pertussis
cacaggcccgcgcggccagcgc

SEQ ID NO: 2352676 - RNA, 15 nt, Bordetella pertussis
cacaggcgcgcggcg

SEQ ID NO: 2352677 - RNA, 14 nt, Bordetella pertussis
cacaggcggcgccg

SEQ ID NO: 2352678 - RNA, 18 nt, Bordetella pertussis
cacaggcggcgccggcac

SEQ ID NO: 2352679 - RNA, 19 nt, Bordetella pertussis
cacaggcugacgcccggcu

SEQ ID NO: 2352680 - RNA, 12 nt, Bordetella pertussis
cacagggggacu

SEQ ID NO: 2352681 - RNA, 16 nt, Bordetella pertussis
cacagggggacuggca

SEQ ID NO: 2352682 - RNA, 19 nt, Bordetella pertussis
cacagggucaaggcgcggc

SEQ ID NO: 2352683 - RNA, 21 nt, Bordetella pertussis
cacagggucaaggcgcggccg

SEQ ID NO: 2352684 - RNA, 14 nt, Bordetella pertussis
cacaggguggcgcc

SEQ ID NO: 2352685 - RNA, 16 nt, Bordetella pertussis
cacaggguggcgccca

SEQ ID NO: 2352686 - RNA, 22 nt, Bordetella pertussis
cacaggguggcgcccagguaca

SEQ ID NO: 2352687 - RNA, 15 nt, Bordetella pertussis
cacaggugcgcggcg

SEQ ID NO: 2352688 - RNA, 18 nt, Bordetella pertussis
cacaggugcgcggcgcgc

SEQ ID NO: 2352689 - RNA, 20 nt, Bordetella pertussis
cacaggugcgcggcgcgccg

SEQ ID NO: 2352690 - RNA, 16 nt, Bordetella pertussis
cacagguuggccgcga

SEQ ID NO: 2352691 - RNA, 18 nt, Bordetella pertussis
cacagguuggccgcgacg

SEQ ID NO: 2352692 - RNA, 17 nt, Bordetella pertussis
cacaguacuuguugcgu

SEQ ID NO: 2352693 - RNA, 18 nt, Bordetella pertussis
cacagugucuaucauggc

SEQ ID NO: 2352694 - RNA, 23 nt, Bordetella pertussis
cacagugucuaucauggccuugg

SEQ ID NO: 2352695 - RNA, 15 nt, Bordetella pertussis
caccagccggccgcc

SEQ ID NO: 2352696 - RNA, 16 nt, Bordetella pertussis
caccagccggccgccg

SEQ ID NO: 2352697 - RNA, 13 nt, Bordetella pertussis
caccagccgggcg

SEQ ID NO: 2352698 - RNA, 17 nt, Bordetella pertussis
caccagccgggcggcca

SEQ ID NO: 2352699 - RNA, 19 nt, Bordetella pertussis
caccagccgggcggccacg

SEQ ID NO: 2352700 - RNA, 14 nt, Bordetella pertussis
caccagcgcacuga

SEQ ID NO: 2352701 - RNA, 15 nt, Bordetella pertussis
caccagcgcauugcc

SEQ ID NO: 2352702 - RNA, 19 nt, Bordetella pertussis
caccagcgcauugccgccg

SEQ ID NO: 2352703 - RNA, 14 nt, Bordetella pertussis
caccagcgccacgc

SEQ ID NO: 2352704 - RNA, 20 nt, Bordetella pertussis
caccagcgccacgcccaggc

SEQ ID NO: 2352705 - RNA, 19 nt, Bordetella pertussis
caccagcgccacgccggcc

SEQ ID NO: 2352706 - RNA, 14 nt, Bordetella pertussis
caccagcgccagga

SEQ ID NO: 2352707 - RNA, 19 nt, Bordetella pertussis
caccagcgccugccgaucg

SEQ ID NO: 2352708 - RNA, 22 nt, Bordetella pertussis
caccagcgccugccgaucgugc

SEQ ID NO: 2352709 - RNA, 14 nt, Bordetella pertussis
caccagcgcgccag

SEQ ID NO: 2352710 - RNA, 15 nt, Bordetella pertussis
caccagcgcgccagc

SEQ ID NO: 2352711 - RNA, 19 nt, Bordetella pertussis
caccagcgcgccgaucacc

SEQ ID NO: 2352712 - RNA, 20 nt, Bordetella pertussis
caccagcgcgccgaucacca

SEQ ID NO: 2352713 - RNA, 22 nt, Bordetella pertussis
caccagcgcgccgaucaccacg

SEQ ID NO: 2352714 - RNA, 21 nt, Bordetella pertussis
caccagcgcgccgcgcgcggc

SEQ ID NO: 2352715 - RNA, 13 nt, Bordetella pertussis
caccagcgcgucg

SEQ ID NO: 2352716 - RNA, 16 nt, Bordetella pertussis
caccagcgcgucgccg

SEQ ID NO: 2352717 - RNA, 19 nt, Bordetella pertussis
caccagcgcgucgccgcca

SEQ ID NO: 2352718 - RNA, 13 nt, Bordetella pertussis
caccagcggcgcc

SEQ ID NO: 2352719 - RNA, 15 nt, Bordetella pertussis
caccagcggcgccgg

SEQ ID NO: 2352720 - RNA, 12 nt, Bordetella pertussis
caccagcggcgu

SEQ ID NO: 2352721 - RNA, 17 nt, Bordetella pertussis
caccagcggcgugcggc

SEQ ID NO: 2352722 - RNA, 22 nt, Bordetella pertussis
caccagcggcgugcggcccagc

SEQ ID NO: 2352723 - RNA, 23 nt, Bordetella pertussis
caccagcggcguggcggccaggc

SEQ ID NO: 2352724 - RNA, 20 nt, Bordetella pertussis
caccagcgucaccagcaggc

SEQ ID NO: 2352725 - RNA, 23 nt, Bordetella pertussis
caccagcgucaccagcaggcggc

SEQ ID NO: 2352726 - RNA, 14 nt, Bordetella pertussis
caccagcuccucga

SEQ ID NO: 2352727 - RNA, 16 nt, Bordetella pertussis
caccagcucgcggccc

SEQ ID NO: 2352728 - RNA, 20 nt, Bordetella pertussis
caccagcucggcggcgauca

SEQ ID NO: 2352729 - RNA, 17 nt, Bordetella pertussis
caccagcuugcgcgccg

SEQ ID NO: 2352730 - RNA, 13 nt, Bordetella pertussis
caccaggaacgcc

SEQ ID NO: 2352731 - RNA, 16 nt, Bordetella pertussis
caccaggaacgccagc

SEQ ID NO: 2352732 - RNA, 19 nt, Bordetella pertussis
caccaggaacgccagcagc

SEQ ID NO: 2352733 - RNA, 20 nt, Bordetella pertussis
caccaggaacgccagcagca

SEQ ID NO: 2352734 - RNA, 21 nt, Bordetella pertussis
caccaggaacgccagcagcac

SEQ ID NO: 2352735 - RNA, 19 nt, Bordetella pertussis
caccaggaagagcuggcgc

SEQ ID NO: 2352736 - RNA, 17 nt, Bordetella pertussis
caccaggauccccagca

SEQ ID NO: 2352737 - RNA, 20 nt, Bordetella pertussis
caccaggauccccagcacau

SEQ ID NO: 2352738 - RNA, 20 nt, Bordetella pertussis
caccaggauuccugcgagga

SEQ ID NO: 2352739 - RNA, 13 nt, Bordetella pertussis
caccaggccgccg

SEQ ID NO: 2352740 - RNA, 23 nt, Bordetella pertussis
caccaggccgccggccagcgcca

SEQ ID NO: 2352741 - RNA, 14 nt, Bordetella pertussis
caccaggccgcggc

SEQ ID NO: 2352742 - RNA, 15 nt, Bordetella pertussis
caccaggccgcggcg

SEQ ID NO: 2352743 - RNA, 17 nt, Bordetella pertussis
caccaggccgcggcgcc

SEQ ID NO: 2352744 - RNA, 13 nt, Bordetella pertussis
caccaggccggcc

SEQ ID NO: 2352745 - RNA, 16 nt, Bordetella pertussis
caccaggccggccagg

SEQ ID NO: 2352746 - RNA, 17 nt, Bordetella pertussis
caccaggccggccaggg

SEQ ID NO: 2352747 - RNA, 14 nt, Bordetella pertussis
caccaggccgucgg

SEQ ID NO: 2352748 - RNA, 15 nt, Bordetella pertussis
caccaggccgucggc

SEQ ID NO: 2352749 - RNA, 19 nt, Bordetella pertussis
caccaggccgucggccagg

SEQ ID NO: 2352750 - RNA, 23 nt, Bordetella pertussis
caccaggccgucggccaggggca

SEQ ID NO: 2352751 - RNA, 15 nt, Bordetella pertussis
caccaggccugccug

SEQ ID NO: 2352752 - RNA, 18 nt, Bordetella pertussis
caccaggccugccugaug

SEQ ID NO: 2352753 - RNA, 15 nt, Bordetella pertussis
caccaggcgcacggc

SEQ ID NO: 2352754 - RNA, 19 nt, Bordetella pertussis
caccaggcgcacggcggca

SEQ ID NO: 2352755 - RNA, 13 nt, Bordetella pertussis
caccaggcgcgcg

SEQ ID NO: 2352756 - RNA, 14 nt, Bordetella pertussis
caccaggcgcgcgc

SEQ ID NO: 2352757 - RNA, 16 nt, Bordetella pertussis
caccaggcgcgcgcca

SEQ ID NO: 2352758 - RNA, 14 nt, Bordetella pertussis
caccaggcgcggcg

SEQ ID NO: 2352759 - RNA, 15 nt, Bordetella pertussis
caccaggcgcggcgu

SEQ ID NO: 2352760 - RNA, 17 nt, Bordetella pertussis
caccaggcgcucgcgcg

SEQ ID NO: 2352761 - RNA, 20 nt, Bordetella pertussis
caccaggcgcucgcgcgcca

SEQ ID NO: 2352762 - RNA, 21 nt, Bordetella pertussis
caccaggcugaucacccacag

SEQ ID NO: 2352763 - RNA, 12 nt, Bordetella pertussis
caccaggcuuuc

SEQ ID NO: 2352764 - RNA, 21 nt, Bordetella pertussis
caccaggcuuucgaagccgcc

SEQ ID NO: 2352765 - RNA, 17 nt, Bordetella pertussis
caccaggcuuugcgcgc

SEQ ID NO: 2352766 - RNA, 22 nt, Bordetella pertussis
caccaggcuuugcgcgccaugc

SEQ ID NO: 2352767 - RNA, 21 nt, Bordetella pertussis
caccagggaccaauacgccgc

SEQ ID NO: 2352768 - RNA, 16 nt, Bordetella pertussis
caccagggccagcuug

SEQ ID NO: 2352769 - RNA, 20 nt, Bordetella pertussis
caccagggcccggacgcggc

SEQ ID NO: 2352770 - RNA, 22 nt, Bordetella pertussis
caccagggcccggacgcggccg

SEQ ID NO: 2352771 - RNA, 12 nt, Bordetella pertussis
caccagggcgcc

SEQ ID NO: 2352772 - RNA, 19 nt, Bordetella pertussis
caccagggcgcccgccgac

SEQ ID NO: 2352773 - RNA, 21 nt, Bordetella pertussis
caccagggcgcccgccgacga

SEQ ID NO: 2352774 - RNA, 14 nt, Bordetella pertussis
caccagggcgcgca

SEQ ID NO: 2352775 - RNA, 15 nt, Bordetella pertussis
caccagggcgcgcag

SEQ ID NO: 2352776 - RNA, 16 nt, Bordetella pertussis
caccagggcgcgcagc

SEQ ID NO: 2352777 - RNA, 20 nt, Bordetella pertussis
caccagggcgcgcagcaggc

SEQ ID NO: 2352778 - RNA, 16 nt, Bordetella pertussis
caccaggguggcgccg

SEQ ID NO: 2352779 - RNA, 18 nt, Bordetella pertussis
caccaggguggcgccggc

SEQ ID NO: 2352780 - RNA, 20 nt, Bordetella pertussis
caccaggguggcgccggcca

SEQ ID NO: 2352781 - RNA, 18 nt, Bordetella pertussis
caccaggguggcgggcgc

SEQ ID NO: 2352782 - RNA, 22 nt, Bordetella pertussis
caccaggguggcgggcgccugc

SEQ ID NO: 2352783 - RNA, 19 nt, Bordetella pertussis
caccaggguuuccucgccg

SEQ ID NO: 2352784 - RNA, 22 nt, Bordetella pertussis
caccaggguuuccucgccgacg

SEQ ID NO: 2352785 - RNA, 20 nt, Bordetella pertussis
caccagguagggcagcaggu

SEQ ID NO: 2352786 - RNA, 14 nt, Bordetella pertussis
caccagguccuggc

SEQ ID NO: 2352787 - RNA, 19 nt, Bordetella pertussis
caccagguccuggcggccg

SEQ ID NO: 2352788 - RNA, 21 nt, Bordetella pertussis
caccagguccuggcggccgcc

SEQ ID NO: 2352789 - RNA, 20 nt, Bordetella pertussis
caccaggucgcggugcgcca

SEQ ID NO: 2352790 - RNA, 23 nt, Bordetella pertussis
caccaggucgcggugcgccacga

SEQ ID NO: 2352791 - RNA, 20 nt, Bordetella pertussis
caccaggucguacagcgccu

SEQ ID NO: 2352792 - RNA, 22 nt, Bordetella pertussis
caccaggucguacagcgccugc

SEQ ID NO: 2352793 - RNA, 17 nt, Bordetella pertussis
caccaggucgucguagc

SEQ ID NO: 2352794 - RNA, 23 nt, Bordetella pertussis
caccagguuggcgauggcgucga

SEQ ID NO: 2352795 - RNA, 23 nt, Bordetella pertussis
caccagguuuuccacagccaggc

SEQ ID NO: 2352796 - RNA, 14 nt, Bordetella pertussis
caccagucccgcac

SEQ ID NO: 2352797 - RNA, 17 nt, Bordetella pertussis
caccagucccgcaccga

SEQ ID NO: 2352798 - RNA, 17 nt, Bordetella pertussis
caccagugcgccggcgc

SEQ ID NO: 2352799 - RNA, 20 nt, Bordetella pertussis
caccagugcgccggcgcggc

SEQ ID NO: 2352800 - RNA, 21 nt, Bordetella pertussis
caccagugcgccggcggcggu

SEQ ID NO: 2352801 - RNA, 23 nt, Bordetella pertussis
caccaguuuucucauggccgcgc

SEQ ID NO: 2352802 - RNA, 15 nt, Bordetella pertussis
caccaucaacgggcc

SEQ ID NO: 2352803 - RNA, 18 nt, Bordetella pertussis
caccaucaacgggccgcu

SEQ ID NO: 2352804 - RNA, 19 nt, Bordetella pertussis
caccaucaacgggccgcug

SEQ ID NO: 2352805 - RNA, 15 nt, Bordetella pertussis
caccaucagccagcc

SEQ ID NO: 2352806 - RNA, 13 nt, Bordetella pertussis
caccaucagcugg

SEQ ID NO: 2352807 - RNA, 22 nt, Bordetella pertussis
caccgagaccgggcgguacagg

SEQ ID NO: 2352808 - RNA, 17 nt, Bordetella pertussis
caccgagauguuccugc

SEQ ID NO: 2352809 - RNA, 14 nt, Bordetella pertussis
caccgagcugccgc

SEQ ID NO: 2352810 - RNA, 21 nt, Bordetella pertussis
caccgaggccgaguggccgcu

SEQ ID NO: 2352811 - RNA, 13 nt, Bordetella pertussis
caccgagggccgg

SEQ ID NO: 2352812 - RNA, 19 nt, Bordetella pertussis
caccgagggccggaacagc

SEQ ID NO: 2352813 - RNA, 17 nt, Bordetella pertussis
caccgaggugccggcgg

SEQ ID NO: 2352814 - RNA, 23 nt, Bordetella pertussis
caccgauccgaugaugcccagga

SEQ ID NO: 2352815 - RNA, 15 nt, Bordetella pertussis
caccgaugcgccggc

SEQ ID NO: 2352816 - RNA, 16 nt, Bordetella pertussis
caccgaugcgccggcc

SEQ ID NO: 2352817 - RNA, 17 nt, Bordetella pertussis
caccgcaggugccuguc

SEQ ID NO: 2352818 - RNA, 18 nt, Bordetella pertussis
caccgcaggugccugucc

SEQ ID NO: 2352819 - RNA, 19 nt, Bordetella pertussis
caccgcaggugccuguccc

SEQ ID NO: 2352820 - RNA, 22 nt, Bordetella pertussis
caccgcaggugccuguccccac

SEQ ID NO: 2352821 - RNA, 12 nt, Bordetella pertussis
caccgcaucgcg

SEQ ID NO: 2352822 - RNA, 13 nt, Bordetella pertussis
caccgcaucgcgc

SEQ ID NO: 2352823 - RNA, 18 nt, Bordetella pertussis
caccgcaucgcgcagcgu

SEQ ID NO: 2352824 - RNA, 20 nt, Bordetella pertussis
caccgcaucgcgcagcgugc

SEQ ID NO: 2352825 - RNA, 15 nt, Bordetella pertussis
caccgcaugggccag

SEQ ID NO: 2352826 - RNA, 21 nt, Bordetella pertussis
caccgcaugggccaggcgcuc

SEQ ID NO: 2352827 - RNA, 23 nt, Bordetella pertussis
caccgcaugggccaggcgcucca

SEQ ID NO: 2352828 - RNA, 14 nt, Bordetella pertussis
caccgccacccgua

SEQ ID NO: 2352829 - RNA, 13 nt, Bordetella pertussis
caccgccacgcgg

SEQ ID NO: 2352830 - RNA, 18 nt, Bordetella pertussis
caccgccacgcgguccag

SEQ ID NO: 2352831 - RNA, 22 nt, Bordetella pertussis
caccgccacgcgguccagcccc

SEQ ID NO: 2352832 - RNA, 14 nt, Bordetella pertussis
caccgccacgucau

SEQ ID NO: 2352833 - RNA, 22 nt, Bordetella pertussis
caccgccagaucguugaucucg

SEQ ID NO: 2352834 - RNA, 14 nt, Bordetella pertussis
caccgccagcccgg

SEQ ID NO: 2352835 - RNA, 21 nt, Bordetella pertussis
caccgccagcgcgucguccag

SEQ ID NO: 2352836 - RNA, 20 nt, Bordetella pertussis
caccgccaugugcgccgcgc

SEQ ID NO: 2352837 - RNA, 12 nt, Bordetella pertussis
caccgcccaggc

SEQ ID NO: 2352838 - RNA, 15 nt, Bordetella pertussis
caccgcccaggcgca

SEQ ID NO: 2352839 - RNA, 15 nt, Bordetella pertussis
caccgcccccgccgc

SEQ ID NO: 2352840 - RNA, 13 nt, Bordetella pertussis
caccgccccgacc

SEQ ID NO: 2352841 - RNA, 14 nt, Bordetella pertussis
caccgcccgcaugu

SEQ ID NO: 2352842 - RNA, 19 nt, Bordetella pertussis
caccgccgauaccacgcgc

SEQ ID NO: 2352843 - RNA, 21 nt, Bordetella pertussis
caccgccgauaccacgcgcgg

SEQ ID NO: 2352844 - RNA, 17 nt, Bordetella pertussis
caccgccgaugccgcca

SEQ ID NO: 2352845 - RNA, 22 nt, Bordetella pertussis
caccgccgaugccgccaucauc

SEQ ID NO: 2352846 - RNA, 12 nt, Bordetella pertussis
caccgccgcaca

SEQ ID NO: 2352847 - RNA, 15 nt, Bordetella pertussis
caccgccgcccgcca

SEQ ID NO: 2352848 - RNA, 20 nt, Bordetella pertussis
caccgccgcccgccaggcca

SEQ ID NO: 2352849 - RNA, 14 nt, Bordetella pertussis
caccgccgccgcca

SEQ ID NO: 2352850 - RNA, 22 nt, Bordetella pertussis
caccgccgccgccaccagcggc

SEQ ID NO: 2352851 - RNA, 16 nt, Bordetella pertussis
caccgccgccgcgccg

SEQ ID NO: 2352852 - RNA, 13 nt, Bordetella pertussis
caccgccgccggc

SEQ ID NO: 2352853 - RNA, 16 nt, Bordetella pertussis
caccgccgccggcccg

SEQ ID NO: 2352854 - RNA, 17 nt, Bordetella pertussis
caccgccgccggcccgg

SEQ ID NO: 2352855 - RNA, 20 nt, Bordetella pertussis
caccgccgcgaccgggccga

SEQ ID NO: 2352856 - RNA, 15 nt, Bordetella pertussis
caccgccgcgccgcc

SEQ ID NO: 2352857 - RNA, 15 nt, Bordetella pertussis
caccgccgcgccgcu

SEQ ID NO: 2352858 - RNA, 23 nt, Bordetella pertussis
caccgccgcggcgaugccggcca

SEQ ID NO: 2352859 - RNA, 14 nt, Bordetella pertussis
caccgccgcguccu

SEQ ID NO: 2352860 - RNA, 13 nt, Bordetella pertussis
caccgccggcggc

SEQ ID NO: 2352861 - RNA, 17 nt, Bordetella pertussis
caccgccggcggcgugc

SEQ ID NO: 2352862 - RNA, 13 nt, Bordetella pertussis
caccgccguggcc

SEQ ID NO: 2352863 - RNA, 22 nt, Bordetella pertussis
caccgccucgaugucaucgccc

SEQ ID NO: 2352864 - RNA, 23 nt, Bordetella pertussis
caccgccucgaugucaucgcccu

SEQ ID NO: 2352865 - RNA, 20 nt, Bordetella pertussis
caccgccugcugcauguccu

SEQ ID NO: 2352866 - RNA, 15 nt, Bordetella pertussis
caccgccugcugcgc

SEQ ID NO: 2352867 - RNA, 20 nt, Bordetella pertussis
caccgccugcugcgccuggc

SEQ ID NO: 2352868 - RNA, 19 nt, Bordetella pertussis
caccgcgaaccaggccugc

SEQ ID NO: 2352869 - RNA, 17 nt, Bordetella pertussis
caccgcgaccaugcggc

SEQ ID NO: 2352870 - RNA, 23 nt, Bordetella pertussis
caccgcgaccaugcggccgucgc

SEQ ID NO: 2352871 - RNA, 11 nt, Bordetella pertussis
caccgcgcagc

SEQ ID NO: 2352872 - RNA, 15 nt, Bordetella pertussis
caccgcgccagcgcc

SEQ ID NO: 2352873 - RNA, 13 nt, Bordetella pertussis
caccgcgcccagg

SEQ ID NO: 2352874 - RNA, 13 nt, Bordetella pertussis
caccgcgccgccc

SEQ ID NO: 2352875 - RNA, 20 nt, Bordetella pertussis
caccgcgccgcccacgccgc

SEQ ID NO: 2352876 - RNA, 21 nt, Bordetella pertussis
caccgcgccgcccacgccgcu

SEQ ID NO: 2352877 - RNA, 22 nt, Bordetella pertussis
caccgcgccgcccacgccgcug

SEQ ID NO: 2352878 - RNA, 13 nt, Bordetella pertussis
caccgcgccgggc

SEQ ID NO: 2352879 - RNA, 16 nt, Bordetella pertussis
caccgcgccgggcguu

SEQ ID NO: 2352880 - RNA, 14 nt, Bordetella pertussis
caccgcggccuugc

SEQ ID NO: 2352881 - RNA, 17 nt, Bordetella pertussis
caccgcggccuugccgg

SEQ ID NO: 2352882 - RNA, 15 nt, Bordetella pertussis
caccgcggcggacca

SEQ ID NO: 2352883 - RNA, 16 nt, Bordetella pertussis
caccgcggcggaccac

SEQ ID NO: 2352884 - RNA, 19 nt, Bordetella pertussis
caccgcggcggaccacacg

SEQ ID NO: 2352885 - RNA, 21 nt, Bordetella pertussis
caccgcggcggaccacacgau

SEQ ID NO: 2352886 - RNA, 20 nt, Bordetella pertussis
caccgcggcgggcucggcgc

SEQ ID NO: 2352887 - RNA, 21 nt, Bordetella pertussis
caccgcggugccgcgcgcggc

SEQ ID NO: 2352888 - RNA, 16 nt, Bordetella pertussis
caccgcgucauacacg

SEQ ID NO: 2352889 - RNA, 19 nt, Bordetella pertussis
caccgcgucauacacggcg

SEQ ID NO: 2352890 - RNA, 14 nt, Bordetella pertussis
caccgcgucggccu

SEQ ID NO: 2352891 - RNA, 19 nt, Bordetella pertussis
caccgcguugagcgccgac

SEQ ID NO: 2352892 - RNA, 12 nt, Bordetella pertussis
caccgcugauca

SEQ ID NO: 2352893 - RNA, 18 nt, Bordetella pertussis
caccgcugaucaggucca

SEQ ID NO: 2352894 - RNA, 22 nt, Bordetella pertussis
caccgcugcgggaggugccgca

SEQ ID NO: 2352895 - RNA, 18 nt, Bordetella pertussis
caccgcuggacgaggcga

SEQ ID NO: 2352896 - RNA, 17 nt, Bordetella pertussis
caccgcuucuucgucgc

SEQ ID NO: 2352897 - RNA, 20 nt, Bordetella pertussis
caccgcuucuucgucgcgcc

SEQ ID NO: 2352898 - RNA, 22 nt, Bordetella pertussis
caccgcuucuucgucgcgccag

SEQ ID NO: 2352899 - RNA, 18 nt, Bordetella pertussis
caccggaggcgccgcgga

SEQ ID NO: 2352900 - RNA, 17 nt, Bordetella pertussis
caccggauccugcggcg

SEQ ID NO: 2352901 - RNA, 19 nt, Bordetella pertussis
caccggauccugcggcgcg

SEQ ID NO: 2352902 - RNA, 20 nt, Bordetella pertussis
caccggauccugcggcgcgg

SEQ ID NO: 2352903 - RNA, 16 nt, Bordetella pertussis
caccggcaagccuugc

SEQ ID NO: 2352904 - RNA, 22 nt, Bordetella pertussis
caccggcaagccuugcggcccu

SEQ ID NO: 2352905 - RNA, 19 nt, Bordetella pertussis
caccggcacgacggccucc

SEQ ID NO: 2352906 - RNA, 13 nt, Bordetella pertussis
caccggcacgccg

SEQ ID NO: 2352907 - RNA, 14 nt, Bordetella pertussis
caccggcacgccgg

SEQ ID NO: 2352908 - RNA, 18 nt, Bordetella pertussis
caccggcacgccggcggc

SEQ ID NO: 2352909 - RNA, 12 nt, Bordetella pertussis
caccggcacgcg

SEQ ID NO: 2352910 - RNA, 13 nt, Bordetella pertussis
caccggcacgcgc

SEQ ID NO: 2352911 - RNA, 15 nt, Bordetella pertussis
caccggcacgcgcca

SEQ ID NO: 2352912 - RNA, 19 nt, Bordetella pertussis
caccggcacgcgccagcug

SEQ ID NO: 2352913 - RNA, 18 nt, Bordetella pertussis
caccggcagcguaucgcc

SEQ ID NO: 2352914 - RNA, 23 nt, Bordetella pertussis
caccggcagcguaucgcccgcgc

SEQ ID NO: 2352915 - RNA, 13 nt, Bordetella pertussis
caccggcaggccg

SEQ ID NO: 2352916 - RNA, 14 nt, Bordetella pertussis
caccggcaggccgc

SEQ ID NO: 2352917 - RNA, 18 nt, Bordetella pertussis
caccggcaggccgcgcug

SEQ ID NO: 2352918 - RNA, 21 nt, Bordetella pertussis
caccggcaggccgcgcugcca

SEQ ID NO: 2352919 - RNA, 23 nt, Bordetella pertussis
caccggcaggccgcgcugccagc

SEQ ID NO: 2352920 - RNA, 14 nt, Bordetella pertussis
caccugcguggccu

SEQ ID NO: 2352921 - RNA, 19 nt, Bordetella pertussis
caccugcguggccucuugc

SEQ ID NO: 2352922 - RNA, 15 nt, Bordetella pertussis
caccugcuccagcga

SEQ ID NO: 2352923 - RNA, 17 nt, Bordetella pertussis
caccugcucggugagcg

SEQ ID NO: 2352924 - RNA, 19 nt, Bordetella pertussis
caccugcucggugagcggc

SEQ ID NO: 2352925 - RNA, 18 nt, Bordetella pertussis
caccugcugcuugaccuu

SEQ ID NO: 2352926 - RNA, 20 nt, Bordetella pertussis
caccugcugcuugaccuugg

SEQ ID NO: 2352927 - RNA, 17 nt, Bordetella pertussis
caccugcuugacguaga

SEQ ID NO: 2352928 - RNA, 21 nt, Bordetella pertussis
caccuggccacaagcggcccc

SEQ ID NO: 2352929 - RNA, 22 nt, Bordetella pertussis
caccuggccacaagcggcccca

SEQ ID NO: 2352930 - RNA, 22 nt, Bordetella pertussis
caccuggcgcccggcggcgcgc

SEQ ID NO: 2352931 - RNA, 19 nt, Bordetella pertussis
caccuggcggugcgccgca

SEQ ID NO: 2352932 - RNA, 21 nt, Bordetella pertussis
caccuggcugaacaggccuuc

SEQ ID NO: 2352933 - RNA, 16 nt, Bordetella pertussis
caccugggccgccugc

SEQ ID NO: 2352934 - RNA, 13 nt, Bordetella pertussis
caccugggccuuc

SEQ ID NO: 2352935 - RNA, 16 nt, Bordetella pertussis
caccugguccauggcg

SEQ ID NO: 2352936 - RNA, 17 nt, Bordetella pertussis
caccugguccugcguga

SEQ ID NO: 2352937 - RNA, 18 nt, Bordetella pertussis
caccuggucgucggccac

SEQ ID NO: 2352938 - RNA, 16 nt, Bordetella pertussis
caccugguggcgcugg

SEQ ID NO: 2352939 - RNA, 19 nt, Bordetella pertussis
caccuuccugcuggaccug

SEQ ID NO: 2352940 - RNA, 14 nt, Bordetella pertussis
caccuucgccgcgc

SEQ ID NO: 2352941 - RNA, 14 nt, Bordetella pertussis
caccuucgcgcagc

SEQ ID NO: 2352942 - RNA, 15 nt, Bordetella pertussis
caccuucgcgcagcg

SEQ ID NO: 2352943 - RNA, 23 nt, Bordetella pertussis
caccuucgcgcagcggcgcgcgc

SEQ ID NO: 2352944 - RNA, 13 nt, Bordetella pertussis
caccuucugccgc

SEQ ID NO: 2352945 - RNA, 17 nt, Bordetella pertussis
caccuucugccgccagg

SEQ ID NO: 2352946 - RNA, 21 nt, Bordetella pertussis
caccuucuuccaggcgcccgc

SEQ ID NO: 2352947 - RNA, 13 nt, Bordetella pertussis
caccuugaccugg

SEQ ID NO: 2352948 - RNA, 18 nt, Bordetella pertussis
caccuugaccuggucggc

SEQ ID NO: 2352949 - RNA, 14 nt, Bordetella pertussis
caccuugacgcgca

SEQ ID NO: 2352950 - RNA, 16 nt, Bordetella pertussis
caccuugaguugcggg

SEQ ID NO: 2352951 - RNA, 13 nt, Bordetella pertussis
caccuugcccacg

SEQ ID NO: 2352952 - RNA, 12 nt, Bordetella pertussis
caccuugccugc

SEQ ID NO: 2352953 - RNA, 16 nt, Bordetella pertussis
caccuugggcgccugc

SEQ ID NO: 2352954 - RNA, 19 nt, Bordetella pertussis
caccuuguacuggucgcgc

SEQ ID NO: 2352955 - RNA, 23 nt, Bordetella pertussis
caccuuguacuggucgcgcagcu

SEQ ID NO: 2352956 - RNA, 17 nt, Bordetella pertussis
caccuugucgcgcagcg

SEQ ID NO: 2352957 - RNA, 16 nt, Bordetella pertussis
caccuuguuggcgccg

SEQ ID NO: 2352958 - RNA, 19 nt, Bordetella pertussis
caccuuguuggcgccggcc

SEQ ID NO: 2352959 - RNA, 20 nt, Bordetella pertussis
caccuuguuggcgccggccg

SEQ ID NO: 2352960 - RNA, 22 nt, Bordetella pertussis
caccuuguuggcgccggccgcg

SEQ ID NO: 2352961 - RNA, 19 nt, Bordetella pertussis
caccuuuccgaucagcugc

SEQ ID NO: 2352962 - RNA, 14 nt, Bordetella pertussis
caccuuucugcugc

SEQ ID NO: 2352963 - RNA, 15 nt, Bordetella pertussis
caccuuucugcugcu

SEQ ID NO: 2352964 - RNA, 18 nt, Bordetella pertussis
cacgaacagcgccaggcu

SEQ ID NO: 2352965 - RNA, 16 nt, Bordetella pertussis
cacgaacggcgcgaag

SEQ ID NO: 2352966 - RNA, 14 nt, Bordetella pertussis
cacgaagcagguga

SEQ ID NO: 2352967 - RNA, 16 nt, Bordetella pertussis
cacgaagccgaugcgc

SEQ ID NO: 2352968 - RNA, 22 nt, Bordetella pertussis
cacgaagccgaugcgccgcgcu

SEQ ID NO: 2352969 - RNA, 14 nt, Bordetella pertussis
cacgaagcgcagca

SEQ ID NO: 2352970 - RNA, 16 nt, Bordetella pertussis
cacgaaggcagcaccu

SEQ ID NO: 2352971 - RNA, 19 nt, Bordetella pertussis
cacgaaggcagcaccucgg

SEQ ID NO: 2352972 - RNA, 21 nt, Bordetella pertussis
cacgaaggcgaucugcggcgu

SEQ ID NO: 2352973 - RNA, 14 nt, Bordetella pertussis
cacgaaggcgccga

SEQ ID NO: 2352974 - RNA, 16 nt, Bordetella pertussis
cacgaagggcagcagc

SEQ ID NO: 2352975 - RNA, 17 nt, Bordetella pertussis
cacgaagggcagcagca

SEQ ID NO: 2352976 - RNA, 21 nt, Bordetella pertussis
cacgaaguacucgccggcgcu

SEQ ID NO: 2352977 - RNA, 20 nt, Bordetella pertussis
cacgaagucgaaccagccgu

SEQ ID NO: 2352978 - RNA, 23 nt, Bordetella pertussis
cacgaagugcgcccccaugucca

SEQ ID NO: 2352979 - RNA, 18 nt, Bordetella pertussis
cacgaauuccucgccgcc

SEQ ID NO: 2352980 - RNA, 20 nt, Bordetella pertussis
cacgaauuccucgccgccca

SEQ ID NO: 2352981 - RNA, 13 nt, Bordetella pertussis
cacgacacgccca

SEQ ID NO: 2352982 - RNA, 14 nt, Bordetella pertussis
cacgacacgcccag

SEQ ID NO: 2352983 - RNA, 15 nt, Bordetella pertussis
cacgacacgcccagc

SEQ ID NO: 2352984 - RNA, 18 nt, Bordetella pertussis
cacgaccagcaggcccac

SEQ ID NO: 2352985 - RNA, 20 nt, Bordetella pertussis
cacgaccaggccguggccca

SEQ ID NO: 2352986 - RNA, 16 nt, Bordetella pertussis
cacgaccggcucgggc

SEQ ID NO: 2352987 - RNA, 19 nt, Bordetella pertussis
cacgaccugcaaccccacc

SEQ ID NO: 2352988 - RNA, 22 nt, Bordetella pertussis
cacgaccugcaaccccaccggc

SEQ ID NO: 2352989 - RNA, 18 nt, Bordetella pertussis
cacgaccuuggcggccga

SEQ ID NO: 2352990 - RNA, 14 nt, Bordetella pertussis
cacgacgaacaaca

SEQ ID NO: 2352991 - RNA, 15 nt, Bordetella pertussis
cacgacgaacaacac

SEQ ID NO: 2352992 - RNA, 16 nt, Bordetella pertussis
cacgacgaacaacacg

SEQ ID NO: 2352993 - RNA, 16 nt, Bordetella pertussis
cacgacgacggccggc

SEQ ID NO: 2352994 - RNA, 16 nt, Bordetella pertussis
cacgacgccgucgcgg

SEQ ID NO: 2352995 - RNA, 19 nt, Bordetella pertussis
cacgacgcgaaccaggcca

SEQ ID NO: 2352996 - RNA, 21 nt, Bordetella pertussis
cacgacgcguuuggcuuacca

SEQ ID NO: 2352997 - RNA, 22 nt, Bordetella pertussis
cacgacggccuccgcgccgacc

SEQ ID NO: 2352998 - RNA, 23 nt, Bordetella pertussis
cacgacgggauugccgucacgcg

SEQ ID NO: 2352999 - RNA, 15 nt, Bordetella pertussis
cacgacggucugggc

SEQ ID NO: 2353000 - RNA, 17 nt, Bordetella pertussis
cacgacggucugggcca

SEQ ID NO: 2353001 - RNA, 21 nt, Bordetella pertussis
cacgacgguuaacgaaucgcu

SEQ ID NO: 2353002 - RNA, 20 nt, Bordetella pertussis
cacgacguagucggcgccca

SEQ ID NO: 2353003 - RNA, 22 nt, Bordetella pertussis
cacgacguagucggcgcccagc

SEQ ID NO: 2353004 - RNA, 20 nt, Bordetella pertussis
cacgacgucgcgcggauccu

SEQ ID NO: 2353005 - RNA, 22 nt, Bordetella pertussis
cacgacgucguagugcgcgccg

SEQ ID NO: 2353006 - RNA, 20 nt, Bordetella pertussis
cacgagaucgccuggggcag

SEQ ID NO: 2353007 - RNA, 17 nt, Bordetella pertussis
cacgagcaguacacgcg

SEQ ID NO: 2353008 - RNA, 18 nt, Bordetella pertussis
cacgagcaguacacgcgc

SEQ ID NO: 2353009 - RNA, 19 nt, Bordetella pertussis
cacgagcaguacacgcgca

SEQ ID NO: 2353010 - RNA, 20 nt, Bordetella pertussis
cacgaggaccgcgaugcugc

SEQ ID NO: 2353011 - RNA, 22 nt, Bordetella pertussis
cacgaggcgcucggccuugccg

SEQ ID NO: 2353012 - RNA, 16 nt, Bordetella pertussis
cacgaggucuugccga

SEQ ID NO: 2353013 - RNA, 23 nt, Bordetella pertussis
cacgauauugguguugccggcca

SEQ ID NO: 2353014 - RNA, 13 nt, Bordetella pertussis
cacgaucaccgcc

SEQ ID NO: 2353015 - RNA, 15 nt, Bordetella pertussis
cacgaucaccgccgc

SEQ ID NO: 2353016 - RNA, 19 nt, Bordetella pertussis
cacgaucaccgccgcggcg

SEQ ID NO: 2353017 - RNA, 17 nt, Bordetella pertussis
cacgaucacgaacagcg

SEQ ID NO: 2353018 - RNA, 13 nt, Bordetella pertussis
cacgaucagcgcc

SEQ ID NO: 2353019 - RNA, 17 nt, Bordetella pertussis
cacgaucagcgcccagg

SEQ ID NO: 2353020 - RNA, 18 nt, Bordetella pertussis
cacgaucagcgcccaggu

SEQ ID NO: 2353021 - RNA, 17 nt, Bordetella pertussis
cacgaucaucaggauga

SEQ ID NO: 2353022 - RNA, 23 nt, Bordetella pertussis
cacgaucaucaggaugaacaucg

SEQ ID NO: 2353023 - RNA, 14 nt, Bordetella pertussis
cacgauccacggcc

SEQ ID NO: 2353024 - RNA, 20 nt, Bordetella pertussis
cacgauccacggccggcgca

SEQ ID NO: 2353025 - RNA, 23 nt, Bordetella pertussis
cacgauccagccguuggcgccca

SEQ ID NO: 2353026 - RNA, 13 nt, Bordetella pertussis
cacgaucgcgccg

SEQ ID NO: 2353027 - RNA, 16 nt, Bordetella pertussis
cacgaucgcgccggcc

SEQ ID NO: 2353028 - RNA, 22 nt, Bordetella pertussis
cacgaucgcgccggccugggcg

SEQ ID NO: 2353029 - RNA, 15 nt, Bordetella pertussis
cacgaucgcggcgcu

SEQ ID NO: 2353030 - RNA, 16 nt, Bordetella pertussis
cacgaucgcggcgcug

SEQ ID NO: 2353031 - RNA, 19 nt, Bordetella pertussis
cacgaucggcgccuggccg

SEQ ID NO: 2353032 - RNA, 14 nt, Bordetella pertussis
cacgccggcgguca

SEQ ID NO: 2353033 - RNA, 20 nt, Bordetella pertussis
cacgccggcggucacgccga

SEQ ID NO: 2353034 - RNA, 13 nt, Bordetella pertussis
cacgccgggcgcg

SEQ ID NO: 2353035 - RNA, 22 nt, Bordetella pertussis
cacgccgggcgcgcugcccagc

SEQ ID NO: 2353036 - RNA, 14 nt, Bordetella pertussis
cacgccgggcgcgg

SEQ ID NO: 2353037 - RNA, 15 nt, Bordetella pertussis
cacgccgggcgcggc

SEQ ID NO: 2353038 - RNA, 17 nt, Bordetella pertussis
cacgccgggcgcggccg

SEQ ID NO: 2353039 - RNA, 21 nt, Bordetella pertussis
cacgccgggcgcggccgccgc

SEQ ID NO: 2353040 - RNA, 19 nt, Bordetella pertussis
cacgccggguugcggcgga

SEQ ID NO: 2353041 - RNA, 16 nt, Bordetella pertussis
cacgccggucgccagc

SEQ ID NO: 2353042 - RNA, 13 nt, Bordetella pertussis
cacgccucgccgg

SEQ ID NO: 2353043 - RNA, 17 nt, Bordetella pertussis
cacgccucgccggcccu

SEQ ID NO: 2353044 - RNA, 19 nt, Bordetella pertussis
cacgccucgccggcccugc

SEQ ID NO: 2353045 - RNA, 21 nt, Bordetella pertussis
cacgccucgccggcccugccg

SEQ ID NO: 2353046 - RNA, 18 nt, Bordetella pertussis
cacgccugccgcgcccgg

SEQ ID NO: 2353047 - RNA, 20 nt, Bordetella pertussis
cacgccuggccgcgcucagc

SEQ ID NO: 2353048 - RNA, 22 nt, Bordetella pertussis
cacgccuggccgcgcucagccu

SEQ ID NO: 2353049 - RNA, 21 nt, Bordetella pertussis
cacgccuguuuuggcgcacgc

SEQ ID NO: 2353050 - RNA, 23 nt, Bordetella pertussis
cacgccuucgagcaccaugccgg

SEQ ID NO: 2353051 - RNA, 16 nt, Bordetella pertussis
cacgccuucgagcugc

SEQ ID NO: 2353052 - RNA, 22 nt, Bordetella pertussis
cacgccuucgagcugcacccac

SEQ ID NO: 2353053 - RNA, 20 nt, Bordetella pertussis
cacgccuugcucgaccaggu

SEQ ID NO: 2353054 - RNA, 22 nt, Bordetella pertussis
cacgccuugcucgaccaggucg

SEQ ID NO: 2353055 - RNA, 20 nt, Bordetella pertussis
cacgccuuguucgcgcgcgg

SEQ ID NO: 2353056 - RNA, 15 nt, Bordetella pertussis
cacgcgcaccaggcc

SEQ ID NO: 2353057 - RNA, 16 nt, Bordetella pertussis
cacgcgcaccaggccu

SEQ ID NO: 2353058 - RNA, 17 nt, Bordetella pertussis
cacgcgcacgacgucgc

SEQ ID NO: 2353059 - RNA, 13 nt, Bordetella pertussis
cacgcgcacggcc

SEQ ID NO: 2353060 - RNA, 15 nt, Bordetella pertussis
cacgcgcagcacgcu

SEQ ID NO: 2353061 - RNA, 18 nt, Bordetella pertussis
cacgcgccagcugaccuc

SEQ ID NO: 2353062 - RNA, 19 nt, Bordetella pertussis
cacgcgccgccaggcgcga

SEQ ID NO: 2353063 - RNA, 16 nt, Bordetella pertussis
cacgcgccgcccgggc

SEQ ID NO: 2353064 - RNA, 20 nt, Bordetella pertussis
cacgcgccgcccgggccggc

SEQ ID NO: 2353065 - RNA, 18 nt, Bordetella pertussis
cacgcgcgauccgcgcca

SEQ ID NO: 2353066 - RNA, 20 nt, Bordetella pertussis
cacgcgcgauccgcgccagg

SEQ ID NO: 2353067 - RNA, 12 nt, Bordetella pertussis
cacgcgcgccgg

SEQ ID NO: 2353068 - RNA, 14 nt, Bordetella pertussis
cacgcgcgccggca

SEQ ID NO: 2353069 - RNA, 17 nt, Bordetella pertussis
cacgcgcgccggcaggg

SEQ ID NO: 2353070 - RNA, 14 nt, Bordetella pertussis
cacgcgcgcgccgc

SEQ ID NO: 2353071 - RNA, 14 nt, Bordetella pertussis
cacgcgcgcggcgc

SEQ ID NO: 2353072 - RNA, 15 nt, Bordetella pertussis
cacgcgcgcggcgcg

SEQ ID NO: 2353073 - RNA, 16 nt, Bordetella pertussis
cacgcgcgcggcgcgg

SEQ ID NO: 2353074 - RNA, 17 nt, Bordetella pertussis
cacgcgcgcggcgcggc

SEQ ID NO: 2353075 - RNA, 17 nt, Bordetella pertussis
cacgcgcgcgggcgcgc

SEQ ID NO: 2353076 - RNA, 18 nt, Bordetella pertussis
cacgcgcgcgggcgcgcc

SEQ ID NO: 2353077 - RNA, 19 nt, Bordetella pertussis
cacgcgcgcgggcgcgccg

SEQ ID NO: 2353078 - RNA, 13 nt, Bordetella pertussis
cacgcgcgcuggc

SEQ ID NO: 2353079 - RNA, 22 nt, Bordetella pertussis
cacgcgcgcuggcgcccggccu

SEQ ID NO: 2353080 - RNA, 16 nt, Bordetella pertussis
cacgcgcggcagcgcc

SEQ ID NO: 2353081 - RNA, 22 nt, Bordetella pertussis
cacgcgcgguucgccgugcagg

SEQ ID NO: 2353082 - RNA, 23 nt, Bordetella pertussis
cacgcgcuccaugaucucgggcg

SEQ ID NO: 2353083 - RNA, 21 nt, Bordetella pertussis
cacgcgcuccggcugcgcgcg

SEQ ID NO: 2353084 - RNA, 22 nt, Bordetella pertussis
cacgcgcuccggcugcgcgcgc

SEQ ID NO: 2353085 - RNA, 13 nt, Bordetella pertussis
cacgcgcucgggc

SEQ ID NO: 2353086 - RNA, 14 nt, Bordetella pertussis
cacgcgcucgggca

SEQ ID NO: 2353087 - RNA, 14 nt, Bordetella pertussis
cacgcgcugcagca

SEQ ID NO: 2353088 - RNA, 16 nt, Bordetella pertussis
cacgcgcugcgcgccg

SEQ ID NO: 2353089 - RNA, 22 nt, Bordetella pertussis
cacgcgcugggcguggcgcgcg

SEQ ID NO: 2353090 - RNA, 20 nt, Bordetella pertussis
cacgcgcuugaggcugguga

SEQ ID NO: 2353091 - RNA, 13 nt, Bordetella pertussis
cacgcgcuugcgc

SEQ ID NO: 2353092 - RNA, 17 nt, Bordetella pertussis
cacgcgcuugcgcgcca

SEQ ID NO: 2353093 - RNA, 14 nt, Bordetella pertussis
cacgcggccgcgca

SEQ ID NO: 2353094 - RNA, 16 nt, Bordetella pertussis
cacgcggccgcgcagg

SEQ ID NO: 2353095 - RNA, 13 nt, Bordetella pertussis
cacgcggcgcggc

SEQ ID NO: 2353096 - RNA, 19 nt, Bordetella pertussis
cacgcggcgcugcuggccg

SEQ ID NO: 2353097 - RNA, 23 nt, Bordetella pertussis
cacgcggcgcugcuggccggcca

SEQ ID NO: 2353098 - RNA, 12 nt, Bordetella pertussis
cacgcgggccgg

SEQ ID NO: 2353099 - RNA, 15 nt, Bordetella pertussis
cacgcgggccggccg

SEQ ID NO: 2353100 - RNA, 18 nt, Bordetella pertussis
cacgcggguggugcugcu

SEQ ID NO: 2353101 - RNA, 20 nt, Bordetella pertussis
cacgcggguggugcugcuca

SEQ ID NO: 2353102 - RNA, 18 nt, Bordetella pertussis
cacgcgguagguagcgcg

SEQ ID NO: 2353103 - RNA, 20 nt, Bordetella pertussis
cacgcgguagguagcgcgca

SEQ ID NO: 2353104 - RNA, 17 nt, Bordetella pertussis
cacgcgguccagccccu

SEQ ID NO: 2353105 - RNA, 17 nt, Bordetella pertussis
cacgcggugcaucucgg

SEQ ID NO: 2353106 - RNA, 18 nt, Bordetella pertussis
cacgcggugcaucucggc

SEQ ID NO: 2353107 - RNA, 19 nt, Bordetella pertussis
cacgcgugaauaccgcgca

SEQ ID NO: 2353108 - RNA, 21 nt, Bordetella pertussis
cacgcgugaauaccgcgcaca

SEQ ID NO: 2353109 - RNA, 23 nt, Bordetella pertussis
cacgcgugaauaccgcgcacagg

SEQ ID NO: 2353110 - RNA, 16 nt, Bordetella pertussis
cacgcguucgggcggc

SEQ ID NO: 2353111 - RNA, 15 nt, Bordetella pertussis
cacgcuagggcgugg

SEQ ID NO: 2353112 - RNA, 14 nt, Bordetella pertussis
cacgcucagcaugc

SEQ ID NO: 2353113 - RNA, 17 nt, Bordetella pertussis
cacgcucuacacggccg

SEQ ID NO: 2353114 - RNA, 19 nt, Bordetella pertussis
cacgcucuacacggccgcc

SEQ ID NO: 2353115 - RNA, 20 nt, Bordetella pertussis
cacgcucuacacggccgcca

SEQ ID NO: 2353116 - RNA, 19 nt, Bordetella pertussis
cacgcucuggagccaccag

SEQ ID NO: 2353117 - RNA, 19 nt, Bordetella pertussis
cacgcucuugagcgcggcc

SEQ ID NO: 2353118 - RNA, 19 nt, Bordetella pertussis
cacgcucuugcgcgcgccg

SEQ ID NO: 2353119 - RNA, 14 nt, Bordetella pertussis
cacgcugaagcgcc

SEQ ID NO: 2353120 - RNA, 16 nt, Bordetella pertussis
cacgcugaagcgccgc

SEQ ID NO: 2353121 - RNA, 18 nt, Bordetella pertussis
cacgcugaagcgccgcca

SEQ ID NO: 2353122 - RNA, 23 nt, Bordetella pertussis
cacgcugaagcgccgccacaggc

SEQ ID NO: 2353123 - RNA, 18 nt, Bordetella pertussis
cacgcugaucgccggcgc

SEQ ID NO: 2353124 - RNA, 14 nt, Bordetella pertussis
cacgcugcccugcu

SEQ ID NO: 2353125 - RNA, 16 nt, Bordetella pertussis
cacgcugcccugcugc

SEQ ID NO: 2353126 - RNA, 14 nt, Bordetella pertussis
cacgcugcgcaggc

SEQ ID NO: 2353127 - RNA, 15 nt, Bordetella pertussis
cacgcugcgcaggcg

SEQ ID NO: 2353128 - RNA, 18 nt, Bordetella pertussis
cacgcugcgcaggcgcgc

SEQ ID NO: 2353129 - RNA, 14 nt, Bordetella pertussis
cacgcugcgcggcg

SEQ ID NO: 2353130 - RNA, 17 nt, Bordetella pertussis
cacgcugcgcggcggcu

SEQ ID NO: 2353131 - RNA, 12 nt, Bordetella pertussis
cacgcugcugcc

SEQ ID NO: 2353132 - RNA, 15 nt, Bordetella pertussis
cacgcuggcaucguc

SEQ ID NO: 2353133 - RNA, 17 nt, Bordetella pertussis
cacgcuggcaucgucgc

SEQ ID NO: 2353134 - RNA, 14 nt, Bordetella pertussis
cacgcuggccgcgc

SEQ ID NO: 2353135 - RNA, 16 nt, Bordetella pertussis
cacgcuggccgcgccc

SEQ ID NO: 2353136 - RNA, 21 nt, Bordetella pertussis
cacgcuggccgcgcccgccgc

SEQ ID NO: 2353137 - RNA, 24 nt, Bordetella pertussis
cacgcuggccgcgcuggcggcgca

SEQ ID NO: 2353138 - RNA, 18 nt, Bordetella pertussis
cacgcuggcgcccgccug

SEQ ID NO: 2353139 - RNA, 23 nt, Bordetella pertussis
cacgcuggcgcccgccugcgcca

SEQ ID NO: 2353140 - RNA, 22 nt, Bordetella pertussis
cacgcuggcggacacgcccugg

SEQ ID NO: 2353141 - RNA, 19 nt, Bordetella pertussis
cacgcuggcuucgucgccg

SEQ ID NO: 2353142 - RNA, 21 nt, Bordetella pertussis
cacgcugggcuacgacccgcu

SEQ ID NO: 2353143 - RNA, 19 nt, Bordetella pertussis
cacgcugguggccaccagc

SEQ ID NO: 2353144 - RNA, 22 nt, Bordetella pertussis
cacgcugguggccaccagcccc

SEQ ID NO: 2353145 - RNA, 19 nt, Bordetella pertussis
cacgucauccugggcgcgc

SEQ ID NO: 2353146 - RNA, 20 nt, Bordetella pertussis
cacgucauugcaucgcagca

SEQ ID NO: 2353147 - RNA, 15 nt, Bordetella pertussis
cacguccaaugccag

SEQ ID NO: 2353148 - RNA, 23 nt, Bordetella pertussis
cacguccagagucugccuggcga

SEQ ID NO: 2353149 - RNA, 13 nt, Bordetella pertussis
cacguccagcacg

SEQ ID NO: 2353150 - RNA, 13 nt, Bordetella pertussis
cacguccagcgcc

SEQ ID NO: 2353151 - RNA, 15 nt, Bordetella pertussis
cacguccagcggcgc

SEQ ID NO: 2353152 - RNA, 23 nt, Bordetella pertussis
cacguccagcggcgcgacgcgcu

SEQ ID NO: 2353153 - RNA, 22 nt, Bordetella pertussis
cacgucccagucgccgcgcccg

SEQ ID NO: 2353154 - RNA, 13 nt, Bordetella pertussis
cacguccggaucu

SEQ ID NO: 2353155 - RNA, 20 nt, Bordetella pertussis
cacgucgaccucgagcaccu

SEQ ID NO: 2353156 - RNA, 17 nt, Bordetella pertussis
cacgucgaucaggccca

SEQ ID NO: 2353157 - RNA, 21 nt, Bordetella pertussis
cacgucgccggcguucuucag

SEQ ID NO: 2353158 - RNA, 21 nt, Bordetella pertussis
cacgucgcgcaauacgccgcc

SEQ ID NO: 2353159 - RNA, 14 nt, Bordetella pertussis
cacgucggcggccg

SEQ ID NO: 2353160 - RNA, 16 nt, Bordetella pertussis
cacgucggcggccgcc

SEQ ID NO: 2353161 - RNA, 13 nt, Bordetella pertussis
cacgucggcgucg

SEQ ID NO: 2353162 - RNA, 20 nt, Bordetella pertussis
cacgucggucgcuuccagcg

SEQ ID NO: 2353163 - RNA, 22 nt, Bordetella pertussis
cacgucggugggaaucggcacc

SEQ ID NO: 2353164 - RNA, 14 nt, Bordetella pertussis
cacgucgucgaugc

SEQ ID NO: 2353165 - RNA, 17 nt, Bordetella pertussis
cacgugaagcgccgcgc

SEQ ID NO: 2353166 - RNA, 16 nt, Bordetella pertussis
cacgugacgccggcga

SEQ ID NO: 2353167 - RNA, 16 nt, Bordetella pertussis
cacgugaugcaggcgg

SEQ ID NO: 2353168 - RNA, 19 nt, Bordetella pertussis
cacgugccggauggcgcgg

SEQ ID NO: 2353169 - RNA, 20 nt, Bordetella pertussis
cacgugccggauggcgcgga

SEQ ID NO: 2353170 - RNA, 21 nt, Bordetella pertussis
cacgugccggccgccuccagg

SEQ ID NO: 2353171 - RNA, 14 nt, Bordetella pertussis
cacgugggcacgcc

SEQ ID NO: 2353172 - RNA, 16 nt, Bordetella pertussis
cacgugggcacgccgg

SEQ ID NO: 2353173 - RNA, 16 nt, Bordetella pertussis
cacgugguccacgaag

SEQ ID NO: 2353174 - RNA, 21 nt, Bordetella pertussis
cacgugguccacgaagcaggu

SEQ ID NO: 2353175 - RNA, 20 nt, Bordetella pertussis
cacguucagcgccggcauga

SEQ ID NO: 2353176 - RNA, 16 nt, Bordetella pertussis
cacguugaagcgcagc

SEQ ID NO: 2353177 - RNA, 14 nt, Bordetella pertussis
cacguugucgcgcg

SEQ ID NO: 2353178 - RNA, 12 nt, Bordetella pertussis
cacuacaaugca

SEQ ID NO: 2353179 - RNA, 15 nt, Bordetella pertussis
cacuacacucugccc

SEQ ID NO: 2353180 - RNA, 18 nt, Bordetella pertussis
cacuccggauaccgccgc

SEQ ID NO: 2353181 - RNA, 20 nt, Bordetella pertussis
cacuccggauaccgccgccg

SEQ ID NO: 2353182 - RNA, 22 nt, Bordetella pertussis
cacuccggauaccgccgccgcu

SEQ ID NO: 2353183 - RNA, 15 nt, Bordetella pertussis
cacucgaugggcgcg

SEQ ID NO: 2353184 - RNA, 16 nt, Bordetella pertussis
cacucgaugggcgcgc

SEQ ID NO: 2353185 - RNA, 14 nt, Bordetella pertussis
cacucggccagcgc

SEQ ID NO: 2353186 - RNA, 14 nt, Bordetella pertussis
cacucggugcgcgc

SEQ ID NO: 2353187 - RNA, 19 nt, Bordetella pertussis
cacucggugcgcgcgccca

SEQ ID NO: 2353188 - RNA, 20 nt, Bordetella pertussis
cacucggugcgcgcgcccac

SEQ ID NO: 2353189 - RNA, 22 nt, Bordetella pertussis
cacucggugcgcgcgcccaccg

SEQ ID NO: 2353190 - RNA, 16 nt, Bordetella pertussis
cacugagaaaggccgc

SEQ ID NO: 2353191 - RNA, 19 nt, Bordetella pertussis
cacugagaaaggccgccac

SEQ ID NO: 2353192 - RNA, 20 nt, Bordetella pertussis
cacugaugcuggucagccug

SEQ ID NO: 2353193 - RNA, 13 nt, Bordetella pertussis
cacugcaccugcu

SEQ ID NO: 2353194 - RNA, 19 nt, Bordetella pertussis
cacugcaccugcuccagcg

SEQ ID NO: 2353195 - RNA, 21 nt, Bordetella pertussis
cacugcagcaguucggcgucg

SEQ ID NO: 2353196 - RNA, 13 nt, Bordetella pertussis
cacugcaucgugc

SEQ ID NO: 2353197 - RNA, 19 nt, Bordetella pertussis
cacugcaucgugcgcgagg

SEQ ID NO: 2353198 - RNA, 17 nt, Bordetella pertussis
cacugccaggcgagcgc

SEQ ID NO: 2353199 - RNA, 18 nt, Bordetella pertussis
cacugccaggcgagcgcc

SEQ ID NO: 2353200 - RNA, 22 nt, Bordetella pertussis
cacugccaggcgagcgccgcgc

SEQ ID NO: 2353201 - RNA, 13 nt, Bordetella pertussis
cacugccaggcgc

SEQ ID NO: 2353202 - RNA, 15 nt, Bordetella pertussis
cacugccaggcgccc

SEQ ID NO: 2353203 - RNA, 17 nt, Bordetella pertussis
cacugccaggcgcccca

SEQ ID NO: 2353204 - RNA, 20 nt, Bordetella pertussis
cacugccaguaggcgcccca

SEQ ID NO: 2353205 - RNA, 14 nt, Bordetella pertussis
cacugcccgcgccg

SEQ ID NO: 2353206 - RNA, 15 nt, Bordetella pertussis
cacugcccgcgccgu

SEQ ID NO: 2353207 - RNA, 21 nt, Bordetella pertussis
cacugcgucacgaaagcgccc

SEQ ID NO: 2353208 - RNA, 18 nt, Bordetella pertussis
cacuggaucgccgaucgg

SEQ ID NO: 2353209 - RNA, 13 nt, Bordetella pertussis
cacuggccagcaa

SEQ ID NO: 2353210 - RNA, 13 nt, Bordetella pertussis
cacuggcccuggc

SEQ ID NO: 2353211 - RNA, 14 nt, Bordetella pertussis
cacuggccgcgcuc

SEQ ID NO: 2353212 - RNA, 21 nt, Bordetella pertussis
cacuggccgcgcucaggccgc

SEQ ID NO: 2353213 - RNA, 16 nt, Bordetella pertussis
cacuggccuucuucac

SEQ ID NO: 2353214 - RNA, 22 nt, Bordetella pertussis
cacuggccuucuucacguagcc

SEQ ID NO: 2353215 - RNA, 22 nt, Bordetella pertussis
cacuggccuugugcgccgucgc

SEQ ID NO: 2353216 - RNA, 11 nt, Bordetella pertussis
cacuggcgcgg

SEQ ID NO: 2353217 - RNA, 12 nt, Bordetella pertussis
cacuggcgcggc

SEQ ID NO: 2353218 - RNA, 13 nt, Bordetella pertussis
cacuggcgcggcg

SEQ ID NO: 2353219 - RNA, 14 nt, Bordetella pertussis
cacuggcgcggcgc

SEQ ID NO: 2353220 - RNA, 15 nt, Bordetella pertussis
cacuggcgcggcgcu

SEQ ID NO: 2353221 - RNA, 10 nt, Bordetella pertussis
cacuggggga

SEQ ID NO: 2353222 - RNA, 16 nt, Bordetella pertussis
cacugggugacgcugg

SEQ ID NO: 2353223 - RNA, 13 nt, Bordetella pertussis
cacuggguggcca

SEQ ID NO: 2353224 - RNA, 16 nt, Bordetella pertussis
cacuggguggccagcg

SEQ ID NO: 2353225 - RNA, 17 nt, Bordetella pertussis
cacuggguggccagcgc

SEQ ID NO: 2353226 - RNA, 20 nt, Bordetella pertussis
cacuggguggccagcgccgc

SEQ ID NO: 2353227 - RNA, 21 nt, Bordetella pertussis
cacuggguggccagcgccgcc

SEQ ID NO: 2353228 - RNA, 22 nt, Bordetella pertussis
cacuggguuuuuccggcucuuc

SEQ ID NO: 2353229 - RNA, 16 nt, Bordetella pertussis
cacugucgccacgggc

SEQ ID NO: 2353230 - RNA, 21 nt, Bordetella pertussis
cacugucggcguuccuggcgc

SEQ ID NO: 2353231 - RNA, 14 nt, Bordetella pertussis
cacuuccagcgccu

SEQ ID NO: 2353232 - RNA, 16 nt, Bordetella pertussis
cacuuccucggcgcgc

SEQ ID NO: 2353233 - RNA, 15 nt, Bordetella pertussis
cacuucgccucggcg

SEQ ID NO: 2353234 - RNA, 15 nt, Bordetella pertussis
cacuugagcagcgcc

SEQ ID NO: 2353235 - RNA, 14 nt, Bordetella pertussis
cacuugcaggccgc

SEQ ID NO: 2353236 - RNA, 15 nt, Bordetella pertussis
cacuugccggccgcc

SEQ ID NO: 2353237 - RNA, 19 nt, Bordetella pertussis
cacuugccggccgcccagg

SEQ ID NO: 2353238 - RNA, 17 nt, Bordetella pertussis
cacuugcgaacggccgc

SEQ ID NO: 2353239 - RNA, 18 nt, Bordetella pertussis
cacuugcgaacggccgcc

SEQ ID NO: 2353240 - RNA, 21 nt, Bordetella pertussis
cacuugcgaacggccgcccgg

SEQ ID NO: 2353241 - RNA, 13 nt, Bordetella pertussis
cacuuggccggcg

SEQ ID NO: 2353242 - RNA, 19 nt, Bordetella pertussis
cacuuucaucaaacgcggc

SEQ ID NO: 2353243 - RNA, 20 nt, Bordetella pertussis
cacuuucaucaaacgcggcg

SEQ ID NO: 2353244 - RNA, 17 nt, Bordetella pertussis
cacuuucgcgcgcgccu

SEQ ID NO: 2353245 - RNA, 13 nt, Bordetella pertussis
cagaaaccccagg

SEQ ID NO: 2353246 - RNA, 22 nt, Bordetella pertussis
cagaaaccccaggggacggcgc

SEQ ID NO: 2353247 - RNA, 23 nt, Bordetella pertussis
cagaaaccccaggggacggcgca

SEQ ID NO: 2353248 - RNA, 14 nt, Bordetella pertussis
cagaaaccgccaca

SEQ ID NO: 2353249 - RNA, 14 nt, Bordetella pertussis
cagaaacuggcgcu

SEQ ID NO: 2353250 - RNA, 15 nt, Bordetella pertussis
cagaaaggaugcccg

SEQ ID NO: 2353251 - RNA, 14 nt, Bordetella pertussis
cagaacagccgcga

SEQ ID NO: 2353252 - RNA, 18 nt, Bordetella pertussis
cagaacagcggaucgccg

SEQ ID NO: 2353253 - RNA, 15 nt, Bordetella pertussis
cagaacccggccggc

SEQ ID NO: 2353254 - RNA, 21 nt, Bordetella pertussis
cagaacgcguaggucaggccc

SEQ ID NO: 2353255 - RNA, 17 nt, Bordetella pertussis
cagaacggaaacgccca

SEQ ID NO: 2353256 - RNA, 18 nt, Bordetella pertussis
cagaacggaaacgcccag

SEQ ID NO: 2353257 - RNA, 19 nt, Bordetella pertussis
cagaacggaaacgcccagc

SEQ ID NO: 2353258 - RNA, 18 nt, Bordetella pertussis
cagcaaaugggccgcagc

SEQ ID NO: 2353259 - RNA, 17 nt, Bordetella pertussis
cagcaaccccagcagcg

SEQ ID NO: 2353260 - RNA, 18 nt, Bordetella pertussis
cagcaaccccagcagcgc

SEQ ID NO: 2353261 - RNA, 15 nt, Bordetella pertussis
cagcaacccgcccgg

SEQ ID NO: 2353262 - RNA, 17 nt, Bordetella pertussis
cagcaacccgcccgggu

SEQ ID NO: 2353263 - RNA, 13 nt, Bordetella pertussis
cagcaacgccggc

SEQ ID NO: 2353264 - RNA, 15 nt, Bordetella pertussis
cagcaacgccggcgg

SEQ ID NO: 2353265 - RNA, 15 nt, Bordetella pertussis
cagcaacgcgccgcu

SEQ ID NO: 2353266 - RNA, 22 nt, Bordetella pertussis
cagcaacggugagccggccacc

SEQ ID NO: 2353267 - RNA, 21 nt, Bordetella pertussis
cagcaacucuuccccgucggc

SEQ ID NO: 2353268 - RNA, 18 nt, Bordetella pertussis
cagcaagaaucggggcgu

SEQ ID NO: 2353269 - RNA, 13 nt, Bordetella pertussis
cagcaagcccacc

SEQ ID NO: 2353270 - RNA, 20 nt, Bordetella pertussis
cagcaagcccaccgggccgg

SEQ ID NO: 2353271 - RNA, 13 nt, Bordetella pertussis
cagcaagcgcgcc

SEQ ID NO: 2353272 - RNA, 14 nt, Bordetella pertussis
cagcaagcgcgcca

SEQ ID NO: 2353273 - RNA, 17 nt, Bordetella pertussis
cagcaagcgcgccauga

SEQ ID NO: 2353274 - RNA, 18 nt, Bordetella pertussis
cagcaagcgcgccaugaa

SEQ ID NO: 2353275 - RNA, 21 nt, Bordetella pertussis
cagcaagcgcgccaugaacuc

SEQ ID NO: 2353276 - RNA, 14 nt, Bordetella pertussis
cagcaagcgcucgg

SEQ ID NO: 2353277 - RNA, 20 nt, Bordetella pertussis
cagcaagcgcucggccacgc

SEQ ID NO: 2353278 - RNA, 17 nt, Bordetella pertussis
cagcaagcugcugcugg

SEQ ID NO: 2353279 - RNA, 17 nt, Bordetella pertussis
cagcaaggacaaggcgc

SEQ ID NO: 2353280 - RNA, 14 nt, Bordetella pertussis
cagcaaggcgcgcc

SEQ ID NO: 2353281 - RNA, 15 nt, Bordetella pertussis
cagcaaggcgcgcca

SEQ ID NO: 2353282 - RNA, 18 nt, Bordetella pertussis
cagcaaggcgcgccaccg

SEQ ID NO: 2353283 - RNA, 17 nt, Bordetella pertussis
cagcaaggcggcaaacc

SEQ ID NO: 2353284 - RNA, 14 nt, Bordetella pertussis
cagcaaggcgucga

SEQ ID NO: 2353285 - RNA, 19 nt, Bordetella pertussis
cagcaaggcgucggccagg

SEQ ID NO: 2353286 - RNA, 14 nt, Bordetella pertussis
cagcaagggcccca

SEQ ID NO: 2353287 - RNA, 17 nt, Bordetella pertussis
cagcaagggccccagca

SEQ ID NO: 2353288 - RNA, 23 nt, Bordetella pertussis
cagcaagggcgucuucgccgacc

SEQ ID NO: 2353289 - RNA, 19 nt, Bordetella pertussis
cagcaagggguccguggcg

SEQ ID NO: 2353290 - RNA, 21 nt, Bordetella pertussis
cagcaagggguccguggcggc

SEQ ID NO: 2353291 - RNA, 22 nt, Bordetella pertussis
cagcaagggguccguggcggcc

SEQ ID NO: 2353292 - RNA, 22 nt, Bordetella pertussis
cagcaaggguucgggcaugucg

SEQ ID NO: 2353293 - RNA, 17 nt, Bordetella pertussis
cagcaagucagcccgcg

SEQ ID NO: 2353294 - RNA, 20 nt, Bordetella pertussis
cagcaagucagcccgcgucg

SEQ ID NO: 2353295 - RNA, 16 nt, Bordetella pertussis
cagcaaugacgacgcc

SEQ ID NO: 2353296 - RNA, 17 nt, Bordetella pertussis
cagcaaugacgacgccg

SEQ ID NO: 2353297 - RNA, 19 nt, Bordetella pertussis
cagcaaugacgacgccggc

SEQ ID NO: 2353298 - RNA, 16 nt, Bordetella pertussis
cagcaauucgaccggc

SEQ ID NO: 2353299 - RNA, 19 nt, Bordetella pertussis
cagcaauucgaccggcagg

SEQ ID NO: 2353300 - RNA, 13 nt, Bordetella pertussis
cagcaauugcccc

SEQ ID NO: 2353301 - RNA, 16 nt, Bordetella pertussis
cagcaauugccccagc

SEQ ID NO: 2353302 - RNA, 19 nt, Bordetella pertussis
cagcaauugccccagcacg

SEQ ID NO: 2353303 - RNA, 17 nt, Bordetella pertussis
cagcacaagggccccuc

SEQ ID NO: 2353304 - RNA, 22 nt, Bordetella pertussis
cagcacacgcauuugcagcggc

SEQ ID NO: 2353305 - RNA, 13 nt, Bordetella pertussis
cagcacacgguca

SEQ ID NO: 2353306 - RNA, 23 nt, Bordetella pertussis
cagcacacggucagcaaccccag

SEQ ID NO: 2353307 - RNA, 18 nt, Bordetella pertussis
cagcacauacgccgccga

SEQ ID NO: 2353308 - RNA, 13 nt, Bordetella pertussis
cagcacaucgccc

SEQ ID NO: 2353309 - RNA, 16 nt, Bordetella pertussis
cagcacaucgcccggc

SEQ ID NO: 2353310 - RNA, 15 nt, Bordetella pertussis
cagcacauggcgcgc

SEQ ID NO: 2353311 - RNA, 12 nt, Bordetella pertussis
cagcaccacauc

SEQ ID NO: 2353312 - RNA, 17 nt, Bordetella pertussis
cagcaccacaucgccgg

SEQ ID NO: 2353313 - RNA, 16 nt, Bordetella pertussis
cagcaccacggcaucg

SEQ ID NO: 2353314 - RNA, 16 nt, Bordetella pertussis
cagcaccacggcggcc

SEQ ID NO: 2353315 - RNA, 17 nt, Bordetella pertussis
cagcaccacgggcucgc

SEQ ID NO: 2353316 - RNA, 20 nt, Bordetella pertussis
cagcaccacgggcucgcuga

SEQ ID NO: 2353317 - RNA, 21 nt, Bordetella pertussis
cagcaccacgggcucgcugac

SEQ ID NO: 2353318 - RNA, 22 nt, Bordetella pertussis
cagcaccacgggcucgcugacc

SEQ ID NO: 2353319 - RNA, 23 nt, Bordetella pertussis
cagcaccacgggcucgcugaccg

SEQ ID NO: 2353320 - RNA, 14 nt, Bordetella pertussis
cagcaccagcaugu

SEQ ID NO: 2353321 - RNA, 14 nt, Bordetella pertussis
cagcaccagcgccu

SEQ ID NO: 2353322 - RNA, 15 nt, Bordetella pertussis
cagcaccagcgccug

SEQ ID NO: 2353323 - RNA, 17 nt, Bordetella pertussis
cagcaccagcgccugcc

SEQ ID NO: 2353324 - RNA, 18 nt, Bordetella pertussis
cagcaccagcgccugccg

SEQ ID NO: 2353325 - RNA, 20 nt, Bordetella pertussis
cagcaccagcgccugccgau

SEQ ID NO: 2353326 - RNA, 18 nt, Bordetella pertussis
cagcaccaggccgccggc

SEQ ID NO: 2353327 - RNA, 12 nt, Bordetella pertussis
cagcaccaggcu

SEQ ID NO: 2353328 - RNA, 13 nt, Bordetella pertussis
cagcaccagggcg

SEQ ID NO: 2353329 - RNA, 17 nt, Bordetella pertussis
cagcaccagggcgcgca

SEQ ID NO: 2353330 - RNA, 18 nt, Bordetella pertussis
cagcaccaugccgaugcc

SEQ ID NO: 2353331 - RNA, 22 nt, Bordetella pertussis
cagcaccaugggcucgugcagc

SEQ ID NO: 2353332 - RNA, 15 nt, Bordetella pertussis
cagcaccccgucggc

SEQ ID NO: 2353333 - RNA, 21 nt, Bordetella pertussis
cagcaccgacaggccgaugcu

SEQ ID NO: 2353334 - RNA, 15 nt, Bordetella pertussis
cagcaccgagcugcc

SEQ ID NO: 2353335 - RNA, 16 nt, Bordetella pertussis
cagcaccgagcugccg

SEQ ID NO: 2353336 - RNA, 18 nt, Bordetella pertussis
cagcaccgagcugccgcc

SEQ ID NO: 2353337 - RNA, 13 nt, Bordetella pertussis
cagcaccgaugcg

SEQ ID NO: 2353338 - RNA, 23 nt, Bordetella pertussis
cagcaccgaugcgccggccuggc

SEQ ID NO: 2353339 - RNA, 19 nt, Bordetella pertussis
cagcaccgccaccguggcg

SEQ ID NO: 2353340 - RNA, 20 nt, Bordetella pertussis
cagcaccgccaccguggcgu

SEQ ID NO: 2353341 - RNA, 23 nt, Bordetella pertussis
cagcaccgccaccguggcgucca

SEQ ID NO: 2353342 - RNA, 21 nt, Bordetella pertussis
cagcaccgccacgcgguccag

SEQ ID NO: 2353343 - RNA, 14 nt, Bordetella pertussis
cagcaccgccagcg

SEQ ID NO: 2353344 - RNA, 15 nt, Bordetella pertussis
cagcaccgccagcgc

SEQ ID NO: 2353345 - RNA, 16 nt, Bordetella pertussis
cagcaccgccaugugc

SEQ ID NO: 2353346 - RNA, 12 nt, Bordetella pertussis
cagcaccgccgc

SEQ ID NO: 2353347 - RNA, 14 nt, Bordetella pertussis
cagcaccgccgcca

SEQ ID NO: 2353348 - RNA, 15 nt, Bordetella pertussis
cagcaccgcgcgcac

SEQ ID NO: 2353349 - RNA, 16 nt, Bordetella pertussis
cagcaccgcgcgcacg

SEQ ID NO: 2353350 - RNA, 17 nt, Bordetella pertussis
cagcaccgcgcgcacga

SEQ ID NO: 2353351 - RNA, 14 nt, Bordetella pertussis
cagcaccgcggcgg

SEQ ID NO: 2353352 - RNA, 18 nt, Bordetella pertussis
cagcaccggauccugcgg

SEQ ID NO: 2353353 - RNA, 14 nt, Bordetella pertussis
cagcaccggcacga

SEQ ID NO: 2353354 - RNA, 18 nt, Bordetella pertussis
cagcaccggcacgcgcca

SEQ ID NO: 2353355 - RNA, 21 nt, Bordetella pertussis
cagcaccggcacgcgccaggc

SEQ ID NO: 2353356 - RNA, 16 nt, Bordetella pertussis
cagcaccggcagaugg

SEQ ID NO: 2353357 - RNA, 18 nt, Bordetella pertussis
cagcaccggcagauggug

SEQ ID NO: 2353358 - RNA, 13 nt, Bordetella pertussis
cagcaccggcagc

SEQ ID NO: 2353359 - RNA, 22 nt, Bordetella pertussis
cagcaccggccgccgcaugccg

SEQ ID NO: 2353360 - RNA, 14 nt, Bordetella pertussis
cagcaccggcguga

SEQ ID NO: 2353361 - RNA, 23 nt, Bordetella pertussis
cagcaccggcgugagcgccaccg

SEQ ID NO: 2353362 - RNA, 12 nt, Bordetella pertussis
cagcaccggcug

SEQ ID NO: 2353363 - RNA, 15 nt, Bordetella pertussis
cagcaccggcugcca

SEQ ID NO: 2353364 - RNA, 20 nt, Bordetella pertussis
cagcaccggcugccagggcc

SEQ ID NO: 2353365 - RNA, 21 nt, Bordetella pertussis
cagcaccggggcagggcgggc

SEQ ID NO: 2353366 - RNA, 15 nt, Bordetella pertussis
cagcaccgugccggc

SEQ ID NO: 2353367 - RNA, 17 nt, Bordetella pertussis
cagcaccgugccggcgu

SEQ ID NO: 2353368 - RNA, 17 nt, Bordetella pertussis
cagcaccucgacgcagc

SEQ ID NO: 2353369 - RNA, 19 nt, Bordetella pertussis
cagcaccucgacgcagccu

SEQ ID NO: 2353370 - RNA, 16 nt, Bordetella pertussis
cagcaccucggcgccc

SEQ ID NO: 2353371 - RNA, 13 nt, Bordetella pertussis
cagcagcagggcc

SEQ ID NO: 2353372 - RNA, 18 nt, Bordetella pertussis
cagcagcaguugcagcau

SEQ ID NO: 2353373 - RNA, 17 nt, Bordetella pertussis
cagcagcaugccgcggu

SEQ ID NO: 2353374 - RNA, 17 nt, Bordetella pertussis
cagcagcaugccuucga

SEQ ID NO: 2353375 - RNA, 18 nt, Bordetella pertussis
cagcagcaugccuucgac

SEQ ID NO: 2353376 - RNA, 15 nt, Bordetella pertussis
cagcagcaugcggcc

SEQ ID NO: 2353377 - RNA, 16 nt, Bordetella pertussis
cagcagcauggcgggc

SEQ ID NO: 2353378 - RNA, 18 nt, Bordetella pertussis
cagcagcauuucgaugcg

SEQ ID NO: 2353379 - RNA, 19 nt, Bordetella pertussis
cagcagcauuucgaugcgc

SEQ ID NO: 2353380 - RNA, 16 nt, Bordetella pertussis
cagcagcccgcuggcc

SEQ ID NO: 2353381 - RNA, 13 nt, Bordetella pertussis
cagcagccgguug

SEQ ID NO: 2353382 - RNA, 16 nt, Bordetella pertussis
cagcagcgacaggacg

SEQ ID NO: 2353383 - RNA, 17 nt, Bordetella pertussis
cagcagcgacaggacgu

SEQ ID NO: 2353384 - RNA, 22 nt, Bordetella pertussis
cagcagcgacggccccagcgcc

SEQ ID NO: 2353385 - RNA, 20 nt, Bordetella pertussis
cagcagcgagcccgccaucg

SEQ ID NO: 2353386 - RNA, 14 nt, Bordetella pertussis
cagcagcgcaucga

SEQ ID NO: 2353387 - RNA, 15 nt, Bordetella pertussis
cagcagcgcaucgcg

SEQ ID NO: 2353388 - RNA, 22 nt, Bordetella pertussis
cagcagcgcaucgcgcgcgccg

SEQ ID NO: 2353389 - RNA, 23 nt, Bordetella pertussis
cagcagcgccacgacgccgucgc

SEQ ID NO: 2353390 - RNA, 12 nt, Bordetella pertussis
cagcagcgccag

SEQ ID NO: 2353391 - RNA, 22 nt, Bordetella pertussis
cagcagcgccagggccaggccg

SEQ ID NO: 2353392 - RNA, 16 nt, Bordetella pertussis
cagcagcgccgccagc

SEQ ID NO: 2353393 - RNA, 20 nt, Bordetella pertussis
cagcagcgccgccagcaugg

SEQ ID NO: 2353394 - RNA, 16 nt, Bordetella pertussis
cagcagcgccgcgccg

SEQ ID NO: 2353395 - RNA, 13 nt, Bordetella pertussis
cagcagcgccggc

SEQ ID NO: 2353396 - RNA, 17 nt, Bordetella pertussis
cagcagcgccggcaggc

SEQ ID NO: 2353397 - RNA, 19 nt, Bordetella pertussis
cagcagcgccggcaggcgc

SEQ ID NO: 2353398 - RNA, 14 nt, Bordetella pertussis
cagcagcgccggga

SEQ ID NO: 2353399 - RNA, 20 nt, Bordetella pertussis
cagcagcgccggggggcgca

SEQ ID NO: 2353400 - RNA, 19 nt, Bordetella pertussis
cagcagcgccuugcggcgc

SEQ ID NO: 2353401 - RNA, 15 nt, Bordetella pertussis
cagcagcgcgccgcc

SEQ ID NO: 2353402 - RNA, 15 nt, Bordetella pertussis
cagcagcgcgccggg

SEQ ID NO: 2353403 - RNA, 16 nt, Bordetella pertussis
cagcagcgcgccgggc

SEQ ID NO: 2353404 - RNA, 14 nt, Bordetella pertussis
cagcagcgcggcgc

SEQ ID NO: 2353405 - RNA, 23 nt, Bordetella pertussis
cagcagcgcggcgccggccguca

SEQ ID NO: 2353406 - RNA, 20 nt, Bordetella pertussis
cagcagcgcgguggccagcg

SEQ ID NO: 2353407 - RNA, 19 nt, Bordetella pertussis
cagcagcgcgugcagccag

SEQ ID NO: 2353408 - RNA, 23 nt, Bordetella pertussis
cagcagcgcgugcagccagcggc

SEQ ID NO: 2353409 - RNA, 14 nt, Bordetella pertussis
cagcagcggcaggu

SEQ ID NO: 2353410 - RNA, 13 nt, Bordetella pertussis
cagcagcggcucg

SEQ ID NO: 2353411 - RNA, 16 nt, Bordetella pertussis
cagcagcggcucgagc

SEQ ID NO: 2353412 - RNA, 17 nt, Bordetella pertussis
cagcagcggcucgagcg

SEQ ID NO: 2353413 - RNA, 19 nt, Bordetella pertussis
cagcagcggcucgagcggc

SEQ ID NO: 2353414 - RNA, 19 nt, Bordetella pertussis
cagcagcgggcuggggcag

SEQ ID NO: 2353415 - RNA, 14 nt, Bordetella pertussis
cagcagcgggcuug

SEQ ID NO: 2353416 - RNA, 20 nt, Bordetella pertussis
cagcagcggguugcgcgcca

SEQ ID NO: 2353417 - RNA, 20 nt, Bordetella pertussis
cagcagcgugaugccgucga

SEQ ID NO: 2353418 - RNA, 24 nt, Bordetella pertussis
cagcagcgugaugccgucgagcgc

SEQ ID NO: 2353419 - RNA, 16 nt, Bordetella pertussis
cagcagcgugaugcgg

SEQ ID NO: 2353420 - RNA, 22 nt, Bordetella pertussis
cagcagcgugcggucguccucg

SEQ ID NO: 2353421 - RNA, 14 nt, Bordetella pertussis
cagcagcguggccg

SEQ ID NO: 2353422 - RNA, 14 nt, Bordetella pertussis
cagcagcuccucgg

SEQ ID NO: 2353423 - RNA, 17 nt, Bordetella pertussis
cagcagcuccucggccu

SEQ ID NO: 2353424 - RNA, 14 nt, Bordetella pertussis
cagcagcucggcga

SEQ ID NO: 2353425 - RNA, 12 nt, Bordetella pertussis
cagcagcucguu

SEQ ID NO: 2353426 - RNA, 16 nt, Bordetella pertussis
cagcagcuggcgcagc

SEQ ID NO: 2353427 - RNA, 22 nt, Bordetella pertussis
cagcagcuggcgcagcacgccg

SEQ ID NO: 2353428 - RNA, 16 nt, Bordetella pertussis
cagcagcuugagcgaa

SEQ ID NO: 2353429 - RNA, 22 nt, Bordetella pertussis
cagcagcuuggccacuucgccg

SEQ ID NO: 2353430 - RNA, 24 nt, Bordetella pertussis
cagcagcuuggugaagcccucguc

SEQ ID NO: 2353431 - RNA, 16 nt, Bordetella pertussis
cagcaggaacaggcug

SEQ ID NO: 2353432 - RNA, 22 nt, Bordetella pertussis
cagcaggaacaggcugcgcagg

SEQ ID NO: 2353433 - RNA, 15 nt, Bordetella pertussis
cagcaggagcccgcu

SEQ ID NO: 2353434 - RNA, 17 nt, Bordetella pertussis
cagcaggauggcgaaca

SEQ ID NO: 2353435 - RNA, 20 nt, Bordetella pertussis
cagcaggauguccacggucg

SEQ ID NO: 2353436 - RNA, 23 nt, Bordetella pertussis
cagcaggauguccacggucgccg

SEQ ID NO: 2353437 - RNA, 13 nt, Bordetella pertussis
cagcaggccagga

SEQ ID NO: 2353438 - RNA, 13 nt, Bordetella pertussis
cagcaggcccacc

SEQ ID NO: 2353439 - RNA, 14 nt, Bordetella pertussis
cagcaggcccaugc

SEQ ID NO: 2353440 - RNA, 19 nt, Bordetella pertussis
cagcaggcccaugccgcgc

SEQ ID NO: 2353441 - RNA, 18 nt, Bordetella pertussis
cagcaggcccuccggcgc

SEQ ID NO: 2353442 - RNA, 19 nt, Bordetella pertussis
cagcaggcccuccggcgcc

SEQ ID NO: 2353443 - RNA, 23 nt, Bordetella pertussis
cagcaggcccuccggcgccagca

SEQ ID NO: 2353444 - RNA, 14 nt, Bordetella pertussis
cagcaggcccuggg

SEQ ID NO: 2353445 - RNA, 20 nt, Bordetella pertussis
cagcaggcccugggcgaggu

SEQ ID NO: 2353446 - RNA, 13 nt, Bordetella pertussis
cagcaggccgcgc

SEQ ID NO: 2353447 - RNA, 12 nt, Bordetella pertussis
cagcaggccggc

SEQ ID NO: 2353448 - RNA, 14 nt, Bordetella pertussis
cagcaggccggcgg

SEQ ID NO: 2353449 - RNA, 18 nt, Bordetella pertussis
cagcaggcgaaacgccag

SEQ ID NO: 2353450 - RNA, 14 nt, Bordetella pertussis
cagcaggcgcacca

SEQ ID NO: 2353451 - RNA, 19 nt, Bordetella pertussis
cagcaggcgcaccagcgcg

SEQ ID NO: 2353452 - RNA, 21 nt, Bordetella pertussis
cagcaggcgcaccagcgcgcc

SEQ ID NO: 2353453 - RNA, 22 nt, Bordetella pertussis
cagcaggcgcaccagcgcgccg

SEQ ID NO: 2353454 - RNA, 15 nt, Bordetella pertussis
cagcaggcgcgcggc

SEQ ID NO: 2353455 - RNA, 19 nt, Bordetella pertussis
cagcaggcgcgcggccucg

SEQ ID NO: 2353456 - RNA, 14 nt, Bordetella pertussis
cagcaggcgcguga

SEQ ID NO: 2353457 - RNA, 18 nt, Bordetella pertussis
cagcaggcgcgugagguc

SEQ ID NO: 2353458 - RNA, 17 nt, Bordetella pertussis
cagcaggcgcgugcuca

SEQ ID NO: 2353459 - RNA, 16 nt, Bordetella pertussis
cagcaggcggccgacc

SEQ ID NO: 2353460 - RNA, 18 nt, Bordetella pertussis
cagcaggcucagcgggcu

SEQ ID NO: 2353461 - RNA, 20 nt, Bordetella pertussis
cagcaggcucagcgggcugc

SEQ ID NO: 2353462 - RNA, 21 nt, Bordetella pertussis
cagcaggcucagcgggcugcu

SEQ ID NO: 2353463 - RNA, 20 nt, Bordetella pertussis
cagcaggcugccgccggcga

SEQ ID NO: 2353464 - RNA, 15 nt, Bordetella pertussis
cagcaggcuggccac

SEQ ID NO: 2353465 - RNA, 15 nt, Bordetella pertussis
cagcaggcugggcga

SEQ ID NO: 2353466 - RNA, 18 nt, Bordetella pertussis
cagcagggacuugggcag

SEQ ID NO: 2353467 - RNA, 20 nt, Bordetella pertussis
cagcagggacuugggcaggc

SEQ ID NO: 2353468 - RNA, 14 nt, Bordetella pertussis
cagcagggccacgc

SEQ ID NO: 2353469 - RNA, 19 nt, Bordetella pertussis
cagcagggccacgcccagg

SEQ ID NO: 2353470 - RNA, 16 nt, Bordetella pertussis
cagcagggccaggccg

SEQ ID NO: 2353471 - RNA, 14 nt, Bordetella pertussis
cagcagggccuggc

SEQ ID NO: 2353472 - RNA, 12 nt, Bordetella pertussis
cagcagggcgcc

SEQ ID NO: 2353473 - RNA, 13 nt, Bordetella pertussis
cagcagggcgccg

SEQ ID NO: 2353474 - RNA, 14 nt, Bordetella pertussis
cagcagggcgccga

SEQ ID NO: 2353475 - RNA, 17 nt, Bordetella pertussis
cagcagggcgccgacga

SEQ ID NO: 2353476 - RNA, 20 nt, Bordetella pertussis
cagcagggcgccgacgaugc

SEQ ID NO: 2353477 - RNA, 12 nt, Bordetella pertussis
cagcagggcggc

SEQ ID NO: 2353478 - RNA, 17 nt, Bordetella pertussis
cagcagggcggcgucga

SEQ ID NO: 2353479 - RNA, 20 nt, Bordetella pertussis
cagcagggucagcggccggc

SEQ ID NO: 2353480 - RNA, 21 nt, Bordetella pertussis
cagcagggucagcggccggcc

SEQ ID NO: 2353481 - RNA, 14 nt, Bordetella pertussis
cagcagggucauga

SEQ ID NO: 2353482 - RNA, 14 nt, Bordetella pertussis
cagcagggucgaga

SEQ ID NO: 2353483 - RNA, 19 nt, Bordetella pertussis
cagcagggucugcaggccg

SEQ ID NO: 2353484 - RNA, 16 nt, Bordetella pertussis
cagccacgcgcgcugg

SEQ ID NO: 2353485 - RNA, 18 nt, Bordetella pertussis
cagccacgugaagcgccg

SEQ ID NO: 2353486 - RNA, 14 nt, Bordetella pertussis
cagccacugcggcc

SEQ ID NO: 2353487 - RNA, 15 nt, Bordetella pertussis
cagccacugcggccc

SEQ ID NO: 2353488 - RNA, 21 nt, Bordetella pertussis
cagccacugcggcccgagcca

SEQ ID NO: 2353489 - RNA, 20 nt, Bordetella pertussis
cagccacuggaacagcuugg

SEQ ID NO: 2353490 - RNA, 23 nt, Bordetella pertussis
cagccagaacaugagccaugccg

SEQ ID NO: 2353491 - RNA, 18 nt, Bordetella pertussis
cagccagauaccguccuu

SEQ ID NO: 2353492 - RNA, 15 nt, Bordetella pertussis
cagccagauuccccc

SEQ ID NO: 2353493 - RNA, 20 nt, Bordetella pertussis
cagccagauucccccgcaca

SEQ ID NO: 2353494 - RNA, 16 nt, Bordetella pertussis
cagccagcccuggccc

SEQ ID NO: 2353495 - RNA, 19 nt, Bordetella pertussis
cagccagccgccgcgcggc

SEQ ID NO: 2353496 - RNA, 20 nt, Bordetella pertussis
cagccagccgccgcgcggcg

SEQ ID NO: 2353497 - RNA, 12 nt, Bordetella pertussis
cagccagccgcu

SEQ ID NO: 2353498 - RNA, 23 nt, Bordetella pertussis
cagccagccgcuugcggccaggc

SEQ ID NO: 2353499 - RNA, 14 nt, Bordetella pertussis
cagccagccggcgg

SEQ ID NO: 2353500 - RNA, 16 nt, Bordetella pertussis
cagccagccggcggcc

SEQ ID NO: 2353501 - RNA, 22 nt, Bordetella pertussis
cagccagccggcggccagcuug

SEQ ID NO: 2353502 - RNA, 11 nt, Bordetella pertussis
cagccagcgau

SEQ ID NO: 2353503 - RNA, 14 nt, Bordetella pertussis
cagccagcgccgca

SEQ ID NO: 2353504 - RNA, 13 nt, Bordetella pertussis
cagccagcggccg

SEQ ID NO: 2353505 - RNA, 14 nt, Bordetella pertussis
cagccagcggccga

SEQ ID NO: 2353506 - RNA, 19 nt, Bordetella pertussis
cagccagcggccgauagcc

SEQ ID NO: 2353507 - RNA, 13 nt, Bordetella pertussis
cagccaggccagc

SEQ ID NO: 2353508 - RNA, 14 nt, Bordetella pertussis
cagccaggccagca

SEQ ID NO: 2353509 - RNA, 23 nt, Bordetella pertussis
cagccaggccagcagcucggcca

SEQ ID NO: 2353510 - RNA, 14 nt, Bordetella pertussis
cagccaggccagcg

SEQ ID NO: 2353511 - RNA, 13 nt, Bordetella pertussis
cagccaggccgau

SEQ ID NO: 2353512 - RNA, 12 nt, Bordetella pertussis
cagccaggccgc

SEQ ID NO: 2353513 - RNA, 15 nt, Bordetella pertussis
cagccaggccucggc

SEQ ID NO: 2353514 - RNA, 16 nt, Bordetella pertussis
cagccaggcgccagcg

SEQ ID NO: 2353515 - RNA, 13 nt, Bordetella pertussis
cagccaggcgcgc

SEQ ID NO: 2353516 - RNA, 16 nt, Bordetella pertussis
cagccaggcgcgcagu

SEQ ID NO: 2353517 - RNA, 21 nt, Bordetella pertussis
cagccaggcgguggccucguc

SEQ ID NO: 2353518 - RNA, 14 nt, Bordetella pertussis
cagccagggcaggg

SEQ ID NO: 2353519 - RNA, 23 nt, Bordetella pertussis
cagccagggcagggcgccgucca

SEQ ID NO: 2353520 - RNA, 18 nt, Bordetella pertussis
cagccagguggcgaugcc

SEQ ID NO: 2353521 - RNA, 22 nt, Bordetella pertussis
cagccagguggcgaugccgggc

SEQ ID NO: 2353522 - RNA, 17 nt, Bordetella pertussis
cagccaucaucaucguc

SEQ ID NO: 2353523 - RNA, 19 nt, Bordetella pertussis
cagccaucaucaucgucgg

SEQ ID NO: 2353524 - RNA, 23 nt, Bordetella pertussis
cagccaucaucaucgucggcgcc

SEQ ID NO: 2353525 - RNA, 15 nt, Bordetella pertussis
cagccauccucgccc

SEQ ID NO: 2353526 - RNA, 21 nt, Bordetella pertussis
cagccauccucgcccagcggc

SEQ ID NO: 2353527 - RNA, 15 nt, Bordetella pertussis
cagccauggaagcgg

SEQ ID NO: 2353528 - RNA, 16 nt, Bordetella pertussis
cagccauggaagcggc

SEQ ID NO: 2353529 - RNA, 17 nt, Bordetella pertussis
cagccauggaagcggca

SEQ ID NO: 2353530 - RNA, 14 nt, Bordetella pertussis
cagccauucggcca

SEQ ID NO: 2353531 - RNA, 17 nt, Bordetella pertussis
cagccauucggccaggu

SEQ ID NO: 2353532 - RNA, 19 nt, Bordetella pertussis
cagccauucggccaggucc

SEQ ID NO: 2353533 - RNA, 18 nt, Bordetella pertussis
cagccauugcccacagca

SEQ ID NO: 2353534 - RNA, 24 nt, Bordetella pertussis
cagcccacaagccguacagcgaag

SEQ ID NO: 2353535 - RNA, 13 nt, Bordetella pertussis
cagcccaccagcg

SEQ ID NO: 2353536 - RNA, 15 nt, Bordetella pertussis
cagcccaccagcgcc

SEQ ID NO: 2353537 - RNA, 16 nt, Bordetella pertussis
cagcccaccagcgcca

SEQ ID NO: 2353538 - RNA, 16 nt, Bordetella pertussis
cagcccaccgcgaacc

SEQ ID NO: 2353539 - RNA, 23 nt, Bordetella pertussis
cagcccaccgcgaaccaggccug

SEQ ID NO: 2353540 - RNA, 13 nt, Bordetella pertussis
cagcccagcacca

SEQ ID NO: 2353541 - RNA, 23 nt, Bordetella pertussis
cagcccagcaccacggcaucggc

SEQ ID NO: 2353542 - RNA, 12 nt, Bordetella pertussis
cagcccagcacg

SEQ ID NO: 2353543 - RNA, 13 nt, Bordetella pertussis
cagcccaggcggg

SEQ ID NO: 2353544 - RNA, 16 nt, Bordetella pertussis
cagcccaggcgggcgu

SEQ ID NO: 2353545 - RNA, 21 nt, Bordetella pertussis
cagcccaguugcuggcccagg

SEQ ID NO: 2353546 - RNA, 16 nt, Bordetella pertussis
cagccccaaugugcug

SEQ ID NO: 2353547 - RNA, 12 nt, Bordetella pertussis
cagccccaccuu

SEQ ID NO: 2353548 - RNA, 23 nt, Bordetella pertussis
cagccccaccuugcccagcagcu

SEQ ID NO: 2353549 - RNA, 14 nt, Bordetella pertussis
cagccccacgccga

SEQ ID NO: 2353550 - RNA, 16 nt, Bordetella pertussis
cagccccacgccgacc

SEQ ID NO: 2353551 - RNA, 18 nt, Bordetella pertussis
cagccccacgccgaccuc

SEQ ID NO: 2353552 - RNA, 13 nt, Bordetella pertussis
cagccccagcgcc

SEQ ID NO: 2353553 - RNA, 14 nt, Bordetella pertussis
cagccccagcgcca

SEQ ID NO: 2353554 - RNA, 15 nt, Bordetella pertussis
cagccccagcgccca

SEQ ID NO: 2353555 - RNA, 16 nt, Bordetella pertussis
cagccccagcgcccag

SEQ ID NO: 2353556 - RNA, 17 nt, Bordetella pertussis
cagccccagcgcccagg

SEQ ID NO: 2353557 - RNA, 18 nt, Bordetella pertussis
cagccccagcgcccaggc

SEQ ID NO: 2353558 - RNA, 20 nt, Bordetella pertussis
cagccccagcgcccaggcga

SEQ ID NO: 2353559 - RNA, 14 nt, Bordetella pertussis
cagccccagcgucc

SEQ ID NO: 2353560 - RNA, 15 nt, Bordetella pertussis
cagccccagcgucca

SEQ ID NO: 2353561 - RNA, 18 nt, Bordetella pertussis
cagccccagcguccaggc

SEQ ID NO: 2353562 - RNA, 12 nt, Bordetella pertussis
cagccccaggcg

SEQ ID NO: 2353563 - RNA, 23 nt, Bordetella pertussis
cagccccccguaggcggcccagg

SEQ ID NO: 2353564 - RNA, 20 nt, Bordetella pertussis
cagcccccugguacgaucag

SEQ ID NO: 2353565 - RNA, 13 nt, Bordetella pertussis
cagccccgcggcc

SEQ ID NO: 2353566 - RNA, 13 nt, Bordetella pertussis
cagccccggcgcg

SEQ ID NO: 2353567 - RNA, 14 nt, Bordetella pertussis
cagccccggcgcgc

SEQ ID NO: 2353568 - RNA, 17 nt, Bordetella pertussis
cagccccggcgcgccgg

SEQ ID NO: 2353569 - RNA, 18 nt, Bordetella pertussis
cagccccggcgcgccggc

SEQ ID NO: 2353570 - RNA, 19 nt, Bordetella pertussis
cagccccgggugcaggucc

SEQ ID NO: 2353571 - RNA, 17 nt, Bordetella pertussis
cagcccgacggccagcg

SEQ ID NO: 2353572 - RNA, 20 nt, Bordetella pertussis
cagcccgauaugcagccgca

SEQ ID NO: 2353573 - RNA, 23 nt, Bordetella pertussis
cagcccgauaugcagccgcacca

SEQ ID NO: 2353574 - RNA, 17 nt, Bordetella pertussis
cagcccgaucgacggcc

SEQ ID NO: 2353575 - RNA, 18 nt, Bordetella pertussis
cagcccgaucgacggccg

SEQ ID NO: 2353576 - RNA, 20 nt, Bordetella pertussis
cagcccgaucgacggccgca

SEQ ID NO: 2353577 - RNA, 17 nt, Bordetella pertussis
cagcccgaugcgccagg

SEQ ID NO: 2353578 - RNA, 18 nt, Bordetella pertussis
cagcccgaugcgccaggc

SEQ ID NO: 2353579 - RNA, 15 nt, Bordetella pertussis
cagcccgcaccgccc

SEQ ID NO: 2353580 - RNA, 20 nt, Bordetella pertussis
cagcccgcccgcgagcggcc

SEQ ID NO: 2353581 - RNA, 15 nt, Bordetella pertussis
cagcccgcccgcgcc

SEQ ID NO: 2353582 - RNA, 17 nt, Bordetella pertussis
cagcccgcccgcgccca

SEQ ID NO: 2353583 - RNA, 20 nt, Bordetella pertussis
cagcccgcccgcgcccagcu

SEQ ID NO: 2353584 - RNA, 23 nt, Bordetella pertussis
cagcccgcccgcgcccagcuuga

SEQ ID NO: 2353585 - RNA, 15 nt, Bordetella pertussis
cagcccgccggcgcg

SEQ ID NO: 2353586 - RNA, 17 nt, Bordetella pertussis
cagcccgccuggcgccg

SEQ ID NO: 2353587 - RNA, 19 nt, Bordetella pertussis
cagcccgccuggcgccgcg

SEQ ID NO: 2353588 - RNA, 17 nt, Bordetella pertussis
cagcccgcgcacgcccg

SEQ ID NO: 2353589 - RNA, 19 nt, Bordetella pertussis
cagcccgcgcacgcccgcg

SEQ ID NO: 2353590 - RNA, 20 nt, Bordetella pertussis
cagcccgcgcacgcccgcga

SEQ ID NO: 2353591 - RNA, 13 nt, Bordetella pertussis
cagcccgcgcgcc

SEQ ID NO: 2353592 - RNA, 16 nt, Bordetella pertussis
cagcccgcgcgccugc

SEQ ID NO: 2353593 - RNA, 14 nt, Bordetella pertussis
cagcccgcgcgcgu

SEQ ID NO: 2353594 - RNA, 23 nt, Bordetella pertussis
cagcccgcgcuggcgcagcaggc

SEQ ID NO: 2353595 - RNA, 21 nt, Bordetella pertussis
cagcccgcgucgcugucggcg

SEQ ID NO: 2353596 - RNA, 19 nt, Bordetella pertussis
cagcccgcguucaggcgcg

SEQ ID NO: 2353597 - RNA, 17 nt, Bordetella pertussis
cagccgggcugccggca

SEQ ID NO: 2353598 - RNA, 22 nt, Bordetella pertussis
cagccggggcgagcgcagccgc

SEQ ID NO: 2353599 - RNA, 23 nt, Bordetella pertussis
cagccggggcgagcgcagccgcu

SEQ ID NO: 2353600 - RNA, 18 nt, Bordetella pertussis
cagccggguggucgcgcc

SEQ ID NO: 2353601 - RNA, 22 nt, Bordetella pertussis
cagccggguggucgcgcccgcc

SEQ ID NO: 2353602 - RNA, 12 nt, Bordetella pertussis
cagccgggugua

SEQ ID NO: 2353603 - RNA, 16 nt, Bordetella pertussis
cagccggugcgcggcu

SEQ ID NO: 2353604 - RNA, 15 nt, Bordetella pertussis
cagccgguuggcgcc

SEQ ID NO: 2353605 - RNA, 13 nt, Bordetella pertussis
cagccgucgcgcu

SEQ ID NO: 2353606 - RNA, 16 nt, Bordetella pertussis
cagccgucgcgcugca

SEQ ID NO: 2353607 - RNA, 15 nt, Bordetella pertussis
cagccgucggcaugg

SEQ ID NO: 2353608 - RNA, 15 nt, Bordetella pertussis
cagccgugccgcgcg

SEQ ID NO: 2353609 - RNA, 17 nt, Bordetella pertussis
cagccgugccgcgcgca

SEQ ID NO: 2353610 - RNA, 18 nt, Bordetella pertussis
cagccgugccgcgcgcac

SEQ ID NO: 2353611 - RNA, 22 nt, Bordetella pertussis
cagccgugccgcgcgcaccggc

SEQ ID NO: 2353612 - RNA, 16 nt, Bordetella pertussis
cagccgugucgcccuu

SEQ ID NO: 2353613 - RNA, 16 nt, Bordetella pertussis
cagccguucauggcgu

SEQ ID NO: 2353614 - RNA, 15 nt, Bordetella pertussis
cagccguugaucugg

SEQ ID NO: 2353615 - RNA, 19 nt, Bordetella pertussis
cagccguugcgccagcggc

SEQ ID NO: 2353616 - RNA, 18 nt, Bordetella pertussis
cagccguuggcgcccagc

SEQ ID NO: 2353617 - RNA, 19 nt, Bordetella pertussis
cagccguuggcgcccagcg

SEQ ID NO: 2353618 - RNA, 22 nt, Bordetella pertussis
cagccguuggcgcccagcgcca

SEQ ID NO: 2353619 - RNA, 23 nt, Bordetella pertussis
cagccguuggcgcccagcgccau

SEQ ID NO: 2353620 - RNA, 19 nt, Bordetella pertussis
cagccucgagguggcgcau

SEQ ID NO: 2353621 - RNA, 19 nt, Bordetella pertussis
cagccugauucccaggccc

SEQ ID NO: 2353622 - RNA, 20 nt, Bordetella pertussis
cagccugauucccaggcccg

SEQ ID NO: 2353623 - RNA, 15 nt, Bordetella pertussis
cagccugcccgggca

SEQ ID NO: 2353624 - RNA, 21 nt, Bordetella pertussis
cagccugcccgggcagcaccg

SEQ ID NO: 2353625 - RNA, 22 nt, Bordetella pertussis
cagccugcccucgggcgacagg

SEQ ID NO: 2353626 - RNA, 18 nt, Bordetella pertussis
cagccugccgcggccgcc

SEQ ID NO: 2353627 - RNA, 19 nt, Bordetella pertussis
cagccugccgcggccgccc

SEQ ID NO: 2353628 - RNA, 19 nt, Bordetella pertussis
cagccugccggcgcgccca

SEQ ID NO: 2353629 - RNA, 14 nt, Bordetella pertussis
cagccugccggcgg

SEQ ID NO: 2353630 - RNA, 16 nt, Bordetella pertussis
cagccuggcaaugcgu

SEQ ID NO: 2353631 - RNA, 14 nt, Bordetella pertussis
cagccuggccuugc

SEQ ID NO: 2353632 - RNA, 15 nt, Bordetella pertussis
cagccuggccuugcg

SEQ ID NO: 2353633 - RNA, 13 nt, Bordetella pertussis
cagccuggcgcca

SEQ ID NO: 2353634 - RNA, 13 nt, Bordetella pertussis
cagccugggccug

SEQ ID NO: 2353635 - RNA, 19 nt, Bordetella pertussis
acagcgccaggcuccauau

SEQ ID NO: 2353636 - RNA, 16 nt, Bordetella pertussis
acagcgcccccagcac

SEQ ID NO: 2353637 - RNA, 23 nt, Bordetella pertussis
acagcgccccgaucagcaagggc

SEQ ID NO: 2353638 - RNA, 13 nt, Bordetella pertussis
acagcgccgcggc

SEQ ID NO: 2353639 - RNA, 13 nt, Bordetella pertussis
acagcgccugcgc

SEQ ID NO: 2353640 - RNA, 16 nt, Bordetella pertussis
acagcgcggcgaaggc

SEQ ID NO: 2353641 - RNA, 19 nt, Bordetella pertussis
acagcgcgggcgcacaaaa

SEQ ID NO: 2353642 - RNA, 15 nt, Bordetella pertussis
acagcggagccgcgc

SEQ ID NO: 2353643 - RNA, 17 nt, Bordetella pertussis
acagcggaucgccggua

SEQ ID NO: 2353644 - RNA, 22 nt, Bordetella pertussis
acagcggcacgccggcggccca

SEQ ID NO: 2353645 - RNA, 12 nt, Bordetella pertussis
acagcggcgcga

SEQ ID NO: 2353646 - RNA, 14 nt, Bordetella pertussis
acagcggcgcgagc

SEQ ID NO: 2353647 - RNA, 19 nt, Bordetella pertussis
acagcgguucguagccggu

SEQ ID NO: 2353648 - RNA, 13 nt, Bordetella pertussis
acagcgucacggc

SEQ ID NO: 2353649 - RNA, 13 nt, Bordetella pertussis
acagcguccagcc

SEQ ID NO: 2353650 - RNA, 18 nt, Bordetella pertussis
acagcgugacggcggcgc

SEQ ID NO: 2353651 - RNA, 17 nt, Bordetella pertussis
acagcucgcgccagggc

SEQ ID NO: 2353652 - RNA, 16 nt, Bordetella pertussis
acagcuggaagcgcgc

SEQ ID NO: 2353653 - RNA, 17 nt, Bordetella pertussis
acagcuggaagcgcgcc

SEQ ID NO: 2353654 - RNA, 20 nt, Bordetella pertussis
acagcuggaagcgcgccagg

SEQ ID NO: 2353655 - RNA, 19 nt, Bordetella pertussis
acagcuugaugggcgaggc

SEQ ID NO: 2353656 - RNA, 13 nt, Bordetella pertussis
acagcuugcgcug

SEQ ID NO: 2353657 - RNA, 20 nt, Bordetella pertussis
acagcuugcgcuggcgcgcg

SEQ ID NO: 2353658 - RNA, 22 nt, Bordetella pertussis
acagcuugggcauuucccagcc

SEQ ID NO: 2353659 - RNA, 19 nt, Bordetella pertussis
acaggaacuccggcggcgc

SEQ ID NO: 2353660 - RNA, 22 nt, Bordetella pertussis
acaggaaggcgagcgcggcaua

SEQ ID NO: 2353661 - RNA, 22 nt, Bordetella pertussis
acaggaucgaaggcagcgcggc

SEQ ID NO: 2353662 - RNA, 12 nt, Bordetella pertussis
acaggauggcga

SEQ ID NO: 2353663 - RNA, 21 nt, Bordetella pertussis
acaggcacaccacgcgaugcg

SEQ ID NO: 2353664 - RNA, 16 nt, Bordetella pertussis
acaggcacacucuguc

SEQ ID NO: 2353665 - RNA, 14 nt, Bordetella pertussis
acaggcacccgcac

SEQ ID NO: 2353666 - RNA, 11 nt, Bordetella pertussis
acaggcacccu

SEQ ID NO: 2353667 - RNA, 23 nt, Bordetella pertussis
acaggcacccugucauacgccau

SEQ ID NO: 2353668 - RNA, 16 nt, Bordetella pertussis
acaggcaccgccgcac

SEQ ID NO: 2353669 - RNA, 14 nt, Bordetella pertussis
acaggcaccuuggc

SEQ ID NO: 2353670 - RNA, 13 nt, Bordetella pertussis
acaggcacgcgcc

SEQ ID NO: 2353671 - RNA, 15 nt, Bordetella pertussis
acaggcacgcgccga

SEQ ID NO: 2353672 - RNA, 14 nt, Bordetella pertussis
acaggcacucggua

SEQ ID NO: 2353673 - RNA, 14 nt, Bordetella pertussis
acaggcacucugcc

SEQ ID NO: 2353674 - RNA, 20 nt, Bordetella pertussis
acaggcacucuugccgcugc

SEQ ID NO: 2353675 - RNA, 15 nt, Bordetella pertussis
acaggcagcugcgcg

SEQ ID NO: 2353676 - RNA, 16 nt, Bordetella pertussis
acaggccagugccugg

SEQ ID NO: 2353677 - RNA, 15 nt, Bordetella pertussis
acaggccaucgccgc

SEQ ID NO: 2353678 - RNA, 19 nt, Bordetella pertussis
acaggccaucggcgccaag

SEQ ID NO: 2353679 - RNA, 14 nt, Bordetella pertussis
acaggcccagcccg

SEQ ID NO: 2353680 - RNA, 13 nt, Bordetella pertussis
acaggcccagcgc

SEQ ID NO: 2353681 - RNA, 19 nt, Bordetella pertussis
acaggcccgcgcggccagc

SEQ ID NO: 2353682 - RNA, 21 nt, Bordetella pertussis
acaggcccucggugcggaaga

SEQ ID NO: 2353683 - RNA, 15 nt, Bordetella pertussis
acaggccggcggcga

SEQ ID NO: 2353684 - RNA, 20 nt, Bordetella pertussis
acaggccggcggcgagcgcg

SEQ ID NO: 2353685 - RNA, 21 nt, Bordetella pertussis
acaggccggcggcgagcgcgg

SEQ ID NO: 2353686 - RNA, 23 nt, Bordetella pertussis
acaggccuggcuuggcggccagg

SEQ ID NO: 2353687 - RNA, 16 nt, Bordetella pertussis
acaggcgccacagggc

SEQ ID NO: 2353688 - RNA, 13 nt, Bordetella pertussis
acaggcgcgccag

SEQ ID NO: 2353689 - RNA, 19 nt, Bordetella pertussis
acaggcgcgccagccgcgc

SEQ ID NO: 2353690 - RNA, 12 nt, Bordetella pertussis
acaggcgcgccc

SEQ ID NO: 2353691 - RNA, 21 nt, Bordetella pertussis
acaggcgcgcccgcguacagc

SEQ ID NO: 2353692 - RNA, 14 nt, Bordetella pertussis
acaggcgcggcacg

SEQ ID NO: 2353693 - RNA, 17 nt, Bordetella pertussis
acaggcgcucgcccucg

SEQ ID NO: 2353694 - RNA, 13 nt, Bordetella pertussis
acaggcgcucgcg

SEQ ID NO: 2353695 - RNA, 22 nt, Bordetella pertussis
acaggcggucuucgaugcuggc

SEQ ID NO: 2353696 - RNA, 16 nt, Bordetella pertussis
acaggcggugcgcgcg

SEQ ID NO: 2353697 - RNA, 18 nt, Bordetella pertussis
acaggcgucugcuacacc

SEQ ID NO: 2353698 - RNA, 13 nt, Bordetella pertussis
acaggcugcgcag

SEQ ID NO: 2353699 - RNA, 17 nt, Bordetella pertussis
acaggcugcgcaggcgc

SEQ ID NO: 2353700 - RNA, 15 nt, Bordetella pertussis
acaggcugcugugcc

SEQ ID NO: 2353701 - RNA, 17 nt, Bordetella pertussis
acaggcugguggcgucg

SEQ ID NO: 2353702 - RNA, 20 nt, Bordetella pertussis
acaggcuguggccgcggccc

SEQ ID NO: 2353703 - RNA, 23 nt, Bordetella pertussis
acaggcuguggccgcggcccagc

SEQ ID NO: 2353704 - RNA, 21 nt, Bordetella pertussis
acagggccgcgagcaugcgca

SEQ ID NO: 2353705 - RNA, 22 nt, Bordetella pertussis
acagggcgucgcgaugcgccag

SEQ ID NO: 2353706 - RNA, 14 nt, Bordetella pertussis
acagggcgucgucg

SEQ ID NO: 2353707 - RNA, 14 nt, Bordetella pertussis
acagggggacuggc

SEQ ID NO: 2353708 - RNA, 13 nt, Bordetella pertussis
acagggggucugg

SEQ ID NO: 2353709 - RNA, 18 nt, Bordetella pertussis
acagggucaaggcgcggc

SEQ ID NO: 2353710 - RNA, 14 nt, Bordetella pertussis
cagcgcaccgucgc

SEQ ID NO: 2353711 - RNA, 18 nt, Bordetella pertussis
cagcgcaccgucgccagg

SEQ ID NO: 2353712 - RNA, 16 nt, Bordetella pertussis
cagcgcacgcagcgcu

SEQ ID NO: 2353713 - RNA, 13 nt, Bordetella pertussis
cagcgcacggucg

SEQ ID NO: 2353714 - RNA, 21 nt, Bordetella pertussis
cagcgcacugagaaaggccgc

SEQ ID NO: 2353715 - RNA, 22 nt, Bordetella pertussis
cagcgcacugagaaaggccgcc

SEQ ID NO: 2353716 - RNA, 18 nt, Bordetella pertussis
cagcgcacugaucgccgc

SEQ ID NO: 2353717 - RNA, 14 nt, Bordetella pertussis
cagcgcagcgccac

SEQ ID NO: 2353718 - RNA, 18 nt, Bordetella pertussis
cagcgcaggaugggcagc

SEQ ID NO: 2353719 - RNA, 21 nt, Bordetella pertussis
cagcgcaggauuuccucgccg

SEQ ID NO: 2353720 - RNA, 13 nt, Bordetella pertussis
cagcgcaggcuga

SEQ ID NO: 2353721 - RNA, 17 nt, Bordetella pertussis
cagcgcauaggacgcca

SEQ ID NO: 2353722 - RNA, 21 nt, Bordetella pertussis
cagcgcauaggacgccaccag

SEQ ID NO: 2353723 - RNA, 13 nt, Bordetella pertussis
cagcgcaucgagc

SEQ ID NO: 2353724 - RNA, 17 nt, Bordetella pertussis
cagcgcaucgccgcagg

SEQ ID NO: 2353725 - RNA, 20 nt, Bordetella pertussis
cagcgcaucgccgcaggcgu

SEQ ID NO: 2353726 - RNA, 15 nt, Bordetella pertussis
cagcgcaucgcgcgc

SEQ ID NO: 2353727 - RNA, 19 nt, Bordetella pertussis
cagcgcaucgcgcgcgccg

SEQ ID NO: 2353728 - RNA, 22 nt, Bordetella pertussis
cagcgcaugccgucgagcgcga

SEQ ID NO: 2353729 - RNA, 14 nt, Bordetella pertussis
cagcgccaccaccg

SEQ ID NO: 2353730 - RNA, 19 nt, Bordetella pertussis
cagcgccaccaccggcacg

SEQ ID NO: 2353731 - RNA, 12 nt, Bordetella pertussis
cagcgccaccag

SEQ ID NO: 2353732 - RNA, 13 nt, Bordetella pertussis
cagcgccaccagc

SEQ ID NO: 2353733 - RNA, 20 nt, Bordetella pertussis
cagcgccaccagcagcgcca

SEQ ID NO: 2353734 - RNA, 22 nt, Bordetella pertussis
cagcgccaccagcagcgccagg

SEQ ID NO: 2353735 - RNA, 13 nt, Bordetella pertussis
cagcgccaccggc

SEQ ID NO: 2353736 - RNA, 16 nt, Bordetella pertussis
cagcgccaccggcugg

SEQ ID NO: 2353737 - RNA, 17 nt, Bordetella pertussis
cagcgccaccguggcca

SEQ ID NO: 2353738 - RNA, 17 nt, Bordetella pertussis
cagcgccacgcccaggc

SEQ ID NO: 2353739 - RNA, 21 nt, Bordetella pertussis
cagcgccacgcccaggccgcu

SEQ ID NO: 2353740 - RNA, 14 nt, Bordetella pertussis
cagcgccacgcccu

SEQ ID NO: 2353741 - RNA, 17 nt, Bordetella pertussis
cagcgccacgcccuggc

SEQ ID NO: 2353742 - RNA, 13 nt, Bordetella pertussis
cagcgccacgccg

SEQ ID NO: 2353743 - RNA, 14 nt, Bordetella pertussis
cagcgccacgccgg

SEQ ID NO: 2353744 - RNA, 15 nt, Bordetella pertussis
cagcgccacgccggc

SEQ ID NO: 2353745 - RNA, 23 nt, Bordetella pertussis
cagcgccacgccggccagcuuga

SEQ ID NO: 2353746 - RNA, 13 nt, Bordetella pertussis
cagcgccacgcug

SEQ ID NO: 2353747 - RNA, 23 nt, Bordetella pertussis
cagcgccacgcuguuuucggccg

SEQ ID NO: 2353748 - RNA, 12 nt, Bordetella pertussis
cagcgccagcac

SEQ ID NO: 2353749 - RNA, 22 nt, Bordetella pertussis
cagcgccagcaccggcacgcgc

SEQ ID NO: 2353750 - RNA, 13 nt, Bordetella pertussis
cagcgccagcacg

SEQ ID NO: 2353751 - RNA, 15 nt, Bordetella pertussis
cagcgccagcacgau

SEQ ID NO: 2353752 - RNA, 20 nt, Bordetella pertussis
cagcgccagcagcaggccgu

SEQ ID NO: 2353753 - RNA, 13 nt, Bordetella pertussis
cagcgccagcagg

SEQ ID NO: 2353754 - RNA, 17 nt, Bordetella pertussis
cagcgccagcaggguca

SEQ ID NO: 2353755 - RNA, 17 nt, Bordetella pertussis
cagcgccagcccgcugc

SEQ ID NO: 2353756 - RNA, 14 nt, Bordetella pertussis
cagcgccagccgcu

SEQ ID NO: 2353757 - RNA, 19 nt, Bordetella pertussis
cagcgccaggaacagcgcc

SEQ ID NO: 2353758 - RNA, 13 nt, Bordetella pertussis
cagcgccaggccg

SEQ ID NO: 2353759 - RNA, 16 nt, Bordetella pertussis
cagcgccaggccgcgc

SEQ ID NO: 2353760 - RNA, 17 nt, Bordetella pertussis
cagcgccaggccgcgca

SEQ ID NO: 2353761 - RNA, 19 nt, Bordetella pertussis
cagcgccaggccgcgcagg

SEQ ID NO: 2353762 - RNA, 13 nt, Bordetella pertussis
cagcgccagggcc

SEQ ID NO: 2353763 - RNA, 14 nt, Bordetella pertussis
cagcgccagggcca

SEQ ID NO: 2353764 - RNA, 15 nt, Bordetella pertussis
cagcgccagggccag

SEQ ID NO: 2353765 - RNA, 17 nt, Bordetella pertussis
cagcgccagggccaggc

SEQ ID NO: 2353766 - RNA, 23 nt, Bordetella pertussis
cagcgccagggccaggccgccgc

SEQ ID NO: 2353767 - RNA, 14 nt, Bordetella pertussis
cagcgccagggugc

SEQ ID NO: 2353768 - RNA, 15 nt, Bordetella pertussis
cagcgccaguccgcg

SEQ ID NO: 2353769 - RNA, 17 nt, Bordetella pertussis
cagcgccaguccgcgcu

SEQ ID NO: 2353770 - RNA, 13 nt, Bordetella pertussis
cagcgccaucauc

SEQ ID NO: 2353771 - RNA, 14 nt, Bordetella pertussis
cagcgccaucgcgc

SEQ ID NO: 2353772 - RNA, 14 nt, Bordetella pertussis
cagcgccaucggca

SEQ ID NO: 2353773 - RNA, 17 nt, Bordetella pertussis
cagcgccaugaugucgc

SEQ ID NO: 2353774 - RNA, 20 nt, Bordetella pertussis
cagcgccaugaugucgcgcg

SEQ ID NO: 2353775 - RNA, 17 nt, Bordetella pertussis
cagcgccauuccgaugu

SEQ ID NO: 2353776 - RNA, 22 nt, Bordetella pertussis
cagcgcccaaucgggcagcacg

SEQ ID NO: 2353777 - RNA, 23 nt, Bordetella pertussis
cagcgcccaaucgggcagcacgc

SEQ ID NO: 2353778 - RNA, 14 nt, Bordetella pertussis
cagcgcccaggcga

SEQ ID NO: 2353779 - RNA, 20 nt, Bordetella pertussis
cagcgcccaggcgaugccca

SEQ ID NO: 2353780 - RNA, 21 nt, Bordetella pertussis
cagcgcccaggcgaugcccag

SEQ ID NO: 2353781 - RNA, 18 nt, Bordetella pertussis
cagcgcccccagcacggu

SEQ ID NO: 2353782 - RNA, 14 nt, Bordetella pertussis
cagcgccccgauca

SEQ ID NO: 2353783 - RNA, 22 nt, Bordetella pertussis
cagcgccccgaucagcaagggc

SEQ ID NO: 2353784 - RNA, 18 nt, Bordetella pertussis
cagcgcccgaaggugggc

SEQ ID NO: 2353785 - RNA, 19 nt, Bordetella pertussis
cagcgcccgaaggugggcg

SEQ ID NO: 2353786 - RNA, 14 nt, Bordetella pertussis
cagcgcccgcgcca

SEQ ID NO: 2353787 - RNA, 17 nt, Bordetella pertussis
cagcgcccgcgccaucg

SEQ ID NO: 2353788 - RNA, 17 nt, Bordetella pertussis
cagcgcccgcggaaagc

SEQ ID NO: 2353789 - RNA, 12 nt, Bordetella pertussis
cagcgccgacga

SEQ ID NO: 2353790 - RNA, 23 nt, Bordetella pertussis
cagcgccgacgauaucgcgaaag

SEQ ID NO: 2353791 - RNA, 15 nt, Bordetella pertussis
cagcgccgacggcau

SEQ ID NO: 2353792 - RNA, 19 nt, Bordetella pertussis
cagcgccgacggcauggcc

SEQ ID NO: 2353793 - RNA, 14 nt, Bordetella pertussis
cagcgccgacucga

SEQ ID NO: 2353794 - RNA, 14 nt, Bordetella pertussis
cagcgccgagcgcc

SEQ ID NO: 2353795 - RNA, 15 nt, Bordetella pertussis
cagcgccgagcgcca

SEQ ID NO: 2353796 - RNA, 21 nt, Bordetella pertussis
cagcgccgagcgccaguucga

SEQ ID NO: 2353797 - RNA, 17 nt, Bordetella pertussis
cagcgccgcagcgucgc

SEQ ID NO: 2353798 - RNA, 21 nt, Bordetella pertussis
cagcgccgccaccucggcguc

SEQ ID NO: 2353799 - RNA, 19 nt, Bordetella pertussis
cagcgccgccagcauggcg

SEQ ID NO: 2353800 - RNA, 23 nt, Bordetella pertussis
cagcgccgccagcauggcggcca

SEQ ID NO: 2353801 - RNA, 17 nt, Bordetella pertussis
cagcgccgccagccgcu

SEQ ID NO: 2353802 - RNA, 23 nt, Bordetella pertussis
cagcgccgccauggcggcgccca

SEQ ID NO: 2353803 - RNA, 20 nt, Bordetella pertussis
cagcgccgccgacggcaugg

SEQ ID NO: 2353804 - RNA, 16 nt, Bordetella pertussis
cagcgccgccuucacc

SEQ ID NO: 2353805 - RNA, 22 nt, Bordetella pertussis
cagcgccgccuucaccggcccc

SEQ ID NO: 2353806 - RNA, 16 nt, Bordetella pertussis
cagcgccgcgccgcgu

SEQ ID NO: 2353807 - RNA, 14 nt, Bordetella pertussis
cagcgccgcgccgg

SEQ ID NO: 2353808 - RNA, 19 nt, Bordetella pertussis
cagcgccgcgccggaucgu

SEQ ID NO: 2353809 - RNA, 14 nt, Bordetella pertussis
cagcgccgcgcgcg

SEQ ID NO: 2353810 - RNA, 15 nt, Bordetella pertussis
cagcgccgcgcgcgu

SEQ ID NO: 2353811 - RNA, 14 nt, Bordetella pertussis
cagcgccgcgcgcu

SEQ ID NO: 2353812 - RNA, 16 nt, Bordetella pertussis
cagcgccgcggccggc

SEQ ID NO: 2353813 - RNA, 22 nt, Bordetella pertussis
cagcgccgcgucgagcgcgacg

SEQ ID NO: 2353814 - RNA, 14 nt, Bordetella pertussis
cagcgccggaaagc

SEQ ID NO: 2353815 - RNA, 18 nt, Bordetella pertussis
cagcgccggcacgcugac

SEQ ID NO: 2353816 - RNA, 20 nt, Bordetella pertussis
cagcgccggcacgcugaccg

SEQ ID NO: 2353817 - RNA, 18 nt, Bordetella pertussis
cagcgccggcacgcugau

SEQ ID NO: 2353818 - RNA, 13 nt, Bordetella pertussis
cagcgccggcagc

SEQ ID NO: 2353819 - RNA, 16 nt, Bordetella pertussis
cagcgccggcagcccc

SEQ ID NO: 2353820 - RNA, 19 nt, Bordetella pertussis
cagcgccggcagccccagc

SEQ ID NO: 2353821 - RNA, 14 nt, Bordetella pertussis
cagcgccggcagcg

SEQ ID NO: 2353822 - RNA, 17 nt, Bordetella pertussis
cagcgccggcaggcgcg

SEQ ID NO: 2353823 - RNA, 18 nt, Bordetella pertussis
cagcgccggcaggcgcgc

SEQ ID NO: 2353824 - RNA, 12 nt, Bordetella pertussis
cagcgcgcggcg

SEQ ID NO: 2353825 - RNA, 15 nt, Bordetella pertussis
cagcgcgcggcgcag

SEQ ID NO: 2353826 - RNA, 17 nt, Bordetella pertussis
cagcgcgcggcgcagcg

SEQ ID NO: 2353827 - RNA, 13 nt, Bordetella pertussis
cagcgcgcggggc

SEQ ID NO: 2353828 - RNA, 17 nt, Bordetella pertussis
cagcgcgcggggcaggc

SEQ ID NO: 2353829 - RNA, 19 nt, Bordetella pertussis
cagcgcgcggggcaggccg

SEQ ID NO: 2353830 - RNA, 20 nt, Bordetella pertussis
cagcgcgcggggcaggccga

SEQ ID NO: 2353831 - RNA, 23 nt, Bordetella pertussis
cagcgcgcggggcaggccgaugu

SEQ ID NO: 2353832 - RNA, 21 nt, Bordetella pertussis
cagcgcgcggugccgccuggc

SEQ ID NO: 2353833 - RNA, 16 nt, Bordetella pertussis
cagcgcggcacgcugc

SEQ ID NO: 2353834 - RNA, 20 nt, Bordetella pertussis
cagcgcggcacgcugcugau

SEQ ID NO: 2353835 - RNA, 16 nt, Bordetella pertussis
cagcgcggcaucggcc

SEQ ID NO: 2353836 - RNA, 17 nt, Bordetella pertussis
cagcgcggcaucggcca

SEQ ID NO: 2353837 - RNA, 18 nt, Bordetella pertussis
cagcgcggcaucggccau

SEQ ID NO: 2353838 - RNA, 14 nt, Bordetella pertussis
cagcgcggcaugcc

SEQ ID NO: 2353839 - RNA, 16 nt, Bordetella pertussis
cagcgcggcaugccgc

SEQ ID NO: 2353840 - RNA, 17 nt, Bordetella pertussis
cagcgcggcaugccgcu

SEQ ID NO: 2353841 - RNA, 17 nt, Bordetella pertussis
cagcgcggccacggccu

SEQ ID NO: 2353842 - RNA, 21 nt, Bordetella pertussis
cagcgcggccagcaccggccg

SEQ ID NO: 2353843 - RNA, 14 nt, Bordetella pertussis
cagcgcggccagcg

SEQ ID NO: 2353844 - RNA, 15 nt, Bordetella pertussis
cagcgcggccagcgc

SEQ ID NO: 2353845 - RNA, 14 nt, Bordetella pertussis
cagcgcggccaggu

SEQ ID NO: 2353846 - RNA, 20 nt, Bordetella pertussis
cagcgcggccaggucggcgu

SEQ ID NO: 2353847 - RNA, 13 nt, Bordetella pertussis
cagcgcggccggc

SEQ ID NO: 2353848 - RNA, 17 nt, Bordetella pertussis
cagcgcggccggcacca

SEQ ID NO: 2353849 - RNA, 21 nt, Bordetella pertussis
cagcgcggccgucaccgccgc

SEQ ID NO: 2353850 - RNA, 20 nt, Bordetella pertussis
cagcgcggcgaaggcgcggc

SEQ ID NO: 2353851 - RNA, 21 nt, Bordetella pertussis
cagcgcggcgaaggcgcggcu

SEQ ID NO: 2353852 - RNA, 14 nt, Bordetella pertussis
cagcgcggcgcaca

SEQ ID NO: 2353853 - RNA, 17 nt, Bordetella pertussis
cagcgcggcgcacaggg

SEQ ID NO: 2353854 - RNA, 23 nt, Bordetella pertussis
cagcgcggcgcacagggcgucgc

SEQ ID NO: 2353855 - RNA, 16 nt, Bordetella pertussis
cagcgcggcgccggcc

SEQ ID NO: 2353856 - RNA, 20 nt, Bordetella pertussis
cagcgcggcgccggccguca

SEQ ID NO: 2353857 - RNA, 19 nt, Bordetella pertussis
cagcgcggcgccggccucc

SEQ ID NO: 2353858 - RNA, 23 nt, Bordetella pertussis
cagcgcggcgccggccuccagca

SEQ ID NO: 2353859 - RNA, 15 nt, Bordetella pertussis
cagcgcggcgcggcc

SEQ ID NO: 2353860 - RNA, 22 nt, Bordetella pertussis
cagcgcggcggacugcgccgca

SEQ ID NO: 2353861 - RNA, 17 nt, Bordetella pertussis
cagcgcggcggcagcgc

SEQ ID NO: 2353862 - RNA, 14 nt, Bordetella pertussis
cagcgcggcggcca

SEQ ID NO: 2353863 - RNA, 17 nt, Bordetella pertussis
cagcgcggcggccaugc

SEQ ID NO: 2353864 - RNA, 23 nt, Bordetella pertussis
cagcgcggcggccaugcccaggc

SEQ ID NO: 2353865 - RNA, 17 nt, Bordetella pertussis
cagcgcggcggcgaccg

SEQ ID NO: 2353866 - RNA, 19 nt, Bordetella pertussis
cagcgcggcggcgaccggc

SEQ ID NO: 2353867 - RNA, 21 nt, Bordetella pertussis
cagcgcggcggcgaccggcgc

SEQ ID NO: 2353868 - RNA, 12 nt, Bordetella pertussis
cagcgcggcggg

SEQ ID NO: 2353869 - RNA, 14 nt, Bordetella pertussis
cagcgcggcgggcg

SEQ ID NO: 2353870 - RNA, 21 nt, Bordetella pertussis
cagcgcggcgggcggcgcggc

SEQ ID NO: 2353871 - RNA, 23 nt, Bordetella pertussis
cagcgcggcgggcggcgcggcca

SEQ ID NO: 2353872 - RNA, 18 nt, Bordetella pertussis
cagcgcggcguugaccug

SEQ ID NO: 2353873 - RNA, 12 nt, Bordetella pertussis
cagcgcgggcca

SEQ ID NO: 2353874 - RNA, 13 nt, Bordetella pertussis
cagcgcgggccac

SEQ ID NO: 2353875 - RNA, 18 nt, Bordetella pertussis
cagcgcgggccacugcgc

SEQ ID NO: 2353876 - RNA, 22 nt, Bordetella pertussis
cagcgcgggccacugcgccugg

SEQ ID NO: 2353877 - RNA, 14 nt, Bordetella pertussis
cagcgcgggcgcac

SEQ ID NO: 2353878 - RNA, 15 nt, Bordetella pertussis
cagcgcgguguugcg

SEQ ID NO: 2353879 - RNA, 18 nt, Bordetella pertussis
cagcgcgguguugcggua

SEQ ID NO: 2353880 - RNA, 18 nt, Bordetella pertussis
cagcgcgguugacugcag

SEQ ID NO: 2353881 - RNA, 22 nt, Bordetella pertussis
cagcgcguccaggugcggcggc

SEQ ID NO: 2353882 - RNA, 21 nt, Bordetella pertussis
cagcgcguccugcacguccuc

SEQ ID NO: 2353883 - RNA, 23 nt, Bordetella pertussis
cagcgcguccugcacguccucga

SEQ ID NO: 2353884 - RNA, 16 nt, Bordetella pertussis
cagcgcgucgagcagc

SEQ ID NO: 2353885 - RNA, 17 nt, Bordetella pertussis
cagcgcgucgagcagcg

SEQ ID NO: 2353886 - RNA, 19 nt, Bordetella pertussis
cagcgcgucgagcagcgca

SEQ ID NO: 2353887 - RNA, 13 nt, Bordetella pertussis
cagcgcgucgccg

SEQ ID NO: 2353888 - RNA, 16 nt, Bordetella pertussis
cagcgcgucgccgcca

SEQ ID NO: 2353889 - RNA, 17 nt, Bordetella pertussis
cagcgcgucgccgccau

SEQ ID NO: 2353890 - RNA, 21 nt, Bordetella pertussis
cagcgcgucgcguagcgcggc

SEQ ID NO: 2353891 - RNA, 22 nt, Bordetella pertussis
cagcgcgucgcguagcgcggcc

SEQ ID NO: 2353892 - RNA, 14 nt, Bordetella pertussis
cagcgcgucggcca

SEQ ID NO: 2353893 - RNA, 19 nt, Bordetella pertussis
cagcgcgucggccagcgcc

SEQ ID NO: 2353894 - RNA, 17 nt, Bordetella pertussis
cagcgcgucggccaggc

SEQ ID NO: 2353895 - RNA, 18 nt, Bordetella pertussis
cagcgcgucggcgccgau

SEQ ID NO: 2353896 - RNA, 19 nt, Bordetella pertussis
cagcgcgucguccagcgug

SEQ ID NO: 2353897 - RNA, 13 nt, Bordetella pertussis
cagcgcguggccg

SEQ ID NO: 2353898 - RNA, 19 nt, Bordetella pertussis
cagcgcgugggccagcaac

SEQ ID NO: 2353899 - RNA, 20 nt, Bordetella pertussis
cagcgcgugggccagcaacu

SEQ ID NO: 2353900 - RNA, 21 nt, Bordetella pertussis
cagcgcgugggccagcaacug

SEQ ID NO: 2353901 - RNA, 19 nt, Bordetella pertussis
cagcgcgugggccaguccg

SEQ ID NO: 2353902 - RNA, 12 nt, Bordetella pertussis
cagcgcgugugg

SEQ ID NO: 2353903 - RNA, 23 nt, Bordetella pertussis
cagcgcgugugguuggcgcugcu

SEQ ID NO: 2353904 - RNA, 15 nt, Bordetella pertussis
cagcgcucgcacggc

SEQ ID NO: 2353905 - RNA, 18 nt, Bordetella pertussis
cagcgcucgggcucgcgc

SEQ ID NO: 2353906 - RNA, 18 nt, Bordetella pertussis
cagcgcucuauucggcca

SEQ ID NO: 2353907 - RNA, 18 nt, Bordetella pertussis
cagcgcugguucgaccug

SEQ ID NO: 2353908 - RNA, 15 nt, Bordetella pertussis
cagcgcuguccaggc

SEQ ID NO: 2353909 - RNA, 16 nt, Bordetella pertussis
cagcgcuguccaggcc

SEQ ID NO: 2353910 - RNA, 17 nt, Bordetella pertussis
cagcgcuguccaggccg

SEQ ID NO: 2353911 - RNA, 13 nt, Bordetella pertussis
cagcgcuucgggc

SEQ ID NO: 2353912 - RNA, 22 nt, Bordetella pertussis
cagcgcuucgggcagcucgcgc

SEQ ID NO: 2353913 - RNA, 16 nt, Bordetella pertussis
cagcgcuucgugcagc

SEQ ID NO: 2353914 - RNA, 17 nt, Bordetella pertussis
cagcgcuucgugcagcg

SEQ ID NO: 2353915 - RNA, 18 nt, Bordetella pertussis
cagcgcuucgugcagcgc

SEQ ID NO: 2353916 - RNA, 20 nt, Bordetella pertussis
cagcgcuucgugcagcgcgu

SEQ ID NO: 2353917 - RNA, 24 nt, Bordetella pertussis
cagcgcuucgugcagcgcgugggc

SEQ ID NO: 2353918 - RNA, 19 nt, Bordetella pertussis
cagcggaaguauucgcgcg

SEQ ID NO: 2353919 - RNA, 21 nt, Bordetella pertussis
cagcggaaguauucgcgcggc

SEQ ID NO: 2353920 - RNA, 15 nt, Bordetella pertussis
cagcggaaugucguu

SEQ ID NO: 2353921 - RNA, 16 nt, Bordetella pertussis
cagcggacggcgcgga

SEQ ID NO: 2353922 - RNA, 20 nt, Bordetella pertussis
cagcggacggcgcggaucgu

SEQ ID NO: 2353923 - RNA, 16 nt, Bordetella pertussis
cagcggacgguagcgc

SEQ ID NO: 2353924 - RNA, 18 nt, Bordetella pertussis
cagcggacguuggccgau

SEQ ID NO: 2353925 - RNA, 14 nt, Bordetella pertussis
cagcggagccgcgc

SEQ ID NO: 2353926 - RNA, 15 nt, Bordetella pertussis
cagcggagccgcgca

SEQ ID NO: 2353927 - RNA, 22 nt, Bordetella pertussis
cagcggagccgcgcacacaugg

SEQ ID NO: 2353928 - RNA, 15 nt, Bordetella pertussis
cagcggagcgacggc

SEQ ID NO: 2353929 - RNA, 18 nt, Bordetella pertussis
cagcggaugaugcggcgc

SEQ ID NO: 2353930 - RNA, 20 nt, Bordetella pertussis
cagcggaugaugcggcgcca

SEQ ID NO: 2353931 - RNA, 15 nt, Bordetella pertussis
cagcggaugccgccc

SEQ ID NO: 2353932 - RNA, 19 nt, Bordetella pertussis
cagcggauggugcucggcg

SEQ ID NO: 2353933 - RNA, 17 nt, Bordetella pertussis
cagcggauugaccagcg

SEQ ID NO: 2353934 - RNA, 22 nt, Bordetella pertussis
cagcggcaaaguagugccccca

SEQ ID NO: 2353935 - RNA, 12 nt, Bordetella pertussis
cagcggcacgcc

SEQ ID NO: 2353936 - RNA, 17 nt, Bordetella pertussis
cagcguccaggcggcca

SEQ ID NO: 2353937 - RNA, 14 nt, Bordetella pertussis
cagcgucccagcca

SEQ ID NO: 2353938 - RNA, 16 nt, Bordetella pertussis
cagcgucgagcugacg

SEQ ID NO: 2353939 - RNA, 19 nt, Bordetella pertussis
cagcgucgagcugacgaag

SEQ ID NO: 2353940 - RNA, 20 nt, Bordetella pertussis
cagcgucgagcugacgaagg

SEQ ID NO: 2353941 - RNA, 15 nt, Bordetella pertussis
cagcgucgcggcguc

SEQ ID NO: 2353942 - RNA, 17 nt, Bordetella pertussis
cagcgucgcggcgucga

SEQ ID NO: 2353943 - RNA, 21 nt, Bordetella pertussis
cagcgucggcguaaggccgcc

SEQ ID NO: 2353944 - RNA, 13 nt, Bordetella pertussis
cagcgucucgggc

SEQ ID NO: 2353945 - RNA, 16 nt, Bordetella pertussis
cagcgucucgggcugg

SEQ ID NO: 2353946 - RNA, 12 nt, Bordetella pertussis
cagcgucugcug

SEQ ID NO: 2353947 - RNA, 23 nt, Bordetella pertussis
cagcgucugcugguacagcccca

SEQ ID NO: 2353948 - RNA, 14 nt, Bordetella pertussis
cagcgucuggcacg

SEQ ID NO: 2353949 - RNA, 17 nt, Bordetella pertussis
cagcgugaaggucggca

SEQ ID NO: 2353950 - RNA, 19 nt, Bordetella pertussis
cagcgugaccgacaggccu

SEQ ID NO: 2353951 - RNA, 20 nt, Bordetella pertussis
cagcgugacggcggcgcgcg

SEQ ID NO: 2353952 - RNA, 20 nt, Bordetella pertussis
cagcgugaugccgucgagcg

SEQ ID NO: 2353953 - RNA, 23 nt, Bordetella pertussis
cagcgugauggggccgggcgcca

SEQ ID NO: 2353954 - RNA, 13 nt, Bordetella pertussis
cagcgugcccagc

SEQ ID NO: 2353955 - RNA, 13 nt, Bordetella pertussis
cagcgugccgccg

SEQ ID NO: 2353956 - RNA, 14 nt, Bordetella pertussis
cagcgugccgccgg

SEQ ID NO: 2353957 - RNA, 15 nt, Bordetella pertussis
cagcgugccgccggc

SEQ ID NO: 2353958 - RNA, 18 nt, Bordetella pertussis
cagcgugccgccggcgcg

SEQ ID NO: 2353959 - RNA, 10 nt, Bordetella pertussis
cagcgugcgc

SEQ ID NO: 2353960 - RNA, 14 nt, Bordetella pertussis
cagcgugcgccccg

SEQ ID NO: 2353961 - RNA, 19 nt, Bordetella pertussis
cagcgugcgccccgccucg

SEQ ID NO: 2353962 - RNA, 20 nt, Bordetella pertussis
cagcgugcgccccgccucga

SEQ ID NO: 2353963 - RNA, 23 nt, Bordetella pertussis
cagcgugcgccccgccucgacga

SEQ ID NO: 2353964 - RNA, 17 nt, Bordetella pertussis
cagcgugcggaccagcg

SEQ ID NO: 2353965 - RNA, 15 nt, Bordetella pertussis
cagcguggagcugcu

SEQ ID NO: 2353966 - RNA, 12 nt, Bordetella pertussis
cagcguggccac

SEQ ID NO: 2353967 - RNA, 22 nt, Bordetella pertussis
cagcguggccaccaggcgcgcg

SEQ ID NO: 2353968 - RNA, 23 nt, Bordetella pertussis
cagcguggccaccaggcgcgcgc

SEQ ID NO: 2353969 - RNA, 12 nt, Bordetella pertussis
cagcguggccgc

SEQ ID NO: 2353970 - RNA, 13 nt, Bordetella pertussis
cagcguggccgcc

SEQ ID NO: 2353971 - RNA, 14 nt, Bordetella pertussis
cagcguggccgcca

SEQ ID NO: 2353972 - RNA, 16 nt, Bordetella pertussis
cagcguggccgccacc

SEQ ID NO: 2353973 - RNA, 21 nt, Bordetella pertussis
cagcguggccgccaccagcgc

SEQ ID NO: 2353974 - RNA, 14 nt, Bordetella pertussis
cagcguggcgcggg

SEQ ID NO: 2353975 - RNA, 17 nt, Bordetella pertussis
cagcguggcgcgggugg

SEQ ID NO: 2353976 - RNA, 15 nt, Bordetella pertussis
cagcguggcggcgac

SEQ ID NO: 2353977 - RNA, 14 nt, Bordetella pertussis
cagcgugggcucga

SEQ ID NO: 2353978 - RNA, 18 nt, Bordetella pertussis
cagcguggggacgcgggc

SEQ ID NO: 2353979 - RNA, 20 nt, Bordetella pertussis
cagcguguagagcaggccgc

SEQ ID NO: 2353980 - RNA, 22 nt, Bordetella pertussis
cagcguguagagcaggccgccc

SEQ ID NO: 2353981 - RNA, 20 nt, Bordetella pertussis
cagcguguaggcggccggcu

SEQ ID NO: 2353982 - RNA, 13 nt, Bordetella pertussis
cagcgugucgccg

SEQ ID NO: 2353983 - RNA, 17 nt, Bordetella pertussis
cagcgugucgccgaccc

SEQ ID NO: 2353984 - RNA, 17 nt, Bordetella pertussis
cagcguucgcgcuugcg

SEQ ID NO: 2353985 - RNA, 14 nt, Bordetella pertussis
cagcguucggccac

SEQ ID NO: 2353986 - RNA, 16 nt, Bordetella pertussis
cagcguucggccaccc

SEQ ID NO: 2353987 - RNA, 14 nt, Bordetella pertussis
cagcguugcggcgu

SEQ ID NO: 2353988 - RNA, 17 nt, Bordetella pertussis
cagcguugcggcgucga

SEQ ID NO: 2353989 - RNA, 24 nt, Bordetella pertussis
cagcguuucaccgcuggacgaggc

SEQ ID NO: 2353990 - RNA, 16 nt, Bordetella pertussis
cagcguuuccagggcg

SEQ ID NO: 2353991 - RNA, 19 nt, Bordetella pertussis
cagcguuuccagggcgcgc

SEQ ID NO: 2353992 - RNA, 23 nt, Bordetella pertussis
cagcguuuccagggcgcgccgca

SEQ ID NO: 2353993 - RNA, 20 nt, Bordetella pertussis
cagcuacggcuggccgucga

SEQ ID NO: 2353994 - RNA, 13 nt, Bordetella pertussis
cagcucagcagcg

SEQ ID NO: 2353995 - RNA, 14 nt, Bordetella pertussis
cagcucagcagcgc

SEQ ID NO: 2353996 - RNA, 15 nt, Bordetella pertussis
cagcucagcagcgcc

SEQ ID NO: 2353997 - RNA, 16 nt, Bordetella pertussis
cagcucagcagcgcca

SEQ ID NO: 2353998 - RNA, 17 nt, Bordetella pertussis
cagcucagcagcgccag

SEQ ID NO: 2353999 - RNA, 21 nt, Bordetella pertussis
cagcucauggcacagcgcggc

SEQ ID NO: 2354000 - RNA, 23 nt, Bordetella pertussis
cagcucauggcacagcgcggcga

SEQ ID NO: 2354001 - RNA, 20 nt, Bordetella pertussis
cagcuccaccgggcugaaca

SEQ ID NO: 2354002 - RNA, 13 nt, Bordetella pertussis
cagcuccagccgc

SEQ ID NO: 2354003 - RNA, 14 nt, Bordetella pertussis
cagcuccagccgca

SEQ ID NO: 2354004 - RNA, 17 nt, Bordetella pertussis
cagcuccagccgcaggc

SEQ ID NO: 2354005 - RNA, 14 nt, Bordetella pertussis
cagcuccagcgcgc

SEQ ID NO: 2354006 - RNA, 17 nt, Bordetella pertussis
cagcuccagcgcgccga

SEQ ID NO: 2354007 - RNA, 21 nt, Bordetella pertussis
cagcuccagcgcgccgaagcg

SEQ ID NO: 2354008 - RNA, 13 nt, Bordetella pertussis
cagcuccagcgcu

SEQ ID NO: 2354009 - RNA, 13 nt, Bordetella pertussis
cagcuccagcugg

SEQ ID NO: 2354010 - RNA, 17 nt, Bordetella pertussis
cagcuccagcuggcgca

SEQ ID NO: 2354011 - RNA, 13 nt, Bordetella pertussis
cagcuccaggugc

SEQ ID NO: 2354012 - RNA, 17 nt, Bordetella pertussis
cagcucccccacgccgc

SEQ ID NO: 2354013 - RNA, 18 nt, Bordetella pertussis
cagcuccggcggcagcgc

SEQ ID NO: 2354014 - RNA, 21 nt, Bordetella pertussis
cagcuccgggucgagcgccga

SEQ ID NO: 2354015 - RNA, 18 nt, Bordetella pertussis
cagcuccguauccugguc

SEQ ID NO: 2354016 - RNA, 14 nt, Bordetella pertussis
cagcuccuugacca

SEQ ID NO: 2354017 - RNA, 17 nt, Bordetella pertussis
cagcucgaccacggcgg

SEQ ID NO: 2354018 - RNA, 18 nt, Bordetella pertussis
cagcucgaccacggcggc

SEQ ID NO: 2354019 - RNA, 20 nt, Bordetella pertussis
cagcucgaccacggcggcuu

SEQ ID NO: 2354020 - RNA, 16 nt, Bordetella pertussis
cagcucgaucaggcgc

SEQ ID NO: 2354021 - RNA, 18 nt, Bordetella pertussis
cagcucgaucaggcgcuc

SEQ ID NO: 2354022 - RNA, 14 nt, Bordetella pertussis
cagcucgccggcga

SEQ ID NO: 2354023 - RNA, 15 nt, Bordetella pertussis
cagcucgcgcagcag

SEQ ID NO: 2354024 - RNA, 16 nt, Bordetella pertussis
cagcucgcgcagcagg

SEQ ID NO: 2354025 - RNA, 17 nt, Bordetella pertussis
cagcucgcgcagcaggc

SEQ ID NO: 2354026 - RNA, 18 nt, Bordetella pertussis
cagcucgcgcagcaggcc

SEQ ID NO: 2354027 - RNA, 19 nt, Bordetella pertussis
cagcucgcgcagcaggccg

SEQ ID NO: 2354028 - RNA, 15 nt, Bordetella pertussis
cagcucgcgccaggg

SEQ ID NO: 2354029 - RNA, 17 nt, Bordetella pertussis
cagcucgcgccagggcc

SEQ ID NO: 2354030 - RNA, 13 nt, Bordetella pertussis
cagcucgcgcgcu

SEQ ID NO: 2354031 - RNA, 21 nt, Bordetella pertussis
cagcucgcgcugcgcgccgcc

SEQ ID NO: 2354032 - RNA, 23 nt, Bordetella pertussis
cagcucgcgcugcgcgccgccgc

SEQ ID NO: 2354033 - RNA, 15 nt, Bordetella pertussis
cagcucgcggcccug

SEQ ID NO: 2354034 - RNA, 24 nt, Bordetella pertussis
cagcucgcggcccuggucgucgcg

SEQ ID NO: 2354035 - RNA, 14 nt, Bordetella pertussis
cagcucgcggucgu

SEQ ID NO: 2354036 - RNA, 19 nt, Bordetella pertussis
cagcucgcguugcaccgcg

SEQ ID NO: 2354037 - RNA, 17 nt, Bordetella pertussis
cagcucggacggauagu

SEQ ID NO: 2354038 - RNA, 22 nt, Bordetella pertussis
cagcucggccaaggcauuggcg

SEQ ID NO: 2354039 - RNA, 17 nt, Bordetella pertussis
cagcucggccaccgccg

SEQ ID NO: 2354040 - RNA, 12 nt, Bordetella pertussis
cagcucggccug

SEQ ID NO: 2354041 - RNA, 17 nt, Bordetella pertussis
cagcucggccugcggcu

SEQ ID NO: 2354042 - RNA, 13 nt, Bordetella pertussis
cagcucggcgaag

SEQ ID NO: 2354043 - RNA, 19 nt, Bordetella pertussis
cagcucggcgaagccgcag

SEQ ID NO: 2354044 - RNA, 21 nt, Bordetella pertussis
cagcucggcgaagccgcagcg

SEQ ID NO: 2354045 - RNA, 23 nt, Bordetella pertussis
cagcucggcgaagccgcagcggc

SEQ ID NO: 2354046 - RNA, 20 nt, Bordetella pertussis
cagcucggcgaccaggccca

SEQ ID NO: 2354047 - RNA, 23 nt, Bordetella pertussis
cagcucggcgaccaggcccaugg

SEQ ID NO: 2354048 - RNA, 21 nt, Bordetella pertussis
cagcucggcgaucugcgcggc

SEQ ID NO: 2354049 - RNA, 20 nt, Bordetella pertussis
caggaaagaggccaggcccu

SEQ ID NO: 2354050 - RNA, 14 nt, Bordetella pertussis
caggaaagcgccgc

SEQ ID NO: 2354051 - RNA, 15 nt, Bordetella pertussis
caggaaagcgccgcc

SEQ ID NO: 2354052 - RNA, 17 nt, Bordetella pertussis
caggaaauacucgagcc

SEQ ID NO: 2354053 - RNA, 16 nt, Bordetella pertussis
caggaaaucaggcgca

SEQ ID NO: 2354054 - RNA, 15 nt, Bordetella pertussis
caggaacaggccggc

SEQ ID NO: 2354055 - RNA, 20 nt, Bordetella pertussis
caggaacauguccaccagcc

SEQ ID NO: 2354056 - RNA, 22 nt, Bordetella pertussis
caggaacauguccaccagccgg

SEQ ID NO: 2354057 - RNA, 21 nt, Bordetella pertussis
caggaacauguucacgcccag

SEQ ID NO: 2354058 - RNA, 22 nt, Bordetella pertussis
caggaacauguucacgcccagg

SEQ ID NO: 2354059 - RNA, 14 nt, Bordetella pertussis
caggaaccagcggc

SEQ ID NO: 2354060 - RNA, 16 nt, Bordetella pertussis
caggaacgccagcagc

SEQ ID NO: 2354061 - RNA, 20 nt, Bordetella pertussis
caggaacucagcgcacugau

SEQ ID NO: 2354062 - RNA, 16 nt, Bordetella pertussis
caggaacuccggcggc

SEQ ID NO: 2354063 - RNA, 19 nt, Bordetella pertussis
caggaacuccggcggcgca

SEQ ID NO: 2354064 - RNA, 23 nt, Bordetella pertussis
caggaacucgcacacgcgcuggg

SEQ ID NO: 2354065 - RNA, 23 nt, Bordetella pertussis
caggaacuugaacggcgcggccu

SEQ ID NO: 2354066 - RNA, 14 nt, Bordetella pertussis
caggaagacuuccg

SEQ ID NO: 2354067 - RNA, 15 nt, Bordetella pertussis
caggaagagcuggcg

SEQ ID NO: 2354068 - RNA, 15 nt, Bordetella pertussis
caggaagaucggccc

SEQ ID NO: 2354069 - RNA, 22 nt, Bordetella pertussis
caggaagaucggcccggcgccg

SEQ ID NO: 2354070 - RNA, 14 nt, Bordetella pertussis
caggaagcagccca

SEQ ID NO: 2354071 - RNA, 17 nt, Bordetella pertussis
caggaagcagcccagca

SEQ ID NO: 2354072 - RNA, 18 nt, Bordetella pertussis
caggaagccugcgcgcga

SEQ ID NO: 2354073 - RNA, 14 nt, Bordetella pertussis
caggaagcgcacca

SEQ ID NO: 2354074 - RNA, 17 nt, Bordetella pertussis
caggaagcgcaccaguu

SEQ ID NO: 2354075 - RNA, 15 nt, Bordetella pertussis
caggaagcgcgccgc

SEQ ID NO: 2354076 - RNA, 22 nt, Bordetella pertussis
caggaagcgcgccgcgcgcacg

SEQ ID NO: 2354077 - RNA, 14 nt, Bordetella pertussis
caggaagcgcgccu

SEQ ID NO: 2354078 - RNA, 23 nt, Bordetella pertussis
caggaagcgcuggcccgucaugg

SEQ ID NO: 2354079 - RNA, 14 nt, Bordetella pertussis
caggaagcggcgca

SEQ ID NO: 2354080 - RNA, 14 nt, Bordetella pertussis
caggaagcgggccu

SEQ ID NO: 2354081 - RNA, 19 nt, Bordetella pertussis
caggaaggcccggucgugg

SEQ ID NO: 2354082 - RNA, 14 nt, Bordetella pertussis
caggaaggccgccg

SEQ ID NO: 2354083 - RNA, 22 nt, Bordetella pertussis
caggaaguugcccaccgacaug

SEQ ID NO: 2354084 - RNA, 17 nt, Bordetella pertussis
caggaauccuggugcca

SEQ ID NO: 2354085 - RNA, 22 nt, Bordetella pertussis
caggaauccuggugccaguccc

SEQ ID NO: 2354086 - RNA, 13 nt, Bordetella pertussis
caggacaaggcgc

SEQ ID NO: 2354087 - RNA, 21 nt, Bordetella pertussis
caggaccgcgccgccgcgccc

SEQ ID NO: 2354088 - RNA, 18 nt, Bordetella pertussis
caggaccuguacuggcug

SEQ ID NO: 2354089 - RNA, 16 nt, Bordetella pertussis
caggacgaacaggccg

SEQ ID NO: 2354090 - RNA, 24 nt, Bordetella pertussis
caggacgaacaggccgccguacga

SEQ ID NO: 2354091 - RNA, 16 nt, Bordetella pertussis
caggacgaucccggcc

SEQ ID NO: 2354092 - RNA, 16 nt, Bordetella pertussis
caggacgccggcgccg

SEQ ID NO: 2354093 - RNA, 18 nt, Bordetella pertussis
caggacgccggcgccggc

SEQ ID NO: 2354094 - RNA, 22 nt, Bordetella pertussis
caggacgcgaagaucccgccgg

SEQ ID NO: 2354095 - RNA, 19 nt, Bordetella pertussis
caggacgggaaagcggcga

SEQ ID NO: 2354096 - RNA, 17 nt, Bordetella pertussis
caggacggggaacaggc

SEQ ID NO: 2354097 - RNA, 20 nt, Bordetella pertussis
caggagcaacuggggcgcuc

SEQ ID NO: 2354098 - RNA, 12 nt, Bordetella pertussis
caggaggcgcgg

SEQ ID NO: 2354099 - RNA, 22 nt, Bordetella pertussis
caggaguucccagcgcgcgaau

SEQ ID NO: 2354100 - RNA, 16 nt, Bordetella pertussis
caggauacgugcugca

SEQ ID NO: 2354101 - RNA, 21 nt, Bordetella pertussis
caggaucaccguuuggccugc

SEQ ID NO: 2354102 - RNA, 23 nt, Bordetella pertussis
caggaucagcuugaugccggcgu

SEQ ID NO: 2354103 - RNA, 15 nt, Bordetella pertussis
caggaucaggccggc

SEQ ID NO: 2354104 - RNA, 17 nt, Bordetella pertussis
caggaucaggccggcga

SEQ ID NO: 2354105 - RNA, 17 nt, Bordetella pertussis
caggauccccagcacau

SEQ ID NO: 2354106 - RNA, 21 nt, Bordetella pertussis
caggaucgaaggcagcgcggc

SEQ ID NO: 2354107 - RNA, 14 nt, Bordetella pertussis
caggaucgcggcca

SEQ ID NO: 2354108 - RNA, 17 nt, Bordetella pertussis
caggaucgucgucauga

SEQ ID NO: 2354109 - RNA, 23 nt, Bordetella pertussis
caggaucugguagugcaggccgc

SEQ ID NO: 2354110 - RNA, 17 nt, Bordetella pertussis
caggaugaacaucggca

SEQ ID NO: 2354111 - RNA, 16 nt, Bordetella pertussis
caggaugagcgccugc

SEQ ID NO: 2354112 - RNA, 20 nt, Bordetella pertussis
caggaugcccuggguggcgg

SEQ ID NO: 2354113 - RNA, 14 nt, Bordetella pertussis
caggaugcccuugg

SEQ ID NO: 2354114 - RNA, 17 nt, Bordetella pertussis
caggaugcccuuggcgg

SEQ ID NO: 2354115 - RNA, 20 nt, Bordetella pertussis
caggaugcccuuggcggcga

SEQ ID NO: 2354116 - RNA, 17 nt, Bordetella pertussis
caggaugccgccuucga

SEQ ID NO: 2354117 - RNA, 23 nt, Bordetella pertussis
caggaugcgcaccggccaggggc

SEQ ID NO: 2354118 - RNA, 14 nt, Bordetella pertussis
caggaugcgcgcca

SEQ ID NO: 2354119 - RNA, 16 nt, Bordetella pertussis
caggaugcgcgccagg

SEQ ID NO: 2354120 - RNA, 21 nt, Bordetella pertussis
caggaugcgcgccaggcuguc

SEQ ID NO: 2354121 - RNA, 17 nt, Bordetella pertussis
caggaugcgcggcacgu

SEQ ID NO: 2354122 - RNA, 21 nt, Bordetella pertussis
caggaugcgcuggccggccgc

SEQ ID NO: 2354123 - RNA, 19 nt, Bordetella pertussis
caggauggagagggccugg

SEQ ID NO: 2354124 - RNA, 21 nt, Bordetella pertussis
caggauggccacgaccaccag

SEQ ID NO: 2354125 - RNA, 23 nt, Bordetella pertussis
caggauggccacgaccaccagcg

SEQ ID NO: 2354126 - RNA, 19 nt, Bordetella pertussis
caggauggcgaucaggaaa

SEQ ID NO: 2354127 - RNA, 19 nt, Bordetella pertussis
caggauggcgccagcccgc

SEQ ID NO: 2354128 - RNA, 23 nt, Bordetella pertussis
caggauggcgccagcccgcccgc

SEQ ID NO: 2354129 - RNA, 18 nt, Bordetella pertussis
caggaugggcagcucgcc

SEQ ID NO: 2354130 - RNA, 19 nt, Bordetella pertussis
caggaugggcagcucgccu

SEQ ID NO: 2354131 - RNA, 16 nt, Bordetella pertussis
caggaugggccguccg

SEQ ID NO: 2354132 - RNA, 16 nt, Bordetella pertussis
caggaugggcgcggcg

SEQ ID NO: 2354133 - RNA, 20 nt, Bordetella pertussis
caggaugggcgcggcgcgcg

SEQ ID NO: 2354134 - RNA, 22 nt, Bordetella pertussis
caggaugggcgcggcgcgcgcc

SEQ ID NO: 2354135 - RNA, 21 nt, Bordetella pertussis
caggauggggcgguggucauc

SEQ ID NO: 2354136 - RNA, 22 nt, Bordetella pertussis
caggauuccugcgaggacaggg

SEQ ID NO: 2354137 - RNA, 20 nt, Bordetella pertussis
caggauuuccucgccguagg

SEQ ID NO: 2354138 - RNA, 13 nt, Bordetella pertussis
caggcaaagccug

SEQ ID NO: 2354139 - RNA, 15 nt, Bordetella pertussis
caggcaaagccugac

SEQ ID NO: 2354140 - RNA, 18 nt, Bordetella pertussis
caggcaaagccugacggc

SEQ ID NO: 2354141 - RNA, 16 nt, Bordetella pertussis
caggcaaaggcccagg

SEQ ID NO: 2354142 - RNA, 21 nt, Bordetella pertussis
caggcaagcugcuggcgcgcc

SEQ ID NO: 2354143 - RNA, 21 nt, Bordetella pertussis
caggcaaucgaugaucacgcg

SEQ ID NO: 2354144 - RNA, 19 nt, Bordetella pertussis
caggcaaugcgcaggcccg

SEQ ID NO: 2354145 - RNA, 22 nt, Bordetella pertussis
caggcaaugcgcaggcccgaca

SEQ ID NO: 2354146 - RNA, 14 nt, Bordetella pertussis
caggcacaccgguc

SEQ ID NO: 2354147 - RNA, 23 nt, Bordetella pertussis
caggcacaccggucuacgccaug

SEQ ID NO: 2354148 - RNA, 16 nt, Bordetella pertussis
caggcacaccgugccg

SEQ ID NO: 2354149 - RNA, 18 nt, Bordetella pertussis
caggcacaccgugccgca

SEQ ID NO: 2354150 - RNA, 16 nt, Bordetella pertussis
caggcacaggaacagc

SEQ ID NO: 2354151 - RNA, 21 nt, Bordetella pertussis
caggcacaggaacagccugcc

SEQ ID NO: 2354152 - RNA, 15 nt, Bordetella pertussis
caggcacccaggggu

SEQ ID NO: 2354153 - RNA, 15 nt, Bordetella pertussis
caggcaccccagcac

SEQ ID NO: 2354154 - RNA, 16 nt, Bordetella pertussis
caggcacccccgaccg

SEQ ID NO: 2354155 - RNA, 17 nt, Bordetella pertussis
caggcaccccggcgccg

SEQ ID NO: 2354156 - RNA, 19 nt, Bordetella pertussis
caggcaccccggcgccgcg

SEQ ID NO: 2354157 - RNA, 24 nt, Bordetella pertussis
caggcaccccgucaugcgccauga

SEQ ID NO: 2354158 - RNA, 17 nt, Bordetella pertussis
caggcacccgcacgggc

SEQ ID NO: 2354159 - RNA, 22 nt, Bordetella pertussis
caggcacccgcacgggcagacg

SEQ ID NO: 2354160 - RNA, 14 nt, Bordetella pertussis
caggcacccggggu

SEQ ID NO: 2354161 - RNA, 15 nt, Bordetella pertussis
caggcccaugccgcg

SEQ ID NO: 2354162 - RNA, 16 nt, Bordetella pertussis
caggcccaugccgcgg

SEQ ID NO: 2354163 - RNA, 14 nt, Bordetella pertussis
caggccccggcccg

SEQ ID NO: 2354164 - RNA, 16 nt, Bordetella pertussis
caggccccggcccggc

SEQ ID NO: 2354165 - RNA, 22 nt, Bordetella pertussis
caggccccggcccggcgggccg

SEQ ID NO: 2354166 - RNA, 22 nt, Bordetella pertussis
caggcccgaaacgcgcagcacc

SEQ ID NO: 2354167 - RNA, 23 nt, Bordetella pertussis
caggcccgaaacgcgcagcaccg

SEQ ID NO: 2354168 - RNA, 18 nt, Bordetella pertussis
caggcccgacaggaucga

SEQ ID NO: 2354169 - RNA, 19 nt, Bordetella pertussis
caggcccgacuuggugggc

SEQ ID NO: 2354170 - RNA, 16 nt, Bordetella pertussis
caggcccgccacggcg

SEQ ID NO: 2354171 - RNA, 18 nt, Bordetella pertussis
caggcccgccagggccau

SEQ ID NO: 2354172 - RNA, 14 nt, Bordetella pertussis
caggcccgcgcggc

SEQ ID NO: 2354173 - RNA, 16 nt, Bordetella pertussis
caggcccgcgcggcca

SEQ ID NO: 2354174 - RNA, 18 nt, Bordetella pertussis
caggcccgcgcggccagc

SEQ ID NO: 2354175 - RNA, 22 nt, Bordetella pertussis
caggcccgcgcggccagcgccg

SEQ ID NO: 2354176 - RNA, 14 nt, Bordetella pertussis
caggcccgcggccg

SEQ ID NO: 2354177 - RNA, 15 nt, Bordetella pertussis
caggcccgcggccgc

SEQ ID NO: 2354178 - RNA, 15 nt, Bordetella pertussis
caggcccgcggcgcc

SEQ ID NO: 2354179 - RNA, 16 nt, Bordetella pertussis
caggcccgcggcgcca

SEQ ID NO: 2354180 - RNA, 21 nt, Bordetella pertussis
caggcccgcggcgccagcgcu

SEQ ID NO: 2354181 - RNA, 18 nt, Bordetella pertussis
caggcccggccgcagggc

SEQ ID NO: 2354182 - RNA, 15 nt, Bordetella pertussis
caggcccgugcucca

SEQ ID NO: 2354183 - RNA, 22 nt, Bordetella pertussis
caggcccgugcuccagaacgcg

SEQ ID NO: 2354184 - RNA, 21 nt, Bordetella pertussis
caggcccguguagacggcaau

SEQ ID NO: 2354185 - RNA, 14 nt, Bordetella pertussis
caggcccuccggcg

SEQ ID NO: 2354186 - RNA, 19 nt, Bordetella pertussis
caggcccuccggcgccagc

SEQ ID NO: 2354187 - RNA, 15 nt, Bordetella pertussis
caggcccucgcggcc

SEQ ID NO: 2354188 - RNA, 18 nt, Bordetella pertussis
caggcccucgcggccguc

SEQ ID NO: 2354189 - RNA, 24 nt, Bordetella pertussis
caggcccucgcggccgucggcgcu

SEQ ID NO: 2354190 - RNA, 14 nt, Bordetella pertussis
caggcccugccgcc

SEQ ID NO: 2354191 - RNA, 20 nt, Bordetella pertussis
caggcccugccgccucagcg

SEQ ID NO: 2354192 - RNA, 16 nt, Bordetella pertussis
caggcccuggcggcgc

SEQ ID NO: 2354193 - RNA, 13 nt, Bordetella pertussis
caggcccuggcug

SEQ ID NO: 2354194 - RNA, 12 nt, Bordetella pertussis
caggcccugggc

SEQ ID NO: 2354195 - RNA, 14 nt, Bordetella pertussis
caggcccugggcca

SEQ ID NO: 2354196 - RNA, 13 nt, Bordetella pertussis
caggcccugggcg

SEQ ID NO: 2354197 - RNA, 13 nt, Bordetella pertussis
caggcccuggggc

SEQ ID NO: 2354198 - RNA, 18 nt, Bordetella pertussis
caggcccuggggccgcgg

SEQ ID NO: 2354199 - RNA, 19 nt, Bordetella pertussis
caggcccuggggccgcggc

SEQ ID NO: 2354200 - RNA, 21 nt, Bordetella pertussis
caggcccuggggccgcggcgc

SEQ ID NO: 2354201 - RNA, 11 nt, Bordetella pertussis
caggcccugua

SEQ ID NO: 2354202 - RNA, 16 nt, Bordetella pertussis
caggcccuugaucagg

SEQ ID NO: 2354203 - RNA, 20 nt, Bordetella pertussis
caggcccuugaucaggcgca

SEQ ID NO: 2354204 - RNA, 23 nt, Bordetella pertussis
caggcccuugaucaggcgcauau

SEQ ID NO: 2354205 - RNA, 16 nt, Bordetella pertussis
caggcccuugauggcc

SEQ ID NO: 2354206 - RNA, 23 nt, Bordetella pertussis
caggccgaaaccgggggaccuuc

SEQ ID NO: 2354207 - RNA, 17 nt, Bordetella pertussis
caggccgaaccacagca

SEQ ID NO: 2354208 - RNA, 19 nt, Bordetella pertussis
caggccgaacgcggucgca

SEQ ID NO: 2354209 - RNA, 15 nt, Bordetella pertussis
caggccgaacuggga

SEQ ID NO: 2354210 - RNA, 20 nt, Bordetella pertussis
caggccgaacugggacaggc

SEQ ID NO: 2354211 - RNA, 22 nt, Bordetella pertussis
caggccgaacugggacaggccc

SEQ ID NO: 2354212 - RNA, 21 nt, Bordetella pertussis
caggccgaacuucagcccggg

SEQ ID NO: 2354213 - RNA, 22 nt, Bordetella pertussis
caggccgaacuucagcccgggc

SEQ ID NO: 2354214 - RNA, 18 nt, Bordetella pertussis
caggccgacgcgcugucc

SEQ ID NO: 2354215 - RNA, 20 nt, Bordetella pertussis
caggccgaggcugcgcgcgc

SEQ ID NO: 2354216 - RNA, 22 nt, Bordetella pertussis
caggccgaggcugcgcgcgcca

SEQ ID NO: 2354217 - RNA, 17 nt, Bordetella pertussis
caggccgaucagcacca

SEQ ID NO: 2354218 - RNA, 19 nt, Bordetella pertussis
caggccgaucagcgacagc

SEQ ID NO: 2354219 - RNA, 16 nt, Bordetella pertussis
caggccgaugaauugc

SEQ ID NO: 2354220 - RNA, 20 nt, Bordetella pertussis
caggccgaugcguccgccgu

SEQ ID NO: 2354221 - RNA, 14 nt, Bordetella pertussis
caggccgauggcgu

SEQ ID NO: 2354222 - RNA, 15 nt, Bordetella pertussis
caggccgauggcguc

SEQ ID NO: 2354223 - RNA, 20 nt, Bordetella pertussis
caggccgauggcguccagca

SEQ ID NO: 2354224 - RNA, 19 nt, Bordetella pertussis
caggccgauuucggccgcc

SEQ ID NO: 2354225 - RNA, 14 nt, Bordetella pertussis
caggccgcagcggg

SEQ ID NO: 2354226 - RNA, 15 nt, Bordetella pertussis
caggccgcagcgggc

SEQ ID NO: 2354227 - RNA, 13 nt, Bordetella pertussis
caggccgcccagc

SEQ ID NO: 2354228 - RNA, 16 nt, Bordetella pertussis
caggccgcccagccgc

SEQ ID NO: 2354229 - RNA, 20 nt, Bordetella pertussis
caggccgcccagccgcgcca

SEQ ID NO: 2354230 - RNA, 14 nt, Bordetella pertussis
caggccgcccagcg

SEQ ID NO: 2354231 - RNA, 16 nt, Bordetella pertussis
caggccgcccagcgca

SEQ ID NO: 2354232 - RNA, 19 nt, Bordetella pertussis
caggccgccccaacggccu

SEQ ID NO: 2354233 - RNA, 13 nt, Bordetella pertussis
caggccgccgccg

SEQ ID NO: 2354234 - RNA, 14 nt, Bordetella pertussis
caggccgccgccgg

SEQ ID NO: 2354235 - RNA, 15 nt, Bordetella pertussis
caggccgccgccggu

SEQ ID NO: 2354236 - RNA, 16 nt, Bordetella pertussis
caggccgccggccagc

SEQ ID NO: 2354237 - RNA, 17 nt, Bordetella pertussis
caggccgccggccagcg

SEQ ID NO: 2354238 - RNA, 20 nt, Bordetella pertussis
caggccgccggccagcgcca

SEQ ID NO: 2354239 - RNA, 17 nt, Bordetella pertussis
caggccgccggcgcggu

SEQ ID NO: 2354240 - RNA, 19 nt, Bordetella pertussis
caggccgccggcggcgucg

SEQ ID NO: 2354241 - RNA, 19 nt, Bordetella pertussis
caggccgccggggaggccu

SEQ ID NO: 2354242 - RNA, 13 nt, Bordetella pertussis
caggccgcgcagc

SEQ ID NO: 2354243 - RNA, 19 nt, Bordetella pertussis
caggccgcgcagcacgccc

SEQ ID NO: 2354244 - RNA, 15 nt, Bordetella pertussis
caggccgcgcagggc

SEQ ID NO: 2354245 - RNA, 11 nt, Bordetella pertussis
caggccgcgcc

SEQ ID NO: 2354246 - RNA, 17 nt, Bordetella pertussis
caggccgcgccacaggc

SEQ ID NO: 2354247 - RNA, 20 nt, Bordetella pertussis
caggccgcgccacaggcgcu

SEQ ID NO: 2354248 - RNA, 14 nt, Bordetella pertussis
caggccgcgccggc

SEQ ID NO: 2354249 - RNA, 16 nt, Bordetella pertussis
caggccgcgccggcuc

SEQ ID NO: 2354250 - RNA, 21 nt, Bordetella pertussis
caggccgcgccggcucccgcg

SEQ ID NO: 2354251 - RNA, 19 nt, Bordetella pertussis
caggccgcgcgugcggggc

SEQ ID NO: 2354252 - RNA, 23 nt, Bordetella pertussis
caggccgcgcgugcggggcggca

SEQ ID NO: 2354253 - RNA, 11 nt, Bordetella pertussis
caggccgcgcu

SEQ ID NO: 2354254 - RNA, 13 nt, Bordetella pertussis
caggccgcgcugg

SEQ ID NO: 2354255 - RNA, 21 nt, Bordetella pertussis
caggccgcgcuggugcuggcc

SEQ ID NO: 2354256 - RNA, 15 nt, Bordetella pertussis
caggccgcggccagg

SEQ ID NO: 2354257 - RNA, 16 nt, Bordetella pertussis
caggccgcggccaggc

SEQ ID NO: 2354258 - RNA, 15 nt, Bordetella pertussis
caggccgcggcgccc

SEQ ID NO: 2354259 - RNA, 21 nt, Bordetella pertussis
caggccgcggcgcccggugcg

SEQ ID NO: 2354260 - RNA, 17 nt, Bordetella pertussis
caggccgcgguggucca

SEQ ID NO: 2354261 - RNA, 23 nt, Bordetella pertussis
caggccgcugggcacauccagcg

SEQ ID NO: 2354262 - RNA, 19 nt, Bordetella pertussis
caggccgcuucgaugcugg

SEQ ID NO: 2354263 - RNA, 19 nt, Bordetella pertussis
caggccgcuuucgaccagc

SEQ ID NO: 2354264 - RNA, 21 nt, Bordetella pertussis
caggccgcuuucgaccagcga

SEQ ID NO: 2354265 - RNA, 24 nt, Bordetella pertussis
caggccgcuuucgaccagcgacag

SEQ ID NO: 2354266 - RNA, 19 nt, Bordetella pertussis
caggccggaaaugccgcgc

SEQ ID NO: 2354267 - RNA, 22 nt, Bordetella pertussis
caggccggaaaugccgcgcgca

SEQ ID NO: 2354268 - RNA, 14 nt, Bordetella pertussis
caggccggaccuug

SEQ ID NO: 2354269 - RNA, 23 nt, Bordetella pertussis
caggccggaugguagaugcgcgc

SEQ ID NO: 2354270 - RNA, 14 nt, Bordetella pertussis
caggccggccagca

SEQ ID NO: 2354271 - RNA, 16 nt, Bordetella pertussis
caggccggccagcaag

SEQ ID NO: 2354272 - RNA, 16 nt, Bordetella pertussis
caggccggccagggcc

SEQ ID NO: 2354273 - RNA, 17 nt, Bordetella pertussis
caggccggccagggcca

SEQ ID NO: 2354274 - RNA, 16 nt, Bordetella pertussis
caggcgcaucgacagc

SEQ ID NO: 2354275 - RNA, 19 nt, Bordetella pertussis
caggcgcaucgacagcgcg

SEQ ID NO: 2354276 - RNA, 15 nt, Bordetella pertussis
caggcgccagcggca

SEQ ID NO: 2354277 - RNA, 17 nt, Bordetella pertussis
caggcgcccgccaccag

SEQ ID NO: 2354278 - RNA, 19 nt, Bordetella pertussis
caggcgcccgccaccagga

SEQ ID NO: 2354279 - RNA, 16 nt, Bordetella pertussis
caggcgcccgugcgcg

SEQ ID NO: 2354280 - RNA, 18 nt, Bordetella pertussis
caggcgccgauccagggc

SEQ ID NO: 2354281 - RNA, 20 nt, Bordetella pertussis
caggcgccgauccagggccg

SEQ ID NO: 2354282 - RNA, 20 nt, Bordetella pertussis
caggcgccgcaacaggcagc

SEQ ID NO: 2354283 - RNA, 16 nt, Bordetella pertussis
caggcgccgcacgccg

SEQ ID NO: 2354284 - RNA, 15 nt, Bordetella pertussis
caggcgccgccgccc

SEQ ID NO: 2354285 - RNA, 18 nt, Bordetella pertussis
caggcgccgccgcccggc

SEQ ID NO: 2354286 - RNA, 20 nt, Bordetella pertussis
caggcgccgcucagcgcggc

SEQ ID NO: 2354287 - RNA, 14 nt, Bordetella pertussis
caggcgccggcugg

SEQ ID NO: 2354288 - RNA, 11 nt, Bordetella pertussis
caggcgccggg

SEQ ID NO: 2354289 - RNA, 16 nt, Bordetella pertussis
caggcgccgggccgcu

SEQ ID NO: 2354290 - RNA, 19 nt, Bordetella pertussis
caggcgccucgcgacggcc

SEQ ID NO: 2354291 - RNA, 15 nt, Bordetella pertussis
caggcgccugccccg

SEQ ID NO: 2354292 - RNA, 20 nt, Bordetella pertussis
caggcgccugccccgccggg

SEQ ID NO: 2354293 - RNA, 22 nt, Bordetella pertussis
caggcgccugccccgccgggac

SEQ ID NO: 2354294 - RNA, 16 nt, Bordetella pertussis
caggcgccuucggcgc

SEQ ID NO: 2354295 - RNA, 20 nt, Bordetella pertussis
caggcgccuuucccgcgccg

SEQ ID NO: 2354296 - RNA, 14 nt, Bordetella pertussis
caggcgcgagacga

SEQ ID NO: 2354297 - RNA, 17 nt, Bordetella pertussis
caggcgcgagcgccggg

SEQ ID NO: 2354298 - RNA, 18 nt, Bordetella pertussis
caggcgcgagguggcgcu

SEQ ID NO: 2354299 - RNA, 20 nt, Bordetella pertussis
caggcgcgagguggcgcucg

SEQ ID NO: 2354300 - RNA, 16 nt, Bordetella pertussis
caggcgcgcaggcggg

SEQ ID NO: 2354301 - RNA, 17 nt, Bordetella pertussis
caggcgcgcaggcgggc

SEQ ID NO: 2354302 - RNA, 17 nt, Bordetella pertussis
caggcgcgcaucgcgcg

SEQ ID NO: 2354303 - RNA, 22 nt, Bordetella pertussis
caggcgcgcaucgcgcggcaug

SEQ ID NO: 2354304 - RNA, 13 nt, Bordetella pertussis
caggcgcgccagc

SEQ ID NO: 2354305 - RNA, 15 nt, Bordetella pertussis
caggcgcgccagccc

SEQ ID NO: 2354306 - RNA, 17 nt, Bordetella pertussis
caggcgcgccagcccgc

SEQ ID NO: 2354307 - RNA, 21 nt, Bordetella pertussis
caggcgcgccagcccgccgcu

SEQ ID NO: 2354308 - RNA, 22 nt, Bordetella pertussis
caggcgcgccagccgcgcgaac

SEQ ID NO: 2354309 - RNA, 17 nt, Bordetella pertussis
caggcgcgccagccgcu

SEQ ID NO: 2354310 - RNA, 18 nt, Bordetella pertussis
caggcgcgccagccgcug

SEQ ID NO: 2354311 - RNA, 18 nt, Bordetella pertussis
caggcgcgccaggggaug

SEQ ID NO: 2354312 - RNA, 23 nt, Bordetella pertussis
caggcgcgccaggggaugacggg

SEQ ID NO: 2354313 - RNA, 17 nt, Bordetella pertussis
caggcgcgccauccuga

SEQ ID NO: 2354314 - RNA, 21 nt, Bordetella pertussis
caggcgcgccauccugaacgc

SEQ ID NO: 2354315 - RNA, 13 nt, Bordetella pertussis
caggcgcgccgcg

SEQ ID NO: 2354316 - RNA, 18 nt, Bordetella pertussis
caggcgcgccgggccggc

SEQ ID NO: 2354317 - RNA, 14 nt, Bordetella pertussis
caggcgcgcgccau

SEQ ID NO: 2354318 - RNA, 17 nt, Bordetella pertussis
caggcgcgcgccaucga

SEQ ID NO: 2354319 - RNA, 20 nt, Bordetella pertussis
caggcgcgcgccaucgacgg

SEQ ID NO: 2354320 - RNA, 13 nt, Bordetella pertussis
caggcgcgcgccu

SEQ ID NO: 2354321 - RNA, 17 nt, Bordetella pertussis
caggcgcgcggcagggc

SEQ ID NO: 2354322 - RNA, 13 nt, Bordetella pertussis
caggcgcgcggcc

SEQ ID NO: 2354323 - RNA, 15 nt, Bordetella pertussis
caggcgcgcggccuc

SEQ ID NO: 2354324 - RNA, 22 nt, Bordetella pertussis
caggcgcgcggcguugcggcgc

SEQ ID NO: 2354325 - RNA, 21 nt, Bordetella pertussis
caggcgcgcgggggugcgcga

SEQ ID NO: 2354326 - RNA, 18 nt, Bordetella pertussis
caggcgcgcucaggccgc

SEQ ID NO: 2354327 - RNA, 19 nt, Bordetella pertussis
caggcgcgcucaggccgcc

SEQ ID NO: 2354328 - RNA, 22 nt, Bordetella pertussis
caggcgcgcucaggccgccggc

SEQ ID NO: 2354329 - RNA, 13 nt, Bordetella pertussis
caggcgcggaucu

SEQ ID NO: 2354330 - RNA, 20 nt, Bordetella pertussis
caggcgcggauugaugucgc

SEQ ID NO: 2354331 - RNA, 23 nt, Bordetella pertussis
caggcgcggauugaugucgcgca

SEQ ID NO: 2354332 - RNA, 11 nt, Bordetella pertussis
caggcgcggca

SEQ ID NO: 2354333 - RNA, 13 nt, Bordetella pertussis
caggcgcggcacg

SEQ ID NO: 2354334 - RNA, 11 nt, Bordetella pertussis
caggcgcggcg

SEQ ID NO: 2354335 - RNA, 16 nt, Bordetella pertussis
caggcgcggcguaucg

SEQ ID NO: 2354336 - RNA, 13 nt, Bordetella pertussis
caggcgcggcugg

SEQ ID NO: 2354337 - RNA, 13 nt, Bordetella pertussis
caggcgcgugcgc

SEQ ID NO: 2354338 - RNA, 14 nt, Bordetella pertussis
caggcgcgugcgca

SEQ ID NO: 2354339 - RNA, 19 nt, Bordetella pertussis
caggcgcgugcucaucggc

SEQ ID NO: 2354340 - RNA, 20 nt, Bordetella pertussis
caggcgcguggccacggcgu

SEQ ID NO: 2354341 - RNA, 21 nt, Bordetella pertussis
caggcgcguggccacggcguc

SEQ ID NO: 2354342 - RNA, 23 nt, Bordetella pertussis
caggcgcucaagggccugucaca

SEQ ID NO: 2354343 - RNA, 14 nt, Bordetella pertussis
caggcgcucagccg

SEQ ID NO: 2354344 - RNA, 22 nt, Bordetella pertussis
caggcgcucagccgugccgcgc

SEQ ID NO: 2354345 - RNA, 15 nt, Bordetella pertussis
caggcgcuccauggc

SEQ ID NO: 2354346 - RNA, 17 nt, Bordetella pertussis
caggcgcucgaggcgcu

SEQ ID NO: 2354347 - RNA, 18 nt, Bordetella pertussis
caggcgcucgaggcgcug

SEQ ID NO: 2354348 - RNA, 20 nt, Bordetella pertussis
caggcgcucgcccucgcgcc

SEQ ID NO: 2354349 - RNA, 13 nt, Bordetella pertussis
caggcgcucgcgc

SEQ ID NO: 2354350 - RNA, 22 nt, Bordetella pertussis
caggcgcucgcgcgccagcagu

SEQ ID NO: 2354351 - RNA, 19 nt, Bordetella pertussis
caggcgcucgcgcugcagg

SEQ ID NO: 2354352 - RNA, 20 nt, Bordetella pertussis
caggcgcucgcgggugcgca

SEQ ID NO: 2354353 - RNA, 14 nt, Bordetella pertussis
caggcgcucggcca

SEQ ID NO: 2354354 - RNA, 17 nt, Bordetella pertussis
caggcgcucggccagcg

SEQ ID NO: 2354355 - RNA, 18 nt, Bordetella pertussis
caggcgcucggccagcga

SEQ ID NO: 2354356 - RNA, 16 nt, Bordetella pertussis
caggcgcucggcguug

SEQ ID NO: 2354357 - RNA, 13 nt, Bordetella pertussis
caggcgcugcagc

SEQ ID NO: 2354358 - RNA, 20 nt, Bordetella pertussis
caggcgcugcagcaauccau

SEQ ID NO: 2354359 - RNA, 22 nt, Bordetella pertussis
caggcgcugcgcgaaacggccg

SEQ ID NO: 2354360 - RNA, 21 nt, Bordetella pertussis
caggcgcugguaaagggcgcg

SEQ ID NO: 2354361 - RNA, 23 nt, Bordetella pertussis
caggcgcugguaaagggcgcgga

SEQ ID NO: 2354362 - RNA, 22 nt, Bordetella pertussis
caggcgcugguaguaggccacu

SEQ ID NO: 2354363 - RNA, 18 nt, Bordetella pertussis
caggcgcuggucgucgcg

SEQ ID NO: 2354364 - RNA, 13 nt, Bordetella pertussis
caggcggagucgc

SEQ ID NO: 2354365 - RNA, 19 nt, Bordetella pertussis
caggcggagucgccccgac

SEQ ID NO: 2354366 - RNA, 24 nt, Bordetella pertussis
caggcggaugcgguacugcggcgc

SEQ ID NO: 2354367 - RNA, 18 nt, Bordetella pertussis
caggcggcagaaggcgac

SEQ ID NO: 2354368 - RNA, 15 nt, Bordetella pertussis
caggcggcaggcgcc

SEQ ID NO: 2354369 - RNA, 16 nt, Bordetella pertussis
caggcggcaggcgccg

SEQ ID NO: 2354370 - RNA, 18 nt, Bordetella pertussis
caggcggcaggcgccgcc

SEQ ID NO: 2354371 - RNA, 18 nt, Bordetella pertussis
caggcggccaccaccagg

SEQ ID NO: 2354372 - RNA, 14 nt, Bordetella pertussis
caggcggccagggc

SEQ ID NO: 2354373 - RNA, 15 nt, Bordetella pertussis
caggcggccagggcc

SEQ ID NO: 2354374 - RNA, 17 nt, Bordetella pertussis
caggcggccagggccug

SEQ ID NO: 2354375 - RNA, 15 nt, Bordetella pertussis
caggcggccgaccag

SEQ ID NO: 2354376 - RNA, 16 nt, Bordetella pertussis
caggcggcgcaucagc

SEQ ID NO: 2354377 - RNA, 13 nt, Bordetella pertussis
caggcggcgcucg

SEQ ID NO: 2354378 - RNA, 18 nt, Bordetella pertussis
caggcggcggcgcggcgc

SEQ ID NO: 2354379 - RNA, 15 nt, Bordetella pertussis
caggcggcggugcca

SEQ ID NO: 2354380 - RNA, 21 nt, Bordetella pertussis
caggcggcguaguucagccac

SEQ ID NO: 2354381 - RNA, 15 nt, Bordetella pertussis
caggcggcugaagaa

SEQ ID NO: 2354382 - RNA, 21 nt, Bordetella pertussis
caggcggcugcccaccuugcg

SEQ ID NO: 2354383 - RNA, 22 nt, Bordetella pertussis
caggcggcugcccaccuugcgc

SEQ ID NO: 2354384 - RNA, 17 nt, Bordetella pertussis
caggcggcuggugccga

SEQ ID NO: 2354385 - RNA, 23 nt, Bordetella pertussis
caggcggcuggugccgacggcgc

SEQ ID NO: 2354386 - RNA, 21 nt, Bordetella pertussis
caggcggcuguagucgccgcu

SEQ ID NO: 2354387 - RNA, 22 nt, Bordetella pertussis
cagggccgccgcgcccagccgc

SEQ ID NO: 2354388 - RNA, 23 nt, Bordetella pertussis
cagggccgccgcgcccagccgcg

SEQ ID NO: 2354389 - RNA, 13 nt, Bordetella pertussis
cagggccgcgagc

SEQ ID NO: 2354390 - RNA, 20 nt, Bordetella pertussis
cagggccgcgagcaugcgca

SEQ ID NO: 2354391 - RNA, 14 nt, Bordetella pertussis
cagggccuccucgg

SEQ ID NO: 2354392 - RNA, 17 nt, Bordetella pertussis
cagggccucgcgggccu

SEQ ID NO: 2354393 - RNA, 18 nt, Bordetella pertussis
cagggccucgcgggccuu

SEQ ID NO: 2354394 - RNA, 16 nt, Bordetella pertussis
cagggccugcgggccg

SEQ ID NO: 2354395 - RNA, 20 nt, Bordetella pertussis
cagggccugcgggccgggca

SEQ ID NO: 2354396 - RNA, 17 nt, Bordetella pertussis
cagggccuggcagaugc

SEQ ID NO: 2354397 - RNA, 13 nt, Bordetella pertussis
cagggcgaagcgc

SEQ ID NO: 2354398 - RNA, 17 nt, Bordetella pertussis
cagggcgaaggccagcg

SEQ ID NO: 2354399 - RNA, 21 nt, Bordetella pertussis
cagggcgacgucccaggccga

SEQ ID NO: 2354400 - RNA, 20 nt, Bordetella pertussis
cagggcgaugaccggcaagc

SEQ ID NO: 2354401 - RNA, 17 nt, Bordetella pertussis
cagggcgaugcggcggc

SEQ ID NO: 2354402 - RNA, 18 nt, Bordetella pertussis
cagggcgaugcggcggcc

SEQ ID NO: 2354403 - RNA, 23 nt, Bordetella pertussis
cagggcgcccgccgacgaaaugc

SEQ ID NO: 2354404 - RNA, 12 nt, Bordetella pertussis
cagggcgccgcg

SEQ ID NO: 2354405 - RNA, 15 nt, Bordetella pertussis
cagggcgccgcggcg

SEQ ID NO: 2354406 - RNA, 12 nt, Bordetella pertussis
cagggcgccggc

SEQ ID NO: 2354407 - RNA, 15 nt, Bordetella pertussis
cagggcgcgacgcca

SEQ ID NO: 2354408 - RNA, 16 nt, Bordetella pertussis
cagggcgcgcagcagg

SEQ ID NO: 2354409 - RNA, 17 nt, Bordetella pertussis
cagggcgcgcagcaggc

SEQ ID NO: 2354410 - RNA, 19 nt, Bordetella pertussis
cagggcgcgcagcaggccc

SEQ ID NO: 2354411 - RNA, 12 nt, Bordetella pertussis
cagggcgcgccg

SEQ ID NO: 2354412 - RNA, 14 nt, Bordetella pertussis
cagggcgcgccgga

SEQ ID NO: 2354413 - RNA, 16 nt, Bordetella pertussis
cagggcgcgccggaac

SEQ ID NO: 2354414 - RNA, 22 nt, Bordetella pertussis
cagggcggaaaacagcaccagc

SEQ ID NO: 2354415 - RNA, 20 nt, Bordetella pertussis
cagggcggccccggccgccc

SEQ ID NO: 2354416 - RNA, 21 nt, Bordetella pertussis
cagggcggccccggccgcccc

SEQ ID NO: 2354417 - RNA, 20 nt, Bordetella pertussis
cagggcggccucgacggccg

SEQ ID NO: 2354418 - RNA, 17 nt, Bordetella pertussis
cagggcggcgacuucgc

SEQ ID NO: 2354419 - RNA, 21 nt, Bordetella pertussis
cagggcgggcggugcggccuc

SEQ ID NO: 2354420 - RNA, 23 nt, Bordetella pertussis
cagggcgggggacgcccgcccgc

SEQ ID NO: 2354421 - RNA, 13 nt, Bordetella pertussis
cagggcggugcgc

SEQ ID NO: 2354422 - RNA, 22 nt, Bordetella pertussis
cagggcggugggcagcgcgucg

SEQ ID NO: 2354423 - RNA, 23 nt, Bordetella pertussis
cagggcggugggcagcgcgucga

SEQ ID NO: 2354424 - RNA, 16 nt, Bordetella pertussis
cagggcgucgcggcgu

SEQ ID NO: 2354425 - RNA, 17 nt, Bordetella pertussis
cagggcgucggccgcgc

SEQ ID NO: 2354426 - RNA, 18 nt, Bordetella pertussis
cagggcgucggccgcgcc

SEQ ID NO: 2354427 - RNA, 22 nt, Bordetella pertussis
cagggcgucggccgcgcccagg

SEQ ID NO: 2354428 - RNA, 14 nt, Bordetella pertussis
cagggcgucggcga

SEQ ID NO: 2354429 - RNA, 13 nt, Bordetella pertussis
cagggcgucugcu

SEQ ID NO: 2354430 - RNA, 17 nt, Bordetella pertussis
cagggcgucugcucgcc

SEQ ID NO: 2354431 - RNA, 18 nt, Bordetella pertussis
cagggcgucugcucgccg

SEQ ID NO: 2354432 - RNA, 20 nt, Bordetella pertussis
cagggcgugcgggacggcca

SEQ ID NO: 2354433 - RNA, 15 nt, Bordetella pertussis
cagggcucguagucg

SEQ ID NO: 2354434 - RNA, 13 nt, Bordetella pertussis
cagggcugcagau

SEQ ID NO: 2354435 - RNA, 22 nt, Bordetella pertussis
cagggcugcgaugcgggccugg

SEQ ID NO: 2354436 - RNA, 16 nt, Bordetella pertussis
cagggcuuccaguucg

SEQ ID NO: 2354437 - RNA, 18 nt, Bordetella pertussis
caggggaugacgggcgag

SEQ ID NO: 2354438 - RNA, 17 nt, Bordetella pertussis
caggggcaggcgcacgc

SEQ ID NO: 2354439 - RNA, 14 nt, Bordetella pertussis
caggggcaugccgg

SEQ ID NO: 2354440 - RNA, 18 nt, Bordetella pertussis
caggggccgcacgcgcgg

SEQ ID NO: 2354441 - RNA, 16 nt, Bordetella pertussis
caggggccggcgcgcc

SEQ ID NO: 2354442 - RNA, 17 nt, Bordetella pertussis
caggggccggcgcgccg

SEQ ID NO: 2354443 - RNA, 18 nt, Bordetella pertussis
caggggccggcgcgccgc

SEQ ID NO: 2354444 - RNA, 21 nt, Bordetella pertussis
caggggccggcgcgccgcgcc

SEQ ID NO: 2354445 - RNA, 16 nt, Bordetella pertussis
caggggcggcgcggcg

SEQ ID NO: 2354446 - RNA, 14 nt, Bordetella pertussis
caggggcucggcca

SEQ ID NO: 2354447 - RNA, 18 nt, Bordetella pertussis
cagggggacuggcacccg

SEQ ID NO: 2354448 - RNA, 19 nt, Bordetella pertussis
cagggggcgccccaacgcg

SEQ ID NO: 2354449 - RNA, 13 nt, Bordetella pertussis
cagggggucaggg

SEQ ID NO: 2354450 - RNA, 18 nt, Bordetella pertussis
caggggguggcggccguc

SEQ ID NO: 2354451 - RNA, 20 nt, Bordetella pertussis
caggggguggcggccgucgg

SEQ ID NO: 2354452 - RNA, 23 nt, Bordetella pertussis
caggguacggcgaugccggcgcu

SEQ ID NO: 2354453 - RNA, 16 nt, Bordetella pertussis
caggguauugaccccc

SEQ ID NO: 2354454 - RNA, 13 nt, Bordetella pertussis
cagggucaaggcg

SEQ ID NO: 2354455 - RNA, 18 nt, Bordetella pertussis
cagggucaaggcgcggcc

SEQ ID NO: 2354456 - RNA, 20 nt, Bordetella pertussis
cagggucaaggcgcggccgu

SEQ ID NO: 2354457 - RNA, 16 nt, Bordetella pertussis
cagggucagcccgcca

SEQ ID NO: 2354458 - RNA, 16 nt, Bordetella pertussis
cagggucagcggccgg

SEQ ID NO: 2354459 - RNA, 23 nt, Bordetella pertussis
cagggucaugaugucggccaggg

SEQ ID NO: 2354460 - RNA, 15 nt, Bordetella pertussis
caggguccagguggc

SEQ ID NO: 2354461 - RNA, 19 nt, Bordetella pertussis
cagggucgagaccagcagc

SEQ ID NO: 2354462 - RNA, 17 nt, Bordetella pertussis
cagggucucggccacgg

SEQ ID NO: 2354463 - RNA, 23 nt, Bordetella pertussis
cagggucugcuggucgcgggcca

SEQ ID NO: 2354464 - RNA, 17 nt, Bordetella pertussis
cagggugaccuggcgcg

SEQ ID NO: 2354465 - RNA, 19 nt, Bordetella pertussis
cagggugaccuggcgcgcg

SEQ ID NO: 2354466 - RNA, 15 nt, Bordetella pertussis
cagggugacgggcug

SEQ ID NO: 2354467 - RNA, 21 nt, Bordetella pertussis
cagggugagggugaccauguc

SEQ ID NO: 2354468 - RNA, 15 nt, Bordetella pertussis
cagggugcaccaggu

SEQ ID NO: 2354469 - RNA, 17 nt, Bordetella pertussis
cagggugccccgccgga

SEQ ID NO: 2354470 - RNA, 14 nt, Bordetella pertussis
cagggugccgcgcc

SEQ ID NO: 2354471 - RNA, 16 nt, Bordetella pertussis
cagggugccgcgccgg

SEQ ID NO: 2354472 - RNA, 18 nt, Bordetella pertussis
cagggugccgcgccgguc

SEQ ID NO: 2354473 - RNA, 14 nt, Bordetella pertussis
cagggugccugucc

SEQ ID NO: 2354474 - RNA, 21 nt, Bordetella pertussis
cagggugccuguccccgcagg

SEQ ID NO: 2354475 - RNA, 20 nt, Bordetella pertussis
cagggugcuguucaggcgcu

SEQ ID NO: 2354476 - RNA, 23 nt, Bordetella pertussis
caggguggagaauucggcgcgua

SEQ ID NO: 2354477 - RNA, 13 nt, Bordetella pertussis
caggguggccagu

SEQ ID NO: 2354478 - RNA, 14 nt, Bordetella pertussis
caggguggccgcga

SEQ ID NO: 2354479 - RNA, 16 nt, Bordetella pertussis
caggguggccgcgacu

SEQ ID NO: 2354480 - RNA, 14 nt, Bordetella pertussis
caggguggcgccca

SEQ ID NO: 2354481 - RNA, 17 nt, Bordetella pertussis
caggguggcgcccaggu

SEQ ID NO: 2354482 - RNA, 18 nt, Bordetella pertussis
caggguggcgccggccac

SEQ ID NO: 2354483 - RNA, 21 nt, Bordetella pertussis
caggguggcgccggccaccgc

SEQ ID NO: 2354484 - RNA, 14 nt, Bordetella pertussis
cagggugggcacgc

SEQ ID NO: 2354485 - RNA, 15 nt, Bordetella pertussis
cagggugggcacgcg

SEQ ID NO: 2354486 - RNA, 17 nt, Bordetella pertussis
cagggugggcacgcgcu

SEQ ID NO: 2354487 - RNA, 18 nt, Bordetella pertussis
cagggugggcacgcgcuu

SEQ ID NO: 2354488 - RNA, 16 nt, Bordetella pertussis
cagggugguggccucg

SEQ ID NO: 2354489 - RNA, 20 nt, Bordetella pertussis
cagggugucgccggggcgca

SEQ ID NO: 2354490 - RNA, 17 nt, Bordetella pertussis
cagggugucggccaggg

SEQ ID NO: 2354491 - RNA, 20 nt, Bordetella pertussis
cagggugucggccagggcgg

SEQ ID NO: 2354492 - RNA, 22 nt, Bordetella pertussis
cagggugucggccagggcggcg

SEQ ID NO: 2354493 - RNA, 19 nt, Bordetella pertussis
caggguucggugccugucc

SEQ ID NO: 2354494 - RNA, 15 nt, Bordetella pertussis
caggguuggcgcgcc

SEQ ID NO: 2354495 - RNA, 18 nt, Bordetella pertussis
caggguuggcgcgccgug

SEQ ID NO: 2354496 - RNA, 21 nt, Bordetella pertussis
caggguuguccgaaccacccg

SEQ ID NO: 2354497 - RNA, 22 nt, Bordetella pertussis
caggguuguccgaaccacccgg

SEQ ID NO: 2354498 - RNA, 24 nt, Bordetella pertussis
caggguuguccgaaccacccggcc

SEQ ID NO: 2354499 - RNA, 18 nt, Bordetella pertussis
caggguuuccucgccgac

SEQ ID NO: 2354500 - RNA, 18 nt, Bordetella pertussis
cagguggacagcgccagc

SEQ ID NO: 2354501 - RNA, 15 nt, Bordetella pertussis
cagguggccagcccg

SEQ ID NO: 2354502 - RNA, 23 nt, Bordetella pertussis
cagguggcccgcaccgggcggcc

SEQ ID NO: 2354503 - RNA, 18 nt, Bordetella pertussis
cagguggcgaugccgggc

SEQ ID NO: 2354504 - RNA, 17 nt, Bordetella pertussis
cagguggcggacaggcc

SEQ ID NO: 2354505 - RNA, 18 nt, Bordetella pertussis
cagguggcggacaggccc

SEQ ID NO: 2354506 - RNA, 20 nt, Bordetella pertussis
cagguggcggacaggcccuc

SEQ ID NO: 2354507 - RNA, 16 nt, Bordetella pertussis
caggugggcgcgcuca

SEQ ID NO: 2354508 - RNA, 20 nt, Bordetella pertussis
cagguggggcagcaggccgg

SEQ ID NO: 2354509 - RNA, 22 nt, Bordetella pertussis
caggugucgccccccaugccgg

SEQ ID NO: 2354510 - RNA, 16 nt, Bordetella pertussis
caggugugccagccgc

SEQ ID NO: 2354511 - RNA, 22 nt, Bordetella pertussis
caggugugccagccgcuggcga

SEQ ID NO: 2354512 - RNA, 18 nt, Bordetella pertussis
cagguguucgcgcaccag

SEQ ID NO: 2354513 - RNA, 15 nt, Bordetella pertussis
cagguuagcggcagu

SEQ ID NO: 2354514 - RNA, 18 nt, Bordetella pertussis
cagguucaugaccaucgc

SEQ ID NO: 2354515 - RNA, 16 nt, Bordetella pertussis
cagguucugcgcgucc

SEQ ID NO: 2354516 - RNA, 19 nt, Bordetella pertussis
cagguucuggucgaacugg

SEQ ID NO: 2354517 - RNA, 16 nt, Bordetella pertussis
cagguugaaggccgcg

SEQ ID NO: 2354518 - RNA, 17 nt, Bordetella pertussis
cagguugaaggccgcga

SEQ ID NO: 2354519 - RNA, 16 nt, Bordetella pertussis
cagguugaucuucuuc

SEQ ID NO: 2354520 - RNA, 17 nt, Bordetella pertussis
cagguugaucuucuucg

SEQ ID NO: 2354521 - RNA, 18 nt, Bordetella pertussis
cagguugcauccggcccg

SEQ ID NO: 2354522 - RNA, 14 nt, Bordetella pertussis
cagguugcgccggc

SEQ ID NO: 2354523 - RNA, 21 nt, Bordetella pertussis
cagguugcggccgccacccag

SEQ ID NO: 2354524 - RNA, 18 nt, Bordetella pertussis
cagguugcgguaguucag

SEQ ID NO: 2354525 - RNA, 14 nt, Bordetella pertussis
cagguuggcgaugg

SEQ ID NO: 2354526 - RNA, 18 nt, Bordetella pertussis
cagguugggugcgccgcc

SEQ ID NO: 2354527 - RNA, 13 nt, Bordetella pertussis
cagguuguccagc

SEQ ID NO: 2354528 - RNA, 18 nt, Bordetella pertussis
cagguuguccagcgcgcc

SEQ ID NO: 2354529 - RNA, 23 nt, Bordetella pertussis
cagguuguccagcgcgcccagcg

SEQ ID NO: 2354530 - RNA, 21 nt, Bordetella pertussis
cagguugucgcgcgagaccag

SEQ ID NO: 2354531 - RNA, 15 nt, Bordetella pertussis
cagguugucggccau

SEQ ID NO: 2354532 - RNA, 18 nt, Bordetella pertussis
cagguugucggccaugcg

SEQ ID NO: 2354533 - RNA, 21 nt, Bordetella pertussis
cagguuuccuuggggucccac

SEQ ID NO: 2354534 - RNA, 17 nt, Bordetella pertussis
cagguuuuccacagcca

SEQ ID NO: 2354535 - RNA, 18 nt, Bordetella pertussis
cagguuuuccacagccag

SEQ ID NO: 2354536 - RNA, 15 nt, Bordetella pertussis
caguacaccggcgug

SEQ ID NO: 2354537 - RNA, 17 nt, Bordetella pertussis
caguacccggugcagcg

SEQ ID NO: 2354538 - RNA, 18 nt, Bordetella pertussis
caguacccggugcagcgu

SEQ ID NO: 2354539 - RNA, 23 nt, Bordetella pertussis
caguacccggugcagcguggcgc

SEQ ID NO: 2354540 - RNA, 16 nt, Bordetella pertussis
caguaccugacccugc

SEQ ID NO: 2354541 - RNA, 20 nt, Bordetella pertussis
caguacgagaacgcgucgcu

SEQ ID NO: 2354542 - RNA, 17 nt, Bordetella pertussis
caguacgaugccgucga

SEQ ID NO: 2354543 - RNA, 19 nt, Bordetella pertussis
caguacgucggacagggcc

SEQ ID NO: 2354544 - RNA, 20 nt, Bordetella pertussis
caguacgucggacagggccc

SEQ ID NO: 2354545 - RNA, 20 nt, Bordetella pertussis
caguacuuguugcgugccgc

SEQ ID NO: 2354546 - RNA, 15 nt, Bordetella pertussis
caguagcacacgccg

SEQ ID NO: 2354547 - RNA, 13 nt, Bordetella pertussis
caguagcgccggc

SEQ ID NO: 2354548 - RNA, 14 nt, Bordetella pertussis
caguaggcgcccca

SEQ ID NO: 2354549 - RNA, 22 nt, Bordetella pertussis
caguaucucggcgcccgcggcc

SEQ ID NO: 2354550 - RNA, 23 nt, Bordetella pertussis
caguaucucggcgcccgcggccu

SEQ ID NO: 2354551 - RNA, 14 nt, Bordetella pertussis
caguaugggcuguc

SEQ ID NO: 2354552 - RNA, 20 nt, Bordetella pertussis
caguccaaggaaagcccggc

SEQ ID NO: 2354553 - RNA, 21 nt, Bordetella pertussis
caguccaaggaaagcccggcc

SEQ ID NO: 2354554 - RNA, 22 nt, Bordetella pertussis
caguccaaggaaagcccggccc

SEQ ID NO: 2354555 - RNA, 14 nt, Bordetella pertussis
caguccagcgcgcc

SEQ ID NO: 2354556 - RNA, 17 nt, Bordetella pertussis
caguccagcgucggcgu

SEQ ID NO: 2354557 - RNA, 17 nt, Bordetella pertussis
caguccaggguguccug

SEQ ID NO: 2354558 - RNA, 19 nt, Bordetella pertussis
cagucccaguccggcagca

SEQ ID NO: 2354559 - RNA, 18 nt, Bordetella pertussis
caguccccaugcggggac

SEQ ID NO: 2354560 - RNA, 22 nt, Bordetella pertussis
caguccccaugcggggacuggc

SEQ ID NO: 2354561 - RNA, 16 nt, Bordetella pertussis
caguccccaugugggg

SEQ ID NO: 2354562 - RNA, 22 nt, Bordetella pertussis
caguccccauguggggacaggc

SEQ ID NO: 2354563 - RNA, 15 nt, Bordetella pertussis
cagucccccgcgggg

SEQ ID NO: 2354564 - RNA, 22 nt, Bordetella pertussis
caguccccguucggggacaggc

SEQ ID NO: 2354565 - RNA, 16 nt, Bordetella pertussis
caguccccugcgggga

SEQ ID NO: 2354566 - RNA, 20 nt, Bordetella pertussis
caguccccugcggggacagg

SEQ ID NO: 2354567 - RNA, 21 nt, Bordetella pertussis
caguccccugcggggacaggc

SEQ ID NO: 2354568 - RNA, 22 nt, Bordetella pertussis
caguccccugcggggacaggca

SEQ ID NO: 2354569 - RNA, 19 nt, Bordetella pertussis
cagucccgcaccgaccagc

SEQ ID NO: 2354570 - RNA, 20 nt, Bordetella pertussis
cagucccgcaccgaccagcg

SEQ ID NO: 2354571 - RNA, 23 nt, Bordetella pertussis
cagucccgcaccgaccagcgcgc

SEQ ID NO: 2354572 - RNA, 16 nt, Bordetella pertussis
cagucccgcaccgggc

SEQ ID NO: 2354573 - RNA, 14 nt, Bordetella pertussis
cagucccguggcgc

SEQ ID NO: 2354574 - RNA, 23 nt, Bordetella pertussis
caguccgcacaguuugucggcga

SEQ ID NO: 2354575 - RNA, 14 nt, Bordetella pertussis
caguccgcagcgca

SEQ ID NO: 2354576 - RNA, 13 nt, Bordetella pertussis
caguccgcccagc

SEQ ID NO: 2354577 - RNA, 21 nt, Bordetella pertussis
caguccgcccagccaggcgcc

SEQ ID NO: 2354578 - RNA, 19 nt, Bordetella pertussis
caguccgcgcucgcccagc

SEQ ID NO: 2354579 - RNA, 13 nt, Bordetella pertussis
caguccguggcgc

SEQ ID NO: 2354580 - RNA, 16 nt, Bordetella pertussis
caguccguggcgcggc

SEQ ID NO: 2354581 - RNA, 18 nt, Bordetella pertussis
caguccguggcgcggcca

SEQ ID NO: 2354582 - RNA, 20 nt, Bordetella pertussis
caguccguggcgcggccaau

SEQ ID NO: 2354583 - RNA, 17 nt, Bordetella pertussis
caguccucaugcgggac

SEQ ID NO: 2354584 - RNA, 20 nt, Bordetella pertussis
caguccucaugcgggacagg

SEQ ID NO: 2354585 - RNA, 16 nt, Bordetella pertussis
caguccuucagcuuga

SEQ ID NO: 2354586 - RNA, 14 nt, Bordetella pertussis
cagucgagcaccgc

SEQ ID NO: 2354587 - RNA, 18 nt, Bordetella pertussis
cagucgcaguucggccuc

SEQ ID NO: 2354588 - RNA, 20 nt, Bordetella pertussis
cagucgcugcucgacagcag

SEQ ID NO: 2354589 - RNA, 21 nt, Bordetella pertussis
cagucgggacggcgcgggcac

SEQ ID NO: 2354590 - RNA, 16 nt, Bordetella pertussis
cagucgggcagcgccc

SEQ ID NO: 2354591 - RNA, 17 nt, Bordetella pertussis
cagucggggccgcagcu

SEQ ID NO: 2354592 - RNA, 18 nt, Bordetella pertussis
cagucggggccgcagcug

SEQ ID NO: 2354593 - RNA, 13 nt, Bordetella pertussis
cagucggucgccg

SEQ ID NO: 2354594 - RNA, 19 nt, Bordetella pertussis
cagucguccagcacgcggc

SEQ ID NO: 2354595 - RNA, 13 nt, Bordetella pertussis
cagucguccuccg

SEQ ID NO: 2354596 - RNA, 12 nt, Bordetella pertussis
cagucgucgccg

SEQ ID NO: 2354597 - RNA, 21 nt, Bordetella pertussis
cagucuccaggcucaggcggc

SEQ ID NO: 2354598 - RNA, 12 nt, Bordetella pertussis
cagucuggaugg

SEQ ID NO: 2354599 - RNA, 22 nt, Bordetella pertussis
cagucuugucauccgucucggc

SEQ ID NO: 2354600 - RNA, 21 nt, Bordetella pertussis
cagugaaacgcgacgcgccgg

SEQ ID NO: 2354601 - RNA, 22 nt, Bordetella pertussis
cagugaaacgcgacgcgccgga

SEQ ID NO: 2354602 - RNA, 20 nt, Bordetella pertussis
cagugcaggggguggcggcc

SEQ ID NO: 2354603 - RNA, 13 nt, Bordetella pertussis
cagugcccugacc

SEQ ID NO: 2354604 - RNA, 18 nt, Bordetella pertussis
cagugcccugacccgcug

SEQ ID NO: 2354605 - RNA, 20 nt, Bordetella pertussis
cagugcccugacccgcuggc

SEQ ID NO: 2354606 - RNA, 22 nt, Bordetella pertussis
cagugcccugacccgcuggcug

SEQ ID NO: 2354607 - RNA, 22 nt, Bordetella pertussis
cagugccugcgaacgcccggcc

SEQ ID NO: 2354608 - RNA, 15 nt, Bordetella pertussis
cagugcgacggaugg

SEQ ID NO: 2354609 - RNA, 15 nt, Bordetella pertussis
cagugcgccggcgcg

SEQ ID NO: 2354610 - RNA, 17 nt, Bordetella pertussis
cagugcgccggcgcggc

SEQ ID NO: 2354611 - RNA, 20 nt, Bordetella pertussis
cagugcgccggcggcgguca

SEQ ID NO: 2354612 - RNA, 17 nt, Bordetella pertussis
caucaccaagggcgccg

SEQ ID NO: 2354613 - RNA, 15 nt, Bordetella pertussis
caucaccagcucgcg

SEQ ID NO: 2354614 - RNA, 16 nt, Bordetella pertussis
caucaccagcucgcgg

SEQ ID NO: 2354615 - RNA, 17 nt, Bordetella pertussis
caucaccaggguggcgg

SEQ ID NO: 2354616 - RNA, 22 nt, Bordetella pertussis
caucaccaggguggcgggcgcc

SEQ ID NO: 2354617 - RNA, 23 nt, Bordetella pertussis
caucaccaggguggcgggcgccu

SEQ ID NO: 2354618 - RNA, 23 nt, Bordetella pertussis
caucaccauggccgacagcgucg

SEQ ID NO: 2354619 - RNA, 12 nt, Bordetella pertussis
caucaccgccuc

SEQ ID NO: 2354620 - RNA, 15 nt, Bordetella pertussis
caucacgagcagguu

SEQ ID NO: 2354621 - RNA, 17 nt, Bordetella pertussis
caucacgccgguguucu

SEQ ID NO: 2354622 - RNA, 19 nt, Bordetella pertussis
caucacgccgguguucucg

SEQ ID NO: 2354623 - RNA, 22 nt, Bordetella pertussis
caucacgcuggccgcgcccgcc

SEQ ID NO: 2354624 - RNA, 16 nt, Bordetella pertussis
caucacgggcgccagc

SEQ ID NO: 2354625 - RNA, 23 nt, Bordetella pertussis
caucacgggcgccagcagcgggc

SEQ ID NO: 2354626 - RNA, 18 nt, Bordetella pertussis
caucacgguaggcgcguc

SEQ ID NO: 2354627 - RNA, 18 nt, Bordetella pertussis
caucacggugccgccgau

SEQ ID NO: 2354628 - RNA, 21 nt, Bordetella pertussis
caucagcacgaucuggcgcgc

SEQ ID NO: 2354629 - RNA, 23 nt, Bordetella pertussis
caucagcacgaucuggcgcgcga

SEQ ID NO: 2354630 - RNA, 17 nt, Bordetella pertussis
caucagcagacccuggc

SEQ ID NO: 2354631 - RNA, 19 nt, Bordetella pertussis
caucagcagacccuggcgc

SEQ ID NO: 2354632 - RNA, 22 nt, Bordetella pertussis
caucagcagacccuggcgcgcg

SEQ ID NO: 2354633 - RNA, 14 nt, Bordetella pertussis
caucagcagcaccu

SEQ ID NO: 2354634 - RNA, 13 nt, Bordetella pertussis
caucagcauggcg

SEQ ID NO: 2354635 - RNA, 14 nt, Bordetella pertussis
caucagcauggcgu

SEQ ID NO: 2354636 - RNA, 16 nt, Bordetella pertussis
caucagcauggcgugc

SEQ ID NO: 2354637 - RNA, 21 nt, Bordetella pertussis
caucagcccuacccugaucaa

SEQ ID NO: 2354638 - RNA, 13 nt, Bordetella pertussis
caucagcgcgaac

SEQ ID NO: 2354639 - RNA, 22 nt, Bordetella pertussis
caucagcgcgcccgcuuccuug

SEQ ID NO: 2354640 - RNA, 14 nt, Bordetella pertussis
caucagcgcgcgca

SEQ ID NO: 2354641 - RNA, 16 nt, Bordetella pertussis
caucagcgcgcgcagc

SEQ ID NO: 2354642 - RNA, 15 nt, Bordetella pertussis
caucagcgugccgcc

SEQ ID NO: 2354643 - RNA, 16 nt, Bordetella pertussis
caucagcgugccgccg

SEQ ID NO: 2354644 - RNA, 21 nt, Bordetella pertussis
caucagcucgaccacggcggc

SEQ ID NO: 2354645 - RNA, 13 nt, Bordetella pertussis
caucaggcccgac

SEQ ID NO: 2354646 - RNA, 22 nt, Bordetella pertussis
caucagggcgaucuugccggcc

SEQ ID NO: 2354647 - RNA, 18 nt, Bordetella pertussis
caucaggggcucggccag

SEQ ID NO: 2354648 - RNA, 19 nt, Bordetella pertussis
caucaggggcucggccagg

SEQ ID NO: 2354649 - RNA, 22 nt, Bordetella pertussis
caucaggggcucggccaggugc

SEQ ID NO: 2354650 - RNA, 21 nt, Bordetella pertussis
caucagguccacuucaccgcu

SEQ ID NO: 2354651 - RNA, 11 nt, Bordetella pertussis
caucaggucga

SEQ ID NO: 2354652 - RNA, 19 nt, Bordetella pertussis
caucaggucgaccugcuug

SEQ ID NO: 2354653 - RNA, 22 nt, Bordetella pertussis
caucaggucgaccugcuugccc

SEQ ID NO: 2354654 - RNA, 22 nt, Bordetella pertussis
caucaggugaaacagcagcggg

SEQ ID NO: 2354655 - RNA, 23 nt, Bordetella pertussis
caucaggugcaggguuggcgcgc

SEQ ID NO: 2354656 - RNA, 19 nt, Bordetella pertussis
caucaggugggccgagccc

SEQ ID NO: 2354657 - RNA, 23 nt, Bordetella pertussis
caucagguucucgauguggcgcu

SEQ ID NO: 2354658 - RNA, 20 nt, Bordetella pertussis
caucaucaacuucaucguca

SEQ ID NO: 2354659 - RNA, 15 nt, Bordetella pertussis
caucauccccagcgc

SEQ ID NO: 2354660 - RNA, 20 nt, Bordetella pertussis
caucauccccagcgccgcca

SEQ ID NO: 2354661 - RNA, 22 nt, Bordetella pertussis
caucauccccagcgccgccaug

SEQ ID NO: 2354662 - RNA, 17 nt, Bordetella pertussis
caucaucgcgcuggcgc

SEQ ID NO: 2354663 - RNA, 21 nt, Bordetella pertussis
caucaucgcgcuggcgcgcga

SEQ ID NO: 2354664 - RNA, 13 nt, Bordetella pertussis
caucaucugggcg

SEQ ID NO: 2354665 - RNA, 14 nt, Bordetella pertussis
caucauggccaggg

SEQ ID NO: 2354666 - RNA, 14 nt, Bordetella pertussis
caucauggcgcgcg

SEQ ID NO: 2354667 - RNA, 15 nt, Bordetella pertussis
caucauggcgucggc

SEQ ID NO: 2354668 - RNA, 19 nt, Bordetella pertussis
caucauguaaggcgcaugc

SEQ ID NO: 2354669 - RNA, 13 nt, Bordetella pertussis
cauccagccaggc

SEQ ID NO: 2354670 - RNA, 16 nt, Bordetella pertussis
cauccagccaggccgc

SEQ ID NO: 2354671 - RNA, 21 nt, Bordetella pertussis
cauccagccgaucagccggcc

SEQ ID NO: 2354672 - RNA, 20 nt, Bordetella pertussis
cauccagcgccagcaccggc

SEQ ID NO: 2354673 - RNA, 14 nt, Bordetella pertussis
cauccagcgcgcga

SEQ ID NO: 2354674 - RNA, 22 nt, Bordetella pertussis
cauccagcgcgcgaucgccagc

SEQ ID NO: 2354675 - RNA, 23 nt, Bordetella pertussis
cauccagcgcgcgaucgccagca

SEQ ID NO: 2354676 - RNA, 15 nt, Bordetella pertussis
cauccagcggacggg

SEQ ID NO: 2354677 - RNA, 11 nt, Bordetella pertussis
cauccagcggc

SEQ ID NO: 2354678 - RNA, 24 nt, Bordetella pertussis
cauccagcucggcgaugcgcgagc

SEQ ID NO: 2354679 - RNA, 12 nt, Bordetella pertussis
cauccaggccgu

SEQ ID NO: 2354680 - RNA, 18 nt, Bordetella pertussis
cauccaggccgugagcgc

SEQ ID NO: 2354681 - RNA, 20 nt, Bordetella pertussis
cauccaggccgugagcgccg

SEQ ID NO: 2354682 - RNA, 21 nt, Bordetella pertussis
cauccaggcgcguugcgcuug

SEQ ID NO: 2354683 - RNA, 21 nt, Bordetella pertussis
cauccaggucuacccgcgcga

SEQ ID NO: 2354684 - RNA, 14 nt, Bordetella pertussis
cauccagguggcgg

SEQ ID NO: 2354685 - RNA, 22 nt, Bordetella pertussis
cauccagguggcggacaggccc

SEQ ID NO: 2354686 - RNA, 23 nt, Bordetella pertussis
cauccaugauuccaccuugccgc

SEQ ID NO: 2354687 - RNA, 15 nt, Bordetella pertussis
caucccagacagcca

SEQ ID NO: 2354688 - RNA, 22 nt, Bordetella pertussis
caucccagacagccacgcgcga

SEQ ID NO: 2354689 - RNA, 16 nt, Bordetella pertussis
caucccauccgcgcca

SEQ ID NO: 2354690 - RNA, 14 nt, Bordetella pertussis
cauccccagcgccg

SEQ ID NO: 2354691 - RNA, 16 nt, Bordetella pertussis
cauccccagcgccgcc

SEQ ID NO: 2354692 - RNA, 17 nt, Bordetella pertussis
cauccccagcgccgcca

SEQ ID NO: 2354693 - RNA, 19 nt, Bordetella pertussis
caucccgacaugccgcccc

SEQ ID NO: 2354694 - RNA, 23 nt, Bordetella pertussis
caucccgacaugccgccccaggc

SEQ ID NO: 2354695 - RNA, 18 nt, Bordetella pertussis
caucccgcccccgccgca

SEQ ID NO: 2354696 - RNA, 19 nt, Bordetella pertussis
caucccggcgcucagcgcg

SEQ ID NO: 2354697 - RNA, 20 nt, Bordetella pertussis
caucccggcgcucagcgcgc

SEQ ID NO: 2354698 - RNA, 19 nt, Bordetella pertussis
caucccugcuugcgcggac

SEQ ID NO: 2354699 - RNA, 13 nt, Bordetella pertussis
cauccgcauacaa

SEQ ID NO: 2354700 - RNA, 14 nt, Bordetella pertussis
cauccgcgccacac

SEQ ID NO: 2354701 - RNA, 19 nt, Bordetella pertussis
cauccgcgccacacgggcg

SEQ ID NO: 2354702 - RNA, 20 nt, Bordetella pertussis
cauccgcgccacacgggcgc

SEQ ID NO: 2354703 - RNA, 17 nt, Bordetella pertussis
cauccgcgcugcugccg

SEQ ID NO: 2354704 - RNA, 13 nt, Bordetella pertussis
cauccggcccagc

SEQ ID NO: 2354705 - RNA, 12 nt, Bordetella pertussis
cauccggcccgg

SEQ ID NO: 2354706 - RNA, 16 nt, Bordetella pertussis
cauccggcccggugca

SEQ ID NO: 2354707 - RNA, 18 nt, Bordetella pertussis
cauccggccgcacgcggc

SEQ ID NO: 2354708 - RNA, 21 nt, Bordetella pertussis
cauccggccgcacgcggccgc

SEQ ID NO: 2354709 - RNA, 15 nt, Bordetella pertussis
cauccggcgcaugau

SEQ ID NO: 2354710 - RNA, 23 nt, Bordetella pertussis
cauccggcgcaugauggccggcc

SEQ ID NO: 2354711 - RNA, 16 nt, Bordetella pertussis
cauccguccgccagga

SEQ ID NO: 2354712 - RNA, 18 nt, Bordetella pertussis
cauccucgggcgacucca

SEQ ID NO: 2354713 - RNA, 15 nt, Bordetella pertussis
cauccugaacgccgc

SEQ ID NO: 2354714 - RNA, 22 nt, Bordetella pertussis
cauccugaugucggccuucugc

SEQ ID NO: 2354715 - RNA, 12 nt, Bordetella pertussis
cauccuggaugu

SEQ ID NO: 2354716 - RNA, 22 nt, Bordetella pertussis
cauccuggccgauuucgcgcgc

SEQ ID NO: 2354717 - RNA, 15 nt, Bordetella pertussis
cauccuggccgccgc

SEQ ID NO: 2354718 - RNA, 20 nt, Bordetella pertussis
cauccuggccgccgcgggcg

SEQ ID NO: 2354719 - RNA, 22 nt, Bordetella pertussis
cauccuggccgccgcgggcgcc

SEQ ID NO: 2354720 - RNA, 13 nt, Bordetella pertussis
cauccugggcgcg

SEQ ID NO: 2354721 - RNA, 14 nt, Bordetella pertussis
cauccuggucgacg

SEQ ID NO: 2354722 - RNA, 17 nt, Bordetella pertussis
cauccuggucgacgcga

SEQ ID NO: 2354723 - RNA, 19 nt, Bordetella pertussis
caucgaacgugcugacggu

SEQ ID NO: 2354724 - RNA, 17 nt, Bordetella pertussis
caucuacgugcuggacc

SEQ ID NO: 2354725 - RNA, 22 nt, Bordetella pertussis
caucuacgugcuggacccgcug

SEQ ID NO: 2354726 - RNA, 13 nt, Bordetella pertussis
caucuccaccagc

SEQ ID NO: 2354727 - RNA, 19 nt, Bordetella pertussis
caucuccaggaugcgcgac

SEQ ID NO: 2354728 - RNA, 15 nt, Bordetella pertussis
caucucgaugcgguc

SEQ ID NO: 2354729 - RNA, 22 nt, Bordetella pertussis
caucucgcggcgguaguaccaa

SEQ ID NO: 2354730 - RNA, 18 nt, Bordetella pertussis
caucucggcaucggccac

SEQ ID NO: 2354731 - RNA, 19 nt, Bordetella pertussis
caucucggcaucggccacg

SEQ ID NO: 2354732 - RNA, 14 nt, Bordetella pertussis
caucucggccgcgg

SEQ ID NO: 2354733 - RNA, 12 nt, Bordetella pertussis
caucugccggua

SEQ ID NO: 2354734 - RNA, 12 nt, Bordetella pertussis
caucugcggcac

SEQ ID NO: 2354735 - RNA, 21 nt, Bordetella pertussis
caucugcugcgagacgcgcuc

SEQ ID NO: 2354736 - RNA, 16 nt, Bordetella pertussis
caucuggaccgcgcgc

SEQ ID NO: 2354737 - RNA, 22 nt, Bordetella pertussis
caucuggcccgucaugugcaga

SEQ ID NO: 2354738 - RNA, 15 nt, Bordetella pertussis
caucuggcgcauggc

SEQ ID NO: 2354739 - RNA, 20 nt, Bordetella pertussis
caucuggcgcauggccggcg

SEQ ID NO: 2354740 - RNA, 21 nt, Bordetella pertussis
caucuggcgcauggccggcgu

SEQ ID NO: 2354741 - RNA, 20 nt, Bordetella pertussis
caucugguugagcagcaccu

SEQ ID NO: 2354742 - RNA, 22 nt, Bordetella pertussis
caucugguugagcagcaccugg

SEQ ID NO: 2354743 - RNA, 16 nt, Bordetella pertussis
caucuguacggccggc

SEQ ID NO: 2354744 - RNA, 19 nt, Bordetella pertussis
caucuguucggcgccgggc

SEQ ID NO: 2354745 - RNA, 15 nt, Bordetella pertussis
caucuucgugcuggc

SEQ ID NO: 2354746 - RNA, 16 nt, Bordetella pertussis
caucuugcaggcgcca

SEQ ID NO: 2354747 - RNA, 16 nt, Bordetella pertussis
caucuugccggccugu

SEQ ID NO: 2354748 - RNA, 14 nt, Bordetella pertussis
caucuugccuuggc

SEQ ID NO: 2354749 - RNA, 16 nt, Bordetella pertussis
caucuugccuuggcga

SEQ ID NO: 2354750 - RNA, 15 nt, Bordetella pertussis
caucuugcgccgcug

SEQ ID NO: 2354751 - RNA, 20 nt, Bordetella pertussis
caucuuggugcgcgccaggu

SEQ ID NO: 2354752 - RNA, 16 nt, Bordetella pertussis
caucuuguccuucagc

SEQ ID NO: 2354753 - RNA, 17 nt, Bordetella pertussis
caugaaagcgaacaggg

SEQ ID NO: 2354754 - RNA, 18 nt, Bordetella pertussis
caugaacacuugacggcc

SEQ ID NO: 2354755 - RNA, 20 nt, Bordetella pertussis
caugaaccgcagcgccaccg

SEQ ID NO: 2354756 - RNA, 23 nt, Bordetella pertussis
caugaacgccgcgcccgcccccu

SEQ ID NO: 2354757 - RNA, 14 nt, Bordetella pertussis
caugaacgcuugac

SEQ ID NO: 2354758 - RNA, 18 nt, Bordetella pertussis
caugaacgcuugacggcc

SEQ ID NO: 2354759 - RNA, 19 nt, Bordetella pertussis
caugaacgcuugacggcca

SEQ ID NO: 2354760 - RNA, 20 nt, Bordetella pertussis
caugaacggcagcgcgcgcg

SEQ ID NO: 2354761 - RNA, 15 nt, Bordetella pertussis
caugaagcgcagcag

SEQ ID NO: 2354762 - RNA, 16 nt, Bordetella pertussis
caugaagcgcagcaga

SEQ ID NO: 2354763 - RNA, 18 nt, Bordetella pertussis
caugaagcgguggcggcc

SEQ ID NO: 2354764 - RNA, 15 nt, Bordetella pertussis
caugaagcugcccag

SEQ ID NO: 2354765 - RNA, 14 nt, Bordetella pertussis
caugaaggcggcca

SEQ ID NO: 2354766 - RNA, 22 nt, Bordetella pertussis
caugaaggcggccagcaugcug

SEQ ID NO: 2354767 - RNA, 16 nt, Bordetella pertussis
caugacaugcgggccu

SEQ ID NO: 2354768 - RNA, 21 nt, Bordetella pertussis
caugaccacgucgaucaggcc

SEQ ID NO: 2354769 - RNA, 23 nt, Bordetella pertussis
caugaccacgucgaucaggccca

SEQ ID NO: 2354770 - RNA, 14 nt, Bordetella pertussis
caugaccagcggcg

SEQ ID NO: 2354771 - RNA, 23 nt, Bordetella pertussis
caugaccagcggcgugaugccca

SEQ ID NO: 2354772 - RNA, 14 nt, Bordetella pertussis
caugaccaucgcgc

SEQ ID NO: 2354773 - RNA, 18 nt, Bordetella pertussis
caugaccgccgccagcag

SEQ ID NO: 2354774 - RNA, 19 nt, Bordetella pertussis
caugaccgccgccagcagc

SEQ ID NO: 2354775 - RNA, 22 nt, Bordetella pertussis
caugaccgccgccagcagcgcc

SEQ ID NO: 2354776 - RNA, 16 nt, Bordetella pertussis
caugaccgccgcgccg

SEQ ID NO: 2354777 - RNA, 17 nt, Bordetella pertussis
caugaccgccgcgccgg

SEQ ID NO: 2354778 - RNA, 20 nt, Bordetella pertussis
caugaccgccggcaccagcg

SEQ ID NO: 2354779 - RNA, 22 nt, Bordetella pertussis
caugaccgccggcaccagcgcc

SEQ ID NO: 2354780 - RNA, 17 nt, Bordetella pertussis
caugaccgcggacgcca

SEQ ID NO: 2354781 - RNA, 15 nt, Bordetella pertussis
caugaccgcguccgc

SEQ ID NO: 2354782 - RNA, 23 nt, Bordetella pertussis
caugaccggcguguccagcggcg

SEQ ID NO: 2354783 - RNA, 14 nt, Bordetella pertussis
caugaccucggccu

SEQ ID NO: 2354784 - RNA, 16 nt, Bordetella pertussis
caugaccucggccugc

SEQ ID NO: 2354785 - RNA, 17 nt, Bordetella pertussis
caugaccucggccugcg

SEQ ID NO: 2354786 - RNA, 16 nt, Bordetella pertussis
caugaccugcgacagc

SEQ ID NO: 2354787 - RNA, 12 nt, Bordetella pertussis
caugacgaccgc

SEQ ID NO: 2354788 - RNA, 20 nt, Bordetella pertussis
caugacgaccuugcggccgc

SEQ ID NO: 2354789 - RNA, 21 nt, Bordetella pertussis
caugacgaccuugcggccgcg

SEQ ID NO: 2354790 - RNA, 17 nt, Bordetella pertussis
caugacgaucacgggcu

SEQ ID NO: 2354791 - RNA, 15 nt, Bordetella pertussis
caugacgcuggucga

SEQ ID NO: 2354792 - RNA, 14 nt, Bordetella pertussis
caugacggccagga

SEQ ID NO: 2354793 - RNA, 20 nt, Bordetella pertussis
caugacggccaggauggcgu

SEQ ID NO: 2354794 - RNA, 16 nt, Bordetella pertussis
caugacgggcggcggc

SEQ ID NO: 2354795 - RNA, 16 nt, Bordetella pertussis
caugacggggccuuca

SEQ ID NO: 2354796 - RNA, 19 nt, Bordetella pertussis
caugacggggucggggcag

SEQ ID NO: 2354797 - RNA, 21 nt, Bordetella pertussis
caugacggggucggggcaggc

SEQ ID NO: 2354798 - RNA, 18 nt, Bordetella pertussis
acaucggaauuggcggcg

SEQ ID NO: 2354799 - RNA, 20 nt, Bordetella pertussis
acaucggcagcgaggcgcgg

SEQ ID NO: 2354800 - RNA, 22 nt, Bordetella pertussis
acaugacgauggucuugccgcc

SEQ ID NO: 2354801 - RNA, 21 nt, Bordetella pertussis
acaugacguucuccagcgccg

SEQ ID NO: 2354802 - RNA, 23 nt, Bordetella pertussis
acaugagccaugccgucuggcgg

SEQ ID NO: 2354803 - RNA, 17 nt, Bordetella pertussis
acaugaugcccagcgcc

SEQ ID NO: 2354804 - RNA, 13 nt, Bordetella pertussis
acaugcagccgcc

SEQ ID NO: 2354805 - RNA, 16 nt, Bordetella pertussis
acaugcccgccggcac

SEQ ID NO: 2354806 - RNA, 16 nt, Bordetella pertussis
acaugcccggccacca

SEQ ID NO: 2354807 - RNA, 21 nt, Bordetella pertussis
acaugcccggccaccagcgug

SEQ ID NO: 2354808 - RNA, 14 nt, Bordetella pertussis
acaugccgcgcgcg

SEQ ID NO: 2354809 - RNA, 17 nt, Bordetella pertussis
acaugcucgaugccggc

SEQ ID NO: 2354810 - RNA, 18 nt, Bordetella pertussis
acaugcucgaugccggcc

SEQ ID NO: 2354811 - RNA, 20 nt, Bordetella pertussis
acaugcugcgacagcagggc

SEQ ID NO: 2354812 - RNA, 18 nt, Bordetella pertussis
acauggccacggcccugg

SEQ ID NO: 2354813 - RNA, 18 nt, Bordetella pertussis
acauggcggugaaggcgc

SEQ ID NO: 2354814 - RNA, 17 nt, Bordetella pertussis
acaugggcaagccgauc

SEQ ID NO: 2354815 - RNA, 22 nt, Bordetella pertussis
acaugggcgcgguagcgccccu

SEQ ID NO: 2354816 - RNA, 22 nt, Bordetella pertussis
acauggggacuggcacccgcaa

SEQ ID NO: 2354817 - RNA, 16 nt, Bordetella pertussis
acauggugaccggggc

SEQ ID NO: 2354818 - RNA, 23 nt, Bordetella pertussis
acauguuguuggucgccacgcca

SEQ ID NO: 2354819 - RNA, 21 nt, Bordetella pertussis
accaacggggccgccaacgcc

SEQ ID NO: 2354820 - RNA, 19 nt, Bordetella pertussis
accaacucgaggcggcgca

SEQ ID NO: 2354821 - RNA, 20 nt, Bordetella pertussis
accaacucgaggcggcgcag

SEQ ID NO: 2354822 - RNA, 20 nt, Bordetella pertussis
accaacugguagugcggcgc

SEQ ID NO: 2354823 - RNA, 21 nt, Bordetella pertussis
accaacugguagugcggcgcc

SEQ ID NO: 2354824 - RNA, 12 nt, Bordetella pertussis
accaagcgccac

SEQ ID NO: 2354825 - RNA, 12 nt, Bordetella pertussis
accaagcugcgc

SEQ ID NO: 2354826 - RNA, 12 nt, Bordetella pertussis
accaagggcgcc

SEQ ID NO: 2354827 - RNA, 21 nt, Bordetella pertussis
accaauacgccgccauggugc

SEQ ID NO: 2354828 - RNA, 17 nt, Bordetella pertussis
accaaucuugccaggcc

SEQ ID NO: 2354829 - RNA, 21 nt, Bordetella pertussis
accaaucuugccaggcccggc

SEQ ID NO: 2354830 - RNA, 22 nt, Bordetella pertussis
accaaucuugccaggcccggcg

SEQ ID NO: 2354831 - RNA, 16 nt, Bordetella pertussis
accacaggguggcgcc

SEQ ID NO: 2354832 - RNA, 18 nt, Bordetella pertussis
accacaggguggcgccca

SEQ ID NO: 2354833 - RNA, 15 nt, Bordetella pertussis
accacaguucggcca

SEQ ID NO: 2354834 - RNA, 15 nt, Bordetella pertussis
accacaucgccggcg

SEQ ID NO: 2354835 - RNA, 22 nt, Bordetella pertussis
accacaucgccggcggcguggc

SEQ ID NO: 2354836 - RNA, 15 nt, Bordetella pertussis
caugcaccagcacau

SEQ ID NO: 2354837 - RNA, 14 nt, Bordetella pertussis
caugcacgggccau

SEQ ID NO: 2354838 - RNA, 16 nt, Bordetella pertussis
caugcacgggccaugg

SEQ ID NO: 2354839 - RNA, 17 nt, Bordetella pertussis
caugcacgggccaugga

SEQ ID NO: 2354840 - RNA, 14 nt, Bordetella pertussis
caugcagccgccgc

SEQ ID NO: 2354841 - RNA, 15 nt, Bordetella pertussis
caugcagccgccgcg

SEQ ID NO: 2354842 - RNA, 22 nt, Bordetella pertussis
caugccagcuugcaggcgccuu

SEQ ID NO: 2354843 - RNA, 14 nt, Bordetella pertussis
caugccauagucgc

SEQ ID NO: 2354844 - RNA, 22 nt, Bordetella pertussis
caugccauggacgagggccggc

SEQ ID NO: 2354845 - RNA, 19 nt, Bordetella pertussis
caugccauggccgcgcggc

SEQ ID NO: 2354846 - RNA, 21 nt, Bordetella pertussis
caugccauggccgcgcggcgc

SEQ ID NO: 2354847 - RNA, 11 nt, Bordetella pertussis
caugcccaggc

SEQ ID NO: 2354848 - RNA, 15 nt, Bordetella pertussis
caugcccaugccgcc

SEQ ID NO: 2354849 - RNA, 17 nt, Bordetella pertussis
caugccccaacggcgca

SEQ ID NO: 2354850 - RNA, 16 nt, Bordetella pertussis
caugccccauccagcg

SEQ ID NO: 2354851 - RNA, 19 nt, Bordetella pertussis
caugccccauccagcggac

SEQ ID NO: 2354852 - RNA, 17 nt, Bordetella pertussis
caugcccgaccgcaugg

SEQ ID NO: 2354853 - RNA, 19 nt, Bordetella pertussis
caugcccgaccgcaugggc

SEQ ID NO: 2354854 - RNA, 14 nt, Bordetella pertussis
caugcccggccacc

SEQ ID NO: 2354855 - RNA, 15 nt, Bordetella pertussis
caugcccuccucggc

SEQ ID NO: 2354856 - RNA, 16 nt, Bordetella pertussis
caugcccuccucggcc

SEQ ID NO: 2354857 - RNA, 17 nt, Bordetella pertussis
caugcccuccucggcca

SEQ ID NO: 2354858 - RNA, 22 nt, Bordetella pertussis
caugcccuccucggccaggucg

SEQ ID NO: 2354859 - RNA, 19 nt, Bordetella pertussis
caugccgaccaccagcacc

SEQ ID NO: 2354860 - RNA, 23 nt, Bordetella pertussis
caugccgacggauucgcccaggg

SEQ ID NO: 2354861 - RNA, 17 nt, Bordetella pertussis
caugccgaugccgcagu

SEQ ID NO: 2354862 - RNA, 12 nt, Bordetella pertussis
caugccgccaug

SEQ ID NO: 2354863 - RNA, 20 nt, Bordetella pertussis
caugccgccaugcagcugga

SEQ ID NO: 2354864 - RNA, 18 nt, Bordetella pertussis
caugccgcccaugccgcc

SEQ ID NO: 2354865 - RNA, 20 nt, Bordetella pertussis
caugccgcccaugccgccgg

SEQ ID NO: 2354866 - RNA, 14 nt, Bordetella pertussis
caugccgccccagg

SEQ ID NO: 2354867 - RNA, 15 nt, Bordetella pertussis
caugccgcccgccau

SEQ ID NO: 2354868 - RNA, 23 nt, Bordetella pertussis
caugccgcccgccaugcacgggc

SEQ ID NO: 2354869 - RNA, 17 nt, Bordetella pertussis
caugccgcgcccgccuu

SEQ ID NO: 2354870 - RNA, 15 nt, Bordetella pertussis
caugccgcgcgccuu

SEQ ID NO: 2354871 - RNA, 15 nt, Bordetella pertussis
caugccgcgcgcgca

SEQ ID NO: 2354872 - RNA, 21 nt, Bordetella pertussis
caugccgcgggcggcgccggc

SEQ ID NO: 2354873 - RNA, 22 nt, Bordetella pertussis
caugccgcgggcggcgccggcc

SEQ ID NO: 2354874 - RNA, 17 nt, Bordetella pertussis
caugccgcugaccagca

SEQ ID NO: 2354875 - RNA, 17 nt, Bordetella pertussis
caugccgcugcaggucg

SEQ ID NO: 2354876 - RNA, 17 nt, Bordetella pertussis
caugccgcugcccagcg

SEQ ID NO: 2354877 - RNA, 15 nt, Bordetella pertussis
caugccggaacaggc

SEQ ID NO: 2354878 - RNA, 19 nt, Bordetella pertussis
caugccggaacaggcgccu

SEQ ID NO: 2354879 - RNA, 15 nt, Bordetella pertussis
caugccggacaagcc

SEQ ID NO: 2354880 - RNA, 18 nt, Bordetella pertussis
caugccggacaagccccu

SEQ ID NO: 2354881 - RNA, 14 nt, Bordetella pertussis
caugccggcaagca

SEQ ID NO: 2354882 - RNA, 19 nt, Bordetella pertussis
caugccggcaagcacgaac

SEQ ID NO: 2354883 - RNA, 15 nt, Bordetella pertussis
caugccggcauaggc

SEQ ID NO: 2354884 - RNA, 23 nt, Bordetella pertussis
caugccggcauaggcggcgcagg

SEQ ID NO: 2354885 - RNA, 24 nt, Bordetella pertussis
caugccggcauaggcggcgcaggc

SEQ ID NO: 2354886 - RNA, 14 nt, Bordetella pertussis
caugccggccaugc

SEQ ID NO: 2354887 - RNA, 20 nt, Bordetella pertussis
caugccggccaugcucagca

SEQ ID NO: 2354888 - RNA, 21 nt, Bordetella pertussis
caugccggccaugcucagcag

SEQ ID NO: 2354889 - RNA, 15 nt, Bordetella pertussis
caugccgggcaagca

SEQ ID NO: 2354890 - RNA, 20 nt, Bordetella pertussis
caugccggggaacaggucgu

SEQ ID NO: 2354891 - RNA, 21 nt, Bordetella pertussis
caugccguccacgcccagcgc

SEQ ID NO: 2354892 - RNA, 16 nt, Bordetella pertussis
caugccguccugcugc

SEQ ID NO: 2354893 - RNA, 17 nt, Bordetella pertussis
caugccguccugcugcg

SEQ ID NO: 2354894 - RNA, 19 nt, Bordetella pertussis
caugccguccugcugcggc

SEQ ID NO: 2354895 - RNA, 14 nt, Bordetella pertussis
caugccgucgagcg

SEQ ID NO: 2354896 - RNA, 17 nt, Bordetella pertussis
caugccgucgagcgcga

SEQ ID NO: 2354897 - RNA, 20 nt, Bordetella pertussis
caugccgucgcgcaccaccu

SEQ ID NO: 2354898 - RNA, 14 nt, Bordetella pertussis
caugccgucgcgcu

SEQ ID NO: 2354899 - RNA, 16 nt, Bordetella pertussis
caugccgucgcgcucg

SEQ ID NO: 2354900 - RNA, 16 nt, Bordetella pertussis
caugccgucuggcggc

SEQ ID NO: 2354901 - RNA, 18 nt, Bordetella pertussis
caugccgucuggcggcag

SEQ ID NO: 2354902 - RNA, 19 nt, Bordetella pertussis
caugccgucuggcggcagc

SEQ ID NO: 2354903 - RNA, 14 nt, Bordetella pertussis
caugccuugcgcga

SEQ ID NO: 2354904 - RNA, 16 nt, Bordetella pertussis
caugcgaaagcggcca

SEQ ID NO: 2354905 - RNA, 21 nt, Bordetella pertussis
caugcgaaaucuucugcgcca

SEQ ID NO: 2354906 - RNA, 23 nt, Bordetella pertussis
caugcgauagcgggccugcagca

SEQ ID NO: 2354907 - RNA, 15 nt, Bordetella pertussis
caugcgcaccaccgc

SEQ ID NO: 2354908 - RNA, 13 nt, Bordetella pertussis
caugcgcaccagg

SEQ ID NO: 2354909 - RNA, 20 nt, Bordetella pertussis
caugcgcaccuugucgcgca

SEQ ID NO: 2354910 - RNA, 14 nt, Bordetella pertussis
caugcgcacgcgcg

SEQ ID NO: 2354911 - RNA, 16 nt, Bordetella pertussis
caugcgcacggacagc

SEQ ID NO: 2354912 - RNA, 18 nt, Bordetella pertussis
caugcgcacggacagccc

SEQ ID NO: 2354913 - RNA, 22 nt, Bordetella pertussis
caugcgcacggacagcccgcgc

SEQ ID NO: 2354914 - RNA, 16 nt, Bordetella pertussis
caugcgcacucgaccg

SEQ ID NO: 2354915 - RNA, 18 nt, Bordetella pertussis
caugcgcagcgcgucggc

SEQ ID NO: 2354916 - RNA, 13 nt, Bordetella pertussis
caugcgcaugcug

SEQ ID NO: 2354917 - RNA, 16 nt, Bordetella pertussis
caugcgcaugcuggau

SEQ ID NO: 2354918 - RNA, 12 nt, Bordetella pertussis
caugcgcauggc

SEQ ID NO: 2354919 - RNA, 13 nt, Bordetella pertussis
caugcgcauggcc

SEQ ID NO: 2354920 - RNA, 16 nt, Bordetella pertussis
caugcgcauggccagc

SEQ ID NO: 2354921 - RNA, 17 nt, Bordetella pertussis
caugcgcauggccagca

SEQ ID NO: 2354922 - RNA, 19 nt, Bordetella pertussis
caugcgcauggccagcaca

SEQ ID NO: 2354923 - RNA, 21 nt, Bordetella pertussis
caugcgcauggccagcgcgca

SEQ ID NO: 2354924 - RNA, 23 nt, Bordetella pertussis
caugcgcauggccagcgcgcagg

SEQ ID NO: 2354925 - RNA, 14 nt, Bordetella pertussis
caugcgccagcagg

SEQ ID NO: 2354926 - RNA, 18 nt, Bordetella pertussis
caugcgccagcaggaugu

SEQ ID NO: 2354927 - RNA, 19 nt, Bordetella pertussis
caugcgccagcaggauguc

SEQ ID NO: 2354928 - RNA, 18 nt, Bordetella pertussis
caugcgccagccagcgca

SEQ ID NO: 2354929 - RNA, 19 nt, Bordetella pertussis
caugcgccagcgccugggc

SEQ ID NO: 2354930 - RNA, 16 nt, Bordetella pertussis
caugcgcccggccacc

SEQ ID NO: 2354931 - RNA, 21 nt, Bordetella pertussis
caugcgccguccucaggcccg

SEQ ID NO: 2354932 - RNA, 18 nt, Bordetella pertussis
caugcgccugucccaggc

SEQ ID NO: 2354933 - RNA, 21 nt, Bordetella pertussis
caugcgccugucccaggcgcu

SEQ ID NO: 2354934 - RNA, 22 nt, Bordetella pertussis
caugcgccugucccaggcgcuc

SEQ ID NO: 2354935 - RNA, 16 nt, Bordetella pertussis
caugcgcgaacgcgcg

SEQ ID NO: 2354936 - RNA, 18 nt, Bordetella pertussis
caugcgcgaacgcgcgcc

SEQ ID NO: 2354937 - RNA, 23 nt, Bordetella pertussis
caugcgcgagggcaucagcgcga

SEQ ID NO: 2354938 - RNA, 18 nt, Bordetella pertussis
caugcgcgaucucguggc

SEQ ID NO: 2354939 - RNA, 21 nt, Bordetella pertussis
caugcgcgaucucguggccca

SEQ ID NO: 2354940 - RNA, 13 nt, Bordetella pertussis
caugcgcgcggcc

SEQ ID NO: 2354941 - RNA, 22 nt, Bordetella pertussis
caugcgcgcggcucgccgcgca

SEQ ID NO: 2354942 - RNA, 16 nt, Bordetella pertussis
caugcgcugcuggcca

SEQ ID NO: 2354943 - RNA, 14 nt, Bordetella pertussis
caugcgcuggcgca

SEQ ID NO: 2354944 - RNA, 22 nt, Bordetella pertussis
caugcgcuggucgcgcagcacg

SEQ ID NO: 2354945 - RNA, 21 nt, Bordetella pertussis
caugcgcuugucgccgcugcg

SEQ ID NO: 2354946 - RNA, 18 nt, Bordetella pertussis
caugcggacgccagcccu

SEQ ID NO: 2354947 - RNA, 22 nt, Bordetella pertussis
caugcggaugaacgaccagcac

SEQ ID NO: 2354948 - RNA, 16 nt, Bordetella pertussis
caugcggccgucgccg

SEQ ID NO: 2354949 - RNA, 13 nt, Bordetella pertussis
cauggcggccgcc

SEQ ID NO: 2354950 - RNA, 15 nt, Bordetella pertussis
cauggcggccgccgc

SEQ ID NO: 2354951 - RNA, 18 nt, Bordetella pertussis
cauggcggccgccgccag

SEQ ID NO: 2354952 - RNA, 19 nt, Bordetella pertussis
cauggcggccgccgccagc

SEQ ID NO: 2354953 - RNA, 13 nt, Bordetella pertussis
cauggcggccggc

SEQ ID NO: 2354954 - RNA, 13 nt, Bordetella pertussis
cauggcggcgccc

SEQ ID NO: 2354955 - RNA, 15 nt, Bordetella pertussis
cauggcggcggccac

SEQ ID NO: 2354956 - RNA, 19 nt, Bordetella pertussis
cauggcggcggccacgacc

SEQ ID NO: 2354957 - RNA, 22 nt, Bordetella pertussis
cauggcgggcgagaucagccac

SEQ ID NO: 2354958 - RNA, 23 nt, Bordetella pertussis
cauggcgggcgagaucagccacc

SEQ ID NO: 2354959 - RNA, 19 nt, Bordetella pertussis
cauggcggucuccgguucg

SEQ ID NO: 2354960 - RNA, 18 nt, Bordetella pertussis
cauggcggugaaggcgcc

SEQ ID NO: 2354961 - RNA, 18 nt, Bordetella pertussis
cauggcgguggccagcgc

SEQ ID NO: 2354962 - RNA, 23 nt, Bordetella pertussis
cauggcgguggccagcgccugga

SEQ ID NO: 2354963 - RNA, 22 nt, Bordetella pertussis
cauggcguagagcagugugccu

SEQ ID NO: 2354964 - RNA, 17 nt, Bordetella pertussis
cauggcguaugacaggg

SEQ ID NO: 2354965 - RNA, 22 nt, Bordetella pertussis
cauggcgucaagccagcggcgc

SEQ ID NO: 2354966 - RNA, 14 nt, Bordetella pertussis
cauggcgucggcca

SEQ ID NO: 2354967 - RNA, 15 nt, Bordetella pertussis
cauggcgucggccac

SEQ ID NO: 2354968 - RNA, 16 nt, Bordetella pertussis
caugggacgacuucga

SEQ ID NO: 2354969 - RNA, 21 nt, Bordetella pertussis
caugggccaggcgcuccagca

SEQ ID NO: 2354970 - RNA, 18 nt, Bordetella pertussis
caugggcccgggcgcgcu

SEQ ID NO: 2354971 - RNA, 16 nt, Bordetella pertussis
caugggccugggcgcc

SEQ ID NO: 2354972 - RNA, 19 nt, Bordetella pertussis
caugggcgaagccacggcc

SEQ ID NO: 2354973 - RNA, 22 nt, Bordetella pertussis
caugggcgaagccacggcccgc

SEQ ID NO: 2354974 - RNA, 23 nt, Bordetella pertussis
caugggcgaagccacggcccgcc

SEQ ID NO: 2354975 - RNA, 18 nt, Bordetella pertussis
caugggcgcaggccgcca

SEQ ID NO: 2354976 - RNA, 19 nt, Bordetella pertussis
caugggcgcaggccgccac

SEQ ID NO: 2354977 - RNA, 19 nt, Bordetella pertussis
caugggcgccgagggccgc

SEQ ID NO: 2354978 - RNA, 21 nt, Bordetella pertussis
caugggcgccgagggccgcgc

SEQ ID NO: 2354979 - RNA, 16 nt, Bordetella pertussis
caugggcgcgcccggc

SEQ ID NO: 2354980 - RNA, 21 nt, Bordetella pertussis
caugggcggcccgcuccaggc

SEQ ID NO: 2354981 - RNA, 14 nt, Bordetella pertussis
caugggcggcgagc

SEQ ID NO: 2354982 - RNA, 12 nt, Bordetella pertussis
caugggcggggc

SEQ ID NO: 2354983 - RNA, 15 nt, Bordetella pertussis
caugggcgucgucgc

SEQ ID NO: 2354984 - RNA, 15 nt, Bordetella pertussis
caugggcgugccgcg

SEQ ID NO: 2354985 - RNA, 17 nt, Bordetella pertussis
caugggcgugccgcgcu

SEQ ID NO: 2354986 - RNA, 21 nt, Bordetella pertussis
caugggcguggugcugacgga

SEQ ID NO: 2354987 - RNA, 17 nt, Bordetella pertussis
caugggcucgcgcgagc

SEQ ID NO: 2354988 - RNA, 20 nt, Bordetella pertussis
caugggcucgcgcgagccca

SEQ ID NO: 2354989 - RNA, 18 nt, Bordetella pertussis
caugggcucgugcagcag

SEQ ID NO: 2354990 - RNA, 19 nt, Bordetella pertussis
caugggcucgugcagcagg

SEQ ID NO: 2354991 - RNA, 19 nt, Bordetella pertussis
cauggggacuggcacccgc

SEQ ID NO: 2354992 - RNA, 14 nt, Bordetella pertussis
cauggggcaggcgc

SEQ ID NO: 2354993 - RNA, 15 nt, Bordetella pertussis
cauggggcaggcgca

SEQ ID NO: 2354994 - RNA, 18 nt, Bordetella pertussis
cauggggcgaggucagca

SEQ ID NO: 2354995 - RNA, 23 nt, Bordetella pertussis
cauggggugcuccugccaggcgc

SEQ ID NO: 2354996 - RNA, 18 nt, Bordetella pertussis
cauggguaaagcgccggc

SEQ ID NO: 2354997 - RNA, 19 nt, Bordetella pertussis
cauggguaaagcgccggcc

SEQ ID NO: 2354998 - RNA, 21 nt, Bordetella pertussis
cauggguaaagcgccggcccg

SEQ ID NO: 2354999 - RNA, 15 nt, Bordetella pertussis
cauggucaggacgac

SEQ ID NO: 2355000 - RNA, 20 nt, Bordetella pertussis
cauggucaugcccuccucgg

SEQ ID NO: 2355001 - RNA, 13 nt, Bordetella pertussis
cauggucgaccag

SEQ ID NO: 2355002 - RNA, 15 nt, Bordetella pertussis
cauggucgaccagca

SEQ ID NO: 2355003 - RNA, 16 nt, Bordetella pertussis
cauggucgaccagcag

SEQ ID NO: 2355004 - RNA, 17 nt, Bordetella pertussis
cauggucgaccagcagc

SEQ ID NO: 2355005 - RNA, 14 nt, Bordetella pertussis
cauggucgcccagc

SEQ ID NO: 2355006 - RNA, 16 nt, Bordetella pertussis
cauggucgcgaccacc

SEQ ID NO: 2355007 - RNA, 15 nt, Bordetella pertussis
cauggucggcauggc

SEQ ID NO: 2355008 - RNA, 18 nt, Bordetella pertussis
cauggucucguccacccc

SEQ ID NO: 2355009 - RNA, 21 nt, Bordetella pertussis
cauggugaacggccccgccag

SEQ ID NO: 2355010 - RNA, 22 nt, Bordetella pertussis
cauggugaccggggcguccacc

SEQ ID NO: 2355011 - RNA, 20 nt, Bordetella pertussis
cauggugccgcgcaggcccu

SEQ ID NO: 2355012 - RNA, 23 nt, Bordetella pertussis
cauggugccggaaaaugccgcgg

SEQ ID NO: 2355013 - RNA, 20 nt, Bordetella pertussis
caugguggcgcaggcaaagc

SEQ ID NO: 2355014 - RNA, 17 nt, Bordetella pertussis
cauggugggcaggucgg

SEQ ID NO: 2355015 - RNA, 19 nt, Bordetella pertussis
cauggugugccuguccccg

SEQ ID NO: 2355016 - RNA, 20 nt, Bordetella pertussis
caugguuucgucaccgaacu

SEQ ID NO: 2355017 - RNA, 18 nt, Bordetella pertussis
cauguaaaaacccggccu

SEQ ID NO: 2355018 - RNA, 18 nt, Bordetella pertussis
cauguagauggccgccuu

SEQ ID NO: 2355019 - RNA, 16 nt, Bordetella pertussis
cauguagcggccgccc

SEQ ID NO: 2355020 - RNA, 18 nt, Bordetella pertussis
cauguaggccucgggcca

SEQ ID NO: 2355021 - RNA, 12 nt, Bordetella pertussis
cauguaguucac

SEQ ID NO: 2355022 - RNA, 17 nt, Bordetella pertussis
cauguauaacguggcgc

SEQ ID NO: 2355023 - RNA, 16 nt, Bordetella pertussis
caugucacgacgucca

SEQ ID NO: 2355024 - RNA, 23 nt, Bordetella pertussis
caugucacgacguccacgauguc

SEQ ID NO: 2355025 - RNA, 16 nt, Bordetella pertussis
caugucagcgccuggc

SEQ ID NO: 2355026 - RNA, 20 nt, Bordetella pertussis
caugucagucguccuccgcg

SEQ ID NO: 2355027 - RNA, 14 nt, Bordetella pertussis
cauguccaccagcc

SEQ ID NO: 2355028 - RNA, 16 nt, Bordetella pertussis
cauguccaccagccgg

SEQ ID NO: 2355029 - RNA, 23 nt, Bordetella pertussis
cauguccaccagccggccgccga

SEQ ID NO: 2355030 - RNA, 14 nt, Bordetella pertussis
cauguccagcgcca

SEQ ID NO: 2355031 - RNA, 16 nt, Bordetella pertussis
cauguccagcgccagg

SEQ ID NO: 2355032 - RNA, 17 nt, Bordetella pertussis
cauguccagcgccaggc

SEQ ID NO: 2355033 - RNA, 15 nt, Bordetella pertussis
caugucccagcgcuc

SEQ ID NO: 2355034 - RNA, 15 nt, Bordetella pertussis
caugucccgaggcgc

SEQ ID NO: 2355035 - RNA, 14 nt, Bordetella pertussis
cauguccgccacgc

SEQ ID NO: 2355036 - RNA, 15 nt, Bordetella pertussis
cauguccgccacgcc

SEQ ID NO: 2355037 - RNA, 14 nt, Bordetella pertussis
cauguccgccaugc

SEQ ID NO: 2355038 - RNA, 15 nt, Bordetella pertussis
cauguccgccaugcg

SEQ ID NO: 2355039 - RNA, 19 nt, Bordetella pertussis
cauguccguaucgcggccg

SEQ ID NO: 2355040 - RNA, 16 nt, Bordetella pertussis
cauguccugcaggucc

SEQ ID NO: 2355041 - RNA, 12 nt, Bordetella pertussis
cauguccuggca

SEQ ID NO: 2355042 - RNA, 18 nt, Bordetella pertussis
cauguccuggcaggccgc

SEQ ID NO: 2355043 - RNA, 22 nt, Bordetella pertussis
caugucgaagcaggcgguacag

SEQ ID NO: 2355044 - RNA, 17 nt, Bordetella pertussis
caugucguacaggccgu

SEQ ID NO: 2355045 - RNA, 16 nt, Bordetella pertussis
caugucguccucggcc

SEQ ID NO: 2355046 - RNA, 17 nt, Bordetella pertussis
caugucguccucggcca

SEQ ID NO: 2355047 - RNA, 19 nt, Bordetella pertussis
caugucguccucggccacg

SEQ ID NO: 2355048 - RNA, 13 nt, Bordetella pertussis
caugugccaccgc

SEQ ID NO: 2355049 - RNA, 17 nt, Bordetella pertussis
caugugccaccgcccag

SEQ ID NO: 2355050 - RNA, 19 nt, Bordetella pertussis
caugugccaccgcccaggc

SEQ ID NO: 2355051 - RNA, 22 nt, Bordetella pertussis
caugugccaccgcccaggcgca

SEQ ID NO: 2355052 - RNA, 22 nt, Bordetella pertussis
caugugcgagagcuccagccgg

SEQ ID NO: 2355053 - RNA, 15 nt, Bordetella pertussis
caugugcgccgcgcc

SEQ ID NO: 2355054 - RNA, 15 nt, Bordetella pertussis
caugugcucgggacg

SEQ ID NO: 2355055 - RNA, 23 nt, Bordetella pertussis
caugugcucgggacgcaggccca

SEQ ID NO: 2355056 - RNA, 17 nt, Bordetella pertussis
caugugcugcggcagcc

SEQ ID NO: 2355057 - RNA, 20 nt, Bordetella pertussis
caugugcugcggcagccagg

SEQ ID NO: 2355058 - RNA, 20 nt, Bordetella pertussis
caugugcuugccgcagcggc

SEQ ID NO: 2355059 - RNA, 16 nt, Bordetella pertussis
cauguggcgcagcguu

SEQ ID NO: 2355060 - RNA, 17 nt, Bordetella pertussis
cauguggggacaggcac

SEQ ID NO: 2355061 - RNA, 14 nt, Bordetella pertussis
cauguucgaccagg

SEQ ID NO: 2355062 - RNA, 18 nt, Bordetella pertussis
accagcgcaccaccagca

SEQ ID NO: 2355063 - RNA, 19 nt, Bordetella pertussis
accagcgcaccaccagcac

SEQ ID NO: 2355064 - RNA, 19 nt, Bordetella pertussis
accagcgcacggucgaaga

SEQ ID NO: 2355065 - RNA, 12 nt, Bordetella pertussis
accagcgccacg

SEQ ID NO: 2355066 - RNA, 14 nt, Bordetella pertussis
accagcgccacgcc

SEQ ID NO: 2355067 - RNA, 15 nt, Bordetella pertussis
accagcgccacgccg

SEQ ID NO: 2355068 - RNA, 18 nt, Bordetella pertussis
accagcgccacgccggcc

SEQ ID NO: 2355069 - RNA, 15 nt, Bordetella pertussis
accagcgccaggaac

SEQ ID NO: 2355070 - RNA, 17 nt, Bordetella pertussis
accagcgccaggaacag

SEQ ID NO: 2355071 - RNA, 13 nt, Bordetella pertussis
accagcgccggcg

SEQ ID NO: 2355072 - RNA, 14 nt, Bordetella pertussis
accagcgccggcgc

SEQ ID NO: 2355073 - RNA, 15 nt, Bordetella pertussis
accagcgccggcgca

SEQ ID NO: 2355074 - RNA, 13 nt, Bordetella pertussis
accagcgccugcc

SEQ ID NO: 2355075 - RNA, 21 nt, Bordetella pertussis
accagcgccugccgaucgugc

SEQ ID NO: 2355076 - RNA, 19 nt, Bordetella pertussis
accagcgcgaacgccugcc

SEQ ID NO: 2355077 - RNA, 20 nt, Bordetella pertussis
accagcgcgaacgccugcca

SEQ ID NO: 2355078 - RNA, 14 nt, Bordetella pertussis
accagcgcgccgcg

SEQ ID NO: 2355079 - RNA, 20 nt, Bordetella pertussis
accagcgcgccgcgcgcggc

SEQ ID NO: 2355080 - RNA, 11 nt, Bordetella pertussis
accagcgcgcg

SEQ ID NO: 2355081 - RNA, 14 nt, Bordetella pertussis
accagcgcgcgccg

SEQ ID NO: 2355082 - RNA, 17 nt, Bordetella pertussis
accagcgcggccagcac

SEQ ID NO: 2355083 - RNA, 18 nt, Bordetella pertussis
accagcgcgucgccgcca

SEQ ID NO: 2355084 - RNA, 20 nt, Bordetella pertussis
accagcgcgucgccgccauu

SEQ ID NO: 2355085 - RNA, 17 nt, Bordetella pertussis
accagcggaucgccggg

SEQ ID NO: 2355086 - RNA, 15 nt, Bordetella pertussis
accagcggcgugcgg

SEQ ID NO: 2355087 - RNA, 21 nt, Bordetella pertussis
accagcggcgugcggcccagc

SEQ ID NO: 2355088 - RNA, 14 nt, Bordetella pertussis
accagcggcguggc

SEQ ID NO: 2355089 - RNA, 18 nt, Bordetella pertussis
accagcggcguggcggcc

SEQ ID NO: 2355090 - RNA, 15 nt, Bordetella pertussis
accagcggcuggcgg

SEQ ID NO: 2355091 - RNA, 18 nt, Bordetella pertussis
accagcgucaccagcagg

SEQ ID NO: 2355092 - RNA, 14 nt, Bordetella pertussis
accagcgucagcac

SEQ ID NO: 2355093 - RNA, 20 nt, Bordetella pertussis
accagcgucagcacaucgcc

SEQ ID NO: 2355094 - RNA, 22 nt, Bordetella pertussis
accagcgucagcacaucgcccg

SEQ ID NO: 2355095 - RNA, 15 nt, Bordetella pertussis
accagcucagcuugg

SEQ ID NO: 2355096 - RNA, 14 nt, Bordetella pertussis
accagcucgacgcc

SEQ ID NO: 2355097 - RNA, 13 nt, Bordetella pertussis
accagcugcacca

SEQ ID NO: 2355098 - RNA, 15 nt, Bordetella pertussis
accagcuugcgcgcc

SEQ ID NO: 2355099 - RNA, 18 nt, Bordetella pertussis
accagcuuggccugcgga

SEQ ID NO: 2355100 - RNA, 17 nt, Bordetella pertussis
accaggaaaaccggcgc

SEQ ID NO: 2355101 - RNA, 18 nt, Bordetella pertussis
accaggaagagcuggcgc

SEQ ID NO: 2355102 - RNA, 14 nt, Bordetella pertussis
accaggaagcgcgc

SEQ ID NO: 2355103 - RNA, 15 nt, Bordetella pertussis
accaggaagcgcgcc

SEQ ID NO: 2355104 - RNA, 16 nt, Bordetella pertussis
accaggaugaugcagc

SEQ ID NO: 2355105 - RNA, 21 nt, Bordetella pertussis
accaggaugaugcagcacacg

SEQ ID NO: 2355106 - RNA, 15 nt, Bordetella pertussis
accaggcagccggcc

SEQ ID NO: 2355107 - RNA, 16 nt, Bordetella pertussis
accaggcagccggccc

SEQ ID NO: 2355108 - RNA, 17 nt, Bordetella pertussis
accaggcagccggcccc

SEQ ID NO: 2355109 - RNA, 19 nt, Bordetella pertussis
accaggcagccggccccgc

SEQ ID NO: 2355110 - RNA, 20 nt, Bordetella pertussis
accaggccacccgccguacc

SEQ ID NO: 2355111 - RNA, 17 nt, Bordetella pertussis
accaggccacgaugaug

SEQ ID NO: 2355112 - RNA, 23 nt, Bordetella pertussis
accaggcccaugaaggcggccag

SEQ ID NO: 2355113 - RNA, 15 nt, Bordetella pertussis
accaggcccgccacg

SEQ ID NO: 2355114 - RNA, 23 nt, Bordetella pertussis
accaggcccgccacggcgcccga

SEQ ID NO: 2355115 - RNA, 11 nt, Bordetella pertussis
accaggccgaa

SEQ ID NO: 2355116 - RNA, 18 nt, Bordetella pertussis
accaggccgacgaggcgc

SEQ ID NO: 2355117 - RNA, 23 nt, Bordetella pertussis
accaggccgagaugugcggcgug

SEQ ID NO: 2355118 - RNA, 15 nt, Bordetella pertussis
accaggccgauggcg

SEQ ID NO: 2355119 - RNA, 13 nt, Bordetella pertussis
accaggccgccag

SEQ ID NO: 2355120 - RNA, 16 nt, Bordetella pertussis
accaggccgccggcca

SEQ ID NO: 2355121 - RNA, 23 nt, Bordetella pertussis
accaggccgccggccagcgccag

SEQ ID NO: 2355122 - RNA, 13 nt, Bordetella pertussis
accaggccgcggc

SEQ ID NO: 2355123 - RNA, 16 nt, Bordetella pertussis
accaggccggccaggg

SEQ ID NO: 2355124 - RNA, 15 nt, Bordetella pertussis
accaggccggcggcg

SEQ ID NO: 2355125 - RNA, 17 nt, Bordetella pertussis
accaggccggcggcggg

SEQ ID NO: 2355126 - RNA, 19 nt, Bordetella pertussis
accaggccguggcccagcc

SEQ ID NO: 2355127 - RNA, 22 nt, Bordetella pertussis
accaggccugcgggugcgccug

SEQ ID NO: 2355128 - RNA, 20 nt, Bordetella pertussis
accaggcgcucgcgcgccag

SEQ ID NO: 2355129 - RNA, 12 nt, Bordetella pertussis
accaggcgcuga

SEQ ID NO: 2355130 - RNA, 21 nt, Bordetella pertussis
accaggcggcgacgaugccgc

SEQ ID NO: 2355131 - RNA, 17 nt, Bordetella pertussis
accaggcgggcaucgcc

SEQ ID NO: 2355132 - RNA, 19 nt, Bordetella pertussis
accaggcgggcaucgccca

SEQ ID NO: 2355133 - RNA, 21 nt, Bordetella pertussis
accaggcgggcaucgcccacc

SEQ ID NO: 2355134 - RNA, 23 nt, Bordetella pertussis
accaggcuccggcuugccgaagg

SEQ ID NO: 2355135 - RNA, 15 nt, Bordetella pertussis
accaggcugcgcgcc

SEQ ID NO: 2355136 - RNA, 16 nt, Bordetella pertussis
accaggcugcgcgccg

SEQ ID NO: 2355137 - RNA, 19 nt, Bordetella pertussis
accaggcugcgcgccggcg

SEQ ID NO: 2355138 - RNA, 22 nt, Bordetella pertussis
accaggcuggagucgggcugcu

SEQ ID NO: 2355139 - RNA, 21 nt, Bordetella pertussis
accaggcuuucgaagccgccc

SEQ ID NO: 2355140 - RNA, 23 nt, Bordetella pertussis
accaggcuuucgaagccgcccca

SEQ ID NO: 2355141 - RNA, 18 nt, Bordetella pertussis
accaggcuuugcgcgcca

SEQ ID NO: 2355142 - RNA, 20 nt, Bordetella pertussis
accaggcuuugcgcgccaug

SEQ ID NO: 2355143 - RNA, 22 nt, Bordetella pertussis
accagggaccaauacgccgcca

SEQ ID NO: 2355144 - RNA, 20 nt, Bordetella pertussis
accagggagccguucuggca

SEQ ID NO: 2355145 - RNA, 13 nt, Bordetella pertussis
accagggccgcca

SEQ ID NO: 2355146 - RNA, 19 nt, Bordetella pertussis
accagggcgcccgccgacg

SEQ ID NO: 2355147 - RNA, 23 nt, Bordetella pertussis
ccaacggggccgccaacgccaag

SEQ ID NO: 2355148 - RNA, 20 nt, Bordetella pertussis
ccaacucgaggcggcgcagg

SEQ ID NO: 2355149 - RNA, 21 nt, Bordetella pertussis
ccaacugccugcagcgcgcgc

SEQ ID NO: 2355150 - RNA, 16 nt, Bordetella pertussis
ccaacuuccguugguc

SEQ ID NO: 2355151 - RNA, 19 nt, Bordetella pertussis
ccaagauggcccagggcag

SEQ ID NO: 2355152 - RNA, 19 nt, Bordetella pertussis
ccaagcagacccgcgccca

SEQ ID NO: 2355153 - RNA, 19 nt, Bordetella pertussis
ccaagcagaccuaccaggc

SEQ ID NO: 2355154 - RNA, 21 nt, Bordetella pertussis
ccaagcagaccuaccaggccg

SEQ ID NO: 2355155 - RNA, 14 nt, Bordetella pertussis
ccaagcagcgccug

SEQ ID NO: 2355156 - RNA, 15 nt, Bordetella pertussis
ccaagcagcgccugc

SEQ ID NO: 2355157 - RNA, 12 nt, Bordetella pertussis
ccaagcagggac

SEQ ID NO: 2355158 - RNA, 11 nt, Bordetella pertussis
ccaagcagggc

SEQ ID NO: 2355159 - RNA, 14 nt, Bordetella pertussis
ccaagcgcacgcgc

SEQ ID NO: 2355160 - RNA, 14 nt, Bordetella pertussis
ccaagcgccacagc

SEQ ID NO: 2355161 - RNA, 19 nt, Bordetella pertussis
ccaagcgccacagcgccau

SEQ ID NO: 2355162 - RNA, 14 nt, Bordetella pertussis
ccaagcgccgcggc

SEQ ID NO: 2355163 - RNA, 21 nt, Bordetella pertussis
ccaagcgccgcggccacgccc

SEQ ID NO: 2355164 - RNA, 15 nt, Bordetella pertussis
ccaagcgcguggcca

SEQ ID NO: 2355165 - RNA, 19 nt, Bordetella pertussis
ccaagcgcguggccaucaa

SEQ ID NO: 2355166 - RNA, 15 nt, Bordetella pertussis
ccaagcggcaggcgg

SEQ ID NO: 2355167 - RNA, 13 nt, Bordetella pertussis
ccaagcuccagga

SEQ ID NO: 2355168 - RNA, 17 nt, Bordetella pertussis
ccaagcugcuggccggc

SEQ ID NO: 2355169 - RNA, 20 nt, Bordetella pertussis
ccaagcuggagaagcgccgc

SEQ ID NO: 2355170 - RNA, 19 nt, Bordetella pertussis
ccaaggagucccuucaugc

SEQ ID NO: 2355171 - RNA, 15 nt, Bordetella pertussis
ccaaggcaagcagcg

SEQ ID NO: 2355172 - RNA, 17 nt, Bordetella pertussis
ccaaggcauuggcgccg

SEQ ID NO: 2355173 - RNA, 21 nt, Bordetella pertussis
ccaaggcauuggcgccgcgcu

SEQ ID NO: 2355174 - RNA, 23 nt, Bordetella pertussis
ccaaggccggcgcgucgcgcggc

SEQ ID NO: 2355175 - RNA, 14 nt, Bordetella pertussis
ccaccagcgucacc

SEQ ID NO: 2355176 - RNA, 20 nt, Bordetella pertussis
ccaccagcguguagagcagg

SEQ ID NO: 2355177 - RNA, 23 nt, Bordetella pertussis
ccaccagcguguagagcaggccg

SEQ ID NO: 2355178 - RNA, 16 nt, Bordetella pertussis
ccaccaggaacgccag

SEQ ID NO: 2355179 - RNA, 21 nt, Bordetella pertussis
ccaccaggaacgccagcagca

SEQ ID NO: 2355180 - RNA, 14 nt, Bordetella pertussis
ccaccaggccgccu

SEQ ID NO: 2355181 - RNA, 12 nt, Bordetella pertussis
ccaccaggccgg

SEQ ID NO: 2355182 - RNA, 13 nt, Bordetella pertussis
ccaccaggccguc

SEQ ID NO: 2355183 - RNA, 15 nt, Bordetella pertussis
ccaccaggccgucgg

SEQ ID NO: 2355184 - RNA, 13 nt, Bordetella pertussis
ccaccaggcgcgc

SEQ ID NO: 2355185 - RNA, 19 nt, Bordetella pertussis
ccaccaggcugaucaccca

SEQ ID NO: 2355186 - RNA, 23 nt, Bordetella pertussis
ccaccagggaccaauacgccgcc

SEQ ID NO: 2355187 - RNA, 14 nt, Bordetella pertussis
ccaccagggccagc

SEQ ID NO: 2355188 - RNA, 15 nt, Bordetella pertussis
ccaccagggccagcu

SEQ ID NO: 2355189 - RNA, 16 nt, Bordetella pertussis
ccaccagggcgcccgc

SEQ ID NO: 2355190 - RNA, 18 nt, Bordetella pertussis
ccaccagggcgcccgccg

SEQ ID NO: 2355191 - RNA, 12 nt, Bordetella pertussis
ccaccagggugc

SEQ ID NO: 2355192 - RNA, 20 nt, Bordetella pertussis
ccaccaggguuuccucgccg

SEQ ID NO: 2355193 - RNA, 21 nt, Bordetella pertussis
ccaccagguagggcagcaggu

SEQ ID NO: 2355194 - RNA, 20 nt, Bordetella pertussis
ccaccaggucguacagcgcc

SEQ ID NO: 2355195 - RNA, 21 nt, Bordetella pertussis
ccaccaggucguacagcgccu

SEQ ID NO: 2355196 - RNA, 14 nt, Bordetella pertussis
ccaccagugcgccg

SEQ ID NO: 2355197 - RNA, 16 nt, Bordetella pertussis
ccaccaucagccagcc

SEQ ID NO: 2355198 - RNA, 18 nt, Bordetella pertussis
ccaccaugucccuggcca

SEQ ID NO: 2355199 - RNA, 16 nt, Bordetella pertussis
ccacccagcucagcgg

SEQ ID NO: 2355200 - RNA, 13 nt, Bordetella pertussis
ccacccaggccca

SEQ ID NO: 2355201 - RNA, 16 nt, Bordetella pertussis
ccacccaggcggcagg

SEQ ID NO: 2355202 - RNA, 19 nt, Bordetella pertussis
ccacccagggcuugacgcg

SEQ ID NO: 2355203 - RNA, 16 nt, Bordetella pertussis
ccacccccggcaccag

SEQ ID NO: 2355204 - RNA, 14 nt, Bordetella pertussis
ccacccccgggcgc

SEQ ID NO: 2355205 - RNA, 23 nt, Bordetella pertussis
ccacccccgucagcacggucggc

SEQ ID NO: 2355206 - RNA, 23 nt, Bordetella pertussis
ccaccccgagauaggcggccagg

SEQ ID NO: 2355207 - RNA, 15 nt, Bordetella pertussis
ccaccccgucaucgc

SEQ ID NO: 2355208 - RNA, 21 nt, Bordetella pertussis
ccaccccgucaucgccgcggc

SEQ ID NO: 2355209 - RNA, 23 nt, Bordetella pertussis
ccaccccgucaucgccgcggcgg

SEQ ID NO: 2355210 - RNA, 20 nt, Bordetella pertussis
ccaccccguugcagcccagc

SEQ ID NO: 2355211 - RNA, 23 nt, Bordetella pertussis
ccacccgcauugaucgaucagcc

SEQ ID NO: 2355212 - RNA, 20 nt, Bordetella pertussis
ccacccgccguaccgggcgg

SEQ ID NO: 2355213 - RNA, 12 nt, Bordetella pertussis
ccacccgcgcca

SEQ ID NO: 2355214 - RNA, 13 nt, Bordetella pertussis
ccacccgcgccag

SEQ ID NO: 2355215 - RNA, 14 nt, Bordetella pertussis
ccacccgcgccagg

SEQ ID NO: 2355216 - RNA, 17 nt, Bordetella pertussis
ccacccggaucgacagg

SEQ ID NO: 2355217 - RNA, 14 nt, Bordetella pertussis
ccacccggccaucg

SEQ ID NO: 2355218 - RNA, 22 nt, Bordetella pertussis
ccacccguaccgccacaccgcu

SEQ ID NO: 2355219 - RNA, 16 nt, Bordetella pertussis
ccacccugccgugcag

SEQ ID NO: 2355220 - RNA, 16 nt, Bordetella pertussis
ccacccuggcacgcug

SEQ ID NO: 2355221 - RNA, 17 nt, Bordetella pertussis
ccacccuucgcgcugca

SEQ ID NO: 2355222 - RNA, 14 nt, Bordetella pertussis
ccaccgaagcggcg

SEQ ID NO: 2355223 - RNA, 15 nt, Bordetella pertussis
ccaccgacggcgcgg

SEQ ID NO: 2355224 - RNA, 16 nt, Bordetella pertussis
ccaccgacggcgcggc

SEQ ID NO: 2355225 - RNA, 17 nt, Bordetella pertussis
ccaccgacggcgcggcg

SEQ ID NO: 2355226 - RNA, 22 nt, Bordetella pertussis
ccaccgagacgcugucgcgccc

SEQ ID NO: 2355227 - RNA, 15 nt, Bordetella pertussis
ccaccgagggccgga

SEQ ID NO: 2355228 - RNA, 23 nt, Bordetella pertussis
ccaccgauccgaugaugcccagg

SEQ ID NO: 2355229 - RNA, 17 nt, Bordetella pertussis
ccaccgcaucgcgcagc

SEQ ID NO: 2355230 - RNA, 14 nt, Bordetella pertussis
ccaccgccagcccg

SEQ ID NO: 2355231 - RNA, 12 nt, Bordetella pertussis
ccaccgcccaga

SEQ ID NO: 2355232 - RNA, 14 nt, Bordetella pertussis
ccaccgcccaggcg

SEQ ID NO: 2355233 - RNA, 19 nt, Bordetella pertussis
ccaccgcccccgccgccau

SEQ ID NO: 2355234 - RNA, 14 nt, Bordetella pertussis
ccaccgccgcccgc

SEQ ID NO: 2355235 - RNA, 21 nt, Bordetella pertussis
ccaccgccgcccgccaggcca

SEQ ID NO: 2355236 - RNA, 15 nt, Bordetella pertussis
ccaccgccguggccg

SEQ ID NO: 2355237 - RNA, 14 nt, Bordetella pertussis
ccaccgccugugcc

SEQ ID NO: 2355238 - RNA, 19 nt, Bordetella pertussis
ccaccgcgaaccaggccug

SEQ ID NO: 2355239 - RNA, 17 nt, Bordetella pertussis
ccaccgcggcggaccac

SEQ ID NO: 2355240 - RNA, 19 nt, Bordetella pertussis
ccaccgcggugccgcgcgc

SEQ ID NO: 2355241 - RNA, 15 nt, Bordetella pertussis
ccaccggcaaggccg

SEQ ID NO: 2355242 - RNA, 17 nt, Bordetella pertussis
ccaccggcaaggccgcg

SEQ ID NO: 2355243 - RNA, 14 nt, Bordetella pertussis
ccaccggcacgccg

SEQ ID NO: 2355244 - RNA, 15 nt, Bordetella pertussis
ccaccggcacgccgg

SEQ ID NO: 2355245 - RNA, 19 nt, Bordetella pertussis
ccaccggcacgccggcggc

SEQ ID NO: 2355246 - RNA, 13 nt, Bordetella pertussis
ccaccggcgcgcg

SEQ ID NO: 2355247 - RNA, 14 nt, Bordetella pertussis
ccaccggcgcgcgc

SEQ ID NO: 2355248 - RNA, 16 nt, Bordetella pertussis
ccaccggcgcgcgcau

SEQ ID NO: 2355249 - RNA, 20 nt, Bordetella pertussis
ccaccggcgcgcgcaugccc

SEQ ID NO: 2355250 - RNA, 17 nt, Bordetella pertussis
ccaccggcuggauaucc

SEQ ID NO: 2355251 - RNA, 16 nt, Bordetella pertussis
ccaccgggacaggcac

SEQ ID NO: 2355252 - RNA, 13 nt, Bordetella pertussis
ccaccgggccggc

SEQ ID NO: 2355253 - RNA, 16 nt, Bordetella pertussis
ccaccgggccggccug

SEQ ID NO: 2355254 - RNA, 19 nt, Bordetella pertussis
ccaccgggcugaacauccu

SEQ ID NO: 2355255 - RNA, 16 nt, Bordetella pertussis
ccaccgguugcagcgc

SEQ ID NO: 2355256 - RNA, 20 nt, Bordetella pertussis
ccaccgguugcagcgcgcca

SEQ ID NO: 2355257 - RNA, 23 nt, Bordetella pertussis
ccaccgguugcagcgcgccaggc

SEQ ID NO: 2355258 - RNA, 19 nt, Bordetella pertussis
ccaccgucucgaacgccgc

SEQ ID NO: 2355259 - RNA, 23 nt, Bordetella pertussis
ccaccgucucgaacgccgcgucg

SEQ ID NO: 2355260 - RNA, 15 nt, Bordetella pertussis
ccaccgucuggcgua

SEQ ID NO: 2355261 - RNA, 16 nt, Bordetella pertussis
ccaccgucuggcguac

SEQ ID NO: 2355262 - RNA, 18 nt, Bordetella pertussis
ccaccgucuugcccgcca

SEQ ID NO: 2355263 - RNA, 20 nt, Bordetella pertussis
ccaccgucuugcccgccagc

SEQ ID NO: 2355264 - RNA, 15 nt, Bordetella pertussis
ccaccgugaccagcg

SEQ ID NO: 2355265 - RNA, 18 nt, Bordetella pertussis
ccaccguggccacggccg

SEQ ID NO: 2355266 - RNA, 20 nt, Bordetella pertussis
ccaccguggccacggccgcg

SEQ ID NO: 2355267 - RNA, 23 nt, Bordetella pertussis
ccaccguggccacggccgcgauc

SEQ ID NO: 2355268 - RNA, 16 nt, Bordetella pertussis
ccaccguggcguccau

SEQ ID NO: 2355269 - RNA, 17 nt, Bordetella pertussis
ccaccuccaccgccagc

SEQ ID NO: 2355270 - RNA, 14 nt, Bordetella pertussis
ccaccucggccucg

SEQ ID NO: 2355271 - RNA, 18 nt, Bordetella pertussis
ccaccucuucagcccggc

SEQ ID NO: 2355272 - RNA, 13 nt, Bordetella pertussis
ccaccuggcagcc

SEQ ID NO: 2355273 - RNA, 16 nt, Bordetella pertussis
ccaccuggccacaagc

SEQ ID NO: 2355274 - RNA, 16 nt, Bordetella pertussis
ccaccuggcgcccggc

SEQ ID NO: 2355275 - RNA, 17 nt, Bordetella pertussis
ccaccuggcgcccggcg

SEQ ID NO: 2355276 - RNA, 19 nt, Bordetella pertussis
ccaccuggcggugcgccgc

SEQ ID NO: 2355277 - RNA, 20 nt, Bordetella pertussis
ccaccuggcggugcgccgca

SEQ ID NO: 2355278 - RNA, 15 nt, Bordetella pertussis
ccaccuggucgucgg

SEQ ID NO: 2355279 - RNA, 20 nt, Bordetella pertussis
ccaccuggucgucggccacg

SEQ ID NO: 2355280 - RNA, 22 nt, Bordetella pertussis
ccaccuggucgucggccacgcc

SEQ ID NO: 2355281 - RNA, 23 nt, Bordetella pertussis
ccaccuggucgucggccacgccc

SEQ ID NO: 2355282 - RNA, 17 nt, Bordetella pertussis
ccaccuucagggcgccg

SEQ ID NO: 2355283 - RNA, 22 nt, Bordetella pertussis
ccaccuuccugcuggaccugcu

SEQ ID NO: 2355284 - RNA, 14 nt, Bordetella pertussis
ccaccuucgccgcg

SEQ ID NO: 2355285 - RNA, 15 nt, Bordetella pertussis
ccaccuucgccgcgc

SEQ ID NO: 2355286 - RNA, 16 nt, Bordetella pertussis
ccaccuucgccgcgca

SEQ ID NO: 2355287 - RNA, 17 nt, Bordetella pertussis
ccaccuucgccgcgcac

SEQ ID NO: 2355288 - RNA, 20 nt, Bordetella pertussis
ccacgcgcuugcgcgccacg

SEQ ID NO: 2355289 - RNA, 14 nt, Bordetella pertussis
ccacgcggccgugg

SEQ ID NO: 2355290 - RNA, 17 nt, Bordetella pertussis
ccacgcggcgcugcugg

SEQ ID NO: 2355291 - RNA, 21 nt, Bordetella pertussis
ccacgcggcgcugcuggccgg

SEQ ID NO: 2355292 - RNA, 16 nt, Bordetella pertussis
ccacgcgggccggccg

SEQ ID NO: 2355293 - RNA, 18 nt, Bordetella pertussis
ccacgcggguggugcugc

SEQ ID NO: 2355294 - RNA, 13 nt, Bordetella pertussis
ccacgcgguccag

SEQ ID NO: 2355295 - RNA, 17 nt, Bordetella pertussis
ccacgcgguccagcccc

SEQ ID NO: 2355296 - RNA, 15 nt, Bordetella pertussis
ccacgcucacgcccg

SEQ ID NO: 2355297 - RNA, 23 nt, Bordetella pertussis
ccacgcucacgcccgugucgccg

SEQ ID NO: 2355298 - RNA, 16 nt, Bordetella pertussis
ccacgcugcccugcug

SEQ ID NO: 2355299 - RNA, 19 nt, Bordetella pertussis
ccacgcugcccugcugcug

SEQ ID NO: 2355300 - RNA, 14 nt, Bordetella pertussis
ccacgcugcgcccg

SEQ ID NO: 2355301 - RNA, 16 nt, Bordetella pertussis
ccacgcugcgcccgcu

SEQ ID NO: 2355302 - RNA, 14 nt, Bordetella pertussis
ccacgcuggccgcg

SEQ ID NO: 2355303 - RNA, 15 nt, Bordetella pertussis
ccacgcuggccgcgc

SEQ ID NO: 2355304 - RNA, 22 nt, Bordetella pertussis
ccacgcuggcuucgucgccggc

SEQ ID NO: 2355305 - RNA, 15 nt, Bordetella pertussis
ccacgcugggccaga

SEQ ID NO: 2355306 - RNA, 16 nt, Bordetella pertussis
ccacgcugggccagac

SEQ ID NO: 2355307 - RNA, 21 nt, Bordetella pertussis
ccacgcugggccagaccgcgc

SEQ ID NO: 2355308 - RNA, 23 nt, Bordetella pertussis
ccacgcugggccagaccgcgcgc

SEQ ID NO: 2355309 - RNA, 22 nt, Bordetella pertussis
ccacgcuguacugguaccaggc

SEQ ID NO: 2355310 - RNA, 22 nt, Bordetella pertussis
ccacgcugucggggugccguuc

SEQ ID NO: 2355311 - RNA, 20 nt, Bordetella pertussis
ccacgcuguuuucggccgac

SEQ ID NO: 2355312 - RNA, 19 nt, Bordetella pertussis
ccacggcaaaagccggggu

SEQ ID NO: 2355313 - RNA, 22 nt, Bordetella pertussis
ccacggcaaugucgcaggccgc

SEQ ID NO: 2355314 - RNA, 20 nt, Bordetella pertussis
ccacggcaggcgccugcccu

SEQ ID NO: 2355315 - RNA, 22 nt, Bordetella pertussis
ccacggcaggcgccugcccugc

SEQ ID NO: 2355316 - RNA, 14 nt, Bordetella pertussis
ccacggcaucgccg

SEQ ID NO: 2355317 - RNA, 17 nt, Bordetella pertussis
ccacggcaucggccagc

SEQ ID NO: 2355318 - RNA, 18 nt, Bordetella pertussis
ccacggcaucggccagca

SEQ ID NO: 2355319 - RNA, 16 nt, Bordetella pertussis
ccacggcaucggcgcc

SEQ ID NO: 2355320 - RNA, 17 nt, Bordetella pertussis
ccacggcaucggcgccg

SEQ ID NO: 2355321 - RNA, 18 nt, Bordetella pertussis
ccacggcaucggcgccgc

SEQ ID NO: 2355322 - RNA, 19 nt, Bordetella pertussis
ccacggcaucggcgccgcg

SEQ ID NO: 2355323 - RNA, 21 nt, Bordetella pertussis
ccacggcaucggcgccgcgcg

SEQ ID NO: 2355324 - RNA, 22 nt, Bordetella pertussis
ccacggcaucggcgccgcgcgc

SEQ ID NO: 2355325 - RNA, 15 nt, Bordetella pertussis
ccacggccacgucgg

SEQ ID NO: 2355326 - RNA, 20 nt, Bordetella pertussis
ccacggccacgucggucgcu

SEQ ID NO: 2355327 - RNA, 12 nt, Bordetella pertussis
ccacggccagca

SEQ ID NO: 2355328 - RNA, 14 nt, Bordetella pertussis
ccacggccagcacu

SEQ ID NO: 2355329 - RNA, 14 nt, Bordetella pertussis
ccacggccgcaugc

SEQ ID NO: 2355330 - RNA, 17 nt, Bordetella pertussis
ccacggccggcagcgcc

SEQ ID NO: 2355331 - RNA, 15 nt, Bordetella pertussis
ccacggccggcgcac

SEQ ID NO: 2355332 - RNA, 19 nt, Bordetella pertussis
ccacggccggcgcacgccg

SEQ ID NO: 2355333 - RNA, 14 nt, Bordetella pertussis
ccacggccgggccu

SEQ ID NO: 2355334 - RNA, 14 nt, Bordetella pertussis
ccacggccugcccg

SEQ ID NO: 2355335 - RNA, 17 nt, Bordetella pertussis
ccacggccugcccgggc

SEQ ID NO: 2355336 - RNA, 18 nt, Bordetella pertussis
ccacggccugcccgggcg

SEQ ID NO: 2355337 - RNA, 20 nt, Bordetella pertussis
ccacggccugcccgggcggg

SEQ ID NO: 2355338 - RNA, 15 nt, Bordetella pertussis
ccacggccuucaugg

SEQ ID NO: 2355339 - RNA, 20 nt, Bordetella pertussis
ccacggcgccaaagcacagg

SEQ ID NO: 2355340 - RNA, 12 nt, Bordetella pertussis
ccacggcgcccg

SEQ ID NO: 2355341 - RNA, 12 nt, Bordetella pertussis
ccacggcgcgcc

SEQ ID NO: 2355342 - RNA, 13 nt, Bordetella pertussis
ccacggcgcgcgc

SEQ ID NO: 2355343 - RNA, 14 nt, Bordetella pertussis
ccacggcggccagg

SEQ ID NO: 2355344 - RNA, 17 nt, Bordetella pertussis
ccacggcggccaggccg

SEQ ID NO: 2355345 - RNA, 20 nt, Bordetella pertussis
ccacggcgggaucgggcagc

SEQ ID NO: 2355346 - RNA, 13 nt, Bordetella pertussis
ccacggcgggccg

SEQ ID NO: 2355347 - RNA, 18 nt, Bordetella pertussis
ccacggcgggccggcucg

SEQ ID NO: 2355348 - RNA, 18 nt, Bordetella pertussis
ccacggcggugaccacca

SEQ ID NO: 2355349 - RNA, 19 nt, Bordetella pertussis
ccacggcggugaccaccag

SEQ ID NO: 2355350 - RNA, 23 nt, Bordetella pertussis
ccacggcggugaucugcucgccg

SEQ ID NO: 2355351 - RNA, 19 nt, Bordetella pertussis
ccacggcgucgaugcgcgc

SEQ ID NO: 2355352 - RNA, 16 nt, Bordetella pertussis
ccacggcgucgccggc

SEQ ID NO: 2355353 - RNA, 20 nt, Bordetella pertussis
ccacggcgucgccggccagg

SEQ ID NO: 2355354 - RNA, 18 nt, Bordetella pertussis
ccacggcguggcgcgccc

SEQ ID NO: 2355355 - RNA, 20 nt, Bordetella pertussis
ccacggcguggcgcgcccgc

SEQ ID NO: 2355356 - RNA, 17 nt, Bordetella pertussis
ccacggcuucgcccagc

SEQ ID NO: 2355357 - RNA, 20 nt, Bordetella pertussis
ccacggcuuuggcguagccg

SEQ ID NO: 2355358 - RNA, 21 nt, Bordetella pertussis
ccacggcuuuggcguagccgg

SEQ ID NO: 2355359 - RNA, 16 nt, Bordetella pertussis
ccacgggaccgcucag

SEQ ID NO: 2355360 - RNA, 17 nt, Bordetella pertussis
ccacgggaccgcucagc

SEQ ID NO: 2355361 - RNA, 13 nt, Bordetella pertussis
ccacgggaugucc

SEQ ID NO: 2355362 - RNA, 22 nt, Bordetella pertussis
ccacgggcgccugguacgacag

SEQ ID NO: 2355363 - RNA, 21 nt, Bordetella pertussis
ccacgggcucgcugaccggcg

SEQ ID NO: 2355364 - RNA, 13 nt, Bordetella pertussis
ccacggggacagg

SEQ ID NO: 2355365 - RNA, 18 nt, Bordetella pertussis
ccacggggacaggcaccu

SEQ ID NO: 2355366 - RNA, 20 nt, Bordetella pertussis
ccacggggacaggcaccucg

SEQ ID NO: 2355367 - RNA, 16 nt, Bordetella pertussis
ccacggucggcacguc

SEQ ID NO: 2355368 - RNA, 22 nt, Bordetella pertussis
ccacggucugcacgccgggcgc

SEQ ID NO: 2355369 - RNA, 18 nt, Bordetella pertussis
ccacggucuggcgcgaca

SEQ ID NO: 2355370 - RNA, 17 nt, Bordetella pertussis
ccacguaggcaaagcgc

SEQ ID NO: 2355371 - RNA, 20 nt, Bordetella pertussis
ccacguccagcacggccgcg

SEQ ID NO: 2355372 - RNA, 13 nt, Bordetella pertussis
ccacgucgcccac

SEQ ID NO: 2355373 - RNA, 14 nt, Bordetella pertussis
ccacgucgccggcg

SEQ ID NO: 2355374 - RNA, 23 nt, Bordetella pertussis
ccacgucgccggcguucuucagc

SEQ ID NO: 2355375 - RNA, 14 nt, Bordetella pertussis
ccacgucgcggcug

SEQ ID NO: 2355376 - RNA, 15 nt, Bordetella pertussis
ccacgucgcggcugg

SEQ ID NO: 2355377 - RNA, 19 nt, Bordetella pertussis
ccacgucgcggcugggcaa

SEQ ID NO: 2355378 - RNA, 11 nt, Bordetella pertussis
ccacgucggcg

SEQ ID NO: 2355379 - RNA, 18 nt, Bordetella pertussis
ccacgucggcggccgccu

SEQ ID NO: 2355380 - RNA, 20 nt, Bordetella pertussis
ccacgucggcggccgccuug

SEQ ID NO: 2355381 - RNA, 15 nt, Bordetella pertussis
ccacgugcugcugga

SEQ ID NO: 2355382 - RNA, 18 nt, Bordetella pertussis
ccacguggacaggcaccu

SEQ ID NO: 2355383 - RNA, 15 nt, Bordetella pertussis
ccacguggaugaugg

SEQ ID NO: 2355384 - RNA, 12 nt, Bordetella pertussis
ccacguggcgac

SEQ ID NO: 2355385 - RNA, 19 nt, Bordetella pertussis
ccacguguggcaggccagc

SEQ ID NO: 2355386 - RNA, 21 nt, Bordetella pertussis
ccacguugaagcgcagccacg

SEQ ID NO: 2355387 - RNA, 20 nt, Bordetella pertussis
ccacguugauccagcgcucg

SEQ ID NO: 2355388 - RNA, 15 nt, Bordetella pertussis
ccacuacacucugcc

SEQ ID NO: 2355389 - RNA, 16 nt, Bordetella pertussis
ccacuacacucugccc

SEQ ID NO: 2355390 - RNA, 23 nt, Bordetella pertussis
ccacuaucagcgcgucacgcuga

SEQ ID NO: 2355391 - RNA, 21 nt, Bordetella pertussis
ccacucagggcggggugccug

SEQ ID NO: 2355392 - RNA, 17 nt, Bordetella pertussis
ccacucgaugggcgcgc

SEQ ID NO: 2355393 - RNA, 18 nt, Bordetella pertussis
ccacucgaugggcgcgcg

SEQ ID NO: 2355394 - RNA, 19 nt, Bordetella pertussis
ccacucgaugggcgcgcgc

SEQ ID NO: 2355395 - RNA, 15 nt, Bordetella pertussis
ccacucggccagcgc

SEQ ID NO: 2355396 - RNA, 15 nt, Bordetella pertussis
ccacucggugcgcgc

SEQ ID NO: 2355397 - RNA, 21 nt, Bordetella pertussis
ccacucggugcgcgcgcccac

SEQ ID NO: 2355398 - RNA, 14 nt, Bordetella pertussis
ccacugcaaggccc

SEQ ID NO: 2355399 - RNA, 17 nt, Bordetella pertussis
ccacugcaaggcccgcc

SEQ ID NO: 2355400 - RNA, 22 nt, Bordetella pertussis
ccacugccaggcgagcgccgcg

SEQ ID NO: 2355401 - RNA, 17 nt, Bordetella pertussis
ccagcaccugcuugacg

SEQ ID NO: 2355402 - RNA, 18 nt, Bordetella pertussis
ccagcacgaaccacaggg

SEQ ID NO: 2355403 - RNA, 16 nt, Bordetella pertussis
ccagcacgaagggcag

SEQ ID NO: 2355404 - RNA, 17 nt, Bordetella pertussis
ccagcacgaagggcagc

SEQ ID NO: 2355405 - RNA, 18 nt, Bordetella pertussis
ccagcacgaagggcagca

SEQ ID NO: 2355406 - RNA, 20 nt, Bordetella pertussis
ccagcacgaagggcagcagc

SEQ ID NO: 2355407 - RNA, 21 nt, Bordetella pertussis
ccagcacgaagggcagcagca

SEQ ID NO: 2355408 - RNA, 15 nt, Bordetella pertussis
ccagcacgagauguc

SEQ ID NO: 2355409 - RNA, 19 nt, Bordetella pertussis
ccagcacgagauguccaug

SEQ ID NO: 2355410 - RNA, 15 nt, Bordetella pertussis
ccagcacgccgcgcu

SEQ ID NO: 2355411 - RNA, 17 nt, Bordetella pertussis
ccagcacgccgcgcucg

SEQ ID NO: 2355412 - RNA, 12 nt, Bordetella pertussis
ccagcacgccgg

SEQ ID NO: 2355413 - RNA, 13 nt, Bordetella pertussis
ccagcacgccggc

SEQ ID NO: 2355414 - RNA, 17 nt, Bordetella pertussis
ccagcacgccggccagg

SEQ ID NO: 2355415 - RNA, 21 nt, Bordetella pertussis
ccagcacgccggccaggucgg

SEQ ID NO: 2355416 - RNA, 22 nt, Bordetella pertussis
ccagcacgccggcgggcaggcu

SEQ ID NO: 2355417 - RNA, 14 nt, Bordetella pertussis
ccagcacgcgcgcc

SEQ ID NO: 2355418 - RNA, 17 nt, Bordetella pertussis
ccagcacgcgcgccagc

SEQ ID NO: 2355419 - RNA, 20 nt, Bordetella pertussis
ccagcacgcgcgccagcugg

SEQ ID NO: 2355420 - RNA, 21 nt, Bordetella pertussis
ccagcacgcgcgccagcuggg

SEQ ID NO: 2355421 - RNA, 12 nt, Bordetella pertussis
ccagcacgcggc

SEQ ID NO: 2355422 - RNA, 14 nt, Bordetella pertussis
ccagcacgcggcgc

SEQ ID NO: 2355423 - RNA, 16 nt, Bordetella pertussis
ccagcacgcggcgcag

SEQ ID NO: 2355424 - RNA, 17 nt, Bordetella pertussis
ccagcacgcggcgcagc

SEQ ID NO: 2355425 - RNA, 15 nt, Bordetella pertussis
ccagcacggccgcgg

SEQ ID NO: 2355426 - RNA, 20 nt, Bordetella pertussis
ccagcacggccgcggccggc

SEQ ID NO: 2355427 - RNA, 16 nt, Bordetella pertussis
ccagcacggcgcacac

SEQ ID NO: 2355428 - RNA, 20 nt, Bordetella pertussis
ccagcacggcgcacaccauc

SEQ ID NO: 2355429 - RNA, 12 nt, Bordetella pertussis
ccagcacggugg

SEQ ID NO: 2355430 - RNA, 15 nt, Bordetella pertussis
ccagcacgguggcgc

SEQ ID NO: 2355431 - RNA, 19 nt, Bordetella pertussis
ccagcacgguggcgcccgg

SEQ ID NO: 2355432 - RNA, 23 nt, Bordetella pertussis
ccagcacgguggcgcccggcggc

SEQ ID NO: 2355433 - RNA, 20 nt, Bordetella pertussis
ccagcagaaugccgcccacg

SEQ ID NO: 2355434 - RNA, 20 nt, Bordetella pertussis
ccagcagauaccggcauggc

SEQ ID NO: 2355435 - RNA, 21 nt, Bordetella pertussis
ccagcagauaccggcauggca

SEQ ID NO: 2355436 - RNA, 14 nt, Bordetella pertussis
ccagcagaucgcgg

SEQ ID NO: 2355437 - RNA, 22 nt, Bordetella pertussis
ccagcagcacgaucgcggcgcu

SEQ ID NO: 2355438 - RNA, 16 nt, Bordetella pertussis
ccagcagcacgcccag

SEQ ID NO: 2355439 - RNA, 23 nt, Bordetella pertussis
ccagcagcagcgagcccgccauc

SEQ ID NO: 2355440 - RNA, 13 nt, Bordetella pertussis
ccagcagcagcgc

SEQ ID NO: 2355441 - RNA, 15 nt, Bordetella pertussis
ccagcagcagcgccg

SEQ ID NO: 2355442 - RNA, 16 nt, Bordetella pertussis
ccagcagcagcgccgc

SEQ ID NO: 2355443 - RNA, 18 nt, Bordetella pertussis
ccagcagcagcgccgcgc

SEQ ID NO: 2355444 - RNA, 19 nt, Bordetella pertussis
ccagcagcagcgccgcgcc

SEQ ID NO: 2355445 - RNA, 14 nt, Bordetella pertussis
ccagcagcaggccg

SEQ ID NO: 2355446 - RNA, 14 nt, Bordetella pertussis
ccagcagcaugccg

SEQ ID NO: 2355447 - RNA, 16 nt, Bordetella pertussis
ccagcagcaugccgcg

SEQ ID NO: 2355448 - RNA, 12 nt, Bordetella pertussis
ccagcagcaugg

SEQ ID NO: 2355449 - RNA, 20 nt, Bordetella pertussis
ccagcagcgacggccccagc

SEQ ID NO: 2355450 - RNA, 15 nt, Bordetella pertussis
ccagcagcgcaucgc

SEQ ID NO: 2355451 - RNA, 20 nt, Bordetella pertussis
ccagcagcgcaucgcgcgcg

SEQ ID NO: 2355452 - RNA, 14 nt, Bordetella pertussis
ccagcagcgccacc

SEQ ID NO: 2355453 - RNA, 19 nt, Bordetella pertussis
ccagcagcgccaccguggc

SEQ ID NO: 2355454 - RNA, 12 nt, Bordetella pertussis
ccagcagcgccg

SEQ ID NO: 2355455 - RNA, 13 nt, Bordetella pertussis
ccagcagcgccgc

SEQ ID NO: 2355456 - RNA, 14 nt, Bordetella pertussis
ccagcagcgccgcc

SEQ ID NO: 2355457 - RNA, 15 nt, Bordetella pertussis
ccagcagcgccgcca

SEQ ID NO: 2355458 - RNA, 18 nt, Bordetella pertussis
ccagcagcgccggaaagc

SEQ ID NO: 2355459 - RNA, 22 nt, Bordetella pertussis
ccagcagcgccgguucgacgcu

SEQ ID NO: 2355460 - RNA, 15 nt, Bordetella pertussis
ccagcagcgccuggg

SEQ ID NO: 2355461 - RNA, 13 nt, Bordetella pertussis
ccagcagcggcag

SEQ ID NO: 2355462 - RNA, 14 nt, Bordetella pertussis
ccagcagcggcagc

SEQ ID NO: 2355463 - RNA, 17 nt, Bordetella pertussis
ccagcagcggcagcagc

SEQ ID NO: 2355464 - RNA, 17 nt, Bordetella pertussis
ccagcagcggcaggucg

SEQ ID NO: 2355465 - RNA, 15 nt, Bordetella pertussis
ccagcagcgggcugg

SEQ ID NO: 2355466 - RNA, 16 nt, Bordetella pertussis
ccagcagcgggcuggg

SEQ ID NO: 2355467 - RNA, 19 nt, Bordetella pertussis
ccagcagcgggcuggggca

SEQ ID NO: 2355468 - RNA, 19 nt, Bordetella pertussis
ccagcagcggguugcgcgc

SEQ ID NO: 2355469 - RNA, 13 nt, Bordetella pertussis
ccagcagcgugau

SEQ ID NO: 2355470 - RNA, 20 nt, Bordetella pertussis
ccagcagcgugaugccgucg

SEQ ID NO: 2355471 - RNA, 12 nt, Bordetella pertussis
ccagcagcgugg

SEQ ID NO: 2355472 - RNA, 20 nt, Bordetella pertussis
ccagcagcuccucggccugc

SEQ ID NO: 2355473 - RNA, 13 nt, Bordetella pertussis
ccagcagcucggc

SEQ ID NO: 2355474 - RNA, 15 nt, Bordetella pertussis
ccagcagcucggcca

SEQ ID NO: 2355475 - RNA, 17 nt, Bordetella pertussis
ccagcagcucggccacc

SEQ ID NO: 2355476 - RNA, 20 nt, Bordetella pertussis
ccagcagcucggccaccgcc

SEQ ID NO: 2355477 - RNA, 23 nt, Bordetella pertussis
ccagcagcucggcgaccaggccc

SEQ ID NO: 2355478 - RNA, 17 nt, Bordetella pertussis
ccagcagcuggcgcagc

SEQ ID NO: 2355479 - RNA, 18 nt, Bordetella pertussis
ccagcagcuggcgcagca

SEQ ID NO: 2355480 - RNA, 14 nt, Bordetella pertussis
ccagcaggagcccg

SEQ ID NO: 2355481 - RNA, 12 nt, Bordetella pertussis
ccagcaggccca

SEQ ID NO: 2355482 - RNA, 19 nt, Bordetella pertussis
ccagcaggcccaccagggc

SEQ ID NO: 2355483 - RNA, 16 nt, Bordetella pertussis
ccagcaggcccugggc

SEQ ID NO: 2355484 - RNA, 21 nt, Bordetella pertussis
ccagcaggcccugggccagca

SEQ ID NO: 2355485 - RNA, 13 nt, Bordetella pertussis
ccagcaggccggu

SEQ ID NO: 2355486 - RNA, 21 nt, Bordetella pertussis
ccagcaggcgaaacgccagcc

SEQ ID NO: 2355487 - RNA, 21 nt, Bordetella pertussis
ccagcaggcgcuggucgucgc

SEQ ID NO: 2355488 - RNA, 14 nt, Bordetella pertussis
ccagcaggcggccg

SEQ ID NO: 2355489 - RNA, 15 nt, Bordetella pertussis
ccagcagggcggcgu

SEQ ID NO: 2355490 - RNA, 17 nt, Bordetella pertussis
ccagcagggucagcggc

SEQ ID NO: 2355491 - RNA, 18 nt, Bordetella pertussis
ccagcagggucagcggcc

SEQ ID NO: 2355492 - RNA, 19 nt, Bordetella pertussis
ccagcagggucagcggccg

SEQ ID NO: 2355493 - RNA, 21 nt, Bordetella pertussis
ccagcagggucagcggccggc

SEQ ID NO: 2355494 - RNA, 17 nt, Bordetella pertussis
ccagcagggucugcagg

SEQ ID NO: 2355495 - RNA, 14 nt, Bordetella pertussis
ccagcaggucgcgc

SEQ ID NO: 2355496 - RNA, 14 nt, Bordetella pertussis
ccagcagguggcgc

SEQ ID NO: 2355497 - RNA, 19 nt, Bordetella pertussis
ccagcaguguuucggccug

SEQ ID NO: 2355498 - RNA, 23 nt, Bordetella pertussis
ccagcaguguuucggccugcucg

SEQ ID NO: 2355499 - RNA, 22 nt, Bordetella pertussis
ccagcaguucgggguccagcaa

SEQ ID NO: 2355500 - RNA, 21 nt, Bordetella pertussis
ccagcaguugcgccaguucgg

SEQ ID NO: 2355501 - RNA, 18 nt, Bordetella pertussis
ccagcauacccugcgcgc

SEQ ID NO: 2355502 - RNA, 22 nt, Bordetella pertussis
ccagcauacccugcgcgccgcc

SEQ ID NO: 2355503 - RNA, 15 nt, Bordetella pertussis
ccagcaucaccagcu

SEQ ID NO: 2355504 - RNA, 21 nt, Bordetella pertussis
ccagcaucaccagcucgcggc

SEQ ID NO: 2355505 - RNA, 13 nt, Bordetella pertussis
ccagcaucaggcc

SEQ ID NO: 2355506 - RNA, 21 nt, Bordetella pertussis
ccagcauccgcgccaggaugg

SEQ ID NO: 2355507 - RNA, 18 nt, Bordetella pertussis
ccagcaucgccgccagcu

SEQ ID NO: 2355508 - RNA, 15 nt, Bordetella pertussis
ccagcaucgcgccuu

SEQ ID NO: 2355509 - RNA, 19 nt, Bordetella pertussis
ccagcaucggcacccagcc

SEQ ID NO: 2355510 - RNA, 20 nt, Bordetella pertussis
ccagcaucggcacccagccg

SEQ ID NO: 2355511 - RNA, 21 nt, Bordetella pertussis
ccagcaucggcacccagccgg

SEQ ID NO: 2355512 - RNA, 22 nt, Bordetella pertussis
ccagcaucggcacccagccgga

SEQ ID NO: 2355513 - RNA, 23 nt, Bordetella pertussis
ccagcaugaucaugccgcugccc

SEQ ID NO: 2355514 - RNA, 13 nt, Bordetella pertussis
ccagccggccgcc

SEQ ID NO: 2355515 - RNA, 13 nt, Bordetella pertussis
ccagccggcgcgc

SEQ ID NO: 2355516 - RNA, 12 nt, Bordetella pertussis
ccagccggcggc

SEQ ID NO: 2355517 - RNA, 16 nt, Bordetella pertussis
ccagccggcggcaugc

SEQ ID NO: 2355518 - RNA, 22 nt, Bordetella pertussis
ccagccggcggcaugcgccagc

SEQ ID NO: 2355519 - RNA, 19 nt, Bordetella pertussis
ccagccggcggccagcuug

SEQ ID NO: 2355520 - RNA, 18 nt, Bordetella pertussis
ccagccgggucggcugau

SEQ ID NO: 2355521 - RNA, 23 nt, Bordetella pertussis
ccagccgggucggcugaugcccu

SEQ ID NO: 2355522 - RNA, 20 nt, Bordetella pertussis
ccagccggguggucgcgccc

SEQ ID NO: 2355523 - RNA, 22 nt, Bordetella pertussis
ccagccggguggucgcgcccgc

SEQ ID NO: 2355524 - RNA, 16 nt, Bordetella pertussis
ccagccggugcgcggc

SEQ ID NO: 2355525 - RNA, 13 nt, Bordetella pertussis
ccagccgucgcgc

SEQ ID NO: 2355526 - RNA, 15 nt, Bordetella pertussis
ccagccgucgcgcug

SEQ ID NO: 2355527 - RNA, 13 nt, Bordetella pertussis
ccagccgucggca

SEQ ID NO: 2355528 - RNA, 18 nt, Bordetella pertussis
ccagccgucggcaugggu

SEQ ID NO: 2355529 - RNA, 21 nt, Bordetella pertussis
ccagccguucaucagcgcgcg

SEQ ID NO: 2355530 - RNA, 15 nt, Bordetella pertussis
ccagccguuggcgcc

SEQ ID NO: 2355531 - RNA, 16 nt, Bordetella pertussis
ccagccguuggcgccc

SEQ ID NO: 2355532 - RNA, 19 nt, Bordetella pertussis
ccagccguuggcgcccagc

SEQ ID NO: 2355533 - RNA, 14 nt, Bordetella pertussis
ccagccugcccggg

SEQ ID NO: 2355534 - RNA, 15 nt, Bordetella pertussis
ccagccugcccgggc

SEQ ID NO: 2355535 - RNA, 18 nt, Bordetella pertussis
ccagccugcccgggcagc

SEQ ID NO: 2355536 - RNA, 14 nt, Bordetella pertussis
ccagccugcccguc

SEQ ID NO: 2355537 - RNA, 16 nt, Bordetella pertussis
ccagccugccgcggcc

SEQ ID NO: 2355538 - RNA, 18 nt, Bordetella pertussis
ccagccugccgcggccgc

SEQ ID NO: 2355539 - RNA, 16 nt, Bordetella pertussis
ccagccugccggcggc

SEQ ID NO: 2355540 - RNA, 12 nt, Bordetella pertussis
ccagccuggccu

SEQ ID NO: 2355541 - RNA, 13 nt, Bordetella pertussis
ccagccuggccuu

SEQ ID NO: 2355542 - RNA, 16 nt, Bordetella pertussis
ccagccuggcgccaac

SEQ ID NO: 2355543 - RNA, 22 nt, Bordetella pertussis
ccagccuggcgccaacccgcca

SEQ ID NO: 2355544 - RNA, 12 nt, Bordetella pertussis
ccagccugugcg

SEQ ID NO: 2355545 - RNA, 23 nt, Bordetella pertussis
ccagccuuggcccacucaugcgc

SEQ ID NO: 2355546 - RNA, 23 nt, Bordetella pertussis
ccagcgaaccgaaaugccgcagc

SEQ ID NO: 2355547 - RNA, 20 nt, Bordetella pertussis
ccagcgacuccggccgggcc

SEQ ID NO: 2355548 - RNA, 18 nt, Bordetella pertussis
ccagcgagaccuugugcg

SEQ ID NO: 2355549 - RNA, 17 nt, Bordetella pertussis
ccagcgagccggccagc

SEQ ID NO: 2355550 - RNA, 15 nt, Bordetella pertussis
ccagcgagcugguga

SEQ ID NO: 2355551 - RNA, 15 nt, Bordetella pertussis
ccagcgaggccgcuu

SEQ ID NO: 2355552 - RNA, 22 nt, Bordetella pertussis
ccagcgaggccgcuucgugcgg

SEQ ID NO: 2355553 - RNA, 18 nt, Bordetella pertussis
ccagcgagucgaccaguu

SEQ ID NO: 2355554 - RNA, 20 nt, Bordetella pertussis
ccagcgaguuguccuggccg

SEQ ID NO: 2355555 - RNA, 16 nt, Bordetella pertussis
ccagcgauacccgcuu

SEQ ID NO: 2355556 - RNA, 22 nt, Bordetella pertussis
ccagcgauacccgcuucgacgg

SEQ ID NO: 2355557 - RNA, 23 nt, Bordetella pertussis
ccagcgauacccgcuucgacggc

SEQ ID NO: 2355558 - RNA, 13 nt, Bordetella pertussis
ccagcgcacgcag

SEQ ID NO: 2355559 - RNA, 15 nt, Bordetella pertussis
ccagcgcacgcagcg

SEQ ID NO: 2355560 - RNA, 19 nt, Bordetella pertussis
ccagcgcacguugagaucc

SEQ ID NO: 2355561 - RNA, 18 nt, Bordetella pertussis
ccagcgcacugagaaagg

SEQ ID NO: 2355562 - RNA, 17 nt, Bordetella pertussis
ccagcgcauaggacgcc

SEQ ID NO: 2355563 - RNA, 17 nt, Bordetella pertussis
ccagcgcauugccgccg

SEQ ID NO: 2355564 - RNA, 18 nt, Bordetella pertussis
ccagcgcauugccgccgc

SEQ ID NO: 2355565 - RNA, 21 nt, Bordetella pertussis
ccagcgcauugccgccgcccu

SEQ ID NO: 2355566 - RNA, 20 nt, Bordetella pertussis
ccagcgcauuggugagcacg

SEQ ID NO: 2355567 - RNA, 18 nt, Bordetella pertussis
ccagcgccaccaccggca

SEQ ID NO: 2355568 - RNA, 23 nt, Bordetella pertussis
ccagcgccaccaccggcacgccg

SEQ ID NO: 2355569 - RNA, 13 nt, Bordetella pertussis
ccagcgccaccag

SEQ ID NO: 2355570 - RNA, 17 nt, Bordetella pertussis
ccagcgccaccagcagc

SEQ ID NO: 2355571 - RNA, 20 nt, Bordetella pertussis
ccagcgccaccagcagcgcc

SEQ ID NO: 2355572 - RNA, 20 nt, Bordetella pertussis
ccagcgccacgcccaggccg

SEQ ID NO: 2355573 - RNA, 17 nt, Bordetella pertussis
ccagcgccacgccggcc

SEQ ID NO: 2355574 - RNA, 12 nt, Bordetella pertussis
ccagcgccagca

SEQ ID NO: 2355575 - RNA, 13 nt, Bordetella pertussis
ccagcgccagcac

SEQ ID NO: 2355576 - RNA, 17 nt, Bordetella pertussis
ccagcgccagcaccggc

SEQ ID NO: 2355577 - RNA, 22 nt, Bordetella pertussis
ccagcgccagcaccggcacgcg

SEQ ID NO: 2355578 - RNA, 15 nt, Bordetella pertussis
ccagcgccagcagca

SEQ ID NO: 2355579 - RNA, 14 nt, Bordetella pertussis
ccagcgccagcagg

SEQ ID NO: 2355580 - RNA, 15 nt, Bordetella pertussis
ccagcgccagcaggg

SEQ ID NO: 2355581 - RNA, 13 nt, Bordetella pertussis
ccagcgccagccg

SEQ ID NO: 2355582 - RNA, 13 nt, Bordetella pertussis
ccagcgccagcgu

SEQ ID NO: 2355583 - RNA, 22 nt, Bordetella pertussis
ccagcgccaggaacagcgccgg

SEQ ID NO: 2355584 - RNA, 16 nt, Bordetella pertussis
ccagcgccaggccgcg

SEQ ID NO: 2355585 - RNA, 15 nt, Bordetella pertussis
ccagcgccagggccg

SEQ ID NO: 2355586 - RNA, 19 nt, Bordetella pertussis
ccagcgccagggccgccgc

SEQ ID NO: 2355587 - RNA, 14 nt, Bordetella pertussis
ccagcgccaguccg

SEQ ID NO: 2355588 - RNA, 17 nt, Bordetella pertussis
ccagcgccaguccgcgc

SEQ ID NO: 2355589 - RNA, 15 nt, Bordetella pertussis
ccagcgccaucaaga

SEQ ID NO: 2355590 - RNA, 12 nt, Bordetella pertussis
ccagcgccaucg

SEQ ID NO: 2355591 - RNA, 21 nt, Bordetella pertussis
ccagcgccaugaugucgcgcg

SEQ ID NO: 2355592 - RNA, 16 nt, Bordetella pertussis
ccagcgcccaggcgau

SEQ ID NO: 2355593 - RNA, 11 nt, Bordetella pertussis
ccagcgcccga

SEQ ID NO: 2355594 - RNA, 13 nt, Bordetella pertussis
ccagcgcccgcgg

SEQ ID NO: 2355595 - RNA, 21 nt, Bordetella pertussis
ccagcgccgcagcgucgcggc

SEQ ID NO: 2355596 - RNA, 13 nt, Bordetella pertussis
ccagcgccgccag

SEQ ID NO: 2355597 - RNA, 15 nt, Bordetella pertussis
ccagcgccgccagcc

SEQ ID NO: 2355598 - RNA, 21 nt, Bordetella pertussis
ccagcgccgccaucauggcgu

SEQ ID NO: 2355599 - RNA, 21 nt, Bordetella pertussis
ccagcgccgccauggcggcgc

SEQ ID NO: 2355600 - RNA, 14 nt, Bordetella pertussis
ccagcgccgccgac

SEQ ID NO: 2355601 - RNA, 18 nt, Bordetella pertussis
ccagcgccgccgacggca

SEQ ID NO: 2355602 - RNA, 12 nt, Bordetella pertussis
ccagcgccgccu

SEQ ID NO: 2355603 - RNA, 21 nt, Bordetella pertussis
ccagcgccgccuucaccggcc

SEQ ID NO: 2355604 - RNA, 23 nt, Bordetella pertussis
ccagcgccgccuucaccggcccc

SEQ ID NO: 2355605 - RNA, 11 nt, Bordetella pertussis
ccagcgccgcg

SEQ ID NO: 2355606 - RNA, 21 nt, Bordetella pertussis
ccagcgccgcgaacuggcggu

SEQ ID NO: 2355607 - RNA, 20 nt, Bordetella pertussis
ccagcgccgcgagcgccgaa

SEQ ID NO: 2355608 - RNA, 14 nt, Bordetella pertussis
ccagcgccgcgccg

SEQ ID NO: 2355609 - RNA, 15 nt, Bordetella pertussis
ccagcgccgcgcgcg

SEQ ID NO: 2355610 - RNA, 13 nt, Bordetella pertussis
ccagcgccgcggc

SEQ ID NO: 2355611 - RNA, 14 nt, Bordetella pertussis
ccagcgccgcggcc

SEQ ID NO: 2355612 - RNA, 15 nt, Bordetella pertussis
ccagcgccgcggccg

SEQ ID NO: 2355613 - RNA, 18 nt, Bordetella pertussis
ccagcgccgcggccggcg

SEQ ID NO: 2355614 - RNA, 19 nt, Bordetella pertussis
ccagcgccgcgucgagcgc

SEQ ID NO: 2355615 - RNA, 23 nt, Bordetella pertussis
ccagcgccgcgucgagcgcgacg

SEQ ID NO: 2355616 - RNA, 13 nt, Bordetella pertussis
ccagcgccggcac

SEQ ID NO: 2355617 - RNA, 16 nt, Bordetella pertussis
ccagcgccggcacgcu

SEQ ID NO: 2355618 - RNA, 15 nt, Bordetella pertussis
ccagcgccggcagcc

SEQ ID NO: 2355619 - RNA, 14 nt, Bordetella pertussis
ccagcgccggcgca

SEQ ID NO: 2355620 - RNA, 15 nt, Bordetella pertussis
ccagcgccggcgcgc

SEQ ID NO: 2355621 - RNA, 16 nt, Bordetella pertussis
ccagcgccggcgcgcg

SEQ ID NO: 2355622 - RNA, 18 nt, Bordetella pertussis
ccagcgccgucagcagcg

SEQ ID NO: 2355623 - RNA, 14 nt, Bordetella pertussis
ccagcgccucgcgc

SEQ ID NO: 2355624 - RNA, 17 nt, Bordetella pertussis
ccagcgccucgucgcgc

SEQ ID NO: 2355625 - RNA, 13 nt, Bordetella pertussis
ccagcgccugcgc

SEQ ID NO: 2355626 - RNA, 17 nt, Bordetella pertussis
ccagcgccugcgcggcc

SEQ ID NO: 2355627 - RNA, 11 nt, Bordetella pertussis
ccagcgccugg

SEQ ID NO: 2355628 - RNA, 13 nt, Bordetella pertussis
ccagcggcgagca

SEQ ID NO: 2355629 - RNA, 13 nt, Bordetella pertussis
ccagcggcgcacc

SEQ ID NO: 2355630 - RNA, 19 nt, Bordetella pertussis
ccagcggcgcaccgacagc

SEQ ID NO: 2355631 - RNA, 23 nt, Bordetella pertussis
ccagcggcgcaccgacagcaagg

SEQ ID NO: 2355632 - RNA, 12 nt, Bordetella pertussis
ccagcggcgcca

SEQ ID NO: 2355633 - RNA, 15 nt, Bordetella pertussis
ccagcggcgccagcg

SEQ ID NO: 2355634 - RNA, 15 nt, Bordetella pertussis
ccagcggcgccgacc

SEQ ID NO: 2355635 - RNA, 14 nt, Bordetella pertussis
ccagcggcgccgga

SEQ ID NO: 2355636 - RNA, 14 nt, Bordetella pertussis
ccagcggcgcgacg

SEQ ID NO: 2355637 - RNA, 16 nt, Bordetella pertussis
ccagcggcgcgacgcg

SEQ ID NO: 2355638 - RNA, 19 nt, Bordetella pertussis
ccagcggcgcggcgcgcug

SEQ ID NO: 2355639 - RNA, 20 nt, Bordetella pertussis
ccagcggcgcggcgcgcugg

SEQ ID NO: 2355640 - RNA, 20 nt, Bordetella pertussis
ccagcggcguauaggccacc

SEQ ID NO: 2355641 - RNA, 13 nt, Bordetella pertussis
ccagcggcgugau

SEQ ID NO: 2355642 - RNA, 20 nt, Bordetella pertussis
ccagcggcgugaugcccagg

SEQ ID NO: 2355643 - RNA, 21 nt, Bordetella pertussis
ccagcggcgugaugcccaggc

SEQ ID NO: 2355644 - RNA, 23 nt, Bordetella pertussis
ccagcggcgugaugcccaggccc

SEQ ID NO: 2355645 - RNA, 13 nt, Bordetella pertussis
ccagcggcgugcg

SEQ ID NO: 2355646 - RNA, 19 nt, Bordetella pertussis
ccagcggcgugcggcccag

SEQ ID NO: 2355647 - RNA, 19 nt, Bordetella pertussis
ccagcggcguggcggccag

SEQ ID NO: 2355648 - RNA, 20 nt, Bordetella pertussis
ccagcggcguggcggccagg

SEQ ID NO: 2355649 - RNA, 15 nt, Bordetella pertussis
ccagcggcugcuuga

SEQ ID NO: 2355650 - RNA, 12 nt, Bordetella pertussis
ccagcggcuggc

SEQ ID NO: 2355651 - RNA, 15 nt, Bordetella pertussis
ccagcggcuggccac

SEQ ID NO: 2355652 - RNA, 15 nt, Bordetella pertussis
ccagcggcuggcgca

SEQ ID NO: 2355653 - RNA, 16 nt, Bordetella pertussis
ccagcggcuggcgcac

SEQ ID NO: 2355654 - RNA, 16 nt, Bordetella pertussis
ccagcggcuggcgccg

SEQ ID NO: 2355655 - RNA, 17 nt, Bordetella pertussis
ccagcgggagccugucc

SEQ ID NO: 2355656 - RNA, 22 nt, Bordetella pertussis
ccagcgggagccuguccccgcg

SEQ ID NO: 2355657 - RNA, 13 nt, Bordetella pertussis
ccagcggggacag

SEQ ID NO: 2355658 - RNA, 17 nt, Bordetella pertussis
ccagcggggacaggcac

SEQ ID NO: 2355659 - RNA, 21 nt, Bordetella pertussis
ccagcggggccgugacgugcu

SEQ ID NO: 2355660 - RNA, 23 nt, Bordetella pertussis
ccagcggggccgugacgugcuug

SEQ ID NO: 2355661 - RNA, 15 nt, Bordetella pertussis
ccagcggugcgcggc

SEQ ID NO: 2355662 - RNA, 16 nt, Bordetella pertussis
ccagcggugcgcggcg

SEQ ID NO: 2355663 - RNA, 17 nt, Bordetella pertussis
ccagcggugcgcggcgc

SEQ ID NO: 2355664 - RNA, 21 nt, Bordetella pertussis
ccagcggugcgcggcgcagcc

SEQ ID NO: 2355665 - RNA, 18 nt, Bordetella pertussis
ccagcgguugcgccagcu

SEQ ID NO: 2355666 - RNA, 15 nt, Bordetella pertussis
ccagcguaucgccgc

SEQ ID NO: 2355667 - RNA, 22 nt, Bordetella pertussis
ccagcguaucgccgccgccggc

SEQ ID NO: 2355668 - RNA, 20 nt, Bordetella pertussis
ccagcgucaccagcaggcgg

SEQ ID NO: 2355669 - RNA, 22 nt, Bordetella pertussis
ccagcgucagcacaucgcccgg

SEQ ID NO: 2355670 - RNA, 18 nt, Bordetella pertussis
ccagcgucagcugggcau

SEQ ID NO: 2355671 - RNA, 14 nt, Bordetella pertussis
ccagcgucaugcgc

SEQ ID NO: 2355672 - RNA, 17 nt, Bordetella pertussis
ccagcgucaugcgcacc

SEQ ID NO: 2355673 - RNA, 13 nt, Bordetella pertussis
ccagcgucauggc

SEQ ID NO: 2355674 - RNA, 19 nt, Bordetella pertussis
ccagcgucauggccuggcc

SEQ ID NO: 2355675 - RNA, 20 nt, Bordetella pertussis
ccagcgucauggccuggccc

SEQ ID NO: 2355676 - RNA, 22 nt, Bordetella pertussis
ccagcgucauggccuggcccag

SEQ ID NO: 2355677 - RNA, 14 nt, Bordetella pertussis
ccagcguccaggcg

SEQ ID NO: 2355678 - RNA, 21 nt, Bordetella pertussis
ccagcguccaggcggccaucg

SEQ ID NO: 2355679 - RNA, 13 nt, Bordetella pertussis
ccagcgucggcgu

SEQ ID NO: 2355680 - RNA, 17 nt, Bordetella pertussis
ccagcgucucgaucacg

SEQ ID NO: 2355681 - RNA, 13 nt, Bordetella pertussis
ccagcgugcccag

SEQ ID NO: 2355682 - RNA, 19 nt, Bordetella pertussis
ccagcgugcccagcgagau

SEQ ID NO: 2355683 - RNA, 15 nt, Bordetella pertussis
ccagcguggagcugc

SEQ ID NO: 2355684 - RNA, 17 nt, Bordetella pertussis
ccagcguggagcugcuc

SEQ ID NO: 2355685 - RNA, 14 nt, Bordetella pertussis
ccagcguggcgcag

SEQ ID NO: 2355686 - RNA, 19 nt, Bordetella pertussis
ccagcguguagagcaggcc

SEQ ID NO: 2355687 - RNA, 20 nt, Bordetella pertussis
ccagcguguagagcaggccg

SEQ ID NO: 2355688 - RNA, 21 nt, Bordetella pertussis
ccagcguguagagcaggccgc

SEQ ID NO: 2355689 - RNA, 22 nt, Bordetella pertussis
ccagcguguagagcaggccgcc

SEQ ID NO: 2355690 - RNA, 23 nt, Bordetella pertussis
ccagcguguagagcaggccgccc

SEQ ID NO: 2355691 - RNA, 18 nt, Bordetella pertussis
ccagcguguaggcggccg

SEQ ID NO: 2355692 - RNA, 19 nt, Bordetella pertussis
ccagcguguaggcggccgg

SEQ ID NO: 2355693 - RNA, 21 nt, Bordetella pertussis
ccagcguguaggcggccggcu

SEQ ID NO: 2355694 - RNA, 21 nt, Bordetella pertussis
ccagcgugucgaacaccaggu

SEQ ID NO: 2355695 - RNA, 23 nt, Bordetella pertussis
ccagcguguggugaaagccgccg

SEQ ID NO: 2355696 - RNA, 14 nt, Bordetella pertussis
ccagcguucggcca

SEQ ID NO: 2355697 - RNA, 20 nt, Bordetella pertussis
ccagcguucggccacccggc

SEQ ID NO: 2355698 - RNA, 23 nt, Bordetella pertussis
ccagcguucggccacccggccca

SEQ ID NO: 2355699 - RNA, 14 nt, Bordetella pertussis
ccagcucagcagcg

SEQ ID NO: 2355700 - RNA, 16 nt, Bordetella pertussis
ccagcucagcagcgcc

SEQ ID NO: 2355701 - RNA, 19 nt, Bordetella pertussis
ccagcucagcagcgccagg

SEQ ID NO: 2355702 - RNA, 21 nt, Bordetella pertussis
ccagcucagcagcgccagggc

SEQ ID NO: 2355703 - RNA, 13 nt, Bordetella pertussis
ccagcucagcgga

SEQ ID NO: 2355704 - RNA, 13 nt, Bordetella pertussis
ccagcucagcuug

SEQ ID NO: 2355705 - RNA, 15 nt, Bordetella pertussis
ccagcuccaccgggc

SEQ ID NO: 2355706 - RNA, 13 nt, Bordetella pertussis
ccagcuccagccg

SEQ ID NO: 2355707 - RNA, 12 nt, Bordetella pertussis
ccagcuccagcg

SEQ ID NO: 2355708 - RNA, 13 nt, Bordetella pertussis
ccagcuccagcgc

SEQ ID NO: 2355709 - RNA, 17 nt, Bordetella pertussis
ccagcuccagcgcgccg

SEQ ID NO: 2355710 - RNA, 14 nt, Bordetella pertussis
ccagcuccagcugg

SEQ ID NO: 2355711 - RNA, 17 nt, Bordetella pertussis
ccagcuccaggugccag

SEQ ID NO: 2355712 - RNA, 18 nt, Bordetella pertussis
ccagcuccccgggcguga

SEQ ID NO: 2355713 - RNA, 17 nt, Bordetella pertussis
ccagcuccggcggcagc

SEQ ID NO: 2355714 - RNA, 23 nt, Bordetella pertussis
ccagcuccggcggcagcgcgaac

SEQ ID NO: 2355715 - RNA, 20 nt, Bordetella pertussis
ccagcucgacgccaucucgc

SEQ ID NO: 2355716 - RNA, 20 nt, Bordetella pertussis
ccagcucgcgcagcaggccg

SEQ ID NO: 2355717 - RNA, 15 nt, Bordetella pertussis
ccagcucgcggcccu

SEQ ID NO: 2355718 - RNA, 20 nt, Bordetella pertussis
ccagcucggccugcggcucg

SEQ ID NO: 2355719 - RNA, 16 nt, Bordetella pertussis
ccagcucggcggccgc

SEQ ID NO: 2355720 - RNA, 19 nt, Bordetella pertussis
ccagcucggcggccgccug

SEQ ID NO: 2355721 - RNA, 20 nt, Bordetella pertussis
ccagcucggcggccgccugc

SEQ ID NO: 2355722 - RNA, 22 nt, Bordetella pertussis
ccagcucgguggucaacggcaa

SEQ ID NO: 2355723 - RNA, 21 nt, Bordetella pertussis
ccagcucguccagguugcccg

SEQ ID NO: 2355724 - RNA, 16 nt, Bordetella pertussis
ccagcucugcucuguc

SEQ ID NO: 2355725 - RNA, 20 nt, Bordetella pertussis
ccagcucugguccaggcggu

SEQ ID NO: 2355726 - RNA, 17 nt, Bordetella pertussis
ccagcucuucgagcgcg

SEQ ID NO: 2355727 - RNA, 20 nt, Bordetella pertussis
ccagcucuucgagcgcggcg

SEQ ID NO: 2355728 - RNA, 21 nt, Bordetella pertussis
ccagcucuucgagcgcggcgc

SEQ ID NO: 2355729 - RNA, 22 nt, Bordetella pertussis
ccagcugaccucgcccaggccg

SEQ ID NO: 2355730 - RNA, 11 nt, Bordetella pertussis
ccagcugcagu

SEQ ID NO: 2355731 - RNA, 16 nt, Bordetella pertussis
ccagcugcaguaugca

SEQ ID NO: 2355732 - RNA, 16 nt, Bordetella pertussis
ccagcugcaugcgcac

SEQ ID NO: 2355733 - RNA, 22 nt, Bordetella pertussis
ccagcugcaugcgcacggacag

SEQ ID NO: 2355734 - RNA, 14 nt, Bordetella pertussis
ccagcugcgcagcg

SEQ ID NO: 2355735 - RNA, 13 nt, Bordetella pertussis
ccagcugcgcccc

SEQ ID NO: 2355736 - RNA, 14 nt, Bordetella pertussis
ccagcugcgccccc

SEQ ID NO: 2355737 - RNA, 13 nt, Bordetella pertussis
ccagcugcgcgcg

SEQ ID NO: 2355738 - RNA, 14 nt, Bordetella pertussis
ccagcugcgcgcga

SEQ ID NO: 2355739 - RNA, 20 nt, Bordetella pertussis
ccagcugcgcgcgagcggcg

SEQ ID NO: 2355740 - RNA, 14 nt, Bordetella pertussis
ccagcugcuucagu

SEQ ID NO: 2355741 - RNA, 21 nt, Bordetella pertussis
ccaggcccaccgcaucgcgca

SEQ ID NO: 2355742 - RNA, 16 nt, Bordetella pertussis
ccaggcccacgccgcg

SEQ ID NO: 2355743 - RNA, 12 nt, Bordetella pertussis
ccaggcccagca

SEQ ID NO: 2355744 - RNA, 13 nt, Bordetella pertussis
ccaggcccagcgc

SEQ ID NO: 2355745 - RNA, 17 nt, Bordetella pertussis
ccaggcccagcgcgcca

SEQ ID NO: 2355746 - RNA, 12 nt, Bordetella pertussis
ccaggcccaggg

SEQ ID NO: 2355747 - RNA, 13 nt, Bordetella pertussis
ccaggcccagggc

SEQ ID NO: 2355748 - RNA, 15 nt, Bordetella pertussis
ccaggcccagggcga

SEQ ID NO: 2355749 - RNA, 13 nt, Bordetella pertussis
ccaggcccaguuc

SEQ ID NO: 2355750 - RNA, 14 nt, Bordetella pertussis
ccaggcccaguucg

SEQ ID NO: 2355751 - RNA, 19 nt, Bordetella pertussis
ccaggcccaguugacgaug

SEQ ID NO: 2355752 - RNA, 19 nt, Bordetella pertussis
ccaggcccaugccgcccgc

SEQ ID NO: 2355753 - RNA, 21 nt, Bordetella pertussis
ccaggcccaugccgcccgcca

SEQ ID NO: 2355754 - RNA, 22 nt, Bordetella pertussis
ccaggcccaugccgcccgccau

SEQ ID NO: 2355755 - RNA, 15 nt, Bordetella pertussis
ccaggcccauggcgu

SEQ ID NO: 2355756 - RNA, 13 nt, Bordetella pertussis
ccaggccccgccg

SEQ ID NO: 2355757 - RNA, 15 nt, Bordetella pertussis
ccaggccccgccggg

SEQ ID NO: 2355758 - RNA, 19 nt, Bordetella pertussis
ccaggccccgccgggccgc

SEQ ID NO: 2355759 - RNA, 21 nt, Bordetella pertussis
ccaggcccgaaacgcgcagca

SEQ ID NO: 2355760 - RNA, 22 nt, Bordetella pertussis
ccaggcccgaaacgcgcagcac

SEQ ID NO: 2355761 - RNA, 19 nt, Bordetella pertussis
ccaggcccgccacggcgcc

SEQ ID NO: 2355762 - RNA, 16 nt, Bordetella pertussis
ccaggcccgccagggc

SEQ ID NO: 2355763 - RNA, 12 nt, Bordetella pertussis
ccaggcccggca

SEQ ID NO: 2355764 - RNA, 16 nt, Bordetella pertussis
ccaggcccggccgcag

SEQ ID NO: 2355765 - RNA, 17 nt, Bordetella pertussis
ccaggcccggccgcagg

SEQ ID NO: 2355766 - RNA, 12 nt, Bordetella pertussis
ccaggcccggcg

SEQ ID NO: 2355767 - RNA, 13 nt, Bordetella pertussis
ccaggcccggcgc

SEQ ID NO: 2355768 - RNA, 20 nt, Bordetella pertussis
ccaggcccgugcuccagaac

SEQ ID NO: 2355769 - RNA, 15 nt, Bordetella pertussis
ccaggcccucgcggc

SEQ ID NO: 2355770 - RNA, 14 nt, Bordetella pertussis
ccaggcccugcgcg

SEQ ID NO: 2355771 - RNA, 18 nt, Bordetella pertussis
ccaggcccuggcuggcca

SEQ ID NO: 2355772 - RNA, 20 nt, Bordetella pertussis
ccaggccgaacuucagcccg

SEQ ID NO: 2355773 - RNA, 18 nt, Bordetella pertussis
ccaggccgaagccaccgu

SEQ ID NO: 2355774 - RNA, 20 nt, Bordetella pertussis
ccaggccgaagccaccgucu

SEQ ID NO: 2355775 - RNA, 21 nt, Bordetella pertussis
ccaggccgaugaauugcgcca

SEQ ID NO: 2355776 - RNA, 23 nt, Bordetella pertussis
ccaggccgaugaauugcgccacg

SEQ ID NO: 2355777 - RNA, 16 nt, Bordetella pertussis
ccaggccgaugccgaa

SEQ ID NO: 2355778 - RNA, 16 nt, Bordetella pertussis
ccaggccgauggcguc

SEQ ID NO: 2355779 - RNA, 20 nt, Bordetella pertussis
ccaggccgauggcguccagc

SEQ ID NO: 2355780 - RNA, 18 nt, Bordetella pertussis
ccaggccgauuucggccg

SEQ ID NO: 2355781 - RNA, 21 nt, Bordetella pertussis
ccaggccgauuucggccgccg

SEQ ID NO: 2355782 - RNA, 13 nt, Bordetella pertussis
ccaggccgcccag

SEQ ID NO: 2355783 - RNA, 18 nt, Bordetella pertussis
ccaggccgcccagccgcg

SEQ ID NO: 2355784 - RNA, 19 nt, Bordetella pertussis
ccaggccgcccagccgcgc

SEQ ID NO: 2355785 - RNA, 13 nt, Bordetella pertussis
ccaggccgccggc

SEQ ID NO: 2355786 - RNA, 15 nt, Bordetella pertussis
ccaggccgccggcca

SEQ ID NO: 2355787 - RNA, 14 nt, Bordetella pertussis
ccaggccgccggcg

SEQ ID NO: 2355788 - RNA, 18 nt, Bordetella pertussis
ccaggccgcggcgcccgg

SEQ ID NO: 2355789 - RNA, 14 nt, Bordetella pertussis
ccaggccggccagg

SEQ ID NO: 2355790 - RNA, 12 nt, Bordetella pertussis
ccaggccggccc

SEQ ID NO: 2355791 - RNA, 14 nt, Bordetella pertussis
ccaggccggccugc

SEQ ID NO: 2355792 - RNA, 18 nt, Bordetella pertussis
ccaggccggccugcaggc

SEQ ID NO: 2355793 - RNA, 14 nt, Bordetella pertussis
ccaggccggccuug

SEQ ID NO: 2355794 - RNA, 14 nt, Bordetella pertussis
ccaggccggcgaaa

SEQ ID NO: 2355795 - RNA, 14 nt, Bordetella pertussis
ccaggccggcgcca

SEQ ID NO: 2355796 - RNA, 16 nt, Bordetella pertussis
ccaggccggcgccagc

SEQ ID NO: 2355797 - RNA, 16 nt, Bordetella pertussis
ccaggccggcgcgccg

SEQ ID NO: 2355798 - RNA, 21 nt, Bordetella pertussis
ccaggccggcgcgccggccca

SEQ ID NO: 2355799 - RNA, 17 nt, Bordetella pertussis
ccaggccggcgcgcucg

SEQ ID NO: 2355800 - RNA, 19 nt, Bordetella pertussis
ccaggccggcgcgcucggc

SEQ ID NO: 2355801 - RNA, 13 nt, Bordetella pertussis
ccaggccggcggc

SEQ ID NO: 2355802 - RNA, 16 nt, Bordetella pertussis
ccaggccggcucgccg

SEQ ID NO: 2355803 - RNA, 13 nt, Bordetella pertussis
ccaggccgggcgu

SEQ ID NO: 2355804 - RNA, 13 nt, Bordetella pertussis
ccaggccggggcc

SEQ ID NO: 2355805 - RNA, 14 nt, Bordetella pertussis
ccaggccggggccg

SEQ ID NO: 2355806 - RNA, 16 nt, Bordetella pertussis
ccaggccggggccgcc

SEQ ID NO: 2355807 - RNA, 20 nt, Bordetella pertussis
ccaggccggggccgcccagc

SEQ ID NO: 2355808 - RNA, 18 nt, Bordetella pertussis
ccaggccgguggaccagg

SEQ ID NO: 2355809 - RNA, 22 nt, Bordetella pertussis
ccaggccgucgauuucggguga

SEQ ID NO: 2355810 - RNA, 17 nt, Bordetella pertussis
ccaggccgucggccagg

SEQ ID NO: 2355811 - RNA, 20 nt, Bordetella pertussis
ccaggccgucggccaggggc

SEQ ID NO: 2355812 - RNA, 17 nt, Bordetella pertussis
ccaggccgugagcgccg

SEQ ID NO: 2355813 - RNA, 18 nt, Bordetella pertussis
ccaggccgugagcgccgc

SEQ ID NO: 2355814 - RNA, 20 nt, Bordetella pertussis
ccaggccgugagcgccgccg

SEQ ID NO: 2355815 - RNA, 16 nt, Bordetella pertussis
ccaggccguggcccag

SEQ ID NO: 2355816 - RNA, 17 nt, Bordetella pertussis
ccaggccguggcccagc

SEQ ID NO: 2355817 - RNA, 18 nt, Bordetella pertussis
ccaggccguggcccagcc

SEQ ID NO: 2355818 - RNA, 19 nt, Bordetella pertussis
ccaggccguggcccagccg

SEQ ID NO: 2355819 - RNA, 23 nt, Bordetella pertussis
ccaggccucggcuugcagguuga

SEQ ID NO: 2355820 - RNA, 14 nt, Bordetella pertussis
ccaggccucggucg

SEQ ID NO: 2355821 - RNA, 15 nt, Bordetella pertussis
ccaggccugccugau

SEQ ID NO: 2355822 - RNA, 23 nt, Bordetella pertussis
ccaggccugcgggugcgccugca

SEQ ID NO: 2355823 - RNA, 16 nt, Bordetella pertussis
ccaggccuucgacguc

SEQ ID NO: 2355824 - RNA, 15 nt, Bordetella pertussis
ccaggcgaaccuggc

SEQ ID NO: 2355825 - RNA, 14 nt, Bordetella pertussis
ccaggcgagcgccg

SEQ ID NO: 2355826 - RNA, 16 nt, Bordetella pertussis
ccaggcgagcgccgcg

SEQ ID NO: 2355827 - RNA, 20 nt, Bordetella pertussis
ccaggcgaggcuggcgccca

SEQ ID NO: 2355828 - RNA, 18 nt, Bordetella pertussis
ccaggcgaugcccagcgc

SEQ ID NO: 2355829 - RNA, 20 nt, Bordetella pertussis
ccaggcgaugcccagcgccg

SEQ ID NO: 2355830 - RNA, 22 nt, Bordetella pertussis
ccaggcgaugcccagcgccgcc

SEQ ID NO: 2355831 - RNA, 23 nt, Bordetella pertussis
ccaggcgaugcccagcgccgccg

SEQ ID NO: 2355832 - RNA, 22 nt, Bordetella pertussis
ccaggcgauggccgggagcggc

SEQ ID NO: 2355833 - RNA, 13 nt, Bordetella pertussis
ccaggcgcaggcg

SEQ ID NO: 2355834 - RNA, 16 nt, Bordetella pertussis
ccaggcgcaggcgcga

SEQ ID NO: 2355835 - RNA, 23 nt, Bordetella pertussis
ccaggcgcauguccgccacgccg

SEQ ID NO: 2355836 - RNA, 18 nt, Bordetella pertussis
ccaggcgccagaugcgcc

SEQ ID NO: 2355837 - RNA, 14 nt, Bordetella pertussis
ccaggcgccccacc

SEQ ID NO: 2355838 - RNA, 21 nt, Bordetella pertussis
ccaggcgccccacccggguac

SEQ ID NO: 2355839 - RNA, 12 nt, Bordetella pertussis
ccaggcgcccgc

SEQ ID NO: 2355840 - RNA, 17 nt, Bordetella pertussis
ccaggcgcccgccacca

SEQ ID NO: 2355841 - RNA, 15 nt, Bordetella pertussis
ccaggcgcccggcgu

SEQ ID NO: 2355842 - RNA, 18 nt, Bordetella pertussis
ccaggcgcccggcgugac

SEQ ID NO: 2355843 - RNA, 15 nt, Bordetella pertussis
ccaggcgccgcacgc

SEQ ID NO: 2355844 - RNA, 17 nt, Bordetella pertussis
ccaggcgccgcacgccg

SEQ ID NO: 2355845 - RNA, 12 nt, Bordetella pertussis
ccaggcgccgcu

SEQ ID NO: 2355846 - RNA, 13 nt, Bordetella pertussis
ccaggcgccggcg

SEQ ID NO: 2355847 - RNA, 15 nt, Bordetella pertussis
ccaggcgccggcggu

SEQ ID NO: 2355848 - RNA, 12 nt, Bordetella pertussis
ccaggcgccggg

SEQ ID NO: 2355849 - RNA, 15 nt, Bordetella pertussis
ccaggcgccgggccg

SEQ ID NO: 2355850 - RNA, 17 nt, Bordetella pertussis
ccaggcgccgggccgcu

SEQ ID NO: 2355851 - RNA, 16 nt, Bordetella pertussis
ccaggcgcgaucgaac

SEQ ID NO: 2355852 - RNA, 12 nt, Bordetella pertussis
ccaggcgcgcaa

SEQ ID NO: 2355853 - RNA, 17 nt, Bordetella pertussis
ccaggcgcgcaucgcgc

SEQ ID NO: 2355854 - RNA, 20 nt, Bordetella pertussis
ccaggcgcgcaucgcgcggc

SEQ ID NO: 2355855 - RNA, 23 nt, Bordetella pertussis
ccagggcggugggcagcgcgucg

SEQ ID NO: 2355856 - RNA, 22 nt, Bordetella pertussis
ccagggcgucggcgacgugaug

SEQ ID NO: 2355857 - RNA, 12 nt, Bordetella pertussis
ccagggcugcgg

SEQ ID NO: 2355858 - RNA, 17 nt, Bordetella pertussis
ccagggcuugacgcgcg

SEQ ID NO: 2355859 - RNA, 17 nt, Bordetella pertussis
ccagggcuugcggcgcu

SEQ ID NO: 2355860 - RNA, 21 nt, Bordetella pertussis
ccagggcuugcggcgcuggcu

SEQ ID NO: 2355861 - RNA, 22 nt, Bordetella pertussis
ccaggggacggcgcacccgcgg

SEQ ID NO: 2355862 - RNA, 21 nt, Bordetella pertussis
ccaggggaugacgggcgagca

SEQ ID NO: 2355863 - RNA, 18 nt, Bordetella pertussis
ccaggggcggcgcggcgc

SEQ ID NO: 2355864 - RNA, 19 nt, Bordetella pertussis
ccaggggcggcgcggcgcu

SEQ ID NO: 2355865 - RNA, 20 nt, Bordetella pertussis
ccagggggucagggccgccc

SEQ ID NO: 2355866 - RNA, 14 nt, Bordetella pertussis
ccagggucaggggc

SEQ ID NO: 2355867 - RNA, 17 nt, Bordetella pertussis
ccagggucaggggcagg

SEQ ID NO: 2355868 - RNA, 14 nt, Bordetella pertussis
ccagggucugcugg

SEQ ID NO: 2355869 - RNA, 17 nt, Bordetella pertussis
ccagggucugcuggucg

SEQ ID NO: 2355870 - RNA, 18 nt, Bordetella pertussis
ccagggugcaccaggugg

SEQ ID NO: 2355871 - RNA, 13 nt, Bordetella pertussis
ccagggugccgcc

SEQ ID NO: 2355872 - RNA, 16 nt, Bordetella pertussis
ccaggguggccaguuc

SEQ ID NO: 2355873 - RNA, 13 nt, Bordetella pertussis
ccaggguggcgcc

SEQ ID NO: 2355874 - RNA, 14 nt, Bordetella pertussis
ccaggguggcgccg

SEQ ID NO: 2355875 - RNA, 15 nt, Bordetella pertussis
ccaggguggcgccgg

SEQ ID NO: 2355876 - RNA, 18 nt, Bordetella pertussis
ccaggguggcgccggcca

SEQ ID NO: 2355877 - RNA, 20 nt, Bordetella pertussis
ccaggguggcgccggccacc

SEQ ID NO: 2355878 - RNA, 23 nt, Bordetella pertussis
ccaggguggcgccggccaccgcc

SEQ ID NO: 2355879 - RNA, 18 nt, Bordetella pertussis
ccaggguggcguccuggu

SEQ ID NO: 2355880 - RNA, 23 nt, Bordetella pertussis
ccaggguguagaccugcgggccg

SEQ ID NO: 2355881 - RNA, 15 nt, Bordetella pertussis
ccaggguguccuggu

SEQ ID NO: 2355882 - RNA, 17 nt, Bordetella pertussis
ccaggguguccuggucg

SEQ ID NO: 2355883 - RNA, 14 nt, Bordetella pertussis
ccagguacaggccg

SEQ ID NO: 2355884 - RNA, 17 nt, Bordetella pertussis
ccagguacaggccgccg

SEQ ID NO: 2355885 - RNA, 19 nt, Bordetella pertussis
ccagguacaggccgccggu

SEQ ID NO: 2355886 - RNA, 22 nt, Bordetella pertussis
ccagguacaucauccccagcgc

SEQ ID NO: 2355887 - RNA, 21 nt, Bordetella pertussis
ccagguaggccggcgcgaccg

SEQ ID NO: 2355888 - RNA, 15 nt, Bordetella pertussis
ccagguaggcggcgc

SEQ ID NO: 2355889 - RNA, 20 nt, Bordetella pertussis
ccagguaggcggcgcgcccg

SEQ ID NO: 2355890 - RNA, 22 nt, Bordetella pertussis
ccagguaggcggcgcgcccgcc

SEQ ID NO: 2355891 - RNA, 16 nt, Bordetella pertussis
ccagguauucggcggu

SEQ ID NO: 2355892 - RNA, 22 nt, Bordetella pertussis
ccagguauugcggggcggcgua

SEQ ID NO: 2355893 - RNA, 16 nt, Bordetella pertussis
ccaggucaucgccagg

SEQ ID NO: 2355894 - RNA, 17 nt, Bordetella pertussis
ccaggucaucgccaggc

SEQ ID NO: 2355895 - RNA, 19 nt, Bordetella pertussis
ccaggucaucgccaggcgc

SEQ ID NO: 2355896 - RNA, 17 nt, Bordetella pertussis
ccagguccacgaugccc

SEQ ID NO: 2355897 - RNA, 19 nt, Bordetella pertussis
ccagguccacgaugcccau

SEQ ID NO: 2355898 - RNA, 16 nt, Bordetella pertussis
ccagguccagcgccac

SEQ ID NO: 2355899 - RNA, 19 nt, Bordetella pertussis
ccagguccagcgccacggc

SEQ ID NO: 2355900 - RNA, 19 nt, Bordetella pertussis
ccagguccgaaccgaccgc

SEQ ID NO: 2355901 - RNA, 20 nt, Bordetella pertussis
ccagguccgaaccgaccgcc

SEQ ID NO: 2355902 - RNA, 14 nt, Bordetella pertussis
ccagguccgccggc

SEQ ID NO: 2355903 - RNA, 19 nt, Bordetella pertussis
ccagguccguguucgacgc

SEQ ID NO: 2355904 - RNA, 22 nt, Bordetella pertussis
ccagguccguguucgacgcggc

SEQ ID NO: 2355905 - RNA, 17 nt, Bordetella pertussis
ccagguccuggcggccg

SEQ ID NO: 2355906 - RNA, 23 nt, Bordetella pertussis
ccagguccuggcggccgcccagc

SEQ ID NO: 2355907 - RNA, 20 nt, Bordetella pertussis
ccaggucgauaucgccaucc

SEQ ID NO: 2355908 - RNA, 20 nt, Bordetella pertussis
ccaggucgcggugcgccacg

SEQ ID NO: 2355909 - RNA, 18 nt, Bordetella pertussis
ccaggucggacgcgccgg

SEQ ID NO: 2355910 - RNA, 19 nt, Bordetella pertussis
ccaggucggacgcgccggg

SEQ ID NO: 2355911 - RNA, 18 nt, Bordetella pertussis
ccaggucggccaccgccg

SEQ ID NO: 2355912 - RNA, 23 nt, Bordetella pertussis
ccaggucggccaccgccguggca

SEQ ID NO: 2355913 - RNA, 15 nt, Bordetella pertussis
ccaggucggccagcc

SEQ ID NO: 2355914 - RNA, 16 nt, Bordetella pertussis
ccaggucggccagccg

SEQ ID NO: 2355915 - RNA, 19 nt, Bordetella pertussis
ccaggucggccagccggcc

SEQ ID NO: 2355916 - RNA, 20 nt, Bordetella pertussis
ccaggucggccagccggccg

SEQ ID NO: 2355917 - RNA, 22 nt, Bordetella pertussis
ccaggucggccagccggccgau

SEQ ID NO: 2355918 - RNA, 12 nt, Bordetella pertussis
ccaggucggcgu

SEQ ID NO: 2355919 - RNA, 22 nt, Bordetella pertussis
ccaggucgggcacgaucaccgc

SEQ ID NO: 2355920 - RNA, 17 nt, Bordetella pertussis
ccaggucguugcgcgaa

SEQ ID NO: 2355921 - RNA, 12 nt, Bordetella pertussis
ccaggucuaccc

SEQ ID NO: 2355922 - RNA, 14 nt, Bordetella pertussis
ccaggugcgggccg

SEQ ID NO: 2355923 - RNA, 20 nt, Bordetella pertussis
ccagguggacagcgccagcc

SEQ ID NO: 2355924 - RNA, 23 nt, Bordetella pertussis
ccagguggacagcgccagcccgc

SEQ ID NO: 2355925 - RNA, 16 nt, Bordetella pertussis
ccagguggcccgcacc

SEQ ID NO: 2355926 - RNA, 14 nt, Bordetella pertussis
ccaggugggcgcgc

SEQ ID NO: 2355927 - RNA, 15 nt, Bordetella pertussis
ccaggugggcgcgcu

SEQ ID NO: 2355928 - RNA, 21 nt, Bordetella pertussis
ccagguucuggucgaacuggc

SEQ ID NO: 2355929 - RNA, 10 nt, Bordetella pertussis
ccagguugag

SEQ ID NO: 2355930 - RNA, 18 nt, Bordetella pertussis
ccagguugagucuggaga

SEQ ID NO: 2355931 - RNA, 20 nt, Bordetella pertussis
ccagguugagucuggagaug

SEQ ID NO: 2355932 - RNA, 15 nt, Bordetella pertussis
ccagguugcauccgg

SEQ ID NO: 2355933 - RNA, 18 nt, Bordetella pertussis
ccagguugcauccggccc

SEQ ID NO: 2355934 - RNA, 14 nt, Bordetella pertussis
ccagguugcggccg

SEQ ID NO: 2355935 - RNA, 16 nt, Bordetella pertussis
ccagguugcggccgcc

SEQ ID NO: 2355936 - RNA, 17 nt, Bordetella pertussis
ccagguugcggccgcca

SEQ ID NO: 2355937 - RNA, 19 nt, Bordetella pertussis
ccagguugcggccgccacc

SEQ ID NO: 2355938 - RNA, 17 nt, Bordetella pertussis
ccagguugggcaccacc

SEQ ID NO: 2355939 - RNA, 22 nt, Bordetella pertussis
ccagguugggugcgccgccggc

SEQ ID NO: 2355940 - RNA, 14 nt, Bordetella pertussis
ccagguugucggcg

SEQ ID NO: 2355941 - RNA, 17 nt, Bordetella pertussis
ccagguugucggcgcca

SEQ ID NO: 2355942 - RNA, 19 nt, Bordetella pertussis
ccagguugucggcgccaca

SEQ ID NO: 2355943 - RNA, 17 nt, Bordetella pertussis
ccagguuuuccacagcc

SEQ ID NO: 2355944 - RNA, 18 nt, Bordetella pertussis
ccagguuuuccacagcca

SEQ ID NO: 2355945 - RNA, 22 nt, Bordetella pertussis
ccagguuuuccacagccaggcc

SEQ ID NO: 2355946 - RNA, 13 nt, Bordetella pertussis
ccaguacaggcug

SEQ ID NO: 2355947 - RNA, 14 nt, Bordetella pertussis
ccaguacgaagggg

SEQ ID NO: 2355948 - RNA, 17 nt, Bordetella pertussis
ccaguacgagaacgcgu

SEQ ID NO: 2355949 - RNA, 19 nt, Bordetella pertussis
ccaguacgucggacagggc

SEQ ID NO: 2355950 - RNA, 16 nt, Bordetella pertussis
ccaguagcacacgccg

SEQ ID NO: 2355951 - RNA, 14 nt, Bordetella pertussis
ccaguaggcgcccc

SEQ ID NO: 2355952 - RNA, 14 nt, Bordetella pertussis
ccaguccaccuuga

SEQ ID NO: 2355953 - RNA, 16 nt, Bordetella pertussis
ccaguccagcgcgccg

SEQ ID NO: 2355954 - RNA, 17 nt, Bordetella pertussis
ccaguccagcgucggcg

SEQ ID NO: 2355955 - RNA, 12 nt, Bordetella pertussis
ccaguccaggcc

SEQ ID NO: 2355956 - RNA, 13 nt, Bordetella pertussis
ccaguccaggccg

SEQ ID NO: 2355957 - RNA, 17 nt, Bordetella pertussis
ccaguccaggccggccu

SEQ ID NO: 2355958 - RNA, 14 nt, Bordetella pertussis
ccaguccagggugu

SEQ ID NO: 2355959 - RNA, 15 nt, Bordetella pertussis
ccaguccauccagcg

SEQ ID NO: 2355960 - RNA, 16 nt, Bordetella pertussis
ccagucccaggaucac

SEQ ID NO: 2355961 - RNA, 23 nt, Bordetella pertussis
ccagucccaggaucaccgccgcg

SEQ ID NO: 2355962 - RNA, 20 nt, Bordetella pertussis
ccaguccccaugcggggacu

SEQ ID NO: 2355963 - RNA, 21 nt, Bordetella pertussis
ccaguccccaugcggggacug

SEQ ID NO: 2355964 - RNA, 15 nt, Bordetella pertussis
ccaguccccaugugg

SEQ ID NO: 2355965 - RNA, 20 nt, Bordetella pertussis
ccagucccccugcggggaca

SEQ ID NO: 2355966 - RNA, 18 nt, Bordetella pertussis
ccaguccccgcagggaca

SEQ ID NO: 2355967 - RNA, 18 nt, Bordetella pertussis
ccaguccccguggggacg

SEQ ID NO: 2355968 - RNA, 18 nt, Bordetella pertussis
ccaucgauaugggcggcc

SEQ ID NO: 2355969 - RNA, 16 nt, Bordetella pertussis
ccaucgccgagccgcu

SEQ ID NO: 2355970 - RNA, 12 nt, Bordetella pertussis
ccaucgccgcca

SEQ ID NO: 2355971 - RNA, 14 nt, Bordetella pertussis
ccaucgccgccacg

SEQ ID NO: 2355972 - RNA, 22 nt, Bordetella pertussis
ccaucgccgccacgugcacgau

SEQ ID NO: 2355973 - RNA, 12 nt, Bordetella pertussis
ccaucgccgccg

SEQ ID NO: 2355974 - RNA, 14 nt, Bordetella pertussis
ccaucgcgcacuug

SEQ ID NO: 2355975 - RNA, 23 nt, Bordetella pertussis
ccaucgcggucgaugaccagcca

SEQ ID NO: 2355976 - RNA, 24 nt, Bordetella pertussis
ccaucgcggucgaugaccagccag

SEQ ID NO: 2355977 - RNA, 14 nt, Bordetella pertussis
ccaucgcguccagg

SEQ ID NO: 2355978 - RNA, 17 nt, Bordetella pertussis
ccaucgcguccaggccc

SEQ ID NO: 2355979 - RNA, 18 nt, Bordetella pertussis
ccaucgcguccaggccca

SEQ ID NO: 2355980 - RNA, 19 nt, Bordetella pertussis
ccaucgcguccaggcccag

SEQ ID NO: 2355981 - RNA, 13 nt, Bordetella pertussis
ccaucgcgugcag

SEQ ID NO: 2355982 - RNA, 15 nt, Bordetella pertussis
ccaucgcgugcagcg

SEQ ID NO: 2355983 - RNA, 19 nt, Bordetella pertussis
ccaucgcgugcagcgacuu

SEQ ID NO: 2355984 - RNA, 19 nt, Bordetella pertussis
ccaucgcugguaugcacga

SEQ ID NO: 2355985 - RNA, 20 nt, Bordetella pertussis
ccaucgcugguaugcacgau

SEQ ID NO: 2355986 - RNA, 15 nt, Bordetella pertussis
ccaucggcgcgcgcu

SEQ ID NO: 2355987 - RNA, 23 nt, Bordetella pertussis
ccaucggcgcgcgcugcacggcc

SEQ ID NO: 2355988 - RNA, 23 nt, Bordetella pertussis
ccaucgggauaccgcuggccagg

SEQ ID NO: 2355989 - RNA, 13 nt, Bordetella pertussis
ccaucgggcugcg

SEQ ID NO: 2355990 - RNA, 17 nt, Bordetella pertussis
ccaucggggggcaggcu

SEQ ID NO: 2355991 - RNA, 15 nt, Bordetella pertussis
ccaucguacgcgugg

SEQ ID NO: 2355992 - RNA, 13 nt, Bordetella pertussis
ccaucguugccug

SEQ ID NO: 2355993 - RNA, 14 nt, Bordetella pertussis
ccaucguugccugg

SEQ ID NO: 2355994 - RNA, 15 nt, Bordetella pertussis
ccaucuacgugcugg

SEQ ID NO: 2355995 - RNA, 14 nt, Bordetella pertussis
ccaucucgcgcgcu

SEQ ID NO: 2355996 - RNA, 19 nt, Bordetella pertussis
ccaucucgucggucaugcc

SEQ ID NO: 2355997 - RNA, 12 nt, Bordetella pertussis
ccaucugcgagc

SEQ ID NO: 2355998 - RNA, 15 nt, Bordetella pertussis
ccaucuggaccgcgc

SEQ ID NO: 2355999 - RNA, 12 nt, Bordetella pertussis
ccaucuggcccg

SEQ ID NO: 2356000 - RNA, 17 nt, Bordetella pertussis
ccaucugguugagcagc

SEQ ID NO: 2356001 - RNA, 18 nt, Bordetella pertussis
ccaucuguacggccggcu

SEQ ID NO: 2356002 - RNA, 17 nt, Bordetella pertussis
ccaucuguucggcgccg

SEQ ID NO: 2356003 - RNA, 20 nt, Bordetella pertussis
ccaucuugcaggcgccaguc

SEQ ID NO: 2356004 - RNA, 18 nt, Bordetella pertussis
ccaucuugccggccuguu

SEQ ID NO: 2356005 - RNA, 20 nt, Bordetella pertussis
ccaucuugccggccuguucu

SEQ ID NO: 2356006 - RNA, 16 nt, Bordetella pertussis
ccaucuuggugcgcgc

SEQ ID NO: 2356007 - RNA, 18 nt, Bordetella pertussis
ccaucuuggugcgcgcca

SEQ ID NO: 2356008 - RNA, 15 nt, Bordetella pertussis
ccaugaacgccgcgc

SEQ ID NO: 2356009 - RNA, 21 nt, Bordetella pertussis
ccaugaacgcuugacggccag

SEQ ID NO: 2356010 - RNA, 22 nt, Bordetella pertussis
ccaugaacgcuugacggccagg

SEQ ID NO: 2356011 - RNA, 21 nt, Bordetella pertussis
ccaugaacucgcgcucggcga

SEQ ID NO: 2356012 - RNA, 18 nt, Bordetella pertussis
ccaugaacuuggcaucca

SEQ ID NO: 2356013 - RNA, 15 nt, Bordetella pertussis
ccaugaaggcggcca

SEQ ID NO: 2356014 - RNA, 18 nt, Bordetella pertussis
ccaugaaggcggccagca

SEQ ID NO: 2356015 - RNA, 18 nt, Bordetella pertussis
ccaugaccacgucgacca

SEQ ID NO: 2356016 - RNA, 19 nt, Bordetella pertussis
ccaugaccacgucgaccag

SEQ ID NO: 2356017 - RNA, 15 nt, Bordetella pertussis
ccaugaccaugccgg

SEQ ID NO: 2356018 - RNA, 20 nt, Bordetella pertussis
ccaugacgaccuugcggccg

SEQ ID NO: 2356019 - RNA, 12 nt, Bordetella pertussis
ccaugacgccgg

SEQ ID NO: 2356020 - RNA, 22 nt, Bordetella pertussis
ccaugacgcuggucgagagccu

SEQ ID NO: 2356021 - RNA, 21 nt, Bordetella pertussis
ccaugacggccauccggccac

SEQ ID NO: 2356022 - RNA, 22 nt, Bordetella pertussis
ccaugaggaacggcaccagccg

SEQ ID NO: 2356023 - RNA, 23 nt, Bordetella pertussis
ccaugaggaacggcaccagccgg

SEQ ID NO: 2356024 - RNA, 17 nt, Bordetella pertussis
ccaugauacccauggcc

SEQ ID NO: 2356025 - RNA, 21 nt, Bordetella pertussis
ccaugaucaggccgaacuggg

SEQ ID NO: 2356026 - RNA, 22 nt, Bordetella pertussis
ccaugaucaggccgaacuggga

SEQ ID NO: 2356027 - RNA, 17 nt, Bordetella pertussis
ccaugaucucgggcgag

SEQ ID NO: 2356028 - RNA, 17 nt, Bordetella pertussis
ccaugauuuccaucgac

SEQ ID NO: 2356029 - RNA, 23 nt, Bordetella pertussis
ccaugauuuccaucgacuuggcc

SEQ ID NO: 2356030 - RNA, 20 nt, Bordetella pertussis
ccaugcaacacgaccagcag

SEQ ID NO: 2356031 - RNA, 13 nt, Bordetella pertussis
ccaugcaccagca

SEQ ID NO: 2356032 - RNA, 12 nt, Bordetella pertussis
ccaugcagcugg

SEQ ID NO: 2356033 - RNA, 16 nt, Bordetella pertussis
ccaugcagcuggaugg

SEQ ID NO: 2356034 - RNA, 15 nt, Bordetella pertussis
ccaugcaguagcgcu

SEQ ID NO: 2356035 - RNA, 18 nt, Bordetella pertussis
ccaugcccaggcccaguu

SEQ ID NO: 2356036 - RNA, 19 nt, Bordetella pertussis
ccaugccccauccagcgga

SEQ ID NO: 2356037 - RNA, 22 nt, Bordetella pertussis
ccaugccgacggauucgcccag

SEQ ID NO: 2356038 - RNA, 12 nt, Bordetella pertussis
ccaugccgccau

SEQ ID NO: 2356039 - RNA, 14 nt, Bordetella pertussis
ccaugccgcccaug

SEQ ID NO: 2356040 - RNA, 20 nt, Bordetella pertussis
ccaugccgcccaugccgccg

SEQ ID NO: 2356041 - RNA, 15 nt, Bordetella pertussis
ccaugccgccgggca

SEQ ID NO: 2356042 - RNA, 15 nt, Bordetella pertussis
ccaugccgcgcccgc

SEQ ID NO: 2356043 - RNA, 16 nt, Bordetella pertussis
ccaugccgcgcccgcc

SEQ ID NO: 2356044 - RNA, 13 nt, Bordetella pertussis
ccaugccgcgcgc

SEQ ID NO: 2356045 - RNA, 15 nt, Bordetella pertussis
ccaugccgcgcgccu

SEQ ID NO: 2356046 - RNA, 17 nt, Bordetella pertussis
ccaugccgcggacccag

SEQ ID NO: 2356047 - RNA, 22 nt, Bordetella pertussis
ccaugccgcgggcggcgccggc

SEQ ID NO: 2356048 - RNA, 20 nt, Bordetella pertussis
ccaugccggccaugcucagc

SEQ ID NO: 2356049 - RNA, 21 nt, Bordetella pertussis
ccaugccggccaugcucagca

SEQ ID NO: 2356050 - RNA, 14 nt, Bordetella pertussis
ccaugccgggaugg

SEQ ID NO: 2356051 - RNA, 17 nt, Bordetella pertussis
ccaugccguccugcugc

SEQ ID NO: 2356052 - RNA, 15 nt, Bordetella pertussis
ccaugccgucgcgca

SEQ ID NO: 2356053 - RNA, 15 nt, Bordetella pertussis
ccaugccgucuggcg

SEQ ID NO: 2356054 - RNA, 19 nt, Bordetella pertussis
ccaugccuugcgcgacagc

SEQ ID NO: 2356055 - RNA, 22 nt, Bordetella pertussis
ccaugccuugcgcgacagcagg

SEQ ID NO: 2356056 - RNA, 23 nt, Bordetella pertussis
ccaugccuugcgcgacagcaggc

SEQ ID NO: 2356057 - RNA, 17 nt, Bordetella pertussis
ccaugcgaaagcggcca

SEQ ID NO: 2356058 - RNA, 18 nt, Bordetella pertussis
ccaugcgaaagcggccag

SEQ ID NO: 2356059 - RNA, 15 nt, Bordetella pertussis
ccaugcgacagcccg

SEQ ID NO: 2356060 - RNA, 21 nt, Bordetella pertussis
ccaugcgacagcccgggaaac

SEQ ID NO: 2356061 - RNA, 18 nt, Bordetella pertussis
ccaugcgauacagcuugg

SEQ ID NO: 2356062 - RNA, 23 nt, Bordetella pertussis
ccaugcgauacagcuuggcgcgc

SEQ ID NO: 2356063 - RNA, 18 nt, Bordetella pertussis
ccaugcgauccagggcga

SEQ ID NO: 2356064 - RNA, 14 nt, Bordetella pertussis
ccaugcgaugcugc

SEQ ID NO: 2356065 - RNA, 18 nt, Bordetella pertussis
ccaugcgaugcugcaggg

SEQ ID NO: 2356066 - RNA, 19 nt, Bordetella pertussis
ccaugcgcacucgaccgcc

SEQ ID NO: 2356067 - RNA, 21 nt, Bordetella pertussis
ccaugcgcacucgaccgccgg

SEQ ID NO: 2356068 - RNA, 15 nt, Bordetella pertussis
ccaugcgcauggcca

SEQ ID NO: 2356069 - RNA, 19 nt, Bordetella pertussis
ccaugcgcauggccagcac

SEQ ID NO: 2356070 - RNA, 14 nt, Bordetella pertussis
ccaugcgccagcag

SEQ ID NO: 2356071 - RNA, 15 nt, Bordetella pertussis
ccaugcgccagcagg

SEQ ID NO: 2356072 - RNA, 16 nt, Bordetella pertussis
ccaugcgccagcagga

SEQ ID NO: 2356073 - RNA, 14 nt, Bordetella pertussis
ccaugcgcccggcc

SEQ ID NO: 2356074 - RNA, 18 nt, Bordetella pertussis
ccaugcgcccggccaccg

SEQ ID NO: 2356075 - RNA, 15 nt, Bordetella pertussis
ccaugcgcgccagca

SEQ ID NO: 2356076 - RNA, 19 nt, Bordetella pertussis
ccaugcgcgguugggcgca

SEQ ID NO: 2356077 - RNA, 16 nt, Bordetella pertussis
ccaugcgcuggcgcaa

SEQ ID NO: 2356078 - RNA, 23 nt, Bordetella pertussis
ccaugcgcuggcgcaaggacgcg

SEQ ID NO: 2356079 - RNA, 14 nt, Bordetella pertussis
ccaugcgcugggca

SEQ ID NO: 2356080 - RNA, 21 nt, Bordetella pertussis
ccaugcggaugaacgaccagc

SEQ ID NO: 2356081 - RNA, 23 nt, Bordetella pertussis
cccaccagccgggcggccacggc

SEQ ID NO: 2356082 - RNA, 15 nt, Bordetella pertussis
cccaccagggccagc

SEQ ID NO: 2356083 - RNA, 18 nt, Bordetella pertussis
cccaccagggccagcuug

SEQ ID NO: 2356084 - RNA, 21 nt, Bordetella pertussis
cccaccaugagcacgccccaa

SEQ ID NO: 2356085 - RNA, 14 nt, Bordetella pertussis
cccacccccagcag

SEQ ID NO: 2356086 - RNA, 14 nt, Bordetella pertussis
cccacccggcacgc

SEQ ID NO: 2356087 - RNA, 19 nt, Bordetella pertussis
cccacccggcacgcgccga

SEQ ID NO: 2356088 - RNA, 14 nt, Bordetella pertussis
cccaccgagacgcu

SEQ ID NO: 2356089 - RNA, 16 nt, Bordetella pertussis
cccaccgagacgcugu

SEQ ID NO: 2356090 - RNA, 18 nt, Bordetella pertussis
cccaccgccgcccgccag

SEQ ID NO: 2356091 - RNA, 20 nt, Bordetella pertussis
cccaccgccgcccgccaggc

SEQ ID NO: 2356092 - RNA, 21 nt, Bordetella pertussis
cccaccgcgaaccaggccugc

SEQ ID NO: 2356093 - RNA, 14 nt, Bordetella pertussis
cccaccggcaugcc

SEQ ID NO: 2356094 - RNA, 14 nt, Bordetella pertussis
cccaccgggacagg

SEQ ID NO: 2356095 - RNA, 16 nt, Bordetella pertussis
cccaccgggacaggca

SEQ ID NO: 2356096 - RNA, 15 nt, Bordetella pertussis
cccaccgggccggcc

SEQ ID NO: 2356097 - RNA, 22 nt, Bordetella pertussis
cccaccugcagccagaucucgc

SEQ ID NO: 2356098 - RNA, 19 nt, Bordetella pertussis
cccaccuggcggugcgccg

SEQ ID NO: 2356099 - RNA, 14 nt, Bordetella pertussis
cccaccuuccugcu

SEQ ID NO: 2356100 - RNA, 22 nt, Bordetella pertussis
cccaccuuccugcuggaccugc

SEQ ID NO: 2356101 - RNA, 14 nt, Bordetella pertussis
cccaccuugcgcgc

SEQ ID NO: 2356102 - RNA, 16 nt, Bordetella pertussis
cccaccuugcgcgcga

SEQ ID NO: 2356103 - RNA, 15 nt, Bordetella pertussis
cccacgaacgccacg

SEQ ID NO: 2356104 - RNA, 18 nt, Bordetella pertussis
cccacgaacgccacgccc

SEQ ID NO: 2356105 - RNA, 18 nt, Bordetella pertussis
cccacgaccugcaacccc

SEQ ID NO: 2356106 - RNA, 14 nt, Bordetella pertussis
cccacgaucaccac

SEQ ID NO: 2356107 - RNA, 19 nt, Bordetella pertussis
cccacgaucaccacgcccg

SEQ ID NO: 2356108 - RNA, 20 nt, Bordetella pertussis
cccacgaucaccacgcccgc

SEQ ID NO: 2356109 - RNA, 20 nt, Bordetella pertussis
cccacgccgaugccgcgcac

SEQ ID NO: 2356110 - RNA, 12 nt, Bordetella pertussis
cccacgccgccg

SEQ ID NO: 2356111 - RNA, 15 nt, Bordetella pertussis
cccacgccgccuggc

SEQ ID NO: 2356112 - RNA, 15 nt, Bordetella pertussis
cccacgccgcugaug

SEQ ID NO: 2356113 - RNA, 21 nt, Bordetella pertussis
cccacgccgcugucgaccucg

SEQ ID NO: 2356114 - RNA, 13 nt, Bordetella pertussis
cccacgcgccgcc

SEQ ID NO: 2356115 - RNA, 20 nt, Bordetella pertussis
cccacgcucuggagccacca

SEQ ID NO: 2356116 - RNA, 12 nt, Bordetella pertussis
cccacgcugcgc

SEQ ID NO: 2356117 - RNA, 15 nt, Bordetella pertussis
cccacggccagcacu

SEQ ID NO: 2356118 - RNA, 15 nt, Bordetella pertussis
cccacggcgauggcc

SEQ ID NO: 2356119 - RNA, 15 nt, Bordetella pertussis
cccacggcguggcgc

SEQ ID NO: 2356120 - RNA, 15 nt, Bordetella pertussis
cccacggggacaggc

SEQ ID NO: 2356121 - RNA, 20 nt, Bordetella pertussis
cccacggggacuggcucccg

SEQ ID NO: 2356122 - RNA, 21 nt, Bordetella pertussis
cccacucacgcaaggccgacu

SEQ ID NO: 2356123 - RNA, 20 nt, Bordetella pertussis
cccacucggugcgcgcgccc

SEQ ID NO: 2356124 - RNA, 21 nt, Bordetella pertussis
cccacucggugcgcgcgccca

SEQ ID NO: 2356125 - RNA, 13 nt, Bordetella pertussis
cccacugccaggc

SEQ ID NO: 2356126 - RNA, 14 nt, Bordetella pertussis
cccacugccaggcg

SEQ ID NO: 2356127 - RNA, 17 nt, Bordetella pertussis
cccacugggggacuggc

SEQ ID NO: 2356128 - RNA, 19 nt, Bordetella pertussis
cccacugggggacuggcac

SEQ ID NO: 2356129 - RNA, 22 nt, Bordetella pertussis
cccacuuccucggcgcgcgcgg

SEQ ID NO: 2356130 - RNA, 16 nt, Bordetella pertussis
cccacuucgaaacccu

SEQ ID NO: 2356131 - RNA, 16 nt, Bordetella pertussis
cccacuugagcagcgc

SEQ ID NO: 2356132 - RNA, 18 nt, Bordetella pertussis
cccacuugagcagcgccu

SEQ ID NO: 2356133 - RNA, 13 nt, Bordetella pertussis
cccacuuggcgau

SEQ ID NO: 2356134 - RNA, 20 nt, Bordetella pertussis
cccagaaacuggcgcugccg

SEQ ID NO: 2356135 - RNA, 16 nt, Bordetella pertussis
cccagaacccggccgg

SEQ ID NO: 2356136 - RNA, 19 nt, Bordetella pertussis
cccagaacccggccggcgc

SEQ ID NO: 2356137 - RNA, 20 nt, Bordetella pertussis
cccagacagccacgcgcgau

SEQ ID NO: 2356138 - RNA, 24 nt, Bordetella pertussis
cccagaccaagcgccacagcgcca

SEQ ID NO: 2356139 - RNA, 17 nt, Bordetella pertussis
cccagaccugcgcgccg

SEQ ID NO: 2356140 - RNA, 19 nt, Bordetella pertussis
cccagaccugcgcgccggc

SEQ ID NO: 2356141 - RNA, 18 nt, Bordetella pertussis
cccagacgcagaccacgc

SEQ ID NO: 2356142 - RNA, 18 nt, Bordetella pertussis
cccagauccgcaaguucg

SEQ ID NO: 2356143 - RNA, 14 nt, Bordetella pertussis
cccagaucgccugg

SEQ ID NO: 2356144 - RNA, 18 nt, Bordetella pertussis
cccagaucgccugggggg

SEQ ID NO: 2356145 - RNA, 13 nt, Bordetella pertussis
cccagauggcgcc

SEQ ID NO: 2356146 - RNA, 19 nt, Bordetella pertussis
cccagcaaggguucgggca

SEQ ID NO: 2356147 - RNA, 21 nt, Bordetella pertussis
cccagcaauuaugcguggccg

SEQ ID NO: 2356148 - RNA, 24 nt, Bordetella pertussis
cccagcaauuaugcguggccgccg

SEQ ID NO: 2356149 - RNA, 19 nt, Bordetella pertussis
cccagcacauagcgcaagc

SEQ ID NO: 2356150 - RNA, 12 nt, Bordetella pertussis
cccagcaccacg

SEQ ID NO: 2356151 - RNA, 15 nt, Bordetella pertussis
cccagcaccacgggc

SEQ ID NO: 2356152 - RNA, 16 nt, Bordetella pertussis
cccagcaccacgggcu

SEQ ID NO: 2356153 - RNA, 14 nt, Bordetella pertussis
cccagcaccaggcc

SEQ ID NO: 2356154 - RNA, 16 nt, Bordetella pertussis
cccagcaccaggccga

SEQ ID NO: 2356155 - RNA, 16 nt, Bordetella pertussis
cccagcaccgccaccg

SEQ ID NO: 2356156 - RNA, 21 nt, Bordetella pertussis
cccagcaccucgacgcagccu

SEQ ID NO: 2356157 - RNA, 21 nt, Bordetella pertussis
cccagcaccugcaggccgccg

SEQ ID NO: 2356158 - RNA, 21 nt, Bordetella pertussis
cccagcacgaagggcagcagc

SEQ ID NO: 2356159 - RNA, 11 nt, Bordetella pertussis
cccagcacgac

SEQ ID NO: 2356160 - RNA, 12 nt, Bordetella pertussis
cccagcacgcgc

SEQ ID NO: 2356161 - RNA, 13 nt, Bordetella pertussis
cccagcacgcgcg

SEQ ID NO: 2356162 - RNA, 21 nt, Bordetella pertussis
cccagcacgcgcgccagcugg

SEQ ID NO: 2356163 - RNA, 13 nt, Bordetella pertussis
cccagcagcacgc

SEQ ID NO: 2356164 - RNA, 13 nt, Bordetella pertussis
cccagcagcagcg

SEQ ID NO: 2356165 - RNA, 13 nt, Bordetella pertussis
cccagcagcgcca

SEQ ID NO: 2356166 - RNA, 21 nt, Bordetella pertussis
cccagcagcgccaccguggcc

SEQ ID NO: 2356167 - RNA, 16 nt, Bordetella pertussis
cccagcagcgccggga

SEQ ID NO: 2356168 - RNA, 12 nt, Bordetella pertussis
cccagcagcggc

SEQ ID NO: 2356169 - RNA, 22 nt, Bordetella pertussis
cccagcaggcuuucgcacagcc

SEQ ID NO: 2356170 - RNA, 23 nt, Bordetella pertussis
cccagcaggcuuucgcacagccg

SEQ ID NO: 2356171 - RNA, 16 nt, Bordetella pertussis
cccagcauccgcgcca

SEQ ID NO: 2356172 - RNA, 19 nt, Bordetella pertussis
cccagcauccgcgccagga

SEQ ID NO: 2356173 - RNA, 17 nt, Bordetella pertussis
cccagcaucugccccag

SEQ ID NO: 2356174 - RNA, 17 nt, Bordetella pertussis
cccagcaugugcgcggc

SEQ ID NO: 2356175 - RNA, 13 nt, Bordetella pertussis
cccagccagcccu

SEQ ID NO: 2356176 - RNA, 16 nt, Bordetella pertussis
cccagccagcccuggc

SEQ ID NO: 2356177 - RNA, 18 nt, Bordetella pertussis
cccagccagcccuggccc

SEQ ID NO: 2356178 - RNA, 15 nt, Bordetella pertussis
cccagccaggcgcca

SEQ ID NO: 2356179 - RNA, 14 nt, Bordetella pertussis
cccagccccgcggc

SEQ ID NO: 2356180 - RNA, 13 nt, Bordetella pertussis
cccagcccggcuu

SEQ ID NO: 2356181 - RNA, 17 nt, Bordetella pertussis
cccagcccugcccgcac

SEQ ID NO: 2356182 - RNA, 13 nt, Bordetella pertussis
cccagccgcaugc

SEQ ID NO: 2356183 - RNA, 16 nt, Bordetella pertussis
cccagccgccugagca

SEQ ID NO: 2356184 - RNA, 18 nt, Bordetella pertussis
cccagccgcucggccacg

SEQ ID NO: 2356185 - RNA, 22 nt, Bordetella pertussis
cccagccgcucggccacgcgcu

SEQ ID NO: 2356186 - RNA, 17 nt, Bordetella pertussis
cccagccggcccccuca

SEQ ID NO: 2356187 - RNA, 13 nt, Bordetella pertussis
cccagccggccga

SEQ ID NO: 2356188 - RNA, 14 nt, Bordetella pertussis
cccagccgucgcgc

SEQ ID NO: 2356189 - RNA, 16 nt, Bordetella pertussis
cccagccgucgcgcug

SEQ ID NO: 2356190 - RNA, 16 nt, Bordetella pertussis
cccagccugccggcgg

SEQ ID NO: 2356191 - RNA, 18 nt, Bordetella pertussis
cccagcgacgagggcgcc

SEQ ID NO: 2356192 - RNA, 19 nt, Bordetella pertussis
cccagcgacgagggcgcca

SEQ ID NO: 2356193 - RNA, 15 nt, Bordetella pertussis
cccagcgagccggcc

SEQ ID NO: 2356194 - RNA, 13 nt, Bordetella pertussis
cccagcgagcggg

SEQ ID NO: 2356195 - RNA, 16 nt, Bordetella pertussis
cccagggcagcggcca

SEQ ID NO: 2356196 - RNA, 13 nt, Bordetella pertussis
cccagggccgcgc

SEQ ID NO: 2356197 - RNA, 17 nt, Bordetella pertussis
cccagggccgcgccggg

SEQ ID NO: 2356198 - RNA, 13 nt, Bordetella pertussis
cccagggcgcgcc

SEQ ID NO: 2356199 - RNA, 14 nt, Bordetella pertussis
cccagggcgcgccg

SEQ ID NO: 2356200 - RNA, 19 nt, Bordetella pertussis
cccagggcuugacgcgcgu

SEQ ID NO: 2356201 - RNA, 15 nt, Bordetella pertussis
cccaggggacggcgc

SEQ ID NO: 2356202 - RNA, 18 nt, Bordetella pertussis
cccaggggacggcgcacc

SEQ ID NO: 2356203 - RNA, 19 nt, Bordetella pertussis
cccaggggacggcgcaccc

SEQ ID NO: 2356204 - RNA, 17 nt, Bordetella pertussis
cccaggggccggcgcgc

SEQ ID NO: 2356205 - RNA, 18 nt, Bordetella pertussis
cccaggggccggcgcgcc

SEQ ID NO: 2356206 - RNA, 19 nt, Bordetella pertussis
cccaggggccggcgcgccg

SEQ ID NO: 2356207 - RNA, 21 nt, Bordetella pertussis
cccagggggucagggccgccc

SEQ ID NO: 2356208 - RNA, 22 nt, Bordetella pertussis
cccagggggucagggccgccca

SEQ ID NO: 2356209 - RNA, 18 nt, Bordetella pertussis
cccaggguguagaccugc

SEQ ID NO: 2356210 - RNA, 16 nt, Bordetella pertussis
cccagguaucggccag

SEQ ID NO: 2356211 - RNA, 17 nt, Bordetella pertussis
cccagguaucggccagc

SEQ ID NO: 2356212 - RNA, 19 nt, Bordetella pertussis
cccagguaucggccagcac

SEQ ID NO: 2356213 - RNA, 15 nt, Bordetella pertussis
cccaggucaucgcca

SEQ ID NO: 2356214 - RNA, 16 nt, Bordetella pertussis
cccaggucaucgccag

SEQ ID NO: 2356215 - RNA, 14 nt, Bordetella pertussis
cccagguccagcgc

SEQ ID NO: 2356216 - RNA, 16 nt, Bordetella pertussis
cccagguccagcgcca

SEQ ID NO: 2356217 - RNA, 17 nt, Bordetella pertussis
cccagguccgccggcac

SEQ ID NO: 2356218 - RNA, 21 nt, Bordetella pertussis
cccagguccgccggcacgcgc

SEQ ID NO: 2356219 - RNA, 14 nt, Bordetella pertussis
cccaggucggacgc

SEQ ID NO: 2356220 - RNA, 18 nt, Bordetella pertussis
cccaggucggacgcgccg

SEQ ID NO: 2356221 - RNA, 19 nt, Bordetella pertussis
cccaggucguugcgcgaag

SEQ ID NO: 2356222 - RNA, 17 nt, Bordetella pertussis
cccagguugaaggccgc

SEQ ID NO: 2356223 - RNA, 22 nt, Bordetella pertussis
cccagguugcucgccucgauga

SEQ ID NO: 2356224 - RNA, 21 nt, Bordetella pertussis
cccaguacggccugcaugucg

SEQ ID NO: 2356225 - RNA, 21 nt, Bordetella pertussis
cccaguauggugaccggcgug

SEQ ID NO: 2356226 - RNA, 15 nt, Bordetella pertussis
cccaguccagggugu

SEQ ID NO: 2356227 - RNA, 14 nt, Bordetella pertussis
cccaguccggcagc

SEQ ID NO: 2356228 - RNA, 19 nt, Bordetella pertussis
cccaguccggcagcaccca

SEQ ID NO: 2356229 - RNA, 20 nt, Bordetella pertussis
cccaguccggcagcacccag

SEQ ID NO: 2356230 - RNA, 16 nt, Bordetella pertussis
cccagucgccgcgccc

SEQ ID NO: 2356231 - RNA, 17 nt, Bordetella pertussis
cccagucgccgcgcccg

SEQ ID NO: 2356232 - RNA, 14 nt, Bordetella pertussis
cccaguuccacgcg

SEQ ID NO: 2356233 - RNA, 18 nt, Bordetella pertussis
cccaguuccacgcggccg

SEQ ID NO: 2356234 - RNA, 17 nt, Bordetella pertussis
cccaguucgcgcagcag

SEQ ID NO: 2356235 - RNA, 19 nt, Bordetella pertussis
cccaguucgcgcagcagcu

SEQ ID NO: 2356236 - RNA, 15 nt, Bordetella pertussis
cccaguucgcggccg

SEQ ID NO: 2356237 - RNA, 14 nt, Bordetella pertussis
cccaguucggcgac

SEQ ID NO: 2356238 - RNA, 15 nt, Bordetella pertussis
cccaguucggcgcgc

SEQ ID NO: 2356239 - RNA, 21 nt, Bordetella pertussis
cccaguucggcgcgcgugccg

SEQ ID NO: 2356240 - RNA, 16 nt, Bordetella pertussis
cccaguucugcagcgu

SEQ ID NO: 2356241 - RNA, 18 nt, Bordetella pertussis
cccaguucugcagcgugc

SEQ ID NO: 2356242 - RNA, 20 nt, Bordetella pertussis
cccaguugacgaugcccagg

SEQ ID NO: 2356243 - RNA, 14 nt, Bordetella pertussis
cccaguugcuggcc

SEQ ID NO: 2356244 - RNA, 15 nt, Bordetella pertussis
cccaguugcuggccc

SEQ ID NO: 2356245 - RNA, 19 nt, Bordetella pertussis
cccaguuuuuccuucagca

SEQ ID NO: 2356246 - RNA, 16 nt, Bordetella pertussis
cccauaccagcccggc

SEQ ID NO: 2356247 - RNA, 21 nt, Bordetella pertussis
cccauagauggaaucauuggc

SEQ ID NO: 2356248 - RNA, 14 nt, Bordetella pertussis
cccauaugccgccg

SEQ ID NO: 2356249 - RNA, 17 nt, Bordetella pertussis
cccaucaccauggccga

SEQ ID NO: 2356250 - RNA, 24 nt, Bordetella pertussis
cccaucaggccgaugcguccgccg

SEQ ID NO: 2356251 - RNA, 23 nt, Bordetella pertussis
cccaucauguuguagugcuccac

SEQ ID NO: 2356252 - RNA, 19 nt, Bordetella pertussis
cccauccagcggacgggcc

SEQ ID NO: 2356253 - RNA, 22 nt, Bordetella pertussis
cccauccagcggacgggccagg

SEQ ID NO: 2356254 - RNA, 16 nt, Bordetella pertussis
cccauccucaucgugc

SEQ ID NO: 2356255 - RNA, 23 nt, Bordetella pertussis
cccauccucaucgugcucgugcu

SEQ ID NO: 2356256 - RNA, 14 nt, Bordetella pertussis
cccauccuggccga

SEQ ID NO: 2356257 - RNA, 16 nt, Bordetella pertussis
cccaucucggccgcgg

SEQ ID NO: 2356258 - RNA, 18 nt, Bordetella pertussis
cccaucucggccgcggcg

SEQ ID NO: 2356259 - RNA, 22 nt, Bordetella pertussis
cccaucugguugagcagcaccu

SEQ ID NO: 2356260 - RNA, 23 nt, Bordetella pertussis
cccaucugguugagcagcaccug

SEQ ID NO: 2356261 - RNA, 17 nt, Bordetella pertussis
cccaucuguacggccgg

SEQ ID NO: 2356262 - RNA, 20 nt, Bordetella pertussis
cccaugaacacuugacggcc

SEQ ID NO: 2356263 - RNA, 23 nt, Bordetella pertussis
cccaugaacacuugacggccaag

SEQ ID NO: 2356264 - RNA, 17 nt, Bordetella pertussis
cccaugaaggcggccag

SEQ ID NO: 2356265 - RNA, 16 nt, Bordetella pertussis
cccaugaccggcgugu

SEQ ID NO: 2356266 - RNA, 21 nt, Bordetella pertussis
cccaugacgaccuugcggccg

SEQ ID NO: 2356267 - RNA, 22 nt, Bordetella pertussis
cccaugacgaccuugcggccgc

SEQ ID NO: 2356268 - RNA, 15 nt, Bordetella pertussis
cccaugauggugccg

SEQ ID NO: 2356269 - RNA, 21 nt, Bordetella pertussis
cccaugccgccaugcagcugg

SEQ ID NO: 2356270 - RNA, 14 nt, Bordetella pertussis
cccaugccgcccgc

SEQ ID NO: 2356271 - RNA, 13 nt, Bordetella pertussis
cccaugccgccgg

SEQ ID NO: 2356272 - RNA, 12 nt, Bordetella pertussis
cccaugccgcgg

SEQ ID NO: 2356273 - RNA, 22 nt, Bordetella pertussis
cccaugccgcggacccaggccu

SEQ ID NO: 2356274 - RNA, 19 nt, Bordetella pertussis
cccaugcgaucggccucgg

SEQ ID NO: 2356275 - RNA, 15 nt, Bordetella pertussis
cccaugcgcauggcc

SEQ ID NO: 2356276 - RNA, 17 nt, Bordetella pertussis
cccaugcgcauggccag

SEQ ID NO: 2356277 - RNA, 18 nt, Bordetella pertussis
cccaugcgcauggccagc

SEQ ID NO: 2356278 - RNA, 15 nt, Bordetella pertussis
cccaugcgcugcgcc

SEQ ID NO: 2356279 - RNA, 19 nt, Bordetella pertussis
cccaugcggccccucaagg

SEQ ID NO: 2356280 - RNA, 14 nt, Bordetella pertussis
cccaugcggggaca

SEQ ID NO: 2356281 - RNA, 18 nt, Bordetella pertussis
cccaugcggggacaggca

SEQ ID NO: 2356282 - RNA, 20 nt, Bordetella pertussis
cccaugcggggacaggcacu

SEQ ID NO: 2356283 - RNA, 22 nt, Bordetella pertussis
cccaugcggggacaggcacucc

SEQ ID NO: 2356284 - RNA, 19 nt, Bordetella pertussis
cccaugcggggacuggcac

SEQ ID NO: 2356285 - RNA, 14 nt, Bordetella pertussis
cccauggcaagcgc

SEQ ID NO: 2356286 - RNA, 16 nt, Bordetella pertussis
cccauggcaagcgcaa

SEQ ID NO: 2356287 - RNA, 15 nt, Bordetella pertussis
cccauggcaugcacc

SEQ ID NO: 2356288 - RNA, 23 nt, Bordetella pertussis
cccauggccaaugaccgacgccg

SEQ ID NO: 2356289 - RNA, 13 nt, Bordetella pertussis
cccauggccaggg

SEQ ID NO: 2356290 - RNA, 14 nt, Bordetella pertussis
cccauggccgugcg

SEQ ID NO: 2356291 - RNA, 20 nt, Bordetella pertussis
cccauggccugcaaccuggu

SEQ ID NO: 2356292 - RNA, 16 nt, Bordetella pertussis
cccauggcgcgcagca

SEQ ID NO: 2356293 - RNA, 22 nt, Bordetella pertussis
cccaugggaaucugcuugccgu

SEQ ID NO: 2356294 - RNA, 16 nt, Bordetella pertussis
cccauggggacuggca

SEQ ID NO: 2356295 - RNA, 17 nt, Bordetella pertussis
cccauggggacuggcac

SEQ ID NO: 2356296 - RNA, 19 nt, Bordetella pertussis
cccauggggacuggcaccu

SEQ ID NO: 2356297 - RNA, 19 nt, Bordetella pertussis
cccauggggugcuccugcc

SEQ ID NO: 2356298 - RNA, 21 nt, Bordetella pertussis
cccauggggugcuccugccag

SEQ ID NO: 2356299 - RNA, 22 nt, Bordetella pertussis
cccauggggugcuccugccagg

SEQ ID NO: 2356300 - RNA, 22 nt, Bordetella pertussis
cccauguagaacgccagggucu

SEQ ID NO: 2356301 - RNA, 16 nt, Bordetella pertussis
cccauguccagguagc

SEQ ID NO: 2356302 - RNA, 19 nt, Bordetella pertussis
cccauguggggacaggcac

SEQ ID NO: 2356303 - RNA, 19 nt, Bordetella pertussis
cccauguugaacugcaggc

SEQ ID NO: 2356304 - RNA, 20 nt, Bordetella pertussis
cccauguugaacugcaggcc

SEQ ID NO: 2356305 - RNA, 13 nt, Bordetella pertussis
cccauucccgccc

SEQ ID NO: 2356306 - RNA, 15 nt, Bordetella pertussis
cccauucgcgcaccg

SEQ ID NO: 2356307 - RNA, 13 nt, Bordetella pertussis
ccccgcacgggga

SEQ ID NO: 2356308 - RNA, 20 nt, Bordetella pertussis
ccccgcacggggacaggcac

SEQ ID NO: 2356309 - RNA, 16 nt, Bordetella pertussis
ccccgcacggggacug

SEQ ID NO: 2356310 - RNA, 21 nt, Bordetella pertussis
ccccgcacggggacuggcacc

SEQ ID NO: 2356311 - RNA, 18 nt, Bordetella pertussis
ccccgcagggacaggcuc

SEQ ID NO: 2356312 - RNA, 20 nt, Bordetella pertussis
ccccgcauggagaccggcgc

SEQ ID NO: 2356313 - RNA, 16 nt, Bordetella pertussis
ccccgcauggggacug

SEQ ID NO: 2356314 - RNA, 18 nt, Bordetella pertussis
ccccgcaugggggcuggc

SEQ ID NO: 2356315 - RNA, 11 nt, Bordetella pertussis
ccccgccaggc

SEQ ID NO: 2356316 - RNA, 11 nt, Bordetella pertussis
ccccgccaggu

SEQ ID NO: 2356317 - RNA, 18 nt, Bordetella pertussis
ccccgccgcacgggcgcc

SEQ ID NO: 2356318 - RNA, 17 nt, Bordetella pertussis
ccccgccgggacaggca

SEQ ID NO: 2356319 - RNA, 21 nt, Bordetella pertussis
ccccgccguggcguugacggc

SEQ ID NO: 2356320 - RNA, 21 nt, Bordetella pertussis
ccccgcgacccagaacccggc

SEQ ID NO: 2356321 - RNA, 22 nt, Bordetella pertussis
ccccgcggaggagguuuuccug

SEQ ID NO: 2356322 - RNA, 12 nt, Bordetella pertussis
ccccgcggccgc

SEQ ID NO: 2356323 - RNA, 13 nt, Bordetella pertussis
ccccgcggcgccc

SEQ ID NO: 2356324 - RNA, 12 nt, Bordetella pertussis
ccccgcggggac

SEQ ID NO: 2356325 - RNA, 17 nt, Bordetella pertussis
ccccgcggggacuggcu

SEQ ID NO: 2356326 - RNA, 18 nt, Bordetella pertussis
ccccgcggggacuggcuc

SEQ ID NO: 2356327 - RNA, 22 nt, Bordetella pertussis
ccccgcggggacuggcucccac

SEQ ID NO: 2356328 - RNA, 23 nt, Bordetella pertussis
ccccgcggggacuggcucccacc

SEQ ID NO: 2356329 - RNA, 15 nt, Bordetella pertussis
ccccgcugaccuggu

SEQ ID NO: 2356330 - RNA, 19 nt, Bordetella pertussis
ccccgcugaccuggugugc

SEQ ID NO: 2356331 - RNA, 20 nt, Bordetella pertussis
ccccgcugaccuggugugcc

SEQ ID NO: 2356332 - RNA, 17 nt, Bordetella pertussis
ccccgcuggccgucgcc

SEQ ID NO: 2356333 - RNA, 15 nt, Bordetella pertussis
ccccgcugggacagg

SEQ ID NO: 2356334 - RNA, 17 nt, Bordetella pertussis
ccccgcugggacaggca

SEQ ID NO: 2356335 - RNA, 18 nt, Bordetella pertussis
ccccggcaccaucgccgc

SEQ ID NO: 2356336 - RNA, 12 nt, Bordetella pertussis
ccccggcccggc

SEQ ID NO: 2356337 - RNA, 15 nt, Bordetella pertussis
ccccggcccggcggg

SEQ ID NO: 2356338 - RNA, 21 nt, Bordetella pertussis
ccccggcccggcgggccggcu

SEQ ID NO: 2356339 - RNA, 14 nt, Bordetella pertussis
ccccggccgacggc

SEQ ID NO: 2356340 - RNA, 13 nt, Bordetella pertussis
ccccggccgcccc

SEQ ID NO: 2356341 - RNA, 14 nt, Bordetella pertussis
ccccggccgccccc

SEQ ID NO: 2356342 - RNA, 11 nt, Bordetella pertussis
ccccggccggu

SEQ ID NO: 2356343 - RNA, 14 nt, Bordetella pertussis
ccccggcgccgcgu

SEQ ID NO: 2356344 - RNA, 14 nt, Bordetella pertussis
ccccggcgcggccg

SEQ ID NO: 2356345 - RNA, 16 nt, Bordetella pertussis
ccccggcgcggccggg

SEQ ID NO: 2356346 - RNA, 19 nt, Bordetella pertussis
ccccggcgcggcgcgcgcc

SEQ ID NO: 2356347 - RNA, 16 nt, Bordetella pertussis
ccccggcucccgcgcc

SEQ ID NO: 2356348 - RNA, 17 nt, Bordetella pertussis
ccccgguagucgccggc

SEQ ID NO: 2356349 - RNA, 20 nt, Bordetella pertussis
ccccggugucgccguggcgg

SEQ ID NO: 2356350 - RNA, 16 nt, Bordetella pertussis
ccccguagcgcaucgc

SEQ ID NO: 2356351 - RNA, 19 nt, Bordetella pertussis
ccccgucaucgggugcggc

SEQ ID NO: 2356352 - RNA, 12 nt, Bordetella pertussis
ccccgucgaccg

SEQ ID NO: 2356353 - RNA, 12 nt, Bordetella pertussis
ccccgucggccg

SEQ ID NO: 2356354 - RNA, 13 nt, Bordetella pertussis
ccccgucggcggc

SEQ ID NO: 2356355 - RNA, 19 nt, Bordetella pertussis
ccccgucggcggcaagcag

SEQ ID NO: 2356356 - RNA, 18 nt, Bordetella pertussis
ccccgucgggacaggcuc

SEQ ID NO: 2356357 - RNA, 15 nt, Bordetella pertussis
ccccgucguccgucc

SEQ ID NO: 2356358 - RNA, 19 nt, Bordetella pertussis
ccccgucguccguccuggc

SEQ ID NO: 2356359 - RNA, 13 nt, Bordetella pertussis
ccccgugcaccau

SEQ ID NO: 2356360 - RNA, 23 nt, Bordetella pertussis
ccccgugccgcggcgcggcccgc

SEQ ID NO: 2356361 - RNA, 20 nt, Bordetella pertussis
ccccgugcggggaccggcac

SEQ ID NO: 2356362 - RNA, 15 nt, Bordetella pertussis
ccccguucggggaca

SEQ ID NO: 2356363 - RNA, 23 nt, Bordetella pertussis
ccccuacgaauccccgcucaggu

SEQ ID NO: 2356364 - RNA, 15 nt, Bordetella pertussis
ccccucauuggcgcg

SEQ ID NO: 2356365 - RNA, 15 nt, Bordetella pertussis
ccccuccggcgccgc

SEQ ID NO: 2356366 - RNA, 13 nt, Bordetella pertussis
ccccugcggggac

SEQ ID NO: 2356367 - RNA, 14 nt, Bordetella pertussis
ccccugcggggaca

SEQ ID NO: 2356368 - RNA, 17 nt, Bordetella pertussis
ccccugcggggacaggc

SEQ ID NO: 2356369 - RNA, 18 nt, Bordetella pertussis
ccccugcggggacaggca

SEQ ID NO: 2356370 - RNA, 18 nt, Bordetella pertussis
ccccugguacgaucaggc

SEQ ID NO: 2356371 - RNA, 14 nt, Bordetella pertussis
ccccuugcggccgc

SEQ ID NO: 2356372 - RNA, 15 nt, Bordetella pertussis
ccccuugcggccgcc

SEQ ID NO: 2356373 - RNA, 16 nt, Bordetella pertussis
ccccuugcggccgccg

SEQ ID NO: 2356374 - RNA, 13 nt, Bordetella pertussis
ccccuuggcuucg

SEQ ID NO: 2356375 - RNA, 11 nt, Bordetella pertussis
cccgaaaccca

SEQ ID NO: 2356376 - RNA, 20 nt, Bordetella pertussis
cccgaaacgcgcagcaccgg

SEQ ID NO: 2356377 - RNA, 21 nt, Bordetella pertussis
cccgaaccggcaucccugcuu

SEQ ID NO: 2356378 - RNA, 16 nt, Bordetella pertussis
cccgaacggggacugg

SEQ ID NO: 2356379 - RNA, 23 nt, Bordetella pertussis
cccgaacggggacuggcaccaau

SEQ ID NO: 2356380 - RNA, 14 nt, Bordetella pertussis
cccgaagcgcagca

SEQ ID NO: 2356381 - RNA, 18 nt, Bordetella pertussis
cccgaagcgcagcaccag

SEQ ID NO: 2356382 - RNA, 16 nt, Bordetella pertussis
cccgaaggcgcggccg

SEQ ID NO: 2356383 - RNA, 14 nt, Bordetella pertussis
cccgacaccuggac

SEQ ID NO: 2356384 - RNA, 20 nt, Bordetella pertussis
cccgacaccuggacccgcuc

SEQ ID NO: 2356385 - RNA, 14 nt, Bordetella pertussis
cccgacaugccgcc

SEQ ID NO: 2356386 - RNA, 17 nt, Bordetella pertussis
cccgacaugccgcccca

SEQ ID NO: 2356387 - RNA, 23 nt, Bordetella pertussis
cccgacaugccgccccaggcgua

SEQ ID NO: 2356388 - RNA, 19 nt, Bordetella pertussis
cccgaccgcaugggcgccg

SEQ ID NO: 2356389 - RNA, 15 nt, Bordetella pertussis
cccgaccugcuggcg

SEQ ID NO: 2356390 - RNA, 17 nt, Bordetella pertussis
cccgacgacaacccgaa

SEQ ID NO: 2356391 - RNA, 21 nt, Bordetella pertussis
cccgacgaggagccggcgggc

SEQ ID NO: 2356392 - RNA, 17 nt, Bordetella pertussis
cccgacgaugaucauga

SEQ ID NO: 2356393 - RNA, 12 nt, Bordetella pertussis
cccgacgccaca

SEQ ID NO: 2356394 - RNA, 13 nt, Bordetella pertussis
cccgacgccgcgc

SEQ ID NO: 2356395 - RNA, 14 nt, Bordetella pertussis
cccgacgcgaggca

SEQ ID NO: 2356396 - RNA, 13 nt, Bordetella pertussis
cccgacggcgccg

SEQ ID NO: 2356397 - RNA, 14 nt, Bordetella pertussis
cccgacggcgccga

SEQ ID NO: 2356398 - RNA, 23 nt, Bordetella pertussis
cccgacggcgccgauccggcgca

SEQ ID NO: 2356399 - RNA, 18 nt, Bordetella pertussis
cccgacggcgccgugcug

SEQ ID NO: 2356400 - RNA, 15 nt, Bordetella pertussis
cccgacggcgcgccc

SEQ ID NO: 2356401 - RNA, 12 nt, Bordetella pertussis
cccgagaccgcc

SEQ ID NO: 2356402 - RNA, 13 nt, Bordetella pertussis
cccgagcgccaca

SEQ ID NO: 2356403 - RNA, 22 nt, Bordetella pertussis
cccgagcgcgacagcaccaacu

SEQ ID NO: 2356404 - RNA, 13 nt, Bordetella pertussis
cccgagcggcgcc

SEQ ID NO: 2356405 - RNA, 14 nt, Bordetella pertussis
cccgagcggcgcca

SEQ ID NO: 2356406 - RNA, 15 nt, Bordetella pertussis
cccgagcgggcaugg

SEQ ID NO: 2356407 - RNA, 15 nt, Bordetella pertussis
cccgagcuggccggc

SEQ ID NO: 2356408 - RNA, 22 nt, Bordetella pertussis
cccgaggcgcgcagcacgccga

SEQ ID NO: 2356409 - RNA, 14 nt, Bordetella pertussis
cccgaggcggcgcg

SEQ ID NO: 2356410 - RNA, 16 nt, Bordetella pertussis
cccgaggcggcgcggg

SEQ ID NO: 2356411 - RNA, 15 nt, Bordetella pertussis
cccgagggcgcggcg

SEQ ID NO: 2356412 - RNA, 17 nt, Bordetella pertussis
cccgagggcgcggcgcc

SEQ ID NO: 2356413 - RNA, 21 nt, Bordetella pertussis
cccgaguccuugacgccgccg

SEQ ID NO: 2356414 - RNA, 23 nt, Bordetella pertussis
cccgaguccuugacgccgccgaa

SEQ ID NO: 2356415 - RNA, 17 nt, Bordetella pertussis
cccgaguugaggaugcg

SEQ ID NO: 2356416 - RNA, 21 nt, Bordetella pertussis
cccgaguugaggaugcgcgcg

SEQ ID NO: 2356417 - RNA, 22 nt, Bordetella pertussis
cccgauacaaggugccuguccc

SEQ ID NO: 2356418 - RNA, 20 nt, Bordetella pertussis
cccgauacgacacgccgcgc

SEQ ID NO: 2356419 - RNA, 21 nt, Bordetella pertussis
cccgauacgacacgccgcgcg

SEQ ID NO: 2356420 - RNA, 18 nt, Bordetella pertussis
cccgauagccgcgcgccu

SEQ ID NO: 2356421 - RNA, 19 nt, Bordetella pertussis
accccgguguaggcgggca

SEQ ID NO: 2356422 - RNA, 16 nt, Bordetella pertussis
accccguagcgcaucg

SEQ ID NO: 2356423 - RNA, 20 nt, Bordetella pertussis
accccguggucgccagcacg

SEQ ID NO: 2356424 - RNA, 15 nt, Bordetella pertussis
accccguugcagccc

SEQ ID NO: 2356425 - RNA, 19 nt, Bordetella pertussis
accccguugcagcccagcg

SEQ ID NO: 2356426 - RNA, 16 nt, Bordetella pertussis
accccuugcggccgcc

SEQ ID NO: 2356427 - RNA, 23 nt, Bordetella pertussis
acccgaaacccagaucgccuggg

SEQ ID NO: 2356428 - RNA, 14 nt, Bordetella pertussis
acccgaaggcgcgg

SEQ ID NO: 2356429 - RNA, 15 nt, Bordetella pertussis
acccgaaggcgcggc

SEQ ID NO: 2356430 - RNA, 21 nt, Bordetella pertussis
acccgagcccuggcuuggccg

SEQ ID NO: 2356431 - RNA, 16 nt, Bordetella pertussis
acccgauaugccaagg

SEQ ID NO: 2356432 - RNA, 21 nt, Bordetella pertussis
acccgaugacggggcggcgcc

SEQ ID NO: 2356433 - RNA, 18 nt, Bordetella pertussis
acccgcaaaaccgggccc

SEQ ID NO: 2356434 - RNA, 20 nt, Bordetella pertussis
acccgcaaaaccgggcccgg

SEQ ID NO: 2356435 - RNA, 21 nt, Bordetella pertussis
acccgcaaaaccgggcccgga

SEQ ID NO: 2356436 - RNA, 16 nt, Bordetella pertussis
acccgcaagauuucau

SEQ ID NO: 2356437 - RNA, 12 nt, Bordetella pertussis
cccgaugcgcca

SEQ ID NO: 2356438 - RNA, 15 nt, Bordetella pertussis
cccgaugcuccgggu

SEQ ID NO: 2356439 - RNA, 14 nt, Bordetella pertussis
cccgaugcucgccg

SEQ ID NO: 2356440 - RNA, 16 nt, Bordetella pertussis
cccgaugcucgccggc

SEQ ID NO: 2356441 - RNA, 19 nt, Bordetella pertussis
cccgaugcucgccggcgcc

SEQ ID NO: 2356442 - RNA, 22 nt, Bordetella pertussis
cccgauggucacacugucgcca

SEQ ID NO: 2356443 - RNA, 22 nt, Bordetella pertussis
cccgauuccaggacgacaggca

SEQ ID NO: 2356444 - RNA, 23 nt, Bordetella pertussis
cccgauuccaggacgacaggcau

SEQ ID NO: 2356445 - RNA, 17 nt, Bordetella pertussis
cccgcaaaaccgggccc

SEQ ID NO: 2356446 - RNA, 21 nt, Bordetella pertussis
cccgcaaaccugaugccuguc

SEQ ID NO: 2356447 - RNA, 17 nt, Bordetella pertussis
cccgcaacgccgcccgu

SEQ ID NO: 2356448 - RNA, 17 nt, Bordetella pertussis
cccgcaacgggccggcc

SEQ ID NO: 2356449 - RNA, 15 nt, Bordetella pertussis
cccgcaaggaccaug

SEQ ID NO: 2356450 - RNA, 19 nt, Bordetella pertussis
cccgcaaggggccggcgcc

SEQ ID NO: 2356451 - RNA, 20 nt, Bordetella pertussis
cccgcaaggggccggcgccg

SEQ ID NO: 2356452 - RNA, 17 nt, Bordetella pertussis
cccgcaagggggacugg

SEQ ID NO: 2356453 - RNA, 11 nt, Bordetella pertussis
cccgcacauac

SEQ ID NO: 2356454 - RNA, 22 nt, Bordetella pertussis
cccgcacauacaaggcgcggca

SEQ ID NO: 2356455 - RNA, 16 nt, Bordetella pertussis
cccgcaccgaccagcg

SEQ ID NO: 2356456 - RNA, 22 nt, Bordetella pertussis
cccgcaccgaccagcgcgcgcc

SEQ ID NO: 2356457 - RNA, 19 nt, Bordetella pertussis
cccgcaccgcccgcaagca

SEQ ID NO: 2356458 - RNA, 14 nt, Bordetella pertussis
cccgcacgcagccc

SEQ ID NO: 2356459 - RNA, 13 nt, Bordetella pertussis
cccgcacgggccg

SEQ ID NO: 2356460 - RNA, 16 nt, Bordetella pertussis
cccgcacggggacugg

SEQ ID NO: 2356461 - RNA, 14 nt, Bordetella pertussis
cccgcagggacagg

SEQ ID NO: 2356462 - RNA, 20 nt, Bordetella pertussis
cccgcagggacaggcacccc

SEQ ID NO: 2356463 - RNA, 20 nt, Bordetella pertussis
cccgcagggacaggcaccga

SEQ ID NO: 2356464 - RNA, 17 nt, Bordetella pertussis
cccgcagguggggcagc

SEQ ID NO: 2356465 - RNA, 23 nt, Bordetella pertussis
cccgcagguggggcagcaggccg

SEQ ID NO: 2356466 - RNA, 18 nt, Bordetella pertussis
cccgcaguacccggugca

SEQ ID NO: 2356467 - RNA, 20 nt, Bordetella pertussis
cccgcaguacccggugcagc

SEQ ID NO: 2356468 - RNA, 16 nt, Bordetella pertussis
cccgcauagacgccga

SEQ ID NO: 2356469 - RNA, 18 nt, Bordetella pertussis
cccgcauagacgccgacc

SEQ ID NO: 2356470 - RNA, 16 nt, Bordetella pertussis
cccgcaucgcgcgccg

SEQ ID NO: 2356471 - RNA, 18 nt, Bordetella pertussis
cccgcaucgcgcgccgcc

SEQ ID NO: 2356472 - RNA, 22 nt, Bordetella pertussis
cccgcaucggcguaccaggcag

SEQ ID NO: 2356473 - RNA, 13 nt, Bordetella pertussis
cccgcaugcgcag

SEQ ID NO: 2356474 - RNA, 22 nt, Bordetella pertussis
cccgcauggagaccggcgccug

SEQ ID NO: 2356475 - RNA, 20 nt, Bordetella pertussis
cccgcaugggggcuggcgcu

SEQ ID NO: 2356476 - RNA, 17 nt, Bordetella pertussis
cccgcaugguggcgcag

SEQ ID NO: 2356477 - RNA, 20 nt, Bordetella pertussis
cccgcaugguggcgcaggca

SEQ ID NO: 2356478 - RNA, 18 nt, Bordetella pertussis
cccgccaacacgauccac

SEQ ID NO: 2356479 - RNA, 14 nt, Bordetella pertussis
cccgccaccaggaa

SEQ ID NO: 2356480 - RNA, 19 nt, Bordetella pertussis
cccgccaccaggaacgcca

SEQ ID NO: 2356481 - RNA, 22 nt, Bordetella pertussis
cccgccaccaggaacgccagca

SEQ ID NO: 2356482 - RNA, 22 nt, Bordetella pertussis
cccgccaccgcccccgccgcca

SEQ ID NO: 2356483 - RNA, 16 nt, Bordetella pertussis
cccgccacgcaggcgg

SEQ ID NO: 2356484 - RNA, 15 nt, Bordetella pertussis
cccgccacggcgccc

SEQ ID NO: 2356485 - RNA, 14 nt, Bordetella pertussis
cccgccacggcggu

SEQ ID NO: 2356486 - RNA, 17 nt, Bordetella pertussis
cccgccacgucgccggc

SEQ ID NO: 2356487 - RNA, 19 nt, Bordetella pertussis
cccgccacgucgccggcgu

SEQ ID NO: 2356488 - RNA, 20 nt, Bordetella pertussis
cccgccacgucgccggcguu

SEQ ID NO: 2356489 - RNA, 15 nt, Bordetella pertussis
cccgccagcaaggcg

SEQ ID NO: 2356490 - RNA, 23 nt, Bordetella pertussis
cccgccagcaaggcggcaaaccc

SEQ ID NO: 2356491 - RNA, 15 nt, Bordetella pertussis
cccgccaggccaggu

SEQ ID NO: 2356492 - RNA, 12 nt, Bordetella pertussis
cccgccaggcga

SEQ ID NO: 2356493 - RNA, 13 nt, Bordetella pertussis
cccgccaggcgaa

SEQ ID NO: 2356494 - RNA, 20 nt, Bordetella pertussis
cccgccaggcgaaccuggcg

SEQ ID NO: 2356495 - RNA, 22 nt, Bordetella pertussis
cccgccagggccauguggcgca

SEQ ID NO: 2356496 - RNA, 11 nt, Bordetella pertussis
cccgccagguu

SEQ ID NO: 2356497 - RNA, 16 nt, Bordetella pertussis
cccgccauccuggccg

SEQ ID NO: 2356498 - RNA, 17 nt, Bordetella pertussis
cccgccauccuggccgc

SEQ ID NO: 2356499 - RNA, 19 nt, Bordetella pertussis
cccgccauccuggccgccg

SEQ ID NO: 2356500 - RNA, 20 nt, Bordetella pertussis
cccgccauccuggccgccgc

SEQ ID NO: 2356501 - RNA, 21 nt, Bordetella pertussis
cccgccauccuggccgccgcg

SEQ ID NO: 2356502 - RNA, 12 nt, Bordetella pertussis
cccgccaucgcg

SEQ ID NO: 2356503 - RNA, 15 nt, Bordetella pertussis
cccgccaucgcgcau

SEQ ID NO: 2356504 - RNA, 18 nt, Bordetella pertussis
cccgccauugcacgcgca

SEQ ID NO: 2356505 - RNA, 19 nt, Bordetella pertussis
cccgccauugcacgcgcag

SEQ ID NO: 2356506 - RNA, 21 nt, Bordetella pertussis
cccgccauugcacgcgcagga

SEQ ID NO: 2356507 - RNA, 18 nt, Bordetella pertussis
cccgcccagcauccgcgc

SEQ ID NO: 2356508 - RNA, 21 nt, Bordetella pertussis
cccgcccagcgagucgaccag

SEQ ID NO: 2356509 - RNA, 21 nt, Bordetella pertussis
cccgccccauugggacgccag

SEQ ID NO: 2356510 - RNA, 23 nt, Bordetella pertussis
cccgccccauugggacgccagcc

SEQ ID NO: 2356511 - RNA, 14 nt, Bordetella pertussis
cccgccccgugcac

SEQ ID NO: 2356512 - RNA, 21 nt, Bordetella pertussis
cccgccccgugcaccaugccg

SEQ ID NO: 2356513 - RNA, 18 nt, Bordetella pertussis
cccgcccgcugaccggcc

SEQ ID NO: 2356514 - RNA, 19 nt, Bordetella pertussis
cccgcccgcugaccggccu

SEQ ID NO: 2356515 - RNA, 12 nt, Bordetella pertussis
cccgcccggguu

SEQ ID NO: 2356516 - RNA, 13 nt, Bordetella pertussis
cccgcccucuucc

SEQ ID NO: 2356517 - RNA, 18 nt, Bordetella pertussis
cccgcccugacgccugcg

SEQ ID NO: 2356518 - RNA, 20 nt, Bordetella pertussis
cccgcccugacgccugcgcc

SEQ ID NO: 2356519 - RNA, 15 nt, Bordetella pertussis
cccgcccugcccggc

SEQ ID NO: 2356520 - RNA, 19 nt, Bordetella pertussis
cccgcccuugccagggccu

SEQ ID NO: 2356521 - RNA, 15 nt, Bordetella pertussis
cccgcccuuggucac

SEQ ID NO: 2356522 - RNA, 20 nt, Bordetella pertussis
cccgccgacgaaaugccggc

SEQ ID NO: 2356523 - RNA, 22 nt, Bordetella pertussis
cccgccgagucggcgauggcgc

SEQ ID NO: 2356524 - RNA, 13 nt, Bordetella pertussis
cccgccgccggcg

SEQ ID NO: 2356525 - RNA, 15 nt, Bordetella pertussis
cccgccgccgggcgc

SEQ ID NO: 2356526 - RNA, 14 nt, Bordetella pertussis
cccgccgcgaucag

SEQ ID NO: 2356527 - RNA, 23 nt, Bordetella pertussis
cccgccgcgaucagcgcggccgc

SEQ ID NO: 2356528 - RNA, 12 nt, Bordetella pertussis
cccgccgcggca

SEQ ID NO: 2356529 - RNA, 13 nt, Bordetella pertussis
cccgccgcggcag

SEQ ID NO: 2356530 - RNA, 21 nt, Bordetella pertussis
cccgccggcgcgcgcgcgccg

SEQ ID NO: 2356531 - RNA, 19 nt, Bordetella pertussis
cccgccgggacaggcaccc

SEQ ID NO: 2356532 - RNA, 20 nt, Bordetella pertussis
cccgccgggccaaggugccu

SEQ ID NO: 2356533 - RNA, 18 nt, Bordetella pertussis
cccggaucauccgggccc

SEQ ID NO: 2356534 - RNA, 16 nt, Bordetella pertussis
cccggaucgacaggaa

SEQ ID NO: 2356535 - RNA, 15 nt, Bordetella pertussis
cccggaucgcacccg

SEQ ID NO: 2356536 - RNA, 23 nt, Bordetella pertussis
cccggaugccaccucgcuugccc

SEQ ID NO: 2356537 - RNA, 19 nt, Bordetella pertussis
cccggcaacccgcccacgc

SEQ ID NO: 2356538 - RNA, 15 nt, Bordetella pertussis
cccggcaaucccggc

SEQ ID NO: 2356539 - RNA, 17 nt, Bordetella pertussis
cccggcaaucccggcga

SEQ ID NO: 2356540 - RNA, 20 nt, Bordetella pertussis
cccggcaccaucgccgccug

SEQ ID NO: 2356541 - RNA, 21 nt, Bordetella pertussis
cccggcaccaucgccgccugc

SEQ ID NO: 2356542 - RNA, 19 nt, Bordetella pertussis
cccggcaccaugcgcacca

SEQ ID NO: 2356543 - RNA, 14 nt, Bordetella pertussis
cccggcacgcgccg

SEQ ID NO: 2356544 - RNA, 13 nt, Bordetella pertussis
cccggcagcugac

SEQ ID NO: 2356545 - RNA, 20 nt, Bordetella pertussis
cccggcagggucucggccac

SEQ ID NO: 2356546 - RNA, 21 nt, Bordetella pertussis
cccggcagggugacgggcugg

SEQ ID NO: 2356547 - RNA, 19 nt, Bordetella pertussis
cccggcaugggcgugccgc

SEQ ID NO: 2356548 - RNA, 16 nt, Bordetella pertussis
cccggccacggccggg

SEQ ID NO: 2356549 - RNA, 17 nt, Bordetella pertussis
cccggccacggccgggc

SEQ ID NO: 2356550 - RNA, 22 nt, Bordetella pertussis
cccggccacgggaccgcucagc

SEQ ID NO: 2356551 - RNA, 22 nt, Bordetella pertussis
cccggccacguguggcaggcca

SEQ ID NO: 2356552 - RNA, 11 nt, Bordetella pertussis
cccggccagag

SEQ ID NO: 2356553 - RNA, 14 nt, Bordetella pertussis
cccggccaggcgcc

SEQ ID NO: 2356554 - RNA, 15 nt, Bordetella pertussis
cccggccaggcgccg

SEQ ID NO: 2356555 - RNA, 19 nt, Bordetella pertussis
cccggccaggcgccggcgg

SEQ ID NO: 2356556 - RNA, 14 nt, Bordetella pertussis
cccggcccaggccg

SEQ ID NO: 2356557 - RNA, 17 nt, Bordetella pertussis
cccggcccaggccgggc

SEQ ID NO: 2356558 - RNA, 11 nt, Bordetella pertussis
cccggccccag

SEQ ID NO: 2356559 - RNA, 15 nt, Bordetella pertussis
cccggccccaggccg

SEQ ID NO: 2356560 - RNA, 14 nt, Bordetella pertussis
cccggcccgcgccg

SEQ ID NO: 2356561 - RNA, 15 nt, Bordetella pertussis
cccggcccggcgggc

SEQ ID NO: 2356562 - RNA, 17 nt, Bordetella pertussis
cccggccgaucgcgccg

SEQ ID NO: 2356563 - RNA, 16 nt, Bordetella pertussis
cccggccgccagcaug

SEQ ID NO: 2356564 - RNA, 17 nt, Bordetella pertussis
cccggccgccagcaugg

SEQ ID NO: 2356565 - RNA, 14 nt, Bordetella pertussis
cccggccgcccccg

SEQ ID NO: 2356566 - RNA, 13 nt, Bordetella pertussis
cccggccgccgcc

SEQ ID NO: 2356567 - RNA, 14 nt, Bordetella pertussis
cccggccgccgccg

SEQ ID NO: 2356568 - RNA, 18 nt, Bordetella pertussis
cccggccgccgccggcaa

SEQ ID NO: 2356569 - RNA, 11 nt, Bordetella pertussis
cccggccgccu

SEQ ID NO: 2356570 - RNA, 21 nt, Bordetella pertussis
cccggccgccucaccgcgccg

SEQ ID NO: 2356571 - RNA, 12 nt, Bordetella pertussis
cccggccggcac

SEQ ID NO: 2356572 - RNA, 17 nt, Bordetella pertussis
cccggccggcacggccg

SEQ ID NO: 2356573 - RNA, 19 nt, Bordetella pertussis
cccggccggcacggccggc

SEQ ID NO: 2356574 - RNA, 16 nt, Bordetella pertussis
cccggccggcccgcgc

SEQ ID NO: 2356575 - RNA, 16 nt, Bordetella pertussis
cccggccggccuuccg

SEQ ID NO: 2356576 - RNA, 13 nt, Bordetella pertussis
cccggccggcgcc

SEQ ID NO: 2356577 - RNA, 17 nt, Bordetella pertussis
cccggccggcgccggca

SEQ ID NO: 2356578 - RNA, 19 nt, Bordetella pertussis
cccggccggcgccggcaaa

SEQ ID NO: 2356579 - RNA, 17 nt, Bordetella pertussis
cccggccucagcggccg

SEQ ID NO: 2356580 - RNA, 12 nt, Bordetella pertussis
cccggccucccg

SEQ ID NO: 2356581 - RNA, 17 nt, Bordetella pertussis
cccggccucgcggcgcg

SEQ ID NO: 2356582 - RNA, 15 nt, Bordetella pertussis
cccggccucgcugcg

SEQ ID NO: 2356583 - RNA, 22 nt, Bordetella pertussis
cccggccucgcugcgggcggcc

SEQ ID NO: 2356584 - RNA, 16 nt, Bordetella pertussis
cccggccugcgggcgc

SEQ ID NO: 2356585 - RNA, 18 nt, Bordetella pertussis
cccggccugcgggcgccg

SEQ ID NO: 2356586 - RNA, 20 nt, Bordetella pertussis
cccggccugcgggcgccgcg

SEQ ID NO: 2356587 - RNA, 22 nt, Bordetella pertussis
cccggccugcgugucaggcgga

SEQ ID NO: 2356588 - RNA, 17 nt, Bordetella pertussis
cccggcgaagccggcac

SEQ ID NO: 2356589 - RNA, 23 nt, Bordetella pertussis
cccggcgaagccggcacgccugc

SEQ ID NO: 2356590 - RNA, 15 nt, Bordetella pertussis
cccggcgaggccgcc

SEQ ID NO: 2356591 - RNA, 16 nt, Bordetella pertussis
cccggcgaggccgccc

SEQ ID NO: 2356592 - RNA, 17 nt, Bordetella pertussis
cccggcgaggccgcccg

SEQ ID NO: 2356593 - RNA, 23 nt, Bordetella pertussis
cccggcgagguugcaggccaggc

SEQ ID NO: 2356594 - RNA, 14 nt, Bordetella pertussis
cccggcgcaugcug

SEQ ID NO: 2356595 - RNA, 13 nt, Bordetella pertussis
cccggcgccaccc

SEQ ID NO: 2356596 - RNA, 12 nt, Bordetella pertussis
cccggcgccagc

SEQ ID NO: 2356597 - RNA, 12 nt, Bordetella pertussis
cccggcgccgcg

SEQ ID NO: 2356598 - RNA, 22 nt, Bordetella pertussis
cccggcgccgcguucacgccgg

SEQ ID NO: 2356599 - RNA, 11 nt, Bordetella pertussis
cccggcgcgca

SEQ ID NO: 2356600 - RNA, 12 nt, Bordetella pertussis
cccggcgcgcca

SEQ ID NO: 2356601 - RNA, 14 nt, Bordetella pertussis
cccggcgcgccacc

SEQ ID NO: 2356602 - RNA, 15 nt, Bordetella pertussis
cccggcgcgccaccc

SEQ ID NO: 2356603 - RNA, 16 nt, Bordetella pertussis
cccggcgcgccggccg

SEQ ID NO: 2356604 - RNA, 18 nt, Bordetella pertussis
cccggcgcgccggccgcc

SEQ ID NO: 2356605 - RNA, 18 nt, Bordetella pertussis
cccggcgcgccuucggca

SEQ ID NO: 2356606 - RNA, 21 nt, Bordetella pertussis
cccggcgcgccuucggcaggc

SEQ ID NO: 2356607 - RNA, 23 nt, Bordetella pertussis
cccggcgcgccuucggcaggcgc

SEQ ID NO: 2356608 - RNA, 13 nt, Bordetella pertussis
cccggcgcggccg

SEQ ID NO: 2356609 - RNA, 12 nt, Bordetella pertussis
cccggcgcggcg

SEQ ID NO: 2356610 - RNA, 15 nt, Bordetella pertussis
cccggcgcggcgcgc

SEQ ID NO: 2356611 - RNA, 17 nt, Bordetella pertussis
cccggcgcucagcgcgc

SEQ ID NO: 2356612 - RNA, 19 nt, Bordetella pertussis
cccggcgcucagcgcgccg

SEQ ID NO: 2356613 - RNA, 12 nt, Bordetella pertussis
cccggcgcuggc

SEQ ID NO: 2356614 - RNA, 14 nt, Bordetella pertussis
cccggcgcuggccg

SEQ ID NO: 2356615 - RNA, 17 nt, Bordetella pertussis
cccggcgcuggccgcca

SEQ ID NO: 2356616 - RNA, 18 nt, Bordetella pertussis
cccggcgcuggccgccau

SEQ ID NO: 2356617 - RNA, 23 nt, Bordetella pertussis
cccggcggccaggccggcgcgcc

SEQ ID NO: 2356618 - RNA, 12 nt, Bordetella pertussis
cccggcggcgcg

SEQ ID NO: 2356619 - RNA, 17 nt, Bordetella pertussis
cccggcggcgcgccgcc

SEQ ID NO: 2356620 - RNA, 18 nt, Bordetella pertussis
cccggcggcgcgccgccg

SEQ ID NO: 2356621 - RNA, 21 nt, Bordetella pertussis
cccggcggcgcgccgccgggc

SEQ ID NO: 2356622 - RNA, 15 nt, Bordetella pertussis
cccggcggcgcggcg

SEQ ID NO: 2356623 - RNA, 19 nt, Bordetella pertussis
cccggcggcgcggcgagca

SEQ ID NO: 2356624 - RNA, 13 nt, Bordetella pertussis
cccggcgggccgg

SEQ ID NO: 2356625 - RNA, 16 nt, Bordetella pertussis
cccggcgggccggcuc

SEQ ID NO: 2356626 - RNA, 13 nt, Bordetella pertussis
cccggcggggaca

SEQ ID NO: 2356627 - RNA, 19 nt, Bordetella pertussis
cccggcggggacaggcgcc

SEQ ID NO: 2356628 - RNA, 16 nt, Bordetella pertussis
cccggcggugaccugg

SEQ ID NO: 2356629 - RNA, 20 nt, Bordetella pertussis
cccggcguagcugcgccgca

SEQ ID NO: 2356630 - RNA, 19 nt, Bordetella pertussis
cccggcgugcccagggcca

SEQ ID NO: 2356631 - RNA, 13 nt, Bordetella pertussis
cccggcgugcuga

SEQ ID NO: 2356632 - RNA, 15 nt, Bordetella pertussis
cccggcuccaggccg

SEQ ID NO: 2356633 - RNA, 16 nt, Bordetella pertussis
cccggcuccaggccgc

SEQ ID NO: 2356634 - RNA, 18 nt, Bordetella pertussis
cccggcuccaggccgccc

SEQ ID NO: 2356635 - RNA, 16 nt, Bordetella pertussis
cccggcucccgcgcca

SEQ ID NO: 2356636 - RNA, 16 nt, Bordetella pertussis
cccggcugcgcggccg

SEQ ID NO: 2356637 - RNA, 22 nt, Bordetella pertussis
cccggcugcucguucugcgcgc

SEQ ID NO: 2356638 - RNA, 20 nt, Bordetella pertussis
cccggcugggacaggcaccc

SEQ ID NO: 2356639 - RNA, 17 nt, Bordetella pertussis
cccgggcaggcucagcc

SEQ ID NO: 2356640 - RNA, 22 nt, Bordetella pertussis
cccgggcaugcgaaagccggcc

SEQ ID NO: 2356641 - RNA, 12 nt, Bordetella pertussis
cccgggccgcug

SEQ ID NO: 2356642 - RNA, 16 nt, Bordetella pertussis
cccgggccgcuggccc

SEQ ID NO: 2356643 - RNA, 22 nt, Bordetella pertussis
cccgggccgucuacaggcccag

SEQ ID NO: 2356644 - RNA, 13 nt, Bordetella pertussis
cccgggcgcaagc

SEQ ID NO: 2356645 - RNA, 12 nt, Bordetella pertussis
cccgggcgcgcu

SEQ ID NO: 2356646 - RNA, 16 nt, Bordetella pertussis
cccgggcgugaccagc

SEQ ID NO: 2356647 - RNA, 15 nt, Bordetella pertussis
accgagcugccgccu

SEQ ID NO: 2356648 - RNA, 18 nt, Bordetella pertussis
accgagggccggaacagc

SEQ ID NO: 2356649 - RNA, 13 nt, Bordetella pertussis
accgagggcgcgu

SEQ ID NO: 2356650 - RNA, 17 nt, Bordetella pertussis
accgaggugccagccug

SEQ ID NO: 2356651 - RNA, 14 nt, Bordetella pertussis
accgauccagcccg

SEQ ID NO: 2356652 - RNA, 15 nt, Bordetella pertussis
accgaugcgccggcc

SEQ ID NO: 2356653 - RNA, 15 nt, Bordetella pertussis
accgauucgcgcacc

SEQ ID NO: 2356654 - RNA, 24 nt, Bordetella pertussis
accgcaaggaaguggccgagcgca

SEQ ID NO: 2356655 - RNA, 19 nt, Bordetella pertussis
accgcacgauggcgcgcga

SEQ ID NO: 2356656 - RNA, 18 nt, Bordetella pertussis
accgcagaagcagccgcg

SEQ ID NO: 2356657 - RNA, 22 nt, Bordetella pertussis
accgcaggcaagcugcuggcgc

SEQ ID NO: 2356658 - RNA, 15 nt, Bordetella pertussis
accgcaugcggcaca

SEQ ID NO: 2356659 - RNA, 16 nt, Bordetella pertussis
accgcaugggccaggc

SEQ ID NO: 2356660 - RNA, 17 nt, Bordetella pertussis
accgccacagcgccgcg

SEQ ID NO: 2356661 - RNA, 20 nt, Bordetella pertussis
accgccaccguggcguccau

SEQ ID NO: 2356662 - RNA, 21 nt, Bordetella pertussis
accgccacgcgguccagcccc

SEQ ID NO: 2356663 - RNA, 20 nt, Bordetella pertussis
accgccacgugcugcuggag

SEQ ID NO: 2356664 - RNA, 12 nt, Bordetella pertussis
accgccagcagg

SEQ ID NO: 2356665 - RNA, 22 nt, Bordetella pertussis
accgccagcaggcccugggcca

SEQ ID NO: 2356666 - RNA, 16 nt, Bordetella pertussis
accgccagcaggcgcu

SEQ ID NO: 2356667 - RNA, 17 nt, Bordetella pertussis
accgccagcauccagcc

SEQ ID NO: 2356668 - RNA, 11 nt, Bordetella pertussis
accgccagccc

SEQ ID NO: 2356669 - RNA, 15 nt, Bordetella pertussis
accgccagcccgguc

SEQ ID NO: 2356670 - RNA, 15 nt, Bordetella pertussis
accgccagcgcgucg

SEQ ID NO: 2356671 - RNA, 22 nt, Bordetella pertussis
cccggugaucgaguaggccggc

SEQ ID NO: 2356672 - RNA, 17 nt, Bordetella pertussis
cccggugcagccgccgc

SEQ ID NO: 2356673 - RNA, 17 nt, Bordetella pertussis
cccggugccaguccccc

SEQ ID NO: 2356674 - RNA, 14 nt, Bordetella pertussis
cccggugccugccc

SEQ ID NO: 2356675 - RNA, 16 nt, Bordetella pertussis
cccggugcguaccagc

SEQ ID NO: 2356676 - RNA, 15 nt, Bordetella pertussis
cccgguucaaccggc

SEQ ID NO: 2356677 - RNA, 16 nt, Bordetella pertussis
cccgguucugcggcgc

SEQ ID NO: 2356678 - RNA, 18 nt, Bordetella pertussis
cccgguuggggucgcgcu

SEQ ID NO: 2356679 - RNA, 22 nt, Bordetella pertussis
cccgguuggugcgaaucacuuc

SEQ ID NO: 2356680 - RNA, 23 nt, Bordetella pertussis
cccguacgucaaggccugcccgg

SEQ ID NO: 2356681 - RNA, 15 nt, Bordetella pertussis
cccguaggcggccca

SEQ ID NO: 2356682 - RNA, 14 nt, Bordetella pertussis
cccgucagcggcgc

SEQ ID NO: 2356683 - RNA, 19 nt, Bordetella pertussis
cccgucaggguacgcucga

SEQ ID NO: 2356684 - RNA, 19 nt, Bordetella pertussis
cccgucaucgggugcggcg

SEQ ID NO: 2356685 - RNA, 17 nt, Bordetella pertussis
cccgucaugcgccgcag

SEQ ID NO: 2356686 - RNA, 18 nt, Bordetella pertussis
cccgucaugcgccgcagc

SEQ ID NO: 2356687 - RNA, 15 nt, Bordetella pertussis
cccgucauggcggca

SEQ ID NO: 2356688 - RNA, 17 nt, Bordetella pertussis
cccgucauggcggcagg

SEQ ID NO: 2356689 - RNA, 18 nt, Bordetella pertussis
cccgucauggcggcaggc

SEQ ID NO: 2356690 - RNA, 21 nt, Bordetella pertussis
cccgucauggcggcaggcgcg

SEQ ID NO: 2356691 - RNA, 16 nt, Bordetella pertussis
cccguccacggccugc

SEQ ID NO: 2356692 - RNA, 14 nt, Bordetella pertussis
cccguccgggcggc

SEQ ID NO: 2356693 - RNA, 17 nt, Bordetella pertussis
cccguccuuggcguccg

SEQ ID NO: 2356694 - RNA, 19 nt, Bordetella pertussis
cccgucgcgccaggccggc

SEQ ID NO: 2356695 - RNA, 15 nt, Bordetella pertussis
cccgucgcuggcgcg

SEQ ID NO: 2356696 - RNA, 18 nt, Bordetella pertussis
cccgucggccgucugggc

SEQ ID NO: 2356697 - RNA, 13 nt, Bordetella pertussis
cccgucucgcgcg

SEQ ID NO: 2356698 - RNA, 16 nt, Bordetella pertussis
cccgucucgcgcgcca

SEQ ID NO: 2356699 - RNA, 22 nt, Bordetella pertussis
cccgucucgcgcgccaggugca

SEQ ID NO: 2356700 - RNA, 23 nt, Bordetella pertussis
cccgugccgcagaagaacaccgu

SEQ ID NO: 2356701 - RNA, 20 nt, Bordetella pertussis
cccgugccgcggcgcggccc

SEQ ID NO: 2356702 - RNA, 13 nt, Bordetella pertussis
cccgugccggccg

SEQ ID NO: 2356703 - RNA, 19 nt, Bordetella pertussis
cccgugcgcgguucaggcu

SEQ ID NO: 2356704 - RNA, 15 nt, Bordetella pertussis
cccgugcgggccugc

SEQ ID NO: 2356705 - RNA, 17 nt, Bordetella pertussis
cccgugcggggaccggc

SEQ ID NO: 2356706 - RNA, 22 nt, Bordetella pertussis
cccgugcggggaccggcacccg

SEQ ID NO: 2356707 - RNA, 16 nt, Bordetella pertussis
cccgugcgggugccug

SEQ ID NO: 2356708 - RNA, 22 nt, Bordetella pertussis
cccgugcgggugccuguccccg

SEQ ID NO: 2356709 - RNA, 18 nt, Bordetella pertussis
cccgugcgugcgccuguc

SEQ ID NO: 2356710 - RNA, 19 nt, Bordetella pertussis
cccgugcgugcgccugucc

SEQ ID NO: 2356711 - RNA, 19 nt, Bordetella pertussis
cccgugcgugugccugucc

SEQ ID NO: 2356712 - RNA, 21 nt, Bordetella pertussis
cccgugcuccagaacgcgccg

SEQ ID NO: 2356713 - RNA, 18 nt, Bordetella pertussis
cccguggcccgggugccu

SEQ ID NO: 2356714 - RNA, 14 nt, Bordetella pertussis
cccguggggacagg

SEQ ID NO: 2356715 - RNA, 17 nt, Bordetella pertussis
cccguggggacaggcac

SEQ ID NO: 2356716 - RNA, 13 nt, Bordetella pertussis
cccguuccccauc

SEQ ID NO: 2356717 - RNA, 23 nt, Bordetella pertussis
cccguuccccaucaucugcggca

SEQ ID NO: 2356718 - RNA, 14 nt, Bordetella pertussis
cccguucggggaca

SEQ ID NO: 2356719 - RNA, 14 nt, Bordetella pertussis
cccguugcagccca

SEQ ID NO: 2356720 - RNA, 21 nt, Bordetella pertussis
cccguugcagcccagcgcgau

SEQ ID NO: 2356721 - RNA, 18 nt, Bordetella pertussis
cccguugcggcgccucgg

SEQ ID NO: 2356722 - RNA, 19 nt, Bordetella pertussis
cccguugcucuuggcaacc

SEQ ID NO: 2356723 - RNA, 21 nt, Bordetella pertussis
cccguuggcgucgagcaccgu

SEQ ID NO: 2356724 - RNA, 15 nt, Bordetella pertussis
cccguuugcgcagcu

SEQ ID NO: 2356725 - RNA, 19 nt, Bordetella pertussis
cccguuugcgcagcucgug

SEQ ID NO: 2356726 - RNA, 17 nt, Bordetella pertussis
cccuacccgccgggcgg

SEQ ID NO: 2356727 - RNA, 16 nt, Bordetella pertussis
cccuacgaguaccgcc

SEQ ID NO: 2356728 - RNA, 18 nt, Bordetella pertussis
cccucacgcuuccccgaa

SEQ ID NO: 2356729 - RNA, 18 nt, Bordetella pertussis
cccucagcccgcaccgcc

SEQ ID NO: 2356730 - RNA, 21 nt, Bordetella pertussis
cccucagcccgcaccgcccgc

SEQ ID NO: 2356731 - RNA, 16 nt, Bordetella pertussis
cccucccacgaccugc

SEQ ID NO: 2356732 - RNA, 20 nt, Bordetella pertussis
cccucccugugggggacagg

SEQ ID NO: 2356733 - RNA, 13 nt, Bordetella pertussis
cccuccggcgccg

SEQ ID NO: 2356734 - RNA, 14 nt, Bordetella pertussis
cccuccggcgccgc

SEQ ID NO: 2356735 - RNA, 15 nt, Bordetella pertussis
cccuccggcgccgcc

SEQ ID NO: 2356736 - RNA, 17 nt, Bordetella pertussis
cccuccgggucgcggca

SEQ ID NO: 2356737 - RNA, 22 nt, Bordetella pertussis
cccuccucgcuuuaccagcugu

SEQ ID NO: 2356738 - RNA, 13 nt, Bordetella pertussis
cccuccucggcca

SEQ ID NO: 2356739 - RNA, 17 nt, Bordetella pertussis
cccucgaugaggccagg

SEQ ID NO: 2356740 - RNA, 20 nt, Bordetella pertussis
cccucgaugaggccagggag

SEQ ID NO: 2356741 - RNA, 12 nt, Bordetella pertussis
cccucgcacggc

SEQ ID NO: 2356742 - RNA, 23 nt, Bordetella pertussis
cccucgcacggccgucaacagca

SEQ ID NO: 2356743 - RNA, 12 nt, Bordetella pertussis
cccucgcccagc

SEQ ID NO: 2356744 - RNA, 15 nt, Bordetella pertussis
cccucgcccagcgag

SEQ ID NO: 2356745 - RNA, 13 nt, Bordetella pertussis
cccucgcccccga

SEQ ID NO: 2356746 - RNA, 17 nt, Bordetella pertussis
cccucgcccgugcgcgg

SEQ ID NO: 2356747 - RNA, 23 nt, Bordetella pertussis
cccucgcgcacggugcgcacgau

SEQ ID NO: 2356748 - RNA, 13 nt, Bordetella pertussis
cccucgcgccacc

SEQ ID NO: 2356749 - RNA, 15 nt, Bordetella pertussis
cccucgcggaugacc

SEQ ID NO: 2356750 - RNA, 17 nt, Bordetella pertussis
cccucgcggaugaccug

SEQ ID NO: 2356751 - RNA, 16 nt, Bordetella pertussis
cccucgcggccgucgg

SEQ ID NO: 2356752 - RNA, 16 nt, Bordetella pertussis
cccucgcugcgcguca

SEQ ID NO: 2356753 - RNA, 14 nt, Bordetella pertussis
cccucggccugcgc

SEQ ID NO: 2356754 - RNA, 17 nt, Bordetella pertussis
cccucggccugcgcgau

SEQ ID NO: 2356755 - RNA, 18 nt, Bordetella pertussis
cccucgggcgacaggcgc

SEQ ID NO: 2356756 - RNA, 22 nt, Bordetella pertussis
cccucgggcgacaggcgcgccc

SEQ ID NO: 2356757 - RNA, 23 nt, Bordetella pertussis
cccucgggugccuguccccacau

SEQ ID NO: 2356758 - RNA, 18 nt, Bordetella pertussis
cccucggucagcgccagg

SEQ ID NO: 2356759 - RNA, 16 nt, Bordetella pertussis
cccucggugcugcugu

SEQ ID NO: 2356760 - RNA, 20 nt, Bordetella pertussis
cccuugagcacggcgcggcu

SEQ ID NO: 2356761 - RNA, 17 nt, Bordetella pertussis
cccuugagcgugggcug

SEQ ID NO: 2356762 - RNA, 19 nt, Bordetella pertussis
cccuugaucagcggcggca

SEQ ID NO: 2356763 - RNA, 16 nt, Bordetella pertussis
cccuugauggccgggc

SEQ ID NO: 2356764 - RNA, 19 nt, Bordetella pertussis
cccuugcccaacgcggcgu

SEQ ID NO: 2356765 - RNA, 11 nt, Bordetella pertussis
cccuugccgca

SEQ ID NO: 2356766 - RNA, 14 nt, Bordetella pertussis
cccuugccgcagcg

SEQ ID NO: 2356767 - RNA, 20 nt, Bordetella pertussis
cccuugccgcagcggggaca

SEQ ID NO: 2356768 - RNA, 11 nt, Bordetella pertussis
cccuugccgcc

SEQ ID NO: 2356769 - RNA, 21 nt, Bordetella pertussis
cccuugcgcaaguucaucauc

SEQ ID NO: 2356770 - RNA, 15 nt, Bordetella pertussis
cccuugcggccgccg

SEQ ID NO: 2356771 - RNA, 16 nt, Bordetella pertussis
cccuugcggggcgcgu

SEQ ID NO: 2356772 - RNA, 22 nt, Bordetella pertussis
cccuugcucagucgggcagcgc

SEQ ID NO: 2356773 - RNA, 20 nt, Bordetella pertussis
cccuuggcuucggucacacu

SEQ ID NO: 2356774 - RNA, 16 nt, Bordetella pertussis
cccuuguagggaaucg

SEQ ID NO: 2356775 - RNA, 14 nt, Bordetella pertussis
cccuugugcugcca

SEQ ID NO: 2356776 - RNA, 22 nt, Bordetella pertussis
cccuugugcugccaugccgcgc

SEQ ID NO: 2356777 - RNA, 23 nt, Bordetella pertussis
ccgaaaacaaaauugcccgcgaa

SEQ ID NO: 2356778 - RNA, 17 nt, Bordetella pertussis
ccgaaacucaccgccgc

SEQ ID NO: 2356779 - RNA, 21 nt, Bordetella pertussis
ccgaaagacugcggcgcgaag

SEQ ID NO: 2356780 - RNA, 14 nt, Bordetella pertussis
ccgaacaaggucca

SEQ ID NO: 2356781 - RNA, 16 nt, Bordetella pertussis
ccgaacaagguccagg

SEQ ID NO: 2356782 - RNA, 23 nt, Bordetella pertussis
ccgaacaagguccaggcccggca

SEQ ID NO: 2356783 - RNA, 18 nt, Bordetella pertussis
ccgaacaccaccgagggc

SEQ ID NO: 2356784 - RNA, 13 nt, Bordetella pertussis
ccgaacaggcggu

SEQ ID NO: 2356785 - RNA, 14 nt, Bordetella pertussis
ccgaaccacagcau

SEQ ID NO: 2356786 - RNA, 14 nt, Bordetella pertussis
ccgaaccacccggc

SEQ ID NO: 2356787 - RNA, 15 nt, Bordetella pertussis
ccgaaccacccggcc

SEQ ID NO: 2356788 - RNA, 15 nt, Bordetella pertussis
ccgaaccagcgcacc

SEQ ID NO: 2356789 - RNA, 20 nt, Bordetella pertussis
ccgaacccugccucagacca

SEQ ID NO: 2356790 - RNA, 17 nt, Bordetella pertussis
ccgaaccgaccgccacg

SEQ ID NO: 2356791 - RNA, 15 nt, Bordetella pertussis
ccgaaccggcauccc

SEQ ID NO: 2356792 - RNA, 20 nt, Bordetella pertussis
ccgaaccggcaucccugcuu

SEQ ID NO: 2356793 - RNA, 19 nt, Bordetella pertussis
ccgaaccuuccuccgacag

SEQ ID NO: 2356794 - RNA, 17 nt, Bordetella pertussis
ccgaacgccgccgcagc

SEQ ID NO: 2356795 - RNA, 20 nt, Bordetella pertussis
ccgaacgccgccgcagccgc

SEQ ID NO: 2356796 - RNA, 20 nt, Bordetella pertussis
ccgaacgcggucgcauuggc

SEQ ID NO: 2356797 - RNA, 21 nt, Bordetella pertussis
ccgaacgcgugcaccagccau

SEQ ID NO: 2356798 - RNA, 14 nt, Bordetella pertussis
ccgaacggcagcag

SEQ ID NO: 2356799 - RNA, 22 nt, Bordetella pertussis
ccgaacggcagcagcgcgccgg

SEQ ID NO: 2356800 - RNA, 16 nt, Bordetella pertussis
ccgaacgggcguggcg

SEQ ID NO: 2356801 - RNA, 17 nt, Bordetella pertussis
ccgaacgggcguggcgc

SEQ ID NO: 2356802 - RNA, 13 nt, Bordetella pertussis
ccgaacggggccg

SEQ ID NO: 2356803 - RNA, 21 nt, Bordetella pertussis
ccgaacggggccgccucggcg

SEQ ID NO: 2356804 - RNA, 19 nt, Bordetella pertussis
ccgaacugggacaggccca

SEQ ID NO: 2356805 - RNA, 17 nt, Bordetella pertussis
ccgaacugggcgcgucg

SEQ ID NO: 2356806 - RNA, 17 nt, Bordetella pertussis
ccgaacugucgcgccac

SEQ ID NO: 2356807 - RNA, 20 nt, Bordetella pertussis
ccgaacugucgcgccacggc

SEQ ID NO: 2356808 - RNA, 21 nt, Bordetella pertussis
ccgaacugucgcgccacggcu

SEQ ID NO: 2356809 - RNA, 15 nt, Bordetella pertussis
ccgaacuucagcccg

SEQ ID NO: 2356810 - RNA, 22 nt, Bordetella pertussis
ccgaagaaauagcccgcggcca

SEQ ID NO: 2356811 - RNA, 13 nt, Bordetella pertussis
ccgaagaggagcu

SEQ ID NO: 2356812 - RNA, 19 nt, Bordetella pertussis
ccgaagcaaugcagcgcga

SEQ ID NO: 2356813 - RNA, 22 nt, Bordetella pertussis
ccgaagcgcagcaccaggucga

SEQ ID NO: 2356814 - RNA, 16 nt, Bordetella pertussis
ccgaagcggcccgggu

SEQ ID NO: 2356815 - RNA, 15 nt, Bordetella pertussis
ccgaagcggcguucu

SEQ ID NO: 2356816 - RNA, 15 nt, Bordetella pertussis
ccgaagcgggcgagg

SEQ ID NO: 2356817 - RNA, 15 nt, Bordetella pertussis
ccgaaggcgcggccg

SEQ ID NO: 2356818 - RNA, 23 nt, Bordetella pertussis
ccgaagggcaccgugaugucgcc

SEQ ID NO: 2356819 - RNA, 12 nt, Bordetella pertussis
ccgaaggguugc

SEQ ID NO: 2356820 - RNA, 14 nt, Bordetella pertussis
ccgaaggguugcag

SEQ ID NO: 2356821 - RNA, 19 nt, Bordetella pertussis
ccgaaggucuuggcgugca

SEQ ID NO: 2356822 - RNA, 20 nt, Bordetella pertussis
ccgaaggucuuggcgugcag

SEQ ID NO: 2356823 - RNA, 23 nt, Bordetella pertussis
ccgaaggucuuggcgugcaggcu

SEQ ID NO: 2356824 - RNA, 19 nt, Bordetella pertussis
ccgaaggugggcgaaccgc

SEQ ID NO: 2356825 - RNA, 21 nt, Bordetella pertussis
ccgaaguacacggccagcacg

SEQ ID NO: 2356826 - RNA, 16 nt, Bordetella pertussis
ccgaagucggcgcgcg

SEQ ID NO: 2356827 - RNA, 18 nt, Bordetella pertussis
ccgaaguugcggccgugc

SEQ ID NO: 2356828 - RNA, 17 nt, Bordetella pertussis
ccgaaugcccgcccuug

SEQ ID NO: 2356829 - RNA, 21 nt, Bordetella pertussis
ccgaauugccgccgcugccgg

SEQ ID NO: 2356830 - RNA, 13 nt, Bordetella pertussis
ccgacaacggcgu

SEQ ID NO: 2356831 - RNA, 16 nt, Bordetella pertussis
ccgacaacggcgugcu

SEQ ID NO: 2356832 - RNA, 18 nt, Bordetella pertussis
ccgacaccaaggggcgga

SEQ ID NO: 2356833 - RNA, 12 nt, Bordetella pertussis
ccgacacgcugg

SEQ ID NO: 2356834 - RNA, 18 nt, Bordetella pertussis
ccgacagcacauggcgcg

SEQ ID NO: 2356835 - RNA, 19 nt, Bordetella pertussis
ccgacagcacauggcgcgc

SEQ ID NO: 2356836 - RNA, 21 nt, Bordetella pertussis
ccgacagcacauggcgcgccg

SEQ ID NO: 2356837 - RNA, 16 nt, Bordetella pertussis
ccgacagcacgcccgc

SEQ ID NO: 2356838 - RNA, 14 nt, Bordetella pertussis
ccgacagcgccagc

SEQ ID NO: 2356839 - RNA, 12 nt, Bordetella pertussis
ccgacagcgccc

SEQ ID NO: 2356840 - RNA, 18 nt, Bordetella pertussis
ccgacagcgucgagcuga

SEQ ID NO: 2356841 - RNA, 19 nt, Bordetella pertussis
ccgacaggaaggcgagcgc

SEQ ID NO: 2356842 - RNA, 23 nt, Bordetella pertussis
ccgacaggaugaagaccacgugg

SEQ ID NO: 2356843 - RNA, 14 nt, Bordetella pertussis
ccgacaggcgccgc

SEQ ID NO: 2356844 - RNA, 21 nt, Bordetella pertussis
ccgacaggcgcgcaggcgggc

SEQ ID NO: 2356845 - RNA, 18 nt, Bordetella pertussis
ccgacaggcggcuguagu

SEQ ID NO: 2356846 - RNA, 23 nt, Bordetella pertussis
ccgacaggcggcuguagucgccg

SEQ ID NO: 2356847 - RNA, 16 nt, Bordetella pertussis
ccgacagguaggcgcc

SEQ ID NO: 2356848 - RNA, 20 nt, Bordetella pertussis
ccgacaugaccgcguccgcg

SEQ ID NO: 2356849 - RNA, 19 nt, Bordetella pertussis
ccgacaugucgugcuggcu

SEQ ID NO: 2356850 - RNA, 13 nt, Bordetella pertussis
ccgaccaccagca

SEQ ID NO: 2356851 - RNA, 22 nt, Bordetella pertussis
ccgaccaccagcaccgaugcgc

SEQ ID NO: 2356852 - RNA, 18 nt, Bordetella pertussis
ccgaccaccugcaccgcc

SEQ ID NO: 2356853 - RNA, 13 nt, Bordetella pertussis
ccgaccagcacga

SEQ ID NO: 2356854 - RNA, 14 nt, Bordetella pertussis
ccgaccagcacgau

SEQ ID NO: 2356855 - RNA, 15 nt, Bordetella pertussis
ccgaccagcgcgcgc

SEQ ID NO: 2356856 - RNA, 17 nt, Bordetella pertussis
ccgaccagcgcgcgccg

SEQ ID NO: 2356857 - RNA, 20 nt, Bordetella pertussis
ccgaccagcgcgcgccggcc

SEQ ID NO: 2356858 - RNA, 17 nt, Bordetella pertussis
ccgaccagcucgacgcc

SEQ ID NO: 2356859 - RNA, 19 nt, Bordetella pertussis
ccgaccaggcccgccacgg

SEQ ID NO: 2356860 - RNA, 15 nt, Bordetella pertussis
ccgaccaggccggcg

SEQ ID NO: 2356861 - RNA, 13 nt, Bordetella pertussis
ccgaccaggcugc

SEQ ID NO: 2356862 - RNA, 15 nt, Bordetella pertussis
ccgaccaggcugcgc

SEQ ID NO: 2356863 - RNA, 19 nt, Bordetella pertussis
ccgaccaggcugcgcgccg

SEQ ID NO: 2356864 - RNA, 17 nt, Bordetella pertussis
ccgaccagguaucgacc

SEQ ID NO: 2356865 - RNA, 20 nt, Bordetella pertussis
ccgaccagguaucgacccag

SEQ ID NO: 2356866 - RNA, 15 nt, Bordetella pertussis
ccgaccaggucgggc

SEQ ID NO: 2356867 - RNA, 15 nt, Bordetella pertussis
ccgacccccggcccg

SEQ ID NO: 2356868 - RNA, 20 nt, Bordetella pertussis
ccgacccccggcccgcgccg

SEQ ID NO: 2356869 - RNA, 21 nt, Bordetella pertussis
ccgacccccggcccgcgccgg

SEQ ID NO: 2356870 - RNA, 14 nt, Bordetella pertussis
ccgacccgcggccc

SEQ ID NO: 2356871 - RNA, 13 nt, Bordetella pertussis
ccgacccugcccg

SEQ ID NO: 2356872 - RNA, 17 nt, Bordetella pertussis
ccgaccgaagaggagcu

SEQ ID NO: 2356873 - RNA, 15 nt, Bordetella pertussis
accgcuggccaggcu

SEQ ID NO: 2356874 - RNA, 16 nt, Bordetella pertussis
accgcuuccgccaccg

SEQ ID NO: 2356875 - RNA, 23 nt, Bordetella pertussis
accgcuuccgccaccgcgccgcc

SEQ ID NO: 2356876 - RNA, 17 nt, Bordetella pertussis
accggaacaccagcaag

SEQ ID NO: 2356877 - RNA, 18 nt, Bordetella pertussis
accggaacaccagcaagc

SEQ ID NO: 2356878 - RNA, 19 nt, Bordetella pertussis
accggaacaccagcaagcc

SEQ ID NO: 2356879 - RNA, 23 nt, Bordetella pertussis
accggaauagauaugggccugau

SEQ ID NO: 2356880 - RNA, 17 nt, Bordetella pertussis
accggaaucaccgccgc

SEQ ID NO: 2356881 - RNA, 12 nt, Bordetella pertussis
accggagcggcu

SEQ ID NO: 2356882 - RNA, 18 nt, Bordetella pertussis
accggagcggcucgccgc

SEQ ID NO: 2356883 - RNA, 12 nt, Bordetella pertussis
accggaggcgcc

SEQ ID NO: 2356884 - RNA, 15 nt, Bordetella pertussis
accggaggcgccgcg

SEQ ID NO: 2356885 - RNA, 14 nt, Bordetella pertussis
accggcaagcgcuc

SEQ ID NO: 2356886 - RNA, 17 nt, Bordetella pertussis
accggcaagcgcucgcc

SEQ ID NO: 2356887 - RNA, 22 nt, Bordetella pertussis
accggcaagcgcucgccggcgc

SEQ ID NO: 2356888 - RNA, 12 nt, Bordetella pertussis
accggcaaggcc

SEQ ID NO: 2356889 - RNA, 14 nt, Bordetella pertussis
accggcaaggccgc

SEQ ID NO: 2356890 - RNA, 14 nt, Bordetella pertussis
accggcaccagcca

SEQ ID NO: 2356891 - RNA, 17 nt, Bordetella pertussis
accggcaccugggccuu

SEQ ID NO: 2356892 - RNA, 18 nt, Bordetella pertussis
accggcaccugggccuuc

SEQ ID NO: 2356893 - RNA, 18 nt, Bordetella pertussis
accggcacgccggcggcg

SEQ ID NO: 2356894 - RNA, 23 nt, Bordetella pertussis
accggcacgccggcggcgcuggc

SEQ ID NO: 2356895 - RNA, 17 nt, Bordetella pertussis
accggcacgcgccaggc

SEQ ID NO: 2356896 - RNA, 15 nt, Bordetella pertussis
accggcagauggugc

SEQ ID NO: 2356897 - RNA, 17 nt, Bordetella pertussis
accggcaggccgcgcug

SEQ ID NO: 2356898 - RNA, 20 nt, Bordetella pertussis
accggcaucccugcuugcgc

SEQ ID NO: 2356899 - RNA, 15 nt, Bordetella pertussis
accggcaugccgucc

SEQ ID NO: 2356900 - RNA, 19 nt, Bordetella pertussis
accggcaugccguccacgc

SEQ ID NO: 2356901 - RNA, 15 nt, Bordetella pertussis
accggccaggggcgc

SEQ ID NO: 2356902 - RNA, 18 nt, Bordetella pertussis
accggccaggggcgcugg

SEQ ID NO: 2356903 - RNA, 19 nt, Bordetella pertussis
accggccaggggcgcuggu

SEQ ID NO: 2356904 - RNA, 17 nt, Bordetella pertussis
accggccagucgcggug

SEQ ID NO: 2356905 - RNA, 12 nt, Bordetella pertussis
ccgacgccagcg

SEQ ID NO: 2356906 - RNA, 15 nt, Bordetella pertussis
ccgacgccgcgcgcg

SEQ ID NO: 2356907 - RNA, 16 nt, Bordetella pertussis
ccgacgccgcgcgcga

SEQ ID NO: 2356908 - RNA, 18 nt, Bordetella pertussis
ccgacgcgcccgggcuga

SEQ ID NO: 2356909 - RNA, 17 nt, Bordetella pertussis
ccgacgcgccgggccac

SEQ ID NO: 2356910 - RNA, 12 nt, Bordetella pertussis
ccgacgcgcugu

SEQ ID NO: 2356911 - RNA, 21 nt, Bordetella pertussis
ccgacgcgcuguccgaugcgc

SEQ ID NO: 2356912 - RNA, 17 nt, Bordetella pertussis
ccgacgcgcuuccagga

SEQ ID NO: 2356913 - RNA, 15 nt, Bordetella pertussis
ccgacgcggccagcg

SEQ ID NO: 2356914 - RNA, 22 nt, Bordetella pertussis
ccgacgcggucgcccaacccgg

SEQ ID NO: 2356915 - RNA, 17 nt, Bordetella pertussis
ccgacggcauggccggc

SEQ ID NO: 2356916 - RNA, 18 nt, Bordetella pertussis
ccgacggccucggccagg

SEQ ID NO: 2356917 - RNA, 22 nt, Bordetella pertussis
ccgacggcgccgugcuggaggu

SEQ ID NO: 2356918 - RNA, 13 nt, Bordetella pertussis
ccgacggcgcgcc

SEQ ID NO: 2356919 - RNA, 16 nt, Bordetella pertussis
ccgacggcgcgcccgc

SEQ ID NO: 2356920 - RNA, 12 nt, Bordetella pertussis
ccgacggcugga

SEQ ID NO: 2356921 - RNA, 13 nt, Bordetella pertussis
ccgacgggccggu

SEQ ID NO: 2356922 - RNA, 13 nt, Bordetella pertussis
ccgacgggcggcu

SEQ ID NO: 2356923 - RNA, 14 nt, Bordetella pertussis
ccgacgggugggug

SEQ ID NO: 2356924 - RNA, 22 nt, Bordetella pertussis
ccgacgguaucucagcgcgccg

SEQ ID NO: 2356925 - RNA, 23 nt, Bordetella pertussis
ccgacgguaucucagcgcgccgc

SEQ ID NO: 2356926 - RNA, 15 nt, Bordetella pertussis
ccgacguagucgcgc

SEQ ID NO: 2356927 - RNA, 19 nt, Bordetella pertussis
ccgacguagucgcgccagc

SEQ ID NO: 2356928 - RNA, 22 nt, Bordetella pertussis
ccgacguagucgcgccagcggc

SEQ ID NO: 2356929 - RNA, 14 nt, Bordetella pertussis
ccgacgugcgccgc

SEQ ID NO: 2356930 - RNA, 16 nt, Bordetella pertussis
ccgacgugcugcugca

SEQ ID NO: 2356931 - RNA, 19 nt, Bordetella pertussis
ccgacgugcugcugcacgu

SEQ ID NO: 2356932 - RNA, 15 nt, Bordetella pertussis
ccgacucccaugacc

SEQ ID NO: 2356933 - RNA, 21 nt, Bordetella pertussis
ccgacucgaaacgggcggcgu

SEQ ID NO: 2356934 - RNA, 22 nt, Bordetella pertussis
ccgacucgaaacgggcggcguc

SEQ ID NO: 2356935 - RNA, 23 nt, Bordetella pertussis
ccgacucgaaacgggcggcgucg

SEQ ID NO: 2356936 - RNA, 12 nt, Bordetella pertussis
ccgacugcugua

SEQ ID NO: 2356937 - RNA, 18 nt, Bordetella pertussis
ccgacugggugcgccuga

SEQ ID NO: 2356938 - RNA, 20 nt, Bordetella pertussis
ccgacuucagacagacgcug

SEQ ID NO: 2356939 - RNA, 22 nt, Bordetella pertussis
ccgacuucucuuucucgggcgu

SEQ ID NO: 2356940 - RNA, 18 nt, Bordetella pertussis
ccgacuuggugggcaccu

SEQ ID NO: 2356941 - RNA, 20 nt, Bordetella pertussis
ccgagaaauccagcgcgccc

SEQ ID NO: 2356942 - RNA, 16 nt, Bordetella pertussis
ccgagaacgccgucgg

SEQ ID NO: 2356943 - RNA, 21 nt, Bordetella pertussis
ccgagaacgccgucggggugg

SEQ ID NO: 2356944 - RNA, 21 nt, Bordetella pertussis
ccgagaagauuucccagagcu

SEQ ID NO: 2356945 - RNA, 15 nt, Bordetella pertussis
ccgagaccgggcggu

SEQ ID NO: 2356946 - RNA, 16 nt, Bordetella pertussis
ccgagaccuucggcca

SEQ ID NO: 2356947 - RNA, 11 nt, Bordetella pertussis
ccgagacgcug

SEQ ID NO: 2356948 - RNA, 15 nt, Bordetella pertussis
ccgagacggccgccg

SEQ ID NO: 2356949 - RNA, 16 nt, Bordetella pertussis
ccgagacggccgccga

SEQ ID NO: 2356950 - RNA, 17 nt, Bordetella pertussis
ccgagacggccgccgac

SEQ ID NO: 2356951 - RNA, 21 nt, Bordetella pertussis
ccgagacggccgccgacgccg

SEQ ID NO: 2356952 - RNA, 18 nt, Bordetella pertussis
ccgagagcugcgucuuga

SEQ ID NO: 2356953 - RNA, 14 nt, Bordetella pertussis
ccgagaugccguuc

SEQ ID NO: 2356954 - RNA, 21 nt, Bordetella pertussis
ccgagauggcgcaggcgcgcg

SEQ ID NO: 2356955 - RNA, 13 nt, Bordetella pertussis
ccgagcccuggcu

SEQ ID NO: 2356956 - RNA, 21 nt, Bordetella pertussis
ccgagcccuggcuuggccgaa

SEQ ID NO: 2356957 - RNA, 21 nt, Bordetella pertussis
ccgagccgaaguacacggcca

SEQ ID NO: 2356958 - RNA, 22 nt, Bordetella pertussis
ccgagccgaaguacacggccag

SEQ ID NO: 2356959 - RNA, 21 nt, Bordetella pertussis
ccgagccgcagguccaggccu

SEQ ID NO: 2356960 - RNA, 22 nt, Bordetella pertussis
ccgagccgccccggcgcggcgc

SEQ ID NO: 2356961 - RNA, 13 nt, Bordetella pertussis
ccgagccggaugg

SEQ ID NO: 2356962 - RNA, 13 nt, Bordetella pertussis
ccgagccggccag

SEQ ID NO: 2356963 - RNA, 16 nt, Bordetella pertussis
ccgagccggccagcgc

SEQ ID NO: 2356964 - RNA, 17 nt, Bordetella pertussis
ccgagccggccagcgcc

SEQ ID NO: 2356965 - RNA, 20 nt, Bordetella pertussis
ccgagccggugggcgcguuc

SEQ ID NO: 2356966 - RNA, 15 nt, Bordetella pertussis
ccgagcgcaccccgg

SEQ ID NO: 2356967 - RNA, 17 nt, Bordetella pertussis
ccgagcgcaccccggcc

SEQ ID NO: 2356968 - RNA, 21 nt, Bordetella pertussis
ccgagcgcgacagcaccaacu

SEQ ID NO: 2356969 - RNA, 12 nt, Bordetella pertussis
ccgagcgcgccc

SEQ ID NO: 2356970 - RNA, 13 nt, Bordetella pertussis
ccgagcgcgcccg

SEQ ID NO: 2356971 - RNA, 14 nt, Bordetella pertussis
ccgagcgcgcccgc

SEQ ID NO: 2356972 - RNA, 15 nt, Bordetella pertussis
ccgagcgcggcaugc

SEQ ID NO: 2356973 - RNA, 22 nt, Bordetella pertussis
ccgagcgcggcaugcgcaugcu

SEQ ID NO: 2356974 - RNA, 15 nt, Bordetella pertussis
ccgagcgcugcgcca

SEQ ID NO: 2356975 - RNA, 15 nt, Bordetella pertussis
ccgagcggcaucugc

SEQ ID NO: 2356976 - RNA, 13 nt, Bordetella pertussis
ccgagcggcgcca

SEQ ID NO: 2356977 - RNA, 16 nt, Bordetella pertussis
ccgagcgggcaugggc

SEQ ID NO: 2356978 - RNA, 19 nt, Bordetella pertussis
ccgagcgggcaugggcccc

SEQ ID NO: 2356979 - RNA, 17 nt, Bordetella pertussis
ccgagcgggccagcgcg

SEQ ID NO: 2356980 - RNA, 21 nt, Bordetella pertussis
ccgagcgggccagcgcggcca

SEQ ID NO: 2356981 - RNA, 14 nt, Bordetella pertussis
ccgagcggggccgc

SEQ ID NO: 2356982 - RNA, 23 nt, Bordetella pertussis
ccgagcgugccgggaugcugcuc

SEQ ID NO: 2356983 - RNA, 21 nt, Bordetella pertussis
ccgagcugagcaccagcagcc

SEQ ID NO: 2356984 - RNA, 22 nt, Bordetella pertussis
ccgagcugccgccuucgucgcg

SEQ ID NO: 2356985 - RNA, 17 nt, Bordetella pertussis
ccgaggaucuggccggc

SEQ ID NO: 2356986 - RNA, 19 nt, Bordetella pertussis
ccgaugcgguaggcccagc

SEQ ID NO: 2356987 - RNA, 15 nt, Bordetella pertussis
ccgaugcucgccggc

SEQ ID NO: 2356988 - RNA, 20 nt, Bordetella pertussis
ccgaugcucgccggcgccgc

SEQ ID NO: 2356989 - RNA, 19 nt, Bordetella pertussis
ccgauggcgccaccuucgc

SEQ ID NO: 2356990 - RNA, 21 nt, Bordetella pertussis
ccgauggcgccaccuucgccg

SEQ ID NO: 2356991 - RNA, 15 nt, Bordetella pertussis
ccgauggcgcgcggc

SEQ ID NO: 2356992 - RNA, 18 nt, Bordetella pertussis
ccgauggcgcgcggcugg

SEQ ID NO: 2356993 - RNA, 19 nt, Bordetella pertussis
ccgauggcgcgcggcuggg

SEQ ID NO: 2356994 - RNA, 16 nt, Bordetella pertussis
ccgauggcgcggccgc

SEQ ID NO: 2356995 - RNA, 22 nt, Bordetella pertussis
ccgauggcguccagcagcagga

SEQ ID NO: 2356996 - RNA, 21 nt, Bordetella pertussis
ccgauggucagcgugucgccg

SEQ ID NO: 2356997 - RNA, 17 nt, Bordetella pertussis
ccgauguagcccauggc

SEQ ID NO: 2356998 - RNA, 18 nt, Bordetella pertussis
ccgauguaugacuugacc

SEQ ID NO: 2356999 - RNA, 19 nt, Bordetella pertussis
ccgauguccacgaaggcgc

SEQ ID NO: 2357000 - RNA, 20 nt, Bordetella pertussis
ccgauguccacgaaggcgcc

SEQ ID NO: 2357001 - RNA, 20 nt, Bordetella pertussis
ccgaugucgaacagcugcag

SEQ ID NO: 2357002 - RNA, 15 nt, Bordetella pertussis
ccgaugucgaccaug

SEQ ID NO: 2357003 - RNA, 22 nt, Bordetella pertussis
ccgauguggcgguucccggggu

SEQ ID NO: 2357004 - RNA, 19 nt, Bordetella pertussis
ccgauguugaacagcugga

SEQ ID NO: 2357005 - RNA, 22 nt, Bordetella pertussis
ccgauguuguuggccgccagcc

SEQ ID NO: 2357006 - RNA, 14 nt, Bordetella pertussis
ccgauguuuuccug

SEQ ID NO: 2357007 - RNA, 17 nt, Bordetella pertussis
ccgauucgccguggcug

SEQ ID NO: 2357008 - RNA, 18 nt, Bordetella pertussis
ccgauugaggccagcacg

SEQ ID NO: 2357009 - RNA, 21 nt, Bordetella pertussis
ccgauugaggccagcacgccg

SEQ ID NO: 2357010 - RNA, 15 nt, Bordetella pertussis
ccgauuucgccgccg

SEQ ID NO: 2357011 - RNA, 13 nt, Bordetella pertussis
ccgauuucggccg

SEQ ID NO: 2357012 - RNA, 17 nt, Bordetella pertussis
ccgauuucggccgccgg

SEQ ID NO: 2357013 - RNA, 21 nt, Bordetella pertussis
ccgcaaaaccgggcccggauc

SEQ ID NO: 2357014 - RNA, 20 nt, Bordetella pertussis
ccgcaaaccugaugccuguc

SEQ ID NO: 2357015 - RNA, 21 nt, Bordetella pertussis
ccgcaaaccugaugccugucc

SEQ ID NO: 2357016 - RNA, 22 nt, Bordetella pertussis
ccgcaaaccugaugccuguccc

SEQ ID NO: 2357017 - RNA, 18 nt, Bordetella pertussis
ccgcaaaucaaugaaaaa

SEQ ID NO: 2357018 - RNA, 17 nt, Bordetella pertussis
ccgcaacaggcagcugc

SEQ ID NO: 2357019 - RNA, 17 nt, Bordetella pertussis
ccgcaacccacccccag

SEQ ID NO: 2357020 - RNA, 18 nt, Bordetella pertussis
ccgcaacccacccccagc

SEQ ID NO: 2357021 - RNA, 21 nt, Bordetella pertussis
ccgcaacccagcagcggcagc

SEQ ID NO: 2357022 - RNA, 18 nt, Bordetella pertussis
ccgcaaccgucgaccggc

SEQ ID NO: 2357023 - RNA, 12 nt, Bordetella pertussis
ccgcaacgccag

SEQ ID NO: 2357024 - RNA, 14 nt, Bordetella pertussis
ccgcaacgccagca

SEQ ID NO: 2357025 - RNA, 19 nt, Bordetella pertussis
ccgcaacgccagcaggcga

SEQ ID NO: 2357026 - RNA, 14 nt, Bordetella pertussis
ccgcaacgccgccc

SEQ ID NO: 2357027 - RNA, 17 nt, Bordetella pertussis
ccgcaacgccgcccguc

SEQ ID NO: 2357028 - RNA, 14 nt, Bordetella pertussis
ccgcaacgccgccg

SEQ ID NO: 2357029 - RNA, 15 nt, Bordetella pertussis
ccgcaacgccgccgg

SEQ ID NO: 2357030 - RNA, 21 nt, Bordetella pertussis
ccgcaacgccgccggcagggc

SEQ ID NO: 2357031 - RNA, 15 nt, Bordetella pertussis
ccgcaacgccgggcc

SEQ ID NO: 2357032 - RNA, 18 nt, Bordetella pertussis
ccgcaacgccgggccgcg

SEQ ID NO: 2357033 - RNA, 21 nt, Bordetella pertussis
ccgcaacgccgggccgcgccg

SEQ ID NO: 2357034 - RNA, 16 nt, Bordetella pertussis
ccgcaacgggccggcc

SEQ ID NO: 2357035 - RNA, 20 nt, Bordetella pertussis
ccgcaacgggccggccgccg

SEQ ID NO: 2357036 - RNA, 12 nt, Bordetella pertussis
ccgcaagcuggc

SEQ ID NO: 2357037 - RNA, 22 nt, Bordetella pertussis
ccgcaagcuggccgaugucgcc

SEQ ID NO: 2357038 - RNA, 15 nt, Bordetella pertussis
ccgcaagcuggcggc

SEQ ID NO: 2357039 - RNA, 17 nt, Bordetella pertussis
ccgcaagcuggcggcgc

SEQ ID NO: 2357040 - RNA, 20 nt, Bordetella pertussis
ccgcaagcuggcggcgcgcg

SEQ ID NO: 2357041 - RNA, 22 nt, Bordetella pertussis
ccgcaagcuggcggcgcgcggc

SEQ ID NO: 2357042 - RNA, 16 nt, Bordetella pertussis
ccgcaaggaaguggcc

SEQ ID NO: 2357043 - RNA, 19 nt, Bordetella pertussis
ccgcaaggaaguggccgag

SEQ ID NO: 2357044 - RNA, 19 nt, Bordetella pertussis
ccgcaaggggccggcgccg

SEQ ID NO: 2357045 - RNA, 18 nt, Bordetella pertussis
ccgcaagggggacuggca

SEQ ID NO: 2357046 - RNA, 19 nt, Bordetella pertussis
ccgcaagggggacuggcac

SEQ ID NO: 2357047 - RNA, 20 nt, Bordetella pertussis
ccgcaagggggacuggcacc

SEQ ID NO: 2357048 - RNA, 23 nt, Bordetella pertussis
ccgcaaguucggcagcgaggcgc

SEQ ID NO: 2357049 - RNA, 19 nt, Bordetella pertussis
ccgcaauaccuucagcccg

SEQ ID NO: 2357050 - RNA, 20 nt, Bordetella pertussis
ccgcaauaccuucagcccgg

SEQ ID NO: 2357051 - RNA, 21 nt, Bordetella pertussis
ccgcaauaccuucagcccggc

SEQ ID NO: 2357052 - RNA, 19 nt, Bordetella pertussis
ccgcaauagaucauccagg

SEQ ID NO: 2357053 - RNA, 22 nt, Bordetella pertussis
ccgcaauagaucauccaggugg

SEQ ID NO: 2357054 - RNA, 20 nt, Bordetella pertussis
ccgcacaguuugucggcgau

SEQ ID NO: 2357055 - RNA, 19 nt, Bordetella pertussis
ccgcacaucgucgacgucg

SEQ ID NO: 2357056 - RNA, 18 nt, Bordetella pertussis
ccgcaccagcgccgacgg

SEQ ID NO: 2357057 - RNA, 19 nt, Bordetella pertussis
ccgcaccagcgccgacggc

SEQ ID NO: 2357058 - RNA, 13 nt, Bordetella pertussis
ccgcaccaggccg

SEQ ID NO: 2357059 - RNA, 16 nt, Bordetella pertussis
ccgcaccaggccgcgg

SEQ ID NO: 2357060 - RNA, 13 nt, Bordetella pertussis
ccgcaccaugcgg

SEQ ID NO: 2357061 - RNA, 16 nt, Bordetella pertussis
ccgcaccaugcggucu

SEQ ID NO: 2357062 - RNA, 22 nt, Bordetella pertussis
ccgcacccgaugacggggcggc

SEQ ID NO: 2357063 - RNA, 17 nt, Bordetella pertussis
ccgcacccgguauccgc

SEQ ID NO: 2357064 - RNA, 20 nt, Bordetella pertussis
ccgcacccgguauccgcgca

SEQ ID NO: 2357065 - RNA, 13 nt, Bordetella pertussis
ccgcaccgaccag

SEQ ID NO: 2357066 - RNA, 16 nt, Bordetella pertussis
ccgcaccgcccgcaag

SEQ ID NO: 2357067 - RNA, 12 nt, Bordetella pertussis
ccgcaccggcgu

SEQ ID NO: 2357068 - RNA, 17 nt, Bordetella pertussis
ccgcaccggcgugcgcu

SEQ ID NO: 2357069 - RNA, 15 nt, Bordetella pertussis
ccgcaccgggcggcc

SEQ ID NO: 2357070 - RNA, 19 nt, Bordetella pertussis
ccgcaccgggcggcccggc

SEQ ID NO: 2357071 - RNA, 23 nt, Bordetella pertussis
ccgcaccggugggagccaguccc

SEQ ID NO: 2357072 - RNA, 19 nt, Bordetella pertussis
ccgcaccugaacaccggcg

SEQ ID NO: 2357073 - RNA, 23 nt, Bordetella pertussis
ccgcaccugaacaccggcgcgcc

SEQ ID NO: 2357074 - RNA, 13 nt, Bordetella pertussis
ccgcacgaagcgg

SEQ ID NO: 2357075 - RNA, 17 nt, Bordetella pertussis
ccgcacgaucgcgccgg

SEQ ID NO: 2357076 - RNA, 16 nt, Bordetella pertussis
ccgcacgauggcgcgc

SEQ ID NO: 2357077 - RNA, 18 nt, Bordetella pertussis
ccgcacgauggcgcgcga

SEQ ID NO: 2357078 - RNA, 11 nt, Bordetella pertussis
ccgcacgcccg

SEQ ID NO: 2357079 - RNA, 12 nt, Bordetella pertussis
ccgcacgcccgc

SEQ ID NO: 2357080 - RNA, 12 nt, Bordetella pertussis
ccgcacgccgac

SEQ ID NO: 2357081 - RNA, 13 nt, Bordetella pertussis
ccgcacgccgacc

SEQ ID NO: 2357082 - RNA, 12 nt, Bordetella pertussis
ccgcacgccggc

SEQ ID NO: 2357083 - RNA, 13 nt, Bordetella pertussis
ccgcacgccggcc

SEQ ID NO: 2357084 - RNA, 17 nt, Bordetella pertussis
ccgcacgccggucgcca

SEQ ID NO: 2357085 - RNA, 12 nt, Bordetella pertussis
ccgcacgcgcgg

SEQ ID NO: 2357086 - RNA, 19 nt, Bordetella pertussis
ccgcacgcgcggcagcgcc

SEQ ID NO: 2357087 - RNA, 20 nt, Bordetella pertussis
ccgcacgcgcggcagcgccg

SEQ ID NO: 2357088 - RNA, 13 nt, Bordetella pertussis
ccgcacgcggccg

SEQ ID NO: 2357089 - RNA, 23 nt, Bordetella pertussis
ccgcacgcucuacacggccgcca

SEQ ID NO: 2357090 - RNA, 16 nt, Bordetella pertussis
ccgcacgggccgacgg

SEQ ID NO: 2357091 - RNA, 17 nt, Bordetella pertussis
ccgcacgggccgacggc

SEQ ID NO: 2357092 - RNA, 21 nt, Bordetella pertussis
ccgcacgggccgacggccucg

SEQ ID NO: 2357093 - RNA, 13 nt, Bordetella pertussis
ccgcacgggcgcc

SEQ ID NO: 2357094 - RNA, 18 nt, Bordetella pertussis
ccgcacgggcgccugucc

SEQ ID NO: 2357095 - RNA, 15 nt, Bordetella pertussis
ccgcacggggacagg

SEQ ID NO: 2357096 - RNA, 17 nt, Bordetella pertussis
ccgcacggggacaggca

SEQ ID NO: 2357097 - RNA, 19 nt, Bordetella pertussis
ccgcacggggacaggcacg

SEQ ID NO: 2357098 - RNA, 22 nt, Bordetella pertussis
ccgcacggggacaggcacgcgc

SEQ ID NO: 2357099 - RNA, 15 nt, Bordetella pertussis
ccgccacccaggcgg

SEQ ID NO: 2357100 - RNA, 17 nt, Bordetella pertussis
ccgccacccaggcggca

SEQ ID NO: 2357101 - RNA, 23 nt, Bordetella pertussis
ccgccacccaggcggcaggcgcc

SEQ ID NO: 2357102 - RNA, 22 nt, Bordetella pertussis
ccgccacccagggcuugacgcg

SEQ ID NO: 2357103 - RNA, 13 nt, Bordetella pertussis
ccgccaccgcccc

SEQ ID NO: 2357104 - RNA, 16 nt, Bordetella pertussis
ccgccaccgcccccgc

SEQ ID NO: 2357105 - RNA, 14 nt, Bordetella pertussis
ccgccaccgcgccg

SEQ ID NO: 2357106 - RNA, 15 nt, Bordetella pertussis
ccgccaccgcgccgc

SEQ ID NO: 2357107 - RNA, 15 nt, Bordetella pertussis
ccgccaccguggcgu

SEQ ID NO: 2357108 - RNA, 20 nt, Bordetella pertussis
ccgccaccucggcgucgccc

SEQ ID NO: 2357109 - RNA, 14 nt, Bordetella pertussis
ccgccaccugggcc

SEQ ID NO: 2357110 - RNA, 15 nt, Bordetella pertussis
ccgccaccugggccg

SEQ ID NO: 2357111 - RNA, 16 nt, Bordetella pertussis
ccgccaccugggccgc

SEQ ID NO: 2357112 - RNA, 24 nt, Bordetella pertussis
ccgccacgaaacccacggcgaugg

SEQ ID NO: 2357113 - RNA, 19 nt, Bordetella pertussis
ccgccacgaagugcgcccc

SEQ ID NO: 2357114 - RNA, 14 nt, Bordetella pertussis
ccgccacgcaggcg

SEQ ID NO: 2357115 - RNA, 14 nt, Bordetella pertussis
ccgccacgcccugg

SEQ ID NO: 2357116 - RNA, 17 nt, Bordetella pertussis
ccgccacgccggccacg

SEQ ID NO: 2357117 - RNA, 21 nt, Bordetella pertussis
ccgccacgccuuguucgcgcg

SEQ ID NO: 2357118 - RNA, 20 nt, Bordetella pertussis
ccgccacgcgcacggccagc

SEQ ID NO: 2357119 - RNA, 17 nt, Bordetella pertussis
ccgccacgcgggccggc

SEQ ID NO: 2357120 - RNA, 18 nt, Bordetella pertussis
ccgccacgcgggccggcc

SEQ ID NO: 2357121 - RNA, 23 nt, Bordetella pertussis
ccgccacgcgguccagccccugc

SEQ ID NO: 2357122 - RNA, 21 nt, Bordetella pertussis
ccgccacgcuggccgcgcugg

SEQ ID NO: 2357123 - RNA, 14 nt, Bordetella pertussis
ccgccacggcgccc

SEQ ID NO: 2357124 - RNA, 20 nt, Bordetella pertussis
ccgccacgggcccgcgcaga

SEQ ID NO: 2357125 - RNA, 21 nt, Bordetella pertussis
ccgccacgggcccgcgcagac

SEQ ID NO: 2357126 - RNA, 17 nt, Bordetella pertussis
ccgccacggucgcgagc

SEQ ID NO: 2357127 - RNA, 15 nt, Bordetella pertussis
ccgccacgucgccgg

SEQ ID NO: 2357128 - RNA, 16 nt, Bordetella pertussis
ccgccagcaaggcggc

SEQ ID NO: 2357129 - RNA, 20 nt, Bordetella pertussis
ccgccagcaaggcgucggcc

SEQ ID NO: 2357130 - RNA, 14 nt, Bordetella pertussis
ccgccagcaccugc

SEQ ID NO: 2357131 - RNA, 17 nt, Bordetella pertussis
ccgccagcaccugcuug

SEQ ID NO: 2357132 - RNA, 14 nt, Bordetella pertussis
ccgccagcagcgcc

SEQ ID NO: 2357133 - RNA, 15 nt, Bordetella pertussis
ccgccagcagcgccg

SEQ ID NO: 2357134 - RNA, 16 nt, Bordetella pertussis
ccgccagcagcucggc

SEQ ID NO: 2357135 - RNA, 21 nt, Bordetella pertussis
ccgccagcagcucggcgacca

SEQ ID NO: 2357136 - RNA, 22 nt, Bordetella pertussis
ccgccagcaggcccugggccag

SEQ ID NO: 2357137 - RNA, 20 nt, Bordetella pertussis
ccgccagcauggcggccagg

SEQ ID NO: 2357138 - RNA, 23 nt, Bordetella pertussis
ccgccagcauggcggccaggcgc

SEQ ID NO: 2357139 - RNA, 23 nt, Bordetella pertussis
ccgccagccaccccgucaucgcc

SEQ ID NO: 2357140 - RNA, 12 nt, Bordetella pertussis
ccgccagcccga

SEQ ID NO: 2357141 - RNA, 20 nt, Bordetella pertussis
ccgccagcccgaggcacaag

SEQ ID NO: 2357142 - RNA, 20 nt, Bordetella pertussis
ccgccagccgcuggcgcgcc

SEQ ID NO: 2357143 - RNA, 21 nt, Bordetella pertussis
ccgccagccgcuggcgcgccg

SEQ ID NO: 2357144 - RNA, 14 nt, Bordetella pertussis
ccgccagccggccc

SEQ ID NO: 2357145 - RNA, 17 nt, Bordetella pertussis
ccgccagccggcccagc

SEQ ID NO: 2357146 - RNA, 12 nt, Bordetella pertussis
ccgccagcgcca

SEQ ID NO: 2357147 - RNA, 16 nt, Bordetella pertussis
ccgccagcgccuggac

SEQ ID NO: 2357148 - RNA, 18 nt, Bordetella pertussis
ccgccagcgccuggaccu

SEQ ID NO: 2357149 - RNA, 20 nt, Bordetella pertussis
ccgccagcgccuggaccugg

SEQ ID NO: 2357150 - RNA, 13 nt, Bordetella pertussis
ccgccagcgcgcc

SEQ ID NO: 2357151 - RNA, 21 nt, Bordetella pertussis
ccgccagcgcgcgcgaggcgg

SEQ ID NO: 2357152 - RNA, 14 nt, Bordetella pertussis
ccgccagcgcgucg

SEQ ID NO: 2357153 - RNA, 22 nt, Bordetella pertussis
ccgccagcgcgucguccagcgu

SEQ ID NO: 2357154 - RNA, 14 nt, Bordetella pertussis
ccgccagcggcugg

SEQ ID NO: 2357155 - RNA, 23 nt, Bordetella pertussis
ccgccaggaaaagccgccuucgg

SEQ ID NO: 2357156 - RNA, 17 nt, Bordetella pertussis
ccgccaggaagaucggc

SEQ ID NO: 2357157 - RNA, 20 nt, Bordetella pertussis
ccgccaggaagaucggcccg

SEQ ID NO: 2357158 - RNA, 22 nt, Bordetella pertussis
ccgccaggaagaucggcccggc

SEQ ID NO: 2357159 - RNA, 21 nt, Bordetella pertussis
ccgccaggaagcgggccugcc

SEQ ID NO: 2357160 - RNA, 14 nt, Bordetella pertussis
ccgccaggacggga

SEQ ID NO: 2357161 - RNA, 13 nt, Bordetella pertussis
ccgccaggccguc

SEQ ID NO: 2357162 - RNA, 15 nt, Bordetella pertussis
ccgccagggccgagc

SEQ ID NO: 2357163 - RNA, 16 nt, Bordetella pertussis
ccgccagggcggcugc

SEQ ID NO: 2357164 - RNA, 17 nt, Bordetella pertussis
ccgccagggcggggccg

SEQ ID NO: 2357165 - RNA, 12 nt, Bordetella pertussis
ccgccaggucgg

SEQ ID NO: 2357166 - RNA, 14 nt, Bordetella pertussis
ccgccaggucggcc

SEQ ID NO: 2357167 - RNA, 15 nt, Bordetella pertussis
ccgccaggucggcca

SEQ ID NO: 2357168 - RNA, 22 nt, Bordetella pertussis
ccgccagguucgccuggcgggg

SEQ ID NO: 2357169 - RNA, 18 nt, Bordetella pertussis
ccgccaguucgucgucgg

SEQ ID NO: 2357170 - RNA, 21 nt, Bordetella pertussis
ccgccaguucgucgucggucg

SEQ ID NO: 2357171 - RNA, 19 nt, Bordetella pertussis
ccgccauaccgaucuacga

SEQ ID NO: 2357172 - RNA, 15 nt, Bordetella pertussis
ccgccauagcugcgc

SEQ ID NO: 2357173 - RNA, 16 nt, Bordetella pertussis
ccgccauagcugcgcc

SEQ ID NO: 2357174 - RNA, 17 nt, Bordetella pertussis
ccgccauaggcgcgcac

SEQ ID NO: 2357175 - RNA, 20 nt, Bordetella pertussis
ccgccauaggcgcgcaccag

SEQ ID NO: 2357176 - RNA, 14 nt, Bordetella pertussis
ccgccaucauccug

SEQ ID NO: 2357177 - RNA, 18 nt, Bordetella pertussis
ccgccaucauccuggucg

SEQ ID NO: 2357178 - RNA, 22 nt, Bordetella pertussis
ccgccaucauccuggucgacgc

SEQ ID NO: 2357179 - RNA, 20 nt, Bordetella pertussis
ccgccaucauggcgucggcc

SEQ ID NO: 2357180 - RNA, 22 nt, Bordetella pertussis
ccgccaucauggcgucggccac

SEQ ID NO: 2357181 - RNA, 23 nt, Bordetella pertussis
ccgccaucauggcgucggccacg

SEQ ID NO: 2357182 - RNA, 18 nt, Bordetella pertussis
ccgccauccuggccgccg

SEQ ID NO: 2357183 - RNA, 20 nt, Bordetella pertussis
ccgccauccuggccgccgcg

SEQ ID NO: 2357184 - RNA, 14 nt, Bordetella pertussis
ccgccaucgccagg

SEQ ID NO: 2357185 - RNA, 17 nt, Bordetella pertussis
ccgccaucgccaggacc

SEQ ID NO: 2357186 - RNA, 17 nt, Bordetella pertussis
ccgccaucgucguagcg

SEQ ID NO: 2357187 - RNA, 22 nt, Bordetella pertussis
ccgccaucgucguagcgccagc

SEQ ID NO: 2357188 - RNA, 15 nt, Bordetella pertussis
ccgccaugcacgggc

SEQ ID NO: 2357189 - RNA, 17 nt, Bordetella pertussis
ccgccaugcacgggcca

SEQ ID NO: 2357190 - RNA, 19 nt, Bordetella pertussis
ccgccaugcacgggccaug

SEQ ID NO: 2357191 - RNA, 21 nt, Bordetella pertussis
ccgccaugcgaugcugcaggg

SEQ ID NO: 2357192 - RNA, 23 nt, Bordetella pertussis
ccgccaugcgaugcugcagggcc

SEQ ID NO: 2357193 - RNA, 18 nt, Bordetella pertussis
ccgccaugcgcaggguuu

SEQ ID NO: 2357194 - RNA, 14 nt, Bordetella pertussis
ccgccaugcgcaug

SEQ ID NO: 2357195 - RNA, 18 nt, Bordetella pertussis
ccgccaugcgcauggcca

SEQ ID NO: 2357196 - RNA, 20 nt, Bordetella pertussis
ccgccaugcgcauggccagc

SEQ ID NO: 2357197 - RNA, 18 nt, Bordetella pertussis
ccgccaugcgccagcagg

SEQ ID NO: 2357198 - RNA, 14 nt, Bordetella pertussis
ccgccaugcggcgc

SEQ ID NO: 2357199 - RNA, 15 nt, Bordetella pertussis
ccgccauggaggcgc

SEQ ID NO: 2357200 - RNA, 18 nt, Bordetella pertussis
ccgccauggaggcgcagc

SEQ ID NO: 2357201 - RNA, 20 nt, Bordetella pertussis
ccgccauggaggcgcagcgc

SEQ ID NO: 2357202 - RNA, 14 nt, Bordetella pertussis
ccgccauggccggc

SEQ ID NO: 2357203 - RNA, 22 nt, Bordetella pertussis
ccgccauggcgcuggcaggcgc

SEQ ID NO: 2357204 - RNA, 15 nt, Bordetella pertussis
ccgccauggcggccg

SEQ ID NO: 2357205 - RNA, 16 nt, Bordetella pertussis
ccgccauggcggccgc

SEQ ID NO: 2357206 - RNA, 18 nt, Bordetella pertussis
ccgccauggcggccgccg

SEQ ID NO: 2357207 - RNA, 21 nt, Bordetella pertussis
ccgccauggcggccgccgcca

SEQ ID NO: 2357208 - RNA, 16 nt, Bordetella pertussis
ccgccauggcggcgcc

SEQ ID NO: 2357209 - RNA, 17 nt, Bordetella pertussis
ccgccauggcggcgccc

SEQ ID NO: 2357210 - RNA, 18 nt, Bordetella pertussis
ccgccauggcggcgccca

SEQ ID NO: 2357211 - RNA, 20 nt, Bordetella pertussis
ccgccgauaccacgcgcggc

SEQ ID NO: 2357212 - RNA, 22 nt, Bordetella pertussis
ccgccgauccacucggccagcg

SEQ ID NO: 2357213 - RNA, 16 nt, Bordetella pertussis
ccgccgauggcgcgcg

SEQ ID NO: 2357214 - RNA, 20 nt, Bordetella pertussis
ccgccgauggcgcgcggcug

SEQ ID NO: 2357215 - RNA, 16 nt, Bordetella pertussis
ccgccgaugugcggcg

SEQ ID NO: 2357216 - RNA, 13 nt, Bordetella pertussis
ccgccgcaagacg

SEQ ID NO: 2357217 - RNA, 14 nt, Bordetella pertussis
ccgccgcaccagcc

SEQ ID NO: 2357218 - RNA, 14 nt, Bordetella pertussis
ccgccgcacgggcg

SEQ ID NO: 2357219 - RNA, 17 nt, Bordetella pertussis
ccgccgcacgggcgccu

SEQ ID NO: 2357220 - RNA, 13 nt, Bordetella pertussis
ccgccgcaugccg

SEQ ID NO: 2357221 - RNA, 12 nt, Bordetella pertussis
ccgccgccacca

SEQ ID NO: 2357222 - RNA, 20 nt, Bordetella pertussis
ccgccgccaccaccucggcc

SEQ ID NO: 2357223 - RNA, 21 nt, Bordetella pertussis
ccgccgccaccaccucggccu

SEQ ID NO: 2357224 - RNA, 21 nt, Bordetella pertussis
ccgccgccaccagcggcgugg

SEQ ID NO: 2357225 - RNA, 14 nt, Bordetella pertussis
ccgccgccagcacg

SEQ ID NO: 2357226 - RNA, 16 nt, Bordetella pertussis
ccgccgccagcacgcc

SEQ ID NO: 2357227 - RNA, 18 nt, Bordetella pertussis
ccgccgccagcacgccau

SEQ ID NO: 2357228 - RNA, 15 nt, Bordetella pertussis
ccgccgccagcagcg

SEQ ID NO: 2357229 - RNA, 20 nt, Bordetella pertussis
ccgccgccagcagcgccgga

SEQ ID NO: 2357230 - RNA, 19 nt, Bordetella pertussis
ccgccgccauagcugcgcc

SEQ ID NO: 2357231 - RNA, 20 nt, Bordetella pertussis
ccgccgcccacgccgccugg

SEQ ID NO: 2357232 - RNA, 20 nt, Bordetella pertussis
ccgccgcccgacagcacgcc

SEQ ID NO: 2357233 - RNA, 11 nt, Bordetella pertussis
ccgccgcccgc

SEQ ID NO: 2357234 - RNA, 14 nt, Bordetella pertussis
ccgccgcccgcccg

SEQ ID NO: 2357235 - RNA, 18 nt, Bordetella pertussis
ccgccgcccgcccgccgc

SEQ ID NO: 2357236 - RNA, 16 nt, Bordetella pertussis
ccgccgcccgccucag

SEQ ID NO: 2357237 - RNA, 12 nt, Bordetella pertussis
ccgccgcccggc

SEQ ID NO: 2357238 - RNA, 13 nt, Bordetella pertussis
ccgccgcccggcc

SEQ ID NO: 2357239 - RNA, 18 nt, Bordetella pertussis
ccgccgcccucgcccccg

SEQ ID NO: 2357240 - RNA, 15 nt, Bordetella pertussis
ccgccgcccuggccg

SEQ ID NO: 2357241 - RNA, 18 nt, Bordetella pertussis
ccgccgcccuggccgcgc

SEQ ID NO: 2357242 - RNA, 15 nt, Bordetella pertussis
ccgccgccgacgaug

SEQ ID NO: 2357243 - RNA, 15 nt, Bordetella pertussis
ccgccgccgcccacg

SEQ ID NO: 2357244 - RNA, 14 nt, Bordetella pertussis
ccgccgccgcggcc

SEQ ID NO: 2357245 - RNA, 15 nt, Bordetella pertussis
ccgccgccggcaauc

SEQ ID NO: 2357246 - RNA, 14 nt, Bordetella pertussis
ccgccgccggcccg

SEQ ID NO: 2357247 - RNA, 15 nt, Bordetella pertussis
ccgccgccggcccgc

SEQ ID NO: 2357248 - RNA, 17 nt, Bordetella pertussis
ccgccgccggcccgcca

SEQ ID NO: 2357249 - RNA, 20 nt, Bordetella pertussis
ccgccgccggcccgccacgc

SEQ ID NO: 2357250 - RNA, 15 nt, Bordetella pertussis
ccgccgccggcgcgg

SEQ ID NO: 2357251 - RNA, 17 nt, Bordetella pertussis
ccgccgccggugauaug

SEQ ID NO: 2357252 - RNA, 17 nt, Bordetella pertussis
ccgccgccuuggacgcg

SEQ ID NO: 2357253 - RNA, 21 nt, Bordetella pertussis
ccgccgcgaucagcgcggccg

SEQ ID NO: 2357254 - RNA, 12 nt, Bordetella pertussis
ccgccgcgcagc

SEQ ID NO: 2357255 - RNA, 15 nt, Bordetella pertussis
ccgccgcgcagccga

SEQ ID NO: 2357256 - RNA, 23 nt, Bordetella pertussis
ccgccgcgccaugcucgcgcaca

SEQ ID NO: 2357257 - RNA, 12 nt, Bordetella pertussis
ccgccgcgccca

SEQ ID NO: 2357258 - RNA, 15 nt, Bordetella pertussis
ccgccgcgcccagca

SEQ ID NO: 2357259 - RNA, 18 nt, Bordetella pertussis
ccgccgcgcccagcagcg

SEQ ID NO: 2357260 - RNA, 17 nt, Bordetella pertussis
ccgccgcgcccagccgc

SEQ ID NO: 2357261 - RNA, 22 nt, Bordetella pertussis
ccgccgcgcccggaucaguccg

SEQ ID NO: 2357262 - RNA, 12 nt, Bordetella pertussis
ccgccgcgccga

SEQ ID NO: 2357263 - RNA, 15 nt, Bordetella pertussis
ccgccgcgccgcccg

SEQ ID NO: 2357264 - RNA, 16 nt, Bordetella pertussis
ccgccgcgccgcccgc

SEQ ID NO: 2357265 - RNA, 14 nt, Bordetella pertussis
ccgccgcgccgcug

SEQ ID NO: 2357266 - RNA, 13 nt, Bordetella pertussis
ccgccgcgcgccg

SEQ ID NO: 2357267 - RNA, 16 nt, Bordetella pertussis
ccgccgcgcgccgcgc

SEQ ID NO: 2357268 - RNA, 13 nt, Bordetella pertussis
ccgccgcgcgcug

SEQ ID NO: 2357269 - RNA, 14 nt, Bordetella pertussis
ccgccgcgcgcugg

SEQ ID NO: 2357270 - RNA, 14 nt, Bordetella pertussis
ccgccgcgcggcgg

SEQ ID NO: 2357271 - RNA, 20 nt, Bordetella pertussis
ccgccgcgcggcggaucggc

SEQ ID NO: 2357272 - RNA, 19 nt, Bordetella pertussis
ccgccgcgcggugcucggc

SEQ ID NO: 2357273 - RNA, 21 nt, Bordetella pertussis
ccgccgcgcucaccgagggcc

SEQ ID NO: 2357274 - RNA, 14 nt, Bordetella pertussis
ccgccgcgcucggc

SEQ ID NO: 2357275 - RNA, 15 nt, Bordetella pertussis
ccgccgcgcucggcg

SEQ ID NO: 2357276 - RNA, 13 nt, Bordetella pertussis
ccgccgcggcagg

SEQ ID NO: 2357277 - RNA, 15 nt, Bordetella pertussis
ccgccgcggcaggcc

SEQ ID NO: 2357278 - RNA, 20 nt, Bordetella pertussis
ccgccgcggcaggccccggc

SEQ ID NO: 2357279 - RNA, 12 nt, Bordetella pertussis
ccgccgcggcca

SEQ ID NO: 2357280 - RNA, 15 nt, Bordetella pertussis
ccgccgcggccagcg

SEQ ID NO: 2357281 - RNA, 16 nt, Bordetella pertussis
ccgccgcggccagcgc

SEQ ID NO: 2357282 - RNA, 22 nt, Bordetella pertussis
ccgccgcggccagcgccgcgcc

SEQ ID NO: 2357283 - RNA, 13 nt, Bordetella pertussis
ccgccgcggccug

SEQ ID NO: 2357284 - RNA, 14 nt, Bordetella pertussis
ccgccgcggccugg

SEQ ID NO: 2357285 - RNA, 17 nt, Bordetella pertussis
ccgccgcggccuggccg

SEQ ID NO: 2357286 - RNA, 15 nt, Bordetella pertussis
ccgccgcgggcgccg

SEQ ID NO: 2357287 - RNA, 18 nt, Bordetella pertussis
ccgccgcgggcgccgcgc

SEQ ID NO: 2357288 - RNA, 14 nt, Bordetella pertussis
ccgccgcguccucg

SEQ ID NO: 2357289 - RNA, 15 nt, Bordetella pertussis
ccgccgcgugcgccg

SEQ ID NO: 2357290 - RNA, 21 nt, Bordetella pertussis
ccgccgcguggcggcgcagcg

SEQ ID NO: 2357291 - RNA, 22 nt, Bordetella pertussis
ccgccgcugccggccgaccggc

SEQ ID NO: 2357292 - RNA, 14 nt, Bordetella pertussis
ccgccggacggcgc

SEQ ID NO: 2357293 - RNA, 15 nt, Bordetella pertussis
ccgccggacggcgcc

SEQ ID NO: 2357294 - RNA, 23 nt, Bordetella pertussis
ccgccggaggcacuccgucaugg

SEQ ID NO: 2357295 - RNA, 15 nt, Bordetella pertussis
ccgccggcaccagcg

SEQ ID NO: 2357296 - RNA, 17 nt, Bordetella pertussis
ccgccggcaccagcgcc

SEQ ID NO: 2357297 - RNA, 18 nt, Bordetella pertussis
ccgccggcaccagcgcca

SEQ ID NO: 2357298 - RNA, 15 nt, Bordetella pertussis
ccgccggcacccggc

SEQ ID NO: 2357299 - RNA, 15 nt, Bordetella pertussis
ccgccggcacgcgcg

SEQ ID NO: 2357300 - RNA, 15 nt, Bordetella pertussis
ccgccggcagggcca

SEQ ID NO: 2357301 - RNA, 17 nt, Bordetella pertussis
ccgccggcagggccagc

SEQ ID NO: 2357302 - RNA, 18 nt, Bordetella pertussis
ccgccggcagggccagcg

SEQ ID NO: 2357303 - RNA, 12 nt, Bordetella pertussis
ccgccggccacc

SEQ ID NO: 2357304 - RNA, 15 nt, Bordetella pertussis
ccgccggccaccagc

SEQ ID NO: 2357305 - RNA, 16 nt, Bordetella pertussis
ccgccggccaccagcg

SEQ ID NO: 2357306 - RNA, 21 nt, Bordetella pertussis
ccgccggccaccagcggcgcc

SEQ ID NO: 2357307 - RNA, 13 nt, Bordetella pertussis
ccgccggccagcc

SEQ ID NO: 2357308 - RNA, 17 nt, Bordetella pertussis
ccgccggccagcgcggc

SEQ ID NO: 2357309 - RNA, 14 nt, Bordetella pertussis
ccgccggcccagga

SEQ ID NO: 2357310 - RNA, 22 nt, Bordetella pertussis
ccgccggcccaggauggcgcca

SEQ ID NO: 2357311 - RNA, 14 nt, Bordetella pertussis
ccgccggcccgcca

SEQ ID NO: 2357312 - RNA, 20 nt, Bordetella pertussis
ccgccggccggugcaucggc

SEQ ID NO: 2357313 - RNA, 21 nt, Bordetella pertussis
ccgccggccucuucgucgccg

SEQ ID NO: 2357314 - RNA, 22 nt, Bordetella pertussis
ccgccggccucuucgucgccgg

SEQ ID NO: 2357315 - RNA, 18 nt, Bordetella pertussis
ccgccggccugcugcagc

SEQ ID NO: 2357316 - RNA, 20 nt, Bordetella pertussis
ccgccggcgauauggccagg

SEQ ID NO: 2357317 - RNA, 18 nt, Bordetella pertussis
ccgccggcgaugaucgcc

SEQ ID NO: 2357318 - RNA, 12 nt, Bordetella pertussis
ccgccggcgcgc

SEQ ID NO: 2357319 - RNA, 14 nt, Bordetella pertussis
ccgccggcgcgcgg

SEQ ID NO: 2357320 - RNA, 15 nt, Bordetella pertussis
ccgccggcgcgcgga

SEQ ID NO: 2357321 - RNA, 22 nt, Bordetella pertussis
ccgccggcgcgcggaugaucgc

SEQ ID NO: 2357322 - RNA, 15 nt, Bordetella pertussis
ccgccggcgcggcug

SEQ ID NO: 2357323 - RNA, 17 nt, Bordetella pertussis
ccgccggcgcggcugcu

SEQ ID NO: 2357324 - RNA, 13 nt, Bordetella pertussis
ccgccggcgcggu

SEQ ID NO: 2357325 - RNA, 22 nt, Bordetella pertussis
ccgccggcgcgguauggccgcc

SEQ ID NO: 2357326 - RNA, 23 nt, Bordetella pertussis
ccgccuggcccaugaacaggcac

SEQ ID NO: 2357327 - RNA, 20 nt, Bordetella pertussis
ccgccuggccuucgcugccc

SEQ ID NO: 2357328 - RNA, 18 nt, Bordetella pertussis
ccgccuggcuuacaggcc

SEQ ID NO: 2357329 - RNA, 22 nt, Bordetella pertussis
ccgccugguaguaaucgcgcgc

SEQ ID NO: 2357330 - RNA, 20 nt, Bordetella pertussis
ccgccugugccagcuggccc

SEQ ID NO: 2357331 - RNA, 20 nt, Bordetella pertussis
ccgccuucagcgggccggca

SEQ ID NO: 2357332 - RNA, 15 nt, Bordetella pertussis
ccgccuucgccgugg

SEQ ID NO: 2357333 - RNA, 13 nt, Bordetella pertussis
ccgccuucggcgg

SEQ ID NO: 2357334 - RNA, 14 nt, Bordetella pertussis
ccgccuucgucgcg

SEQ ID NO: 2357335 - RNA, 19 nt, Bordetella pertussis
ccgccuucgucgcgcaccc

SEQ ID NO: 2357336 - RNA, 12 nt, Bordetella pertussis
ccgccuucuuga

SEQ ID NO: 2357337 - RNA, 14 nt, Bordetella pertussis
ccgccuucuugaac

SEQ ID NO: 2357338 - RNA, 22 nt, Bordetella pertussis
ccgccuucuugaacagcucggc

SEQ ID NO: 2357339 - RNA, 21 nt, Bordetella pertussis
ccgccuugacgguggccgcgg

SEQ ID NO: 2357340 - RNA, 23 nt, Bordetella pertussis
ccgccuugacgguggccgcggcg

SEQ ID NO: 2357341 - RNA, 23 nt, Bordetella pertussis
ccgccuugccuugcgcggccacc

SEQ ID NO: 2357342 - RNA, 18 nt, Bordetella pertussis
ccgccuuggacgcgcugu

SEQ ID NO: 2357343 - RNA, 16 nt, Bordetella pertussis
ccgcgaaacggcgggc

SEQ ID NO: 2357344 - RNA, 18 nt, Bordetella pertussis
ccgcgaaacggcgggcgc

SEQ ID NO: 2357345 - RNA, 20 nt, Bordetella pertussis
ccgcgaaacggcgggcgcgc

SEQ ID NO: 2357346 - RNA, 23 nt, Bordetella pertussis
ccgcgaaacggcgggcgcgcagg

SEQ ID NO: 2357347 - RNA, 21 nt, Bordetella pertussis
ccgcgaacagauccacgcccg

SEQ ID NO: 2357348 - RNA, 14 nt, Bordetella pertussis
ccgcgaaccaggcc

SEQ ID NO: 2357349 - RNA, 15 nt, Bordetella pertussis
ccgcgaaccaggccu

SEQ ID NO: 2357350 - RNA, 17 nt, Bordetella pertussis
ccgcgaaccaggccugc

SEQ ID NO: 2357351 - RNA, 15 nt, Bordetella pertussis
ccgcgaaccggugcu

SEQ ID NO: 2357352 - RNA, 14 nt, Bordetella pertussis
ccgcgaacgcgccg

SEQ ID NO: 2357353 - RNA, 15 nt, Bordetella pertussis
ccgcgaacgcgccgg

SEQ ID NO: 2357354 - RNA, 16 nt, Bordetella pertussis
ccgcgaacgcgccggc

SEQ ID NO: 2357355 - RNA, 18 nt, Bordetella pertussis
ccgcgaacgcgccggccc

SEQ ID NO: 2357356 - RNA, 12 nt, Bordetella pertussis
ccgcgaagcagc

SEQ ID NO: 2357357 - RNA, 15 nt, Bordetella pertussis
ccgcgaagcagccgg

SEQ ID NO: 2357358 - RNA, 16 nt, Bordetella pertussis
ccgcgaagcagccggc

SEQ ID NO: 2357359 - RNA, 22 nt, Bordetella pertussis
ccgcgaagcagccggccaaggc

SEQ ID NO: 2357360 - RNA, 17 nt, Bordetella pertussis
ccgcgaagcgcgccagc

SEQ ID NO: 2357361 - RNA, 21 nt, Bordetella pertussis
ccgcgaagcgcgccagcagcg

SEQ ID NO: 2357362 - RNA, 23 nt, Bordetella pertussis
ccgcgaagcgcgccagcagcgcc

SEQ ID NO: 2357363 - RNA, 13 nt, Bordetella pertussis
ccgcgaagugccu

SEQ ID NO: 2357364 - RNA, 19 nt, Bordetella pertussis
ccgcgacacaaggcggccg

SEQ ID NO: 2357365 - RNA, 22 nt, Bordetella pertussis
ccgcgacacaaggcggccgcgc

SEQ ID NO: 2357366 - RNA, 13 nt, Bordetella pertussis
ccgcgaccaccag

SEQ ID NO: 2357367 - RNA, 16 nt, Bordetella pertussis
ccgcgaccaccagcac

SEQ ID NO: 2357368 - RNA, 17 nt, Bordetella pertussis
ccgcgaccaccagcacc

SEQ ID NO: 2357369 - RNA, 15 nt, Bordetella pertussis
ccgcgaccacggucu

SEQ ID NO: 2357370 - RNA, 20 nt, Bordetella pertussis
ccgcgaccacggucuggcgc

SEQ ID NO: 2357371 - RNA, 24 nt, Bordetella pertussis
ccgcgaccacggucuggcgcgaca

SEQ ID NO: 2357372 - RNA, 17 nt, Bordetella pertussis
ccgcgaccaugcggccg

SEQ ID NO: 2357373 - RNA, 20 nt, Bordetella pertussis
ccgcgaccaugcggccgucg

SEQ ID NO: 2357374 - RNA, 21 nt, Bordetella pertussis
ccgcgaccaugcggccgucgc

SEQ ID NO: 2357375 - RNA, 19 nt, Bordetella pertussis
ccgcgacccagaacccggc

SEQ ID NO: 2357376 - RNA, 20 nt, Bordetella pertussis
ccgcgacccagaacccggcc

SEQ ID NO: 2357377 - RNA, 21 nt, Bordetella pertussis
ccgcgacccagaacccggccg

SEQ ID NO: 2357378 - RNA, 22 nt, Bordetella pertussis
ccgcgacgaccccgccgugccg

SEQ ID NO: 2357379 - RNA, 23 nt, Bordetella pertussis
ccgcgacgaccccgccgugccgg

SEQ ID NO: 2357380 - RNA, 20 nt, Bordetella pertussis
ccgcgacgcgccugcgcgcg

SEQ ID NO: 2357381 - RNA, 23 nt, Bordetella pertussis
ccgcgacgcggacuucgcccggg

SEQ ID NO: 2357382 - RNA, 17 nt, Bordetella pertussis
ccgcgacgcuacagcgu

SEQ ID NO: 2357383 - RNA, 16 nt, Bordetella pertussis
ccgcgacgcuggcgau

SEQ ID NO: 2357384 - RNA, 14 nt, Bordetella pertussis
ccgcgacgcuguug

SEQ ID NO: 2357385 - RNA, 21 nt, Bordetella pertussis
ccgcgacgguccugcgcgccg

SEQ ID NO: 2357386 - RNA, 22 nt, Bordetella pertussis
ccgcgacgguccugcgcgccga

SEQ ID NO: 2357387 - RNA, 19 nt, Bordetella pertussis
ccgcgagcaugcgcagcgc

SEQ ID NO: 2357388 - RNA, 20 nt, Bordetella pertussis
ccgcgagcaugcgcagcgcg

SEQ ID NO: 2357389 - RNA, 23 nt, Bordetella pertussis
ccgcgagcaugcgcagcgcgucg

SEQ ID NO: 2357390 - RNA, 15 nt, Bordetella pertussis
ccgcgagcggccagc

SEQ ID NO: 2357391 - RNA, 16 nt, Bordetella pertussis
ccgcgagcggccagcc

SEQ ID NO: 2357392 - RNA, 22 nt, Bordetella pertussis
ccgcgauaugcgagacgaaggc

SEQ ID NO: 2357393 - RNA, 18 nt, Bordetella pertussis
ccgcgauauugaaggccg

SEQ ID NO: 2357394 - RNA, 13 nt, Bordetella pertussis
ccgcgaucagcgc

SEQ ID NO: 2357395 - RNA, 19 nt, Bordetella pertussis
ccgcgaucagcgcggccgc

SEQ ID NO: 2357396 - RNA, 20 nt, Bordetella pertussis
ccgcgaucagcgcggccgcu

SEQ ID NO: 2357397 - RNA, 21 nt, Bordetella pertussis
ccgcgaugcaugaaccgcagc

SEQ ID NO: 2357398 - RNA, 16 nt, Bordetella pertussis
ccgcgauggcgccggc

SEQ ID NO: 2357399 - RNA, 14 nt, Bordetella pertussis
ccgcgaugucgcgc

SEQ ID NO: 2357400 - RNA, 16 nt, Bordetella pertussis
ccgcgcaaggccugcu

SEQ ID NO: 2357401 - RNA, 20 nt, Bordetella pertussis
ccgcgcaaggcggcccggcc

SEQ ID NO: 2357402 - RNA, 21 nt, Bordetella pertussis
ccgcgcacagcccgaucgacg

SEQ ID NO: 2357403 - RNA, 16 nt, Bordetella pertussis
ccgcgcacagcgcggc

SEQ ID NO: 2357404 - RNA, 17 nt, Bordetella pertussis
ccgcgcacaggucgccg

SEQ ID NO: 2357405 - RNA, 15 nt, Bordetella pertussis
ccgcgcaccaggcgc

SEQ ID NO: 2357406 - RNA, 16 nt, Bordetella pertussis
ccgcgcaccaggcgcg

SEQ ID NO: 2357407 - RNA, 17 nt, Bordetella pertussis
ccgcgcaccaggcgcgg

SEQ ID NO: 2357408 - RNA, 19 nt, Bordetella pertussis
ccgcgcaccaggcgcggcg

SEQ ID NO: 2357409 - RNA, 13 nt, Bordetella pertussis
ccgcgcacccagg

SEQ ID NO: 2357410 - RNA, 14 nt, Bordetella pertussis
ccgcgcacccaggc

SEQ ID NO: 2357411 - RNA, 17 nt, Bordetella pertussis
ccgcgcacccaggccca

SEQ ID NO: 2357412 - RNA, 15 nt, Bordetella pertussis
ccgcgcaccugcugc

SEQ ID NO: 2357413 - RNA, 15 nt, Bordetella pertussis
ccgcgcaccugggcg

SEQ ID NO: 2357414 - RNA, 14 nt, Bordetella pertussis
ccgcgcacgcacug

SEQ ID NO: 2357415 - RNA, 15 nt, Bordetella pertussis
ccgcgcacgcacuga

SEQ ID NO: 2357416 - RNA, 16 nt, Bordetella pertussis
ccgcgcagaaaccgcc

SEQ ID NO: 2357417 - RNA, 14 nt, Bordetella pertussis
ccgcgcagcacgcc

SEQ ID NO: 2357418 - RNA, 16 nt, Bordetella pertussis
ccgcgcagcacgcccg

SEQ ID NO: 2357419 - RNA, 13 nt, Bordetella pertussis
ccgcgcagcagca

SEQ ID NO: 2357420 - RNA, 16 nt, Bordetella pertussis
ccgcgcagcccggcgu

SEQ ID NO: 2357421 - RNA, 21 nt, Bordetella pertussis
ccgcgcagcccggcgugccca

SEQ ID NO: 2357422 - RNA, 23 nt, Bordetella pertussis
ccgcgcagcccggcgugcccagg

SEQ ID NO: 2357423 - RNA, 11 nt, Bordetella pertussis
ccgcgcagccg

SEQ ID NO: 2357424 - RNA, 21 nt, Bordetella pertussis
ccgcgcagccgacaggcgcgc

SEQ ID NO: 2357425 - RNA, 13 nt, Bordetella pertussis
ccgcgcagccgcu

SEQ ID NO: 2357426 - RNA, 17 nt, Bordetella pertussis
ccgcgcagcgucugcgc

SEQ ID NO: 2357427 - RNA, 16 nt, Bordetella pertussis
ccgcgcaggucggcga

SEQ ID NO: 2357428 - RNA, 19 nt, Bordetella pertussis
ccgcgcaucgaucaggcug

SEQ ID NO: 2357429 - RNA, 21 nt, Bordetella pertussis
ccgcgcaugauuccugucgcg

SEQ ID NO: 2357430 - RNA, 20 nt, Bordetella pertussis
ccgcgcaugcaagacaggcc

SEQ ID NO: 2357431 - RNA, 21 nt, Bordetella pertussis
ccgcgcaugcaagacaggccg

SEQ ID NO: 2357432 - RNA, 18 nt, Bordetella pertussis
ccgcgcaugccagcuugc

SEQ ID NO: 2357433 - RNA, 20 nt, Bordetella pertussis
ccgcgcauggacugcaggcg

SEQ ID NO: 2357434 - RNA, 21 nt, Bordetella pertussis
ccgcgcauggacugcaggcgc

SEQ ID NO: 2357435 - RNA, 17 nt, Bordetella pertussis
ccgcgcauuugccgcgg

SEQ ID NO: 2357436 - RNA, 18 nt, Bordetella pertussis
ccgcgcauuugccgcggc

SEQ ID NO: 2357437 - RNA, 22 nt, Bordetella pertussis
ccgcgcauuugccgcggcgaag

SEQ ID NO: 2357438 - RNA, 12 nt, Bordetella pertussis
ccgcgcgcagcg

SEQ ID NO: 2357439 - RNA, 15 nt, Bordetella pertussis
ccgcgcgcagcgagg

SEQ ID NO: 2357440 - RNA, 13 nt, Bordetella pertussis
ccgcgcgcagcgc

SEQ ID NO: 2357441 - RNA, 17 nt, Bordetella pertussis
ccgcgcgcagcgcgccg

SEQ ID NO: 2357442 - RNA, 15 nt, Bordetella pertussis
ccgcgcgcauccagg

SEQ ID NO: 2357443 - RNA, 17 nt, Bordetella pertussis
ccgcgcgcauccaggug

SEQ ID NO: 2357444 - RNA, 12 nt, Bordetella pertussis
ccgcgcgccgcg

SEQ ID NO: 2357445 - RNA, 16 nt, Bordetella pertussis
ccgcgcgccgcgccuu

SEQ ID NO: 2357446 - RNA, 22 nt, Bordetella pertussis
ccgcgcgccgcuguggacgccg

SEQ ID NO: 2357447 - RNA, 11 nt, Bordetella pertussis
ccgcgcgccgg

SEQ ID NO: 2357448 - RNA, 12 nt, Bordetella pertussis
ccgcgcgccggc

SEQ ID NO: 2357449 - RNA, 14 nt, Bordetella pertussis
ccgcgcgccggcgc

SEQ ID NO: 2357450 - RNA, 16 nt, Bordetella pertussis
ccgcgcgccggcgccg

SEQ ID NO: 2357451 - RNA, 22 nt, Bordetella pertussis
ccgcgcgccggcgccggcgcgc

SEQ ID NO: 2357452 - RNA, 19 nt, Bordetella pertussis
ccgcgcgccugcaugucca

SEQ ID NO: 2357453 - RNA, 21 nt, Bordetella pertussis
ccgcgcgccugcucguacagc

SEQ ID NO: 2357454 - RNA, 19 nt, Bordetella pertussis
ccgcgcgccuuacuccggc

SEQ ID NO: 2357455 - RNA, 22 nt, Bordetella pertussis
ccgcgcgccuuccugggcgccg

SEQ ID NO: 2357456 - RNA, 11 nt, Bordetella pertussis
ccgcgcgcgac

SEQ ID NO: 2357457 - RNA, 24 nt, Bordetella pertussis
ccgcgcgcgacgacagcggcgagc

SEQ ID NO: 2357458 - RNA, 14 nt, Bordetella pertussis
ccgcgcgcgacgcg

SEQ ID NO: 2357459 - RNA, 16 nt, Bordetella pertussis
ccgcgcgcgagcugcg

SEQ ID NO: 2357460 - RNA, 12 nt, Bordetella pertussis
ccgcgcgcgcca

SEQ ID NO: 2357461 - RNA, 18 nt, Bordetella pertussis
ccgcgcgcggccggcacc

SEQ ID NO: 2357462 - RNA, 16 nt, Bordetella pertussis
ccgcgcgcggccggcg

SEQ ID NO: 2357463 - RNA, 22 nt, Bordetella pertussis
ccgcgcgcggccggcgcgccgg

SEQ ID NO: 2357464 - RNA, 23 nt, Bordetella pertussis
ccgcgcgcggccggcgcgccggc

SEQ ID NO: 2357465 - RNA, 14 nt, Bordetella pertussis
ccgcgcgcggcggc

SEQ ID NO: 2357466 - RNA, 18 nt, Bordetella pertussis
ccgcgcgcgggcgcccgc

SEQ ID NO: 2357467 - RNA, 18 nt, Bordetella pertussis
ccgcgcgcguauggcggc

SEQ ID NO: 2357468 - RNA, 15 nt, Bordetella pertussis
ccgcgcgcgucgccg

SEQ ID NO: 2357469 - RNA, 16 nt, Bordetella pertussis
ccgcgcgcgucgccgc

SEQ ID NO: 2357470 - RNA, 21 nt, Bordetella pertussis
ccgcgcgcgucgccgcuggcc

SEQ ID NO: 2357471 - RNA, 11 nt, Bordetella pertussis
ccgcgcgcgug

SEQ ID NO: 2357472 - RNA, 14 nt, Bordetella pertussis
ccgcgcgcgugccg

SEQ ID NO: 2357473 - RNA, 18 nt, Bordetella pertussis
ccgcgcgcgugccgcagg

SEQ ID NO: 2357474 - RNA, 21 nt, Bordetella pertussis
ccgcgcgcguucaggucgccg

SEQ ID NO: 2357475 - RNA, 17 nt, Bordetella pertussis
ccgcgcgcuucaggcgc

SEQ ID NO: 2357476 - RNA, 18 nt, Bordetella pertussis
ccgcgcgcuucaggcgcc

SEQ ID NO: 2357477 - RNA, 19 nt, Bordetella pertussis
ccgcgcgcuucaggcgccg

SEQ ID NO: 2357478 - RNA, 19 nt, Bordetella pertussis
ccgcgcgcuuccucgacca

SEQ ID NO: 2357479 - RNA, 20 nt, Bordetella pertussis
ccgcgcgcuuccucgaccag

SEQ ID NO: 2357480 - RNA, 21 nt, Bordetella pertussis
ccgcgcgcuuccucgaccagg

SEQ ID NO: 2357481 - RNA, 14 nt, Bordetella pertussis
ccgcgcggccagcg

SEQ ID NO: 2357482 - RNA, 15 nt, Bordetella pertussis
ccgcgcggccagcgc

SEQ ID NO: 2357483 - RNA, 18 nt, Bordetella pertussis
ccgcgcggccagcgccgg

SEQ ID NO: 2357484 - RNA, 14 nt, Bordetella pertussis
ccgcgcggccgggc

SEQ ID NO: 2357485 - RNA, 16 nt, Bordetella pertussis
ccgcgcggcgccugcc

SEQ ID NO: 2357486 - RNA, 23 nt, Bordetella pertussis
ccgcgcggcgcguucagcagcag

SEQ ID NO: 2357487 - RNA, 17 nt, Bordetella pertussis
ccgcgcggcgcugcacg

SEQ ID NO: 2357488 - RNA, 19 nt, Bordetella pertussis
ccgcgcggcgcugcacgcg

SEQ ID NO: 2357489 - RNA, 17 nt, Bordetella pertussis
ccgcgcgggcggcccgc

SEQ ID NO: 2357490 - RNA, 20 nt, Bordetella pertussis
ccgcgcgguacgcaccgccg

SEQ ID NO: 2357491 - RNA, 23 nt, Bordetella pertussis
ccgcgcggucgccaucggccggc

SEQ ID NO: 2357492 - RNA, 21 nt, Bordetella pertussis
ccgcgcggugcucggcgaacu

SEQ ID NO: 2357493 - RNA, 18 nt, Bordetella pertussis
ccgcgcgguggccgccgc

SEQ ID NO: 2357494 - RNA, 16 nt, Bordetella pertussis
ccgcgcgguucgcaua

SEQ ID NO: 2357495 - RNA, 17 nt, Bordetella pertussis
ccgcgcguacgcggcgc

SEQ ID NO: 2357496 - RNA, 17 nt, Bordetella pertussis
ccgcgcguaucggcgcg

SEQ ID NO: 2357497 - RNA, 21 nt, Bordetella pertussis
ccgcgcguaugcaccgggccg

SEQ ID NO: 2357498 - RNA, 21 nt, Bordetella pertussis
ccgcgcgugcggggcggcagg

SEQ ID NO: 2357499 - RNA, 13 nt, Bordetella pertussis
ccgcgcgugcuga

SEQ ID NO: 2357500 - RNA, 17 nt, Bordetella pertussis
ccgcgcucagcaccagg

SEQ ID NO: 2357501 - RNA, 20 nt, Bordetella pertussis
ccgcgcucagcaccaggccg

SEQ ID NO: 2357502 - RNA, 13 nt, Bordetella pertussis
ccgcgcucaggcc

SEQ ID NO: 2357503 - RNA, 14 nt, Bordetella pertussis
ccgcgcucaggccg

SEQ ID NO: 2357504 - RNA, 17 nt, Bordetella pertussis
ccgcgcucaggccgcug

SEQ ID NO: 2357505 - RNA, 21 nt, Bordetella pertussis
ccgcgcucaggccgcugggca

SEQ ID NO: 2357506 - RNA, 15 nt, Bordetella pertussis
ccgcgcuccagggcg

SEQ ID NO: 2357507 - RNA, 20 nt, Bordetella pertussis
ccgcgcuccagggcgucggc

SEQ ID NO: 2357508 - RNA, 22 nt, Bordetella pertussis
ccgcgcuccagggcgucggcga

SEQ ID NO: 2357509 - RNA, 15 nt, Bordetella pertussis
ccgcgcucgcccagc

SEQ ID NO: 2357510 - RNA, 16 nt, Bordetella pertussis
ccgcgcucgcccagcc

SEQ ID NO: 2357511 - RNA, 19 nt, Bordetella pertussis
ccgcgcucgcccagccgcc

SEQ ID NO: 2357512 - RNA, 13 nt, Bordetella pertussis
ccgcgcucgcgcc

SEQ ID NO: 2357513 - RNA, 21 nt, Bordetella pertussis
ccgcgcucgcgccaggccccg

SEQ ID NO: 2357514 - RNA, 22 nt, Bordetella pertussis
ccgcgcucgcgccaggccccgc

SEQ ID NO: 2357515 - RNA, 16 nt, Bordetella pertussis
ccgcgcugccagccau

SEQ ID NO: 2357516 - RNA, 19 nt, Bordetella pertussis
ccgcgcugccugaaaccgc

SEQ ID NO: 2357517 - RNA, 16 nt, Bordetella pertussis
ccgcgcugcggucagc

SEQ ID NO: 2357518 - RNA, 21 nt, Bordetella pertussis
ccgcgcugcggucagcugugg

SEQ ID NO: 2357519 - RNA, 20 nt, Bordetella pertussis
ccgcgcugcugcaggccggc

SEQ ID NO: 2357520 - RNA, 17 nt, Bordetella pertussis
ccgcgcugcugccgucg

SEQ ID NO: 2357521 - RNA, 20 nt, Bordetella pertussis
ccgcgcugcugccgucggcg

SEQ ID NO: 2357522 - RNA, 22 nt, Bordetella pertussis
ccgcgcugcugccgucggcguu

SEQ ID NO: 2357523 - RNA, 17 nt, Bordetella pertussis
ccgcgcuggaagacgug

SEQ ID NO: 2357524 - RNA, 16 nt, Bordetella pertussis
ccgcgcuggcgcagca

SEQ ID NO: 2357525 - RNA, 20 nt, Bordetella pertussis
ccgcgcuggcgcagcaggcg

SEQ ID NO: 2357526 - RNA, 22 nt, Bordetella pertussis
ccgcgcuggcgcagcaggcgcg

SEQ ID NO: 2357527 - RNA, 23 nt, Bordetella pertussis
ccgcgcuggcgcagcaggcgcgc

SEQ ID NO: 2357528 - RNA, 21 nt, Bordetella pertussis
ccgcgcuggcgcuggccgccc

SEQ ID NO: 2357529 - RNA, 22 nt, Bordetella pertussis
ccgcgcuggcgcuggccgcccg

SEQ ID NO: 2357530 - RNA, 15 nt, Bordetella pertussis
ccgcgcuggcggcgc

SEQ ID NO: 2357531 - RNA, 21 nt, Bordetella pertussis
ccgcgcuggcggcgcaggccg

SEQ ID NO: 2357532 - RNA, 23 nt, Bordetella pertussis
ccgcgcuggcggcgcaggccgcg

SEQ ID NO: 2357533 - RNA, 18 nt, Bordetella pertussis
ccgcgcugggcgcugcug

SEQ ID NO: 2357534 - RNA, 17 nt, Bordetella pertussis
ccgcgcuggugcuggcc

SEQ ID NO: 2357535 - RNA, 14 nt, Bordetella pertussis
ccgcgcugugcgac

SEQ ID NO: 2357536 - RNA, 22 nt, Bordetella pertussis
ccgcgcuguugcuccaggccgg

SEQ ID NO: 2357537 - RNA, 23 nt, Bordetella pertussis
ccgcgcuguugcuccaggccggc

SEQ ID NO: 2357538 - RNA, 14 nt, Bordetella pertussis
ccgcgcuucgucgg

SEQ ID NO: 2357539 - RNA, 16 nt, Bordetella pertussis
ccgcgcuucgucggcg

SEQ ID NO: 2357540 - RNA, 17 nt, Bordetella pertussis
ccgcgcuucgucggcgu

SEQ ID NO: 2357541 - RNA, 16 nt, Bordetella pertussis
ccgcggaaagcuggcg

SEQ ID NO: 2357542 - RNA, 18 nt, Bordetella pertussis
ccgcggaaagcuggcguu

SEQ ID NO: 2357543 - RNA, 15 nt, Bordetella pertussis
ccgcggaagucgggc

SEQ ID NO: 2357544 - RNA, 22 nt, Bordetella pertussis
ccgcggaagucgggcaccagca

SEQ ID NO: 2357545 - RNA, 14 nt, Bordetella pertussis
ccgcggaggcgaaa

SEQ ID NO: 2357546 - RNA, 17 nt, Bordetella pertussis
ccgcggaggugucgccg

SEQ ID NO: 2357547 - RNA, 22 nt, Bordetella pertussis
ccgcggauugccguccuggcga

SEQ ID NO: 2357548 - RNA, 19 nt, Bordetella pertussis
ccgcggcaaauggggcggc

SEQ ID NO: 2357549 - RNA, 23 nt, Bordetella pertussis
ccgcggcaaauggggcggccggg

SEQ ID NO: 2357550 - RNA, 15 nt, Bordetella pertussis
ccgcgucggccgcgu

SEQ ID NO: 2357551 - RNA, 14 nt, Bordetella pertussis
ccgcgucggccuca

SEQ ID NO: 2357552 - RNA, 17 nt, Bordetella pertussis
ccgcgucggccugccag

SEQ ID NO: 2357553 - RNA, 20 nt, Bordetella pertussis
ccgcgucggcgaagcugucc

SEQ ID NO: 2357554 - RNA, 15 nt, Bordetella pertussis
ccgcgucggcgcggu

SEQ ID NO: 2357555 - RNA, 19 nt, Bordetella pertussis
ccgcgucgguggccagcca

SEQ ID NO: 2357556 - RNA, 17 nt, Bordetella pertussis
ccgcgucguucaucgcc

SEQ ID NO: 2357557 - RNA, 16 nt, Bordetella pertussis
ccgcgucuaccuggac

SEQ ID NO: 2357558 - RNA, 23 nt, Bordetella pertussis
ccgcgucuaccuggacgggcugg

SEQ ID NO: 2357559 - RNA, 14 nt, Bordetella pertussis
ccgcgucugggccg

SEQ ID NO: 2357560 - RNA, 19 nt, Bordetella pertussis
ccgcgucuucggcgcggcg

SEQ ID NO: 2357561 - RNA, 23 nt, Bordetella pertussis
ccgcgucuucggcgcggcgggcu

SEQ ID NO: 2357562 - RNA, 16 nt, Bordetella pertussis
ccgcgucuuggcgggc

SEQ ID NO: 2357563 - RNA, 18 nt, Bordetella pertussis
ccgcgucuuggcgggcac

SEQ ID NO: 2357564 - RNA, 14 nt, Bordetella pertussis
ccgcgugacggccg

SEQ ID NO: 2357565 - RNA, 15 nt, Bordetella pertussis
ccgcgugacggccgc

SEQ ID NO: 2357566 - RNA, 16 nt, Bordetella pertussis
ccgcgugacggccgcc

SEQ ID NO: 2357567 - RNA, 17 nt, Bordetella pertussis
ccgcgugacggccgcca

SEQ ID NO: 2357568 - RNA, 13 nt, Bordetella pertussis
ccgcgugccuguc

SEQ ID NO: 2357569 - RNA, 16 nt, Bordetella pertussis
ccgcgugcgccgggcu

SEQ ID NO: 2357570 - RNA, 14 nt, Bordetella pertussis
ccgcgugcgugccg

SEQ ID NO: 2357571 - RNA, 20 nt, Bordetella pertussis
ccgcgugcgugccgacgaug

SEQ ID NO: 2357572 - RNA, 19 nt, Bordetella pertussis
ccgcgugcguuucggaccc

SEQ ID NO: 2357573 - RNA, 12 nt, Bordetella pertussis
ccgcguggauuu

SEQ ID NO: 2357574 - RNA, 21 nt, Bordetella pertussis
ccgcguggauuuugcggaagg

SEQ ID NO: 2357575 - RNA, 15 nt, Bordetella pertussis
ccgcguggcgcugcg

SEQ ID NO: 2357576 - RNA, 19 nt, Bordetella pertussis
ccgcguggcggcgcagcgc

SEQ ID NO: 2357577 - RNA, 20 nt, Bordetella pertussis
ccgcguucacgccggcgcgc

SEQ ID NO: 2357578 - RNA, 22 nt, Bordetella pertussis
ccgcguucacgccggcgcgccg

SEQ ID NO: 2357579 - RNA, 23 nt, Bordetella pertussis
ccgcguucacgccggcgcgccgg

SEQ ID NO: 2357580 - RNA, 13 nt, Bordetella pertussis
ccgcguucaggcg

SEQ ID NO: 2357581 - RNA, 19 nt, Bordetella pertussis
ccgcguucaggcgcggcug

SEQ ID NO: 2357582 - RNA, 18 nt, Bordetella pertussis
ccgcguugaccggcuggc

SEQ ID NO: 2357583 - RNA, 21 nt, Bordetella pertussis
ccgcguugaccggcuggcgca

SEQ ID NO: 2357584 - RNA, 22 nt, Bordetella pertussis
ccgcguugaccggcuggcgcac

SEQ ID NO: 2357585 - RNA, 15 nt, Bordetella pertussis
ccgcguugagcgccg

SEQ ID NO: 2357586 - RNA, 16 nt, Bordetella pertussis
ccgcguugcagccaca

SEQ ID NO: 2357587 - RNA, 23 nt, Bordetella pertussis
ccgcguugcgcugcccgucgcug

SEQ ID NO: 2357588 - RNA, 20 nt, Bordetella pertussis
ccgcguuucccucggugcug

SEQ ID NO: 2357589 - RNA, 16 nt, Bordetella pertussis
ccgcuaccaggcgcgc

SEQ ID NO: 2357590 - RNA, 17 nt, Bordetella pertussis
ccgcuaccaggcgcgcg

SEQ ID NO: 2357591 - RNA, 18 nt, Bordetella pertussis
ccgcuaccaggcgcgcgc

SEQ ID NO: 2357592 - RNA, 14 nt, Bordetella pertussis
ccgcuaccccggca

SEQ ID NO: 2357593 - RNA, 16 nt, Bordetella pertussis
ccgcuaccccggcagc

SEQ ID NO: 2357594 - RNA, 13 nt, Bordetella pertussis
ccgcuacgcgggc

SEQ ID NO: 2357595 - RNA, 18 nt, Bordetella pertussis
ccgcuacgcgggcuugcu

SEQ ID NO: 2357596 - RNA, 20 nt, Bordetella pertussis
ccgcuacgcgggcuugcugc

SEQ ID NO: 2357597 - RNA, 22 nt, Bordetella pertussis
ccgcuacgcgggcuugcugccc

SEQ ID NO: 2357598 - RNA, 23 nt, Bordetella pertussis
ccgcuacguguccugccggggca

SEQ ID NO: 2357599 - RNA, 16 nt, Bordetella pertussis
ccgcuaucauccgcgc

SEQ ID NO: 2357600 - RNA, 17 nt, Bordetella pertussis
ccgcuaucauccgcgca

SEQ ID NO: 2357601 - RNA, 22 nt, Bordetella pertussis
ccgcuaugcgggcuugcugccc

SEQ ID NO: 2357602 - RNA, 17 nt, Bordetella pertussis
ccgcucaauucggccug

SEQ ID NO: 2357603 - RNA, 15 nt, Bordetella pertussis
ccgcucagcgcggcg

SEQ ID NO: 2357604 - RNA, 16 nt, Bordetella pertussis
ccgcucagcgcggcgc

SEQ ID NO: 2357605 - RNA, 20 nt, Bordetella pertussis
ccgcucaggauacgugcugc

SEQ ID NO: 2357606 - RNA, 22 nt, Bordetella pertussis
ccgcucagguagaccacgcgcu

SEQ ID NO: 2357607 - RNA, 22 nt, Bordetella pertussis
ccgcucaugccggcaagcacga

SEQ ID NO: 2357608 - RNA, 14 nt, Bordetella pertussis
ccgcuccaccagca

SEQ ID NO: 2357609 - RNA, 22 nt, Bordetella pertussis
ccgcuccaccagcaccggcagc

SEQ ID NO: 2357610 - RNA, 22 nt, Bordetella pertussis
ccgcuccauguaaaaacccggc

SEQ ID NO: 2357611 - RNA, 14 nt, Bordetella pertussis
ccgcuccgccaugg

SEQ ID NO: 2357612 - RNA, 14 nt, Bordetella pertussis
ccgcuccggcauga

SEQ ID NO: 2357613 - RNA, 16 nt, Bordetella pertussis
ccgcucgacgucgccc

SEQ ID NO: 2357614 - RNA, 19 nt, Bordetella pertussis
ccgcucgaggccaggcuga

SEQ ID NO: 2357615 - RNA, 14 nt, Bordetella pertussis
ccgcucggccacgc

SEQ ID NO: 2357616 - RNA, 19 nt, Bordetella pertussis
ccgcucggccacgcgcugc

SEQ ID NO: 2357617 - RNA, 13 nt, Bordetella pertussis
ccgcucggccagc

SEQ ID NO: 2357618 - RNA, 15 nt, Bordetella pertussis
ccgcucguacuccau

SEQ ID NO: 2357619 - RNA, 20 nt, Bordetella pertussis
ccgcucgucaugaucccgcg

SEQ ID NO: 2357620 - RNA, 23 nt, Bordetella pertussis
ccgcugaacguguaggucagcgc

SEQ ID NO: 2357621 - RNA, 22 nt, Bordetella pertussis
ccgcugaaggaccucgcgccgg

SEQ ID NO: 2357622 - RNA, 23 nt, Bordetella pertussis
ccgcugaaggaccucgcgccggu

SEQ ID NO: 2357623 - RNA, 13 nt, Bordetella pertussis
ccgcugaccggcc

SEQ ID NO: 2357624 - RNA, 15 nt, Bordetella pertussis
ccgcugaccggccug

SEQ ID NO: 2357625 - RNA, 16 nt, Bordetella pertussis
ccgcugaccggccugg

SEQ ID NO: 2357626 - RNA, 16 nt, Bordetella pertussis
ccgcugaucaggucca

SEQ ID NO: 2357627 - RNA, 15 nt, Bordetella pertussis
ccgcugauggcgguc

SEQ ID NO: 2357628 - RNA, 19 nt, Bordetella pertussis
ccgcugauggcggucacca

SEQ ID NO: 2357629 - RNA, 11 nt, Bordetella pertussis
ccgcugcagau

SEQ ID NO: 2357630 - RNA, 14 nt, Bordetella pertussis
ccgcugcagcacgc

SEQ ID NO: 2357631 - RNA, 16 nt, Bordetella pertussis
ccgcugcaugggcggc

SEQ ID NO: 2357632 - RNA, 19 nt, Bordetella pertussis
ccgcugcaugggcggcccg

SEQ ID NO: 2357633 - RNA, 20 nt, Bordetella pertussis
ccgcugcaugggcggcccgc

SEQ ID NO: 2357634 - RNA, 21 nt, Bordetella pertussis
ccgcugcccaccuuccugcug

SEQ ID NO: 2357635 - RNA, 22 nt, Bordetella pertussis
ccgcugcccaccuuccugcugg

SEQ ID NO: 2357636 - RNA, 12 nt, Bordetella pertussis
ccgcugcccagc

SEQ ID NO: 2357637 - RNA, 21 nt, Bordetella pertussis
ccgcugccgagacggccgccg

SEQ ID NO: 2357638 - RNA, 16 nt, Bordetella pertussis
ccgcugccgcgcgccg

SEQ ID NO: 2357639 - RNA, 18 nt, Bordetella pertussis
ccgcugccgcgcgccggc

SEQ ID NO: 2357640 - RNA, 22 nt, Bordetella pertussis
ccgcugccggccgaccggcgcg

SEQ ID NO: 2357641 - RNA, 17 nt, Bordetella pertussis
ccgcugccgggcucggc

SEQ ID NO: 2357642 - RNA, 15 nt, Bordetella pertussis
ccgcugcgaaaaagc

SEQ ID NO: 2357643 - RNA, 19 nt, Bordetella pertussis
ccgcugcgaaaaagcccgc

SEQ ID NO: 2357644 - RNA, 20 nt, Bordetella pertussis
ccgcugcgaaaaagcccgcg

SEQ ID NO: 2357645 - RNA, 22 nt, Bordetella pertussis
ccgcugcgaaaaagcccgcgcc

SEQ ID NO: 2357646 - RNA, 15 nt, Bordetella pertussis
ccgcugcgcagcagc

SEQ ID NO: 2357647 - RNA, 17 nt, Bordetella pertussis
ccgcugcgcagcagcgc

SEQ ID NO: 2357648 - RNA, 18 nt, Bordetella pertussis
ccgcugcgcgcggccugg

SEQ ID NO: 2357649 - RNA, 15 nt, Bordetella pertussis
ccgcugcgcggucac

SEQ ID NO: 2357650 - RNA, 15 nt, Bordetella pertussis
ccgcugcgcuggccg

SEQ ID NO: 2357651 - RNA, 17 nt, Bordetella pertussis
ccgcugcgcuggccgcg

SEQ ID NO: 2357652 - RNA, 20 nt, Bordetella pertussis
ccgcugcgcuugaccgccuc

SEQ ID NO: 2357653 - RNA, 15 nt, Bordetella pertussis
ccgcugcguccacca

SEQ ID NO: 2357654 - RNA, 16 nt, Bordetella pertussis
ccgcugcuaugccgug

SEQ ID NO: 2357655 - RNA, 12 nt, Bordetella pertussis
ccgcuggccagc

SEQ ID NO: 2357656 - RNA, 19 nt, Bordetella pertussis
ccgcuggccagccgcucgc

SEQ ID NO: 2357657 - RNA, 13 nt, Bordetella pertussis
ccgcuggccaggc

SEQ ID NO: 2357658 - RNA, 14 nt, Bordetella pertussis
ccgcuggccaggcu

SEQ ID NO: 2357659 - RNA, 19 nt, Bordetella pertussis
ccgcuggccaugccgucgc

SEQ ID NO: 2357660 - RNA, 20 nt, Bordetella pertussis
ccgcuggccaugccgucgcg

SEQ ID NO: 2357661 - RNA, 21 nt, Bordetella pertussis
ccgcuggccaugccgucgcgc

SEQ ID NO: 2357662 - RNA, 18 nt, Bordetella pertussis
ccgcuggccgaucugcug

SEQ ID NO: 2357663 - RNA, 20 nt, Bordetella pertussis
ccggauauggccggcgcgcu

SEQ ID NO: 2357664 - RNA, 22 nt, Bordetella pertussis
ccggauauggccggcgcgcucg

SEQ ID NO: 2357665 - RNA, 23 nt, Bordetella pertussis
ccggauauggccggcgcgcucgc

SEQ ID NO: 2357666 - RNA, 19 nt, Bordetella pertussis
ccggaucauccgggcccgg

SEQ ID NO: 2357667 - RNA, 15 nt, Bordetella pertussis
ccggauccagccgcu

SEQ ID NO: 2357668 - RNA, 22 nt, Bordetella pertussis
ccggauccagcugcgaaagcgc

SEQ ID NO: 2357669 - RNA, 17 nt, Bordetella pertussis
ccggaucccaggccggc

SEQ ID NO: 2357670 - RNA, 18 nt, Bordetella pertussis
ccggaucccaggccggcu

SEQ ID NO: 2357671 - RNA, 12 nt, Bordetella pertussis
ccggauccugcg

SEQ ID NO: 2357672 - RNA, 23 nt, Bordetella pertussis
ccggauccugcggcgcggugucg

SEQ ID NO: 2357673 - RNA, 18 nt, Bordetella pertussis
ccggaucgacaggaacag

SEQ ID NO: 2357674 - RNA, 16 nt, Bordetella pertussis
ccggaucgagcgcggu

SEQ ID NO: 2357675 - RNA, 18 nt, Bordetella pertussis
ccggaucgcacacaccgc

SEQ ID NO: 2357676 - RNA, 22 nt, Bordetella pertussis
ccggaucgcacacaccgcguca

SEQ ID NO: 2357677 - RNA, 20 nt, Bordetella pertussis
ccggaucggccggcagcgcg

SEQ ID NO: 2357678 - RNA, 17 nt, Bordetella pertussis
ccggaucguagugcgug

SEQ ID NO: 2357679 - RNA, 18 nt, Bordetella pertussis
ccggaucguagugcgugg

SEQ ID NO: 2357680 - RNA, 21 nt, Bordetella pertussis
ccggaugcacguagcgcagca

SEQ ID NO: 2357681 - RNA, 20 nt, Bordetella pertussis
ccggaugccgaacugucgcg

SEQ ID NO: 2357682 - RNA, 17 nt, Bordetella pertussis
ccggaugcgcguggcgc

SEQ ID NO: 2357683 - RNA, 12 nt, Bordetella pertussis
ccggauggcgcg

SEQ ID NO: 2357684 - RNA, 15 nt, Bordetella pertussis
ccggauggcgucccg

SEQ ID NO: 2357685 - RNA, 12 nt, Bordetella pertussis
ccggcaaacccg

SEQ ID NO: 2357686 - RNA, 21 nt, Bordetella pertussis
ccggcaacaucuccaccagcg

SEQ ID NO: 2357687 - RNA, 21 nt, Bordetella pertussis
ccggcaagaugccggccuguc

SEQ ID NO: 2357688 - RNA, 19 nt, Bordetella pertussis
ccggcaagcacgaacaggu

SEQ ID NO: 2357689 - RNA, 17 nt, Bordetella pertussis
ccggcaagccagggcag

SEQ ID NO: 2357690 - RNA, 14 nt, Bordetella pertussis
ccggcaagccuugc

SEQ ID NO: 2357691 - RNA, 16 nt, Bordetella pertussis
ccggcaagcgcucgcc

SEQ ID NO: 2357692 - RNA, 12 nt, Bordetella pertussis
ccggcaaggccg

SEQ ID NO: 2357693 - RNA, 14 nt, Bordetella pertussis
ccggcaaggccgcg

SEQ ID NO: 2357694 - RNA, 18 nt, Bordetella pertussis
ccggcaaggccgcgaacg

SEQ ID NO: 2357695 - RNA, 16 nt, Bordetella pertussis
ccggcaaggggccagc

SEQ ID NO: 2357696 - RNA, 22 nt, Bordetella pertussis
ccggcaaggggccagccuggcg

SEQ ID NO: 2357697 - RNA, 17 nt, Bordetella pertussis
ccggcaaggucagcagc

SEQ ID NO: 2357698 - RNA, 22 nt, Bordetella pertussis
ccggcaaggucagcagcaugcc

SEQ ID NO: 2357699 - RNA, 14 nt, Bordetella pertussis
ccggcaaucccggc

SEQ ID NO: 2357700 - RNA, 21 nt, Bordetella pertussis
ccggcaaucgaaaagcccgcc

SEQ ID NO: 2357701 - RNA, 14 nt, Bordetella pertussis
ccggcaccacgacc

SEQ ID NO: 2357702 - RNA, 17 nt, Bordetella pertussis
ccggcaccacgaccggc

SEQ ID NO: 2357703 - RNA, 18 nt, Bordetella pertussis
ccggcaccacgaccggcu

SEQ ID NO: 2357704 - RNA, 23 nt, Bordetella pertussis
ccggcaccagcgccacgcccagg

SEQ ID NO: 2357705 - RNA, 16 nt, Bordetella pertussis
ccggcaccaucgccgc

SEQ ID NO: 2357706 - RNA, 22 nt, Bordetella pertussis
ccggcaccaucugcgucgcguu

SEQ ID NO: 2357707 - RNA, 18 nt, Bordetella pertussis
ccggcaccaugcgcacca

SEQ ID NO: 2357708 - RNA, 11 nt, Bordetella pertussis
ccggcaccccg

SEQ ID NO: 2357709 - RNA, 19 nt, Bordetella pertussis
ccggcacccgcuaccccgg

SEQ ID NO: 2357710 - RNA, 13 nt, Bordetella pertussis
ccggcacccggcu

SEQ ID NO: 2357711 - RNA, 15 nt, Bordetella pertussis
ccggcaccguccagc

SEQ ID NO: 2357712 - RNA, 15 nt, Bordetella pertussis
ccggcaccugggccu

SEQ ID NO: 2357713 - RNA, 19 nt, Bordetella pertussis
ccggcaccuucuuccaggc

SEQ ID NO: 2357714 - RNA, 17 nt, Bordetella pertussis
ccggcacgacgaucggc

SEQ ID NO: 2357715 - RNA, 23 nt, Bordetella pertussis
ccggcacgacgaucggccugaac

SEQ ID NO: 2357716 - RNA, 13 nt, Bordetella pertussis
ccggcacgcccag

SEQ ID NO: 2357717 - RNA, 14 nt, Bordetella pertussis
ccggcacgcccagc

SEQ ID NO: 2357718 - RNA, 21 nt, Bordetella pertussis
ccggcacgcccagccgcagca

SEQ ID NO: 2357719 - RNA, 18 nt, Bordetella pertussis
ccggcacgccggcggcgc

SEQ ID NO: 2357720 - RNA, 15 nt, Bordetella pertussis
ccggcacgccugccg

SEQ ID NO: 2357721 - RNA, 16 nt, Bordetella pertussis
ccggcacgccugccgc

SEQ ID NO: 2357722 - RNA, 18 nt, Bordetella pertussis
ccggcacgccugccgcgc

SEQ ID NO: 2357723 - RNA, 19 nt, Bordetella pertussis
ccggcacgccugccgcgcc

SEQ ID NO: 2357724 - RNA, 20 nt, Bordetella pertussis
ccggcacgccugccgcgccc

SEQ ID NO: 2357725 - RNA, 21 nt, Bordetella pertussis
ccggcacgccugccgcgcccg

SEQ ID NO: 2357726 - RNA, 23 nt, Bordetella pertussis
ccggcacgccugccgcgcccggc

SEQ ID NO: 2357727 - RNA, 13 nt, Bordetella pertussis
ccggcacgcgcca

SEQ ID NO: 2357728 - RNA, 14 nt, Bordetella pertussis
ccggcacgcgccag

SEQ ID NO: 2357729 - RNA, 15 nt, Bordetella pertussis
ccggcacgcgccagc

SEQ ID NO: 2357730 - RNA, 18 nt, Bordetella pertussis
ccggcacgcgccaggcgu

SEQ ID NO: 2357731 - RNA, 14 nt, Bordetella pertussis
ccggcacgcgccga

SEQ ID NO: 2357732 - RNA, 16 nt, Bordetella pertussis
ccggcacgcugaucgc

SEQ ID NO: 2357733 - RNA, 17 nt, Bordetella pertussis
ccggcacgcugaucgcc

SEQ ID NO: 2357734 - RNA, 19 nt, Bordetella pertussis
ccggcacgcugaucgccgg

SEQ ID NO: 2357735 - RNA, 20 nt, Bordetella pertussis
ccggcacgcugaucgccggc

SEQ ID NO: 2357736 - RNA, 14 nt, Bordetella pertussis
ccggcacggccggc

SEQ ID NO: 2357737 - RNA, 20 nt, Bordetella pertussis
ccggcacggccggccaggcg

SEQ ID NO: 2357738 - RNA, 21 nt, Bordetella pertussis
ccggcacggccggccaggcgc

SEQ ID NO: 2357739 - RNA, 23 nt, Bordetella pertussis
ccggcacgguucagaacgcguag

SEQ ID NO: 2357740 - RNA, 15 nt, Bordetella pertussis
ccggcacguaccagg

SEQ ID NO: 2357741 - RNA, 17 nt, Bordetella pertussis
ccggcacguaccaggcg

SEQ ID NO: 2357742 - RNA, 19 nt, Bordetella pertussis
ccggcacguaccaggcgcu

SEQ ID NO: 2357743 - RNA, 23 nt, Bordetella pertussis
ccggcacguaccaggcgcugacc

SEQ ID NO: 2357744 - RNA, 23 nt, Bordetella pertussis
ccggcacgucauugcaucgcagc

SEQ ID NO: 2357745 - RNA, 14 nt, Bordetella pertussis
ccggcacguccggc

SEQ ID NO: 2357746 - RNA, 21 nt, Bordetella pertussis
ccggcagaacagcggaucgcc

SEQ ID NO: 2357747 - RNA, 13 nt, Bordetella pertussis
ccggcagaucggc

SEQ ID NO: 2357748 - RNA, 15 nt, Bordetella pertussis
ccggcagaucggcgc

SEQ ID NO: 2357749 - RNA, 22 nt, Bordetella pertussis
ccggcagaucggcgcuggccug

SEQ ID NO: 2357750 - RNA, 16 nt, Bordetella pertussis
ccggcagcagcagcgu

SEQ ID NO: 2357751 - RNA, 18 nt, Bordetella pertussis
ccggcagcagggauucgg

SEQ ID NO: 2357752 - RNA, 14 nt, Bordetella pertussis
ccggcagccccagc

SEQ ID NO: 2357753 - RNA, 23 nt, Bordetella pertussis
ccggcagccccagcgcccaggcg

SEQ ID NO: 2357754 - RNA, 14 nt, Bordetella pertussis
ccggcagcgcgacc

SEQ ID NO: 2357755 - RNA, 16 nt, Bordetella pertussis
ccggcagcgcgaccgg

SEQ ID NO: 2357756 - RNA, 20 nt, Bordetella pertussis
ccggcagcgcgaccggcgcg

SEQ ID NO: 2357757 - RNA, 15 nt, Bordetella pertussis
ccggcagcggccagc

SEQ ID NO: 2357758 - RNA, 19 nt, Bordetella pertussis
ccggcagcggccagcgcgg

SEQ ID NO: 2357759 - RNA, 21 nt, Bordetella pertussis
ccggcagcguaucgcccgcgc

SEQ ID NO: 2357760 - RNA, 21 nt, Bordetella pertussis
ccggcagcgucaauccgccgc

SEQ ID NO: 2357761 - RNA, 15 nt, Bordetella pertussis
ccggcaggaucugca

SEQ ID NO: 2357762 - RNA, 12 nt, Bordetella pertussis
ccggcaggccgg

SEQ ID NO: 2357763 - RNA, 13 nt, Bordetella pertussis
ccggcaggcgcgc

SEQ ID NO: 2357764 - RNA, 15 nt, Bordetella pertussis
ccggcaggcgcgcca

SEQ ID NO: 2357765 - RNA, 20 nt, Bordetella pertussis
ccggcaggcgcgccagcccg

SEQ ID NO: 2357766 - RNA, 22 nt, Bordetella pertussis
ccggcaggcgcgccagcccgcc

SEQ ID NO: 2357767 - RNA, 17 nt, Bordetella pertussis
ccggcagggccagcgcc

SEQ ID NO: 2357768 - RNA, 17 nt, Bordetella pertussis
ccggcagggcggccagg

SEQ ID NO: 2357769 - RNA, 18 nt, Bordetella pertussis
ccggcagggcggccaggc

SEQ ID NO: 2357770 - RNA, 20 nt, Bordetella pertussis
ccggcagggcggccaggccg

SEQ ID NO: 2357771 - RNA, 15 nt, Bordetella pertussis
ccggcagggucucgg

SEQ ID NO: 2357772 - RNA, 20 nt, Bordetella pertussis
ccggcagggucucggccacg

SEQ ID NO: 2357773 - RNA, 23 nt, Bordetella pertussis
ccggcagggucucggccacgguc

SEQ ID NO: 2357774 - RNA, 19 nt, Bordetella pertussis
ccggcagggugacgggcug

SEQ ID NO: 2357775 - RNA, 19 nt, Bordetella pertussis
accgguugcagcgcgccag

SEQ ID NO: 2357776 - RNA, 14 nt, Bordetella pertussis
accgguuggccagc

SEQ ID NO: 2357777 - RNA, 18 nt, Bordetella pertussis
accgguuggccagcucca

SEQ ID NO: 2357778 - RNA, 20 nt, Bordetella pertussis
accgguuggccagcuccagg

SEQ ID NO: 2357779 - RNA, 17 nt, Bordetella pertussis
accguacccgcgccguc

SEQ ID NO: 2357780 - RNA, 19 nt, Bordetella pertussis
accguccuugagcgccagc

SEQ ID NO: 2357781 - RNA, 18 nt, Bordetella pertussis
accgucgaccggcccgca

SEQ ID NO: 2357782 - RNA, 23 nt, Bordetella pertussis
accgucggugaugcucugcccgu

SEQ ID NO: 2357783 - RNA, 23 nt, Bordetella pertussis
accgucguccucggcacggccag

SEQ ID NO: 2357784 - RNA, 17 nt, Bordetella pertussis
accgucucgaacgccgc

SEQ ID NO: 2357785 - RNA, 20 nt, Bordetella pertussis
accgucuggcguacgcugcu

SEQ ID NO: 2357786 - RNA, 14 nt, Bordetella pertussis
accgucuugcccgc

SEQ ID NO: 2357787 - RNA, 13 nt, Bordetella pertussis
accgugaccagcg

SEQ ID NO: 2357788 - RNA, 13 nt, Bordetella pertussis
accgugaccugcg

SEQ ID NO: 2357789 - RNA, 22 nt, Bordetella pertussis
accgugauauagaccagcagcu

SEQ ID NO: 2357790 - RNA, 14 nt, Bordetella pertussis
accgugaugcgcgc

SEQ ID NO: 2357791 - RNA, 18 nt, Bordetella pertussis
accgugaugucgccgucg

SEQ ID NO: 2357792 - RNA, 13 nt, Bordetella pertussis
accgugccgccga

SEQ ID NO: 2357793 - RNA, 15 nt, Bordetella pertussis
accgugcuggccgac

SEQ ID NO: 2357794 - RNA, 18 nt, Bordetella pertussis
accguggaaaccgcgucg

SEQ ID NO: 2357795 - RNA, 18 nt, Bordetella pertussis
accguggccacggccgcg

SEQ ID NO: 2357796 - RNA, 24 nt, Bordetella pertussis
accguucuuccgcacgccgaccug

SEQ ID NO: 2357797 - RNA, 17 nt, Bordetella pertussis
accguuuuggcaggcug

SEQ ID NO: 2357798 - RNA, 15 nt, Bordetella pertussis
accuaccucagcaug

SEQ ID NO: 2357799 - RNA, 16 nt, Bordetella pertussis
accuaccucagcaugg

SEQ ID NO: 2357800 - RNA, 17 nt, Bordetella pertussis
accucagcauggcggga

SEQ ID NO: 2357801 - RNA, 16 nt, Bordetella pertussis
accucagccugcuggu

SEQ ID NO: 2357802 - RNA, 17 nt, Bordetella pertussis
accuccaccucgaacgc

SEQ ID NO: 2357803 - RNA, 18 nt, Bordetella pertussis
accuccaguaucguuuuc

SEQ ID NO: 2357804 - RNA, 13 nt, Bordetella pertussis
accucgacgcagc

SEQ ID NO: 2357805 - RNA, 14 nt, Bordetella pertussis
accucgacgcgcau

SEQ ID NO: 2357806 - RNA, 17 nt, Bordetella pertussis
accucgagcaccuugac

SEQ ID NO: 2357807 - RNA, 14 nt, Bordetella pertussis
accucgaucaccac

SEQ ID NO: 2357808 - RNA, 17 nt, Bordetella pertussis
accucgaucaccaccgg

SEQ ID NO: 2357809 - RNA, 13 nt, Bordetella pertussis
accucgauggcgg

SEQ ID NO: 2357810 - RNA, 16 nt, Bordetella pertussis
accucgccgcgccagc

SEQ ID NO: 2357811 - RNA, 16 nt, Bordetella pertussis
accucgcgccggucac

SEQ ID NO: 2357812 - RNA, 21 nt, Bordetella pertussis
accucgcgccggucacgcugg

SEQ ID NO: 2357813 - RNA, 22 nt, Bordetella pertussis
accucgcguagugguaugaccg

SEQ ID NO: 2357814 - RNA, 21 nt, Bordetella pertussis
accucgcuugcccgugccuug

SEQ ID NO: 2357815 - RNA, 22 nt, Bordetella pertussis
accucggacgagacaggcgcgc

SEQ ID NO: 2357816 - RNA, 19 nt, Bordetella pertussis
accucggcaccgaggccga

SEQ ID NO: 2357817 - RNA, 15 nt, Bordetella pertussis
accucggccggggcg

SEQ ID NO: 2357818 - RNA, 17 nt, Bordetella pertussis
accucggcgcccagcug

SEQ ID NO: 2357819 - RNA, 19 nt, Bordetella pertussis
accucggcgcccagcugcu

SEQ ID NO: 2357820 - RNA, 14 nt, Bordetella pertussis
accucggcgccgcg

SEQ ID NO: 2357821 - RNA, 18 nt, Bordetella pertussis
accucggcgccgcggcgc

SEQ ID NO: 2357822 - RNA, 17 nt, Bordetella pertussis
accucggcgcucaggaa

SEQ ID NO: 2357823 - RNA, 18 nt, Bordetella pertussis
accucguaaguggcggcg

SEQ ID NO: 2357824 - RNA, 17 nt, Bordetella pertussis
accucuucagcccggcg

SEQ ID NO: 2357825 - RNA, 19 nt, Bordetella pertussis
accucuucagcccggcgcg

SEQ ID NO: 2357826 - RNA, 21 nt, Bordetella pertussis
accucuucagcccggcgcgcc

SEQ ID NO: 2357827 - RNA, 17 nt, Bordetella pertussis
accugaacaccggcgcg

SEQ ID NO: 2357828 - RNA, 17 nt, Bordetella pertussis
accugaagguggcguuc

SEQ ID NO: 2357829 - RNA, 21 nt, Bordetella pertussis
accugaauccguaagcgcugg

SEQ ID NO: 2357830 - RNA, 12 nt, Bordetella pertussis
accugacccugc

SEQ ID NO: 2357831 - RNA, 14 nt, Bordetella pertussis
accugacccugcgc

SEQ ID NO: 2357832 - RNA, 17 nt, Bordetella pertussis
accugaccgugcauccc

SEQ ID NO: 2357833 - RNA, 22 nt, Bordetella pertussis
accugaccucgcgguugcgucu

SEQ ID NO: 2357834 - RNA, 16 nt, Bordetella pertussis
accugagccaggcgcc

SEQ ID NO: 2357835 - RNA, 22 nt, Bordetella pertussis
accugagccaggcgcccggcgu

SEQ ID NO: 2357836 - RNA, 18 nt, Bordetella pertussis
accugaucgcgcagcgcc

SEQ ID NO: 2357837 - RNA, 20 nt, Bordetella pertussis
accugaucgcgcagcgccug

SEQ ID NO: 2357838 - RNA, 12 nt, Bordetella pertussis
ccggccaggggc

SEQ ID NO: 2357839 - RNA, 16 nt, Bordetella pertussis
ccggccaggggcgcug

SEQ ID NO: 2357840 - RNA, 17 nt, Bordetella pertussis
ccggccaggggcgcugg

SEQ ID NO: 2357841 - RNA, 19 nt, Bordetella pertussis
ccggccaggggcgcugguc

SEQ ID NO: 2357842 - RNA, 16 nt, Bordetella pertussis
ccggccaggucggcgg

SEQ ID NO: 2357843 - RNA, 19 nt, Bordetella pertussis
ccggccaggucggcggcca

SEQ ID NO: 2357844 - RNA, 18 nt, Bordetella pertussis
ccggccaucaggugcagg

SEQ ID NO: 2357845 - RNA, 22 nt, Bordetella pertussis
ccggccaucaggugcaggguug

SEQ ID NO: 2357846 - RNA, 17 nt, Bordetella pertussis
ccggccauggcccuugc

SEQ ID NO: 2357847 - RNA, 15 nt, Bordetella pertussis
ccggccauggccgcc

SEQ ID NO: 2357848 - RNA, 16 nt, Bordetella pertussis
ccggccauggcggccg

SEQ ID NO: 2357849 - RNA, 18 nt, Bordetella pertussis
ccggccauggcggccggc

SEQ ID NO: 2357850 - RNA, 14 nt, Bordetella pertussis
ccggcccaaggccc

SEQ ID NO: 2357851 - RNA, 12 nt, Bordetella pertussis
ccggcccagcac

SEQ ID NO: 2357852 - RNA, 18 nt, Bordetella pertussis
ccggcccagcacgccgcg

SEQ ID NO: 2357853 - RNA, 15 nt, Bordetella pertussis
ccggcccagcgccau

SEQ ID NO: 2357854 - RNA, 19 nt, Bordetella pertussis
ccggcccagcgccaucggc

SEQ ID NO: 2357855 - RNA, 11 nt, Bordetella pertussis
ccggcccagga

SEQ ID NO: 2357856 - RNA, 19 nt, Bordetella pertussis
ccggcccaggauggcgcca

SEQ ID NO: 2357857 - RNA, 13 nt, Bordetella pertussis
ccggcccaggccg

SEQ ID NO: 2357858 - RNA, 16 nt, Bordetella pertussis
ccggcccaggccgggc

SEQ ID NO: 2357859 - RNA, 14 nt, Bordetella pertussis
ccggcccaggcgcg

SEQ ID NO: 2357860 - RNA, 16 nt, Bordetella pertussis
ccggcccaggcgcgcu

SEQ ID NO: 2357861 - RNA, 18 nt, Bordetella pertussis
ccggcccaugaccggcgu

SEQ ID NO: 2357862 - RNA, 23 nt, Bordetella pertussis
ccggccccaggaugcgcaccggc

SEQ ID NO: 2357863 - RNA, 14 nt, Bordetella pertussis
ccggccccaggccg

SEQ ID NO: 2357864 - RNA, 21 nt, Bordetella pertussis
ccggccccauccucaucgugc

SEQ ID NO: 2357865 - RNA, 22 nt, Bordetella pertussis
ccggccccauccucaucgugcu

SEQ ID NO: 2357866 - RNA, 17 nt, Bordetella pertussis
ccggccccgcaaggggc

SEQ ID NO: 2357867 - RNA, 23 nt, Bordetella pertussis
ccggcccgaagauuuccucgcgc

SEQ ID NO: 2357868 - RNA, 13 nt, Bordetella pertussis
ccggcccgccucg

SEQ ID NO: 2357869 - RNA, 17 nt, Bordetella pertussis
ccggcccgccucgagcg

SEQ ID NO: 2357870 - RNA, 15 nt, Bordetella pertussis
ccggcccgcgcgccu

SEQ ID NO: 2357871 - RNA, 13 nt, Bordetella pertussis
ccggcccggcggg

SEQ ID NO: 2357872 - RNA, 19 nt, Bordetella pertussis
ccggcccguuggcaggcca

SEQ ID NO: 2357873 - RNA, 18 nt, Bordetella pertussis
ccggccgaaaccgccgcg

SEQ ID NO: 2357874 - RNA, 20 nt, Bordetella pertussis
ccggccgaaaccgccgcggc

SEQ ID NO: 2357875 - RNA, 14 nt, Bordetella pertussis
ccggccgacaggug

SEQ ID NO: 2357876 - RNA, 15 nt, Bordetella pertussis
ccggccgacaggugg

SEQ ID NO: 2357877 - RNA, 16 nt, Bordetella pertussis
ccggccgaccggcgcg

SEQ ID NO: 2357878 - RNA, 17 nt, Bordetella pertussis
ccggccgaccggcgcgc

SEQ ID NO: 2357879 - RNA, 13 nt, Bordetella pertussis
ccggccgacggca

SEQ ID NO: 2357880 - RNA, 15 nt, Bordetella pertussis
ccggccgacggcgcu

SEQ ID NO: 2357881 - RNA, 16 nt, Bordetella pertussis
ccggccgauagccgcg

SEQ ID NO: 2357882 - RNA, 20 nt, Bordetella pertussis
ccggccgauagccgcggcgc

SEQ ID NO: 2357883 - RNA, 14 nt, Bordetella pertussis
ccggccgaucgcgc

SEQ ID NO: 2357884 - RNA, 16 nt, Bordetella pertussis
ccggccgaucgcgccg

SEQ ID NO: 2357885 - RNA, 22 nt, Bordetella pertussis
ccggccgaugacaucgccgcug

SEQ ID NO: 2357886 - RNA, 23 nt, Bordetella pertussis
ccggccgaugacaucgccgcugc

SEQ ID NO: 2357887 - RNA, 17 nt, Bordetella pertussis
ccggccgauggcaucgc

SEQ ID NO: 2357888 - RNA, 20 nt, Bordetella pertussis
ccggcgccagccgcuccagg

SEQ ID NO: 2357889 - RNA, 14 nt, Bordetella pertussis
ccggcgcccccagc

SEQ ID NO: 2357890 - RNA, 15 nt, Bordetella pertussis
ccggcgcccccagca

SEQ ID NO: 2357891 - RNA, 18 nt, Bordetella pertussis
ccggcgcccccagcagcg

SEQ ID NO: 2357892 - RNA, 18 nt, Bordetella pertussis
ccggcgcccgccgccggg

SEQ ID NO: 2357893 - RNA, 22 nt, Bordetella pertussis
ccggcgcccucuuucgccgcgc

SEQ ID NO: 2357894 - RNA, 14 nt, Bordetella pertussis
ccggcgcccuugau

SEQ ID NO: 2357895 - RNA, 14 nt, Bordetella pertussis
ccggcgccgacgcg

SEQ ID NO: 2357896 - RNA, 17 nt, Bordetella pertussis
ccggcgccgacgcgcug

SEQ ID NO: 2357897 - RNA, 13 nt, Bordetella pertussis
ccggcgccgcccc

SEQ ID NO: 2357898 - RNA, 14 nt, Bordetella pertussis
ccggcgccgccccu

SEQ ID NO: 2357899 - RNA, 13 nt, Bordetella pertussis
ccggcgccgcgcg

SEQ ID NO: 2357900 - RNA, 13 nt, Bordetella pertussis
ccggcgccgcguu

SEQ ID NO: 2357901 - RNA, 19 nt, Bordetella pertussis
ccggcgccgcguucacgcc

SEQ ID NO: 2357902 - RNA, 18 nt, Bordetella pertussis
ccggcgccggcgacgccg

SEQ ID NO: 2357903 - RNA, 15 nt, Bordetella pertussis
ccggcgccggcgcgc

SEQ ID NO: 2357904 - RNA, 14 nt, Bordetella pertussis
ccggcgccggcucc

SEQ ID NO: 2357905 - RNA, 18 nt, Bordetella pertussis
ccggcgccgggcagcccg

SEQ ID NO: 2357906 - RNA, 19 nt, Bordetella pertussis
ccggcgccgggcagcccgc

SEQ ID NO: 2357907 - RNA, 21 nt, Bordetella pertussis
ccggcgccgggcagcccgcgc

SEQ ID NO: 2357908 - RNA, 11 nt, Bordetella pertussis
ccggcgccggu

SEQ ID NO: 2357909 - RNA, 13 nt, Bordetella pertussis
ccggcgccuggcc

SEQ ID NO: 2357910 - RNA, 14 nt, Bordetella pertussis
ccggcgccuggccg

SEQ ID NO: 2357911 - RNA, 16 nt, Bordetella pertussis
ccggcgccuggccgua

SEQ ID NO: 2357912 - RNA, 13 nt, Bordetella pertussis
ccggcgccugggg

SEQ ID NO: 2357913 - RNA, 14 nt, Bordetella pertussis
ccggcgccuuggcc

SEQ ID NO: 2357914 - RNA, 18 nt, Bordetella pertussis
ccggcgccuuggccuggg

SEQ ID NO: 2357915 - RNA, 18 nt, Bordetella pertussis
ccggcgcgaacaccggca

SEQ ID NO: 2357916 - RNA, 22 nt, Bordetella pertussis
ccggcgcgaaccccuccggcgu

SEQ ID NO: 2357917 - RNA, 19 nt, Bordetella pertussis
ccggcgcgaacggcuugau

SEQ ID NO: 2357918 - RNA, 15 nt, Bordetella pertussis
ccggcgcgaccgccu

SEQ ID NO: 2357919 - RNA, 23 nt, Bordetella pertussis
ccggcgcgauggucaccacccgc

SEQ ID NO: 2357920 - RNA, 22 nt, Bordetella pertussis
ccggcgcgcaaaccgacgcggc

SEQ ID NO: 2357921 - RNA, 17 nt, Bordetella pertussis
ccggcgcgcauccggug

SEQ ID NO: 2357922 - RNA, 14 nt, Bordetella pertussis
ccggcgcgccaccc

SEQ ID NO: 2357923 - RNA, 16 nt, Bordetella pertussis
ccggcgcgccacccug

SEQ ID NO: 2357924 - RNA, 14 nt, Bordetella pertussis
ccggcgcgccaugg

SEQ ID NO: 2357925 - RNA, 11 nt, Bordetella pertussis
ccggcgcgccc

SEQ ID NO: 2357926 - RNA, 13 nt, Bordetella pertussis
ccggcgcgcccag

SEQ ID NO: 2357927 - RNA, 16 nt, Bordetella pertussis
ccggcgcgcccuugcc

SEQ ID NO: 2357928 - RNA, 12 nt, Bordetella pertussis
ccggcgcgccgc

SEQ ID NO: 2357929 - RNA, 14 nt, Bordetella pertussis
ccggcgcgccgccc

SEQ ID NO: 2357930 - RNA, 16 nt, Bordetella pertussis
ccggcgcgccgcccgc

SEQ ID NO: 2357931 - RNA, 18 nt, Bordetella pertussis
ccggcgcgccgcgccgcc

SEQ ID NO: 2357932 - RNA, 19 nt, Bordetella pertussis
ccggcgcgccgcgccgccc

SEQ ID NO: 2357933 - RNA, 15 nt, Bordetella pertussis
ccggcgcgccggccg

SEQ ID NO: 2357934 - RNA, 16 nt, Bordetella pertussis
ccggcgcgccggccgc

SEQ ID NO: 2357935 - RNA, 17 nt, Bordetella pertussis
ccggcgcgccggccgcc

SEQ ID NO: 2357936 - RNA, 18 nt, Bordetella pertussis
ccggcgcgccggccgcca

SEQ ID NO: 2357937 - RNA, 17 nt, Bordetella pertussis
ccggcgcgccggccugc

SEQ ID NO: 2357938 - RNA, 13 nt, Bordetella pertussis
ccggcgcgccggg

SEQ ID NO: 2357939 - RNA, 11 nt, Bordetella pertussis
ccggcgcgccu

SEQ ID NO: 2357940 - RNA, 17 nt, Bordetella pertussis
ccggcgcgccucggcgc

SEQ ID NO: 2357941 - RNA, 18 nt, Bordetella pertussis
ccggcgcgccucggcgcg

SEQ ID NO: 2357942 - RNA, 14 nt, Bordetella pertussis
ccggcgcgccugcc

SEQ ID NO: 2357943 - RNA, 22 nt, Bordetella pertussis
ccggcgcgccuggcgcgcccac

SEQ ID NO: 2357944 - RNA, 21 nt, Bordetella pertussis
ccggcgcgccuuacgcggcgc

SEQ ID NO: 2357945 - RNA, 23 nt, Bordetella pertussis
ccggcgcgccuucggcaggcgcc

SEQ ID NO: 2357946 - RNA, 10 nt, Bordetella pertussis
ccggcgcgcg

SEQ ID NO: 2357947 - RNA, 22 nt, Bordetella pertussis
ccggcgcgcgaucucgggcagg

SEQ ID NO: 2357948 - RNA, 14 nt, Bordetella pertussis
ccggcgcgcgcgac

SEQ ID NO: 2357949 - RNA, 17 nt, Bordetella pertussis
ccggcgcgcgcgcgccg

SEQ ID NO: 2357950 - RNA, 16 nt, Bordetella pertussis
ccggcgcgcgcggcca

SEQ ID NO: 2357951 - RNA, 14 nt, Bordetella pertussis
ccggcgcgcggccg

SEQ ID NO: 2357952 - RNA, 14 nt, Bordetella pertussis
ccggcgcggacaga

SEQ ID NO: 2357953 - RNA, 15 nt, Bordetella pertussis
ccggcgcggcagccu

SEQ ID NO: 2357954 - RNA, 12 nt, Bordetella pertussis
ccggcgcggccu

SEQ ID NO: 2357955 - RNA, 14 nt, Bordetella pertussis
ccggcgcggcgcgc

SEQ ID NO: 2357956 - RNA, 18 nt, Bordetella pertussis
ccggcgcggcgcgcgccg

SEQ ID NO: 2357957 - RNA, 22 nt, Bordetella pertussis
ccggcgcggcgcggccggcuug

SEQ ID NO: 2357958 - RNA, 13 nt, Bordetella pertussis
ccggcgcggcugc

SEQ ID NO: 2357959 - RNA, 20 nt, Bordetella pertussis
ccggcgcggcugcugggcau

SEQ ID NO: 2357960 - RNA, 14 nt, Bordetella pertussis
ccggcgcgggcgca

SEQ ID NO: 2357961 - RNA, 20 nt, Bordetella pertussis
ccggcgcgguauggccgccc

SEQ ID NO: 2357962 - RNA, 22 nt, Bordetella pertussis
ccggcgcggugaggcggccggg

SEQ ID NO: 2357963 - RNA, 16 nt, Bordetella pertussis
ccggcgcgguggccau

SEQ ID NO: 2357964 - RNA, 21 nt, Bordetella pertussis
ccggcgcgguggccaugcugg

SEQ ID NO: 2357965 - RNA, 17 nt, Bordetella pertussis
ccggcgcguccacgccg

SEQ ID NO: 2357966 - RNA, 19 nt, Bordetella pertussis
ccggcgcgucgccggcgau

SEQ ID NO: 2357967 - RNA, 14 nt, Bordetella pertussis
ccggcgcgucgcgc

SEQ ID NO: 2357968 - RNA, 17 nt, Bordetella pertussis
ccggcgcgucgcgcggc

SEQ ID NO: 2357969 - RNA, 18 nt, Bordetella pertussis
ccggcgcgugcuggcgca

SEQ ID NO: 2357970 - RNA, 21 nt, Bordetella pertussis
ccggcgcgugcuggcgcagca

SEQ ID NO: 2357971 - RNA, 24 nt, Bordetella pertussis
ccggcgcguuccaugcgauccagg

SEQ ID NO: 2357972 - RNA, 18 nt, Bordetella pertussis
ccggcgcguugcggaugg

SEQ ID NO: 2357973 - RNA, 14 nt, Bordetella pertussis
ccggcgcucagcgc

SEQ ID NO: 2357974 - RNA, 18 nt, Bordetella pertussis
ccggcgcucagcgcgccg

SEQ ID NO: 2357975 - RNA, 17 nt, Bordetella pertussis
ccggcgcucgccccggc

SEQ ID NO: 2357976 - RNA, 22 nt, Bordetella pertussis
ccggcgcucgccccggcgcgca

SEQ ID NO: 2357977 - RNA, 14 nt, Bordetella pertussis
ccggcgcugcgguc

SEQ ID NO: 2357978 - RNA, 14 nt, Bordetella pertussis
ccggcgcuggcgca

SEQ ID NO: 2357979 - RNA, 20 nt, Bordetella pertussis
ccggcgcuggcgcauggcug

SEQ ID NO: 2357980 - RNA, 20 nt, Bordetella pertussis
ccggcgcuggcuucggcgua

SEQ ID NO: 2357981 - RNA, 13 nt, Bordetella pertussis
ccggcggaucacc

SEQ ID NO: 2357982 - RNA, 23 nt, Bordetella pertussis
ccggcggaucacccagcggcugg

SEQ ID NO: 2357983 - RNA, 22 nt, Bordetella pertussis
ccggcggcaaaaaaaaccgcgc

SEQ ID NO: 2357984 - RNA, 22 nt, Bordetella pertussis
ccggcggcaccauugccggcgc

SEQ ID NO: 2357985 - RNA, 13 nt, Bordetella pertussis
ccggcggcacgcu

SEQ ID NO: 2357986 - RNA, 18 nt, Bordetella pertussis
ccggcggcacggccggcc

SEQ ID NO: 2357987 - RNA, 12 nt, Bordetella pertussis
ccggcggcagcg

SEQ ID NO: 2357988 - RNA, 13 nt, Bordetella pertussis
ccggcggcagcgc

SEQ ID NO: 2357989 - RNA, 19 nt, Bordetella pertussis
ccggcggcauucagcgcug

SEQ ID NO: 2357990 - RNA, 19 nt, Bordetella pertussis
ccggcggccagcgcgccgc

SEQ ID NO: 2357991 - RNA, 13 nt, Bordetella pertussis
ccggcggccagcu

SEQ ID NO: 2357992 - RNA, 18 nt, Bordetella pertussis
ccggcggccaggccggcg

SEQ ID NO: 2357993 - RNA, 12 nt, Bordetella pertussis
ccggcggccauc

SEQ ID NO: 2357994 - RNA, 17 nt, Bordetella pertussis
ccggcggccggucaggg

SEQ ID NO: 2357995 - RNA, 22 nt, Bordetella pertussis
ccggcggccuaugugcaggcca

SEQ ID NO: 2357996 - RNA, 16 nt, Bordetella pertussis
ccggcggccugcacgg

SEQ ID NO: 2357997 - RNA, 19 nt, Bordetella pertussis
ccggcggccugcacggugg

SEQ ID NO: 2357998 - RNA, 16 nt, Bordetella pertussis
ccggcggccugcaggc

SEQ ID NO: 2357999 - RNA, 18 nt, Bordetella pertussis
ccggcggccugcaggccg

SEQ ID NO: 2358000 - RNA, 15 nt, Bordetella pertussis
ccggcggccuggacc

SEQ ID NO: 2358001 - RNA, 19 nt, Bordetella pertussis
ccggcggcgagcgcggcgc

SEQ ID NO: 2358002 - RNA, 18 nt, Bordetella pertussis
ccggcugcuugcccagcg

SEQ ID NO: 2358003 - RNA, 20 nt, Bordetella pertussis
ccggcugcuugcccagcgga

SEQ ID NO: 2358004 - RNA, 21 nt, Bordetella pertussis
ccggcuggauggugccgccgc

SEQ ID NO: 2358005 - RNA, 16 nt, Bordetella pertussis
ccggcuggcaugcggc

SEQ ID NO: 2358006 - RNA, 19 nt, Bordetella pertussis
ccggcuggcaugcggcgga

SEQ ID NO: 2358007 - RNA, 14 nt, Bordetella pertussis
ccggcuggcgcacg

SEQ ID NO: 2358008 - RNA, 17 nt, Bordetella pertussis
ccggcuucagccgcaag

SEQ ID NO: 2358009 - RNA, 14 nt, Bordetella pertussis
ccggcuuccagcag

SEQ ID NO: 2358010 - RNA, 16 nt, Bordetella pertussis
ccggcuuccagcagca

SEQ ID NO: 2358011 - RNA, 17 nt, Bordetella pertussis
ccggcuuccagcagcau

SEQ ID NO: 2358012 - RNA, 14 nt, Bordetella pertussis
ccggcuugcauggu

SEQ ID NO: 2358013 - RNA, 16 nt, Bordetella pertussis
ccggcuugcauggugc

SEQ ID NO: 2358014 - RNA, 19 nt, Bordetella pertussis
ccggcuugcgcaagccggc

SEQ ID NO: 2358015 - RNA, 15 nt, Bordetella pertussis
ccggcuugcgccagc

SEQ ID NO: 2358016 - RNA, 19 nt, Bordetella pertussis
ccggcuugcgccagccacg

SEQ ID NO: 2358017 - RNA, 15 nt, Bordetella pertussis
ccggcuuggccucgg

SEQ ID NO: 2358018 - RNA, 20 nt, Bordetella pertussis
ccggcuuggccucggccggc

SEQ ID NO: 2358019 - RNA, 14 nt, Bordetella pertussis
ccggcuugggcaca

SEQ ID NO: 2358020 - RNA, 18 nt, Bordetella pertussis
ccggcuuggggcgcgccg

SEQ ID NO: 2358021 - RNA, 18 nt, Bordetella pertussis
ccggcuuucagcgccgag

SEQ ID NO: 2358022 - RNA, 20 nt, Bordetella pertussis
ccgggaaaaagagccugucc

SEQ ID NO: 2358023 - RNA, 23 nt, Bordetella pertussis
ccgggaaaaagagccuguccccg

SEQ ID NO: 2358024 - RNA, 18 nt, Bordetella pertussis
ccgggaaacucgcgcagc

SEQ ID NO: 2358025 - RNA, 13 nt, Bordetella pertussis
ccgggaaggcggg

SEQ ID NO: 2358026 - RNA, 16 nt, Bordetella pertussis
ccgggaaguccgccgc

SEQ ID NO: 2358027 - RNA, 18 nt, Bordetella pertussis
ccgggaaguccgccgcgu

SEQ ID NO: 2358028 - RNA, 15 nt, Bordetella pertussis
ccgggacaggcaccc

SEQ ID NO: 2358029 - RNA, 18 nt, Bordetella pertussis
ccgggacaggcaccccgu

SEQ ID NO: 2358030 - RNA, 17 nt, Bordetella pertussis
ccgggacaggcacccgc

SEQ ID NO: 2358031 - RNA, 21 nt, Bordetella pertussis
ccgggacaggcacccgcgcgc

SEQ ID NO: 2358032 - RNA, 24 nt, Bordetella pertussis
ccgggacaggcacccgcgcgcagc

SEQ ID NO: 2358033 - RNA, 15 nt, Bordetella pertussis
ccgggacaggcaccu

SEQ ID NO: 2358034 - RNA, 16 nt, Bordetella pertussis
ccgggaccuuggcggc

SEQ ID NO: 2358035 - RNA, 17 nt, Bordetella pertussis
ccgggaccuuggcggcu

SEQ ID NO: 2358036 - RNA, 20 nt, Bordetella pertussis
ccgggaccuuggcggcuggc

SEQ ID NO: 2358037 - RNA, 18 nt, Bordetella pertussis
ccgggagccuguccccga

SEQ ID NO: 2358038 - RNA, 22 nt, Bordetella pertussis
ccgggauccacgccgccggcca

SEQ ID NO: 2358039 - RNA, 21 nt, Bordetella pertussis
ccgggaucugcgagccuucgg

SEQ ID NO: 2358040 - RNA, 15 nt, Bordetella pertussis
ccgggaugccguagg

SEQ ID NO: 2358041 - RNA, 20 nt, Bordetella pertussis
ccgggaugccguaggugcgc

SEQ ID NO: 2358042 - RNA, 19 nt, Bordetella pertussis
ccgggaugcugcucggcca

SEQ ID NO: 2358043 - RNA, 17 nt, Bordetella pertussis
ccgggcaagcagauggc

SEQ ID NO: 2358044 - RNA, 21 nt, Bordetella pertussis
ccgggcaagcagauggccauc

SEQ ID NO: 2358045 - RNA, 16 nt, Bordetella pertussis
ccgggcaaucggcgug

SEQ ID NO: 2358046 - RNA, 17 nt, Bordetella pertussis
ccgggcaccgagccgca

SEQ ID NO: 2358047 - RNA, 18 nt, Bordetella pertussis
ccgggcacguaguacagc

SEQ ID NO: 2358048 - RNA, 18 nt, Bordetella pertussis
ccgggcagcaccgcugcu

SEQ ID NO: 2358049 - RNA, 14 nt, Bordetella pertussis
ccgggcagcccgcg

SEQ ID NO: 2358050 - RNA, 20 nt, Bordetella pertussis
ccgggcagcccgcgcacgcc

SEQ ID NO: 2358051 - RNA, 12 nt, Bordetella pertussis
ccgggcaggccg

SEQ ID NO: 2358052 - RNA, 14 nt, Bordetella pertussis
ccgggcaggccgcg

SEQ ID NO: 2358053 - RNA, 16 nt, Bordetella pertussis
ccgggcaggccgcgcu

SEQ ID NO: 2358054 - RNA, 18 nt, Bordetella pertussis
ccgggcaggccgcgcugg

SEQ ID NO: 2358055 - RNA, 19 nt, Bordetella pertussis
ccgggcaggcucagcccgg

SEQ ID NO: 2358056 - RNA, 17 nt, Bordetella pertussis
ccgggcaguucgggcac

SEQ ID NO: 2358057 - RNA, 19 nt, Bordetella pertussis
ccgggcauggcccggcucg

SEQ ID NO: 2358058 - RNA, 21 nt, Bordetella pertussis
ccgggcauggcccggcucgcc

SEQ ID NO: 2358059 - RNA, 21 nt, Bordetella pertussis
ccgggcauugccggagcagca

SEQ ID NO: 2358060 - RNA, 15 nt, Bordetella pertussis
ccgggccaaggugcc

SEQ ID NO: 2358061 - RNA, 13 nt, Bordetella pertussis
ccgggccacgagc

SEQ ID NO: 2358062 - RNA, 14 nt, Bordetella pertussis
ccgggccacgcgca

SEQ ID NO: 2358063 - RNA, 16 nt, Bordetella pertussis
ccgggccacgcgcaca

SEQ ID NO: 2358064 - RNA, 22 nt, Bordetella pertussis
ccgggccaugcgggucaggccg

SEQ ID NO: 2358065 - RNA, 12 nt, Bordetella pertussis
ccgggcccgcgc

SEQ ID NO: 2358066 - RNA, 21 nt, Bordetella pertussis
ccgggcccggccacggccggg

SEQ ID NO: 2358067 - RNA, 16 nt, Bordetella pertussis
ccgggcccggcgcgcc

SEQ ID NO: 2358068 - RNA, 18 nt, Bordetella pertussis
ccgggccgaccaggccgg

SEQ ID NO: 2358069 - RNA, 13 nt, Bordetella pertussis
ccgggccgacgcg

SEQ ID NO: 2358070 - RNA, 14 nt, Bordetella pertussis
ccgggccgacgcgc

SEQ ID NO: 2358071 - RNA, 16 nt, Bordetella pertussis
ccgggccgacgcgccc

SEQ ID NO: 2358072 - RNA, 24 nt, Bordetella pertussis
ccgggccgacgcgcccgggcugau

SEQ ID NO: 2358073 - RNA, 22 nt, Bordetella pertussis
ccgggccgcgaccacggucugg

SEQ ID NO: 2358074 - RNA, 12 nt, Bordetella pertussis
ccgggccgcgcc

SEQ ID NO: 2358075 - RNA, 14 nt, Bordetella pertussis
ccgggccgcgccgc

SEQ ID NO: 2358076 - RNA, 16 nt, Bordetella pertussis
ccgggccgcgccgccu

SEQ ID NO: 2358077 - RNA, 12 nt, Bordetella pertussis
ccgggccgcugg

SEQ ID NO: 2358078 - RNA, 18 nt, Bordetella pertussis
ccgggccgcuggcccggg

SEQ ID NO: 2358079 - RNA, 11 nt, Bordetella pertussis
ccgggccggcc

SEQ ID NO: 2358080 - RNA, 15 nt, Bordetella pertussis
ccgggccggcgggca

SEQ ID NO: 2358081 - RNA, 16 nt, Bordetella pertussis
ccgggccggcgggcgu

SEQ ID NO: 2358082 - RNA, 12 nt, Bordetella pertussis
ccgggccgucgc

SEQ ID NO: 2358083 - RNA, 15 nt, Bordetella pertussis
ccgggccgucgccgc

SEQ ID NO: 2358084 - RNA, 16 nt, Bordetella pertussis
ccgggccgucgccgcg

SEQ ID NO: 2358085 - RNA, 12 nt, Bordetella pertussis
ccgggccgucgu

SEQ ID NO: 2358086 - RNA, 16 nt, Bordetella pertussis
ccgggccgucgugcgc

SEQ ID NO: 2358087 - RNA, 19 nt, Bordetella pertussis
ccgggccgucuacaggccc

SEQ ID NO: 2358088 - RNA, 17 nt, Bordetella pertussis
ccgggccgugcgccggg

SEQ ID NO: 2358089 - RNA, 14 nt, Bordetella pertussis
ccgggccuagcccg

SEQ ID NO: 2358090 - RNA, 16 nt, Bordetella pertussis
ccgggccuagcccggc

SEQ ID NO: 2358091 - RNA, 20 nt, Bordetella pertussis
ccgggccuagcccggcgcca

SEQ ID NO: 2358092 - RNA, 22 nt, Bordetella pertussis
ccgggccucaaucgaugaugug

SEQ ID NO: 2358093 - RNA, 17 nt, Bordetella pertussis
ccgggccuggccugcgc

SEQ ID NO: 2358094 - RNA, 14 nt, Bordetella pertussis
ccgggcgaccccgg

SEQ ID NO: 2358095 - RNA, 18 nt, Bordetella pertussis
ccgggcgacggcgugcug

SEQ ID NO: 2358096 - RNA, 16 nt, Bordetella pertussis
ccgggcgcaagcgcgc

SEQ ID NO: 2358097 - RNA, 18 nt, Bordetella pertussis
ccgggcgcaagcgcgccg

SEQ ID NO: 2358098 - RNA, 19 nt, Bordetella pertussis
ccgggcgcaagcgcgccga

SEQ ID NO: 2358099 - RNA, 12 nt, Bordetella pertussis
ccgggcgccagg

SEQ ID NO: 2358100 - RNA, 13 nt, Bordetella pertussis
ccgggcgccgcgc

SEQ ID NO: 2358101 - RNA, 14 nt, Bordetella pertussis
ccgggcgccggcgg

SEQ ID NO: 2358102 - RNA, 16 nt, Bordetella pertussis
ccgggcgccggcggca

SEQ ID NO: 2358103 - RNA, 14 nt, Bordetella pertussis
ccgggcgccugcgc

SEQ ID NO: 2358104 - RNA, 18 nt, Bordetella pertussis
ccgggcgccugcgccacc

SEQ ID NO: 2358105 - RNA, 14 nt, Bordetella pertussis
ccgggcgcgcgccg

SEQ ID NO: 2358106 - RNA, 12 nt, Bordetella pertussis
ccgggcgcgcug

SEQ ID NO: 2358107 - RNA, 15 nt, Bordetella pertussis
ccgggcgcgcugccc

SEQ ID NO: 2358108 - RNA, 19 nt, Bordetella pertussis
ccgggcgcgcugcccagcc

SEQ ID NO: 2358109 - RNA, 20 nt, Bordetella pertussis
ccgggcgcgcugcccagcca

SEQ ID NO: 2358110 - RNA, 13 nt, Bordetella pertussis
ccgggcgcgcugu

SEQ ID NO: 2358111 - RNA, 18 nt, Bordetella pertussis
ccgggcgcggccaggcgc

SEQ ID NO: 2358112 - RNA, 15 nt, Bordetella pertussis
ccgggcgcggcccgg

SEQ ID NO: 2358113 - RNA, 22 nt, Bordetella pertussis
ccgggcgcggcccggcgucggg

SEQ ID NO: 2358114 - RNA, 21 nt, Bordetella pertussis
ccgggcgcggccgccgcccgc

SEQ ID NO: 2358115 - RNA, 14 nt, Bordetella pertussis
ccgggcgcggcgcc

SEQ ID NO: 2358116 - RNA, 15 nt, Bordetella pertussis
ccgguaugccugcca

SEQ ID NO: 2358117 - RNA, 16 nt, Bordetella pertussis
ccggucaccgccgccg

SEQ ID NO: 2358118 - RNA, 13 nt, Bordetella pertussis
ccggucagcaggg

SEQ ID NO: 2358119 - RNA, 15 nt, Bordetella pertussis
ccggucagcagggcg

SEQ ID NO: 2358120 - RNA, 18 nt, Bordetella pertussis
ccggucagcagggcgccg

SEQ ID NO: 2358121 - RNA, 22 nt, Bordetella pertussis
ccggucagcccaggcgggcgug

SEQ ID NO: 2358122 - RNA, 22 nt, Bordetella pertussis
ccggucagggaggcuguccccg

SEQ ID NO: 2358123 - RNA, 23 nt, Bordetella pertussis
ccggucaugaaguccgacaggca

SEQ ID NO: 2358124 - RNA, 23 nt, Bordetella pertussis
ccggucaugcaccugcaggguca

SEQ ID NO: 2358125 - RNA, 12 nt, Bordetella pertussis
ccgguccagaug

SEQ ID NO: 2358126 - RNA, 14 nt, Bordetella pertussis
ccgguccagaugau

SEQ ID NO: 2358127 - RNA, 23 nt, Bordetella pertussis
ccgguccagaugauggucggugc

SEQ ID NO: 2358128 - RNA, 13 nt, Bordetella pertussis
ccgguccaggccg

SEQ ID NO: 2358129 - RNA, 14 nt, Bordetella pertussis
ccgguccgccucgc

SEQ ID NO: 2358130 - RNA, 18 nt, Bordetella pertussis
ccggucgacccucagccc

SEQ ID NO: 2358131 - RNA, 18 nt, Bordetella pertussis
ccggucgaucagggcgcg

SEQ ID NO: 2358132 - RNA, 14 nt, Bordetella pertussis
ccggucgccagcga

SEQ ID NO: 2358133 - RNA, 14 nt, Bordetella pertussis
ccggucgcccgccg

SEQ ID NO: 2358134 - RNA, 16 nt, Bordetella pertussis
ccggucgcccgccgcg

SEQ ID NO: 2358135 - RNA, 17 nt, Bordetella pertussis
ccggucgcccgccgcgu

SEQ ID NO: 2358136 - RNA, 18 nt, Bordetella pertussis
ccggucgcccgccgcgua

SEQ ID NO: 2358137 - RNA, 12 nt, Bordetella pertussis
ccggucgccgcg

SEQ ID NO: 2358138 - RNA, 22 nt, Bordetella pertussis
ccggucgcgauccggugaucau

SEQ ID NO: 2358139 - RNA, 13 nt, Bordetella pertussis
ccggucgcgcgug

SEQ ID NO: 2358140 - RNA, 20 nt, Bordetella pertussis
ccggucgcgcgugcaggccg

SEQ ID NO: 2358141 - RNA, 22 nt, Bordetella pertussis
ccggucgcgcgugcaggccgcg

SEQ ID NO: 2358142 - RNA, 18 nt, Bordetella pertussis
ccggucggcccaggucau

SEQ ID NO: 2358143 - RNA, 21 nt, Bordetella pertussis
ccggucggcccaggucaucgc

SEQ ID NO: 2358144 - RNA, 14 nt, Bordetella pertussis
ccggucggccgcuc

SEQ ID NO: 2358145 - RNA, 16 nt, Bordetella pertussis
ccggucggccgcuccg

SEQ ID NO: 2358146 - RNA, 13 nt, Bordetella pertussis
ccggucggccggc

SEQ ID NO: 2358147 - RNA, 14 nt, Bordetella pertussis
ccggucggccggca

SEQ ID NO: 2358148 - RNA, 16 nt, Bordetella pertussis
ccggucggccggcagc

SEQ ID NO: 2358149 - RNA, 21 nt, Bordetella pertussis
ccggucuacgccaugagcgcu

SEQ ID NO: 2358150 - RNA, 23 nt, Bordetella pertussis
ccggucuacgccaugagcgcuug

SEQ ID NO: 2358151 - RNA, 22 nt, Bordetella pertussis
ccggucuaugucgaggaccuga

SEQ ID NO: 2358152 - RNA, 15 nt, Bordetella pertussis
ccggucuccagcgcg

SEQ ID NO: 2358153 - RNA, 19 nt, Bordetella pertussis
ccggucuccagcgcgucgg

SEQ ID NO: 2358154 - RNA, 20 nt, Bordetella pertussis
ccggucuccagcgcgucggc

SEQ ID NO: 2358155 - RNA, 21 nt, Bordetella pertussis
ccggucuccagcgcgucggcc

SEQ ID NO: 2358156 - RNA, 18 nt, Bordetella pertussis
ccggucuggucggcgaug

SEQ ID NO: 2358157 - RNA, 14 nt, Bordetella pertussis
ccggugaacaccag

SEQ ID NO: 2358158 - RNA, 18 nt, Bordetella pertussis
ccggugaacaccagggug

SEQ ID NO: 2358159 - RNA, 16 nt, Bordetella pertussis
ccggugagauccagcg

SEQ ID NO: 2358160 - RNA, 18 nt, Bordetella pertussis
ccggugaucagcaggccc

SEQ ID NO: 2358161 - RNA, 21 nt, Bordetella pertussis
ccggugaucagcaggcccacc

SEQ ID NO: 2358162 - RNA, 20 nt, Bordetella pertussis
ccggugaucaucgugccggg

SEQ ID NO: 2358163 - RNA, 19 nt, Bordetella pertussis
ccggugaucaugccgcuga

SEQ ID NO: 2358164 - RNA, 15 nt, Bordetella pertussis
ccggugaucuugccg

SEQ ID NO: 2358165 - RNA, 15 nt, Bordetella pertussis
ccggugaugcccgag

SEQ ID NO: 2358166 - RNA, 17 nt, Bordetella pertussis
ccggugaugcccgaggc

SEQ ID NO: 2358167 - RNA, 22 nt, Bordetella pertussis
ccggugaugcccgaggcggcgc

SEQ ID NO: 2358168 - RNA, 21 nt, Bordetella pertussis
ccggugaugcggcgcgccgcg

SEQ ID NO: 2358169 - RNA, 17 nt, Bordetella pertussis
ccggugauguacgcauc

SEQ ID NO: 2358170 - RNA, 20 nt, Bordetella pertussis
ccggugauguacgcaucggc

SEQ ID NO: 2358171 - RNA, 22 nt, Bordetella pertussis
ccggugauguacgcaucggcgc

SEQ ID NO: 2358172 - RNA, 23 nt, Bordetella pertussis
ccggugauguacgcaucggcgcc

SEQ ID NO: 2358173 - RNA, 16 nt, Bordetella pertussis
ccggugauuucggcgc

SEQ ID NO: 2358174 - RNA, 22 nt, Bordetella pertussis
ccggugauuucggcgcaucggc

SEQ ID NO: 2358175 - RNA, 15 nt, Bordetella pertussis
ccggugcaccaggcc

SEQ ID NO: 2358176 - RNA, 20 nt, Bordetella pertussis
ccggugcagcguggcgcggg

SEQ ID NO: 2358177 - RNA, 20 nt, Bordetella pertussis
ccggugcaggucaucgcgcu

SEQ ID NO: 2358178 - RNA, 22 nt, Bordetella pertussis
ccggugcaggucaucgcgcugg

SEQ ID NO: 2358179 - RNA, 13 nt, Bordetella pertussis
ccggugccugccc

SEQ ID NO: 2358180 - RNA, 19 nt, Bordetella pertussis
ccggugcgauagcgccgcg

SEQ ID NO: 2358181 - RNA, 21 nt, Bordetella pertussis
ccggugcgauagcgccgcgca

SEQ ID NO: 2358182 - RNA, 20 nt, Bordetella pertussis
ccggugcgcacauggcggau

SEQ ID NO: 2358183 - RNA, 13 nt, Bordetella pertussis
ccggugcgcagca

SEQ ID NO: 2358184 - RNA, 18 nt, Bordetella pertussis
ccggugcgcagcaccagc

SEQ ID NO: 2358185 - RNA, 15 nt, Bordetella pertussis
ccggugcgcgcaggg

SEQ ID NO: 2358186 - RNA, 17 nt, Bordetella pertussis
ccggugcgcgcagggcg

SEQ ID NO: 2358187 - RNA, 20 nt, Bordetella pertussis
ccggugcgcgcagggcggcc

SEQ ID NO: 2358188 - RNA, 21 nt, Bordetella pertussis
ccggugcgcgcagggcggccg

SEQ ID NO: 2358189 - RNA, 14 nt, Bordetella pertussis
ccggugcgcggcgc

SEQ ID NO: 2358190 - RNA, 18 nt, Bordetella pertussis
ccggugcgcggcgccccc

SEQ ID NO: 2358191 - RNA, 23 nt, Bordetella pertussis
ccggugcgcgugggcacccggcc

SEQ ID NO: 2358192 - RNA, 17 nt, Bordetella pertussis
ccggugcguaccagccc

SEQ ID NO: 2358193 - RNA, 19 nt, Bordetella pertussis
ccgguggaaauacagaucg

SEQ ID NO: 2358194 - RNA, 13 nt, Bordetella pertussis
ccgguggacggcc

SEQ ID NO: 2358195 - RNA, 17 nt, Bordetella pertussis
ccgguggacggccagca

SEQ ID NO: 2358196 - RNA, 20 nt, Bordetella pertussis
ccgguggccagcagcuguuc

SEQ ID NO: 2358197 - RNA, 21 nt, Bordetella pertussis
ccgguggugcugcugggcgcc

SEQ ID NO: 2358198 - RNA, 14 nt, Bordetella pertussis
ccgguggugcuggg

SEQ ID NO: 2358199 - RNA, 19 nt, Bordetella pertussis
ccgguggugcugggcggcg

SEQ ID NO: 2358200 - RNA, 21 nt, Bordetella pertussis
ccgguggugcugggcggcggg

SEQ ID NO: 2358201 - RNA, 22 nt, Bordetella pertussis
ccgguggugcugggcggcgggc

SEQ ID NO: 2358202 - RNA, 15 nt, Bordetella pertussis
ccgguguaggcgggc

SEQ ID NO: 2358203 - RNA, 16 nt, Bordetella pertussis
ccgguguaggcgggca

SEQ ID NO: 2358204 - RNA, 19 nt, Bordetella pertussis
ccggugucggcccacugga

SEQ ID NO: 2358205 - RNA, 16 nt, Bordetella pertussis
ccggugucggggccgg

SEQ ID NO: 2358206 - RNA, 17 nt, Bordetella pertussis
ccggugucggggccggg

SEQ ID NO: 2358207 - RNA, 18 nt, Bordetella pertussis
ccggugucggggccgggc

SEQ ID NO: 2358208 - RNA, 22 nt, Bordetella pertussis
ccggugucggggccgggccggc

SEQ ID NO: 2358209 - RNA, 15 nt, Bordetella pertussis
ccgguguucucgcug

SEQ ID NO: 2358210 - RNA, 20 nt, Bordetella pertussis
ccgguuccugcaaggccggc

SEQ ID NO: 2358211 - RNA, 23 nt, Bordetella pertussis
ccgguuccugcaaggccggcggc

SEQ ID NO: 2358212 - RNA, 23 nt, Bordetella pertussis
ccgguucgaugaccugggccugg

SEQ ID NO: 2358213 - RNA, 14 nt, Bordetella pertussis
ccgguucgcccacc

SEQ ID NO: 2358214 - RNA, 15 nt, Bordetella pertussis
ccgguucgcccacca

SEQ ID NO: 2358215 - RNA, 16 nt, Bordetella pertussis
ccgguucggcgcggcg

SEQ ID NO: 2358216 - RNA, 18 nt, Bordetella pertussis
ccgguucugcggcgcgua

SEQ ID NO: 2358217 - RNA, 13 nt, Bordetella pertussis
ccgguugacgauc

SEQ ID NO: 2358218 - RNA, 19 nt, Bordetella pertussis
ccgguugcagcgcgccagg

SEQ ID NO: 2358219 - RNA, 14 nt, Bordetella pertussis
ccgguugcgcgccg

SEQ ID NO: 2358220 - RNA, 17 nt, Bordetella pertussis
ccgguuggggucgcgcu

SEQ ID NO: 2358221 - RNA, 18 nt, Bordetella pertussis
ccgguuggggucgcgcug

SEQ ID NO: 2358222 - RNA, 15 nt, Bordetella pertussis
ccgguugguggcgau

SEQ ID NO: 2358223 - RNA, 19 nt, Bordetella pertussis
ccgguuuuuuugcgccgcu

SEQ ID NO: 2358224 - RNA, 17 nt, Bordetella pertussis
ccguaaagaugcgcgcc

SEQ ID NO: 2358225 - RNA, 18 nt, Bordetella pertussis
ccguaaagaugcgcgccg

SEQ ID NO: 2358226 - RNA, 19 nt, Bordetella pertussis
ccguaaagaugcgcgccgu

SEQ ID NO: 2358227 - RNA, 13 nt, Bordetella pertussis
ccguaagcgcugg

SEQ ID NO: 2358228 - RNA, 17 nt, Bordetella pertussis
ccgucgagccgggcgcc

SEQ ID NO: 2358229 - RNA, 22 nt, Bordetella pertussis
ccgucgagccgguccgccucgc

SEQ ID NO: 2358230 - RNA, 18 nt, Bordetella pertussis
ccgucgagcgcggccagg

SEQ ID NO: 2358231 - RNA, 20 nt, Bordetella pertussis
ccgucgagcgcggccaggcg

SEQ ID NO: 2358232 - RNA, 18 nt, Bordetella pertussis
ccgucgaugaccagcgcc

SEQ ID NO: 2358233 - RNA, 20 nt, Bordetella pertussis
ccgucgaugaccagcgccgg

SEQ ID NO: 2358234 - RNA, 21 nt, Bordetella pertussis
ccgucgaugaccagcgccggc

SEQ ID NO: 2358235 - RNA, 16 nt, Bordetella pertussis
ccgucgcacuggguuu

SEQ ID NO: 2358236 - RNA, 18 nt, Bordetella pertussis
ccgucgccaaagcgcagc

SEQ ID NO: 2358237 - RNA, 16 nt, Bordetella pertussis
ccgucgcccuggcggc

SEQ ID NO: 2358238 - RNA, 15 nt, Bordetella pertussis
ccgucgccgaucggc

SEQ ID NO: 2358239 - RNA, 15 nt, Bordetella pertussis
ccgucgccgcccaug

SEQ ID NO: 2358240 - RNA, 18 nt, Bordetella pertussis
ccgucgccgcccugcugc

SEQ ID NO: 2358241 - RNA, 16 nt, Bordetella pertussis
ccgucgccgcgcggcg

SEQ ID NO: 2358242 - RNA, 16 nt, Bordetella pertussis
ccgucgcgccaggccg

SEQ ID NO: 2358243 - RNA, 17 nt, Bordetella pertussis
ccgucgcgccaggccgg

SEQ ID NO: 2358244 - RNA, 21 nt, Bordetella pertussis
ccgucgcgcucggacgccgcg

SEQ ID NO: 2358245 - RNA, 22 nt, Bordetella pertussis
ccgucgcgcucggacgccgcgc

SEQ ID NO: 2358246 - RNA, 23 nt, Bordetella pertussis
ccgucgcgcugcaauugcgcggc

SEQ ID NO: 2358247 - RNA, 17 nt, Bordetella pertussis
ccgucgcggaccuccug

SEQ ID NO: 2358248 - RNA, 16 nt, Bordetella pertussis
ccgucgcuggcgcguu

SEQ ID NO: 2358249 - RNA, 16 nt, Bordetella pertussis
ccgucggccacguccg

SEQ ID NO: 2358250 - RNA, 13 nt, Bordetella pertussis
ccgucggccagcu

SEQ ID NO: 2358251 - RNA, 14 nt, Bordetella pertussis
ccgucggccgcgcc

SEQ ID NO: 2358252 - RNA, 15 nt, Bordetella pertussis
ccgucggccgucugg

SEQ ID NO: 2358253 - RNA, 18 nt, Bordetella pertussis
ccgucggcgcuggcgcgc

SEQ ID NO: 2358254 - RNA, 19 nt, Bordetella pertussis
ccgucggcgcuggcgcgcu

SEQ ID NO: 2358255 - RNA, 12 nt, Bordetella pertussis
ccgucggcggca

SEQ ID NO: 2358256 - RNA, 20 nt, Bordetella pertussis
ccgucggcggcaagcagccg

SEQ ID NO: 2358257 - RNA, 21 nt, Bordetella pertussis
ccgucggcggcaagcagccgg

SEQ ID NO: 2358258 - RNA, 22 nt, Bordetella pertussis
ccgucggcggcaagcagccgga

SEQ ID NO: 2358259 - RNA, 22 nt, Bordetella pertussis
ccgucggcguugugccggcgca

SEQ ID NO: 2358260 - RNA, 12 nt, Bordetella pertussis
ccgucgggacag

SEQ ID NO: 2358261 - RNA, 13 nt, Bordetella pertussis
ccgucgggacagg

SEQ ID NO: 2358262 - RNA, 12 nt, Bordetella pertussis
ccgucgggcagg

SEQ ID NO: 2358263 - RNA, 15 nt, Bordetella pertussis
ccgucgggggccggc

SEQ ID NO: 2358264 - RNA, 21 nt, Bordetella pertussis
ccgucgggggccggcucgccc

SEQ ID NO: 2358265 - RNA, 19 nt, Bordetella pertussis
ccgucggguugccgcugca

SEQ ID NO: 2358266 - RNA, 20 nt, Bordetella pertussis
ccgucggugguggugacguu

SEQ ID NO: 2358267 - RNA, 16 nt, Bordetella pertussis
ccgucgucaucgccau

SEQ ID NO: 2358268 - RNA, 17 nt, Bordetella pertussis
ccgucguccucggcacg

SEQ ID NO: 2358269 - RNA, 19 nt, Bordetella pertussis
ccgucguccucggcacggc

SEQ ID NO: 2358270 - RNA, 19 nt, Bordetella pertussis
ccgucgucguccacgcccg

SEQ ID NO: 2358271 - RNA, 21 nt, Bordetella pertussis
ccgucgucguccacgcccggu

SEQ ID NO: 2358272 - RNA, 14 nt, Bordetella pertussis
ccgucgugcgccug

SEQ ID NO: 2358273 - RNA, 15 nt, Bordetella pertussis
ccgucgugcgccugg

SEQ ID NO: 2358274 - RNA, 16 nt, Bordetella pertussis
ccgucguugacgggga

SEQ ID NO: 2358275 - RNA, 18 nt, Bordetella pertussis
ccgucguugacggggacg

SEQ ID NO: 2358276 - RNA, 13 nt, Bordetella pertussis
ccgucuacaggcc

SEQ ID NO: 2358277 - RNA, 18 nt, Bordetella pertussis
ccgucuauggccugcagg

SEQ ID NO: 2358278 - RNA, 17 nt, Bordetella pertussis
ccgucucgaacgccgcg

SEQ ID NO: 2358279 - RNA, 14 nt, Bordetella pertussis
ccgucucgcgcgcc

SEQ ID NO: 2358280 - RNA, 15 nt, Bordetella pertussis
ccgucucgcgcgcca

SEQ ID NO: 2358281 - RNA, 13 nt, Bordetella pertussis
ccgucuggcggca

SEQ ID NO: 2358282 - RNA, 17 nt, Bordetella pertussis
ccgucuggcggcagcuc

SEQ ID NO: 2358283 - RNA, 21 nt, Bordetella pertussis
ccgucuggcggcagcucgcgc

SEQ ID NO: 2358284 - RNA, 24 nt, Bordetella pertussis
ccgucugggcgugaaaggccagcg

SEQ ID NO: 2358285 - RNA, 17 nt, Bordetella pertussis
ccgucugugcgccccgc

SEQ ID NO: 2358286 - RNA, 18 nt, Bordetella pertussis
ccgucuugcccgccagcg

SEQ ID NO: 2358287 - RNA, 19 nt, Bordetella pertussis
ccgucuuggcguggugggc

SEQ ID NO: 2358288 - RNA, 14 nt, Bordetella pertussis
ccgugaaggugccg

SEQ ID NO: 2358289 - RNA, 18 nt, Bordetella pertussis
ccgugaaugcgccuggcg

SEQ ID NO: 2358290 - RNA, 18 nt, Bordetella pertussis
ccgugaccugcgucugcg

SEQ ID NO: 2358291 - RNA, 19 nt, Bordetella pertussis
ccgugaccugcucgucgcc

SEQ ID NO: 2358292 - RNA, 20 nt, Bordetella pertussis
ccgugacgcugauggccgcc

SEQ ID NO: 2358293 - RNA, 18 nt, Bordetella pertussis
ccgugacguugagcgccg

SEQ ID NO: 2358294 - RNA, 19 nt, Bordetella pertussis
ccgugacguugagcgccgg

SEQ ID NO: 2358295 - RNA, 23 nt, Bordetella pertussis
ccgugacuucggccgccagccgg

SEQ ID NO: 2358296 - RNA, 13 nt, Bordetella pertussis
ccgugagcgccgc

SEQ ID NO: 2358297 - RNA, 15 nt, Bordetella pertussis
ccgugagcgccgccg

SEQ ID NO: 2358298 - RNA, 19 nt, Bordetella pertussis
ccgugauauagaccagcag

SEQ ID NO: 2358299 - RNA, 21 nt, Bordetella pertussis
ccgugaucuugaugccgccca

SEQ ID NO: 2358300 - RNA, 23 nt, Bordetella pertussis
ccgugaucuugaugccgcccagc

SEQ ID NO: 2358301 - RNA, 15 nt, Bordetella pertussis
ccgugaugcgcgccg

SEQ ID NO: 2358302 - RNA, 15 nt, Bordetella pertussis
ccgugauggcgcggg

SEQ ID NO: 2358303 - RNA, 20 nt, Bordetella pertussis
ccgugaugucgccgucggca

SEQ ID NO: 2358304 - RNA, 13 nt, Bordetella pertussis
ccgugcagauggc

SEQ ID NO: 2358305 - RNA, 13 nt, Bordetella pertussis
ccgugcaggcccg

SEQ ID NO: 2358306 - RNA, 14 nt, Bordetella pertussis
ccgugcagggccag

SEQ ID NO: 2358307 - RNA, 22 nt, Bordetella pertussis
ccgugcaucccaauuggccgcc

SEQ ID NO: 2358308 - RNA, 21 nt, Bordetella pertussis
ccgugcccgagggcgcgucga

SEQ ID NO: 2358309 - RNA, 14 nt, Bordetella pertussis
ccgugcccggcggg

SEQ ID NO: 2358310 - RNA, 17 nt, Bordetella pertussis
ccgugcccggcgggccg

SEQ ID NO: 2358311 - RNA, 22 nt, Bordetella pertussis
ccgugccgcgcgcaccggcuug

SEQ ID NO: 2358312 - RNA, 23 nt, Bordetella pertussis
ccgugccgcgcgcaccggcuugg

SEQ ID NO: 2358313 - RNA, 22 nt, Bordetella pertussis
ccgugccgcggcgcggcccgcc

SEQ ID NO: 2358314 - RNA, 23 nt, Bordetella pertussis
ccgugccgggccuggugcccgac

SEQ ID NO: 2358315 - RNA, 18 nt, Bordetella pertussis
ccgugcgaggcgaacagg

SEQ ID NO: 2358316 - RNA, 21 nt, Bordetella pertussis
ccgugcgaggcgaacaggcac

SEQ ID NO: 2358317 - RNA, 22 nt, Bordetella pertussis
ccgugcgaggcgaacaggcaca

SEQ ID NO: 2358318 - RNA, 22 nt, Bordetella pertussis
ccgugcgcaacgcgcgcgcgca

SEQ ID NO: 2358319 - RNA, 19 nt, Bordetella pertussis
ccgugcgccaacgcgucga

SEQ ID NO: 2358320 - RNA, 18 nt, Bordetella pertussis
ccgugcgccagcgccagc

SEQ ID NO: 2358321 - RNA, 13 nt, Bordetella pertussis
ccgugcgcccgac

SEQ ID NO: 2358322 - RNA, 14 nt, Bordetella pertussis
ccgugcgcgcccga

SEQ ID NO: 2358323 - RNA, 19 nt, Bordetella pertussis
ccgugcgcggcgagccgcg

SEQ ID NO: 2358324 - RNA, 20 nt, Bordetella pertussis
ccgugcgcggcgagccgcgc

SEQ ID NO: 2358325 - RNA, 17 nt, Bordetella pertussis
ccgugcgcgggcgcggc

SEQ ID NO: 2358326 - RNA, 19 nt, Bordetella pertussis
ccgugcgcgggcgcggcag

SEQ ID NO: 2358327 - RNA, 20 nt, Bordetella pertussis
ccgugcgcgggcgcggcagg

SEQ ID NO: 2358328 - RNA, 22 nt, Bordetella pertussis
ccgugcgcgggcgcggcaggcg

SEQ ID NO: 2358329 - RNA, 13 nt, Bordetella pertussis
ccgugcggcgcgc

SEQ ID NO: 2358330 - RNA, 23 nt, Bordetella pertussis
ccgugcggcgcgcacgggcgagg

SEQ ID NO: 2358331 - RNA, 17 nt, Bordetella pertussis
ccgugcgggccugcagu

SEQ ID NO: 2358332 - RNA, 21 nt, Bordetella pertussis
ccgugcgggccugcaguucgg

SEQ ID NO: 2358333 - RNA, 15 nt, Bordetella pertussis
ccgugcggggaccgg

SEQ ID NO: 2358334 - RNA, 17 nt, Bordetella pertussis
ccgugcgguucgucagg

SEQ ID NO: 2358335 - RNA, 22 nt, Bordetella pertussis
ccgugcgguucgucagggccgc

SEQ ID NO: 2358336 - RNA, 17 nt, Bordetella pertussis
ccgugcgugugccuguc

SEQ ID NO: 2358337 - RNA, 19 nt, Bordetella pertussis
ccgugcgugugccuguccc

SEQ ID NO: 2358338 - RNA, 20 nt, Bordetella pertussis
ccgugcuccagaacgcgccg

SEQ ID NO: 2358339 - RNA, 22 nt, Bordetella pertussis
ccgugcuccagaacgcgccgua

SEQ ID NO: 2358340 - RNA, 18 nt, Bordetella pertussis
ccuccagcuccagcgcgc

SEQ ID NO: 2358341 - RNA, 21 nt, Bordetella pertussis
ccuccaggcccaggcgaccca

SEQ ID NO: 2358342 - RNA, 21 nt, Bordetella pertussis
ccuccaggcggcggugccagc

SEQ ID NO: 2358343 - RNA, 18 nt, Bordetella pertussis
ccucccacgaccugcaac

SEQ ID NO: 2358344 - RNA, 14 nt, Bordetella pertussis
ccucccagaaacug

SEQ ID NO: 2358345 - RNA, 22 nt, Bordetella pertussis
ccucccagaaacuggcgcugcc

SEQ ID NO: 2358346 - RNA, 16 nt, Bordetella pertussis
ccucccagaccugcgc

SEQ ID NO: 2358347 - RNA, 20 nt, Bordetella pertussis
ccucccagaccugcgcgccg

SEQ ID NO: 2358348 - RNA, 22 nt, Bordetella pertussis
ccucccagaccugcgcgccggc

SEQ ID NO: 2358349 - RNA, 21 nt, Bordetella pertussis
ccucccgucgucguccacgcc

SEQ ID NO: 2358350 - RNA, 22 nt, Bordetella pertussis
ccucccgucgucguccacgccc

SEQ ID NO: 2358351 - RNA, 13 nt, Bordetella pertussis
ccucccugugggg

SEQ ID NO: 2358352 - RNA, 19 nt, Bordetella pertussis
ccucccugugggggacagg

SEQ ID NO: 2358353 - RNA, 21 nt, Bordetella pertussis
ccucccugugggggacaggca

SEQ ID NO: 2358354 - RNA, 14 nt, Bordetella pertussis
ccuccgacaggcgc

SEQ ID NO: 2358355 - RNA, 16 nt, Bordetella pertussis
ccuccgacaggcgccg

SEQ ID NO: 2358356 - RNA, 18 nt, Bordetella pertussis
ccuccgacaggcgccgca

SEQ ID NO: 2358357 - RNA, 19 nt, Bordetella pertussis
ccuccgagacguagggcac

SEQ ID NO: 2358358 - RNA, 20 nt, Bordetella pertussis
ccuccgagacguagggcaca

SEQ ID NO: 2358359 - RNA, 14 nt, Bordetella pertussis
ccuccgcauggacg

SEQ ID NO: 2358360 - RNA, 17 nt, Bordetella pertussis
ccuccgcguugcgcugc

SEQ ID NO: 2358361 - RNA, 19 nt, Bordetella pertussis
ccuccgcguugcgcugccc

SEQ ID NO: 2358362 - RNA, 13 nt, Bordetella pertussis
ccuccggcgccag

SEQ ID NO: 2358363 - RNA, 22 nt, Bordetella pertussis
ccuccggcgccagcaugcgcgc

SEQ ID NO: 2358364 - RNA, 23 nt, Bordetella pertussis
ccuccggcucuaccaacccugcc

SEQ ID NO: 2358365 - RNA, 15 nt, Bordetella pertussis
ccuccgggucgcggc

SEQ ID NO: 2358366 - RNA, 16 nt, Bordetella pertussis
ccuccgggucgcggca

SEQ ID NO: 2358367 - RNA, 14 nt, Bordetella pertussis
ccuccguccaugcg

SEQ ID NO: 2358368 - RNA, 18 nt, Bordetella pertussis
ccuccucgcuuuaccagc

SEQ ID NO: 2358369 - RNA, 14 nt, Bordetella pertussis
ccuccucggccagg

SEQ ID NO: 2358370 - RNA, 22 nt, Bordetella pertussis
ccuccucggccaggucgcgcau

SEQ ID NO: 2358371 - RNA, 11 nt, Bordetella pertussis
ccuccugcagc

SEQ ID NO: 2358372 - RNA, 12 nt, Bordetella pertussis
ccuccugccggc

SEQ ID NO: 2358373 - RNA, 23 nt, Bordetella pertussis
ccucgaacaggccaucgccgccg

SEQ ID NO: 2358374 - RNA, 19 nt, Bordetella pertussis
ccucgaagaccucggcgcu

SEQ ID NO: 2358375 - RNA, 14 nt, Bordetella pertussis
ccucgaagaucucg

SEQ ID NO: 2358376 - RNA, 15 nt, Bordetella pertussis
ccucgaagaucucga

SEQ ID NO: 2358377 - RNA, 14 nt, Bordetella pertussis
ccucgaagcccggc

SEQ ID NO: 2358378 - RNA, 16 nt, Bordetella pertussis
ccucgaagcccggcag

SEQ ID NO: 2358379 - RNA, 19 nt, Bordetella pertussis
ccucgaagcggcucaggcg

SEQ ID NO: 2358380 - RNA, 13 nt, Bordetella pertussis
ccucgaccagccc

SEQ ID NO: 2358381 - RNA, 14 nt, Bordetella pertussis
ccucgaccagcccg

SEQ ID NO: 2358382 - RNA, 15 nt, Bordetella pertussis
ccucgaccagcccgg

SEQ ID NO: 2358383 - RNA, 19 nt, Bordetella pertussis
ccucgaccagcccggccgc

SEQ ID NO: 2358384 - RNA, 20 nt, Bordetella pertussis
ccucgaccagcccggccgcc

SEQ ID NO: 2358385 - RNA, 21 nt, Bordetella pertussis
ccucgaccagcccggccgcca

SEQ ID NO: 2358386 - RNA, 22 nt, Bordetella pertussis
ccucgaccagcccggccgccag

SEQ ID NO: 2358387 - RNA, 16 nt, Bordetella pertussis
ccucgaccagcgcgcg

SEQ ID NO: 2358388 - RNA, 21 nt, Bordetella pertussis
ccucgacgaugcccugcgcca

SEQ ID NO: 2358389 - RNA, 22 nt, Bordetella pertussis
ccucgacgaugcccugcgccag

SEQ ID NO: 2358390 - RNA, 23 nt, Bordetella pertussis
ccucgacgaugcccugcgccagc

SEQ ID NO: 2358391 - RNA, 24 nt, Bordetella pertussis
ccucgacgaugcccugcgccagcg

SEQ ID NO: 2358392 - RNA, 16 nt, Bordetella pertussis
ccucgacgcagccuuc

SEQ ID NO: 2358393 - RNA, 19 nt, Bordetella pertussis
ccucgacgcccgggcggcu

SEQ ID NO: 2358394 - RNA, 13 nt, Bordetella pertussis
ccucgacgcgcau

SEQ ID NO: 2358395 - RNA, 23 nt, Bordetella pertussis
ccucgacgcuguagaggcgcggc

SEQ ID NO: 2358396 - RNA, 24 nt, Bordetella pertussis
ccucgacgcuguagaggcgcggcu

SEQ ID NO: 2358397 - RNA, 15 nt, Bordetella pertussis
ccucgacggccgccg

SEQ ID NO: 2358398 - RNA, 21 nt, Bordetella pertussis
ccucgacguaagugcccaggc

SEQ ID NO: 2358399 - RNA, 14 nt, Bordetella pertussis
ccucgacgucgccc

SEQ ID NO: 2358400 - RNA, 16 nt, Bordetella pertussis
ccucgagcaccuugac

SEQ ID NO: 2358401 - RNA, 19 nt, Bordetella pertussis
ccucgagguauucgcgcga

SEQ ID NO: 2358402 - RNA, 20 nt, Bordetella pertussis
ccucgagguauucgcgcgau

SEQ ID NO: 2358403 - RNA, 19 nt, Bordetella pertussis
ccucgaucaccaccggcaa

SEQ ID NO: 2358404 - RNA, 24 nt, Bordetella pertussis
ccucgaucagcgaaugcgacagcg

SEQ ID NO: 2358405 - RNA, 18 nt, Bordetella pertussis
ccucgaucgcguucgugg

SEQ ID NO: 2358406 - RNA, 18 nt, Bordetella pertussis
ccucgauggcgguggugg

SEQ ID NO: 2358407 - RNA, 18 nt, Bordetella pertussis
ccucgauugaccagcacc

SEQ ID NO: 2358408 - RNA, 16 nt, Bordetella pertussis
ccucgauuuccgaggc

SEQ ID NO: 2358409 - RNA, 16 nt, Bordetella pertussis
ccucgcaagcggccau

SEQ ID NO: 2358410 - RNA, 17 nt, Bordetella pertussis
ccucgcaagcggccaug

SEQ ID NO: 2358411 - RNA, 16 nt, Bordetella pertussis
ccucgcaucggccugc

SEQ ID NO: 2358412 - RNA, 14 nt, Bordetella pertussis
ccucgccagcggca

SEQ ID NO: 2358413 - RNA, 17 nt, Bordetella pertussis
ccucgccagcggcagcg

SEQ ID NO: 2358414 - RNA, 18 nt, Bordetella pertussis
ccucgccagcggcagcgc

SEQ ID NO: 2358415 - RNA, 12 nt, Bordetella pertussis
ccucgcccagcg

SEQ ID NO: 2358416 - RNA, 21 nt, Bordetella pertussis
ccucgcccagcgagccggcca

SEQ ID NO: 2358417 - RNA, 22 nt, Bordetella pertussis
ccucgcccagcgagccggccag

SEQ ID NO: 2358418 - RNA, 23 nt, Bordetella pertussis
ccucgcccagcgagccggccagc

SEQ ID NO: 2358419 - RNA, 18 nt, Bordetella pertussis
ccucgcccagcggcgccg

SEQ ID NO: 2358420 - RNA, 19 nt, Bordetella pertussis
ccucgcccgaucggccggc

SEQ ID NO: 2358421 - RNA, 21 nt, Bordetella pertussis
ccucgcccgaucggccggccg

SEQ ID NO: 2358422 - RNA, 15 nt, Bordetella pertussis
ccucgccgcccagcc

SEQ ID NO: 2358423 - RNA, 14 nt, Bordetella pertussis
ccucgccgcgccag

SEQ ID NO: 2358424 - RNA, 16 nt, Bordetella pertussis
ccucgccgcgccagcu

SEQ ID NO: 2358425 - RNA, 16 nt, Bordetella pertussis
ccucgccggcccugcc

SEQ ID NO: 2358426 - RNA, 19 nt, Bordetella pertussis
ccucgccggccuggcgcgc

SEQ ID NO: 2358427 - RNA, 19 nt, Bordetella pertussis
ccucgcgaaagcacgccau

SEQ ID NO: 2358428 - RNA, 18 nt, Bordetella pertussis
ccucgcgacggccucccg

SEQ ID NO: 2358429 - RNA, 19 nt, Bordetella pertussis
ccucgcgacggccucccgc

SEQ ID NO: 2358430 - RNA, 19 nt, Bordetella pertussis
ccucgcgcacggugcgcac

SEQ ID NO: 2358431 - RNA, 15 nt, Bordetella pertussis
ccucgcgcagggcgg

SEQ ID NO: 2358432 - RNA, 13 nt, Bordetella pertussis
ccucgcgccacca

SEQ ID NO: 2358433 - RNA, 13 nt, Bordetella pertussis
ccucgcgcgcgau

SEQ ID NO: 2358434 - RNA, 21 nt, Bordetella pertussis
ccucgcgcgcgaugcgcaggc

SEQ ID NO: 2358435 - RNA, 15 nt, Bordetella pertussis
ccucgcgcgcggacu

SEQ ID NO: 2358436 - RNA, 18 nt, Bordetella pertussis
ccucgcgcuccagcaugu

SEQ ID NO: 2358437 - RNA, 17 nt, Bordetella pertussis
ccucgcgcucgagcgcg

SEQ ID NO: 2358438 - RNA, 14 nt, Bordetella pertussis
ccucgcgcugcagc

SEQ ID NO: 2358439 - RNA, 16 nt, Bordetella pertussis
ccucgcgcugcagcau

SEQ ID NO: 2358440 - RNA, 18 nt, Bordetella pertussis
ccucgcggcgcagcauga

SEQ ID NO: 2358441 - RNA, 20 nt, Bordetella pertussis
ccucgcggcgcagcaugagc

SEQ ID NO: 2358442 - RNA, 23 nt, Bordetella pertussis
ccucgcguagugguaugaccggc

SEQ ID NO: 2358443 - RNA, 15 nt, Bordetella pertussis
ccucgcugccagggu

SEQ ID NO: 2358444 - RNA, 13 nt, Bordetella pertussis
ccucgcugccggc

SEQ ID NO: 2358445 - RNA, 20 nt, Bordetella pertussis
ccucgcugccggcgcccuug

SEQ ID NO: 2358446 - RNA, 13 nt, Bordetella pertussis
ccucgcugcgggc

SEQ ID NO: 2358447 - RNA, 14 nt, Bordetella pertussis
ccucgcugcgggcg

SEQ ID NO: 2358448 - RNA, 15 nt, Bordetella pertussis
ccucgcugcgggcgg

SEQ ID NO: 2358449 - RNA, 16 nt, Bordetella pertussis
ccucgcugcgggcggc

SEQ ID NO: 2358450 - RNA, 19 nt, Bordetella pertussis
ccucgcuggagaccggcau

SEQ ID NO: 2358451 - RNA, 18 nt, Bordetella pertussis
ccucggacgagacaggcg

SEQ ID NO: 2358452 - RNA, 23 nt, Bordetella pertussis
ccugcacgaagcggaugcgccgc

SEQ ID NO: 2358453 - RNA, 13 nt, Bordetella pertussis
ccugcacgcgcgc

SEQ ID NO: 2358454 - RNA, 15 nt, Bordetella pertussis
ccugcacgcgggcca

SEQ ID NO: 2358455 - RNA, 16 nt, Bordetella pertussis
ccugcacgcgggcgcu

SEQ ID NO: 2358456 - RNA, 16 nt, Bordetella pertussis
ccugcacgcucuugag

SEQ ID NO: 2358457 - RNA, 20 nt, Bordetella pertussis
ccugcacggugggcagcagc

SEQ ID NO: 2358458 - RNA, 14 nt, Bordetella pertussis
ccugcacgucccag

SEQ ID NO: 2358459 - RNA, 15 nt, Bordetella pertussis
ccugcacgucccagu

SEQ ID NO: 2358460 - RNA, 22 nt, Bordetella pertussis
ccugcacgucccagucgccgcg

SEQ ID NO: 2358461 - RNA, 23 nt, Bordetella pertussis
ccugcacgucccagucgccgcgc

SEQ ID NO: 2358462 - RNA, 19 nt, Bordetella pertussis
ccugcagaccagcaccggc

SEQ ID NO: 2358463 - RNA, 16 nt, Bordetella pertussis
ccugcagcacggccac

SEQ ID NO: 2358464 - RNA, 17 nt, Bordetella pertussis
ccugcagcagcguggcc

SEQ ID NO: 2358465 - RNA, 21 nt, Bordetella pertussis
ccugcagcagcguggccgcca

SEQ ID NO: 2358466 - RNA, 22 nt, Bordetella pertussis
ccugcagcagcguggccgccac

SEQ ID NO: 2358467 - RNA, 13 nt, Bordetella pertussis
ccugcagcaggcg

SEQ ID NO: 2358468 - RNA, 19 nt, Bordetella pertussis
ccugcagcaggucggucgc

SEQ ID NO: 2358469 - RNA, 12 nt, Bordetella pertussis
ccugcagcauga

SEQ ID NO: 2358470 - RNA, 13 nt, Bordetella pertussis
ccugcagcgccgc

SEQ ID NO: 2358471 - RNA, 14 nt, Bordetella pertussis
ccugcagcgccgcc

SEQ ID NO: 2358472 - RNA, 16 nt, Bordetella pertussis
ccugcagcgccgccug

SEQ ID NO: 2358473 - RNA, 19 nt, Bordetella pertussis
ccugcagcggccaguccac

SEQ ID NO: 2358474 - RNA, 22 nt, Bordetella pertussis
ccugcaggaaauacucgagccg

SEQ ID NO: 2358475 - RNA, 23 nt, Bordetella pertussis
ccugcaggaacucgcacacgcgc

SEQ ID NO: 2358476 - RNA, 19 nt, Bordetella pertussis
ccugcaggaaggccgccgc

SEQ ID NO: 2358477 - RNA, 20 nt, Bordetella pertussis
ccugcaggaaggccgccgcg

SEQ ID NO: 2358478 - RNA, 14 nt, Bordetella pertussis
ccugcaggcccacc

SEQ ID NO: 2358479 - RNA, 20 nt, Bordetella pertussis
ccugcaggcccaccggcaug

SEQ ID NO: 2358480 - RNA, 15 nt, Bordetella pertussis
ccugcaggcccagca

SEQ ID NO: 2358481 - RNA, 17 nt, Bordetella pertussis
ccugcaggcccagcacg

SEQ ID NO: 2358482 - RNA, 23 nt, Bordetella pertussis
ccugcaggcccagcacgcgcgcc

SEQ ID NO: 2358483 - RNA, 12 nt, Bordetella pertussis
ccugcaggcccg

SEQ ID NO: 2358484 - RNA, 14 nt, Bordetella pertussis
ccugcaggcccggc

SEQ ID NO: 2358485 - RNA, 14 nt, Bordetella pertussis
ccugcaggccgccg

SEQ ID NO: 2358486 - RNA, 15 nt, Bordetella pertussis
ccugcaggccgccgg

SEQ ID NO: 2358487 - RNA, 18 nt, Bordetella pertussis
ccugcaggccgccggcca

SEQ ID NO: 2358488 - RNA, 20 nt, Bordetella pertussis
ccugcaggccgccggccagc

SEQ ID NO: 2358489 - RNA, 12 nt, Bordetella pertussis
ccugcaggccgg

SEQ ID NO: 2358490 - RNA, 13 nt, Bordetella pertussis
ccugcaggcggcg

SEQ ID NO: 2358491 - RNA, 14 nt, Bordetella pertussis
ccugcaggcggcgc

SEQ ID NO: 2358492 - RNA, 15 nt, Bordetella pertussis
ccugcaggcucuuga

SEQ ID NO: 2358493 - RNA, 11 nt, Bordetella pertussis
ccugcagggca

SEQ ID NO: 2358494 - RNA, 12 nt, Bordetella pertussis
ccugcagggcau

SEQ ID NO: 2358495 - RNA, 22 nt, Bordetella pertussis
ccugcagggcgucugcucgccg

SEQ ID NO: 2358496 - RNA, 16 nt, Bordetella pertussis
ccugcagggucagccc

SEQ ID NO: 2358497 - RNA, 20 nt, Bordetella pertussis
ccugcagggucagcccgcca

SEQ ID NO: 2358498 - RNA, 23 nt, Bordetella pertussis
ccugcagggucagcccgccaucg

SEQ ID NO: 2358499 - RNA, 20 nt, Bordetella pertussis
ccugcaggugccgccggcgc

SEQ ID NO: 2358500 - RNA, 21 nt, Bordetella pertussis
ccugcaggugccgccggcgcg

SEQ ID NO: 2358501 - RNA, 15 nt, Bordetella pertussis
ccugcaguucggccg

SEQ ID NO: 2358502 - RNA, 16 nt, Bordetella pertussis
ccugcaguucggccgc

SEQ ID NO: 2358503 - RNA, 17 nt, Bordetella pertussis
ccugcaguucggccgcc

SEQ ID NO: 2358504 - RNA, 24 nt, Bordetella pertussis
ccugcaguucggccgccaggucgg

SEQ ID NO: 2358505 - RNA, 23 nt, Bordetella pertussis
ccugcaucacgguaggcgcgucg

SEQ ID NO: 2358506 - RNA, 15 nt, Bordetella pertussis
ccugcauccggccca

SEQ ID NO: 2358507 - RNA, 18 nt, Bordetella pertussis
ccugcaugaccgccgcca

SEQ ID NO: 2358508 - RNA, 12 nt, Bordetella pertussis
ccugcaugccau

SEQ ID NO: 2358509 - RNA, 20 nt, Bordetella pertussis
ccugcauguccagcggcgua

SEQ ID NO: 2358510 - RNA, 19 nt, Bordetella pertussis
ccugcaugucguacaggcc

SEQ ID NO: 2358511 - RNA, 22 nt, Bordetella pertussis
ccugccaaagacaaugccccgc

SEQ ID NO: 2358512 - RNA, 18 nt, Bordetella pertussis
ccugccaagcgccgcggc

SEQ ID NO: 2358513 - RNA, 20 nt, Bordetella pertussis
ccugccaagcgccgcggcca

SEQ ID NO: 2358514 - RNA, 20 nt, Bordetella pertussis
ccugccaauagcgguggcgg

SEQ ID NO: 2358515 - RNA, 16 nt, Bordetella pertussis
ccugccaccagcgcgc

SEQ ID NO: 2358516 - RNA, 19 nt, Bordetella pertussis
ccugccaccagcgcgccag

SEQ ID NO: 2358517 - RNA, 15 nt, Bordetella pertussis
ccugccaccgacaag

SEQ ID NO: 2358518 - RNA, 18 nt, Bordetella pertussis
ccugccagaacagccgcg

SEQ ID NO: 2358519 - RNA, 20 nt, Bordetella pertussis
ccugccagaacagccgcgag

SEQ ID NO: 2358520 - RNA, 14 nt, Bordetella pertussis
ccugccagcccacc

SEQ ID NO: 2358521 - RNA, 17 nt, Bordetella pertussis
ccugccagcccaccagc

SEQ ID NO: 2358522 - RNA, 15 nt, Bordetella pertussis
ccugccagccugcca

SEQ ID NO: 2358523 - RNA, 20 nt, Bordetella pertussis
ccugccagccugccacaucg

SEQ ID NO: 2358524 - RNA, 14 nt, Bordetella pertussis
ccugccaggcgccg

SEQ ID NO: 2358525 - RNA, 15 nt, Bordetella pertussis
ccugccaggcgccgc

SEQ ID NO: 2358526 - RNA, 16 nt, Bordetella pertussis
ccugccaggcgccgcg

SEQ ID NO: 2358527 - RNA, 12 nt, Bordetella pertussis
ccugccaguucg

SEQ ID NO: 2358528 - RNA, 17 nt, Bordetella pertussis
ccugccaguucgaugcg

SEQ ID NO: 2358529 - RNA, 20 nt, Bordetella pertussis
ccugccaguucgaugcgcuu

SEQ ID NO: 2358530 - RNA, 17 nt, Bordetella pertussis
ccugccaguugccgccg

SEQ ID NO: 2358531 - RNA, 18 nt, Bordetella pertussis
ccugccaguugccgccgc

SEQ ID NO: 2358532 - RNA, 20 nt, Bordetella pertussis
ccugccaguugccgccgccg

SEQ ID NO: 2358533 - RNA, 21 nt, Bordetella pertussis
ccugccaguugccgccgccgg

SEQ ID NO: 2358534 - RNA, 18 nt, Bordetella pertussis
ccugccauccggccgcac

SEQ ID NO: 2358535 - RNA, 19 nt, Bordetella pertussis
ccugccaugccccauccag

SEQ ID NO: 2358536 - RNA, 16 nt, Bordetella pertussis
ccugccauucggacac

SEQ ID NO: 2358537 - RNA, 16 nt, Bordetella pertussis
ccugccauugcgcggc

SEQ ID NO: 2358538 - RNA, 15 nt, Bordetella pertussis
ccugcccaccgccgc

SEQ ID NO: 2358539 - RNA, 19 nt, Bordetella pertussis
ccugcccauucccgcccug

SEQ ID NO: 2358540 - RNA, 19 nt, Bordetella pertussis
ccugccccaucccauccgc

SEQ ID NO: 2358541 - RNA, 18 nt, Bordetella pertussis
ccugccccugcggggaca

SEQ ID NO: 2358542 - RNA, 17 nt, Bordetella pertussis
ccugcccgagaccgccc

SEQ ID NO: 2358543 - RNA, 15 nt, Bordetella pertussis
ccugcccgcaacgcc

SEQ ID NO: 2358544 - RNA, 24 nt, Bordetella pertussis
ccugcccgcaacgccgcccguccg

SEQ ID NO: 2358545 - RNA, 14 nt, Bordetella pertussis
ccugcccgccuggu

SEQ ID NO: 2358546 - RNA, 13 nt, Bordetella pertussis
ccugcccggcagg

SEQ ID NO: 2358547 - RNA, 14 nt, Bordetella pertussis
ccugcccggcaggg

SEQ ID NO: 2358548 - RNA, 15 nt, Bordetella pertussis
ccugcccggcagggu

SEQ ID NO: 2358549 - RNA, 14 nt, Bordetella pertussis
ccugcccggcgagc

SEQ ID NO: 2358550 - RNA, 19 nt, Bordetella pertussis
ccugcccgggcaccagguc

SEQ ID NO: 2358551 - RNA, 20 nt, Bordetella pertussis
ccugcccgggcaccaggucc

SEQ ID NO: 2358552 - RNA, 16 nt, Bordetella pertussis
ccugcccgggcagcac

SEQ ID NO: 2358553 - RNA, 13 nt, Bordetella pertussis
ccugcccgggcgg

SEQ ID NO: 2358554 - RNA, 17 nt, Bordetella pertussis
ccugcccguucacgcgc

SEQ ID NO: 2358555 - RNA, 20 nt, Bordetella pertussis
ccugcccguucacgcgcagc

SEQ ID NO: 2358556 - RNA, 15 nt, Bordetella pertussis
ccugcccucgggcga

SEQ ID NO: 2358557 - RNA, 16 nt, Bordetella pertussis
ccugcccugcggcuug

SEQ ID NO: 2358558 - RNA, 23 nt, Bordetella pertussis
ccugccgaucaagagccuggagc

SEQ ID NO: 2358559 - RNA, 22 nt, Bordetella pertussis
ccugccgaucgugcacgcccgc

SEQ ID NO: 2358560 - RNA, 21 nt, Bordetella pertussis
ccugccgcaucccgcccccgc

SEQ ID NO: 2358561 - RNA, 17 nt, Bordetella pertussis
ccugccgccaagggcgc

SEQ ID NO: 2358562 - RNA, 17 nt, Bordetella pertussis
ccugccgcccgagcugg

SEQ ID NO: 2358563 - RNA, 19 nt, Bordetella pertussis
ccugccgcccgagcuggcc

SEQ ID NO: 2358564 - RNA, 14 nt, Bordetella pertussis
ccugccgcgcccgg

SEQ ID NO: 2358565 - RNA, 17 nt, Bordetella pertussis
ccugcggggacaggcac

SEQ ID NO: 2358566 - RNA, 22 nt, Bordetella pertussis
ccugcggggacaggcacccugc

SEQ ID NO: 2358567 - RNA, 17 nt, Bordetella pertussis
ccugcgggggcaggcac

SEQ ID NO: 2358568 - RNA, 17 nt, Bordetella pertussis
ccugcggggucugcagg

SEQ ID NO: 2358569 - RNA, 20 nt, Bordetella pertussis
ccugcgggugcgccugcagc

SEQ ID NO: 2358570 - RNA, 23 nt, Bordetella pertussis
ccugcgggugcgccugcagcgcc

SEQ ID NO: 2358571 - RNA, 24 nt, Bordetella pertussis
ccugcgggugcgccugcagcgccg

SEQ ID NO: 2358572 - RNA, 14 nt, Bordetella pertussis
ccugcguccagccg

SEQ ID NO: 2358573 - RNA, 17 nt, Bordetella pertussis
ccugcgucugcgugccg

SEQ ID NO: 2358574 - RNA, 15 nt, Bordetella pertussis
ccugcgugauggcgu

SEQ ID NO: 2358575 - RNA, 14 nt, Bordetella pertussis
ccugcguggccgcg

SEQ ID NO: 2358576 - RNA, 15 nt, Bordetella pertussis
ccugcguggccgcgu

SEQ ID NO: 2358577 - RNA, 14 nt, Bordetella pertussis
ccugcguggcgcag

SEQ ID NO: 2358578 - RNA, 18 nt, Bordetella pertussis
ccugcguggcgggccgcg

SEQ ID NO: 2358579 - RNA, 19 nt, Bordetella pertussis
ccugcguggcgggccgcgc

SEQ ID NO: 2358580 - RNA, 23 nt, Bordetella pertussis
ccugcguggcgggccgcgccgcg

SEQ ID NO: 2358581 - RNA, 16 nt, Bordetella pertussis
ccugcgugucaggcgg

SEQ ID NO: 2358582 - RNA, 20 nt, Bordetella pertussis
ccugcguugcgaucagcgcu

SEQ ID NO: 2358583 - RNA, 19 nt, Bordetella pertussis
ccugcuaagggaguaugug

SEQ ID NO: 2358584 - RNA, 21 nt, Bordetella pertussis
ccugcuaguacaccgucgcgc

SEQ ID NO: 2358585 - RNA, 15 nt, Bordetella pertussis
ccugcucacgccccg

SEQ ID NO: 2358586 - RNA, 16 nt, Bordetella pertussis
ccugcucacgccccgc

SEQ ID NO: 2358587 - RNA, 18 nt, Bordetella pertussis
ccugcucacgccccgccc

SEQ ID NO: 2358588 - RNA, 21 nt, Bordetella pertussis
ccugcucccacgaacgccacg

SEQ ID NO: 2358589 - RNA, 17 nt, Bordetella pertussis
ccugcucgauccgggca

SEQ ID NO: 2358590 - RNA, 24 nt, Bordetella pertussis
ccugcucgaucugguuggccacau

SEQ ID NO: 2358591 - RNA, 16 nt, Bordetella pertussis
ccugcucgcaggccug

SEQ ID NO: 2358592 - RNA, 15 nt, Bordetella pertussis
ccugcucgcgcagcg

SEQ ID NO: 2358593 - RNA, 21 nt, Bordetella pertussis
ccugcucggugagcggcacga

SEQ ID NO: 2358594 - RNA, 14 nt, Bordetella pertussis
ccugcucguacagc

SEQ ID NO: 2358595 - RNA, 20 nt, Bordetella pertussis
ccugcugcaauucgccgaug

SEQ ID NO: 2358596 - RNA, 15 nt, Bordetella pertussis
ccugcugcagcacac

SEQ ID NO: 2358597 - RNA, 13 nt, Bordetella pertussis
ccugcugcagcgu

SEQ ID NO: 2358598 - RNA, 14 nt, Bordetella pertussis
ccugcugcagcgug

SEQ ID NO: 2358599 - RNA, 15 nt, Bordetella pertussis
ccugcugcagcguga

SEQ ID NO: 2358600 - RNA, 12 nt, Bordetella pertussis
ccugcugcccgc

SEQ ID NO: 2358601 - RNA, 19 nt, Bordetella pertussis
ccugcugcgccuggccgcg

SEQ ID NO: 2358602 - RNA, 17 nt, Bordetella pertussis
ccugcugcgccuggcgg

SEQ ID NO: 2358603 - RNA, 16 nt, Bordetella pertussis
ccugcugcggcacggc

SEQ ID NO: 2358604 - RNA, 17 nt, Bordetella pertussis
ccugcugcggcacggcc

SEQ ID NO: 2358605 - RNA, 18 nt, Bordetella pertussis
ccugcugcggcacggcca

SEQ ID NO: 2358606 - RNA, 15 nt, Bordetella pertussis
ccugcugcugcagcc

SEQ ID NO: 2358607 - RNA, 21 nt, Bordetella pertussis
ccugcugcuugaccuuggcuu

SEQ ID NO: 2358608 - RNA, 14 nt, Bordetella pertussis
ccugcuggccgccg

SEQ ID NO: 2358609 - RNA, 16 nt, Bordetella pertussis
ccugcuggccgccggc

SEQ ID NO: 2358610 - RNA, 18 nt, Bordetella pertussis
ccugcuggccgccggcgc

SEQ ID NO: 2358611 - RNA, 13 nt, Bordetella pertussis
ccugcuggcgcag

SEQ ID NO: 2358612 - RNA, 17 nt, Bordetella pertussis
ccugcuggcgcgcacca

SEQ ID NO: 2358613 - RNA, 16 nt, Bordetella pertussis
ccugcuggcgcgucgg

SEQ ID NO: 2358614 - RNA, 22 nt, Bordetella pertussis
ccugcuggcgcgucggcgcgcg

SEQ ID NO: 2358615 - RNA, 21 nt, Bordetella pertussis
ccugcuggcguuugcgcgcgc

SEQ ID NO: 2358616 - RNA, 21 nt, Bordetella pertussis
ccugcugggguggagcgcggc

SEQ ID NO: 2358617 - RNA, 14 nt, Bordetella pertussis
ccugcuggucggcc

SEQ ID NO: 2358618 - RNA, 17 nt, Bordetella pertussis
ccugcuggucggccucg

SEQ ID NO: 2358619 - RNA, 16 nt, Bordetella pertussis
ccugcuggucggcgug

SEQ ID NO: 2358620 - RNA, 13 nt, Bordetella pertussis
ccugcugguggcg

SEQ ID NO: 2358621 - RNA, 14 nt, Bordetella pertussis
ccugcugucgcugg

SEQ ID NO: 2358622 - RNA, 15 nt, Bordetella pertussis
ccugcugucgcuggg

SEQ ID NO: 2358623 - RNA, 22 nt, Bordetella pertussis
ccugcugugccccacacgcgcg

SEQ ID NO: 2358624 - RNA, 21 nt, Bordetella pertussis
ccugcugugcgauggcacggc

SEQ ID NO: 2358625 - RNA, 17 nt, Bordetella pertussis
ccugcuguucaccuuca

SEQ ID NO: 2358626 - RNA, 21 nt, Bordetella pertussis
ccugcuguucaccuucaacau

SEQ ID NO: 2358627 - RNA, 14 nt, Bordetella pertussis
ccugcuugaagacg

SEQ ID NO: 2358628 - RNA, 20 nt, Bordetella pertussis
ccugcuugaagacgcccagg

SEQ ID NO: 2358629 - RNA, 13 nt, Bordetella pertussis
ccugcuugcagga

SEQ ID NO: 2358630 - RNA, 15 nt, Bordetella pertussis
ccugcuugcccagca

SEQ ID NO: 2358631 - RNA, 14 nt, Bordetella pertussis
ccugcuuggcagcc

SEQ ID NO: 2358632 - RNA, 14 nt, Bordetella pertussis
ccugcuuggccgcg

SEQ ID NO: 2358633 - RNA, 18 nt, Bordetella pertussis
ccugcuuguacaggcgcg

SEQ ID NO: 2358634 - RNA, 21 nt, Bordetella pertussis
ccugcuuguacaggcgcggca

SEQ ID NO: 2358635 - RNA, 16 nt, Bordetella pertussis
ccugcuuugagcaggc

SEQ ID NO: 2358636 - RNA, 20 nt, Bordetella pertussis
ccuggaacuugggaucggcc

SEQ ID NO: 2358637 - RNA, 19 nt, Bordetella pertussis
ccuggaagugaugccgccg

SEQ ID NO: 2358638 - RNA, 14 nt, Bordetella pertussis
ccuggaccggcucc

SEQ ID NO: 2358639 - RNA, 16 nt, Bordetella pertussis
ccuggacgagggccgc

SEQ ID NO: 2358640 - RNA, 20 nt, Bordetella pertussis
ccuggacgcgcuggccgaca

SEQ ID NO: 2358641 - RNA, 17 nt, Bordetella pertussis
ccuggagaucgccgccg

SEQ ID NO: 2358642 - RNA, 17 nt, Bordetella pertussis
ccuggagcucggguggg

SEQ ID NO: 2358643 - RNA, 16 nt, Bordetella pertussis
ccuggaggccgagcgc

SEQ ID NO: 2358644 - RNA, 16 nt, Bordetella pertussis
ccuggaugccaugccg

SEQ ID NO: 2358645 - RNA, 17 nt, Bordetella pertussis
ccuggauggcggccgcc

SEQ ID NO: 2358646 - RNA, 16 nt, Bordetella pertussis
ccuggaugugcgcggg

SEQ ID NO: 2358647 - RNA, 18 nt, Bordetella pertussis
ccuggcaaggggguucgc

SEQ ID NO: 2358648 - RNA, 17 nt, Bordetella pertussis
ccuggcaaugcguggcc

SEQ ID NO: 2358649 - RNA, 14 nt, Bordetella pertussis
ccuggcacgcugga

SEQ ID NO: 2358650 - RNA, 13 nt, Bordetella pertussis
ccuggcagcuggc

SEQ ID NO: 2358651 - RNA, 23 nt, Bordetella pertussis
ccuggcagcuggcgcgggcggcc

SEQ ID NO: 2358652 - RNA, 13 nt, Bordetella pertussis
ccuggcaggccgc

SEQ ID NO: 2358653 - RNA, 17 nt, Bordetella pertussis
ccuggcagucagccguu

SEQ ID NO: 2358654 - RNA, 16 nt, Bordetella pertussis
ccuggcauugagcacu

SEQ ID NO: 2358655 - RNA, 23 nt, Bordetella pertussis
ccuggccaccaacgaaggcaucc

SEQ ID NO: 2358656 - RNA, 16 nt, Bordetella pertussis
ccuggccacgcugcug

SEQ ID NO: 2358657 - RNA, 21 nt, Bordetella pertussis
ccuggcccacaucgucgcgcu

SEQ ID NO: 2358658 - RNA, 24 nt, Bordetella pertussis
ccuggcccacaucgucgcgcuggg

SEQ ID NO: 2358659 - RNA, 19 nt, Bordetella pertussis
ccuggcccagaucugccgc

SEQ ID NO: 2358660 - RNA, 18 nt, Bordetella pertussis
ccuggcccagcgcauaga

SEQ ID NO: 2358661 - RNA, 13 nt, Bordetella pertussis
ccuggcccagcuc

SEQ ID NO: 2358662 - RNA, 16 nt, Bordetella pertussis
ccuggccccaggcgcc

SEQ ID NO: 2358663 - RNA, 19 nt, Bordetella pertussis
ccuggccccaggcgcccga

SEQ ID NO: 2358664 - RNA, 20 nt, Bordetella pertussis
ccuggcccgaacggcccauc

SEQ ID NO: 2358665 - RNA, 13 nt, Bordetella pertussis
ccuggccgaacgc

SEQ ID NO: 2358666 - RNA, 19 nt, Bordetella pertussis
ccuggccgaacgccgccgc

SEQ ID NO: 2358667 - RNA, 23 nt, Bordetella pertussis
ccuggccgagcgcggcaugcgca

SEQ ID NO: 2358668 - RNA, 18 nt, Bordetella pertussis
ccuggccgauuucgcgcg

SEQ ID NO: 2358669 - RNA, 14 nt, Bordetella pertussis
ccuggccgcccagc

SEQ ID NO: 2358670 - RNA, 19 nt, Bordetella pertussis
ccuggccgccgcgggcgcc

SEQ ID NO: 2358671 - RNA, 21 nt, Bordetella pertussis
ccuggccgccgcgggcgccgc

SEQ ID NO: 2358672 - RNA, 15 nt, Bordetella pertussis
ccuggccgccggcgg

SEQ ID NO: 2358673 - RNA, 14 nt, Bordetella pertussis
ccuggccgcgccgu

SEQ ID NO: 2358674 - RNA, 13 nt, Bordetella pertussis
ccuggccgcgcgc

SEQ ID NO: 2358675 - RNA, 14 nt, Bordetella pertussis
ccuggccgcgcgcc

SEQ ID NO: 2358676 - RNA, 12 nt, Bordetella pertussis
ccuggccgcgcu

SEQ ID NO: 2358677 - RNA, 11 nt, Bordetella pertussis
ccuggccggcg

SEQ ID NO: 2358678 - RNA, 21 nt, Bordetella pertussis
ccuggucgaccaggccggugc

SEQ ID NO: 2358679 - RNA, 14 nt, Bordetella pertussis
ccuggucgacgccg

SEQ ID NO: 2358680 - RNA, 17 nt, Bordetella pertussis
ccuggucgagcgggcgc

SEQ ID NO: 2358681 - RNA, 15 nt, Bordetella pertussis
ccuggucgaucagcc

SEQ ID NO: 2358682 - RNA, 19 nt, Bordetella pertussis
ccuggucgaucagccccug

SEQ ID NO: 2358683 - RNA, 14 nt, Bordetella pertussis
ccuggucgaucgag

SEQ ID NO: 2358684 - RNA, 14 nt, Bordetella pertussis
ccuggucgcgcgcc

SEQ ID NO: 2358685 - RNA, 15 nt, Bordetella pertussis
ccuggucgcgcgccu

SEQ ID NO: 2358686 - RNA, 18 nt, Bordetella pertussis
ccuggucgcuggcgccgg

SEQ ID NO: 2358687 - RNA, 17 nt, Bordetella pertussis
ccuggucggcgcggcag

SEQ ID NO: 2358688 - RNA, 16 nt, Bordetella pertussis
ccuggucgucgcggcc

SEQ ID NO: 2358689 - RNA, 16 nt, Bordetella pertussis
ccuggucgucggccac

SEQ ID NO: 2358690 - RNA, 19 nt, Bordetella pertussis
ccuggucgucggccacgcc

SEQ ID NO: 2358691 - RNA, 20 nt, Bordetella pertussis
ccuggucgucggccacgccc

SEQ ID NO: 2358692 - RNA, 21 nt, Bordetella pertussis
ccuggugcaccacgcgcucca

SEQ ID NO: 2358693 - RNA, 15 nt, Bordetella pertussis
ccuggugcacgccga

SEQ ID NO: 2358694 - RNA, 13 nt, Bordetella pertussis
ccuggugcccgac

SEQ ID NO: 2358695 - RNA, 17 nt, Bordetella pertussis
ccuggugcccgacgccg

SEQ ID NO: 2358696 - RNA, 16 nt, Bordetella pertussis
ccugguggaccugccg

SEQ ID NO: 2358697 - RNA, 16 nt, Bordetella pertussis
ccugguguucggcacc

SEQ ID NO: 2358698 - RNA, 17 nt, Bordetella pertussis
ccugguucaggcgagcg

SEQ ID NO: 2358699 - RNA, 22 nt, Bordetella pertussis
ccugguucaggcgagcggcguc

SEQ ID NO: 2358700 - RNA, 19 nt, Bordetella pertussis
ccugguugaccgagcccgg

SEQ ID NO: 2358701 - RNA, 20 nt, Bordetella pertussis
ccugguugaccgagcccggc

SEQ ID NO: 2358702 - RNA, 22 nt, Bordetella pertussis
ccugguugaccgagcccggcac

SEQ ID NO: 2358703 - RNA, 19 nt, Bordetella pertussis
ccugguugccgaaggguug

SEQ ID NO: 2358704 - RNA, 14 nt, Bordetella pertussis
ccugguuggccgcc

SEQ ID NO: 2358705 - RNA, 23 nt, Bordetella pertussis
ccugguuggccucgcgcucgcgc

SEQ ID NO: 2358706 - RNA, 24 nt, Bordetella pertussis
ccugguuggccucgcgcucgcgcu

SEQ ID NO: 2358707 - RNA, 14 nt, Bordetella pertussis
ccuguaccagauga

SEQ ID NO: 2358708 - RNA, 14 nt, Bordetella pertussis
ccuguaugccguag

SEQ ID NO: 2358709 - RNA, 20 nt, Bordetella pertussis
ccuguaugccguaggcgccg

SEQ ID NO: 2358710 - RNA, 20 nt, Bordetella pertussis
ccuguccauauauauagggc

SEQ ID NO: 2358711 - RNA, 19 nt, Bordetella pertussis
ccugucccaaccgggacag

SEQ ID NO: 2358712 - RNA, 15 nt, Bordetella pertussis
ccugucccaauccgc

SEQ ID NO: 2358713 - RNA, 20 nt, Bordetella pertussis
ccugucccagcggggacagg

SEQ ID NO: 2358714 - RNA, 21 nt, Bordetella pertussis
ccuguccccacagggggucug

SEQ ID NO: 2358715 - RNA, 20 nt, Bordetella pertussis
ccuguccccacauggggacu

SEQ ID NO: 2358716 - RNA, 21 nt, Bordetella pertussis
ccuguccccacauggggacug

SEQ ID NO: 2358717 - RNA, 19 nt, Bordetella pertussis
ccuguccccaccgggacag

SEQ ID NO: 2358718 - RNA, 15 nt, Bordetella pertussis
ccuguccccacgggg

SEQ ID NO: 2358719 - RNA, 18 nt, Bordetella pertussis
ccuguccccacggggaca

SEQ ID NO: 2358720 - RNA, 19 nt, Bordetella pertussis
ccuguccccacggggacag

SEQ ID NO: 2358721 - RNA, 18 nt, Bordetella pertussis
ccuguccccacguggaca

SEQ ID NO: 2358722 - RNA, 16 nt, Bordetella pertussis
ccuguccccacugggg

SEQ ID NO: 2358723 - RNA, 20 nt, Bordetella pertussis
ccuguccccacugggggacu

SEQ ID NO: 2358724 - RNA, 24 nt, Bordetella pertussis
ccuguccccacugggggacuggca

SEQ ID NO: 2358725 - RNA, 24 nt, Bordetella pertussis
ccuguccccccauggggacuggca

SEQ ID NO: 2358726 - RNA, 12 nt, Bordetella pertussis
ccuguccccgaa

SEQ ID NO: 2358727 - RNA, 19 nt, Bordetella pertussis
ccuguccccgaaggggacu

SEQ ID NO: 2358728 - RNA, 17 nt, Bordetella pertussis
ccuguccccgcaagggg

SEQ ID NO: 2358729 - RNA, 21 nt, Bordetella pertussis
ccuguccccgcaagggggacu

SEQ ID NO: 2358730 - RNA, 21 nt, Bordetella pertussis
ccuguccccgcacggggacag

SEQ ID NO: 2358731 - RNA, 20 nt, Bordetella pertussis
ccuguccccgcacggggacu

SEQ ID NO: 2358732 - RNA, 14 nt, Bordetella pertussis
ccuguccccgcaug

SEQ ID NO: 2358733 - RNA, 20 nt, Bordetella pertussis
ccuguccccgcaugggggcu

SEQ ID NO: 2358734 - RNA, 21 nt, Bordetella pertussis
ccuguccccgcaugggggcug

SEQ ID NO: 2358735 - RNA, 19 nt, Bordetella pertussis
ccuguccccgccgggacag

SEQ ID NO: 2358736 - RNA, 18 nt, Bordetella pertussis
ccuguccccgcggggaca

SEQ ID NO: 2358737 - RNA, 19 nt, Bordetella pertussis
ccuguccccgcggggacug

SEQ ID NO: 2358738 - RNA, 15 nt, Bordetella pertussis
ccuguccccgcuggg

SEQ ID NO: 2358739 - RNA, 17 nt, Bordetella pertussis
ccuguccccgcugggac

SEQ ID NO: 2358740 - RNA, 19 nt, Bordetella pertussis
ccuguccccgcugggacag

SEQ ID NO: 2358741 - RNA, 13 nt, Bordetella pertussis
ccuguccccgucg

SEQ ID NO: 2358742 - RNA, 18 nt, Bordetella pertussis
ccuguccccgucgggaca

SEQ ID NO: 2358743 - RNA, 19 nt, Bordetella pertussis
ccuguccccgucgggacag

SEQ ID NO: 2358744 - RNA, 19 nt, Bordetella pertussis
ccuguccccguggggacag

SEQ ID NO: 2358745 - RNA, 18 nt, Bordetella pertussis
ccugucccgacggggaca

SEQ ID NO: 2358746 - RNA, 23 nt, Bordetella pertussis
ccugucccgcacgcagcccuucg

SEQ ID NO: 2358747 - RNA, 18 nt, Bordetella pertussis
ccugucccggcugggaca

SEQ ID NO: 2358748 - RNA, 13 nt, Bordetella pertussis
ccugucccugccg

SEQ ID NO: 2358749 - RNA, 18 nt, Bordetella pertussis
ccugucccugcggggacu

SEQ ID NO: 2358750 - RNA, 13 nt, Bordetella pertussis
ccugucgcgcugc

SEQ ID NO: 2358751 - RNA, 15 nt, Bordetella pertussis
ccugucgcgcugcuu

SEQ ID NO: 2358752 - RNA, 22 nt, Bordetella pertussis
ccugucggccgaaccgcgcagc

SEQ ID NO: 2358753 - RNA, 19 nt, Bordetella pertussis
ccugucggugaugauccug

SEQ ID NO: 2358754 - RNA, 15 nt, Bordetella pertussis
ccugugccagcuggc

SEQ ID NO: 2358755 - RNA, 13 nt, Bordetella pertussis
ccuguggcgcacc

SEQ ID NO: 2358756 - RNA, 15 nt, Bordetella pertussis
ccuguucccgccggg

SEQ ID NO: 2358757 - RNA, 18 nt, Bordetella pertussis
ccuguucccgccgggcca

SEQ ID NO: 2358758 - RNA, 18 nt, Bordetella pertussis
ccuguucgccaaucugcc

SEQ ID NO: 2358759 - RNA, 20 nt, Bordetella pertussis
ccuguucgccaaucugccgc

SEQ ID NO: 2358760 - RNA, 21 nt, Bordetella pertussis
ccuguucgcgcaauugcuucu

SEQ ID NO: 2358761 - RNA, 14 nt, Bordetella pertussis
ccuguucgcgcggc

SEQ ID NO: 2358762 - RNA, 22 nt, Bordetella pertussis
ccuguucgcggugucgcaccgc

SEQ ID NO: 2358763 - RNA, 14 nt, Bordetella pertussis
ccuguucggccacg

SEQ ID NO: 2358764 - RNA, 19 nt, Bordetella pertussis
ccuguucggccgggaccuu

SEQ ID NO: 2358765 - RNA, 13 nt, Bordetella pertussis
ccuuacgcggcgc

SEQ ID NO: 2358766 - RNA, 18 nt, Bordetella pertussis
ccuuacgcgguccgcagc

SEQ ID NO: 2358767 - RNA, 14 nt, Bordetella pertussis
ccuucaccggcccc

SEQ ID NO: 2358768 - RNA, 15 nt, Bordetella pertussis
ccuucaccggcccca

SEQ ID NO: 2358769 - RNA, 19 nt, Bordetella pertussis
ccuucacgacacgcccagc

SEQ ID NO: 2358770 - RNA, 14 nt, Bordetella pertussis
ccuucagcgggccg

SEQ ID NO: 2358771 - RNA, 13 nt, Bordetella pertussis
ccuucaugaucug

SEQ ID NO: 2358772 - RNA, 21 nt, Bordetella pertussis
ccuucaugaucuggccgacca

SEQ ID NO: 2358773 - RNA, 22 nt, Bordetella pertussis
ccuucaugaucuggccgaccag

SEQ ID NO: 2358774 - RNA, 23 nt, Bordetella pertussis
ccuucauggcgucguccagcuug

SEQ ID NO: 2358775 - RNA, 15 nt, Bordetella pertussis
ccuucauuuccuggu

SEQ ID NO: 2358776 - RNA, 20 nt, Bordetella pertussis
ccuucccgcuuuccgccgag

SEQ ID NO: 2358777 - RNA, 22 nt, Bordetella pertussis
ccuucccggccgaaaccgccgc

SEQ ID NO: 2358778 - RNA, 18 nt, Bordetella pertussis
ccuuccggcagcggccag

SEQ ID NO: 2358779 - RNA, 22 nt, Bordetella pertussis
ccuuccggcagcggccagcgcg

SEQ ID NO: 2358780 - RNA, 12 nt, Bordetella pertussis
ccuuccggcccc

SEQ ID NO: 2358781 - RNA, 13 nt, Bordetella pertussis
ccuuccugcugga

SEQ ID NO: 2358782 - RNA, 20 nt, Bordetella pertussis
ccuuccugcuggaccugcug

SEQ ID NO: 2358783 - RNA, 17 nt, Bordetella pertussis
ccuuccugggcgccggc

SEQ ID NO: 2358784 - RNA, 20 nt, Bordetella pertussis
ccuuccuugaccaccuugcc

SEQ ID NO: 2358785 - RNA, 17 nt, Bordetella pertussis
ccuucgacgcggcggcc

SEQ ID NO: 2358786 - RNA, 18 nt, Bordetella pertussis
ccuucgacgcggcggccg

SEQ ID NO: 2358787 - RNA, 18 nt, Bordetella pertussis
ccuucgacguccagcccg

SEQ ID NO: 2358788 - RNA, 17 nt, Bordetella pertussis
ccuucgagcaccaugcc

SEQ ID NO: 2358789 - RNA, 16 nt, Bordetella pertussis
ccuucgaggccggcgu

SEQ ID NO: 2358790 - RNA, 16 nt, Bordetella pertussis
ccuuggcguccggccc

SEQ ID NO: 2358791 - RNA, 15 nt, Bordetella pertussis
ccuuggcuucgguca

SEQ ID NO: 2358792 - RNA, 21 nt, Bordetella pertussis
ccuuggcuucggucacacugg

SEQ ID NO: 2358793 - RNA, 17 nt, Bordetella pertussis
ccuuggcuugcagcgcc

SEQ ID NO: 2358794 - RNA, 23 nt, Bordetella pertussis
ccuugggauuggcgaaaggcacc

SEQ ID NO: 2358795 - RNA, 19 nt, Bordetella pertussis
ccuugggcucgucgacgcg

SEQ ID NO: 2358796 - RNA, 21 nt, Bordetella pertussis
ccuugggcucgucgacgcggc

SEQ ID NO: 2358797 - RNA, 23 nt, Bordetella pertussis
ccuugggcucgucgacgcggccg

SEQ ID NO: 2358798 - RNA, 17 nt, Bordetella pertussis
ccuuggucgcgaccucg

SEQ ID NO: 2358799 - RNA, 19 nt, Bordetella pertussis
ccuuggucugcaggcucug

SEQ ID NO: 2358800 - RNA, 23 nt, Bordetella pertussis
ccuuggugggauccucgcugccg

SEQ ID NO: 2358801 - RNA, 22 nt, Bordetella pertussis
ccuuguacuggucgcgcagcug

SEQ ID NO: 2358802 - RNA, 18 nt, Bordetella pertussis
ccuugucgcgcagcgccg

SEQ ID NO: 2358803 - RNA, 21 nt, Bordetella pertussis
ccuugucgcgcagcgccgcca

SEQ ID NO: 2358804 - RNA, 15 nt, Bordetella pertussis
ccuugucgcgggcag

SEQ ID NO: 2358805 - RNA, 13 nt, Bordetella pertussis
ccuugugcgccag

SEQ ID NO: 2358806 - RNA, 17 nt, Bordetella pertussis
ccuugugcgccagcgcg

SEQ ID NO: 2358807 - RNA, 14 nt, Bordetella pertussis
ccuugugcgcgcca

SEQ ID NO: 2358808 - RNA, 17 nt, Bordetella pertussis
ccuugugcggcagguug

SEQ ID NO: 2358809 - RNA, 18 nt, Bordetella pertussis
ccuugugcguuggcgcgg

SEQ ID NO: 2358810 - RNA, 19 nt, Bordetella pertussis
ccuugugcguuggcgcggc

SEQ ID NO: 2358811 - RNA, 18 nt, Bordetella pertussis
ccuuguuggcgccggccg

SEQ ID NO: 2358812 - RNA, 22 nt, Bordetella pertussis
ccuuguuggcgccggccgcgcg

SEQ ID NO: 2358813 - RNA, 15 nt, Bordetella pertussis
ccuuuauugcuuuuc

SEQ ID NO: 2358814 - RNA, 20 nt, Bordetella pertussis
ccuuucaccggcaccagcca

SEQ ID NO: 2358815 - RNA, 22 nt, Bordetella pertussis
ccuuucauuucggcgccgcgcu

SEQ ID NO: 2358816 - RNA, 15 nt, Bordetella pertussis
ccuuucccgcgccga

SEQ ID NO: 2358817 - RNA, 15 nt, Bordetella pertussis
ccuuuccuccugccg

SEQ ID NO: 2358818 - RNA, 17 nt, Bordetella pertussis
cgaaaaacggcggaaau

SEQ ID NO: 2358819 - RNA, 15 nt, Bordetella pertussis
cgaaaacccgcggca

SEQ ID NO: 2358820 - RNA, 19 nt, Bordetella pertussis
cgaaaagcccgccgagucg

SEQ ID NO: 2358821 - RNA, 17 nt, Bordetella pertussis
cgaaacaggcgccgucg

SEQ ID NO: 2358822 - RNA, 19 nt, Bordetella pertussis
cgaaacauaagucugcgcc

SEQ ID NO: 2358823 - RNA, 20 nt, Bordetella pertussis
cgaaacauaagucugcgccu

SEQ ID NO: 2358824 - RNA, 17 nt, Bordetella pertussis
cgaaacccgcugggcca

SEQ ID NO: 2358825 - RNA, 20 nt, Bordetella pertussis
cgaaacccgcugggccagca

SEQ ID NO: 2358826 - RNA, 17 nt, Bordetella pertussis
cgaaacccgggccgucg

SEQ ID NO: 2358827 - RNA, 19 nt, Bordetella pertussis
cgaaacccucgugaucgac

SEQ ID NO: 2358828 - RNA, 12 nt, Bordetella pertussis
cgaaaccggcgc

SEQ ID NO: 2358829 - RNA, 21 nt, Bordetella pertussis
cgaaaccggcgcgcgcggcca

SEQ ID NO: 2358830 - RNA, 14 nt, Bordetella pertussis
cgaaacgcgcagca

SEQ ID NO: 2358831 - RNA, 15 nt, Bordetella pertussis
cgaaacgcgcagcac

SEQ ID NO: 2358832 - RNA, 17 nt, Bordetella pertussis
cgaaacgcgcagcaccg

SEQ ID NO: 2358833 - RNA, 13 nt, Bordetella pertussis
cgaaacgcgcguc

SEQ ID NO: 2358834 - RNA, 13 nt, Bordetella pertussis
cgaaacggccagc

SEQ ID NO: 2358835 - RNA, 16 nt, Bordetella pertussis
cgaaacggccgggucc

SEQ ID NO: 2358836 - RNA, 14 nt, Bordetella pertussis
cgaaacucaccgcc

SEQ ID NO: 2358837 - RNA, 15 nt, Bordetella pertussis
cgaaacucaccgccg

SEQ ID NO: 2358838 - RNA, 21 nt, Bordetella pertussis
cgaaagcacgccauggucucg

SEQ ID NO: 2358839 - RNA, 15 nt, Bordetella pertussis
cgaaagccagcgccu

SEQ ID NO: 2358840 - RNA, 16 nt, Bordetella pertussis
cgaaagccagcgccug

SEQ ID NO: 2358841 - RNA, 17 nt, Bordetella pertussis
cgaaagccagcgccugc

SEQ ID NO: 2358842 - RNA, 18 nt, Bordetella pertussis
cgaaagccggccuccggg

SEQ ID NO: 2358843 - RNA, 15 nt, Bordetella pertussis
cgaaagccgucggcc

SEQ ID NO: 2358844 - RNA, 20 nt, Bordetella pertussis
cgaaagcgcgucgagcaggc

SEQ ID NO: 2358845 - RNA, 22 nt, Bordetella pertussis
cgaaagcgcgucgagcaggccg

SEQ ID NO: 2358846 - RNA, 14 nt, Bordetella pertussis
cgaaagcggccagc

SEQ ID NO: 2358847 - RNA, 22 nt, Bordetella pertussis
cgaaagcggcgugugcccagca

SEQ ID NO: 2358848 - RNA, 21 nt, Bordetella pertussis
cgaaaggcaccgagcacagca

SEQ ID NO: 2358849 - RNA, 17 nt, Bordetella pertussis
cgaaagguccuggagac

SEQ ID NO: 2358850 - RNA, 21 nt, Bordetella pertussis
cgaaaugaagucgucgauggc

SEQ ID NO: 2358851 - RNA, 17 nt, Bordetella pertussis
cgaaaugcccagcgagc

SEQ ID NO: 2358852 - RNA, 18 nt, Bordetella pertussis
cgaaaugccgaagcgcgc

SEQ ID NO: 2358853 - RNA, 14 nt, Bordetella pertussis
cgaaaugccgcagc

SEQ ID NO: 2358854 - RNA, 15 nt, Bordetella pertussis
cgaaaugccgcagca

SEQ ID NO: 2358855 - RNA, 19 nt, Bordetella pertussis
cgaaaugccgcagcaccac

SEQ ID NO: 2358856 - RNA, 22 nt, Bordetella pertussis
cgaaaugcgcguuggccugacc

SEQ ID NO: 2358857 - RNA, 19 nt, Bordetella pertussis
cgaaauggugcggccauga

SEQ ID NO: 2358858 - RNA, 19 nt, Bordetella pertussis
cgaacaacacgaugaucgc

SEQ ID NO: 2358859 - RNA, 15 nt, Bordetella pertussis
cgaacaacagcgccu

SEQ ID NO: 2358860 - RNA, 16 nt, Bordetella pertussis
cgaacaacagcgccug

SEQ ID NO: 2358861 - RNA, 21 nt, Bordetella pertussis
cgaacaagguccaggcccggc

SEQ ID NO: 2358862 - RNA, 22 nt, Bordetella pertussis
cgaacaagguccaggcccggca

SEQ ID NO: 2358863 - RNA, 15 nt, Bordetella pertussis
cgaacaccagcucgg

SEQ ID NO: 2358864 - RNA, 19 nt, Bordetella pertussis
cgaacaccagcucggcggc

SEQ ID NO: 2358865 - RNA, 17 nt, Bordetella pertussis
cgaacaccggcaggccg

SEQ ID NO: 2358866 - RNA, 19 nt, Bordetella pertussis
cgaacaccggcaggccgcg

SEQ ID NO: 2358867 - RNA, 14 nt, Bordetella pertussis
cgaacacgccgacc

SEQ ID NO: 2358868 - RNA, 15 nt, Bordetella pertussis
cgaacacgccgaccg

SEQ ID NO: 2358869 - RNA, 14 nt, Bordetella pertussis
cgaacacgcgcgcc

SEQ ID NO: 2358870 - RNA, 15 nt, Bordetella pertussis
cgaacacgcgcgccg

SEQ ID NO: 2358871 - RNA, 19 nt, Bordetella pertussis
cgaacacgucgcgggcgau

SEQ ID NO: 2358872 - RNA, 19 nt, Bordetella pertussis
cgaacagauccacgcccgc

SEQ ID NO: 2358873 - RNA, 22 nt, Bordetella pertussis
cgaacagcauggcggcgcccgc

SEQ ID NO: 2358874 - RNA, 22 nt, Bordetella pertussis
cgaacagccagggcagggcgcc

SEQ ID NO: 2358875 - RNA, 13 nt, Bordetella pertussis
cgaacaggccauc

SEQ ID NO: 2358876 - RNA, 17 nt, Bordetella pertussis
cgaacaggccaucgccg

SEQ ID NO: 2358877 - RNA, 20 nt, Bordetella pertussis
cgaacaggccaucgccgccg

SEQ ID NO: 2358878 - RNA, 23 nt, Bordetella pertussis
cgaacauguuguuggucgccacg

SEQ ID NO: 2358879 - RNA, 13 nt, Bordetella pertussis
cgaaccacccggc

SEQ ID NO: 2358880 - RNA, 15 nt, Bordetella pertussis
cgaaccagcgcacca

SEQ ID NO: 2358881 - RNA, 16 nt, Bordetella pertussis
cgaaccagcgcaccac

SEQ ID NO: 2358882 - RNA, 20 nt, Bordetella pertussis
cgaaccaguugcgggccucg

SEQ ID NO: 2358883 - RNA, 22 nt, Bordetella pertussis
cgaacccgccgcgaucagcgcg

SEQ ID NO: 2358884 - RNA, 13 nt, Bordetella pertussis
cgaacccgggcgu

SEQ ID NO: 2358885 - RNA, 19 nt, Bordetella pertussis
cgaacccugccucagacca

SEQ ID NO: 2358886 - RNA, 20 nt, Bordetella pertussis
cgaaccgaaaugccgcagca

SEQ ID NO: 2358887 - RNA, 21 nt, Bordetella pertussis
cgaaccgaaaugccgcagcac

SEQ ID NO: 2358888 - RNA, 23 nt, Bordetella pertussis
cgaaccgaaaugccgcagcacca

SEQ ID NO: 2358889 - RNA, 12 nt, Bordetella pertussis
cgaaccgaauuc

SEQ ID NO: 2358890 - RNA, 16 nt, Bordetella pertussis
cgaaccgaccgccacg

SEQ ID NO: 2358891 - RNA, 17 nt, Bordetella pertussis
cgaaccgaccgccacga

SEQ ID NO: 2358892 - RNA, 17 nt, Bordetella pertussis
cgaaccgcgcagccgcu

SEQ ID NO: 2358893 - RNA, 19 nt, Bordetella pertussis
cgaaccuuccuccgacagg

SEQ ID NO: 2358894 - RNA, 20 nt, Bordetella pertussis
cgaaccuuccuccgacaggc

SEQ ID NO: 2358895 - RNA, 16 nt, Bordetella pertussis
cgaacgacacccgguc

SEQ ID NO: 2358896 - RNA, 14 nt, Bordetella pertussis
cgaacgaggcgcgg

SEQ ID NO: 2358897 - RNA, 23 nt, Bordetella pertussis
cgaacgauucggagucgugcagg

SEQ ID NO: 2358898 - RNA, 12 nt, Bordetella pertussis
cgaacgccacgc

SEQ ID NO: 2358899 - RNA, 14 nt, Bordetella pertussis
cgaacgccacgccc

SEQ ID NO: 2358900 - RNA, 15 nt, Bordetella pertussis
cgaacgccacgcccg

SEQ ID NO: 2358901 - RNA, 15 nt, Bordetella pertussis
cgaacgcccggccca

SEQ ID NO: 2358902 - RNA, 18 nt, Bordetella pertussis
cgaacgcccggcccaggc

SEQ ID NO: 2358903 - RNA, 17 nt, Bordetella pertussis
cgaagggcaggucgucg

SEQ ID NO: 2358904 - RNA, 23 nt, Bordetella pertussis
cgaagggcaggucgucgagccgg

SEQ ID NO: 2358905 - RNA, 23 nt, Bordetella pertussis
cgaagggcugcgugcgggacagg

SEQ ID NO: 2358906 - RNA, 20 nt, Bordetella pertussis
cgaagggucucagaccaucu

SEQ ID NO: 2358907 - RNA, 22 nt, Bordetella pertussis
cgaaggucuuggcgugcaggcu

SEQ ID NO: 2358908 - RNA, 15 nt, Bordetella pertussis
cgaagguggcacauc

SEQ ID NO: 2358909 - RNA, 21 nt, Bordetella pertussis
cgaagguggcacaucagcgug

SEQ ID NO: 2358910 - RNA, 23 nt, Bordetella pertussis
cgaaggugggcgaaccgcggcgc

SEQ ID NO: 2358911 - RNA, 21 nt, Bordetella pertussis
cgaagguguugaccacgcccu

SEQ ID NO: 2358912 - RNA, 22 nt, Bordetella pertussis
cgaagguuucguagccgccgac

SEQ ID NO: 2358913 - RNA, 14 nt, Bordetella pertussis
cgaaguacucgccg

SEQ ID NO: 2358914 - RNA, 18 nt, Bordetella pertussis
cgaaguagaacgccggcu

SEQ ID NO: 2358915 - RNA, 22 nt, Bordetella pertussis
cgaaguauuucaggaugccgcc

SEQ ID NO: 2358916 - RNA, 15 nt, Bordetella pertussis
cgaaguccgcgcgca

SEQ ID NO: 2358917 - RNA, 15 nt, Bordetella pertussis
cgaaguccugcaugc

SEQ ID NO: 2358918 - RNA, 17 nt, Bordetella pertussis
cgaaguccugcaugcca

SEQ ID NO: 2358919 - RNA, 16 nt, Bordetella pertussis
cgaaguugcggccgug

SEQ ID NO: 2358920 - RNA, 18 nt, Bordetella pertussis
cgaaguugcggccgugcg

SEQ ID NO: 2358921 - RNA, 16 nt, Bordetella pertussis
cgaaguugucgccaua

SEQ ID NO: 2358922 - RNA, 14 nt, Bordetella pertussis
cgaauacgccacgu

SEQ ID NO: 2358923 - RNA, 14 nt, Bordetella pertussis
cgaauaugcccucu

SEQ ID NO: 2358924 - RNA, 22 nt, Bordetella pertussis
cgaauccaccggcgcgcgcaug

SEQ ID NO: 2358925 - RNA, 17 nt, Bordetella pertussis
cgaauccagggccacgc

SEQ ID NO: 2358926 - RNA, 22 nt, Bordetella pertussis
cgaauccaucaucagcauggcg

SEQ ID NO: 2358927 - RNA, 14 nt, Bordetella pertussis
cgaauccggccagc

SEQ ID NO: 2358928 - RNA, 22 nt, Bordetella pertussis
cgaauccggccagcacgccggc

SEQ ID NO: 2358929 - RNA, 21 nt, Bordetella pertussis
cgaaucguaggcgcuguuggc

SEQ ID NO: 2358930 - RNA, 16 nt, Bordetella pertussis
cgaaucguucacgccc

SEQ ID NO: 2358931 - RNA, 22 nt, Bordetella pertussis
cgaaugcacgggcgcugcccag

SEQ ID NO: 2358932 - RNA, 23 nt, Bordetella pertussis
cgaaugcacgggcgcugcccagg

SEQ ID NO: 2358933 - RNA, 23 nt, Bordetella pertussis
cgaaugccugguaggcgagcagg

SEQ ID NO: 2358934 - RNA, 19 nt, Bordetella pertussis
cgaaugcguguuccagcgc

SEQ ID NO: 2358935 - RNA, 22 nt, Bordetella pertussis
cgaaugcguguuccagcgccug

SEQ ID NO: 2358936 - RNA, 17 nt, Bordetella pertussis
cgaauggcugcgcgccg

SEQ ID NO: 2358937 - RNA, 19 nt, Bordetella pertussis
cgaauggucggccucggcg

SEQ ID NO: 2358938 - RNA, 18 nt, Bordetella pertussis
cgaauugccgccgcugcc

SEQ ID NO: 2358939 - RNA, 20 nt, Bordetella pertussis
cgaauuuuucuuccaguucg

SEQ ID NO: 2358940 - RNA, 16 nt, Bordetella pertussis
cgacaaauagccgacc

SEQ ID NO: 2358941 - RNA, 18 nt, Bordetella pertussis
cgacaacaagccgggcgc

SEQ ID NO: 2358942 - RNA, 19 nt, Bordetella pertussis
cgacaacaagccgggcgcc

SEQ ID NO: 2358943 - RNA, 21 nt, Bordetella pertussis
cgacaacagcuugcccggcgu

SEQ ID NO: 2358944 - RNA, 14 nt, Bordetella pertussis
cgacaaccgcggcg

SEQ ID NO: 2358945 - RNA, 14 nt, Bordetella pertussis
cgacacccccaggg

SEQ ID NO: 2358946 - RNA, 22 nt, Bordetella pertussis
cgacacccccagggcgcgccgg

SEQ ID NO: 2358947 - RNA, 14 nt, Bordetella pertussis
cgacacccgcggcc

SEQ ID NO: 2358948 - RNA, 15 nt, Bordetella pertussis
cgacacccgcggcca

SEQ ID NO: 2358949 - RNA, 16 nt, Bordetella pertussis
cgacacccgcggccag

SEQ ID NO: 2358950 - RNA, 18 nt, Bordetella pertussis
cgacacccggucggccca

SEQ ID NO: 2358951 - RNA, 20 nt, Bordetella pertussis
cgacacccggucggcccagg

SEQ ID NO: 2358952 - RNA, 14 nt, Bordetella pertussis
cgacacccuugcgc

SEQ ID NO: 2358953 - RNA, 18 nt, Bordetella pertussis
cgacaccuacauccugga

SEQ ID NO: 2358954 - RNA, 17 nt, Bordetella pertussis
cgacaccuggacccgcu

SEQ ID NO: 2358955 - RNA, 14 nt, Bordetella pertussis
cgacacgcagcaac

SEQ ID NO: 2358956 - RNA, 14 nt, Bordetella pertussis
cgacacgcccagca

SEQ ID NO: 2358957 - RNA, 16 nt, Bordetella pertussis
cgacacgcccagcagg

SEQ ID NO: 2358958 - RNA, 19 nt, Bordetella pertussis
cgacacggcggugccgcgc

SEQ ID NO: 2358959 - RNA, 17 nt, Bordetella pertussis
cgacacggggcaaccgg

SEQ ID NO: 2358960 - RNA, 22 nt, Bordetella pertussis
cgacacggggcaaccggccuug

SEQ ID NO: 2358961 - RNA, 14 nt, Bordetella pertussis
cgacacgucaucgu

SEQ ID NO: 2358962 - RNA, 20 nt, Bordetella pertussis
cgacagaccguagcgcaggc

SEQ ID NO: 2358963 - RNA, 21 nt, Bordetella pertussis
cgacagaccguagcgcaggcg

SEQ ID NO: 2358964 - RNA, 22 nt, Bordetella pertussis
cgacagaccguagcgcaggcgc

SEQ ID NO: 2358965 - RNA, 16 nt, Bordetella pertussis
cgacagcaaugacgac

SEQ ID NO: 2358966 - RNA, 18 nt, Bordetella pertussis
cgacagcaaugacgacgc

SEQ ID NO: 2358967 - RNA, 15 nt, Bordetella pertussis
cgacagcacauggcg

SEQ ID NO: 2358968 - RNA, 23 nt, Bordetella pertussis
cgacagcaccaacugguagugcg

SEQ ID NO: 2358969 - RNA, 12 nt, Bordetella pertussis
cgacagcacgcc

SEQ ID NO: 2358970 - RNA, 15 nt, Bordetella pertussis
cgacagcacgcccgc

SEQ ID NO: 2358971 - RNA, 17 nt, Bordetella pertussis
cgacagcacgcccgcca

SEQ ID NO: 2358972 - RNA, 20 nt, Bordetella pertussis
cgacagcacgcccgccagca

SEQ ID NO: 2358973 - RNA, 17 nt, Bordetella pertussis
cgacagcagcaugcggc

SEQ ID NO: 2358974 - RNA, 20 nt, Bordetella pertussis
cgacagcagcaugcggcccg

SEQ ID NO: 2358975 - RNA, 14 nt, Bordetella pertussis
cgacagcagcccgc

SEQ ID NO: 2358976 - RNA, 16 nt, Bordetella pertussis
cgacagcagcccgcug

SEQ ID NO: 2358977 - RNA, 20 nt, Bordetella pertussis
cgacagcagcccgcuggccg

SEQ ID NO: 2358978 - RNA, 20 nt, Bordetella pertussis
cgacagcaggccggucagga

SEQ ID NO: 2358979 - RNA, 14 nt, Bordetella pertussis
cgacagcagggcca

SEQ ID NO: 2358980 - RNA, 16 nt, Bordetella pertussis
cgacagcagggccagg

SEQ ID NO: 2358981 - RNA, 17 nt, Bordetella pertussis
cgacagcagggccaggc

SEQ ID NO: 2358982 - RNA, 21 nt, Bordetella pertussis
cgacagcagggucggccccau

SEQ ID NO: 2358983 - RNA, 22 nt, Bordetella pertussis
cgacagcagggucggccccaug

SEQ ID NO: 2358984 - RNA, 20 nt, Bordetella pertussis
cgacagcaucuuggccgcca

SEQ ID NO: 2358985 - RNA, 22 nt, Bordetella pertussis
cgacagcaucuuggccgccacg

SEQ ID NO: 2358986 - RNA, 20 nt, Bordetella pertussis
cgacagcaugaacggcagcg

SEQ ID NO: 2358987 - RNA, 14 nt, Bordetella pertussis
cgacagccaggcca

SEQ ID NO: 2358988 - RNA, 19 nt, Bordetella pertussis
cgacagccaggccagcgcc

SEQ ID NO: 2358989 - RNA, 21 nt, Bordetella pertussis
cgacagccaggccagcgccag

SEQ ID NO: 2358990 - RNA, 22 nt, Bordetella pertussis
cgacagccaggccagcgccaga

SEQ ID NO: 2358991 - RNA, 20 nt, Bordetella pertussis
cgacagccgcgccagcgccu

SEQ ID NO: 2358992 - RNA, 23 nt, Bordetella pertussis
cgacagccgcgccagcgccucca

SEQ ID NO: 2358993 - RNA, 15 nt, Bordetella pertussis
cgacagcgacagcca

SEQ ID NO: 2358994 - RNA, 13 nt, Bordetella pertussis
cgacagcgccccg

SEQ ID NO: 2358995 - RNA, 15 nt, Bordetella pertussis
cgacagcgcgcagga

SEQ ID NO: 2358996 - RNA, 13 nt, Bordetella pertussis
cgacagcgcgccc

SEQ ID NO: 2358997 - RNA, 14 nt, Bordetella pertussis
cgacagcgcgcccg

SEQ ID NO: 2358998 - RNA, 21 nt, Bordetella pertussis
cgacagcgcugguggccagau

SEQ ID NO: 2358999 - RNA, 17 nt, Bordetella pertussis
cgacagcuugcgcuggc

SEQ ID NO: 2359000 - RNA, 23 nt, Bordetella pertussis
cgacaggaacauguucacgccca

SEQ ID NO: 2359001 - RNA, 21 nt, Bordetella pertussis
cgacaggaucgaaggcagcgc

SEQ ID NO: 2359002 - RNA, 22 nt, Bordetella pertussis
cgacaggaugggcgcuuggccc

SEQ ID NO: 2359003 - RNA, 14 nt, Bordetella pertussis
cgacaggcccgcgg

SEQ ID NO: 2359004 - RNA, 17 nt, Bordetella pertussis
cgacaggcccgcggccg

SEQ ID NO: 2359005 - RNA, 12 nt, Bordetella pertussis
cgacaggccgau

SEQ ID NO: 2359006 - RNA, 14 nt, Bordetella pertussis
cgacaggccgaugc

SEQ ID NO: 2359007 - RNA, 17 nt, Bordetella pertussis
cgacaggccgaugcugg

SEQ ID NO: 2359008 - RNA, 21 nt, Bordetella pertussis
cgacaggccuggcuuggcggc

SEQ ID NO: 2359009 - RNA, 14 nt, Bordetella pertussis
cgacaggcgcagcu

SEQ ID NO: 2359010 - RNA, 16 nt, Bordetella pertussis
cgacaggcgcagcucg

SEQ ID NO: 2359011 - RNA, 12 nt, Bordetella pertussis
cgacaggcgccg

SEQ ID NO: 2359012 - RNA, 14 nt, Bordetella pertussis
cgacaggcgccgca

SEQ ID NO: 2359013 - RNA, 15 nt, Bordetella pertussis
cgacaggcgcgcagg

SEQ ID NO: 2359014 - RNA, 14 nt, Bordetella pertussis
cgacaggcgcgccc

SEQ ID NO: 2359015 - RNA, 18 nt, Bordetella pertussis
cgaccccgccgugccggg

SEQ ID NO: 2359016 - RNA, 18 nt, Bordetella pertussis
cgacccgaaggcgcggcc

SEQ ID NO: 2359017 - RNA, 22 nt, Bordetella pertussis
cgacccgaaggcgcggccgggc

SEQ ID NO: 2359018 - RNA, 16 nt, Bordetella pertussis
cgacccgagcccuggc

SEQ ID NO: 2359019 - RNA, 19 nt, Bordetella pertussis
cgacccgagcccuggcuug

SEQ ID NO: 2359020 - RNA, 17 nt, Bordetella pertussis
cgacccgauagccgcgc

SEQ ID NO: 2359021 - RNA, 19 nt, Bordetella pertussis
cgacccgauagccgcgcgc

SEQ ID NO: 2359022 - RNA, 23 nt, Bordetella pertussis
cgacccgauagccgcgcgccugc

SEQ ID NO: 2359023 - RNA, 14 nt, Bordetella pertussis
cgacccgcaccgac

SEQ ID NO: 2359024 - RNA, 20 nt, Bordetella pertussis
cgacccgcucggccacgcgc

SEQ ID NO: 2359025 - RNA, 21 nt, Bordetella pertussis
cgacccgcugaaggaccucgc

SEQ ID NO: 2359026 - RNA, 17 nt, Bordetella pertussis
cgacccggacaacgcgc

SEQ ID NO: 2359027 - RNA, 19 nt, Bordetella pertussis
cgacccggacaacgcgcgc

SEQ ID NO: 2359028 - RNA, 21 nt, Bordetella pertussis
cgacccggacaacgcgcgcca

SEQ ID NO: 2359029 - RNA, 16 nt, Bordetella pertussis
cgacccgggcgggcgu

SEQ ID NO: 2359030 - RNA, 12 nt, Bordetella pertussis
cgacccguggcc

SEQ ID NO: 2359031 - RNA, 15 nt, Bordetella pertussis
cgacccguggcccgg

SEQ ID NO: 2359032 - RNA, 16 nt, Bordetella pertussis
cgacccucagcccgca

SEQ ID NO: 2359033 - RNA, 20 nt, Bordetella pertussis
cgacccucagcccgcaccgc

SEQ ID NO: 2359034 - RNA, 14 nt, Bordetella pertussis
cgacccugcccggc

SEQ ID NO: 2359035 - RNA, 21 nt, Bordetella pertussis
cgacccuguacaagcgcacgc

SEQ ID NO: 2359036 - RNA, 23 nt, Bordetella pertussis
cgacccuguacaagcgcacgcug

SEQ ID NO: 2359037 - RNA, 20 nt, Bordetella pertussis
cgacccuuucauuucggcgc

SEQ ID NO: 2359038 - RNA, 16 nt, Bordetella pertussis
cgaccgaaaagcccac

SEQ ID NO: 2359039 - RNA, 18 nt, Bordetella pertussis
cgaccgaaaagcccacgu

SEQ ID NO: 2359040 - RNA, 21 nt, Bordetella pertussis
cgaccgaaccgauccagcccg

SEQ ID NO: 2359041 - RNA, 22 nt, Bordetella pertussis
cgaccgacagcacauggcgcgc

SEQ ID NO: 2359042 - RNA, 23 nt, Bordetella pertussis
cgaccgacagcacauggcgcgcc

SEQ ID NO: 2359043 - RNA, 15 nt, Bordetella pertussis
cgaccgacggcaucg

SEQ ID NO: 2359044 - RNA, 15 nt, Bordetella pertussis
cgaccgagccggcca

SEQ ID NO: 2359045 - RNA, 20 nt, Bordetella pertussis
cgaccgagccggccagcgcc

SEQ ID NO: 2359046 - RNA, 21 nt, Bordetella pertussis
cgaccgagccggccagcgccu

SEQ ID NO: 2359047 - RNA, 22 nt, Bordetella pertussis
cgaccgagccggccagcgccug

SEQ ID NO: 2359048 - RNA, 19 nt, Bordetella pertussis
cgaccgauucgcgcaccga

SEQ ID NO: 2359049 - RNA, 20 nt, Bordetella pertussis
cgaccgcacgauggcgcgcg

SEQ ID NO: 2359050 - RNA, 21 nt, Bordetella pertussis
cgaccgcacgauggcgcgcga

SEQ ID NO: 2359051 - RNA, 16 nt, Bordetella pertussis
cgaccgcauagcgcau

SEQ ID NO: 2359052 - RNA, 16 nt, Bordetella pertussis
cgaccgcaugggcgcc

SEQ ID NO: 2359053 - RNA, 12 nt, Bordetella pertussis
cgaccgccacga

SEQ ID NO: 2359054 - RNA, 16 nt, Bordetella pertussis
cgaccgccagcaggcc

SEQ ID NO: 2359055 - RNA, 15 nt, Bordetella pertussis
cgaccgccgccacgc

SEQ ID NO: 2359056 - RNA, 18 nt, Bordetella pertussis
cgaccgccgccuuggacg

SEQ ID NO: 2359057 - RNA, 13 nt, Bordetella pertussis
cgaccgccggccg

SEQ ID NO: 2359058 - RNA, 19 nt, Bordetella pertussis
cgaccgccuccagcgcggc

SEQ ID NO: 2359059 - RNA, 15 nt, Bordetella pertussis
cgaccgccucgacgc

SEQ ID NO: 2359060 - RNA, 16 nt, Bordetella pertussis
cgaccgccucgacgcc

SEQ ID NO: 2359061 - RNA, 18 nt, Bordetella pertussis
cgaccgccucgacgcccg

SEQ ID NO: 2359062 - RNA, 18 nt, Bordetella pertussis
cgaccgcgaagccgcccg

SEQ ID NO: 2359063 - RNA, 15 nt, Bordetella pertussis
cgaccgcgcggcgcu

SEQ ID NO: 2359064 - RNA, 18 nt, Bordetella pertussis
cgaccgcgcggcgcugca

SEQ ID NO: 2359065 - RNA, 22 nt, Bordetella pertussis
cgaccgcgcggcgcugcacgcg

SEQ ID NO: 2359066 - RNA, 23 nt, Bordetella pertussis
cgaccgcgcggcgcugcacgcgg

SEQ ID NO: 2359067 - RNA, 14 nt, Bordetella pertussis
cgaccgcggcgguc

SEQ ID NO: 2359068 - RNA, 20 nt, Bordetella pertussis
cgaccgcggcgguccugcug

SEQ ID NO: 2359069 - RNA, 23 nt, Bordetella pertussis
cgaccgcguaguugucggcgcag

SEQ ID NO: 2359070 - RNA, 17 nt, Bordetella pertussis
cgaccgcuacccugccc

SEQ ID NO: 2359071 - RNA, 21 nt, Bordetella pertussis
cgaccgcuuccgccaccgcgc

SEQ ID NO: 2359072 - RNA, 21 nt, Bordetella pertussis
cgaccggaaucaccgccgcga

SEQ ID NO: 2359073 - RNA, 22 nt, Bordetella pertussis
cgaccggaaucaccgccgcgac

SEQ ID NO: 2359074 - RNA, 13 nt, Bordetella pertussis
cgaccggcaccug

SEQ ID NO: 2359075 - RNA, 14 nt, Bordetella pertussis
cgaccggcgccggc

SEQ ID NO: 2359076 - RNA, 16 nt, Bordetella pertussis
cgaccggcgccggcuc

SEQ ID NO: 2359077 - RNA, 13 nt, Bordetella pertussis
cgaccggcgcgcg

SEQ ID NO: 2359078 - RNA, 19 nt, Bordetella pertussis
cgaccggcucgaucgccgc

SEQ ID NO: 2359079 - RNA, 21 nt, Bordetella pertussis
cgaccggcucgaucgccgccg

SEQ ID NO: 2359080 - RNA, 15 nt, Bordetella pertussis
cgaccgggccgacca

SEQ ID NO: 2359081 - RNA, 15 nt, Bordetella pertussis
cgaccgucagcaugc

SEQ ID NO: 2359082 - RNA, 16 nt, Bordetella pertussis
cgaccgucagcaugcc

SEQ ID NO: 2359083 - RNA, 13 nt, Bordetella pertussis
cgaccuccaggcc

SEQ ID NO: 2359084 - RNA, 14 nt, Bordetella pertussis
cgaccuccaggccc

SEQ ID NO: 2359085 - RNA, 18 nt, Bordetella pertussis
cgaccuccaggcccaggc

SEQ ID NO: 2359086 - RNA, 15 nt, Bordetella pertussis
cgaccucgagcaccu

SEQ ID NO: 2359087 - RNA, 17 nt, Bordetella pertussis
cgaccucggcggcgucg

SEQ ID NO: 2359088 - RNA, 21 nt, Bordetella pertussis
cgaccucgggacggcccugca

SEQ ID NO: 2359089 - RNA, 16 nt, Bordetella pertussis
cgaccucgucgggcug

SEQ ID NO: 2359090 - RNA, 21 nt, Bordetella pertussis
cgaccucuucguugucgcgcg

SEQ ID NO: 2359091 - RNA, 22 nt, Bordetella pertussis
cgaccucuucguugucgcgcgc

SEQ ID NO: 2359092 - RNA, 23 nt, Bordetella pertussis
cgaccucuucguugucgcgcgcg

SEQ ID NO: 2359093 - RNA, 16 nt, Bordetella pertussis
cgaccugaucgcgcag

SEQ ID NO: 2359094 - RNA, 17 nt, Bordetella pertussis
cgaccugaucgcgcagc

SEQ ID NO: 2359095 - RNA, 18 nt, Bordetella pertussis
cgaccugaucgcgcagcg

SEQ ID NO: 2359096 - RNA, 20 nt, Bordetella pertussis
cgaccugaucgcgcagcgcc

SEQ ID NO: 2359097 - RNA, 11 nt, Bordetella pertussis
cgaccugcccg

SEQ ID NO: 2359098 - RNA, 15 nt, Bordetella pertussis
cgaccugcccgagac

SEQ ID NO: 2359099 - RNA, 21 nt, Bordetella pertussis
cgaccugcccgagaccgcccg

SEQ ID NO: 2359100 - RNA, 23 nt, Bordetella pertussis
cgaccugccgcccgagcuggccg

SEQ ID NO: 2359101 - RNA, 17 nt, Bordetella pertussis
cgaccugcgcaccggcc

SEQ ID NO: 2359102 - RNA, 19 nt, Bordetella pertussis
cgaccugcgcaccggccgg

SEQ ID NO: 2359103 - RNA, 20 nt, Bordetella pertussis
cgaccugcgcaccggccggc

SEQ ID NO: 2359104 - RNA, 15 nt, Bordetella pertussis
cgaccugcgcgaccg

SEQ ID NO: 2359105 - RNA, 17 nt, Bordetella pertussis
cgaccugcgcgaccgcc

SEQ ID NO: 2359106 - RNA, 21 nt, Bordetella pertussis
cgaccugcgggcgcagcgccg

SEQ ID NO: 2359107 - RNA, 17 nt, Bordetella pertussis
cgaccugcuggcgcgca

SEQ ID NO: 2359108 - RNA, 14 nt, Bordetella pertussis
cgaccuggcgcccg

SEQ ID NO: 2359109 - RNA, 20 nt, Bordetella pertussis
cgaccuggcgcccgacggcg

SEQ ID NO: 2359110 - RNA, 13 nt, Bordetella pertussis
cgaccuugcggcc

SEQ ID NO: 2359111 - RNA, 17 nt, Bordetella pertussis
cgaccuugcggccgcgc

SEQ ID NO: 2359112 - RNA, 16 nt, Bordetella pertussis
cgaccuugcugacgcg

SEQ ID NO: 2359113 - RNA, 12 nt, Bordetella pertussis
cgaccuugcugg

SEQ ID NO: 2359114 - RNA, 17 nt, Bordetella pertussis
cgaccuugcuggaccgc

SEQ ID NO: 2359115 - RNA, 19 nt, Bordetella pertussis
cgaccuugcuggaccgcgc

SEQ ID NO: 2359116 - RNA, 20 nt, Bordetella pertussis
cgaccuugcuggaccgcgcc

SEQ ID NO: 2359117 - RNA, 21 nt, Bordetella pertussis
cgaccuugcuggaccgcgccu

SEQ ID NO: 2359118 - RNA, 13 nt, Bordetella pertussis
cgaccuuggcggc

SEQ ID NO: 2359119 - RNA, 19 nt, Bordetella pertussis
cgacgaaacccgggccguc

SEQ ID NO: 2359120 - RNA, 21 nt, Bordetella pertussis
cgacgaaacccgggccgucgc

SEQ ID NO: 2359121 - RNA, 22 nt, Bordetella pertussis
cgacgaacaacacgaugaucgc

SEQ ID NO: 2359122 - RNA, 14 nt, Bordetella pertussis
cgacgaacaaggcc

SEQ ID NO: 2359123 - RNA, 15 nt, Bordetella pertussis
cgacgaacaaggccg

SEQ ID NO: 2359124 - RNA, 13 nt, Bordetella pertussis
cgacgaacacgcg

SEQ ID NO: 2359125 - RNA, 15 nt, Bordetella pertussis
cgacgaacacgcgcg

SEQ ID NO: 2359126 - RNA, 17 nt, Bordetella pertussis
cgacgaacacgcgcgcc

SEQ ID NO: 2359127 - RNA, 18 nt, Bordetella pertussis
cgacggauucgcccaggg

SEQ ID NO: 2359128 - RNA, 19 nt, Bordetella pertussis
cgacggcaagucgacgcug

SEQ ID NO: 2359129 - RNA, 18 nt, Bordetella pertussis
cgacggcaaugccugcgc

SEQ ID NO: 2359130 - RNA, 14 nt, Bordetella pertussis
cgacggcagccccg

SEQ ID NO: 2359131 - RNA, 22 nt, Bordetella pertussis
cgacggcaucgauuucucgcug

SEQ ID NO: 2359132 - RNA, 18 nt, Bordetella pertussis
cgacggcauggccggcag

SEQ ID NO: 2359133 - RNA, 19 nt, Bordetella pertussis
cgacggcauggcggccagc

SEQ ID NO: 2359134 - RNA, 20 nt, Bordetella pertussis
cgacggcauggcggccagcu

SEQ ID NO: 2359135 - RNA, 12 nt, Bordetella pertussis
cgacggccagcg

SEQ ID NO: 2359136 - RNA, 14 nt, Bordetella pertussis
cgacggccagcgcg

SEQ ID NO: 2359137 - RNA, 13 nt, Bordetella pertussis
cgacggccccagc

SEQ ID NO: 2359138 - RNA, 16 nt, Bordetella pertussis
cgacggccccagcgcc

SEQ ID NO: 2359139 - RNA, 17 nt, Bordetella pertussis
cgacggccccagcgccg

SEQ ID NO: 2359140 - RNA, 20 nt, Bordetella pertussis
cgacggccccagcgccgcga

SEQ ID NO: 2359141 - RNA, 14 nt, Bordetella pertussis
cgacggccggcgcg

SEQ ID NO: 2359142 - RNA, 19 nt, Bordetella pertussis
cgacggccggcgcgugcug

SEQ ID NO: 2359143 - RNA, 22 nt, Bordetella pertussis
cgacggccucccgccgcccggc

SEQ ID NO: 2359144 - RNA, 18 nt, Bordetella pertussis
cgacggccuccgcgccga

SEQ ID NO: 2359145 - RNA, 20 nt, Bordetella pertussis
cgacggccuccgcgccgacc

SEQ ID NO: 2359146 - RNA, 21 nt, Bordetella pertussis
cgacggccuccgcgccgacca

SEQ ID NO: 2359147 - RNA, 11 nt, Bordetella pertussis
cgacggccucg

SEQ ID NO: 2359148 - RNA, 18 nt, Bordetella pertussis
cgacggccucggccagga

SEQ ID NO: 2359149 - RNA, 22 nt, Bordetella pertussis
cgacggccugccaccgacaagc

SEQ ID NO: 2359150 - RNA, 19 nt, Bordetella pertussis
cgacggccuggaggccgag

SEQ ID NO: 2359151 - RNA, 20 nt, Bordetella pertussis
cgacggccuggaggccgagc

SEQ ID NO: 2359152 - RNA, 21 nt, Bordetella pertussis
cgacggccuggaggccgagcg

SEQ ID NO: 2359153 - RNA, 22 nt, Bordetella pertussis
cgacggccuggaggccgagcgc

SEQ ID NO: 2359154 - RNA, 17 nt, Bordetella pertussis
cgacggcgauguccugg

SEQ ID NO: 2359155 - RNA, 18 nt, Bordetella pertussis
cgacggcgauguccuggu

SEQ ID NO: 2359156 - RNA, 12 nt, Bordetella pertussis
cgacggcgcccu

SEQ ID NO: 2359157 - RNA, 14 nt, Bordetella pertussis
cgacggcgcccugc

SEQ ID NO: 2359158 - RNA, 17 nt, Bordetella pertussis
cgacggcgccgugcugg

SEQ ID NO: 2359159 - RNA, 23 nt, Bordetella pertussis
cgacggcgccuauugcgacgccg

SEQ ID NO: 2359160 - RNA, 14 nt, Bordetella pertussis
cgacggcgccuggc

SEQ ID NO: 2359161 - RNA, 22 nt, Bordetella pertussis
cgacggcgccuggcgcaugacg

SEQ ID NO: 2359162 - RNA, 13 nt, Bordetella pertussis
cgacggcgcgccc

SEQ ID NO: 2359163 - RNA, 14 nt, Bordetella pertussis
cgacggcgcgcccg

SEQ ID NO: 2359164 - RNA, 12 nt, Bordetella pertussis
cgacggcgcggc

SEQ ID NO: 2359165 - RNA, 13 nt, Bordetella pertussis
cgacggcgcggcg

SEQ ID NO: 2359166 - RNA, 12 nt, Bordetella pertussis
cgacggcggcgc

SEQ ID NO: 2359167 - RNA, 21 nt, Bordetella pertussis
cgacggcggcgcggcgccagc

SEQ ID NO: 2359168 - RNA, 17 nt, Bordetella pertussis
cgacggcgggaccggcg

SEQ ID NO: 2359169 - RNA, 16 nt, Bordetella pertussis
cgacggcgucggccug

SEQ ID NO: 2359170 - RNA, 23 nt, Bordetella pertussis
cgacggcucgcgcucgcccggcc

SEQ ID NO: 2359171 - RNA, 15 nt, Bordetella pertussis
cgacggcuugcgcau

SEQ ID NO: 2359172 - RNA, 16 nt, Bordetella pertussis
cgacgggauccucgcu

SEQ ID NO: 2359173 - RNA, 21 nt, Bordetella pertussis
cgacgggauugccgucacgcg

SEQ ID NO: 2359174 - RNA, 14 nt, Bordetella pertussis
cgacgggcggcugc

SEQ ID NO: 2359175 - RNA, 19 nt, Bordetella pertussis
cgacgggcggcugccagug

SEQ ID NO: 2359176 - RNA, 14 nt, Bordetella pertussis
cgacggggugccug

SEQ ID NO: 2359177 - RNA, 20 nt, Bordetella pertussis
cgacggggugccugucccug

SEQ ID NO: 2359178 - RNA, 23 nt, Bordetella pertussis
cgacgguagccgggucuggccgg

SEQ ID NO: 2359179 - RNA, 20 nt, Bordetella pertussis
cgacgguaucucagcgcgcc

SEQ ID NO: 2359180 - RNA, 15 nt, Bordetella pertussis
cgacggugcgcgcca

SEQ ID NO: 2359181 - RNA, 20 nt, Bordetella pertussis
cgacggugcgcgccacggcg

SEQ ID NO: 2359182 - RNA, 19 nt, Bordetella pertussis
cgacgguggcuggggcugg

SEQ ID NO: 2359183 - RNA, 22 nt, Bordetella pertussis
cgacgguggcuggggcuggcau

SEQ ID NO: 2359184 - RNA, 15 nt, Bordetella pertussis
cgacguaagugccca

SEQ ID NO: 2359185 - RNA, 16 nt, Bordetella pertussis
cgacguaagugcccag

SEQ ID NO: 2359186 - RNA, 21 nt, Bordetella pertussis
cgacguaagugcccaggcccg

SEQ ID NO: 2359187 - RNA, 16 nt, Bordetella pertussis
cgacguagucgcgcca

SEQ ID NO: 2359188 - RNA, 17 nt, Bordetella pertussis
cgacguagucgcgccag

SEQ ID NO: 2359189 - RNA, 19 nt, Bordetella pertussis
cgacguagucgcgccagcg

SEQ ID NO: 2359190 - RNA, 19 nt, Bordetella pertussis
cgacguccacgaugucguc

SEQ ID NO: 2359191 - RNA, 13 nt, Bordetella pertussis
cgacguccagccc

SEQ ID NO: 2359192 - RNA, 12 nt, Bordetella pertussis
cgacgucccagg

SEQ ID NO: 2359193 - RNA, 15 nt, Bordetella pertussis
cgacgucccaggccg

SEQ ID NO: 2359194 - RNA, 16 nt, Bordetella pertussis
cgacgucccaggccga

SEQ ID NO: 2359195 - RNA, 13 nt, Bordetella pertussis
cgacguccgcccg

SEQ ID NO: 2359196 - RNA, 15 nt, Bordetella pertussis
cgacguccgcccggu

SEQ ID NO: 2359197 - RNA, 12 nt, Bordetella pertussis
cgacguccuggu

SEQ ID NO: 2359198 - RNA, 14 nt, Bordetella pertussis
cgacguccuggugg

SEQ ID NO: 2359199 - RNA, 15 nt, Bordetella pertussis
cgacgucgcccaacg

SEQ ID NO: 2359200 - RNA, 14 nt, Bordetella pertussis
cgacgucggccucg

SEQ ID NO: 2359201 - RNA, 17 nt, Bordetella pertussis
cgacgucguaccccgag

SEQ ID NO: 2359202 - RNA, 18 nt, Bordetella pertussis
cgacgucguagugcgcgc

SEQ ID NO: 2359203 - RNA, 21 nt, Bordetella pertussis
cgacgucguagugcgcgccgc

SEQ ID NO: 2359204 - RNA, 18 nt, Bordetella pertussis
cgacgucuugcugccguc

SEQ ID NO: 2359205 - RNA, 22 nt, Bordetella pertussis
cgacgucuugcugccguccuug

SEQ ID NO: 2359206 - RNA, 13 nt, Bordetella pertussis
cgacgugcgccgc

SEQ ID NO: 2359207 - RNA, 14 nt, Bordetella pertussis
cgacgugcgccgca

SEQ ID NO: 2359208 - RNA, 19 nt, Bordetella pertussis
cgacgugcugcugcacgug

SEQ ID NO: 2359209 - RNA, 21 nt, Bordetella pertussis
cgacguggaccgcgcgguggc

SEQ ID NO: 2359210 - RNA, 21 nt, Bordetella pertussis
cgacguggcgcuccaugcggc

SEQ ID NO: 2359211 - RNA, 14 nt, Bordetella pertussis
cgacgugucggcca

SEQ ID NO: 2359212 - RNA, 16 nt, Bordetella pertussis
cgacgugucggccacc

SEQ ID NO: 2359213 - RNA, 20 nt, Bordetella pertussis
cgacgugucggccaccacga

SEQ ID NO: 2359214 - RNA, 16 nt, Bordetella pertussis
cgacguuaugcucgcg

SEQ ID NO: 2359215 - RNA, 21 nt, Bordetella pertussis
cgacguugcgcgacaggcccg

SEQ ID NO: 2359216 - RNA, 21 nt, Bordetella pertussis
cgacguuggcgaaugccuggu

SEQ ID NO: 2359217 - RNA, 14 nt, Bordetella pertussis
cgacguuguucagg

SEQ ID NO: 2359218 - RNA, 18 nt, Bordetella pertussis
cgacuacggcggacuggc

SEQ ID NO: 2359219 - RNA, 20 nt, Bordetella pertussis
cgacuacggcggacuggccg

SEQ ID NO: 2359220 - RNA, 14 nt, Bordetella pertussis
cgacuacuggcaac

SEQ ID NO: 2359221 - RNA, 13 nt, Bordetella pertussis
cgacuccggccgg

SEQ ID NO: 2359222 - RNA, 16 nt, Bordetella pertussis
cgacuccggccgggcc

SEQ ID NO: 2359223 - RNA, 18 nt, Bordetella pertussis
cgacucgaaacgggcggc

SEQ ID NO: 2359224 - RNA, 20 nt, Bordetella pertussis
cgacucgaaacgggcggcgu

SEQ ID NO: 2359225 - RNA, 22 nt, Bordetella pertussis
cgacucgaaacgggcggcgucg

SEQ ID NO: 2359226 - RNA, 17 nt, Bordetella pertussis
cgacucgaacaccggcu

SEQ ID NO: 2359227 - RNA, 14 nt, Bordetella pertussis
cgacucgaagaagu

SEQ ID NO: 2359228 - RNA, 12 nt, Bordetella pertussis
cgacucggcauc

SEQ ID NO: 2359229 - RNA, 14 nt, Bordetella pertussis
cgacucggccgaga

SEQ ID NO: 2359230 - RNA, 15 nt, Bordetella pertussis
cgacucgucgaccac

SEQ ID NO: 2359231 - RNA, 19 nt, Bordetella pertussis
cgacucgucgaccaccagc

SEQ ID NO: 2359232 - RNA, 17 nt, Bordetella pertussis
cgacugcagcaggcugg

SEQ ID NO: 2359233 - RNA, 19 nt, Bordetella pertussis
cgacugcagcaggcugggc

SEQ ID NO: 2359234 - RNA, 20 nt, Bordetella pertussis
cgacugccccagcggcuggc

SEQ ID NO: 2359235 - RNA, 14 nt, Bordetella pertussis
cgacugccccaugg

SEQ ID NO: 2359236 - RNA, 19 nt, Bordetella pertussis
cgacugccccauggcaugc

SEQ ID NO: 2359237 - RNA, 15 nt, Bordetella pertussis
cgacugcgcaugguc

SEQ ID NO: 2359238 - RNA, 13 nt, Bordetella pertussis
cgacuggcccagg

SEQ ID NO: 2359239 - RNA, 18 nt, Bordetella pertussis
cgacuggcccaggcgggc

SEQ ID NO: 2359240 - RNA, 21 nt, Bordetella pertussis
cgagccgcagaacagcagcgu

SEQ ID NO: 2359241 - RNA, 23 nt, Bordetella pertussis
cgagccgcagaacagcagcguga

SEQ ID NO: 2359242 - RNA, 18 nt, Bordetella pertussis
cgagccgcagguccaggc

SEQ ID NO: 2359243 - RNA, 20 nt, Bordetella pertussis
cgagccgcagguccaggccu

SEQ ID NO: 2359244 - RNA, 12 nt, Bordetella pertussis
cgagccgcccac

SEQ ID NO: 2359245 - RNA, 16 nt, Bordetella pertussis
cgagccgcccacgggc

SEQ ID NO: 2359246 - RNA, 17 nt, Bordetella pertussis
cgagccgcccacgggcg

SEQ ID NO: 2359247 - RNA, 19 nt, Bordetella pertussis
cgagccgcccacgggcgcc

SEQ ID NO: 2359248 - RNA, 18 nt, Bordetella pertussis
cgagccgccccggcgcgg

SEQ ID NO: 2359249 - RNA, 20 nt, Bordetella pertussis
cgagccgccccggcgcggcg

SEQ ID NO: 2359250 - RNA, 19 nt, Bordetella pertussis
cgagccgcgcgcaugcgcc

SEQ ID NO: 2359251 - RNA, 18 nt, Bordetella pertussis
cgagccgcugucgcaggc

SEQ ID NO: 2359252 - RNA, 21 nt, Bordetella pertussis
cgagccgcugucgcaggcgcu

SEQ ID NO: 2359253 - RNA, 18 nt, Bordetella pertussis
cgagccggacgugggcgc

SEQ ID NO: 2359254 - RNA, 13 nt, Bordetella pertussis
cgagccggccagc

SEQ ID NO: 2359255 - RNA, 14 nt, Bordetella pertussis
cgagccggccagcg

SEQ ID NO: 2359256 - RNA, 21 nt, Bordetella pertussis
cgagccggccagcgccugggc

SEQ ID NO: 2359257 - RNA, 12 nt, Bordetella pertussis
cgagccggccgc

SEQ ID NO: 2359258 - RNA, 17 nt, Bordetella pertussis
cgagccggccgcgcccg

SEQ ID NO: 2359259 - RNA, 18 nt, Bordetella pertussis
cgagccggcuccaguccc

SEQ ID NO: 2359260 - RNA, 16 nt, Bordetella pertussis
cgagccgggcaccgag

SEQ ID NO: 2359261 - RNA, 21 nt, Bordetella pertussis
cgagccgggcaccgagccgca

SEQ ID NO: 2359262 - RNA, 13 nt, Bordetella pertussis
cgagccgggcgcc

SEQ ID NO: 2359263 - RNA, 15 nt, Bordetella pertussis
cgagccgggcgccga

SEQ ID NO: 2359264 - RNA, 20 nt, Bordetella pertussis
cgagccgggcgccgauccag

SEQ ID NO: 2359265 - RNA, 21 nt, Bordetella pertussis
cgagccgguacagccaggcca

SEQ ID NO: 2359266 - RNA, 22 nt, Bordetella pertussis
cgagccgguacagccaggccag

SEQ ID NO: 2359267 - RNA, 16 nt, Bordetella pertussis
cgagccgguccgccuc

SEQ ID NO: 2359268 - RNA, 17 nt, Bordetella pertussis
cgagccgguccgccucg

SEQ ID NO: 2359269 - RNA, 22 nt, Bordetella pertussis
cgagccgguccgccucgcacag

SEQ ID NO: 2359270 - RNA, 19 nt, Bordetella pertussis
cgagccuaugaagacgcgc

SEQ ID NO: 2359271 - RNA, 24 nt, Bordetella pertussis
cgagccuaugaagacgcgcucgcc

SEQ ID NO: 2359272 - RNA, 21 nt, Bordetella pertussis
cgagccucacuccauagcgcc

SEQ ID NO: 2359273 - RNA, 22 nt, Bordetella pertussis
cgagccucacuccauagcgccg

SEQ ID NO: 2359274 - RNA, 15 nt, Bordetella pertussis
cgagccuucggccgg

SEQ ID NO: 2359275 - RNA, 16 nt, Bordetella pertussis
cgagccuucggccggc

SEQ ID NO: 2359276 - RNA, 14 nt, Bordetella pertussis
cgagcgaugcccug

SEQ ID NO: 2359277 - RNA, 16 nt, Bordetella pertussis
cgagcgcaagcaccgc

SEQ ID NO: 2359278 - RNA, 19 nt, Bordetella pertussis
cgagcgcaagcaccgccug

SEQ ID NO: 2359279 - RNA, 15 nt, Bordetella pertussis
cgagcgcacaggcgg

SEQ ID NO: 2359280 - RNA, 16 nt, Bordetella pertussis
cgagcgcacaggcggc

SEQ ID NO: 2359281 - RNA, 20 nt, Bordetella pertussis
cgagcgcacaggcggcgccg

SEQ ID NO: 2359282 - RNA, 16 nt, Bordetella pertussis
cgagcgcaccauggcg

SEQ ID NO: 2359283 - RNA, 23 nt, Bordetella pertussis
cgagcgcaccccggccgacggca

SEQ ID NO: 2359284 - RNA, 13 nt, Bordetella pertussis
cgagcgcagcaag

SEQ ID NO: 2359285 - RNA, 23 nt, Bordetella pertussis
cgagcgcagcaagcugcugcugg

SEQ ID NO: 2359286 - RNA, 21 nt, Bordetella pertussis
cgagcgccacauaaucgucgg

SEQ ID NO: 2359287 - RNA, 19 nt, Bordetella pertussis
cgagcgccgaaccuuccuc

SEQ ID NO: 2359288 - RNA, 20 nt, Bordetella pertussis
cgagcgccgaagucggcucg

SEQ ID NO: 2359289 - RNA, 17 nt, Bordetella pertussis
cgagcgccgccaggccg

SEQ ID NO: 2359290 - RNA, 15 nt, Bordetella pertussis
cgagcgccgcgcucc

SEQ ID NO: 2359291 - RNA, 17 nt, Bordetella pertussis
cgagcgccgcgcuccag

SEQ ID NO: 2359292 - RNA, 21 nt, Bordetella pertussis
cgagcgccgggcgccgcgccc

SEQ ID NO: 2359293 - RNA, 23 nt, Bordetella pertussis
cgagcgccucgcgcuccaugggc

SEQ ID NO: 2359294 - RNA, 16 nt, Bordetella pertussis
cgagcgccugcagcgu

SEQ ID NO: 2359295 - RNA, 16 nt, Bordetella pertussis
cgagcgccugggcggc

SEQ ID NO: 2359296 - RNA, 18 nt, Bordetella pertussis
cgagcgccugggcggcca

SEQ ID NO: 2359297 - RNA, 20 nt, Bordetella pertussis
cgagcgcgaaauccagcgcg

SEQ ID NO: 2359298 - RNA, 21 nt, Bordetella pertussis
cgagcgcgaaauccagcgcgc

SEQ ID NO: 2359299 - RNA, 14 nt, Bordetella pertussis
cgagcgcgacagca

SEQ ID NO: 2359300 - RNA, 18 nt, Bordetella pertussis
cgagcgcgacagcaccaa

SEQ ID NO: 2359301 - RNA, 15 nt, Bordetella pertussis
cgagcgcgacgcgcu

SEQ ID NO: 2359302 - RNA, 17 nt, Bordetella pertussis
cgagcgcgacgcgcucg

SEQ ID NO: 2359303 - RNA, 11 nt, Bordetella pertussis
cgagcgcgagc

SEQ ID NO: 2359304 - RNA, 15 nt, Bordetella pertussis
cgagcgcgagcaggg

SEQ ID NO: 2359305 - RNA, 13 nt, Bordetella pertussis
cgagcgcgccagc

SEQ ID NO: 2359306 - RNA, 16 nt, Bordetella pertussis
cgagcgcgccagcacg

SEQ ID NO: 2359307 - RNA, 11 nt, Bordetella pertussis
cgagcgcgccc

SEQ ID NO: 2359308 - RNA, 17 nt, Bordetella pertussis
cgagcgcgcgcaugcgc

SEQ ID NO: 2359309 - RNA, 19 nt, Bordetella pertussis
cgagcgcgcgcaugcgcac

SEQ ID NO: 2359310 - RNA, 22 nt, Bordetella pertussis
cgagcgcgcgcaugcgcacgcg

SEQ ID NO: 2359311 - RNA, 19 nt, Bordetella pertussis
cgagcgcggaucgaaguug

SEQ ID NO: 2359312 - RNA, 15 nt, Bordetella pertussis
cgagcgcggcauagc

SEQ ID NO: 2359313 - RNA, 20 nt, Bordetella pertussis
cgagcgcggcauagcccagg

SEQ ID NO: 2359314 - RNA, 22 nt, Bordetella pertussis
cgagcgcggcauagcccaggcc

SEQ ID NO: 2359315 - RNA, 14 nt, Bordetella pertussis
cgagcgcggcaugc

SEQ ID NO: 2359316 - RNA, 16 nt, Bordetella pertussis
cgagcgcggcaugcgc

SEQ ID NO: 2359317 - RNA, 17 nt, Bordetella pertussis
cgagcgcggcaugcgca

SEQ ID NO: 2359318 - RNA, 15 nt, Bordetella pertussis
cgagcgcggccaggc

SEQ ID NO: 2359319 - RNA, 16 nt, Bordetella pertussis
cgagcgcggccaggcg

SEQ ID NO: 2359320 - RNA, 23 nt, Bordetella pertussis
cgagcgcggcgauacgcgccgcc

SEQ ID NO: 2359321 - RNA, 14 nt, Bordetella pertussis
cgagcgcggcgcgc

SEQ ID NO: 2359322 - RNA, 17 nt, Bordetella pertussis
cgagcgcggcgcgcgcc

SEQ ID NO: 2359323 - RNA, 21 nt, Bordetella pertussis
cgagcgcggcgggugccgcga

SEQ ID NO: 2359324 - RNA, 23 nt, Bordetella pertussis
cgagcgcggcgggugccgcgaga

SEQ ID NO: 2359325 - RNA, 17 nt, Bordetella pertussis
cgagcgcgguggccgcu

SEQ ID NO: 2359326 - RNA, 21 nt, Bordetella pertussis
cgagcgcguggaaccgccgcu

SEQ ID NO: 2359327 - RNA, 22 nt, Bordetella pertussis
cgagcgcguggaaccgccgcuu

SEQ ID NO: 2359328 - RNA, 14 nt, Bordetella pertussis
cgagcgcucccgcc

SEQ ID NO: 2359329 - RNA, 15 nt, Bordetella pertussis
cgagcgcucccgcca

SEQ ID NO: 2359330 - RNA, 20 nt, Bordetella pertussis
cgagcgcucgcucacggggc

SEQ ID NO: 2359331 - RNA, 22 nt, Bordetella pertussis
cgagcgcucgcucacggggcug

SEQ ID NO: 2359332 - RNA, 14 nt, Bordetella pertussis
cgagcggcagcagc

SEQ ID NO: 2359333 - RNA, 15 nt, Bordetella pertussis
cgagcggcagcagcg

SEQ ID NO: 2359334 - RNA, 14 nt, Bordetella pertussis
cgagcggccagccu

SEQ ID NO: 2359335 - RNA, 23 nt, Bordetella pertussis
cgagcggccagccugccgcggcc

SEQ ID NO: 2359336 - RNA, 21 nt, Bordetella pertussis
cgagcggcgccagucgcgcag

SEQ ID NO: 2359337 - RNA, 20 nt, Bordetella pertussis
cgagcggcggcuucgcgcag

SEQ ID NO: 2359338 - RNA, 22 nt, Bordetella pertussis
cgagcggcggcuucgcgcagca

SEQ ID NO: 2359339 - RNA, 15 nt, Bordetella pertussis
cgagcggcgugcgcg

SEQ ID NO: 2359340 - RNA, 19 nt, Bordetella pertussis
cgagcggcgugcgcgugca

SEQ ID NO: 2359341 - RNA, 15 nt, Bordetella pertussis
cgagcgggcaugggc

SEQ ID NO: 2359342 - RNA, 18 nt, Bordetella pertussis
cgagcgggccagcgcggc

SEQ ID NO: 2359343 - RNA, 19 nt, Bordetella pertussis
cgagcgggccagcgcggcc

SEQ ID NO: 2359344 - RNA, 13 nt, Bordetella pertussis
cgagcgggcccga

SEQ ID NO: 2359345 - RNA, 19 nt, Bordetella pertussis
cgagcgggcccgacagcgc

SEQ ID NO: 2359346 - RNA, 21 nt, Bordetella pertussis
cgagcgggcccgacagcgccc

SEQ ID NO: 2359347 - RNA, 13 nt, Bordetella pertussis
cgagcgggccggu

SEQ ID NO: 2359348 - RNA, 12 nt, Bordetella pertussis
cgagcgggcgcc

SEQ ID NO: 2359349 - RNA, 19 nt, Bordetella pertussis
cgagcgggugaugcugcag

SEQ ID NO: 2359350 - RNA, 21 nt, Bordetella pertussis
cgagcgggugaugcugcagcg

SEQ ID NO: 2359351 - RNA, 21 nt, Bordetella pertussis
cgagcguguugcgugcgagca

SEQ ID NO: 2359352 - RNA, 13 nt, Bordetella pertussis
cgaggggcccuug

SEQ ID NO: 2359353 - RNA, 21 nt, Bordetella pertussis
cgaggggcccuugugcugcca

SEQ ID NO: 2359354 - RNA, 21 nt, Bordetella pertussis
cgagggggcuuuuugccuugg

SEQ ID NO: 2359355 - RNA, 16 nt, Bordetella pertussis
cgagggucaggcgcgc

SEQ ID NO: 2359356 - RNA, 23 nt, Bordetella pertussis
cgagguaagugggcugcggcgug

SEQ ID NO: 2359357 - RNA, 20 nt, Bordetella pertussis
cgagguagggcgcggccagg

SEQ ID NO: 2359358 - RNA, 12 nt, Bordetella pertussis
cgagguccaggc

SEQ ID NO: 2359359 - RNA, 13 nt, Bordetella pertussis
cgagguccaggcg

SEQ ID NO: 2359360 - RNA, 14 nt, Bordetella pertussis
cgagguccaggcgg

SEQ ID NO: 2359361 - RNA, 19 nt, Bordetella pertussis
cgagguccgcauggguucg

SEQ ID NO: 2359362 - RNA, 14 nt, Bordetella pertussis
cgaggucgcccuug

SEQ ID NO: 2359363 - RNA, 12 nt, Bordetella pertussis
cgaggucggcgg

SEQ ID NO: 2359364 - RNA, 22 nt, Bordetella pertussis
cgaggugcacgugggcacgccg

SEQ ID NO: 2359365 - RNA, 19 nt, Bordetella pertussis
cgaggugccggacgccgac

SEQ ID NO: 2359366 - RNA, 15 nt, Bordetella pertussis
cgaggugccggcggu

SEQ ID NO: 2359367 - RNA, 22 nt, Bordetella pertussis
cgaggugccggcggugaugacg

SEQ ID NO: 2359368 - RNA, 23 nt, Bordetella pertussis
cgagguggaugcguucgcggccc

SEQ ID NO: 2359369 - RNA, 14 nt, Bordetella pertussis
cgaggugggcggca

SEQ ID NO: 2359370 - RNA, 16 nt, Bordetella pertussis
cgaggugggcggcagc

SEQ ID NO: 2359371 - RNA, 22 nt, Bordetella pertussis
cgaggugggcggcagcaggcgc

SEQ ID NO: 2359372 - RNA, 16 nt, Bordetella pertussis
cgagguugcaggccag

SEQ ID NO: 2359373 - RNA, 17 nt, Bordetella pertussis
cgagguugcaggccagg

SEQ ID NO: 2359374 - RNA, 17 nt, Bordetella pertussis
cgagguuuccgccaugc

SEQ ID NO: 2359375 - RNA, 21 nt, Bordetella pertussis
cgagguuuccgccaugcggcg

SEQ ID NO: 2359376 - RNA, 13 nt, Bordetella pertussis
cgaguaccgccgc

SEQ ID NO: 2359377 - RNA, 13 nt, Bordetella pertussis
cgaguaggccggc

SEQ ID NO: 2359378 - RNA, 16 nt, Bordetella pertussis
cgaguauucacgccgc

SEQ ID NO: 2359379 - RNA, 20 nt, Bordetella pertussis
cgaguccuugacgccgccga

SEQ ID NO: 2359380 - RNA, 23 nt, Bordetella pertussis
cgagucggcgauggcgcgcgcca

SEQ ID NO: 2359381 - RNA, 14 nt, Bordetella pertussis
cgagugcaggcccg

SEQ ID NO: 2359382 - RNA, 19 nt, Bordetella pertussis
cgagugcaggcccgacagg

SEQ ID NO: 2359383 - RNA, 18 nt, Bordetella pertussis
cgagugcgccccgccacg

SEQ ID NO: 2359384 - RNA, 13 nt, Bordetella pertussis
cgagugcuugacg

SEQ ID NO: 2359385 - RNA, 20 nt, Bordetella pertussis
cgagugggcggccuugccgg

SEQ ID NO: 2359386 - RNA, 15 nt, Bordetella pertussis
cgaguucggcgcgcc

SEQ ID NO: 2359387 - RNA, 17 nt, Bordetella pertussis
cgaguucggcgcgcccg

SEQ ID NO: 2359388 - RNA, 18 nt, Bordetella pertussis
cgaguucggcgcgcccgc

SEQ ID NO: 2359389 - RNA, 17 nt, Bordetella pertussis
cgaguucgucgucgcca

SEQ ID NO: 2359390 - RNA, 22 nt, Bordetella pertussis
cgaguugaggaugcgcgcggcc

SEQ ID NO: 2359391 - RNA, 14 nt, Bordetella pertussis
cgaguugcgcgcca

SEQ ID NO: 2359392 - RNA, 13 nt, Bordetella pertussis
cgaguugcucgga

SEQ ID NO: 2359393 - RNA, 18 nt, Bordetella pertussis
cgauacaaggugccuguc

SEQ ID NO: 2359394 - RNA, 18 nt, Bordetella pertussis
cgauacagcuuggcgcgc

SEQ ID NO: 2359395 - RNA, 14 nt, Bordetella pertussis
cgauacaggcgcuc

SEQ ID NO: 2359396 - RNA, 20 nt, Bordetella pertussis
cgauacaggcgcucgcgcug

SEQ ID NO: 2359397 - RNA, 14 nt, Bordetella pertussis
cgauaccacgcgcg

SEQ ID NO: 2359398 - RNA, 21 nt, Bordetella pertussis
cgauaccgcaaacgugguguc

SEQ ID NO: 2359399 - RNA, 17 nt, Bordetella pertussis
cgauaccgucgcgcucg

SEQ ID NO: 2359400 - RNA, 18 nt, Bordetella pertussis
cgauaccgucgcgcucga

SEQ ID NO: 2359401 - RNA, 15 nt, Bordetella pertussis
cgauacgacacgccg

SEQ ID NO: 2359402 - RNA, 19 nt, Bordetella pertussis
cgauacgacacgccgcgcg

SEQ ID NO: 2359403 - RNA, 18 nt, Bordetella pertussis
cgauacgcgccgccuggc

SEQ ID NO: 2359404 - RNA, 14 nt, Bordetella pertussis
cgauacgcgugcgc

SEQ ID NO: 2359405 - RNA, 18 nt, Bordetella pertussis
cgauacgcgugcgcggcc

SEQ ID NO: 2359406 - RNA, 21 nt, Bordetella pertussis
cgauacgcgugcgcggccgcg

SEQ ID NO: 2359407 - RNA, 17 nt, Bordetella pertussis
cgauacugcgcaugggc

SEQ ID NO: 2359408 - RNA, 23 nt, Bordetella pertussis
cgauagauggccagguggcggcg

SEQ ID NO: 2359409 - RNA, 16 nt, Bordetella pertussis
cgauagccgcgcgccu

SEQ ID NO: 2359410 - RNA, 22 nt, Bordetella pertussis
cgauagccgcgcgccugcagca

SEQ ID NO: 2359411 - RNA, 18 nt, Bordetella pertussis
cgauagccgugaccugcu

SEQ ID NO: 2359412 - RNA, 19 nt, Bordetella pertussis
cgauagccgugaccugcuc

SEQ ID NO: 2359413 - RNA, 13 nt, Bordetella pertussis
cgauagcgccgcg

SEQ ID NO: 2359414 - RNA, 19 nt, Bordetella pertussis
cgauagcgcuugccugacg

SEQ ID NO: 2359415 - RNA, 17 nt, Bordetella pertussis
cgauagcgggccugcag

SEQ ID NO: 2359416 - RNA, 15 nt, Bordetella pertussis
cgauaggugcgcagc

SEQ ID NO: 2359417 - RNA, 16 nt, Bordetella pertussis
cgauaggugcgcagcc

SEQ ID NO: 2359418 - RNA, 16 nt, Bordetella pertussis
cgauauccaggcgcgu

SEQ ID NO: 2359419 - RNA, 15 nt, Bordetella pertussis
cgauauccagguagg

SEQ ID NO: 2359420 - RNA, 15 nt, Bordetella pertussis
cgauauccaucggcg

SEQ ID NO: 2359421 - RNA, 12 nt, Bordetella pertussis
cgauaucccaug

SEQ ID NO: 2359422 - RNA, 17 nt, Bordetella pertussis
cgauaucccaugggacg

SEQ ID NO: 2359423 - RNA, 23 nt, Bordetella pertussis
cgauauccuugcgcucgcccagc

SEQ ID NO: 2359424 - RNA, 12 nt, Bordetella pertussis
cgauaucgccau

SEQ ID NO: 2359425 - RNA, 16 nt, Bordetella pertussis
cgauaugcagcaccgg

SEQ ID NO: 2359426 - RNA, 19 nt, Bordetella pertussis
cgauaugcagccgcaccag

SEQ ID NO: 2359427 - RNA, 20 nt, Bordetella pertussis
cgauaugcagccgcaccagc

SEQ ID NO: 2359428 - RNA, 22 nt, Bordetella pertussis
cgauaugcgagacgaaggcgcc

SEQ ID NO: 2359429 - RNA, 23 nt, Bordetella pertussis
cgauaugcgagacgaaggcgccg

SEQ ID NO: 2359430 - RNA, 14 nt, Bordetella pertussis
cgauauuggcgucg

SEQ ID NO: 2359431 - RNA, 17 nt, Bordetella pertussis
cgauauuggcgucggcc

SEQ ID NO: 2359432 - RNA, 19 nt, Bordetella pertussis
cgauauugguguugccggc

SEQ ID NO: 2359433 - RNA, 22 nt, Bordetella pertussis
cgauauugguguugccggccag

SEQ ID NO: 2359434 - RNA, 18 nt, Bordetella pertussis
cgaucaacgugcgccagg

SEQ ID NO: 2359435 - RNA, 19 nt, Bordetella pertussis
cgaucaacgugcgccaggc

SEQ ID NO: 2359436 - RNA, 21 nt, Bordetella pertussis
cgaucaacgugcgccaggcaa

SEQ ID NO: 2359437 - RNA, 16 nt, Bordetella pertussis
cgaucaagagccugga

SEQ ID NO: 2359438 - RNA, 17 nt, Bordetella pertussis
cgaucaagggguggcug

SEQ ID NO: 2359439 - RNA, 18 nt, Bordetella pertussis
cgaucaccacgcccgcgc

SEQ ID NO: 2359440 - RNA, 22 nt, Bordetella pertussis
cgaucaccacgcccgcgccgca

SEQ ID NO: 2359441 - RNA, 16 nt, Bordetella pertussis
cgaucaccgccgcggc

SEQ ID NO: 2359442 - RNA, 18 nt, Bordetella pertussis
cgaucaccugcguggccg

SEQ ID NO: 2359443 - RNA, 19 nt, Bordetella pertussis
cgaucacgaacagcgccag

SEQ ID NO: 2359444 - RNA, 20 nt, Bordetella pertussis
cgaucacgaacagcgccagg

SEQ ID NO: 2359445 - RNA, 21 nt, Bordetella pertussis
cgaucacgaacagcgccaggc

SEQ ID NO: 2359446 - RNA, 23 nt, Bordetella pertussis
cgaucacgccgaaggcgugaggc

SEQ ID NO: 2359447 - RNA, 18 nt, Bordetella pertussis
cgaucacggccaacccuc

SEQ ID NO: 2359448 - RNA, 13 nt, Bordetella pertussis
cgaucacggcgcg

SEQ ID NO: 2359449 - RNA, 17 nt, Bordetella pertussis
cgaucacggcgcgcgcc

SEQ ID NO: 2359450 - RNA, 18 nt, Bordetella pertussis
cgaucacggcgcgcgccu

SEQ ID NO: 2359451 - RNA, 22 nt, Bordetella pertussis
cgaucacgggcuguucgcgcag

SEQ ID NO: 2359452 - RNA, 24 nt, Bordetella pertussis
cgaucacgggcuguucgcgcagca

SEQ ID NO: 2359453 - RNA, 12 nt, Bordetella pertussis
cgaucagcacca

SEQ ID NO: 2359454 - RNA, 20 nt, Bordetella pertussis
cgaucagcaccacggcggcc

SEQ ID NO: 2359455 - RNA, 15 nt, Bordetella pertussis
cgaucagcaggucgg

SEQ ID NO: 2359456 - RNA, 16 nt, Bordetella pertussis
cgaucagcaggucggc

SEQ ID NO: 2359457 - RNA, 22 nt, Bordetella pertussis
cgaucagcaggucggcgcggcc

SEQ ID NO: 2359458 - RNA, 21 nt, Bordetella pertussis
cgaucagccacgugaagcgcc

SEQ ID NO: 2359459 - RNA, 14 nt, Bordetella pertussis
cgaucagccagccg

SEQ ID NO: 2359460 - RNA, 15 nt, Bordetella pertussis
cgaucagccagccgg

SEQ ID NO: 2359461 - RNA, 16 nt, Bordetella pertussis
cgaucagccagccggc

SEQ ID NO: 2359462 - RNA, 20 nt, Bordetella pertussis
cgaucagccagccggcggcc

SEQ ID NO: 2359463 - RNA, 23 nt, Bordetella pertussis
cgaucagccagccggcggccagc

SEQ ID NO: 2359464 - RNA, 14 nt, Bordetella pertussis
cgaucugcgcggcg

SEQ ID NO: 2359465 - RNA, 14 nt, Bordetella pertussis
cgaucugcggcgug

SEQ ID NO: 2359466 - RNA, 18 nt, Bordetella pertussis
cgaucugcugggccgggu

SEQ ID NO: 2359467 - RNA, 12 nt, Bordetella pertussis
cgaucuggccga

SEQ ID NO: 2359468 - RNA, 21 nt, Bordetella pertussis
cgaucuggccgauggccucgc

SEQ ID NO: 2359469 - RNA, 14 nt, Bordetella pertussis
cgaucuggcgcgcg

SEQ ID NO: 2359470 - RNA, 21 nt, Bordetella pertussis
cgaucuggcgcgcgaccaggc

SEQ ID NO: 2359471 - RNA, 23 nt, Bordetella pertussis
cgaucuggcgcgcgaccaggcug

SEQ ID NO: 2359472 - RNA, 16 nt, Bordetella pertussis
cgaucuggcucacgau

SEQ ID NO: 2359473 - RNA, 19 nt, Bordetella pertussis
cgaucugggccucggccag

SEQ ID NO: 2359474 - RNA, 15 nt, Bordetella pertussis
cgaucuucagcacca

SEQ ID NO: 2359475 - RNA, 19 nt, Bordetella pertussis
cgaucuucagcaccagcuc

SEQ ID NO: 2359476 - RNA, 19 nt, Bordetella pertussis
cgaucuucucgacggcgcg

SEQ ID NO: 2359477 - RNA, 20 nt, Bordetella pertussis
cgaucuucuggacgcugacc

SEQ ID NO: 2359478 - RNA, 21 nt, Bordetella pertussis
cgaucuucuggacuugcggca

SEQ ID NO: 2359479 - RNA, 17 nt, Bordetella pertussis
cgaucuugccggccugg

SEQ ID NO: 2359480 - RNA, 22 nt, Bordetella pertussis
cgaucuuguaggcgauccaggc

SEQ ID NO: 2359481 - RNA, 14 nt, Bordetella pertussis
cgaugaacagcggc

SEQ ID NO: 2359482 - RNA, 20 nt, Bordetella pertussis
cgaugaacagcggcacgccg

SEQ ID NO: 2359483 - RNA, 16 nt, Bordetella pertussis
cgaugaacgacagggu

SEQ ID NO: 2359484 - RNA, 22 nt, Bordetella pertussis
cgaugaacgacccggucgugua

SEQ ID NO: 2359485 - RNA, 15 nt, Bordetella pertussis
cgaugaacgcgcgca

SEQ ID NO: 2359486 - RNA, 19 nt, Bordetella pertussis
cgaugaagacgaugguggc

SEQ ID NO: 2359487 - RNA, 20 nt, Bordetella pertussis
cgaugaagcccgagcggcgc

SEQ ID NO: 2359488 - RNA, 22 nt, Bordetella pertussis
cgaugaagcccgagcggcgcca

SEQ ID NO: 2359489 - RNA, 19 nt, Bordetella pertussis
cgaugaaggugcgcagcag

SEQ ID NO: 2359490 - RNA, 20 nt, Bordetella pertussis
cgaugaaggugcgcagcagg

SEQ ID NO: 2359491 - RNA, 16 nt, Bordetella pertussis
cgaugaagucgcggcc

SEQ ID NO: 2359492 - RNA, 18 nt, Bordetella pertussis
cgaugaagucgcggcccg

SEQ ID NO: 2359493 - RNA, 20 nt, Bordetella pertussis
cgaugaagucgcggcccgcc

SEQ ID NO: 2359494 - RNA, 20 nt, Bordetella pertussis
cgaugaauuccagccaggcc

SEQ ID NO: 2359495 - RNA, 16 nt, Bordetella pertussis
cgaugaauugcgccac

SEQ ID NO: 2359496 - RNA, 13 nt, Bordetella pertussis
cgaugacaucgcc

SEQ ID NO: 2359497 - RNA, 15 nt, Bordetella pertussis
cgaugacaucgccgc

SEQ ID NO: 2359498 - RNA, 16 nt, Bordetella pertussis
cgaugacaucgccgcu

SEQ ID NO: 2359499 - RNA, 23 nt, Bordetella pertussis
cgaugacaucgccgcugcgcagc

SEQ ID NO: 2359500 - RNA, 14 nt, Bordetella pertussis
cgaugaccagcagc

SEQ ID NO: 2359501 - RNA, 21 nt, Bordetella pertussis
cgaugaccagcagcgaaucgc

SEQ ID NO: 2359502 - RNA, 19 nt, Bordetella pertussis
cgaugaccagcagcgccgg

SEQ ID NO: 2359503 - RNA, 17 nt, Bordetella pertussis
cgaugaccagccagccg

SEQ ID NO: 2359504 - RNA, 19 nt, Bordetella pertussis
cgaugaccaucacgagcag

SEQ ID NO: 2359505 - RNA, 14 nt, Bordetella pertussis
cgaugaccggccag

SEQ ID NO: 2359506 - RNA, 17 nt, Bordetella pertussis
cgaugaccggccaggcg

SEQ ID NO: 2359507 - RNA, 18 nt, Bordetella pertussis
cgaugaccggccaggcgc

SEQ ID NO: 2359508 - RNA, 23 nt, Bordetella pertussis
cgaugaccgggucgucgggcggc

SEQ ID NO: 2359509 - RNA, 16 nt, Bordetella pertussis
cgaugaccucgcgcug

SEQ ID NO: 2359510 - RNA, 15 nt, Bordetella pertussis
cgaugaccucggcga

SEQ ID NO: 2359511 - RNA, 19 nt, Bordetella pertussis
cgaugaccucggcgagcgc

SEQ ID NO: 2359512 - RNA, 20 nt, Bordetella pertussis
cgaugaccucggcgagcgcc

SEQ ID NO: 2359513 - RNA, 21 nt, Bordetella pertussis
cgaugaccucggcgagcgccu

SEQ ID NO: 2359514 - RNA, 14 nt, Bordetella pertussis
cgaugacgcgccgc

SEQ ID NO: 2359515 - RNA, 15 nt, Bordetella pertussis
cgaugacgcgccgcg

SEQ ID NO: 2359516 - RNA, 17 nt, Bordetella pertussis
cgaugacggcuucgacc

SEQ ID NO: 2359517 - RNA, 18 nt, Bordetella pertussis
cgaugacggcuucgacca

SEQ ID NO: 2359518 - RNA, 20 nt, Bordetella pertussis
cgaugacggcuucgaccacg

SEQ ID NO: 2359519 - RNA, 13 nt, Bordetella pertussis
cgaugaggccgau

SEQ ID NO: 2359520 - RNA, 15 nt, Bordetella pertussis
cgaugaucacgcgcu

SEQ ID NO: 2359521 - RNA, 19 nt, Bordetella pertussis
cgaugaucacgcgcuccgg

SEQ ID NO: 2359522 - RNA, 14 nt, Bordetella pertussis
cgaugaucaugaug

SEQ ID NO: 2359523 - RNA, 14 nt, Bordetella pertussis
cgaugaucgcgccg

SEQ ID NO: 2359524 - RNA, 18 nt, Bordetella pertussis
cgaugaucgcgccgacga

SEQ ID NO: 2359525 - RNA, 15 nt, Bordetella pertussis
cgaugaugagcgcgc

SEQ ID NO: 2359526 - RNA, 16 nt, Bordetella pertussis
cgaugaugagcgcgcc

SEQ ID NO: 2359527 - RNA, 19 nt, Bordetella pertussis
cgaugaugagcgcgccgcc

SEQ ID NO: 2359528 - RNA, 20 nt, Bordetella pertussis
cgaugaugagcgcgccgccg

SEQ ID NO: 2359529 - RNA, 15 nt, Bordetella pertussis
cgaugaugcccagga

SEQ ID NO: 2359530 - RNA, 16 nt, Bordetella pertussis
cgaugaugcccaggau

SEQ ID NO: 2359531 - RNA, 19 nt, Bordetella pertussis
cgaugauggauucgcgccg

SEQ ID NO: 2359532 - RNA, 20 nt, Bordetella pertussis
cgaugauggauucgcgccgg

SEQ ID NO: 2359533 - RNA, 15 nt, Bordetella pertussis
cgaugauggcguccg

SEQ ID NO: 2359534 - RNA, 22 nt, Bordetella pertussis
cgaugauggggucgccgggcag

SEQ ID NO: 2359535 - RNA, 19 nt, Bordetella pertussis
cgaugauggugaacgccac

SEQ ID NO: 2359536 - RNA, 23 nt, Bordetella pertussis
cgaugauggugaacgccaccagg

SEQ ID NO: 2359537 - RNA, 18 nt, Bordetella pertussis
cgaugaugugguagccgc

SEQ ID NO: 2359538 - RNA, 16 nt, Bordetella pertussis
cgaugcaauagcgccc

SEQ ID NO: 2359539 - RNA, 21 nt, Bordetella pertussis
cgaugcaauagcgcccgccuu

SEQ ID NO: 2359540 - RNA, 21 nt, Bordetella pertussis
cgaugcacggaacgugccguc

SEQ ID NO: 2359541 - RNA, 23 nt, Bordetella pertussis
cgaugcaugaaccgcagcgccac

SEQ ID NO: 2359542 - RNA, 15 nt, Bordetella pertussis
cgaugcauucggcgg

SEQ ID NO: 2359543 - RNA, 16 nt, Bordetella pertussis
cgaugcauucggcggc

SEQ ID NO: 2359544 - RNA, 19 nt, Bordetella pertussis
cgaugcauucggcggccgg

SEQ ID NO: 2359545 - RNA, 21 nt, Bordetella pertussis
cgaugccagugaaacgcgacg

SEQ ID NO: 2359546 - RNA, 12 nt, Bordetella pertussis
cgaugcccacca

SEQ ID NO: 2359547 - RNA, 16 nt, Bordetella pertussis
cgaugcccaccagccg

SEQ ID NO: 2359548 - RNA, 17 nt, Bordetella pertussis
cgaugcccaccagccgc

SEQ ID NO: 2359549 - RNA, 18 nt, Bordetella pertussis
cgaugcccaccagccgcc

SEQ ID NO: 2359550 - RNA, 22 nt, Bordetella pertussis
cgaugcccaccagccgcccggc

SEQ ID NO: 2359551 - RNA, 11 nt, Bordetella pertussis
cgaugcccagc

SEQ ID NO: 2359552 - RNA, 18 nt, Bordetella pertussis
cgaugcccagcaccgcca

SEQ ID NO: 2359553 - RNA, 17 nt, Bordetella pertussis
cgaugcccagcgccgcc

SEQ ID NO: 2359554 - RNA, 15 nt, Bordetella pertussis
cgaugcccaggcccg

SEQ ID NO: 2359555 - RNA, 21 nt, Bordetella pertussis
cgaugcccaggcccgccaggg

SEQ ID NO: 2359556 - RNA, 16 nt, Bordetella pertussis
cgaugcccagggccgc

SEQ ID NO: 2359557 - RNA, 14 nt, Bordetella pertussis
cgaugcccaggucg

SEQ ID NO: 2359558 - RNA, 20 nt, Bordetella pertussis
cgaugccccaguccaggccg

SEQ ID NO: 2359559 - RNA, 13 nt, Bordetella pertussis
cgaugcccgacga

SEQ ID NO: 2359560 - RNA, 14 nt, Bordetella pertussis
cgaugcccgacgac

SEQ ID NO: 2359561 - RNA, 18 nt, Bordetella pertussis
cgaugcccgcgcaccagg

SEQ ID NO: 2359562 - RNA, 19 nt, Bordetella pertussis
cgaugcccgcgcaccaggc

SEQ ID NO: 2359563 - RNA, 16 nt, Bordetella pertussis
cgaugcccucgcgcac

SEQ ID NO: 2359564 - RNA, 17 nt, Bordetella pertussis
cgaugcccucgcgcacg

SEQ ID NO: 2359565 - RNA, 20 nt, Bordetella pertussis
cgaugcccucgcgcacggug

SEQ ID NO: 2359566 - RNA, 14 nt, Bordetella pertussis
cgaugcccugcgcc

SEQ ID NO: 2359567 - RNA, 15 nt, Bordetella pertussis
cgaugcccugcgcca

SEQ ID NO: 2359568 - RNA, 13 nt, Bordetella pertussis
cgaugcccuggau

SEQ ID NO: 2359569 - RNA, 20 nt, Bordetella pertussis
cgaugccgaacaaaccgucg

SEQ ID NO: 2359570 - RNA, 14 nt, Bordetella pertussis
cgaugccgaacucg

SEQ ID NO: 2359571 - RNA, 18 nt, Bordetella pertussis
cgaugccgaccaggcugc

SEQ ID NO: 2359572 - RNA, 15 nt, Bordetella pertussis
cgaugccgaccgagc

SEQ ID NO: 2359573 - RNA, 21 nt, Bordetella pertussis
cgaugccgauacgucgcagca

SEQ ID NO: 2359574 - RNA, 16 nt, Bordetella pertussis
cgaugccgcagauggc

SEQ ID NO: 2359575 - RNA, 18 nt, Bordetella pertussis
cgaugccgcagauggcca

SEQ ID NO: 2359576 - RNA, 21 nt, Bordetella pertussis
cgaugccgcagauggccagca

SEQ ID NO: 2359577 - RNA, 14 nt, Bordetella pertussis
cgauggcuuggcgc

SEQ ID NO: 2359578 - RNA, 18 nt, Bordetella pertussis
cgauggcuuggcgcuuac

SEQ ID NO: 2359579 - RNA, 23 nt, Bordetella pertussis
cgaugggcccgggcaggcucagc

SEQ ID NO: 2359580 - RNA, 14 nt, Bordetella pertussis
cgaugggccugccc

SEQ ID NO: 2359581 - RNA, 13 nt, Bordetella pertussis
cgauggggcagcc

SEQ ID NO: 2359582 - RNA, 20 nt, Bordetella pertussis
cgauggggccauggcacagg

SEQ ID NO: 2359583 - RNA, 15 nt, Bordetella pertussis
cgauggggccgucgc

SEQ ID NO: 2359584 - RNA, 17 nt, Bordetella pertussis
cgaugggguagucggcc

SEQ ID NO: 2359585 - RNA, 18 nt, Bordetella pertussis
cgaugggguagucggcca

SEQ ID NO: 2359586 - RNA, 20 nt, Bordetella pertussis
cgaugggguagucggccacc

SEQ ID NO: 2359587 - RNA, 22 nt, Bordetella pertussis
cgauggggucgggccgcgcgcg

SEQ ID NO: 2359588 - RNA, 18 nt, Bordetella pertussis
cgaugguaucggccgggc

SEQ ID NO: 2359589 - RNA, 21 nt, Bordetella pertussis
cgaugguaucggccgggccgg

SEQ ID NO: 2359590 - RNA, 20 nt, Bordetella pertussis
cgauggucacacugucgcca

SEQ ID NO: 2359591 - RNA, 15 nt, Bordetella pertussis
cgauggucaccaccc

SEQ ID NO: 2359592 - RNA, 17 nt, Bordetella pertussis
cgauggucaccacccgc

SEQ ID NO: 2359593 - RNA, 23 nt, Bordetella pertussis
cgauggucaccacccgcacgccg

SEQ ID NO: 2359594 - RNA, 14 nt, Bordetella pertussis
cgauggucagcaug

SEQ ID NO: 2359595 - RNA, 15 nt, Bordetella pertussis
cgauggucggccgga

SEQ ID NO: 2359596 - RNA, 21 nt, Bordetella pertussis
cgauggucggccggaugcgca

SEQ ID NO: 2359597 - RNA, 23 nt, Bordetella pertussis
cgauggucggccggaugcgcagg

SEQ ID NO: 2359598 - RNA, 18 nt, Bordetella pertussis
cgauggucuugccgccgu

SEQ ID NO: 2359599 - RNA, 16 nt, Bordetella pertussis
cgauggugcauucguc

SEQ ID NO: 2359600 - RNA, 15 nt, Bordetella pertussis
cgauggugccggccg

SEQ ID NO: 2359601 - RNA, 16 nt, Bordetella pertussis
cgauggugccggccgu

SEQ ID NO: 2359602 - RNA, 18 nt, Bordetella pertussis
cgauggugccggccgucu

SEQ ID NO: 2359603 - RNA, 15 nt, Bordetella pertussis
cgauggugccgggcu

SEQ ID NO: 2359604 - RNA, 22 nt, Bordetella pertussis
cgauggugcgggcgauuucguc

SEQ ID NO: 2359605 - RNA, 20 nt, Bordetella pertussis
cgaugguggcguucucgacc

SEQ ID NO: 2359606 - RNA, 23 nt, Bordetella pertussis
cgaugguggcguucucgacccgc

SEQ ID NO: 2359607 - RNA, 17 nt, Bordetella pertussis
cgauguagagggucugg

SEQ ID NO: 2359608 - RNA, 21 nt, Bordetella pertussis
cgauguagagggucuggccgg

SEQ ID NO: 2359609 - RNA, 18 nt, Bordetella pertussis
cgauguagaucuggcgcg

SEQ ID NO: 2359610 - RNA, 23 nt, Bordetella pertussis
cgauguagaucuggcgcgucagg

SEQ ID NO: 2359611 - RNA, 15 nt, Bordetella pertussis
cgauguagcccaugg

SEQ ID NO: 2359612 - RNA, 13 nt, Bordetella pertussis
cgauguagccgac

SEQ ID NO: 2359613 - RNA, 18 nt, Bordetella pertussis
cgauguagggcagcucgc

SEQ ID NO: 2359614 - RNA, 19 nt, Bordetella pertussis
cgauguccacgaaggcgcc

SEQ ID NO: 2359615 - RNA, 14 nt, Bordetella pertussis
cgauguccagcgag

SEQ ID NO: 2359616 - RNA, 15 nt, Bordetella pertussis
cgauguccagcgagc

SEQ ID NO: 2359617 - RNA, 14 nt, Bordetella pertussis
cgaugucgaacagc

SEQ ID NO: 2359618 - RNA, 15 nt, Bordetella pertussis
cgaugucgaacagcu

SEQ ID NO: 2359619 - RNA, 22 nt, Bordetella pertussis
cgaugucgaggaucaugucguc

SEQ ID NO: 2359620 - RNA, 14 nt, Bordetella pertussis
cgaugucgcccaug

SEQ ID NO: 2359621 - RNA, 15 nt, Bordetella pertussis
cgaugucgcccaugc

SEQ ID NO: 2359622 - RNA, 20 nt, Bordetella pertussis
cgaugucgccgccgcgcacc

SEQ ID NO: 2359623 - RNA, 17 nt, Bordetella pertussis
cgaugucgccgccugcg

SEQ ID NO: 2359624 - RNA, 16 nt, Bordetella pertussis
cgaugucgcgcgcgcu

SEQ ID NO: 2359625 - RNA, 20 nt, Bordetella pertussis
cgaugucguacacaugcuug

SEQ ID NO: 2359626 - RNA, 16 nt, Bordetella pertussis
cgaugucguccagcuc

SEQ ID NO: 2359627 - RNA, 20 nt, Bordetella pertussis
cgaugucguccagcuccagg

SEQ ID NO: 2359628 - RNA, 19 nt, Bordetella pertussis
cgaugucgugaucgccagc

SEQ ID NO: 2359629 - RNA, 17 nt, Bordetella pertussis
cgaugugcaugccgucg

SEQ ID NO: 2359630 - RNA, 18 nt, Bordetella pertussis
cgaugugcaugccgucgc

SEQ ID NO: 2359631 - RNA, 16 nt, Bordetella pertussis
cgauguggccuaccgc

SEQ ID NO: 2359632 - RNA, 16 nt, Bordetella pertussis
cgauguggcgcgccau

SEQ ID NO: 2359633 - RNA, 14 nt, Bordetella pertussis
cgauguggcgcugg

SEQ ID NO: 2359634 - RNA, 18 nt, Bordetella pertussis
cgauguggcgcuggcggc

SEQ ID NO: 2359635 - RNA, 21 nt, Bordetella pertussis
cgauguggcgcuggcggcugc

SEQ ID NO: 2359636 - RNA, 17 nt, Bordetella pertussis
cgauguuacagaugggc

SEQ ID NO: 2359637 - RNA, 18 nt, Bordetella pertussis
cgauguucacgcgcaagc

SEQ ID NO: 2359638 - RNA, 17 nt, Bordetella pertussis
cgauguucaggccaugc

SEQ ID NO: 2359639 - RNA, 14 nt, Bordetella pertussis
cgauguucggaugc

SEQ ID NO: 2359640 - RNA, 14 nt, Bordetella pertussis
cgauguugaacagc

SEQ ID NO: 2359641 - RNA, 17 nt, Bordetella pertussis
cgauguugaacagcugg

SEQ ID NO: 2359642 - RNA, 16 nt, Bordetella pertussis
cgauguugccgccggc

SEQ ID NO: 2359643 - RNA, 15 nt, Bordetella pertussis
cgauguugcgcaggc

SEQ ID NO: 2359644 - RNA, 18 nt, Bordetella pertussis
cgauguuguuggccgcca

SEQ ID NO: 2359645 - RNA, 16 nt, Bordetella pertussis
cgauuaugccgcccgc

SEQ ID NO: 2359646 - RNA, 16 nt, Bordetella pertussis
cgauuccagcgccgcc

SEQ ID NO: 2359647 - RNA, 18 nt, Bordetella pertussis
cgauuccagcgccgccuu

SEQ ID NO: 2359648 - RNA, 13 nt, Bordetella pertussis
cgauucccuggcg

SEQ ID NO: 2359649 - RNA, 18 nt, Bordetella pertussis
cgauucccuggcgcgcca

SEQ ID NO: 2359650 - RNA, 20 nt, Bordetella pertussis
cgauucccuggcgcgccagc

SEQ ID NO: 2359651 - RNA, 20 nt, Bordetella pertussis
cgauucuuuccuggccggcg

SEQ ID NO: 2359652 - RNA, 13 nt, Bordetella pertussis
cgauugaccagca

SEQ ID NO: 2359653 - RNA, 18 nt, Bordetella pertussis
cgauugaccagcaccagc

SEQ ID NO: 2359654 - RNA, 19 nt, Bordetella pertussis
cgauugaccagcaccagcg

SEQ ID NO: 2359655 - RNA, 18 nt, Bordetella pertussis
cgauugaggccagcacgc

SEQ ID NO: 2359656 - RNA, 14 nt, Bordetella pertussis
cgauugcagguggc

SEQ ID NO: 2359657 - RNA, 15 nt, Bordetella pertussis
cgauugcagguggcc

SEQ ID NO: 2359658 - RNA, 19 nt, Bordetella pertussis
cgauugcagguggccagcc

SEQ ID NO: 2359659 - RNA, 22 nt, Bordetella pertussis
cgauugcagguggccagcccgg

SEQ ID NO: 2359660 - RNA, 23 nt, Bordetella pertussis
cgauugcagguggccagcccggu

SEQ ID NO: 2359661 - RNA, 20 nt, Bordetella pertussis
cgauugcaguacccaguacg

SEQ ID NO: 2359662 - RNA, 14 nt, Bordetella pertussis
cgauugucgucgcg

SEQ ID NO: 2359663 - RNA, 19 nt, Bordetella pertussis
cgauugucgucgcgcgaga

SEQ ID NO: 2359664 - RNA, 19 nt, Bordetella pertussis
cgauugugcaugacggcca

SEQ ID NO: 2359665 - RNA, 18 nt, Bordetella pertussis
cgauuucacccagggugu

SEQ ID NO: 2359666 - RNA, 22 nt, Bordetella pertussis
cgauuuccgcuaccaggcgcgc

SEQ ID NO: 2359667 - RNA, 19 nt, Bordetella pertussis
cgauuucgcgcgccagcgc

SEQ ID NO: 2359668 - RNA, 14 nt, Bordetella pertussis
cgauuucggccgcc

SEQ ID NO: 2359669 - RNA, 17 nt, Bordetella pertussis
cgauuucggccgccggc

SEQ ID NO: 2359670 - RNA, 17 nt, Bordetella pertussis
cgauuucggcggccagg

SEQ ID NO: 2359671 - RNA, 20 nt, Bordetella pertussis
cgauuucuucgccuggccgg

SEQ ID NO: 2359672 - RNA, 18 nt, Bordetella pertussis
cgauuugccgcagcccgc

SEQ ID NO: 2359673 - RNA, 20 nt, Bordetella pertussis
cgcaaaacgcaugaccugcg

SEQ ID NO: 2359674 - RNA, 18 nt, Bordetella pertussis
cgcaaaccgacgcggcca

SEQ ID NO: 2359675 - RNA, 19 nt, Bordetella pertussis
cgcaaaccgacgcggccag

SEQ ID NO: 2359676 - RNA, 22 nt, Bordetella pertussis
cgcaaaccgacgcggccagcgg

SEQ ID NO: 2359677 - RNA, 13 nt, Bordetella pertussis
cgcaaaccugccg

SEQ ID NO: 2359678 - RNA, 14 nt, Bordetella pertussis
cgcaacacgcgcga

SEQ ID NO: 2359679 - RNA, 16 nt, Bordetella pertussis
cgcaacagacccgggc

SEQ ID NO: 2359680 - RNA, 22 nt, Bordetella pertussis
cgcaacagacccgggccgcugg

SEQ ID NO: 2359681 - RNA, 12 nt, Bordetella pertussis
cgcaacaggucg

SEQ ID NO: 2359682 - RNA, 14 nt, Bordetella pertussis
cgcaaccaggggcg

SEQ ID NO: 2359683 - RNA, 22 nt, Bordetella pertussis
cgcaaccaggggcggcgcggcg

SEQ ID NO: 2359684 - RNA, 18 nt, Bordetella pertussis
cgcaacccacccccagca

SEQ ID NO: 2359685 - RNA, 12 nt, Bordetella pertussis
cgcaacccagca

SEQ ID NO: 2359686 - RNA, 14 nt, Bordetella pertussis
cgcaacccagcagc

SEQ ID NO: 2359687 - RNA, 18 nt, Bordetella pertussis
cgcaacccgcuuuuuccu

SEQ ID NO: 2359688 - RNA, 15 nt, Bordetella pertussis
cgcaacccggccucg

SEQ ID NO: 2359689 - RNA, 14 nt, Bordetella pertussis
cgcaaccggcccga

SEQ ID NO: 2359690 - RNA, 15 nt, Bordetella pertussis
cgcaccagcgcgccg

SEQ ID NO: 2359691 - RNA, 15 nt, Bordetella pertussis
cgcaccaggcccaug

SEQ ID NO: 2359692 - RNA, 12 nt, Bordetella pertussis
cgcaccaggccg

SEQ ID NO: 2359693 - RNA, 13 nt, Bordetella pertussis
cgcaccaggccgc

SEQ ID NO: 2359694 - RNA, 16 nt, Bordetella pertussis
cgcaccaggcgcggcg

SEQ ID NO: 2359695 - RNA, 19 nt, Bordetella pertussis
cgcaccaggcgcucgcgcg

SEQ ID NO: 2359696 - RNA, 24 nt, Bordetella pertussis
cgcaccaggcgcucgcgcgccagc

SEQ ID NO: 2359697 - RNA, 12 nt, Bordetella pertussis
cgcaccaggcug

SEQ ID NO: 2359698 - RNA, 21 nt, Bordetella pertussis
cgcaccaggcuggggccgagc

SEQ ID NO: 2359699 - RNA, 19 nt, Bordetella pertussis
cgcaccaguuucucggcca

SEQ ID NO: 2359700 - RNA, 21 nt, Bordetella pertussis
cgcaccaguuucucggccacu

SEQ ID NO: 2359701 - RNA, 16 nt, Bordetella pertussis
cgcaccauggcgccca

SEQ ID NO: 2359702 - RNA, 21 nt, Bordetella pertussis
cgcaccauggcgcccacggcc

SEQ ID NO: 2359703 - RNA, 20 nt, Bordetella pertussis
cgcaccaugggcgucgucgc

SEQ ID NO: 2359704 - RNA, 12 nt, Bordetella pertussis
cgcaccaugugc

SEQ ID NO: 2359705 - RNA, 19 nt, Bordetella pertussis
cgcaccauucucgcccugc

SEQ ID NO: 2359706 - RNA, 14 nt, Bordetella pertussis
cgcacccaggccca

SEQ ID NO: 2359707 - RNA, 17 nt, Bordetella pertussis
cgcaccccggccgacgg

SEQ ID NO: 2359708 - RNA, 18 nt, Bordetella pertussis
cgcaccccggugucgccg

SEQ ID NO: 2359709 - RNA, 23 nt, Bordetella pertussis
cgcaccccggugucgccguggcg

SEQ ID NO: 2359710 - RNA, 24 nt, Bordetella pertussis
cgcacccgaugacggggcggcgcc

SEQ ID NO: 2359711 - RNA, 16 nt, Bordetella pertussis
cgcacccgccuggacg

SEQ ID NO: 2359712 - RNA, 20 nt, Bordetella pertussis
cgcacccgccuggacggcga

SEQ ID NO: 2359713 - RNA, 21 nt, Bordetella pertussis
cgcacccgccuggacggcgag

SEQ ID NO: 2359714 - RNA, 19 nt, Bordetella pertussis
cgcacccgguauccgcgca

SEQ ID NO: 2359715 - RNA, 20 nt, Bordetella pertussis
cgcacccgguauccgcgcau

SEQ ID NO: 2359716 - RNA, 23 nt, Bordetella pertussis
cgcacccggugaucaugccgcug

SEQ ID NO: 2359717 - RNA, 14 nt, Bordetella pertussis
cgcacccgucccug

SEQ ID NO: 2359718 - RNA, 15 nt, Bordetella pertussis
cgcacccgucccugg

SEQ ID NO: 2359719 - RNA, 19 nt, Bordetella pertussis
cgcacccgucccuggucca

SEQ ID NO: 2359720 - RNA, 21 nt, Bordetella pertussis
cgcacccgucccugguccagc

SEQ ID NO: 2359721 - RNA, 22 nt, Bordetella pertussis
cgcacccgucccugguccagca

SEQ ID NO: 2359722 - RNA, 19 nt, Bordetella pertussis
cgcaccgacagcaagggca

SEQ ID NO: 2359723 - RNA, 17 nt, Bordetella pertussis
cgcaccgaccagcgcgc

SEQ ID NO: 2359724 - RNA, 19 nt, Bordetella pertussis
cgcaccgaccagcgcgcgc

SEQ ID NO: 2359725 - RNA, 20 nt, Bordetella pertussis
cgcaccgaccagcgcgcgcc

SEQ ID NO: 2359726 - RNA, 16 nt, Bordetella pertussis
cgcaccgacugcgcau

SEQ ID NO: 2359727 - RNA, 20 nt, Bordetella pertussis
cgcaccgacugcgcaugguc

SEQ ID NO: 2359728 - RNA, 17 nt, Bordetella pertussis
cgcaccgaggugccggc

SEQ ID NO: 2359729 - RNA, 20 nt, Bordetella pertussis
cgcaccgaggugccggcggu

SEQ ID NO: 2359730 - RNA, 16 nt, Bordetella pertussis
cgcaccgcaugggcca

SEQ ID NO: 2359731 - RNA, 19 nt, Bordetella pertussis
cgcaccgcaugggccaggc

SEQ ID NO: 2359732 - RNA, 12 nt, Bordetella pertussis
cgcaccgcccgc

SEQ ID NO: 2359733 - RNA, 14 nt, Bordetella pertussis
cgcaccgccgccgg

SEQ ID NO: 2359734 - RNA, 15 nt, Bordetella pertussis
cgcaccgccgccggc

SEQ ID NO: 2359735 - RNA, 16 nt, Bordetella pertussis
cgcaccgccgccggcc

SEQ ID NO: 2359736 - RNA, 17 nt, Bordetella pertussis
cgcaccgccgccggccc

SEQ ID NO: 2359737 - RNA, 18 nt, Bordetella pertussis
cgcaccgccgccggcccg

SEQ ID NO: 2359738 - RNA, 20 nt, Bordetella pertussis
cgcaccgccgccggcccgga

SEQ ID NO: 2359739 - RNA, 14 nt, Bordetella pertussis
cgcaccgccugcgg

SEQ ID NO: 2359740 - RNA, 15 nt, Bordetella pertussis
cgcaccgccugcugc

SEQ ID NO: 2359741 - RNA, 14 nt, Bordetella pertussis
cgcaccgcgccagc

SEQ ID NO: 2359742 - RNA, 18 nt, Bordetella pertussis
cgcaccgcgccagcgccg

SEQ ID NO: 2359743 - RNA, 20 nt, Bordetella pertussis
cgcaccgcgcugggaaacag

SEQ ID NO: 2359744 - RNA, 19 nt, Bordetella pertussis
cgcaccggaggcgccgcgg

SEQ ID NO: 2359745 - RNA, 17 nt, Bordetella pertussis
cgcaccggcacgcgcca

SEQ ID NO: 2359746 - RNA, 19 nt, Bordetella pertussis
cgcaccggcacgcgccagc

SEQ ID NO: 2359747 - RNA, 22 nt, Bordetella pertussis
cgcaccggcacgcgccagcuga

SEQ ID NO: 2359748 - RNA, 18 nt, Bordetella pertussis
cgcaccggccaggggcgc

SEQ ID NO: 2359749 - RNA, 13 nt, Bordetella pertussis
cgcaccggccggc

SEQ ID NO: 2359750 - RNA, 14 nt, Bordetella pertussis
cgcaccggccggcc

SEQ ID NO: 2359751 - RNA, 18 nt, Bordetella pertussis
cgcaccggcgugcgcugg

SEQ ID NO: 2359752 - RNA, 22 nt, Bordetella pertussis
cgcaccgggcaaucggcgugca

SEQ ID NO: 2359753 - RNA, 12 nt, Bordetella pertussis
cgcaccgggcgg

SEQ ID NO: 2359754 - RNA, 13 nt, Bordetella pertussis
cgcaccgggcggc

SEQ ID NO: 2359755 - RNA, 15 nt, Bordetella pertussis
cgcaccgggcggccc

SEQ ID NO: 2359756 - RNA, 16 nt, Bordetella pertussis
cgcaccgggcggcccg

SEQ ID NO: 2359757 - RNA, 19 nt, Bordetella pertussis
cgcaccgggcggcccggcg

SEQ ID NO: 2359758 - RNA, 20 nt, Bordetella pertussis
cgcaccgggcggcccggcgg

SEQ ID NO: 2359759 - RNA, 21 nt, Bordetella pertussis
cgcaccgggcggcccggcgga

SEQ ID NO: 2359760 - RNA, 21 nt, Bordetella pertussis
cgcaccgucacgcgcuccagc

SEQ ID NO: 2359761 - RNA, 14 nt, Bordetella pertussis
cgcaccugcugcgg

SEQ ID NO: 2359762 - RNA, 22 nt, Bordetella pertussis
cgcaccugcugcggcacggcca

SEQ ID NO: 2359763 - RNA, 23 nt, Bordetella pertussis
cgcaccugcugcggcacggccag

SEQ ID NO: 2359764 - RNA, 13 nt, Bordetella pertussis
cgcaccugggagg

SEQ ID NO: 2359765 - RNA, 23 nt, Bordetella pertussis
cgcaccugggaggggccggcuuu

SEQ ID NO: 2359766 - RNA, 12 nt, Bordetella pertussis
cgcaccugggcg

SEQ ID NO: 2359767 - RNA, 22 nt, Bordetella pertussis
cgcaccuguucggcggcgccca

SEQ ID NO: 2359768 - RNA, 17 nt, Bordetella pertussis
cgcaccuugucgcgcag

SEQ ID NO: 2359769 - RNA, 16 nt, Bordetella pertussis
cgcaccuuucugcugc

SEQ ID NO: 2359770 - RNA, 21 nt, Bordetella pertussis
cgcaccuuucugcugcucgcg

SEQ ID NO: 2359771 - RNA, 14 nt, Bordetella pertussis
cgcacgaagccgau

SEQ ID NO: 2359772 - RNA, 20 nt, Bordetella pertussis
cgcacgaaguacucgccggc

SEQ ID NO: 2359773 - RNA, 22 nt, Bordetella pertussis
cgcacgaaguacucgccggcgc

SEQ ID NO: 2359774 - RNA, 13 nt, Bordetella pertussis
cgcacgacagcau

SEQ ID NO: 2359775 - RNA, 14 nt, Bordetella pertussis
cgcacgacagcauc

SEQ ID NO: 2359776 - RNA, 24 nt, Bordetella pertussis
cgcacgacagcaucuuggccgcca

SEQ ID NO: 2359777 - RNA, 13 nt, Bordetella pertussis
cgcacgaccacca

SEQ ID NO: 2359778 - RNA, 16 nt, Bordetella pertussis
cgcacgacgucgcgcg

SEQ ID NO: 2359779 - RNA, 14 nt, Bordetella pertussis
cgcacgaucgcgcc

SEQ ID NO: 2359780 - RNA, 15 nt, Bordetella pertussis
cgcacgaucgcgccg

SEQ ID NO: 2359781 - RNA, 19 nt, Bordetella pertussis
cgcacgauggaaucgucga

SEQ ID NO: 2359782 - RNA, 16 nt, Bordetella pertussis
cgcacgauggcgcgcg

SEQ ID NO: 2359783 - RNA, 15 nt, Bordetella pertussis
cgcacgauggggccg

SEQ ID NO: 2359784 - RNA, 18 nt, Bordetella pertussis
cgcacgauugucgucgcg

SEQ ID NO: 2359785 - RNA, 20 nt, Bordetella pertussis
cgcacgauugucgucgcgcg

SEQ ID NO: 2359786 - RNA, 16 nt, Bordetella pertussis
cgcacgcaccgcgcca

SEQ ID NO: 2359787 - RNA, 19 nt, Bordetella pertussis
cgcacgcaccgcgccagcg

SEQ ID NO: 2359788 - RNA, 12 nt, Bordetella pertussis
cgcacgcccaga

SEQ ID NO: 2359789 - RNA, 16 nt, Bordetella pertussis
cgcacgcccgccugca

SEQ ID NO: 2359790 - RNA, 17 nt, Bordetella pertussis
cgcacgcccgccugcag

SEQ ID NO: 2359791 - RNA, 19 nt, Bordetella pertussis
cgcacgcccgccugcagca

SEQ ID NO: 2359792 - RNA, 22 nt, Bordetella pertussis
cgcacgcccgccugcagcagcg

SEQ ID NO: 2359793 - RNA, 24 nt, Bordetella pertussis
cgcacgcccgccugcagcagcgcc

SEQ ID NO: 2359794 - RNA, 15 nt, Bordetella pertussis
cgcacgcccgcgacg

SEQ ID NO: 2359795 - RNA, 17 nt, Bordetella pertussis
cgcacgcccgcgacgcu

SEQ ID NO: 2359796 - RNA, 19 nt, Bordetella pertussis
cgcacgcccgcgacgcugg

SEQ ID NO: 2359797 - RNA, 15 nt, Bordetella pertussis
cgcacgccgaccugg

SEQ ID NO: 2359798 - RNA, 16 nt, Bordetella pertussis
cgcacgccgaccuggc

SEQ ID NO: 2359799 - RNA, 17 nt, Bordetella pertussis
cgcacgccgaccuggcg

SEQ ID NO: 2359800 - RNA, 14 nt, Bordetella pertussis
cgcacgccgcgccg

SEQ ID NO: 2359801 - RNA, 15 nt, Bordetella pertussis
cgcacgccgcgccgg

SEQ ID NO: 2359802 - RNA, 14 nt, Bordetella pertussis
cgcacgccggccug

SEQ ID NO: 2359803 - RNA, 19 nt, Bordetella pertussis
cgcagcacggcuugcgcgc

SEQ ID NO: 2359804 - RNA, 20 nt, Bordetella pertussis
cgcagcacggcuugcgcgcc

SEQ ID NO: 2359805 - RNA, 18 nt, Bordetella pertussis
cgcagcagauugccgcgc

SEQ ID NO: 2359806 - RNA, 22 nt, Bordetella pertussis
cgcagcagauugccgcgcggcg

SEQ ID NO: 2359807 - RNA, 15 nt, Bordetella pertussis
cgcagcagcagcgca

SEQ ID NO: 2359808 - RNA, 17 nt, Bordetella pertussis
cgcagcagcagcgcauc

SEQ ID NO: 2359809 - RNA, 11 nt, Bordetella pertussis
cgcagcagcga

SEQ ID NO: 2359810 - RNA, 16 nt, Bordetella pertussis
cgcagcagcgccggca

SEQ ID NO: 2359811 - RNA, 22 nt, Bordetella pertussis
cgcagcagcgccggcaggcgcg

SEQ ID NO: 2359812 - RNA, 21 nt, Bordetella pertussis
cgcagcagcgcgguggccagc

SEQ ID NO: 2359813 - RNA, 14 nt, Bordetella pertussis
cgcagcagcuugcc

SEQ ID NO: 2359814 - RNA, 15 nt, Bordetella pertussis
cgcagcagcuugccg

SEQ ID NO: 2359815 - RNA, 21 nt, Bordetella pertussis
cgcagcagcuugccgaccgcu

SEQ ID NO: 2359816 - RNA, 14 nt, Bordetella pertussis
cgcagcaggccagg

SEQ ID NO: 2359817 - RNA, 15 nt, Bordetella pertussis
cgcagcaggccagga

SEQ ID NO: 2359818 - RNA, 13 nt, Bordetella pertussis
cgcagcaggccca

SEQ ID NO: 2359819 - RNA, 21 nt, Bordetella pertussis
cgcagcaggcccaugccgcgc

SEQ ID NO: 2359820 - RNA, 14 nt, Bordetella pertussis
cgcagcaggccgcg

SEQ ID NO: 2359821 - RNA, 17 nt, Bordetella pertussis
cgcagcaggccgcgcgu

SEQ ID NO: 2359822 - RNA, 13 nt, Bordetella pertussis
cgcagcaggcgcg

SEQ ID NO: 2359823 - RNA, 15 nt, Bordetella pertussis
cgcagcaggcgcgcg

SEQ ID NO: 2359824 - RNA, 17 nt, Bordetella pertussis
cgcagcaggcgcgcggc

SEQ ID NO: 2359825 - RNA, 18 nt, Bordetella pertussis
cgcagcaggcgcgcggcc

SEQ ID NO: 2359826 - RNA, 14 nt, Bordetella pertussis
cgcagcaggcgcgu

SEQ ID NO: 2359827 - RNA, 17 nt, Bordetella pertussis
cgcagcaggcgcgugcu

SEQ ID NO: 2359828 - RNA, 16 nt, Bordetella pertussis
cgcagcaggcgcucgg

SEQ ID NO: 2359829 - RNA, 19 nt, Bordetella pertussis
cgcagcaggcgcucggcca

SEQ ID NO: 2359830 - RNA, 20 nt, Bordetella pertussis
cgcagcaggcgcucggccag

SEQ ID NO: 2359831 - RNA, 16 nt, Bordetella pertussis
cgcagcagggccuggc

SEQ ID NO: 2359832 - RNA, 17 nt, Bordetella pertussis
cgcagcagggccuggca

SEQ ID NO: 2359833 - RNA, 21 nt, Bordetella pertussis
cgcagcagguggaucgacgag

SEQ ID NO: 2359834 - RNA, 13 nt, Bordetella pertussis
cgcagcaguucgg

SEQ ID NO: 2359835 - RNA, 19 nt, Bordetella pertussis
cgcagcaguucggucagcg

SEQ ID NO: 2359836 - RNA, 21 nt, Bordetella pertussis
cgcagcaguucggucagcgcg

SEQ ID NO: 2359837 - RNA, 17 nt, Bordetella pertussis
cgcagcaucuugcgccg

SEQ ID NO: 2359838 - RNA, 15 nt, Bordetella pertussis
cgcagcaugagcuga

SEQ ID NO: 2359839 - RNA, 18 nt, Bordetella pertussis
cgcagcaugagcugaugc

SEQ ID NO: 2359840 - RNA, 15 nt, Bordetella pertussis
cgcagcauggcgcca

SEQ ID NO: 2359841 - RNA, 17 nt, Bordetella pertussis
cgcagcauggcgccagc

SEQ ID NO: 2359842 - RNA, 20 nt, Bordetella pertussis
cgcagcauggcgccagcugg

SEQ ID NO: 2359843 - RNA, 23 nt, Bordetella pertussis
cgcagcauggcgccagcuggacc

SEQ ID NO: 2359844 - RNA, 18 nt, Bordetella pertussis
cgcagcauuucggcgccg

SEQ ID NO: 2359845 - RNA, 15 nt, Bordetella pertussis
cgcagcauuucuucc

SEQ ID NO: 2359846 - RNA, 13 nt, Bordetella pertussis
cgcagccacagcg

SEQ ID NO: 2359847 - RNA, 15 nt, Bordetella pertussis
cgcagccacgggaug

SEQ ID NO: 2359848 - RNA, 20 nt, Bordetella pertussis
cgcagccagguaagcuggcg

SEQ ID NO: 2359849 - RNA, 22 nt, Bordetella pertussis
cgcagccagguaagcuggcgcu

SEQ ID NO: 2359850 - RNA, 20 nt, Bordetella pertussis
cgcagcccacucagggcggg

SEQ ID NO: 2359851 - RNA, 13 nt, Bordetella pertussis
cgcagcccgcgcg

SEQ ID NO: 2359852 - RNA, 16 nt, Bordetella pertussis
cgcagcccgcgcgccu

SEQ ID NO: 2359853 - RNA, 19 nt, Bordetella pertussis
cgcagcccggcgugcccag

SEQ ID NO: 2359854 - RNA, 14 nt, Bordetella pertussis
cgcagccgacaggc

SEQ ID NO: 2359855 - RNA, 17 nt, Bordetella pertussis
cgcagccgacaggcgcg

SEQ ID NO: 2359856 - RNA, 19 nt, Bordetella pertussis
cgcagccgacaggcgcgca

SEQ ID NO: 2359857 - RNA, 13 nt, Bordetella pertussis
cgcagccgcagua

SEQ ID NO: 2359858 - RNA, 13 nt, Bordetella pertussis
cgcagccgccagc

SEQ ID NO: 2359859 - RNA, 15 nt, Bordetella pertussis
cgcagccgccagcgc

SEQ ID NO: 2359860 - RNA, 17 nt, Bordetella pertussis
cgcagccgccagcgccu

SEQ ID NO: 2359861 - RNA, 21 nt, Bordetella pertussis
cgcagccgccauaggcgcgca

SEQ ID NO: 2359862 - RNA, 22 nt, Bordetella pertussis
cgcagccgccauaggcgcgcac

SEQ ID NO: 2359863 - RNA, 13 nt, Bordetella pertussis
cgcagccgcccgg

SEQ ID NO: 2359864 - RNA, 17 nt, Bordetella pertussis
cgcagccgcccggcagc

SEQ ID NO: 2359865 - RNA, 14 nt, Bordetella pertussis
cgcagccgcgcgcc

SEQ ID NO: 2359866 - RNA, 15 nt, Bordetella pertussis
cgcagccgcgcgccu

SEQ ID NO: 2359867 - RNA, 20 nt, Bordetella pertussis
cgcagccgcuccagccacca

SEQ ID NO: 2359868 - RNA, 16 nt, Bordetella pertussis
cgcagccgcuucacgc

SEQ ID NO: 2359869 - RNA, 13 nt, Bordetella pertussis
cgcagccggccgg

SEQ ID NO: 2359870 - RNA, 15 nt, Bordetella pertussis
cgcagccgggcugcc

SEQ ID NO: 2359871 - RNA, 17 nt, Bordetella pertussis
cgcagccgggcugccgg

SEQ ID NO: 2359872 - RNA, 20 nt, Bordetella pertussis
cgcagccgggcugccggcag

SEQ ID NO: 2359873 - RNA, 22 nt, Bordetella pertussis
cgcagccgggcugccggcagca

SEQ ID NO: 2359874 - RNA, 16 nt, Bordetella pertussis
cgcagccgucgcgcug

SEQ ID NO: 2359875 - RNA, 17 nt, Bordetella pertussis
cgcagccgucgcgcugc

SEQ ID NO: 2359876 - RNA, 17 nt, Bordetella pertussis
cgcagcgaacggcccac

SEQ ID NO: 2359877 - RNA, 12 nt, Bordetella pertussis
cgcagcgaggcc

SEQ ID NO: 2359878 - RNA, 16 nt, Bordetella pertussis
cgcagcgaggccucgu

SEQ ID NO: 2359879 - RNA, 19 nt, Bordetella pertussis
cgcagcgaggccucgugcu

SEQ ID NO: 2359880 - RNA, 14 nt, Bordetella pertussis
cgcagcgcaccgac

SEQ ID NO: 2359881 - RNA, 18 nt, Bordetella pertussis
cgcagcgcaccgacggca

SEQ ID NO: 2359882 - RNA, 14 nt, Bordetella pertussis
cgcagcgcagcgcc

SEQ ID NO: 2359883 - RNA, 21 nt, Bordetella pertussis
cgcagcgcaggauuuccucgc

SEQ ID NO: 2359884 - RNA, 15 nt, Bordetella pertussis
cgcagcgccaccggc

SEQ ID NO: 2359885 - RNA, 18 nt, Bordetella pertussis
cgcagcgccaccggcugg

SEQ ID NO: 2359886 - RNA, 14 nt, Bordetella pertussis
cgcagcgccacgcu

SEQ ID NO: 2359887 - RNA, 15 nt, Bordetella pertussis
cgcagcgccacgcug

SEQ ID NO: 2359888 - RNA, 13 nt, Bordetella pertussis
cgcagcgcccagg

SEQ ID NO: 2359889 - RNA, 14 nt, Bordetella pertussis
cgcagcgcccaggc

SEQ ID NO: 2359890 - RNA, 16 nt, Bordetella pertussis
cgcagcgcccaggcga

SEQ ID NO: 2359891 - RNA, 22 nt, Bordetella pertussis
cgcagcgcccaggcgaauccgc

SEQ ID NO: 2359892 - RNA, 16 nt, Bordetella pertussis
cgcagcgccgccaccu

SEQ ID NO: 2359893 - RNA, 22 nt, Bordetella pertussis
cgcagcgccgccaccucggcgu

SEQ ID NO: 2359894 - RNA, 14 nt, Bordetella pertussis
cgcagcgccgcgau

SEQ ID NO: 2359895 - RNA, 12 nt, Bordetella pertussis
cgcagcgccgcu

SEQ ID NO: 2359896 - RNA, 13 nt, Bordetella pertussis
cgcagcgccugca

SEQ ID NO: 2359897 - RNA, 15 nt, Bordetella pertussis
cgcagcgccuggccg

SEQ ID NO: 2359898 - RNA, 16 nt, Bordetella pertussis
cgcagcgccuggccga

SEQ ID NO: 2359899 - RNA, 20 nt, Bordetella pertussis
cgcagcgccuggccgagcgc

SEQ ID NO: 2359900 - RNA, 16 nt, Bordetella pertussis
cgcagcgcgaccgggc

SEQ ID NO: 2359901 - RNA, 16 nt, Bordetella pertussis
cgcagcgcgucggcgc

SEQ ID NO: 2359902 - RNA, 17 nt, Bordetella pertussis
cgcagcgcgucggcgcg

SEQ ID NO: 2359903 - RNA, 21 nt, Bordetella pertussis
cgcagcgcgugugguuggcgc

SEQ ID NO: 2359904 - RNA, 22 nt, Bordetella pertussis
cgcagcgcucauguucgggcgc

SEQ ID NO: 2359905 - RNA, 16 nt, Bordetella pertussis
cgcagcggaugccgcc

SEQ ID NO: 2359906 - RNA, 22 nt, Bordetella pertussis
cgcagcggaugccgcccgugca

SEQ ID NO: 2359907 - RNA, 16 nt, Bordetella pertussis
cgcagcggcagcgcac

SEQ ID NO: 2359908 - RNA, 18 nt, Bordetella pertussis
cgcagcggcagcgcaccg

SEQ ID NO: 2359909 - RNA, 13 nt, Bordetella pertussis
cgcagcggcaggc

SEQ ID NO: 2359910 - RNA, 15 nt, Bordetella pertussis
cgcagcggcaggccc

SEQ ID NO: 2359911 - RNA, 16 nt, Bordetella pertussis
cgcagcggcaggcccu

SEQ ID NO: 2359912 - RNA, 18 nt, Bordetella pertussis
cgcagcggcaggcccugc

SEQ ID NO: 2359913 - RNA, 22 nt, Bordetella pertussis
cgcagcggcaggcccugccgcc

SEQ ID NO: 2359914 - RNA, 15 nt, Bordetella pertussis
cgcagcggcaggcgg

SEQ ID NO: 2359915 - RNA, 15 nt, Bordetella pertussis
cgcagcggcgcgcgc

SEQ ID NO: 2359916 - RNA, 16 nt, Bordetella pertussis
cgcagcggcgcgcgca

SEQ ID NO: 2359917 - RNA, 19 nt, Bordetella pertussis
cgcaguaucccggccaggc

SEQ ID NO: 2359918 - RNA, 21 nt, Bordetella pertussis
cgcaguaucuggugcgcgucc

SEQ ID NO: 2359919 - RNA, 17 nt, Bordetella pertussis
cgcaguauuccugcugg

SEQ ID NO: 2359920 - RNA, 23 nt, Bordetella pertussis
cgcaguccaaggaaagcccggcc

SEQ ID NO: 2359921 - RNA, 17 nt, Bordetella pertussis
cgcagucccaguccggc

SEQ ID NO: 2359922 - RNA, 12 nt, Bordetella pertussis
cgcagucggggc

SEQ ID NO: 2359923 - RNA, 16 nt, Bordetella pertussis
cgcagucggggccgca

SEQ ID NO: 2359924 - RNA, 18 nt, Bordetella pertussis
cgcagucggggccgcagc

SEQ ID NO: 2359925 - RNA, 16 nt, Bordetella pertussis
cgcagugcgcgcgccc

SEQ ID NO: 2359926 - RNA, 22 nt, Bordetella pertussis
cgcaguggcgagggucaggcgc

SEQ ID NO: 2359927 - RNA, 14 nt, Bordetella pertussis
cgcagugggccagu

SEQ ID NO: 2359928 - RNA, 21 nt, Bordetella pertussis
cgcaguucggccucaucccga

SEQ ID NO: 2359929 - RNA, 18 nt, Bordetella pertussis
cgcaguugcgucuccagc

SEQ ID NO: 2359930 - RNA, 20 nt, Bordetella pertussis
cgcaguugcgucuccagcgc

SEQ ID NO: 2359931 - RNA, 21 nt, Bordetella pertussis
cgcaguugcgucuccagcgcg

SEQ ID NO: 2359932 - RNA, 23 nt, Bordetella pertussis
cgcaguugcgucuccagcgcggc

SEQ ID NO: 2359933 - RNA, 23 nt, Bordetella pertussis
cgcaguuugacgucauggccgau

SEQ ID NO: 2359934 - RNA, 20 nt, Bordetella pertussis
cgcauacaacuucagccagc

SEQ ID NO: 2359935 - RNA, 21 nt, Bordetella pertussis
cgcauacaacuucagccagcg

SEQ ID NO: 2359936 - RNA, 18 nt, Bordetella pertussis
cgcauacagggcggugcg

SEQ ID NO: 2359937 - RNA, 14 nt, Bordetella pertussis
cgcauaccggccgc

SEQ ID NO: 2359938 - RNA, 15 nt, Bordetella pertussis
cgcauaccggccgcg

SEQ ID NO: 2359939 - RNA, 20 nt, Bordetella pertussis
cgcauaccggccgcgggugg

SEQ ID NO: 2359940 - RNA, 20 nt, Bordetella pertussis
cgcauaccuuggcgcccagc

SEQ ID NO: 2359941 - RNA, 22 nt, Bordetella pertussis
cgcauacgcggguucgacgccg

SEQ ID NO: 2359942 - RNA, 21 nt, Bordetella pertussis
cgcauacggacgagcgcagca

SEQ ID NO: 2359943 - RNA, 16 nt, Bordetella pertussis
cgcauacucgaugccc

SEQ ID NO: 2359944 - RNA, 23 nt, Bordetella pertussis
cgcauacucgaugcccagcaccg

SEQ ID NO: 2359945 - RNA, 22 nt, Bordetella pertussis
cgcauagcgcaugaugcugccg

SEQ ID NO: 2359946 - RNA, 15 nt, Bordetella pertussis
cgcauagguaucggc

SEQ ID NO: 2359947 - RNA, 22 nt, Bordetella pertussis
cgcauagguaucggcccgcgcc

SEQ ID NO: 2359948 - RNA, 15 nt, Bordetella pertussis
cgcauauccaggcgg

SEQ ID NO: 2359949 - RNA, 17 nt, Bordetella pertussis
cgcauauccaggcggcg

SEQ ID NO: 2359950 - RNA, 19 nt, Bordetella pertussis
cgcauauggagccaggcgg

SEQ ID NO: 2359951 - RNA, 14 nt, Bordetella pertussis
cgcaucacgcuggc

SEQ ID NO: 2359952 - RNA, 16 nt, Bordetella pertussis
cgcaucacgcuggccg

SEQ ID NO: 2359953 - RNA, 20 nt, Bordetella pertussis
cgcaucacgcuggccgcgcc

SEQ ID NO: 2359954 - RNA, 22 nt, Bordetella pertussis
cgcaucacgcuggccgcgcccg

SEQ ID NO: 2359955 - RNA, 17 nt, Bordetella pertussis
cgcaucagcgcgcccgc

SEQ ID NO: 2359956 - RNA, 21 nt, Bordetella pertussis
cgcaucccagacagccacgcg

SEQ ID NO: 2359957 - RNA, 22 nt, Bordetella pertussis
cgcaucccagacagccacgcgc

SEQ ID NO: 2359958 - RNA, 13 nt, Bordetella pertussis
cgcaucccgcccc

SEQ ID NO: 2359959 - RNA, 16 nt, Bordetella pertussis
cgcaucccgcccccgc

SEQ ID NO: 2359960 - RNA, 21 nt, Bordetella pertussis
cgcauccgguggugcugggcg

SEQ ID NO: 2359961 - RNA, 22 nt, Bordetella pertussis
cgcauccgguggugcugggcgg

SEQ ID NO: 2359962 - RNA, 13 nt, Bordetella pertussis
cgcaucgacagcg

SEQ ID NO: 2359963 - RNA, 17 nt, Bordetella pertussis
cgcaucgacagcgcgcc

SEQ ID NO: 2359964 - RNA, 20 nt, Bordetella pertussis
cgcaucgacagcgcgcccgc

SEQ ID NO: 2359965 - RNA, 16 nt, Bordetella pertussis
cgcaucgaucagcgcg

SEQ ID NO: 2359966 - RNA, 21 nt, Bordetella pertussis
cgcaucgaucaggcugucgcg

SEQ ID NO: 2359967 - RNA, 17 nt, Bordetella pertussis
cgcaucgaucucggccu

SEQ ID NO: 2359968 - RNA, 20 nt, Bordetella pertussis
cgcaucgaucucggccucgg

SEQ ID NO: 2359969 - RNA, 15 nt, Bordetella pertussis
cgcaucgaugcggcc

SEQ ID NO: 2359970 - RNA, 14 nt, Bordetella pertussis
cgcaucgccgcagg

SEQ ID NO: 2359971 - RNA, 19 nt, Bordetella pertussis
cgcaucgccgcaggcgugc

SEQ ID NO: 2359972 - RNA, 14 nt, Bordetella pertussis
cgcaucgcgcgccg

SEQ ID NO: 2359973 - RNA, 22 nt, Bordetella pertussis
cgcaucgcgcgccgccgcccgc

SEQ ID NO: 2359974 - RNA, 16 nt, Bordetella pertussis
cgcaucgcgcgcgccg

SEQ ID NO: 2359975 - RNA, 22 nt, Bordetella pertussis
cgcaucgcgcgcgccggcaucg

SEQ ID NO: 2359976 - RNA, 17 nt, Bordetella pertussis
cgcaucgcgcggcaugg

SEQ ID NO: 2359977 - RNA, 12 nt, Bordetella pertussis
cgcaucgcggca

SEQ ID NO: 2359978 - RNA, 14 nt, Bordetella pertussis
cgcaucgcggcagc

SEQ ID NO: 2359979 - RNA, 15 nt, Bordetella pertussis
cgcaucgcggcagcc

SEQ ID NO: 2359980 - RNA, 17 nt, Bordetella pertussis
cgcaucgcggcagcccg

SEQ ID NO: 2359981 - RNA, 18 nt, Bordetella pertussis
cgcaucgcggcagcccgg

SEQ ID NO: 2359982 - RNA, 22 nt, Bordetella pertussis
cgcaucggcgccaguagcgccg

SEQ ID NO: 2359983 - RNA, 13 nt, Bordetella pertussis
cgcaucggcgccg

SEQ ID NO: 2359984 - RNA, 14 nt, Bordetella pertussis
cgcaucggcgccga

SEQ ID NO: 2359985 - RNA, 15 nt, Bordetella pertussis
cgcaucggcggcagg

SEQ ID NO: 2359986 - RNA, 14 nt, Bordetella pertussis
cgcaucucgucgag

SEQ ID NO: 2359987 - RNA, 15 nt, Bordetella pertussis
cgcaucugcggggca

SEQ ID NO: 2359988 - RNA, 19 nt, Bordetella pertussis
cgcaugaccugcgacagca

SEQ ID NO: 2359989 - RNA, 15 nt, Bordetella pertussis
cgcaugacgaggugc

SEQ ID NO: 2359990 - RNA, 21 nt, Bordetella pertussis
cgcaugacggcgucgagcacg

SEQ ID NO: 2359991 - RNA, 15 nt, Bordetella pertussis
cgcaugagccggcag

SEQ ID NO: 2359992 - RNA, 16 nt, Bordetella pertussis
cgcaugaugcugccgg

SEQ ID NO: 2359993 - RNA, 17 nt, Bordetella pertussis
cgcaugaugcugccggg

SEQ ID NO: 2359994 - RNA, 19 nt, Bordetella pertussis
cgcaugaugcugccgggca

SEQ ID NO: 2359995 - RNA, 14 nt, Bordetella pertussis
cgcaugauggccgg

SEQ ID NO: 2359996 - RNA, 16 nt, Bordetella pertussis
cgcaugauggccggcc

SEQ ID NO: 2359997 - RNA, 20 nt, Bordetella pertussis
cgcaugauggccggccugcc

SEQ ID NO: 2359998 - RNA, 23 nt, Bordetella pertussis
cgcaugauggccggccugccggc

SEQ ID NO: 2359999 - RNA, 18 nt, Bordetella pertussis
cgcaugcaagacaggccg

SEQ ID NO: 2360000 - RNA, 13 nt, Bordetella pertussis
cgcaugccagcuu

SEQ ID NO: 2360001 - RNA, 18 nt, Bordetella pertussis
cgcaugccagcuugcagg

SEQ ID NO: 2360002 - RNA, 23 nt, Bordetella pertussis
cgcaugccauggccgcgcggcgc

SEQ ID NO: 2360003 - RNA, 17 nt, Bordetella pertussis
cgcaugccgucgagcgc

SEQ ID NO: 2360004 - RNA, 15 nt, Bordetella pertussis
cgcaugcgcacgcgc

SEQ ID NO: 2360005 - RNA, 22 nt, Bordetella pertussis
cgcaugcgccugucccaggcgc

SEQ ID NO: 2360006 - RNA, 23 nt, Bordetella pertussis
cgcaugcgccugucccaggcgcu

SEQ ID NO: 2360007 - RNA, 20 nt, Bordetella pertussis
cgcaugcgcgcggcucgccg

SEQ ID NO: 2360008 - RNA, 19 nt, Bordetella pertussis
cgcaugcggcacaaccugg

SEQ ID NO: 2360009 - RNA, 21 nt, Bordetella pertussis
cgcaugcggcacaaccuggcg

SEQ ID NO: 2360010 - RNA, 14 nt, Bordetella pertussis
cgcaugcggcggcu

SEQ ID NO: 2360011 - RNA, 22 nt, Bordetella pertussis
cgcaugcgguuucucagcgcgc

SEQ ID NO: 2360012 - RNA, 17 nt, Bordetella pertussis
cgcaugcgugaagccca

SEQ ID NO: 2360013 - RNA, 20 nt, Bordetella pertussis
cgcaugcgugaagcccaugg

SEQ ID NO: 2360014 - RNA, 14 nt, Bordetella pertussis
cgcaugcgugcgca

SEQ ID NO: 2360015 - RNA, 15 nt, Bordetella pertussis
cgcaugcgugcgcau

SEQ ID NO: 2360016 - RNA, 20 nt, Bordetella pertussis
cgcaugcugcagcugcuugc

SEQ ID NO: 2360017 - RNA, 14 nt, Bordetella pertussis
cgcaugcugcgcga

SEQ ID NO: 2360018 - RNA, 16 nt, Bordetella pertussis
cgcaugcugcgcgagg

SEQ ID NO: 2360019 - RNA, 15 nt, Bordetella pertussis
cgcauggaccgccgc

SEQ ID NO: 2360020 - RNA, 17 nt, Bordetella pertussis
cgcauggaccgccgccg

SEQ ID NO: 2360021 - RNA, 14 nt, Bordetella pertussis
cgcauggacgccgc

SEQ ID NO: 2360022 - RNA, 16 nt, Bordetella pertussis
cgcauggacgccgccg

SEQ ID NO: 2360023 - RNA, 18 nt, Bordetella pertussis
cgcauggacugcaggcgc

SEQ ID NO: 2360024 - RNA, 16 nt, Bordetella pertussis
cgcauggagaccggcg

SEQ ID NO: 2360025 - RNA, 16 nt, Bordetella pertussis
cgcauggccagcgcgc

SEQ ID NO: 2360026 - RNA, 16 nt, Bordetella pertussis
cgcauggccggcgugu

SEQ ID NO: 2360027 - RNA, 20 nt, Bordetella pertussis
cgcauggcgaugaccucggc

SEQ ID NO: 2360028 - RNA, 16 nt, Bordetella pertussis
cgcauggcggcccugu

SEQ ID NO: 2360029 - RNA, 17 nt, Bordetella pertussis
cgccaccguggcgucca

SEQ ID NO: 2360030 - RNA, 14 nt, Bordetella pertussis
cgccaccucgauca

SEQ ID NO: 2360031 - RNA, 20 nt, Bordetella pertussis
cgccaccucggcgucgcccg

SEQ ID NO: 2360032 - RNA, 19 nt, Bordetella pertussis
cgccaccuggcgcccggcg

SEQ ID NO: 2360033 - RNA, 14 nt, Bordetella pertussis
cgccaccugggccg

SEQ ID NO: 2360034 - RNA, 19 nt, Bordetella pertussis
cgccaccugggccgccugc

SEQ ID NO: 2360035 - RNA, 22 nt, Bordetella pertussis
cgccaccugggccgccugcugg

SEQ ID NO: 2360036 - RNA, 17 nt, Bordetella pertussis
cgccaccuucgccgcgc

SEQ ID NO: 2360037 - RNA, 18 nt, Bordetella pertussis
cgccacgaagugcgcccc

SEQ ID NO: 2360038 - RNA, 20 nt, Bordetella pertussis
cgccacgcaggcgggcgccg

SEQ ID NO: 2360039 - RNA, 12 nt, Bordetella pertussis
cgccacgccagc

SEQ ID NO: 2360040 - RNA, 14 nt, Bordetella pertussis
cgccacgccagcgg

SEQ ID NO: 2360041 - RNA, 15 nt, Bordetella pertussis
cgccacgccagcggc

SEQ ID NO: 2360042 - RNA, 17 nt, Bordetella pertussis
cgccacgcccaggccgc

SEQ ID NO: 2360043 - RNA, 13 nt, Bordetella pertussis
cgccacgcccauc

SEQ ID NO: 2360044 - RNA, 17 nt, Bordetella pertussis
cgccacgcccgucccga

SEQ ID NO: 2360045 - RNA, 20 nt, Bordetella pertussis
cgccacgcccgucucgcgcg

SEQ ID NO: 2360046 - RNA, 14 nt, Bordetella pertussis
cgccacgcccuggc

SEQ ID NO: 2360047 - RNA, 15 nt, Bordetella pertussis
cgccacgcccuggca

SEQ ID NO: 2360048 - RNA, 21 nt, Bordetella pertussis
cgccacgcccuggcagcuggc

SEQ ID NO: 2360049 - RNA, 13 nt, Bordetella pertussis
cgccacgccggcc

SEQ ID NO: 2360050 - RNA, 14 nt, Bordetella pertussis
cgccacgccggcca

SEQ ID NO: 2360051 - RNA, 20 nt, Bordetella pertussis
cgccacgccggccacgaacg

SEQ ID NO: 2360052 - RNA, 15 nt, Bordetella pertussis
cgccacgccggccag

SEQ ID NO: 2360053 - RNA, 22 nt, Bordetella pertussis
cgccacgccuuguucgcgcgcg

SEQ ID NO: 2360054 - RNA, 12 nt, Bordetella pertussis
cgccacgcgcac

SEQ ID NO: 2360055 - RNA, 14 nt, Bordetella pertussis
cgccacgcgcacgg

SEQ ID NO: 2360056 - RNA, 24 nt, Bordetella pertussis
cgccacgcgcggaucggccacgau

SEQ ID NO: 2360057 - RNA, 13 nt, Bordetella pertussis
cgccacgcgggcc

SEQ ID NO: 2360058 - RNA, 17 nt, Bordetella pertussis
cgccacgcgggccggcc

SEQ ID NO: 2360059 - RNA, 17 nt, Bordetella pertussis
cgccacgcgguccagcc

SEQ ID NO: 2360060 - RNA, 18 nt, Bordetella pertussis
cgccacgcuggccgcgcu

SEQ ID NO: 2360061 - RNA, 13 nt, Bordetella pertussis
cgccacggcgaug

SEQ ID NO: 2360062 - RNA, 22 nt, Bordetella pertussis
cgccacggcgaugaacagcggc

SEQ ID NO: 2360063 - RNA, 23 nt, Bordetella pertussis
cgccacggcgaugaacagcggca

SEQ ID NO: 2360064 - RNA, 14 nt, Bordetella pertussis
cgccacggcgcccg

SEQ ID NO: 2360065 - RNA, 23 nt, Bordetella pertussis
cgccacggcgucgccggccaggc

SEQ ID NO: 2360066 - RNA, 13 nt, Bordetella pertussis
cgccacggcuucg

SEQ ID NO: 2360067 - RNA, 17 nt, Bordetella pertussis
cgccacgggcccgcgca

SEQ ID NO: 2360068 - RNA, 19 nt, Bordetella pertussis
cgccacgggcccgcgcaga

SEQ ID NO: 2360069 - RNA, 22 nt, Bordetella pertussis
cgccacgggcccgcgcagacgg

SEQ ID NO: 2360070 - RNA, 12 nt, Bordetella pertussis
cgccacgggcgu

SEQ ID NO: 2360071 - RNA, 21 nt, Bordetella pertussis
cgccacgggcgucaccggcga

SEQ ID NO: 2360072 - RNA, 22 nt, Bordetella pertussis
cgccacggucugcacgccgggc

SEQ ID NO: 2360073 - RNA, 20 nt, Bordetella pertussis
cgccacgucacggaucagcc

SEQ ID NO: 2360074 - RNA, 14 nt, Bordetella pertussis
cgccacguccagca

SEQ ID NO: 2360075 - RNA, 17 nt, Bordetella pertussis
cgccacguccagcacgg

SEQ ID NO: 2360076 - RNA, 18 nt, Bordetella pertussis
cgccacguccagcacggc

SEQ ID NO: 2360077 - RNA, 20 nt, Bordetella pertussis
cgccacguccagcacggccg

SEQ ID NO: 2360078 - RNA, 20 nt, Bordetella pertussis
cgccacgucgaccucgagca

SEQ ID NO: 2360079 - RNA, 14 nt, Bordetella pertussis
cgccacgugcacga

SEQ ID NO: 2360080 - RNA, 15 nt, Bordetella pertussis
cgccacgugcugcug

SEQ ID NO: 2360081 - RNA, 15 nt, Bordetella pertussis
cgccacugccaggcg

SEQ ID NO: 2360082 - RNA, 20 nt, Bordetella pertussis
cgccacugccaggcgcccca

SEQ ID NO: 2360083 - RNA, 21 nt, Bordetella pertussis
cgccacuggccuugugcgccg

SEQ ID NO: 2360084 - RNA, 13 nt, Bordetella pertussis
cgccacuuccuug

SEQ ID NO: 2360085 - RNA, 21 nt, Bordetella pertussis
cgccacuuccuugccauccag

SEQ ID NO: 2360086 - RNA, 19 nt, Bordetella pertussis
cgccacuucgccucggcgg

SEQ ID NO: 2360087 - RNA, 14 nt, Bordetella pertussis
cgccacuugcaggc

SEQ ID NO: 2360088 - RNA, 16 nt, Bordetella pertussis
cgccacuugcaggccg

SEQ ID NO: 2360089 - RNA, 17 nt, Bordetella pertussis
cgccacuugcaggccgc

SEQ ID NO: 2360090 - RNA, 18 nt, Bordetella pertussis
cgccacuugcggcaggug

SEQ ID NO: 2360091 - RNA, 17 nt, Bordetella pertussis
cgccagaaagcgcggcc

SEQ ID NO: 2360092 - RNA, 18 nt, Bordetella pertussis
cgccagaaagcgcggccg

SEQ ID NO: 2360093 - RNA, 15 nt, Bordetella pertussis
cgccagaugcgccgc

SEQ ID NO: 2360094 - RNA, 13 nt, Bordetella pertussis
cgccagcaaggcg

SEQ ID NO: 2360095 - RNA, 14 nt, Bordetella pertussis
cgccagcaaggcgg

SEQ ID NO: 2360096 - RNA, 15 nt, Bordetella pertussis
cgccagcaaggcggc

SEQ ID NO: 2360097 - RNA, 22 nt, Bordetella pertussis
cgccagcaaggcgucggccagg

SEQ ID NO: 2360098 - RNA, 23 nt, Bordetella pertussis
cgccagcaaggcgucggccaggc

SEQ ID NO: 2360099 - RNA, 16 nt, Bordetella pertussis
cgccagcacagugucu

SEQ ID NO: 2360100 - RNA, 14 nt, Bordetella pertussis
cgccagcaccggca

SEQ ID NO: 2360101 - RNA, 17 nt, Bordetella pertussis
cgccagcaccggcacgc

SEQ ID NO: 2360102 - RNA, 23 nt, Bordetella pertussis
cgccagcaccggcacgcgccagg

SEQ ID NO: 2360103 - RNA, 14 nt, Bordetella pertussis
cgccagcaccugcu

SEQ ID NO: 2360104 - RNA, 13 nt, Bordetella pertussis
cgccagcacgcca

SEQ ID NO: 2360105 - RNA, 15 nt, Bordetella pertussis
cgccagcacgcgcag

SEQ ID NO: 2360106 - RNA, 16 nt, Bordetella pertussis
cgccagcacgcgcagc

SEQ ID NO: 2360107 - RNA, 17 nt, Bordetella pertussis
cgccagcacgcgcagcu

SEQ ID NO: 2360108 - RNA, 20 nt, Bordetella pertussis
cgccagcacgcgcagcuugc

SEQ ID NO: 2360109 - RNA, 12 nt, Bordetella pertussis
cgccagcacggc

SEQ ID NO: 2360110 - RNA, 17 nt, Bordetella pertussis
cgccagcacgguggcgc

SEQ ID NO: 2360111 - RNA, 22 nt, Bordetella pertussis
cgccagcacgguggcgcccggc

SEQ ID NO: 2360112 - RNA, 19 nt, Bordetella pertussis
cgccagcagcacgucguag

SEQ ID NO: 2360113 - RNA, 13 nt, Bordetella pertussis
cgccagcagcgcc

SEQ ID NO: 2360114 - RNA, 13 nt, Bordetella pertussis
cgccagcagcggg

SEQ ID NO: 2360115 - RNA, 14 nt, Bordetella pertussis
cgccagcagcgggc

SEQ ID NO: 2360116 - RNA, 16 nt, Bordetella pertussis
cgccagcagcucggcg

SEQ ID NO: 2360117 - RNA, 22 nt, Bordetella pertussis
cgccagcagcucggcgaccagg

SEQ ID NO: 2360118 - RNA, 23 nt, Bordetella pertussis
cgccagcaggauguccacggucg

SEQ ID NO: 2360119 - RNA, 22 nt, Bordetella pertussis
cgccagcaggcccugggccagc

SEQ ID NO: 2360120 - RNA, 19 nt, Bordetella pertussis
cgccagcaggcccugggcg

SEQ ID NO: 2360121 - RNA, 14 nt, Bordetella pertussis
cgccagcaggcgaa

SEQ ID NO: 2360122 - RNA, 15 nt, Bordetella pertussis
cgccagcaggcgaaa

SEQ ID NO: 2360123 - RNA, 14 nt, Bordetella pertussis
cgccagcaggcgcu

SEQ ID NO: 2360124 - RNA, 19 nt, Bordetella pertussis
cgccagcaggcgcucggcu

SEQ ID NO: 2360125 - RNA, 17 nt, Bordetella pertussis
cgccagcagggucagcg

SEQ ID NO: 2360126 - RNA, 21 nt, Bordetella pertussis
cgccagcagggucagcggccg

SEQ ID NO: 2360127 - RNA, 22 nt, Bordetella pertussis
cgccagcagggucagcggccgg

SEQ ID NO: 2360128 - RNA, 23 nt, Bordetella pertussis
cgccagcagggucagcggccggc

SEQ ID NO: 2360129 - RNA, 13 nt, Bordetella pertussis
cgccagcauccag

SEQ ID NO: 2360130 - RNA, 17 nt, Bordetella pertussis
cgccagcauccagccga

SEQ ID NO: 2360131 - RNA, 12 nt, Bordetella pertussis
cgccagcaugac

SEQ ID NO: 2360132 - RNA, 23 nt, Bordetella pertussis
cgccagcaugacggggucggggc

SEQ ID NO: 2360133 - RNA, 23 nt, Bordetella pertussis
cgccagcaugaucaugccgcugc

SEQ ID NO: 2360134 - RNA, 16 nt, Bordetella pertussis
cgccagcaugcgcgcg

SEQ ID NO: 2360135 - RNA, 18 nt, Bordetella pertussis
cgccagcaugcgcgcggc

SEQ ID NO: 2360136 - RNA, 20 nt, Bordetella pertussis
cgccagcaugcgcgcggccu

SEQ ID NO: 2360137 - RNA, 17 nt, Bordetella pertussis
cgccagcauggcggcca

SEQ ID NO: 2360138 - RNA, 19 nt, Bordetella pertussis
cgccagcauggcggccagg

SEQ ID NO: 2360139 - RNA, 17 nt, Bordetella pertussis
cgccagcauggcgucga

SEQ ID NO: 2360140 - RNA, 16 nt, Bordetella pertussis
cgccagccaccccguc

SEQ ID NO: 2360141 - RNA, 18 nt, Bordetella pertussis
cgccagccacgcgcgcug

SEQ ID NO: 2360142 - RNA, 20 nt, Bordetella pertussis
cgccaggacuucgucgauca

SEQ ID NO: 2360143 - RNA, 22 nt, Bordetella pertussis
cgccaggauggccacgaccacc

SEQ ID NO: 2360144 - RNA, 20 nt, Bordetella pertussis
cgccaggcaaaggcccaggc

SEQ ID NO: 2360145 - RNA, 22 nt, Bordetella pertussis
cgccaggcauucucggacaggu

SEQ ID NO: 2360146 - RNA, 22 nt, Bordetella pertussis
cgccaggccaaaaaaaaccggc

SEQ ID NO: 2360147 - RNA, 13 nt, Bordetella pertussis
cgccaggccaggu

SEQ ID NO: 2360148 - RNA, 17 nt, Bordetella pertussis
cgccaggcccagggcca

SEQ ID NO: 2360149 - RNA, 19 nt, Bordetella pertussis
cgccaggcccagggccagg

SEQ ID NO: 2360150 - RNA, 20 nt, Bordetella pertussis
cgccaggcccagggccaggu

SEQ ID NO: 2360151 - RNA, 13 nt, Bordetella pertussis
cgccaggccccgc

SEQ ID NO: 2360152 - RNA, 16 nt, Bordetella pertussis
cgccaggccgcgcagg

SEQ ID NO: 2360153 - RNA, 15 nt, Bordetella pertussis
cgccaggccggcggc

SEQ ID NO: 2360154 - RNA, 12 nt, Bordetella pertussis
cgccaggccuuc

SEQ ID NO: 2360155 - RNA, 19 nt, Bordetella pertussis
cgccaggcgaaccuggcgg

SEQ ID NO: 2360156 - RNA, 17 nt, Bordetella pertussis
cgccaggcgauggccgg

SEQ ID NO: 2360157 - RNA, 20 nt, Bordetella pertussis
cgccaggcgcauguccgcca

SEQ ID NO: 2360158 - RNA, 14 nt, Bordetella pertussis
cgccaggcgccggg

SEQ ID NO: 2360159 - RNA, 15 nt, Bordetella pertussis
cgccaggcgccgggc

SEQ ID NO: 2360160 - RNA, 19 nt, Bordetella pertussis
cgccaggcgccgggccgcu

SEQ ID NO: 2360161 - RNA, 13 nt, Bordetella pertussis
cgccaggcgcgca

SEQ ID NO: 2360162 - RNA, 14 nt, Bordetella pertussis
cgccaggcgcgcau

SEQ ID NO: 2360163 - RNA, 19 nt, Bordetella pertussis
cgccaggcgcucggcguug

SEQ ID NO: 2360164 - RNA, 21 nt, Bordetella pertussis
cgccaggcgguacaggccggc

SEQ ID NO: 2360165 - RNA, 22 nt, Bordetella pertussis
cgccaggcggucauagacggcg

SEQ ID NO: 2360166 - RNA, 19 nt, Bordetella pertussis
cgccaggcguagaccaccu

SEQ ID NO: 2360167 - RNA, 12 nt, Bordetella pertussis
cgccaggcuguc

SEQ ID NO: 2360168 - RNA, 22 nt, Bordetella pertussis
cgccaggcugucgucgucggca

SEQ ID NO: 2360169 - RNA, 14 nt, Bordetella pertussis
cgccagggccaggc

SEQ ID NO: 2360170 - RNA, 18 nt, Bordetella pertussis
cgccagggccaggccgcc

SEQ ID NO: 2360171 - RNA, 19 nt, Bordetella pertussis
cgccagggccaggccgccg

SEQ ID NO: 2360172 - RNA, 22 nt, Bordetella pertussis
cgccagggccaggccgccgccg

SEQ ID NO: 2360173 - RNA, 14 nt, Bordetella pertussis
cgccagggccaugu

SEQ ID NO: 2360174 - RNA, 21 nt, Bordetella pertussis
cgccagggccauguggcgcag

SEQ ID NO: 2360175 - RNA, 15 nt, Bordetella pertussis
cgccagggccccucc

SEQ ID NO: 2360176 - RNA, 19 nt, Bordetella pertussis
cgccagggccccuccggcg

SEQ ID NO: 2360177 - RNA, 20 nt, Bordetella pertussis
cgccagggccgccgcgccca

SEQ ID NO: 2360178 - RNA, 22 nt, Bordetella pertussis
cgccagggccuccucggucggg

SEQ ID NO: 2360179 - RNA, 14 nt, Bordetella pertussis
cgccagggcggggc

SEQ ID NO: 2360180 - RNA, 22 nt, Bordetella pertussis
cgccagggcguuuuccagcauc

SEQ ID NO: 2360181 - RNA, 17 nt, Bordetella pertussis
cgccagggucugcuggu

SEQ ID NO: 2360182 - RNA, 20 nt, Bordetella pertussis
cgccagguaggccggcgcga

SEQ ID NO: 2360183 - RNA, 23 nt, Bordetella pertussis
cgccagguaggccggcgcgaccg

SEQ ID NO: 2360184 - RNA, 17 nt, Bordetella pertussis
cgccaggucgcgcacca

SEQ ID NO: 2360185 - RNA, 14 nt, Bordetella pertussis
cgccaggucggcca

SEQ ID NO: 2360186 - RNA, 17 nt, Bordetella pertussis
cgccaggucggccaccg

SEQ ID NO: 2360187 - RNA, 21 nt, Bordetella pertussis
cgccaggucggccaccgccgu

SEQ ID NO: 2360188 - RNA, 16 nt, Bordetella pertussis
cgccaggucggccagc

SEQ ID NO: 2360189 - RNA, 17 nt, Bordetella pertussis
cgccaggucggccagcc

SEQ ID NO: 2360190 - RNA, 18 nt, Bordetella pertussis
cgccaggucggccagccg

SEQ ID NO: 2360191 - RNA, 20 nt, Bordetella pertussis
cgccaggucggccagccggc

SEQ ID NO: 2360192 - RNA, 21 nt, Bordetella pertussis
cgccaggugcuugcggcuguc

SEQ ID NO: 2360193 - RNA, 16 nt, Bordetella pertussis
cgccagguucgccugg

SEQ ID NO: 2360194 - RNA, 17 nt, Bordetella pertussis
cgccagguucgccuggc

SEQ ID NO: 2360195 - RNA, 19 nt, Bordetella pertussis
cgccagguucgccuggcgg

SEQ ID NO: 2360196 - RNA, 16 nt, Bordetella pertussis
cgccaguagcgccggc

SEQ ID NO: 2360197 - RNA, 13 nt, Bordetella pertussis
cgccaguccagcg

SEQ ID NO: 2360198 - RNA, 14 nt, Bordetella pertussis
cgccaguccagcgc

SEQ ID NO: 2360199 - RNA, 21 nt, Bordetella pertussis
cgccaguccccaugcggggac

SEQ ID NO: 2360200 - RNA, 22 nt, Bordetella pertussis
cgccaguccccaugcggggacu

SEQ ID NO: 2360201 - RNA, 22 nt, Bordetella pertussis
cgccaguccgcgcucgcccagc

SEQ ID NO: 2360202 - RNA, 14 nt, Bordetella pertussis
cgccagucgcgcag

SEQ ID NO: 2360203 - RNA, 16 nt, Bordetella pertussis
cgccagucgcgcagca

SEQ ID NO: 2360204 - RNA, 22 nt, Bordetella pertussis
cgccaguucaaggcgcgaguau

SEQ ID NO: 2360205 - RNA, 22 nt, Bordetella pertussis
cgccaguucgaguuccgcgacg

SEQ ID NO: 2360206 - RNA, 23 nt, Bordetella pertussis
cgccaguucgaguuccgcgacgc

SEQ ID NO: 2360207 - RNA, 18 nt, Bordetella pertussis
cgccaguugcgcaccgcu

SEQ ID NO: 2360208 - RNA, 16 nt, Bordetella pertussis
cgccaguugcggggcg

SEQ ID NO: 2360209 - RNA, 22 nt, Bordetella pertussis
cgccaguugcggggcgcccagc

SEQ ID NO: 2360210 - RNA, 13 nt, Bordetella pertussis
cgccaguuguagg

SEQ ID NO: 2360211 - RNA, 22 nt, Bordetella pertussis
cgccaguuguagguccaguaca

SEQ ID NO: 2360212 - RNA, 14 nt, Bordetella pertussis
cgccauacccgguc

SEQ ID NO: 2360213 - RNA, 20 nt, Bordetella pertussis
cgccauacugcaugauggcc

SEQ ID NO: 2360214 - RNA, 22 nt, Bordetella pertussis
cgccauagcguucgguggcgug

SEQ ID NO: 2360215 - RNA, 18 nt, Bordetella pertussis
cgccauaggcgcgcacca

SEQ ID NO: 2360216 - RNA, 21 nt, Bordetella pertussis
cgccauaggcgcgcaccagcc

SEQ ID NO: 2360217 - RNA, 22 nt, Bordetella pertussis
cgccauaggcgcgcaccagccc

SEQ ID NO: 2360218 - RNA, 22 nt, Bordetella pertussis
cgccauaugcgcgaaguggcca

SEQ ID NO: 2360219 - RNA, 19 nt, Bordetella pertussis
cgccauauugaugcagcac

SEQ ID NO: 2360220 - RNA, 21 nt, Bordetella pertussis
cgccauauugaugcagcacgu

SEQ ID NO: 2360221 - RNA, 18 nt, Bordetella pertussis
cgccaucaagagcaccgu

SEQ ID NO: 2360222 - RNA, 13 nt, Bordetella pertussis
cgccaucauccug

SEQ ID NO: 2360223 - RNA, 19 nt, Bordetella pertussis
cgccaucaucgcgauccuc

SEQ ID NO: 2360224 - RNA, 16 nt, Bordetella pertussis
cgccaucauggcgucg

SEQ ID NO: 2360225 - RNA, 14 nt, Bordetella pertussis
cgccauccuggccg

SEQ ID NO: 2360226 - RNA, 16 nt, Bordetella pertussis
cgccauccuggccgcc

SEQ ID NO: 2360227 - RNA, 18 nt, Bordetella pertussis
cgccauccuggccgccgc

SEQ ID NO: 2360228 - RNA, 20 nt, Bordetella pertussis
cgccauccuggccgccgcgg

SEQ ID NO: 2360229 - RNA, 21 nt, Bordetella pertussis
cgccaucgacgcuugccggcg

SEQ ID NO: 2360230 - RNA, 22 nt, Bordetella pertussis
cgccaucgacgcuugccggcga

SEQ ID NO: 2360231 - RNA, 23 nt, Bordetella pertussis
cgccaucgacgcuugccggcgau

SEQ ID NO: 2360232 - RNA, 15 nt, Bordetella pertussis
cgccaucgacgggcg

SEQ ID NO: 2360233 - RNA, 17 nt, Bordetella pertussis
cgccaucgacgggcggc

SEQ ID NO: 2360234 - RNA, 16 nt, Bordetella pertussis
cgccaucgcgucgacg

SEQ ID NO: 2360235 - RNA, 22 nt, Bordetella pertussis
cgccaucggcauuucgcauacc

SEQ ID NO: 2360236 - RNA, 14 nt, Bordetella pertussis
cgccaucggccggc

SEQ ID NO: 2360237 - RNA, 18 nt, Bordetella pertussis
cgccaucggucucuucga

SEQ ID NO: 2360238 - RNA, 18 nt, Bordetella pertussis
cgccaucgucguagcgcc

SEQ ID NO: 2360239 - RNA, 19 nt, Bordetella pertussis
cgccaucgucguagcgcca

SEQ ID NO: 2360240 - RNA, 23 nt, Bordetella pertussis
cgccaucucaaccacgaacacga

SEQ ID NO: 2360241 - RNA, 12 nt, Bordetella pertussis
cgccaucucgcg

SEQ ID NO: 2360242 - RNA, 14 nt, Bordetella pertussis
cgccaucucgcgcg

SEQ ID NO: 2360243 - RNA, 15 nt, Bordetella pertussis
cgccaucucgcgcgc

SEQ ID NO: 2360244 - RNA, 16 nt, Bordetella pertussis
cgccaucucgcgcgcu

SEQ ID NO: 2360245 - RNA, 14 nt, Bordetella pertussis
cgccaucucgucgg

SEQ ID NO: 2360246 - RNA, 22 nt, Bordetella pertussis
cgccaucucgucggucaugccc

SEQ ID NO: 2360247 - RNA, 13 nt, Bordetella pertussis
cgccaucugcugc

SEQ ID NO: 2360248 - RNA, 16 nt, Bordetella pertussis
cgccaucuugcaggcg

SEQ ID NO: 2360249 - RNA, 17 nt, Bordetella pertussis
cgccaugaaagcgaaca

SEQ ID NO: 2360250 - RNA, 20 nt, Bordetella pertussis
cgccaugaacucgcgcucgg

SEQ ID NO: 2360251 - RNA, 14 nt, Bordetella pertussis
cgccaugaccacgu

SEQ ID NO: 2360252 - RNA, 18 nt, Bordetella pertussis
cgccaugacgcuggucga

SEQ ID NO: 2360253 - RNA, 16 nt, Bordetella pertussis
cgccaugagcgcuuga

SEQ ID NO: 2360254 - RNA, 21 nt, Bordetella pertussis
cgcccacugccaggcgagcgc

SEQ ID NO: 2360255 - RNA, 23 nt, Bordetella pertussis
cgcccacugccaggcgagcgccg

SEQ ID NO: 2360256 - RNA, 18 nt, Bordetella pertussis
cgcccacuuccucggcgc

SEQ ID NO: 2360257 - RNA, 17 nt, Bordetella pertussis
cgcccagauggccgaau

SEQ ID NO: 2360258 - RNA, 12 nt, Bordetella pertussis
cgcccagcaccu

SEQ ID NO: 2360259 - RNA, 19 nt, Bordetella pertussis
cgcccagcaccucgacgca

SEQ ID NO: 2360260 - RNA, 21 nt, Bordetella pertussis
cgcccagcaccucgacgcagc

SEQ ID NO: 2360261 - RNA, 23 nt, Bordetella pertussis
cgcccagcagauaccggcauggc

SEQ ID NO: 2360262 - RNA, 15 nt, Bordetella pertussis
cgcccagcagcgcca

SEQ ID NO: 2360263 - RNA, 16 nt, Bordetella pertussis
cgcccagcagcgccac

SEQ ID NO: 2360264 - RNA, 11 nt, Bordetella pertussis
cgcccagcagg

SEQ ID NO: 2360265 - RNA, 16 nt, Bordetella pertussis
cgcccagcauccgcgc

SEQ ID NO: 2360266 - RNA, 20 nt, Bordetella pertussis
cgcccagcauccgcgccagg

SEQ ID NO: 2360267 - RNA, 17 nt, Bordetella pertussis
cgcccagcaugcgcgcg

SEQ ID NO: 2360268 - RNA, 13 nt, Bordetella pertussis
cgcccagccaggc

SEQ ID NO: 2360269 - RNA, 17 nt, Bordetella pertussis
cgcccagccaggcgcca

SEQ ID NO: 2360270 - RNA, 18 nt, Bordetella pertussis
cgcccagccaggcgccag

SEQ ID NO: 2360271 - RNA, 19 nt, Bordetella pertussis
cgcccagccaggcgccagc

SEQ ID NO: 2360272 - RNA, 12 nt, Bordetella pertussis
cgcccagccccg

SEQ ID NO: 2360273 - RNA, 13 nt, Bordetella pertussis
cgcccagccccgc

SEQ ID NO: 2360274 - RNA, 14 nt, Bordetella pertussis
cgcccagccccgcg

SEQ ID NO: 2360275 - RNA, 18 nt, Bordetella pertussis
cgcccagccccgcggccg

SEQ ID NO: 2360276 - RNA, 13 nt, Bordetella pertussis
cgcccagcccugc

SEQ ID NO: 2360277 - RNA, 17 nt, Bordetella pertussis
cgcccagcccugcccgc

SEQ ID NO: 2360278 - RNA, 14 nt, Bordetella pertussis
cgcccagccgcagc

SEQ ID NO: 2360279 - RNA, 15 nt, Bordetella pertussis
cgcccagccgcagca

SEQ ID NO: 2360280 - RNA, 19 nt, Bordetella pertussis
cgcccagccgcagcaggcg

SEQ ID NO: 2360281 - RNA, 14 nt, Bordetella pertussis
cgcccagccgccug

SEQ ID NO: 2360282 - RNA, 13 nt, Bordetella pertussis
cgcccagccgcgc

SEQ ID NO: 2360283 - RNA, 15 nt, Bordetella pertussis
cgcccagccgcgcca

SEQ ID NO: 2360284 - RNA, 12 nt, Bordetella pertussis
cgcccagccggc

SEQ ID NO: 2360285 - RNA, 15 nt, Bordetella pertussis
cgcccagccggccga

SEQ ID NO: 2360286 - RNA, 13 nt, Bordetella pertussis
cgcccagccugcc

SEQ ID NO: 2360287 - RNA, 14 nt, Bordetella pertussis
cgcccagccugccg

SEQ ID NO: 2360288 - RNA, 22 nt, Bordetella pertussis
cgcccagcgacgagggcgccau

SEQ ID NO: 2360289 - RNA, 16 nt, Bordetella pertussis
cgcccagcgagccggc

SEQ ID NO: 2360290 - RNA, 17 nt, Bordetella pertussis
cgcccagcgagccggcc

SEQ ID NO: 2360291 - RNA, 18 nt, Bordetella pertussis
cgcccagcgagccggcca

SEQ ID NO: 2360292 - RNA, 21 nt, Bordetella pertussis
cgcccagcgagccggccagcg

SEQ ID NO: 2360293 - RNA, 12 nt, Bordetella pertussis
cgcccagcgcca

SEQ ID NO: 2360294 - RNA, 15 nt, Bordetella pertussis
cgcccagcgccauca

SEQ ID NO: 2360295 - RNA, 14 nt, Bordetella pertussis
cgcccagcgccggc

SEQ ID NO: 2360296 - RNA, 15 nt, Bordetella pertussis
cgcccagcgccggca

SEQ ID NO: 2360297 - RNA, 19 nt, Bordetella pertussis
cgcccagcgccggcacgcu

SEQ ID NO: 2360298 - RNA, 22 nt, Bordetella pertussis
cgcccagcgccugcaaguccag

SEQ ID NO: 2360299 - RNA, 21 nt, Bordetella pertussis
cgcccagcgcgucggccagcg

SEQ ID NO: 2360300 - RNA, 20 nt, Bordetella pertussis
cgcccagcgcgugggccagc

SEQ ID NO: 2360301 - RNA, 21 nt, Bordetella pertussis
cgcccagcgcgugggccagca

SEQ ID NO: 2360302 - RNA, 22 nt, Bordetella pertussis
cgcccagcgcgugggccagcaa

SEQ ID NO: 2360303 - RNA, 20 nt, Bordetella pertussis
cgcccagcgcuugcacgcca

SEQ ID NO: 2360304 - RNA, 14 nt, Bordetella pertussis
cgcccagcggcagg

SEQ ID NO: 2360305 - RNA, 19 nt, Bordetella pertussis
cgcccagcggcaggcuggc

SEQ ID NO: 2360306 - RNA, 12 nt, Bordetella pertussis
cgcccagcggcg

SEQ ID NO: 2360307 - RNA, 13 nt, Bordetella pertussis
cgcccagcggcgc

SEQ ID NO: 2360308 - RNA, 15 nt, Bordetella pertussis
cgcccagcggcgccg

SEQ ID NO: 2360309 - RNA, 13 nt, Bordetella pertussis
cgcccagcugcuu

SEQ ID NO: 2360310 - RNA, 14 nt, Bordetella pertussis
cgcccagcugcuuc

SEQ ID NO: 2360311 - RNA, 16 nt, Bordetella pertussis
cgcccagcuggcgccc

SEQ ID NO: 2360312 - RNA, 17 nt, Bordetella pertussis
cgcccagcuggcgcccc

SEQ ID NO: 2360313 - RNA, 23 nt, Bordetella pertussis
cgcccagcuugaugccgccgaac

SEQ ID NO: 2360314 - RNA, 23 nt, Bordetella pertussis
cgcccaggagcaacuggggcgcu

SEQ ID NO: 2360315 - RNA, 14 nt, Bordetella pertussis
cgcccaggccagcc

SEQ ID NO: 2360316 - RNA, 16 nt, Bordetella pertussis
cgcccaggcccaccgc

SEQ ID NO: 2360317 - RNA, 19 nt, Bordetella pertussis
cgcccaggcccaccgcauc

SEQ ID NO: 2360318 - RNA, 14 nt, Bordetella pertussis
cgcccaggcccagc

SEQ ID NO: 2360319 - RNA, 14 nt, Bordetella pertussis
cgcccaggccgggc

SEQ ID NO: 2360320 - RNA, 21 nt, Bordetella pertussis
cgcccaggccgggcgagccga

SEQ ID NO: 2360321 - RNA, 16 nt, Bordetella pertussis
cgcccaggccguggcg

SEQ ID NO: 2360322 - RNA, 18 nt, Bordetella pertussis
cgcccaggccguggcgca

SEQ ID NO: 2360323 - RNA, 21 nt, Bordetella pertussis
cgcccaggccguggcgcacca

SEQ ID NO: 2360324 - RNA, 18 nt, Bordetella pertussis
cgcccaggcgaugcccag

SEQ ID NO: 2360325 - RNA, 19 nt, Bordetella pertussis
cgcccaggcgaugcccagc

SEQ ID NO: 2360326 - RNA, 20 nt, Bordetella pertussis
cgcccaggcgaugcccagcg

SEQ ID NO: 2360327 - RNA, 12 nt, Bordetella pertussis
cgcccaggcgca

SEQ ID NO: 2360328 - RNA, 16 nt, Bordetella pertussis
cgcccaggcgcagccg

SEQ ID NO: 2360329 - RNA, 23 nt, Bordetella pertussis
cgcccaggcgcagccgcgcgccu

SEQ ID NO: 2360330 - RNA, 18 nt, Bordetella pertussis
cgcccaggggccggcgcg

SEQ ID NO: 2360331 - RNA, 19 nt, Bordetella pertussis
cgcccaggggccggcgcgc

SEQ ID NO: 2360332 - RNA, 20 nt, Bordetella pertussis
cgcccaggggccggcgcgcc

SEQ ID NO: 2360333 - RNA, 21 nt, Bordetella pertussis
cgcccaggggccggcgcgccg

SEQ ID NO: 2360334 - RNA, 19 nt, Bordetella pertussis
cgcccagggucggaugcgg

SEQ ID NO: 2360335 - RNA, 21 nt, Bordetella pertussis
cgcccagguccgaaccgaccg

SEQ ID NO: 2360336 - RNA, 22 nt, Bordetella pertussis
cgcccagguccgaaccgaccgc

SEQ ID NO: 2360337 - RNA, 23 nt, Bordetella pertussis
cgcccagguccgaaccgaccgcc

SEQ ID NO: 2360338 - RNA, 16 nt, Bordetella pertussis
cgcccagguccugcgc

SEQ ID NO: 2360339 - RNA, 17 nt, Bordetella pertussis
cgcccaggucggacgcg

SEQ ID NO: 2360340 - RNA, 19 nt, Bordetella pertussis
cgcccaggucggacgcgcc

SEQ ID NO: 2360341 - RNA, 21 nt, Bordetella pertussis
cgcccaggucggacgcgccgg

SEQ ID NO: 2360342 - RNA, 23 nt, Bordetella pertussis
cgcccaggucggacgcgccgggc

SEQ ID NO: 2360343 - RNA, 15 nt, Bordetella pertussis
cgcccagguugcggc

SEQ ID NO: 2360344 - RNA, 17 nt, Bordetella pertussis
cgcccagguugcggccg

SEQ ID NO: 2360345 - RNA, 18 nt, Bordetella pertussis
cgcccagguugcggccgc

SEQ ID NO: 2360346 - RNA, 20 nt, Bordetella pertussis
cgcccagguugcggccgcca

SEQ ID NO: 2360347 - RNA, 21 nt, Bordetella pertussis
cgcccagguugcggccgccac

SEQ ID NO: 2360348 - RNA, 22 nt, Bordetella pertussis
cgcccagguugcggccgccacc

SEQ ID NO: 2360349 - RNA, 23 nt, Bordetella pertussis
cgcccagguugcggccgccaccc

SEQ ID NO: 2360350 - RNA, 20 nt, Bordetella pertussis
cgcccaguauggugaccggc

SEQ ID NO: 2360351 - RNA, 22 nt, Bordetella pertussis
cgcccaguauggugaccggcgu

SEQ ID NO: 2360352 - RNA, 19 nt, Bordetella pertussis
cgcccagucccaggccgac

SEQ ID NO: 2360353 - RNA, 17 nt, Bordetella pertussis
cgcccagucguccagca

SEQ ID NO: 2360354 - RNA, 19 nt, Bordetella pertussis
cgcccaguuccacgcggcc

SEQ ID NO: 2360355 - RNA, 24 nt, Bordetella pertussis
cgcccaguuccacgcggccguggc

SEQ ID NO: 2360356 - RNA, 22 nt, Bordetella pertussis
cgcccaugaucagggccgugcc

SEQ ID NO: 2360357 - RNA, 13 nt, Bordetella pertussis
cgcccaugauggu

SEQ ID NO: 2360358 - RNA, 15 nt, Bordetella pertussis
cgcccaugccgccca

SEQ ID NO: 2360359 - RNA, 17 nt, Bordetella pertussis
cgcccaugccgcccaug

SEQ ID NO: 2360360 - RNA, 23 nt, Bordetella pertussis
cgcccaugccgcccaugccgccg

SEQ ID NO: 2360361 - RNA, 14 nt, Bordetella pertussis
cgcccaugccgccg

SEQ ID NO: 2360362 - RNA, 16 nt, Bordetella pertussis
cgcccaugcgaucggc

SEQ ID NO: 2360363 - RNA, 17 nt, Bordetella pertussis
cgcccaugcgcauggcc

SEQ ID NO: 2360364 - RNA, 20 nt, Bordetella pertussis
cgcccaugcgcauggccagc

SEQ ID NO: 2360365 - RNA, 14 nt, Bordetella pertussis
cgcccaugcgcugg

SEQ ID NO: 2360366 - RNA, 18 nt, Bordetella pertussis
cgcccaugcgcuggcgca

SEQ ID NO: 2360367 - RNA, 15 nt, Bordetella pertussis
cgcccgcccgcugac

SEQ ID NO: 2360368 - RNA, 15 nt, Bordetella pertussis
cgcccgcccugggca

SEQ ID NO: 2360369 - RNA, 13 nt, Bordetella pertussis
cgcccgccgacga

SEQ ID NO: 2360370 - RNA, 14 nt, Bordetella pertussis
cgcccgccgccggg

SEQ ID NO: 2360371 - RNA, 15 nt, Bordetella pertussis
cgcccgccgccgggc

SEQ ID NO: 2360372 - RNA, 21 nt, Bordetella pertussis
cgcccgccgcgucggcgccga

SEQ ID NO: 2360373 - RNA, 14 nt, Bordetella pertussis
cgcccgccgggccg

SEQ ID NO: 2360374 - RNA, 15 nt, Bordetella pertussis
cgcccgccgggccgu

SEQ ID NO: 2360375 - RNA, 14 nt, Bordetella pertussis
cgcccgccguggcc

SEQ ID NO: 2360376 - RNA, 15 nt, Bordetella pertussis
cgcccgccugcagca

SEQ ID NO: 2360377 - RNA, 17 nt, Bordetella pertussis
cgcccgccugcagcagc

SEQ ID NO: 2360378 - RNA, 15 nt, Bordetella pertussis
cgcccgccugcgcca

SEQ ID NO: 2360379 - RNA, 18 nt, Bordetella pertussis
cgcccgccugcgccagcc

SEQ ID NO: 2360380 - RNA, 20 nt, Bordetella pertussis
cgcccgccugcgccagccgc

SEQ ID NO: 2360381 - RNA, 22 nt, Bordetella pertussis
cgcccgccugcgccagccgcgc

SEQ ID NO: 2360382 - RNA, 16 nt, Bordetella pertussis
cgcccgccugcguggc

SEQ ID NO: 2360383 - RNA, 21 nt, Bordetella pertussis
cgcccgccugcguggcgggcc

SEQ ID NO: 2360384 - RNA, 18 nt, Bordetella pertussis
cgcccgccuucagcgggc

SEQ ID NO: 2360385 - RNA, 20 nt, Bordetella pertussis
cgcccgccuucggcggcggg

SEQ ID NO: 2360386 - RNA, 14 nt, Bordetella pertussis
cgcccgcgacgcug

SEQ ID NO: 2360387 - RNA, 15 nt, Bordetella pertussis
cgcccgcgacgcugg

SEQ ID NO: 2360388 - RNA, 19 nt, Bordetella pertussis
cgcccgcgagcggccagcc

SEQ ID NO: 2360389 - RNA, 20 nt, Bordetella pertussis
cgcccgcgccaucgcgucga

SEQ ID NO: 2360390 - RNA, 14 nt, Bordetella pertussis
cgcccgcgcccagc

SEQ ID NO: 2360391 - RNA, 12 nt, Bordetella pertussis
cgcccgcgcgcg

SEQ ID NO: 2360392 - RNA, 13 nt, Bordetella pertussis
cgcccgcgcgcga

SEQ ID NO: 2360393 - RNA, 17 nt, Bordetella pertussis
cgcccgcgcgcgagcug

SEQ ID NO: 2360394 - RNA, 18 nt, Bordetella pertussis
cgcccgcgcgcgagcugc

SEQ ID NO: 2360395 - RNA, 23 nt, Bordetella pertussis
cgcccgcgcgguauugcgccacc

SEQ ID NO: 2360396 - RNA, 14 nt, Bordetella pertussis
cgcccgcggaucgg

SEQ ID NO: 2360397 - RNA, 15 nt, Bordetella pertussis
cgcccgcggccagcc

SEQ ID NO: 2360398 - RNA, 12 nt, Bordetella pertussis
cgcccgcggcgc

SEQ ID NO: 2360399 - RNA, 14 nt, Bordetella pertussis
cgcccgcggcgccc

SEQ ID NO: 2360400 - RNA, 15 nt, Bordetella pertussis
cgcccgcggcgccca

SEQ ID NO: 2360401 - RNA, 17 nt, Bordetella pertussis
cgcccgcggcgcccagc

SEQ ID NO: 2360402 - RNA, 14 nt, Bordetella pertussis
cgcccgcggcggcc

SEQ ID NO: 2360403 - RNA, 17 nt, Bordetella pertussis
cgcccgcggcggcccgg

SEQ ID NO: 2360404 - RNA, 13 nt, Bordetella pertussis
cgcccgcguacag

SEQ ID NO: 2360405 - RNA, 14 nt, Bordetella pertussis
cgcccgcgucacga

SEQ ID NO: 2360406 - RNA, 17 nt, Bordetella pertussis
cgcccgcuacgcgggcu

SEQ ID NO: 2360407 - RNA, 14 nt, Bordetella pertussis
cgcccgcuccacca

SEQ ID NO: 2360408 - RNA, 18 nt, Bordetella pertussis
cgcccgcuccaccagcac

SEQ ID NO: 2360409 - RNA, 12 nt, Bordetella pertussis
cgcccgcugacc

SEQ ID NO: 2360410 - RNA, 14 nt, Bordetella pertussis
cgcccgcugaccgg

SEQ ID NO: 2360411 - RNA, 16 nt, Bordetella pertussis
cgcccgcugaccggcc

SEQ ID NO: 2360412 - RNA, 17 nt, Bordetella pertussis
cgcccgcugaccggccu

SEQ ID NO: 2360413 - RNA, 14 nt, Bordetella pertussis
cgcccgcuuccuug

SEQ ID NO: 2360414 - RNA, 16 nt, Bordetella pertussis
cgcccgcuuccuuggg

SEQ ID NO: 2360415 - RNA, 19 nt, Bordetella pertussis
cgcccgcuucuuccuugcg

SEQ ID NO: 2360416 - RNA, 18 nt, Bordetella pertussis
cgcccgcuugcggccggc

SEQ ID NO: 2360417 - RNA, 16 nt, Bordetella pertussis
cgcccggcaacccgcc

SEQ ID NO: 2360418 - RNA, 15 nt, Bordetella pertussis
cgcccggcaugggcg

SEQ ID NO: 2360419 - RNA, 14 nt, Bordetella pertussis
cgcccggcccaggc

SEQ ID NO: 2360420 - RNA, 15 nt, Bordetella pertussis
cgcccggccgccuca

SEQ ID NO: 2360421 - RNA, 12 nt, Bordetella pertussis
cgcccggccggc

SEQ ID NO: 2360422 - RNA, 18 nt, Bordetella pertussis
cgcccggccggcacggcc

SEQ ID NO: 2360423 - RNA, 20 nt, Bordetella pertussis
cgcccggccggcacggccgg

SEQ ID NO: 2360424 - RNA, 14 nt, Bordetella pertussis
cgcccggccggccc

SEQ ID NO: 2360425 - RNA, 22 nt, Bordetella pertussis
cgcccggccggcccgcgcgccu

SEQ ID NO: 2360426 - RNA, 14 nt, Bordetella pertussis
cgcccggccggccu

SEQ ID NO: 2360427 - RNA, 15 nt, Bordetella pertussis
cgcccggccugcggg

SEQ ID NO: 2360428 - RNA, 21 nt, Bordetella pertussis
cgcccggcgaaagcgucggcu

SEQ ID NO: 2360429 - RNA, 11 nt, Bordetella pertussis
cgcccggcgcc

SEQ ID NO: 2360430 - RNA, 12 nt, Bordetella pertussis
cgcccggcgcca

SEQ ID NO: 2360431 - RNA, 13 nt, Bordetella pertussis
cgcccggcgccau

SEQ ID NO: 2360432 - RNA, 15 nt, Bordetella pertussis
cgcccggcgccgcgc

SEQ ID NO: 2360433 - RNA, 14 nt, Bordetella pertussis
cgcccggcgcgccu

SEQ ID NO: 2360434 - RNA, 16 nt, Bordetella pertussis
cgcccggcgcgccuuc

SEQ ID NO: 2360435 - RNA, 21 nt, Bordetella pertussis
cgcccggcgcggugaggcggc

SEQ ID NO: 2360436 - RNA, 22 nt, Bordetella pertussis
cgcccggcgcggugaggcggcc

SEQ ID NO: 2360437 - RNA, 12 nt, Bordetella pertussis
cgcccggcggcc

SEQ ID NO: 2360438 - RNA, 17 nt, Bordetella pertussis
cgcccggcggccaggcc

SEQ ID NO: 2360439 - RNA, 18 nt, Bordetella pertussis
cgcccggcggccaggccg

SEQ ID NO: 2360440 - RNA, 19 nt, Bordetella pertussis
cgcccggcggccaggccgg

SEQ ID NO: 2360441 - RNA, 13 nt, Bordetella pertussis
cgcccggcggcgc

SEQ ID NO: 2360442 - RNA, 17 nt, Bordetella pertussis
cgcccggcggcgcggcg

SEQ ID NO: 2360443 - RNA, 17 nt, Bordetella pertussis
cgcccggcgugacgcug

SEQ ID NO: 2360444 - RNA, 18 nt, Bordetella pertussis
cgcccggcuccaggccgc

SEQ ID NO: 2360445 - RNA, 21 nt, Bordetella pertussis
cgcccggcuccaggccgccca

SEQ ID NO: 2360446 - RNA, 14 nt, Bordetella pertussis
cgcccggcucgcug

SEQ ID NO: 2360447 - RNA, 13 nt, Bordetella pertussis
cgcccgggccggc

SEQ ID NO: 2360448 - RNA, 13 nt, Bordetella pertussis
cgcccgggccguc

SEQ ID NO: 2360449 - RNA, 15 nt, Bordetella pertussis
cgcccgggccgucua

SEQ ID NO: 2360450 - RNA, 13 nt, Bordetella pertussis
cgcccgggcgccg

SEQ ID NO: 2360451 - RNA, 15 nt, Bordetella pertussis
cgcccgggcgccggc

SEQ ID NO: 2360452 - RNA, 17 nt, Bordetella pertussis
cgcccgggcgccggcac

SEQ ID NO: 2360453 - RNA, 12 nt, Bordetella pertussis
cgcccgggcggc

SEQ ID NO: 2360454 - RNA, 20 nt, Bordetella pertussis
cgcccgggcugauccgcacc

SEQ ID NO: 2360455 - RNA, 23 nt, Bordetella pertussis
cgcccgggcugauccgcaccggc

SEQ ID NO: 2360456 - RNA, 13 nt, Bordetella pertussis
cgcccggggcggc

SEQ ID NO: 2360457 - RNA, 21 nt, Bordetella pertussis
cgcccggggugugccgaugcu

SEQ ID NO: 2360458 - RNA, 23 nt, Bordetella pertussis
cgcccggguuggcguccaggcgc

SEQ ID NO: 2360459 - RNA, 22 nt, Bordetella pertussis
cgcccggucugccacacgcggu

SEQ ID NO: 2360460 - RNA, 14 nt, Bordetella pertussis
cgcccggugccugc

SEQ ID NO: 2360461 - RNA, 17 nt, Bordetella pertussis
cgcccggugcgcgcagg

SEQ ID NO: 2360462 - RNA, 22 nt, Bordetella pertussis
cgcccggugcgcgcagggcggc

SEQ ID NO: 2360463 - RNA, 20 nt, Bordetella pertussis
cgcccggugcguaccagccc

SEQ ID NO: 2360464 - RNA, 16 nt, Bordetella pertussis
cgcccguccacggccu

SEQ ID NO: 2360465 - RNA, 21 nt, Bordetella pertussis
cgcccguccacggccugcgcg

SEQ ID NO: 2360466 - RNA, 14 nt, Bordetella pertussis
cgcccgucccgacc

SEQ ID NO: 2360467 - RNA, 20 nt, Bordetella pertussis
cgcccgucccgacccccggc

SEQ ID NO: 2360468 - RNA, 16 nt, Bordetella pertussis
cgcccguccgggcggc

SEQ ID NO: 2360469 - RNA, 15 nt, Bordetella pertussis
cgcccgucucgcgcg

SEQ ID NO: 2360470 - RNA, 22 nt, Bordetella pertussis
cgcccgucucgcgcgccaggug

SEQ ID NO: 2360471 - RNA, 14 nt, Bordetella pertussis
cgcccgugccgcag

SEQ ID NO: 2360472 - RNA, 13 nt, Bordetella pertussis
cgcccgugcgcgg

SEQ ID NO: 2360473 - RNA, 15 nt, Bordetella pertussis
cgcccgugcgcggcg

SEQ ID NO: 2360474 - RNA, 16 nt, Bordetella pertussis
cgcccgugcgcggcga

SEQ ID NO: 2360475 - RNA, 19 nt, Bordetella pertussis
cgcccgugcgcggcgagcc

SEQ ID NO: 2360476 - RNA, 23 nt, Bordetella pertussis
cgcccgugcgcggcgagccgcgc

SEQ ID NO: 2360477 - RNA, 14 nt, Bordetella pertussis
cgcccgugucgccg

SEQ ID NO: 2360478 - RNA, 20 nt, Bordetella pertussis
cgcccgugucgccgucggua

SEQ ID NO: 2360479 - RNA, 17 nt, Bordetella pertussis
cgcccucaguccagcug

SEQ ID NO: 2360480 - RNA, 14 nt, Bordetella pertussis
cgcccucgcccccg

SEQ ID NO: 2360481 - RNA, 14 nt, Bordetella pertussis
cgcccucgcgccac

SEQ ID NO: 2360482 - RNA, 14 nt, Bordetella pertussis
cgccgaccacgcug

SEQ ID NO: 2360483 - RNA, 22 nt, Bordetella pertussis
cgccgaccagguaucgacccag

SEQ ID NO: 2360484 - RNA, 16 nt, Bordetella pertussis
cgccgacccgggcggg

SEQ ID NO: 2360485 - RNA, 19 nt, Bordetella pertussis
cgccgacccgggcgggcgu

SEQ ID NO: 2360486 - RNA, 16 nt, Bordetella pertussis
cgccgacccugcccgg

SEQ ID NO: 2360487 - RNA, 20 nt, Bordetella pertussis
cgccgacccugcccggcagg

SEQ ID NO: 2360488 - RNA, 17 nt, Bordetella pertussis
cgccgaccgcacgaugg

SEQ ID NO: 2360489 - RNA, 22 nt, Bordetella pertussis
cgccgaccgcacgauggcgcgc

SEQ ID NO: 2360490 - RNA, 14 nt, Bordetella pertussis
cgccgaccggcccc

SEQ ID NO: 2360491 - RNA, 15 nt, Bordetella pertussis
cgccgaccggcccca

SEQ ID NO: 2360492 - RNA, 14 nt, Bordetella pertussis
cgccgaccgggccg

SEQ ID NO: 2360493 - RNA, 19 nt, Bordetella pertussis
cgccgaccgggccgaccag

SEQ ID NO: 2360494 - RNA, 21 nt, Bordetella pertussis
cgccgaccgggccgaccaggc

SEQ ID NO: 2360495 - RNA, 14 nt, Bordetella pertussis
cgccgaccucggca

SEQ ID NO: 2360496 - RNA, 18 nt, Bordetella pertussis
cgccgaccucggcaccga

SEQ ID NO: 2360497 - RNA, 23 nt, Bordetella pertussis
cgccgaccucuucguugucgcgc

SEQ ID NO: 2360498 - RNA, 16 nt, Bordetella pertussis
cgccgaccuggcgccc

SEQ ID NO: 2360499 - RNA, 18 nt, Bordetella pertussis
cgccgaccuggcgcccga

SEQ ID NO: 2360500 - RNA, 18 nt, Bordetella pertussis
cgccgacgaaaugccggc

SEQ ID NO: 2360501 - RNA, 21 nt, Bordetella pertussis
cgccgacgaaaugccggcgaa

SEQ ID NO: 2360502 - RNA, 13 nt, Bordetella pertussis
cgccgacgaccga

SEQ ID NO: 2360503 - RNA, 15 nt, Bordetella pertussis
cgccgacgaccgaac

SEQ ID NO: 2360504 - RNA, 21 nt, Bordetella pertussis
cgccgacgauaucgcgaaagc

SEQ ID NO: 2360505 - RNA, 13 nt, Bordetella pertussis
cgccgacgaugcc

SEQ ID NO: 2360506 - RNA, 19 nt, Bordetella pertussis
cgccgacgaugccgcccac

SEQ ID NO: 2360507 - RNA, 20 nt, Bordetella pertussis
cgccgacgaugucgccgccg

SEQ ID NO: 2360508 - RNA, 23 nt, Bordetella pertussis
cgccgacgaugucgccgccgcgc

SEQ ID NO: 2360509 - RNA, 14 nt, Bordetella pertussis
cgccgacgccgcca

SEQ ID NO: 2360510 - RNA, 18 nt, Bordetella pertussis
cgccgacgcgccgggcca

SEQ ID NO: 2360511 - RNA, 15 nt, Bordetella pertussis
cgccgacgcgcuggc

SEQ ID NO: 2360512 - RNA, 22 nt, Bordetella pertussis
cgccgacgcuucguucagcuuc

SEQ ID NO: 2360513 - RNA, 13 nt, Bordetella pertussis
cgccgacggcaug

SEQ ID NO: 2360514 - RNA, 14 nt, Bordetella pertussis
cgccgacggcaugg

SEQ ID NO: 2360515 - RNA, 16 nt, Bordetella pertussis
cgccgacggcauggcc

SEQ ID NO: 2360516 - RNA, 22 nt, Bordetella pertussis
cgccgacggcauggcggccagc

SEQ ID NO: 2360517 - RNA, 12 nt, Bordetella pertussis
cgccgacggcgc

SEQ ID NO: 2360518 - RNA, 13 nt, Bordetella pertussis
cgccgacggcgcc

SEQ ID NO: 2360519 - RNA, 14 nt, Bordetella pertussis
cgccgacggcgccc

SEQ ID NO: 2360520 - RNA, 18 nt, Bordetella pertussis
cgccgacggcgcccugca

SEQ ID NO: 2360521 - RNA, 14 nt, Bordetella pertussis
cgccgacggcggcg

SEQ ID NO: 2360522 - RNA, 16 nt, Bordetella pertussis
cgccgacggcggcgcg

SEQ ID NO: 2360523 - RNA, 18 nt, Bordetella pertussis
cgccgacggcggcgcggc

SEQ ID NO: 2360524 - RNA, 20 nt, Bordetella pertussis
cgccgacggcggcgcggcgc

SEQ ID NO: 2360525 - RNA, 21 nt, Bordetella pertussis
cgccgacugggcuugccggug

SEQ ID NO: 2360526 - RNA, 18 nt, Bordetella pertussis
accugcaaccccaccggc

SEQ ID NO: 2360527 - RNA, 15 nt, Bordetella pertussis
accugcaccgaagca

SEQ ID NO: 2360528 - RNA, 17 nt, Bordetella pertussis
accugcacgauggcgcc

SEQ ID NO: 2360529 - RNA, 19 nt, Bordetella pertussis
accugcacgauggcgccgg

SEQ ID NO: 2360530 - RNA, 23 nt, Bordetella pertussis
accugcacgauggcgccggcuuc

SEQ ID NO: 2360531 - RNA, 16 nt, Bordetella pertussis
accugcagcaggcgca

SEQ ID NO: 2360532 - RNA, 17 nt, Bordetella pertussis
accugcagcaggcgcac

SEQ ID NO: 2360533 - RNA, 23 nt, Bordetella pertussis
accugcagggucagcccgccauc

SEQ ID NO: 2360534 - RNA, 13 nt, Bordetella pertussis
accugccacugca

SEQ ID NO: 2360535 - RNA, 16 nt, Bordetella pertussis
accugcccgagaccgc

SEQ ID NO: 2360536 - RNA, 16 nt, Bordetella pertussis
accugccugccgccug

SEQ ID NO: 2360537 - RNA, 22 nt, Bordetella pertussis
accugcgccaggugcuugcggc

SEQ ID NO: 2360538 - RNA, 19 nt, Bordetella pertussis
accugcgccgcuuccggcc

SEQ ID NO: 2360539 - RNA, 21 nt, Bordetella pertussis
accugcgcuaugggggcgagc

SEQ ID NO: 2360540 - RNA, 14 nt, Bordetella pertussis
accugcgggccgca

SEQ ID NO: 2360541 - RNA, 15 nt, Bordetella pertussis
accugcgggcgcagc

SEQ ID NO: 2360542 - RNA, 22 nt, Bordetella pertussis
accugcgggcgcagcgccgcuu

SEQ ID NO: 2360543 - RNA, 18 nt, Bordetella pertussis
accugcgucugcacgcug

SEQ ID NO: 2360544 - RNA, 22 nt, Bordetella pertussis
accugcgucugcgugccggagc

SEQ ID NO: 2360545 - RNA, 16 nt, Bordetella pertussis
accugcguggccucuu

SEQ ID NO: 2360546 - RNA, 15 nt, Bordetella pertussis
accugcuccagcgaa

SEQ ID NO: 2360547 - RNA, 17 nt, Bordetella pertussis
accugcucgagcggcgg

SEQ ID NO: 2360548 - RNA, 13 nt, Bordetella pertussis
accugcugcggca

SEQ ID NO: 2360549 - RNA, 15 nt, Bordetella pertussis
accugcugcggcacg

SEQ ID NO: 2360550 - RNA, 20 nt, Bordetella pertussis
accugcugcggcacggccag

SEQ ID NO: 2360551 - RNA, 16 nt, Bordetella pertussis
accugcuggccgccgg

SEQ ID NO: 2360552 - RNA, 17 nt, Bordetella pertussis
accugcuggccgccggc

SEQ ID NO: 2360553 - RNA, 14 nt, Bordetella pertussis
accugcuggcgcgc

SEQ ID NO: 2360554 - RNA, 16 nt, Bordetella pertussis
accugcuggcgcgcac

SEQ ID NO: 2360555 - RNA, 19 nt, Bordetella pertussis
accugcuggcgcgcaccau

SEQ ID NO: 2360556 - RNA, 22 nt, Bordetella pertussis
accugcuggcguuugcgcgcgc

SEQ ID NO: 2360557 - RNA, 23 nt, Bordetella pertussis
accugcuggggguuggccuugcc

SEQ ID NO: 2360558 - RNA, 23 nt, Bordetella pertussis
accugcuugacguagaugcgggu

SEQ ID NO: 2360559 - RNA, 22 nt, Bordetella pertussis
accugcuugagcaccacguccu

SEQ ID NO: 2360560 - RNA, 19 nt, Bordetella pertussis
accugcuuggcgaacacca

SEQ ID NO: 2360561 - RNA, 15 nt, Bordetella pertussis
accuggacgagggcc

SEQ ID NO: 2360562 - RNA, 22 nt, Bordetella pertussis
accuggcccggcaccguccagc

SEQ ID NO: 2360563 - RNA, 22 nt, Bordetella pertussis
accuggcgaucgucaccaucgc

SEQ ID NO: 2360564 - RNA, 23 nt, Bordetella pertussis
accuggcgaucgucaccaucgcc

SEQ ID NO: 2360565 - RNA, 19 nt, Bordetella pertussis
accuggcgcccgacggcgc

SEQ ID NO: 2360566 - RNA, 18 nt, Bordetella pertussis
accuggcgcccggcggcg

SEQ ID NO: 2360567 - RNA, 19 nt, Bordetella pertussis
accuggcgcccggcggcgc

SEQ ID NO: 2360568 - RNA, 13 nt, Bordetella pertussis
accuggcgcgcgg

SEQ ID NO: 2360569 - RNA, 16 nt, Bordetella pertussis
accuggcggugcgccg

SEQ ID NO: 2360570 - RNA, 18 nt, Bordetella pertussis
accuggcggugcgccgca

SEQ ID NO: 2360571 - RNA, 17 nt, Bordetella pertussis
accugggaggggccggc

SEQ ID NO: 2360572 - RNA, 17 nt, Bordetella pertussis
accugggcaaccgccac

SEQ ID NO: 2360573 - RNA, 20 nt, Bordetella pertussis
accugggcaucaacacgcug

SEQ ID NO: 2360574 - RNA, 23 nt, Bordetella pertussis
accugggcaucaacacgcuggac

SEQ ID NO: 2360575 - RNA, 15 nt, Bordetella pertussis
accugggccgccugc

SEQ ID NO: 2360576 - RNA, 18 nt, Bordetella pertussis
accugggccgccugcugg

SEQ ID NO: 2360577 - RNA, 20 nt, Bordetella pertussis
accugguacggcaucccgac

SEQ ID NO: 2360578 - RNA, 17 nt, Bordetella pertussis
accuggucaagggcggc

SEQ ID NO: 2360579 - RNA, 18 nt, Bordetella pertussis
accuggucaagggcggcc

SEQ ID NO: 2360580 - RNA, 22 nt, Bordetella pertussis
accuggucaagggcggccaugc

SEQ ID NO: 2360581 - RNA, 19 nt, Bordetella pertussis
accuggucgaucagccccu

SEQ ID NO: 2360582 - RNA, 13 nt, Bordetella pertussis
accuggucggccu

SEQ ID NO: 2360583 - RNA, 14 nt, Bordetella pertussis
accuggucggccuu

SEQ ID NO: 2360584 - RNA, 15 nt, Bordetella pertussis
accuggucggccuuc

SEQ ID NO: 2360585 - RNA, 14 nt, Bordetella pertussis
accuggucgggcgu

SEQ ID NO: 2360586 - RNA, 13 nt, Bordetella pertussis
accugguggcgcu

SEQ ID NO: 2360587 - RNA, 17 nt, Bordetella pertussis
accuguaccagaugaga

SEQ ID NO: 2360588 - RNA, 14 nt, Bordetella pertussis
accuguggcgcacc

SEQ ID NO: 2360589 - RNA, 16 nt, Bordetella pertussis
accuguucggcggcgc

SEQ ID NO: 2360590 - RNA, 20 nt, Bordetella pertussis
accuucaacaucgcccuguc

SEQ ID NO: 2360591 - RNA, 17 nt, Bordetella pertussis
accuucacgacacgccc

SEQ ID NO: 2360592 - RNA, 13 nt, Bordetella pertussis
accuucagcccgg

SEQ ID NO: 2360593 - RNA, 15 nt, Bordetella pertussis
accuucagcccggcg

SEQ ID NO: 2360594 - RNA, 12 nt, Bordetella pertussis
accuuccugcug

SEQ ID NO: 2360595 - RNA, 20 nt, Bordetella pertussis
cgccgauggcgcggccgcca

SEQ ID NO: 2360596 - RNA, 16 nt, Bordetella pertussis
cgccgauggugcgggc

SEQ ID NO: 2360597 - RNA, 22 nt, Bordetella pertussis
cgccgauguaugacuugaccgc

SEQ ID NO: 2360598 - RNA, 23 nt, Bordetella pertussis
cgccgauguccacgaaggcgccg

SEQ ID NO: 2360599 - RNA, 18 nt, Bordetella pertussis
cgccgauugaggccagca

SEQ ID NO: 2360600 - RNA, 23 nt, Bordetella pertussis
cgccgauugaggccagcacgccg

SEQ ID NO: 2360601 - RNA, 17 nt, Bordetella pertussis
cgccgauuucgccgccg

SEQ ID NO: 2360602 - RNA, 18 nt, Bordetella pertussis
cgccgauuucgccgccgc

SEQ ID NO: 2360603 - RNA, 18 nt, Bordetella pertussis
cgccgcaacgccgccggc

SEQ ID NO: 2360604 - RNA, 15 nt, Bordetella pertussis
cgccgcaacgccggg

SEQ ID NO: 2360605 - RNA, 16 nt, Bordetella pertussis
cgccgcaacgccgggc

SEQ ID NO: 2360606 - RNA, 14 nt, Bordetella pertussis
cgccgcaagacggc

SEQ ID NO: 2360607 - RNA, 23 nt, Bordetella pertussis
cgccgcaauagaucauccaggug

SEQ ID NO: 2360608 - RNA, 13 nt, Bordetella pertussis
cgccgcacaucgu

SEQ ID NO: 2360609 - RNA, 18 nt, Bordetella pertussis
cgccgcacaucgucgacg

SEQ ID NO: 2360610 - RNA, 11 nt, Bordetella pertussis
cgccgcaccag

SEQ ID NO: 2360611 - RNA, 16 nt, Bordetella pertussis
cgccgcaccagccuga

SEQ ID NO: 2360612 - RNA, 15 nt, Bordetella pertussis
cgccgcaccagcggc

SEQ ID NO: 2360613 - RNA, 16 nt, Bordetella pertussis
cgccgcaccagcggcg

SEQ ID NO: 2360614 - RNA, 13 nt, Bordetella pertussis
cgccgcaccaggc

SEQ ID NO: 2360615 - RNA, 15 nt, Bordetella pertussis
cgccgcaccaggccg

SEQ ID NO: 2360616 - RNA, 19 nt, Bordetella pertussis
cgccgcacgccggucgcca

SEQ ID NO: 2360617 - RNA, 13 nt, Bordetella pertussis
cgccgcacgggcg

SEQ ID NO: 2360618 - RNA, 15 nt, Bordetella pertussis
cgccgcacgggcgcc

SEQ ID NO: 2360619 - RNA, 21 nt, Bordetella pertussis
cgccgcacgggcgccuguccc

SEQ ID NO: 2360620 - RNA, 15 nt, Bordetella pertussis
cgccgcagauggcgu

SEQ ID NO: 2360621 - RNA, 14 nt, Bordetella pertussis
cgccgcagcaccuc

SEQ ID NO: 2360622 - RNA, 18 nt, Bordetella pertussis
cgccgcagcaccucggcg

SEQ ID NO: 2360623 - RNA, 17 nt, Bordetella pertussis
cgccgcagccgccagcg

SEQ ID NO: 2360624 - RNA, 22 nt, Bordetella pertussis
cgccgcagccgccagcgccugg

SEQ ID NO: 2360625 - RNA, 21 nt, Bordetella pertussis
cgccgcagcgucgcggcgucg

SEQ ID NO: 2360626 - RNA, 22 nt, Bordetella pertussis
cgccgcagcgucgcggcgucga

SEQ ID NO: 2360627 - RNA, 16 nt, Bordetella pertussis
cgccgcagcguggcgu

SEQ ID NO: 2360628 - RNA, 14 nt, Bordetella pertussis
cgccgcagugcgcg

SEQ ID NO: 2360629 - RNA, 17 nt, Bordetella pertussis
cgccgcagugcgcgcgc

SEQ ID NO: 2360630 - RNA, 18 nt, Bordetella pertussis
cgccgcagugcgcgcgcc

SEQ ID NO: 2360631 - RNA, 22 nt, Bordetella pertussis
cgccgcagugcgcgcgccccca

SEQ ID NO: 2360632 - RNA, 23 nt, Bordetella pertussis
cgccgcauaccuuggcgcccagc

SEQ ID NO: 2360633 - RNA, 15 nt, Bordetella pertussis
cgccgcaugccgggc

SEQ ID NO: 2360634 - RNA, 12 nt, Bordetella pertussis
cgccgcaugcgg

SEQ ID NO: 2360635 - RNA, 15 nt, Bordetella pertussis
cgccgcaugcggcgg

SEQ ID NO: 2360636 - RNA, 16 nt, Bordetella pertussis
cgccgcaugggcgcgc

SEQ ID NO: 2360637 - RNA, 17 nt, Bordetella pertussis
cgccgcaugggcgcgcc

SEQ ID NO: 2360638 - RNA, 18 nt, Bordetella pertussis
cgccgcaugggcgcgccc

SEQ ID NO: 2360639 - RNA, 21 nt, Bordetella pertussis
cgccgcaugggcgcgcccggc

SEQ ID NO: 2360640 - RNA, 22 nt, Bordetella pertussis
cgccgcaugggcgcgcccggcg

SEQ ID NO: 2360641 - RNA, 22 nt, Bordetella pertussis
cgccgcauuuccucgaccagcg

SEQ ID NO: 2360642 - RNA, 23 nt, Bordetella pertussis
cgccgcauuuccucgaccagcgc

SEQ ID NO: 2360643 - RNA, 23 nt, Bordetella pertussis
cgccgcauuucguaaagccgcac

SEQ ID NO: 2360644 - RNA, 14 nt, Bordetella pertussis
cgccgccacaggcu

SEQ ID NO: 2360645 - RNA, 15 nt, Bordetella pertussis
cgccgccacaggcug

SEQ ID NO: 2360646 - RNA, 16 nt, Bordetella pertussis
cgccgccacaggcuga

SEQ ID NO: 2360647 - RNA, 19 nt, Bordetella pertussis
cgccgccacaggcugacgc

SEQ ID NO: 2360648 - RNA, 20 nt, Bordetella pertussis
cgccgccacaggcugacgcc

SEQ ID NO: 2360649 - RNA, 13 nt, Bordetella pertussis
cgccgccaccagc

SEQ ID NO: 2360650 - RNA, 17 nt, Bordetella pertussis
cgccgccaccagcggcg

SEQ ID NO: 2360651 - RNA, 22 nt, Bordetella pertussis
cgccgccaccagggcgcccgcc

SEQ ID NO: 2360652 - RNA, 15 nt, Bordetella pertussis
cgccgccacgcgcac

SEQ ID NO: 2360653 - RNA, 18 nt, Bordetella pertussis
cgccgccacgcgcacggc

SEQ ID NO: 2360654 - RNA, 13 nt, Bordetella pertussis
cgccgccacgcug

SEQ ID NO: 2360655 - RNA, 15 nt, Bordetella pertussis
cgccgccacgcuggc

SEQ ID NO: 2360656 - RNA, 21 nt, Bordetella pertussis
cgccgccacgcuggccgcgcu

SEQ ID NO: 2360657 - RNA, 12 nt, Bordetella pertussis
cgccgccagcac

SEQ ID NO: 2360658 - RNA, 13 nt, Bordetella pertussis
cgccgccagcagc

SEQ ID NO: 2360659 - RNA, 17 nt, Bordetella pertussis
cgccgccagcagcgccg

SEQ ID NO: 2360660 - RNA, 18 nt, Bordetella pertussis
cgccgccagcagcgccgg

SEQ ID NO: 2360661 - RNA, 20 nt, Bordetella pertussis
cgccgccagcauggcggcca

SEQ ID NO: 2360662 - RNA, 17 nt, Bordetella pertussis
cgccgccagccgcuggc

SEQ ID NO: 2360663 - RNA, 21 nt, Bordetella pertussis
cgccgccagccgcuggcgcgc

SEQ ID NO: 2360664 - RNA, 14 nt, Bordetella pertussis
cgccgccagccugc

SEQ ID NO: 2360665 - RNA, 12 nt, Bordetella pertussis
cgccgccagcgc

SEQ ID NO: 2360666 - RNA, 18 nt, Bordetella pertussis
cgccgccagcgcgccgcc

SEQ ID NO: 2360667 - RNA, 14 nt, Bordetella pertussis
cgccgccagcuugg

SEQ ID NO: 2360668 - RNA, 20 nt, Bordetella pertussis
cgccgccaggaaaagccgcc

SEQ ID NO: 2360669 - RNA, 13 nt, Bordetella pertussis
cgccgccaggccg

SEQ ID NO: 2360670 - RNA, 18 nt, Bordetella pertussis
cgccgccaggcgcgaucg

SEQ ID NO: 2360671 - RNA, 18 nt, Bordetella pertussis
cgccgccauggcggcgcc

SEQ ID NO: 2360672 - RNA, 14 nt, Bordetella pertussis
cgccgccauggucg

SEQ ID NO: 2360673 - RNA, 20 nt, Bordetella pertussis
cgccgccauggucgcgacca

SEQ ID NO: 2360674 - RNA, 23 nt, Bordetella pertussis
cgccgccauggucgcgaccaccg

SEQ ID NO: 2360675 - RNA, 23 nt, Bordetella pertussis
cgccgccauggugccgcgcaggc

SEQ ID NO: 2360676 - RNA, 13 nt, Bordetella pertussis
cgccgcccaccac

SEQ ID NO: 2360677 - RNA, 16 nt, Bordetella pertussis
cgccgcccacgccgcu

SEQ ID NO: 2360678 - RNA, 17 nt, Bordetella pertussis
cgccgcccacgccgcug

SEQ ID NO: 2360679 - RNA, 23 nt, Bordetella pertussis
cgccgcccacgccgcugucgacc

SEQ ID NO: 2360680 - RNA, 13 nt, Bordetella pertussis
cgccgcccacggc

SEQ ID NO: 2360681 - RNA, 14 nt, Bordetella pertussis
cgccgcccacggcg

SEQ ID NO: 2360682 - RNA, 13 nt, Bordetella pertussis
cgccgcccagccg

SEQ ID NO: 2360683 - RNA, 17 nt, Bordetella pertussis
cgccgcccagccggccg

SEQ ID NO: 2360684 - RNA, 19 nt, Bordetella pertussis
cgccgcccagccggccgau

SEQ ID NO: 2360685 - RNA, 17 nt, Bordetella pertussis
cgccgcccagcgcgugg

SEQ ID NO: 2360686 - RNA, 19 nt, Bordetella pertussis
cgccgcccagcgcgugggc

SEQ ID NO: 2360687 - RNA, 22 nt, Bordetella pertussis
cgccgcccaugcgcauggccag

SEQ ID NO: 2360688 - RNA, 18 nt, Bordetella pertussis
cgccgccccaguugcgcg

SEQ ID NO: 2360689 - RNA, 17 nt, Bordetella pertussis
cgccgcccccgcccagc

SEQ ID NO: 2360690 - RNA, 22 nt, Bordetella pertussis
cgccgccccgucaucgggugcg

SEQ ID NO: 2360691 - RNA, 15 nt, Bordetella pertussis
cgccgcccgacagca

SEQ ID NO: 2360692 - RNA, 21 nt, Bordetella pertussis
cgccgcccgacagcacgcccg

SEQ ID NO: 2360693 - RNA, 14 nt, Bordetella pertussis
cgccgcccgccagg

SEQ ID NO: 2360694 - RNA, 16 nt, Bordetella pertussis
cgccgcccgcccgccg

SEQ ID NO: 2360695 - RNA, 14 nt, Bordetella pertussis
cgccgcccgccuca

SEQ ID NO: 2360696 - RNA, 15 nt, Bordetella pertussis
cgccgcccgcggcca

SEQ ID NO: 2360697 - RNA, 12 nt, Bordetella pertussis
cgccgcccgcuu

SEQ ID NO: 2360698 - RNA, 13 nt, Bordetella pertussis
cgccgcccggccg

SEQ ID NO: 2360699 - RNA, 14 nt, Bordetella pertussis
cgccgcccggccgg

SEQ ID NO: 2360700 - RNA, 16 nt, Bordetella pertussis
cgccgcccggccggcc

SEQ ID NO: 2360701 - RNA, 15 nt, Bordetella pertussis
cgccgcccgggccgg

SEQ ID NO: 2360702 - RNA, 17 nt, Bordetella pertussis
cgccgcccgggccggcu

SEQ ID NO: 2360703 - RNA, 15 nt, Bordetella pertussis
cgccgcccgugccag

SEQ ID NO: 2360704 - RNA, 13 nt, Bordetella pertussis
cgccgcccugcug

SEQ ID NO: 2360705 - RNA, 15 nt, Bordetella pertussis
cgccgcccugcugcc

SEQ ID NO: 2360706 - RNA, 18 nt, Bordetella pertussis
cgccgcccugcugcccgc

SEQ ID NO: 2360707 - RNA, 19 nt, Bordetella pertussis
cgccgcccuggccgcgccg

SEQ ID NO: 2360708 - RNA, 18 nt, Bordetella pertussis
cgccgcgaucagcgcggc

SEQ ID NO: 2360709 - RNA, 20 nt, Bordetella pertussis
cgccgcgaucagcgcggccg

SEQ ID NO: 2360710 - RNA, 15 nt, Bordetella pertussis
cgccgcgauggcgcc

SEQ ID NO: 2360711 - RNA, 20 nt, Bordetella pertussis
cgccgcgauggcgccggcca

SEQ ID NO: 2360712 - RNA, 22 nt, Bordetella pertussis
cgccgcgauggcgccggccagc

SEQ ID NO: 2360713 - RNA, 22 nt, Bordetella pertussis
cgccgcgauugcagguggccag

SEQ ID NO: 2360714 - RNA, 13 nt, Bordetella pertussis
cgccgcgcacagc

SEQ ID NO: 2360715 - RNA, 23 nt, Bordetella pertussis
cgccgcgcacagcccgaucgacg

SEQ ID NO: 2360716 - RNA, 17 nt, Bordetella pertussis
cgccgcgcaccaccgag

SEQ ID NO: 2360717 - RNA, 14 nt, Bordetella pertussis
cgccgcgcacgaug

SEQ ID NO: 2360718 - RNA, 13 nt, Bordetella pertussis
cgccgcgcacgca

SEQ ID NO: 2360719 - RNA, 16 nt, Bordetella pertussis
cgccgcgcacgggcgc

SEQ ID NO: 2360720 - RNA, 21 nt, Bordetella pertussis
cgccgcgcacgggcgccuguc

SEQ ID NO: 2360721 - RNA, 14 nt, Bordetella pertussis
cgccgcgcagcagc

SEQ ID NO: 2360722 - RNA, 15 nt, Bordetella pertussis
cgccgcgcagcagca

SEQ ID NO: 2360723 - RNA, 13 nt, Bordetella pertussis
cgccgcgcagccg

SEQ ID NO: 2360724 - RNA, 22 nt, Bordetella pertussis
cgccgcgcagccgacaggcgcg

SEQ ID NO: 2360725 - RNA, 21 nt, Bordetella pertussis
cgccgcgcaggaugacguggc

SEQ ID NO: 2360726 - RNA, 21 nt, Bordetella pertussis
cgccgcgcaucgaucaggcug

SEQ ID NO: 2360727 - RNA, 13 nt, Bordetella pertussis
cgccgcgccaggc

SEQ ID NO: 2360728 - RNA, 23 nt, Bordetella pertussis
cgccgcgccagguaggccggcgc

SEQ ID NO: 2360729 - RNA, 13 nt, Bordetella pertussis
cgccgcgcccagc

SEQ ID NO: 2360730 - RNA, 14 nt, Bordetella pertussis
cgccgcgcccagca

SEQ ID NO: 2360731 - RNA, 15 nt, Bordetella pertussis
cgccgcgcccagcag

SEQ ID NO: 2360732 - RNA, 14 nt, Bordetella pertussis
cgccgcgccccauc

SEQ ID NO: 2360733 - RNA, 13 nt, Bordetella pertussis
cgccgcgcccgcc

SEQ ID NO: 2360734 - RNA, 14 nt, Bordetella pertussis
cgccgcgcccgcuu

SEQ ID NO: 2360735 - RNA, 13 nt, Bordetella pertussis
cgccgcgcccggc

SEQ ID NO: 2360736 - RNA, 16 nt, Bordetella pertussis
cgccgcgcccggccgg

SEQ ID NO: 2360737 - RNA, 16 nt, Bordetella pertussis
cgccgcgcccguccac

SEQ ID NO: 2360738 - RNA, 16 nt, Bordetella pertussis
cgccgcgcccuggcgc

SEQ ID NO: 2360739 - RNA, 19 nt, Bordetella pertussis
cgccgcgcccuggcgcggc

SEQ ID NO: 2360740 - RNA, 11 nt, Bordetella pertussis
cgccgcgccga

SEQ ID NO: 2360741 - RNA, 19 nt, Bordetella pertussis
cgccgcgccgaacgcgcag

SEQ ID NO: 2360742 - RNA, 21 nt, Bordetella pertussis
cgccgcgccgaacgcgcagcg

SEQ ID NO: 2360743 - RNA, 15 nt, Bordetella pertussis
cgccgcgccgcccgc

SEQ ID NO: 2360744 - RNA, 13 nt, Bordetella pertussis
cgccgcgccgccg

SEQ ID NO: 2360745 - RNA, 14 nt, Bordetella pertussis
cgccgcgccgccgc

SEQ ID NO: 2360746 - RNA, 13 nt, Bordetella pertussis
cgccgcgccgcug

SEQ ID NO: 2360747 - RNA, 17 nt, Bordetella pertussis
cgccgcgccggaucguc

SEQ ID NO: 2360748 - RNA, 18 nt, Bordetella pertussis
cgccgcgccggcgcgcga

SEQ ID NO: 2360749 - RNA, 17 nt, Bordetella pertussis
cgccgcgccgggcgcgc

SEQ ID NO: 2360750 - RNA, 17 nt, Bordetella pertussis
cgccgcgccggggcggc

SEQ ID NO: 2360751 - RNA, 20 nt, Bordetella pertussis
cgccgcgccggggcggcgca

SEQ ID NO: 2360752 - RNA, 23 nt, Bordetella pertussis
cgccgcgccggggcggcgcagca

SEQ ID NO: 2360753 - RNA, 15 nt, Bordetella pertussis
cgccgcgccggucag

SEQ ID NO: 2360754 - RNA, 20 nt, Bordetella pertussis
cgccgcgccgguggccagca

SEQ ID NO: 2360755 - RNA, 13 nt, Bordetella pertussis
cgccgcgccucgg

SEQ ID NO: 2360756 - RNA, 15 nt, Bordetella pertussis
cgccgcgccuugccc

SEQ ID NO: 2360757 - RNA, 16 nt, Bordetella pertussis
cgccgcgccuugcccg

SEQ ID NO: 2360758 - RNA, 15 nt, Bordetella pertussis
cgccgcgcgacagcc

SEQ ID NO: 2360759 - RNA, 20 nt, Bordetella pertussis
cgccgcgcgacagccgcgcc

SEQ ID NO: 2360760 - RNA, 20 nt, Bordetella pertussis
cgccgcgcgcacggcgcccu

SEQ ID NO: 2360761 - RNA, 21 nt, Bordetella pertussis
cgccgcgcgccauccggcgca

SEQ ID NO: 2360762 - RNA, 14 nt, Bordetella pertussis
cgccgcgcgccgcg

SEQ ID NO: 2360763 - RNA, 15 nt, Bordetella pertussis
cgccgcgcgccgcgc

SEQ ID NO: 2360764 - RNA, 17 nt, Bordetella pertussis
cgccgcgcgccgcgccu

SEQ ID NO: 2360765 - RNA, 16 nt, Bordetella pertussis
cgccgcgcgccgcggc

SEQ ID NO: 2360766 - RNA, 15 nt, Bordetella pertussis
cgccgcgcgcgacgc

SEQ ID NO: 2360767 - RNA, 17 nt, Bordetella pertussis
cgccgcgcgcgacgcga

SEQ ID NO: 2360768 - RNA, 13 nt, Bordetella pertussis
cgccgcgcgcggc

SEQ ID NO: 2360769 - RNA, 18 nt, Bordetella pertussis
cgccgcgcgcggccccgg

SEQ ID NO: 2360770 - RNA, 14 nt, Bordetella pertussis
cgccgcgcgcggcg

SEQ ID NO: 2360771 - RNA, 14 nt, Bordetella pertussis
cgccgcgcgcuggc

SEQ ID NO: 2360772 - RNA, 12 nt, Bordetella pertussis
cgccgcgcggcg

SEQ ID NO: 2360773 - RNA, 13 nt, Bordetella pertussis
cgccgcgcggcga

SEQ ID NO: 2360774 - RNA, 15 nt, Bordetella pertussis
cgccgcgcggcgagg

SEQ ID NO: 2360775 - RNA, 11 nt, Bordetella pertussis
cgccgcgcgua

SEQ ID NO: 2360776 - RNA, 18 nt, Bordetella pertussis
cgccgcgcucaccgaggg

SEQ ID NO: 2360777 - RNA, 14 nt, Bordetella pertussis
cgccgcgcucagca

SEQ ID NO: 2360778 - RNA, 19 nt, Bordetella pertussis
cgccgcgcucagcaccagg

SEQ ID NO: 2360779 - RNA, 16 nt, Bordetella pertussis
cgccgcgcucgcgcca

SEQ ID NO: 2360780 - RNA, 19 nt, Bordetella pertussis
cgccgcgcucgcgccaggc

SEQ ID NO: 2360781 - RNA, 18 nt, Bordetella pertussis
cgccgcgcugauccuggc

SEQ ID NO: 2360782 - RNA, 22 nt, Bordetella pertussis
cgccgcgcugauccuggcucug

SEQ ID NO: 2360783 - RNA, 15 nt, Bordetella pertussis
cgccgcgcuucgucg

SEQ ID NO: 2360784 - RNA, 21 nt, Bordetella pertussis
cgccgcgcuucgucggcgucg

SEQ ID NO: 2360785 - RNA, 14 nt, Bordetella pertussis
cgccgcggaggcga

SEQ ID NO: 2360786 - RNA, 14 nt, Bordetella pertussis
cgccgcggaucgug

SEQ ID NO: 2360787 - RNA, 18 nt, Bordetella pertussis
cgccgcggcaagccgcgg

SEQ ID NO: 2360788 - RNA, 19 nt, Bordetella pertussis
cgccgcggcaagccgcggc

SEQ ID NO: 2360789 - RNA, 16 nt, Bordetella pertussis
cgccgcggcacggggc

SEQ ID NO: 2360790 - RNA, 19 nt, Bordetella pertussis
cgccgcggcaggccccggc

SEQ ID NO: 2360791 - RNA, 13 nt, Bordetella pertussis
cgccgcggccagc

SEQ ID NO: 2360792 - RNA, 12 nt, Bordetella pertussis
cgccgcggccgg

SEQ ID NO: 2360793 - RNA, 13 nt, Bordetella pertussis
cgccgcggccggc

SEQ ID NO: 2360794 - RNA, 16 nt, Bordetella pertussis
cgccgcggccggcgca

SEQ ID NO: 2360795 - RNA, 19 nt, Bordetella pertussis
cgccgcggccggcggcgcc

SEQ ID NO: 2360796 - RNA, 13 nt, Bordetella pertussis
cgccgcggccucg

SEQ ID NO: 2360797 - RNA, 14 nt, Bordetella pertussis
cgccgcggccuguc

SEQ ID NO: 2360798 - RNA, 15 nt, Bordetella pertussis
cgccgcggccugucc

SEQ ID NO: 2360799 - RNA, 20 nt, Bordetella pertussis
cgccgcggcgaugccggcca

SEQ ID NO: 2360800 - RNA, 22 nt, Bordetella pertussis
cgccgcggcgaugccggccagc

SEQ ID NO: 2360801 - RNA, 14 nt, Bordetella pertussis
cgccgcggcgcugg

SEQ ID NO: 2360802 - RNA, 16 nt, Bordetella pertussis
cgccgcggcggcgagg

SEQ ID NO: 2360803 - RNA, 16 nt, Bordetella pertussis
cgccgcggcgggcgau

SEQ ID NO: 2360804 - RNA, 23 nt, Bordetella pertussis
cgccgcggcgggcgauugcucga

SEQ ID NO: 2360805 - RNA, 14 nt, Bordetella pertussis
cgccgcggcgggcu

SEQ ID NO: 2360806 - RNA, 17 nt, Bordetella pertussis
cgccgcggcuugccgcg

SEQ ID NO: 2360807 - RNA, 18 nt, Bordetella pertussis
cgccgcggcuugccgcgg

SEQ ID NO: 2360808 - RNA, 15 nt, Bordetella pertussis
cgccgcgggcaaagc

SEQ ID NO: 2360809 - RNA, 19 nt, Bordetella pertussis
cgccgcgggcaaagcccag

SEQ ID NO: 2360810 - RNA, 20 nt, Bordetella pertussis
cgccgcgggcaaagcccagc

SEQ ID NO: 2360811 - RNA, 21 nt, Bordetella pertussis
cgccgcgggcaaagcccagca

SEQ ID NO: 2360812 - RNA, 22 nt, Bordetella pertussis
cgccgcgggcaaagcccagcaa

SEQ ID NO: 2360813 - RNA, 16 nt, Bordetella pertussis
cgccgcgggcgccgcg

SEQ ID NO: 2360814 - RNA, 17 nt, Bordetella pertussis
cgccgcgggcgccgcgc

SEQ ID NO: 2360815 - RNA, 18 nt, Bordetella pertussis
cgccgcgggcgccgcgca

SEQ ID NO: 2360816 - RNA, 19 nt, Bordetella pertussis
cgccgcgggcgccgcgcac

SEQ ID NO: 2360817 - RNA, 21 nt, Bordetella pertussis
cgccgcgggcggccacgcgcc

SEQ ID NO: 2360818 - RNA, 17 nt, Bordetella pertussis
cgccgcgggcugcgaca

SEQ ID NO: 2360819 - RNA, 23 nt, Bordetella pertussis
cgccgcgggcugcgacaggcgca

SEQ ID NO: 2360820 - RNA, 18 nt, Bordetella pertussis
cgccgcggucgcagacga

SEQ ID NO: 2360821 - RNA, 14 nt, Bordetella pertussis
cgccgcggugcugg

SEQ ID NO: 2360822 - RNA, 12 nt, Bordetella pertussis
cgccggccagcc

SEQ ID NO: 2360823 - RNA, 21 nt, Bordetella pertussis
cgccggccagccugugcgcca

SEQ ID NO: 2360824 - RNA, 23 nt, Bordetella pertussis
cgccggccagccugugcgccaug

SEQ ID NO: 2360825 - RNA, 13 nt, Bordetella pertussis
cgccggccagcgc

SEQ ID NO: 2360826 - RNA, 15 nt, Bordetella pertussis
cgccggccagcgcca

SEQ ID NO: 2360827 - RNA, 14 nt, Bordetella pertussis
cgccggccagcgcg

SEQ ID NO: 2360828 - RNA, 17 nt, Bordetella pertussis
cgccggccagcgcgccg

SEQ ID NO: 2360829 - RNA, 20 nt, Bordetella pertussis
cgccggccagcgcgccggcc

SEQ ID NO: 2360830 - RNA, 22 nt, Bordetella pertussis
cgccggccagcgcggcaucggc

SEQ ID NO: 2360831 - RNA, 23 nt, Bordetella pertussis
cgccggccagcgcggcaucggcc

SEQ ID NO: 2360832 - RNA, 14 nt, Bordetella pertussis
cgccggccagcggc

SEQ ID NO: 2360833 - RNA, 12 nt, Bordetella pertussis
cgccggccagcu

SEQ ID NO: 2360834 - RNA, 13 nt, Bordetella pertussis
cgccggccagcuu

SEQ ID NO: 2360835 - RNA, 12 nt, Bordetella pertussis
cgccggccagga

SEQ ID NO: 2360836 - RNA, 15 nt, Bordetella pertussis
cgccggccaggcccu

SEQ ID NO: 2360837 - RNA, 12 nt, Bordetella pertussis
cgccggccaggg

SEQ ID NO: 2360838 - RNA, 14 nt, Bordetella pertussis
cgccggccagggcc

SEQ ID NO: 2360839 - RNA, 15 nt, Bordetella pertussis
cgccggccagggcca

SEQ ID NO: 2360840 - RNA, 16 nt, Bordetella pertussis
cgccggccagggccac

SEQ ID NO: 2360841 - RNA, 18 nt, Bordetella pertussis
cgccggccagggccacca

SEQ ID NO: 2360842 - RNA, 22 nt, Bordetella pertussis
cgccggccagggcgaugcggcg

SEQ ID NO: 2360843 - RNA, 21 nt, Bordetella pertussis
cgccggccaggucggcggcca

SEQ ID NO: 2360844 - RNA, 23 nt, Bordetella pertussis
cgccggccaggucggcggccagc

SEQ ID NO: 2360845 - RNA, 14 nt, Bordetella pertussis
cgccggccaucacg

SEQ ID NO: 2360846 - RNA, 17 nt, Bordetella pertussis
cgccggccaucacgccg

SEQ ID NO: 2360847 - RNA, 21 nt, Bordetella pertussis
cgccggccaucacgccgaucu

SEQ ID NO: 2360848 - RNA, 19 nt, Bordetella pertussis
cgccggccauggcggccgg

SEQ ID NO: 2360849 - RNA, 19 nt, Bordetella pertussis
cgccggcccaaggccccgc

SEQ ID NO: 2360850 - RNA, 22 nt, Bordetella pertussis
cgccggcccaaggccccgcgac

SEQ ID NO: 2360851 - RNA, 13 nt, Bordetella pertussis
cgccggcccagga

SEQ ID NO: 2360852 - RNA, 21 nt, Bordetella pertussis
cgccggcccaggauggcgcca

SEQ ID NO: 2360853 - RNA, 14 nt, Bordetella pertussis
cgccggcccaggcg

SEQ ID NO: 2360854 - RNA, 16 nt, Bordetella pertussis
cgccggcccaggcgcg

SEQ ID NO: 2360855 - RNA, 20 nt, Bordetella pertussis
cgccggcccaggcgcgcugg

SEQ ID NO: 2360856 - RNA, 13 nt, Bordetella pertussis
cgccggcccgcca

SEQ ID NO: 2360857 - RNA, 15 nt, Bordetella pertussis
cgccggcccgccacg

SEQ ID NO: 2360858 - RNA, 22 nt, Bordetella pertussis
cgccggcccgccacgcgggccg

SEQ ID NO: 2360859 - RNA, 15 nt, Bordetella pertussis
cgccggcccgccucg

SEQ ID NO: 2360860 - RNA, 16 nt, Bordetella pertussis
cgccggcccgccucga

SEQ ID NO: 2360861 - RNA, 16 nt, Bordetella pertussis
cgccggcccggcaaca

SEQ ID NO: 2360862 - RNA, 15 nt, Bordetella pertussis
cgccggcccugccgc

SEQ ID NO: 2360863 - RNA, 17 nt, Bordetella pertussis
cgccggccgacggcgcu

SEQ ID NO: 2360864 - RNA, 14 nt, Bordetella pertussis
cgccggccgccagc

SEQ ID NO: 2360865 - RNA, 22 nt, Bordetella pertussis
cgccggccgccauggccggcgu

SEQ ID NO: 2360866 - RNA, 13 nt, Bordetella pertussis
cgccggccgccug

SEQ ID NO: 2360867 - RNA, 17 nt, Bordetella pertussis
cgccggccgcgcccagc

SEQ ID NO: 2360868 - RNA, 20 nt, Bordetella pertussis
cgccggccgcgcccagcgug

SEQ ID NO: 2360869 - RNA, 18 nt, Bordetella pertussis
cgccggccgcgcgcgcca

SEQ ID NO: 2360870 - RNA, 16 nt, Bordetella pertussis
cgccggccgcggggcu

SEQ ID NO: 2360871 - RNA, 18 nt, Bordetella pertussis
cgccggccgcggggcugg

SEQ ID NO: 2360872 - RNA, 21 nt, Bordetella pertussis
cgccggccggggucuugccgc

SEQ ID NO: 2360873 - RNA, 17 nt, Bordetella pertussis
cgccggccuccagcauc

SEQ ID NO: 2360874 - RNA, 19 nt, Bordetella pertussis
cgccggccuccagcaucgc

SEQ ID NO: 2360875 - RNA, 20 nt, Bordetella pertussis
cgccggccucuucgucgccg

SEQ ID NO: 2360876 - RNA, 11 nt, Bordetella pertussis
cgccggccugc

SEQ ID NO: 2360877 - RNA, 14 nt, Bordetella pertussis
cgccggccugcgcc

SEQ ID NO: 2360878 - RNA, 16 nt, Bordetella pertussis
cgccggccugcgccag

SEQ ID NO: 2360879 - RNA, 17 nt, Bordetella pertussis
cgccggccugcgccagc

SEQ ID NO: 2360880 - RNA, 20 nt, Bordetella pertussis
cgccggccugcgccagcucc

SEQ ID NO: 2360881 - RNA, 15 nt, Bordetella pertussis
cgccggccugcgccg

SEQ ID NO: 2360882 - RNA, 16 nt, Bordetella pertussis
cgccggccugcgccgg

SEQ ID NO: 2360883 - RNA, 21 nt, Bordetella pertussis
cgccggccugcgccgggcgcg

SEQ ID NO: 2360884 - RNA, 20 nt, Bordetella pertussis
cgccggccugcucgccggcc

SEQ ID NO: 2360885 - RNA, 13 nt, Bordetella pertussis
cgccggccugcug

SEQ ID NO: 2360886 - RNA, 18 nt, Bordetella pertussis
cgccggccugcugcagca

SEQ ID NO: 2360887 - RNA, 16 nt, Bordetella pertussis
cgccggccuggcgcga

SEQ ID NO: 2360888 - RNA, 17 nt, Bordetella pertussis
cgccggccuggcgcgcg

SEQ ID NO: 2360889 - RNA, 21 nt, Bordetella pertussis
cgccggccuggcgcgcggccu

SEQ ID NO: 2360890 - RNA, 14 nt, Bordetella pertussis
cgccggccugggcg

SEQ ID NO: 2360891 - RNA, 12 nt, Bordetella pertussis
cgccggccuugc

SEQ ID NO: 2360892 - RNA, 15 nt, Bordetella pertussis
cgccggccuugccgu

SEQ ID NO: 2360893 - RNA, 17 nt, Bordetella pertussis
cgccggcgaaugccggc

SEQ ID NO: 2360894 - RNA, 18 nt, Bordetella pertussis
cgccggcgaaugccggcc

SEQ ID NO: 2360895 - RNA, 21 nt, Bordetella pertussis
cgccggcgaaugccggccgau

SEQ ID NO: 2360896 - RNA, 15 nt, Bordetella pertussis
cgccggcgacgccgc

SEQ ID NO: 2360897 - RNA, 14 nt, Bordetella pertussis
cgccggcgacgugg

SEQ ID NO: 2360898 - RNA, 14 nt, Bordetella pertussis
cgccggcgaugacg

SEQ ID NO: 2360899 - RNA, 15 nt, Bordetella pertussis
cgccggcgaugacgg

SEQ ID NO: 2360900 - RNA, 17 nt, Bordetella pertussis
cgccggcgaugaucgcc

SEQ ID NO: 2360901 - RNA, 13 nt, Bordetella pertussis
cgccggcgcaacg

SEQ ID NO: 2360902 - RNA, 18 nt, Bordetella pertussis
cgccggcgcaacgggccg

SEQ ID NO: 2360903 - RNA, 19 nt, Bordetella pertussis
cgccggcgcaacgggccga

SEQ ID NO: 2360904 - RNA, 13 nt, Bordetella pertussis
cgccggcgcaccc

SEQ ID NO: 2360905 - RNA, 15 nt, Bordetella pertussis
cgccggcgcaugagc

SEQ ID NO: 2360906 - RNA, 17 nt, Bordetella pertussis
cgccggcgcccccagca

SEQ ID NO: 2360907 - RNA, 18 nt, Bordetella pertussis
cgccggcgcccccagcag

SEQ ID NO: 2360908 - RNA, 21 nt, Bordetella pertussis
cgccggcgcccccagcagcga

SEQ ID NO: 2360909 - RNA, 13 nt, Bordetella pertussis
cgccggcgccgcc

SEQ ID NO: 2360910 - RNA, 15 nt, Bordetella pertussis
cgccggcgccgggca

SEQ ID NO: 2360911 - RNA, 12 nt, Bordetella pertussis
cgccggcgccgu

SEQ ID NO: 2360912 - RNA, 22 nt, Bordetella pertussis
cgccggcgccuuggccugggcg

SEQ ID NO: 2360913 - RNA, 12 nt, Bordetella pertussis
cgccggcgcgcc

SEQ ID NO: 2360914 - RNA, 19 nt, Bordetella pertussis
cgccggcgcgccgcccgcu

SEQ ID NO: 2360915 - RNA, 16 nt, Bordetella pertussis
cgccggcgcgccggcc

SEQ ID NO: 2360916 - RNA, 17 nt, Bordetella pertussis
cgccggcgcgccggccg

SEQ ID NO: 2360917 - RNA, 22 nt, Bordetella pertussis
cgccggcgcgcgaucucgggca

SEQ ID NO: 2360918 - RNA, 23 nt, Bordetella pertussis
cgccggcgcgcgaucucgggcag

SEQ ID NO: 2360919 - RNA, 14 nt, Bordetella pertussis
cgccggcgcgcgcu

SEQ ID NO: 2360920 - RNA, 13 nt, Bordetella pertussis
cgccggcgcggcg

SEQ ID NO: 2360921 - RNA, 16 nt, Bordetella pertussis
cgccggcgcggcgguc

SEQ ID NO: 2360922 - RNA, 13 nt, Bordetella pertussis
cgccggcgcggcu

SEQ ID NO: 2360923 - RNA, 14 nt, Bordetella pertussis
cgccggcgcggcug

SEQ ID NO: 2360924 - RNA, 19 nt, Bordetella pertussis
cgccggcgcggcugcuggg

SEQ ID NO: 2360925 - RNA, 14 nt, Bordetella pertussis
cgccggcggcaagg

SEQ ID NO: 2360926 - RNA, 15 nt, Bordetella pertussis
cgccggcggcaaggu

SEQ ID NO: 2360927 - RNA, 15 nt, Bordetella pertussis
cgccggcggcaccgc

SEQ ID NO: 2360928 - RNA, 17 nt, Bordetella pertussis
cgccggcggcaccgcgc

SEQ ID NO: 2360929 - RNA, 20 nt, Bordetella pertussis
cgccggcggcaccgcgcagc

SEQ ID NO: 2360930 - RNA, 21 nt, Bordetella pertussis
cgccggcggcaccgcgcagcc

SEQ ID NO: 2360931 - RNA, 11 nt, Bordetella pertussis
cgccggcggcc

SEQ ID NO: 2360932 - RNA, 22 nt, Bordetella pertussis
cgccggcggcccauucgcgcac

SEQ ID NO: 2360933 - RNA, 13 nt, Bordetella pertussis
cgccggcggccug

SEQ ID NO: 2360934 - RNA, 16 nt, Bordetella pertussis
cgccggcggccugcag

SEQ ID NO: 2360935 - RNA, 20 nt, Bordetella pertussis
cgccggcggccugcaggccg

SEQ ID NO: 2360936 - RNA, 18 nt, Bordetella pertussis
cgccggggcggcucggcc

SEQ ID NO: 2360937 - RNA, 20 nt, Bordetella pertussis
cgccggggcggcucggcccu

SEQ ID NO: 2360938 - RNA, 13 nt, Bordetella pertussis
cgccggggcgugg

SEQ ID NO: 2360939 - RNA, 20 nt, Bordetella pertussis
cgccggggcguggccgcagu

SEQ ID NO: 2360940 - RNA, 21 nt, Bordetella pertussis
cgccggggggcgcacgccgcg

SEQ ID NO: 2360941 - RNA, 19 nt, Bordetella pertussis
cgccggguccggccgcgca

SEQ ID NO: 2360942 - RNA, 14 nt, Bordetella pertussis
cgccgggucgccgg

SEQ ID NO: 2360943 - RNA, 19 nt, Bordetella pertussis
cgccgggucgcugugcgcg

SEQ ID NO: 2360944 - RNA, 22 nt, Bordetella pertussis
cgccgggucgcugugcgcggcg

SEQ ID NO: 2360945 - RNA, 19 nt, Bordetella pertussis
cgccggguguuccggcgcg

SEQ ID NO: 2360946 - RNA, 20 nt, Bordetella pertussis
cgccggguguuccggcgcgc

SEQ ID NO: 2360947 - RNA, 23 nt, Bordetella pertussis
cgccggguuuuuacaugccgcgc

SEQ ID NO: 2360948 - RNA, 18 nt, Bordetella pertussis
cgccgguagcgcugggcg

SEQ ID NO: 2360949 - RNA, 20 nt, Bordetella pertussis
cgccgguagcgcugggcgcc

SEQ ID NO: 2360950 - RNA, 15 nt, Bordetella pertussis
cgccggucaccgccg

SEQ ID NO: 2360951 - RNA, 15 nt, Bordetella pertussis
cgccggucacgcugg

SEQ ID NO: 2360952 - RNA, 16 nt, Bordetella pertussis
cgccggucacgcuggu

SEQ ID NO: 2360953 - RNA, 19 nt, Bordetella pertussis
cgccggucacgcugguggc

SEQ ID NO: 2360954 - RNA, 21 nt, Bordetella pertussis
cgccggucacgcugguggcca

SEQ ID NO: 2360955 - RNA, 23 nt, Bordetella pertussis
cgccggucacguacucgccgucg

SEQ ID NO: 2360956 - RNA, 15 nt, Bordetella pertussis
cgccggucacugccg

SEQ ID NO: 2360957 - RNA, 17 nt, Bordetella pertussis
cgccggucaugcaccug

SEQ ID NO: 2360958 - RNA, 13 nt, Bordetella pertussis
cgccgguccagcg

SEQ ID NO: 2360959 - RNA, 14 nt, Bordetella pertussis
cgccgguccagcgc

SEQ ID NO: 2360960 - RNA, 22 nt, Bordetella pertussis
cgccgguccgacgguagccggg

SEQ ID NO: 2360961 - RNA, 23 nt, Bordetella pertussis
cgccgguccgacgguagccgggu

SEQ ID NO: 2360962 - RNA, 16 nt, Bordetella pertussis
cgccggucgccgcggg

SEQ ID NO: 2360963 - RNA, 14 nt, Bordetella pertussis
cgccggucgcggcg

SEQ ID NO: 2360964 - RNA, 15 nt, Bordetella pertussis
cgccggucgcggcgu

SEQ ID NO: 2360965 - RNA, 14 nt, Bordetella pertussis
cgccggucggccgc

SEQ ID NO: 2360966 - RNA, 21 nt, Bordetella pertussis
cgccggucggccgcuccgcca

SEQ ID NO: 2360967 - RNA, 15 nt, Bordetella pertussis
cgccggucugggcgc

SEQ ID NO: 2360968 - RNA, 17 nt, Bordetella pertussis
cgccggugaccgccagc

SEQ ID NO: 2360969 - RNA, 18 nt, Bordetella pertussis
cgccggugaccgccagca

SEQ ID NO: 2360970 - RNA, 23 nt, Bordetella pertussis
cgccggugaccgccagcaggcgc

SEQ ID NO: 2360971 - RNA, 19 nt, Bordetella pertussis
cgccggugauaugcgccag

SEQ ID NO: 2360972 - RNA, 15 nt, Bordetella pertussis
cgccggugaugcgau

SEQ ID NO: 2360973 - RNA, 22 nt, Bordetella pertussis
cgccggugauguacgcaucggc

SEQ ID NO: 2360974 - RNA, 15 nt, Bordetella pertussis
cgccggugcaccagg

SEQ ID NO: 2360975 - RNA, 16 nt, Bordetella pertussis
cgccggugcaccaggc

SEQ ID NO: 2360976 - RNA, 18 nt, Bordetella pertussis
cgccggugcaccaggcca

SEQ ID NO: 2360977 - RNA, 20 nt, Bordetella pertussis
cgccggugcaccaggccacc

SEQ ID NO: 2360978 - RNA, 14 nt, Bordetella pertussis
cgccggugcgcggc

SEQ ID NO: 2360979 - RNA, 16 nt, Bordetella pertussis
cgccggugcgcggcgc

SEQ ID NO: 2360980 - RNA, 17 nt, Bordetella pertussis
cgccggugcgcggcgcc

SEQ ID NO: 2360981 - RNA, 18 nt, Bordetella pertussis
cgccggugcgcggcgccc

SEQ ID NO: 2360982 - RNA, 13 nt, Bordetella pertussis
cgccgguggccag

SEQ ID NO: 2360983 - RNA, 15 nt, Bordetella pertussis
cgccgguggccagca

SEQ ID NO: 2360984 - RNA, 17 nt, Bordetella pertussis
cgccgguggccagcagc

SEQ ID NO: 2360985 - RNA, 18 nt, Bordetella pertussis
cgccgguggccagcagcu

SEQ ID NO: 2360986 - RNA, 15 nt, Bordetella pertussis
cgccgguggugucga

SEQ ID NO: 2360987 - RNA, 23 nt, Bordetella pertussis
cgccgguguagcugcccgcgaua

SEQ ID NO: 2360988 - RNA, 15 nt, Bordetella pertussis
cgccggugucggggc

SEQ ID NO: 2360989 - RNA, 17 nt, Bordetella pertussis
cgccggugucggggccg

SEQ ID NO: 2360990 - RNA, 18 nt, Bordetella pertussis
cgccggugucggggccgg

SEQ ID NO: 2360991 - RNA, 23 nt, Bordetella pertussis
cgccggugucggggccgggccgg

SEQ ID NO: 2360992 - RNA, 13 nt, Bordetella pertussis
cgccgguucgacg

SEQ ID NO: 2360993 - RNA, 16 nt, Bordetella pertussis
cgccgguucgacgcug

SEQ ID NO: 2360994 - RNA, 15 nt, Bordetella pertussis
cgccgguucggucga

SEQ ID NO: 2360995 - RNA, 22 nt, Bordetella pertussis
cgccgguucggucgacgacggc

SEQ ID NO: 2360996 - RNA, 23 nt, Bordetella pertussis
cgccgguucggucgacgacggca

SEQ ID NO: 2360997 - RNA, 18 nt, Bordetella pertussis
cgccgguuucggugaagc

SEQ ID NO: 2360998 - RNA, 15 nt, Bordetella pertussis
cgccguacagccgcg

SEQ ID NO: 2360999 - RNA, 15 nt, Bordetella pertussis
cgccguacagggccg

SEQ ID NO: 2361000 - RNA, 15 nt, Bordetella pertussis
cgccguaccagcgcg

SEQ ID NO: 2361001 - RNA, 16 nt, Bordetella pertussis
cgccguaccagcgcga

SEQ ID NO: 2361002 - RNA, 14 nt, Bordetella pertussis
cgccguaccccagc

SEQ ID NO: 2361003 - RNA, 16 nt, Bordetella pertussis
cgccguaccccagcau

SEQ ID NO: 2361004 - RNA, 16 nt, Bordetella pertussis
cgccguaccgggcggu

SEQ ID NO: 2361005 - RNA, 19 nt, Bordetella pertussis
cgccguaccugcagcaggc

SEQ ID NO: 2361006 - RNA, 20 nt, Bordetella pertussis
cgccguaccugcagcaggcg

SEQ ID NO: 2361007 - RNA, 13 nt, Bordetella pertussis
cgccguacugggc

SEQ ID NO: 2361008 - RNA, 16 nt, Bordetella pertussis
cgccguacugggcacc

SEQ ID NO: 2361009 - RNA, 19 nt, Bordetella pertussis
cgccguacugggcaccacg

SEQ ID NO: 2361010 - RNA, 13 nt, Bordetella pertussis
cgccguagccgcu

SEQ ID NO: 2361011 - RNA, 20 nt, Bordetella pertussis
cgccguagccgcugcgcgcg

SEQ ID NO: 2361012 - RNA, 13 nt, Bordetella pertussis
cgccguagcgcgc

SEQ ID NO: 2361013 - RNA, 14 nt, Bordetella pertussis
cgccguagcgcgcc

SEQ ID NO: 2361014 - RNA, 17 nt, Bordetella pertussis
cgccguagcgcgccagc

SEQ ID NO: 2361015 - RNA, 19 nt, Bordetella pertussis
cgccguagcgcgccagccg

SEQ ID NO: 2361016 - RNA, 22 nt, Bordetella pertussis
cgccguaggacagccccagcag

SEQ ID NO: 2361017 - RNA, 23 nt, Bordetella pertussis
cgccguaggacagccccagcagc

SEQ ID NO: 2361018 - RNA, 19 nt, Bordetella pertussis
cgccguaggcuugcagcuu

SEQ ID NO: 2361019 - RNA, 13 nt, Bordetella pertussis
cgccgucagcagc

SEQ ID NO: 2361020 - RNA, 19 nt, Bordetella pertussis
cgccgucagcagcgcggcg

SEQ ID NO: 2361021 - RNA, 21 nt, Bordetella pertussis
cgccgucagcagcgcggcgcc

SEQ ID NO: 2361022 - RNA, 22 nt, Bordetella pertussis
cgccgucagcagcgcggcgccg

SEQ ID NO: 2361023 - RNA, 17 nt, Bordetella pertussis
cgccgucagcucgauca

SEQ ID NO: 2361024 - RNA, 18 nt, Bordetella pertussis
cgccgucagcucgaucag

SEQ ID NO: 2361025 - RNA, 20 nt, Bordetella pertussis
cgccgucaggaucaggccgg

SEQ ID NO: 2361026 - RNA, 21 nt, Bordetella pertussis
cgccgucaggaucaggccggc

SEQ ID NO: 2361027 - RNA, 22 nt, Bordetella pertussis
cgccgucaggaucaggccggcg

SEQ ID NO: 2361028 - RNA, 23 nt, Bordetella pertussis
cgccgucaggaucaggccggcga

SEQ ID NO: 2361029 - RNA, 13 nt, Bordetella pertussis
cgccguccagcgc

SEQ ID NO: 2361030 - RNA, 19 nt, Bordetella pertussis
cgccguccagcgcggcaug

SEQ ID NO: 2361031 - RNA, 15 nt, Bordetella pertussis
cgccguccaggcgcc

SEQ ID NO: 2361032 - RNA, 17 nt, Bordetella pertussis
cgccguccaggcgccgc

SEQ ID NO: 2361033 - RNA, 20 nt, Bordetella pertussis
cgccguccaggcgccgcacg

SEQ ID NO: 2361034 - RNA, 23 nt, Bordetella pertussis
cgccguccaggcgccgcacgccg

SEQ ID NO: 2361035 - RNA, 18 nt, Bordetella pertussis
cgccguccgagcccgacg

SEQ ID NO: 2361036 - RNA, 20 nt, Bordetella pertussis
cgccguccgugagugcagcg

SEQ ID NO: 2361037 - RNA, 14 nt, Bordetella pertussis
cgccgucgaacucc

SEQ ID NO: 2361038 - RNA, 18 nt, Bordetella pertussis
cgccgucgaacuccugca

SEQ ID NO: 2361039 - RNA, 16 nt, Bordetella pertussis
cgccgucgaagccggc

SEQ ID NO: 2361040 - RNA, 17 nt, Bordetella pertussis
cgccgucgaagccggcg

SEQ ID NO: 2361041 - RNA, 18 nt, Bordetella pertussis
cgccgucgaagccggcgc

SEQ ID NO: 2361042 - RNA, 19 nt, Bordetella pertussis
cgccgucgaagccggcgcc

SEQ ID NO: 2361043 - RNA, 12 nt, Bordetella pertussis
cgccgucgaccc

SEQ ID NO: 2361044 - RNA, 18 nt, Bordetella pertussis
cgccgucgaccccgucga

SEQ ID NO: 2361045 - RNA, 21 nt, Bordetella pertussis
cgccgucgagcaucccggcgc

SEQ ID NO: 2361046 - RNA, 21 nt, Bordetella pertussis
cgccgucgaucccaucgcgcg

SEQ ID NO: 2361047 - RNA, 21 nt, Bordetella pertussis
cgccgucgauguagagggucu

SEQ ID NO: 2361048 - RNA, 19 nt, Bordetella pertussis
cgccucgaugaaggugcgc

SEQ ID NO: 2361049 - RNA, 19 nt, Bordetella pertussis
cgccucgaugcccucgcgc

SEQ ID NO: 2361050 - RNA, 21 nt, Bordetella pertussis
cgccucgaugucaucgcccuc

SEQ ID NO: 2361051 - RNA, 20 nt, Bordetella pertussis
cgccucgauugaccagcacc

SEQ ID NO: 2361052 - RNA, 21 nt, Bordetella pertussis
cgccucgauugaccagcacca

SEQ ID NO: 2361053 - RNA, 17 nt, Bordetella pertussis
cgccucgcaucggccug

SEQ ID NO: 2361054 - RNA, 17 nt, Bordetella pertussis
cgccucgccggcccugc

SEQ ID NO: 2361055 - RNA, 16 nt, Bordetella pertussis
cgccucgcgacggccu

SEQ ID NO: 2361056 - RNA, 21 nt, Bordetella pertussis
cgccucgcgacggccucccgc

SEQ ID NO: 2361057 - RNA, 17 nt, Bordetella pertussis
cgccucgcgcucgagcg

SEQ ID NO: 2361058 - RNA, 19 nt, Bordetella pertussis
cgccucgcgcucgagcgcg

SEQ ID NO: 2361059 - RNA, 19 nt, Bordetella pertussis
cgccucggacgccuggcgc

SEQ ID NO: 2361060 - RNA, 20 nt, Bordetella pertussis
cgccucggacgccuggcgcg

SEQ ID NO: 2361061 - RNA, 23 nt, Bordetella pertussis
cgccucggcauccagcucggcga

SEQ ID NO: 2361062 - RNA, 19 nt, Bordetella pertussis
cgccucggcgcgcgcggcg

SEQ ID NO: 2361063 - RNA, 15 nt, Bordetella pertussis
cgccucggcggccag

SEQ ID NO: 2361064 - RNA, 16 nt, Bordetella pertussis
cgccucggcggccagc

SEQ ID NO: 2361065 - RNA, 22 nt, Bordetella pertussis
cgccucggcggccagcgcgccc

SEQ ID NO: 2361066 - RNA, 23 nt, Bordetella pertussis
cgccucggcggccagcgcgcccu

SEQ ID NO: 2361067 - RNA, 21 nt, Bordetella pertussis
cgccucggcgguugcccgccc

SEQ ID NO: 2361068 - RNA, 15 nt, Bordetella pertussis
cgccucggcuugcgc

SEQ ID NO: 2361069 - RNA, 17 nt, Bordetella pertussis
cgccucggcuugcgcgg

SEQ ID NO: 2361070 - RNA, 20 nt, Bordetella pertussis
cgccucggcuugcgcggcgc

SEQ ID NO: 2361071 - RNA, 17 nt, Bordetella pertussis
cgccucgggcacggcca

SEQ ID NO: 2361072 - RNA, 14 nt, Bordetella pertussis
cgccucgggcgcaa

SEQ ID NO: 2361073 - RNA, 19 nt, Bordetella pertussis
cgccucgggcgcaacgucg

SEQ ID NO: 2361074 - RNA, 16 nt, Bordetella pertussis
cgccucgguccagcgg

SEQ ID NO: 2361075 - RNA, 21 nt, Bordetella pertussis
cgccucggucugcuucaucca

SEQ ID NO: 2361076 - RNA, 18 nt, Bordetella pertussis
cgccucguccugcaggcg

SEQ ID NO: 2361077 - RNA, 22 nt, Bordetella pertussis
cgccucguccugcaggcggcgc

SEQ ID NO: 2361078 - RNA, 23 nt, Bordetella pertussis
cgccucguccugcaggcggcgca

SEQ ID NO: 2361079 - RNA, 12 nt, Bordetella pertussis
cgccucgucgcg

SEQ ID NO: 2361080 - RNA, 22 nt, Bordetella pertussis
cgccucuucgaugaugagcgcg

SEQ ID NO: 2361081 - RNA, 12 nt, Bordetella pertussis
cgccugagcugc

SEQ ID NO: 2361082 - RNA, 13 nt, Bordetella pertussis
cgccugagcugcc

SEQ ID NO: 2361083 - RNA, 17 nt, Bordetella pertussis
cgccugcaccgccgcgc

SEQ ID NO: 2361084 - RNA, 15 nt, Bordetella pertussis
cgccugcacgaccug

SEQ ID NO: 2361085 - RNA, 16 nt, Bordetella pertussis
cgccugcacgaccugc

SEQ ID NO: 2361086 - RNA, 17 nt, Bordetella pertussis
cgccugcacgaccugcg

SEQ ID NO: 2361087 - RNA, 19 nt, Bordetella pertussis
cgccugcacgaccugcgca

SEQ ID NO: 2361088 - RNA, 18 nt, Bordetella pertussis
cgccugcagcacggccac

SEQ ID NO: 2361089 - RNA, 19 nt, Bordetella pertussis
cgccugcagcacggccacg

SEQ ID NO: 2361090 - RNA, 13 nt, Bordetella pertussis
cgccugcagcagc

SEQ ID NO: 2361091 - RNA, 14 nt, Bordetella pertussis
cgccugcagcagcg

SEQ ID NO: 2361092 - RNA, 15 nt, Bordetella pertussis
cgccugcagcagcgc

SEQ ID NO: 2361093 - RNA, 18 nt, Bordetella pertussis
cgccugcagcagcggcag

SEQ ID NO: 2361094 - RNA, 17 nt, Bordetella pertussis
cgccugcagcagcgugg

SEQ ID NO: 2361095 - RNA, 20 nt, Bordetella pertussis
cgccugcagcagcguggccg

SEQ ID NO: 2361096 - RNA, 22 nt, Bordetella pertussis
cgccugcagcagcguggccgcc

SEQ ID NO: 2361097 - RNA, 12 nt, Bordetella pertussis
cgccugcagcgc

SEQ ID NO: 2361098 - RNA, 15 nt, Bordetella pertussis
cgccugcagcgccgc

SEQ ID NO: 2361099 - RNA, 17 nt, Bordetella pertussis
cgccugcagcgccgccu

SEQ ID NO: 2361100 - RNA, 18 nt, Bordetella pertussis
cgccugcagcgccgccug

SEQ ID NO: 2361101 - RNA, 22 nt, Bordetella pertussis
cgccugcaggcggucggugaca

SEQ ID NO: 2361102 - RNA, 13 nt, Bordetella pertussis
cgccugcaggucu

SEQ ID NO: 2361103 - RNA, 16 nt, Bordetella pertussis
cgccugcauccggccc

SEQ ID NO: 2361104 - RNA, 17 nt, Bordetella pertussis
cgccugcauccggccca

SEQ ID NO: 2361105 - RNA, 19 nt, Bordetella pertussis
cgccugcauccggcccagc

SEQ ID NO: 2361106 - RNA, 20 nt, Bordetella pertussis
cgccugcauccggcccagcg

SEQ ID NO: 2361107 - RNA, 17 nt, Bordetella pertussis
cgccugcauguccagcg

SEQ ID NO: 2361108 - RNA, 12 nt, Bordetella pertussis
cgccugccagaa

SEQ ID NO: 2361109 - RNA, 20 nt, Bordetella pertussis
cgccugccagaacagccgcg

SEQ ID NO: 2361110 - RNA, 22 nt, Bordetella pertussis
cgccugccagaacagccgcgag

SEQ ID NO: 2361111 - RNA, 14 nt, Bordetella pertussis
cgccugccccgccg

SEQ ID NO: 2361112 - RNA, 22 nt, Bordetella pertussis
cgccugccccgccugcgccagg

SEQ ID NO: 2361113 - RNA, 15 nt, Bordetella pertussis
cgccugccccggcag

SEQ ID NO: 2361114 - RNA, 13 nt, Bordetella pertussis
cgccugcccgcaa

SEQ ID NO: 2361115 - RNA, 20 nt, Bordetella pertussis
cgccugcccgcaacgccgcc

SEQ ID NO: 2361116 - RNA, 18 nt, Bordetella pertussis
cgccugcccgcacgggcc

SEQ ID NO: 2361117 - RNA, 19 nt, Bordetella pertussis
cgccugcccgcacgggccg

SEQ ID NO: 2361118 - RNA, 23 nt, Bordetella pertussis
cgccugccgaucgugcacgcccg

SEQ ID NO: 2361119 - RNA, 15 nt, Bordetella pertussis
cgccugccgcauccc

SEQ ID NO: 2361120 - RNA, 22 nt, Bordetella pertussis
cgccugccgcaucccgcccccg

SEQ ID NO: 2361121 - RNA, 15 nt, Bordetella pertussis
cgccugccgcgcccg

SEQ ID NO: 2361122 - RNA, 16 nt, Bordetella pertussis
cgccugccgcgcccgg

SEQ ID NO: 2361123 - RNA, 22 nt, Bordetella pertussis
cgccugccgcgcccggcggcca

SEQ ID NO: 2361124 - RNA, 12 nt, Bordetella pertussis
cgccugccgcgu

SEQ ID NO: 2361125 - RNA, 13 nt, Bordetella pertussis
cgccugccgcgug

SEQ ID NO: 2361126 - RNA, 17 nt, Bordetella pertussis
cgccugccgcgugcccg

SEQ ID NO: 2361127 - RNA, 19 nt, Bordetella pertussis
cgccugccgcgugcccgcg

SEQ ID NO: 2361128 - RNA, 23 nt, Bordetella pertussis
cgccugccgcgugcccgcgucca

SEQ ID NO: 2361129 - RNA, 19 nt, Bordetella pertussis
cgccugccggccuggcuca

SEQ ID NO: 2361130 - RNA, 19 nt, Bordetella pertussis
cgccugccguuauauauag

SEQ ID NO: 2361131 - RNA, 13 nt, Bordetella pertussis
cgccugcgccacc

SEQ ID NO: 2361132 - RNA, 14 nt, Bordetella pertussis
cgccugcgccaccu

SEQ ID NO: 2361133 - RNA, 16 nt, Bordetella pertussis
cgccugcgccaccugg

SEQ ID NO: 2361134 - RNA, 23 nt, Bordetella pertussis
cgccugcgccacguccagcacgg

SEQ ID NO: 2361135 - RNA, 16 nt, Bordetella pertussis
cgccugcgccagccgc

SEQ ID NO: 2361136 - RNA, 14 nt, Bordetella pertussis
cgccugcgccaggu

SEQ ID NO: 2361137 - RNA, 23 nt, Bordetella pertussis
cgccugcgccaggugggccaggu

SEQ ID NO: 2361138 - RNA, 20 nt, Bordetella pertussis
cgccugcgccauggcgcgca

SEQ ID NO: 2361139 - RNA, 22 nt, Bordetella pertussis
cgccugcgccauguggcgacgc

SEQ ID NO: 2361140 - RNA, 22 nt, Bordetella pertussis
cgccugcgccggguccggccgc

SEQ ID NO: 2361141 - RNA, 16 nt, Bordetella pertussis
cgccugcgcgccgccu

SEQ ID NO: 2361142 - RNA, 17 nt, Bordetella pertussis
cgccugcgcgccgccuc

SEQ ID NO: 2361143 - RNA, 15 nt, Bordetella pertussis
cgccugcgcgcgcug

SEQ ID NO: 2361144 - RNA, 14 nt, Bordetella pertussis
cgccugcgcggccu

SEQ ID NO: 2361145 - RNA, 16 nt, Bordetella pertussis
cgccugcgcggccucg

SEQ ID NO: 2361146 - RNA, 13 nt, Bordetella pertussis
cgccugcgcggcg

SEQ ID NO: 2361147 - RNA, 14 nt, Bordetella pertussis
cgccugcggacggc

SEQ ID NO: 2361148 - RNA, 17 nt, Bordetella pertussis
cgccugcggacggcggg

SEQ ID NO: 2361149 - RNA, 20 nt, Bordetella pertussis
cgccugcggacggcgggcgc

SEQ ID NO: 2361150 - RNA, 21 nt, Bordetella pertussis
cgccugcggacggcgggcgcc

SEQ ID NO: 2361151 - RNA, 11 nt, Bordetella pertussis
cgccugcggca

SEQ ID NO: 2361152 - RNA, 13 nt, Bordetella pertussis
cgccugcggcagg

SEQ ID NO: 2361153 - RNA, 17 nt, Bordetella pertussis
cgccugcggcaggccgc

SEQ ID NO: 2361154 - RNA, 18 nt, Bordetella pertussis
cgccugcggcaggccgca

SEQ ID NO: 2361155 - RNA, 20 nt, Bordetella pertussis
cgccugcggcaggccgcagc

SEQ ID NO: 2361156 - RNA, 21 nt, Bordetella pertussis
cgccugcggcaggccgcagcg

SEQ ID NO: 2361157 - RNA, 14 nt, Bordetella pertussis
cgccugcggcaugg

SEQ ID NO: 2361158 - RNA, 17 nt, Bordetella pertussis
cgccugcggcgcggccg

SEQ ID NO: 2361159 - RNA, 18 nt, Bordetella pertussis
cgccugcggggccgcuuc

SEQ ID NO: 2361160 - RNA, 22 nt, Bordetella pertussis
cgccugcgucguugccccgauc

SEQ ID NO: 2361161 - RNA, 19 nt, Bordetella pertussis
cgccuugacgaucucggcg

SEQ ID NO: 2361162 - RNA, 21 nt, Bordetella pertussis
cgccuugacgaucucggcguu

SEQ ID NO: 2361163 - RNA, 16 nt, Bordetella pertussis
cgccuugacgcugcuc

SEQ ID NO: 2361164 - RNA, 23 nt, Bordetella pertussis
cgccuugacgguggccgcggcgu

SEQ ID NO: 2361165 - RNA, 13 nt, Bordetella pertussis
cgccuugcccggg

SEQ ID NO: 2361166 - RNA, 21 nt, Bordetella pertussis
cgccuugcccgggcuggccgc

SEQ ID NO: 2361167 - RNA, 11 nt, Bordetella pertussis
cgccuugccgc

SEQ ID NO: 2361168 - RNA, 16 nt, Bordetella pertussis
cgccuugccgccgcgc

SEQ ID NO: 2361169 - RNA, 17 nt, Bordetella pertussis
cgccuugccgccgugcg

SEQ ID NO: 2361170 - RNA, 18 nt, Bordetella pertussis
cgccuugccuuccaggaa

SEQ ID NO: 2361171 - RNA, 18 nt, Bordetella pertussis
cgccuugccuugcgcggc

SEQ ID NO: 2361172 - RNA, 21 nt, Bordetella pertussis
cgccuugccuugcgcggccac

SEQ ID NO: 2361173 - RNA, 14 nt, Bordetella pertussis
cgccuuggccguca

SEQ ID NO: 2361174 - RNA, 15 nt, Bordetella pertussis
cgccuuggccgucaa

SEQ ID NO: 2361175 - RNA, 17 nt, Bordetella pertussis
cgccuuggccugggcgc

SEQ ID NO: 2361176 - RNA, 15 nt, Bordetella pertussis
cgccuugucggggaa

SEQ ID NO: 2361177 - RNA, 16 nt, Bordetella pertussis
cgccuuucccgcgccg

SEQ ID NO: 2361178 - RNA, 22 nt, Bordetella pertussis
cgccuuugccgcuggacgcgcc

SEQ ID NO: 2361179 - RNA, 23 nt, Bordetella pertussis
cgccuuugccgcuggacgcgccg

SEQ ID NO: 2361180 - RNA, 14 nt, Bordetella pertussis
cgccuuuucgcagc

SEQ ID NO: 2361181 - RNA, 15 nt, Bordetella pertussis
cgcgaaacggccggg

SEQ ID NO: 2361182 - RNA, 14 nt, Bordetella pertussis
cgcgaaagcacgcc

SEQ ID NO: 2361183 - RNA, 15 nt, Bordetella pertussis
cgcgaaagcgcugcg

SEQ ID NO: 2361184 - RNA, 18 nt, Bordetella pertussis
cgcgaaagcgcugcgccg

SEQ ID NO: 2361185 - RNA, 14 nt, Bordetella pertussis
cgcgaaagcggcgu

SEQ ID NO: 2361186 - RNA, 16 nt, Bordetella pertussis
cgcgaaagcggcgugu

SEQ ID NO: 2361187 - RNA, 23 nt, Bordetella pertussis
cgcgaaagcggcgugugcccagc

SEQ ID NO: 2361188 - RNA, 16 nt, Bordetella pertussis
cgcgaaaugcccagcg

SEQ ID NO: 2361189 - RNA, 19 nt, Bordetella pertussis
cgcgaaaugcccagcgagc

SEQ ID NO: 2361190 - RNA, 16 nt, Bordetella pertussis
cgcgaacaccggcagg

SEQ ID NO: 2361191 - RNA, 15 nt, Bordetella pertussis
cgcgaaccaggccac

SEQ ID NO: 2361192 - RNA, 18 nt, Bordetella pertussis
cgcgaaccaggccaccgc

SEQ ID NO: 2361193 - RNA, 17 nt, Bordetella pertussis
cgcgaaccaggccugcg

SEQ ID NO: 2361194 - RNA, 18 nt, Bordetella pertussis
cgcgaaccaggccugcgg

SEQ ID NO: 2361195 - RNA, 20 nt, Bordetella pertussis
cgcgaacccgaucgcgaugg

SEQ ID NO: 2361196 - RNA, 17 nt, Bordetella pertussis
cgcgaaccggugcuggu

SEQ ID NO: 2361197 - RNA, 14 nt, Bordetella pertussis
cgcgaacgccugcc

SEQ ID NO: 2361198 - RNA, 15 nt, Bordetella pertussis
cgcgaacgccugcca

SEQ ID NO: 2361199 - RNA, 14 nt, Bordetella pertussis
cgcgaacgcgccgg

SEQ ID NO: 2361200 - RNA, 20 nt, Bordetella pertussis
cgcgaacgcgccggcccagg

SEQ ID NO: 2361201 - RNA, 15 nt, Bordetella pertussis
cgcgaacgcgcgccg

SEQ ID NO: 2361202 - RNA, 22 nt, Bordetella pertussis
cgcgaacgcgcgccggccagcg

SEQ ID NO: 2361203 - RNA, 14 nt, Bordetella pertussis
cgcgaacgcggcca

SEQ ID NO: 2361204 - RNA, 13 nt, Bordetella pertussis
cgcgaacggcagg

SEQ ID NO: 2361205 - RNA, 21 nt, Bordetella pertussis
cgcgaacggcaggugcacgca

SEQ ID NO: 2361206 - RNA, 21 nt, Bordetella pertussis
cgcgaacuuggccaugccaac

SEQ ID NO: 2361207 - RNA, 15 nt, Bordetella pertussis
cgcgaagcagccggc

SEQ ID NO: 2361208 - RNA, 17 nt, Bordetella pertussis
cgcgaagcagccggcca

SEQ ID NO: 2361209 - RNA, 13 nt, Bordetella pertussis
cgcgaagcgcccu

SEQ ID NO: 2361210 - RNA, 14 nt, Bordetella pertussis
cgcgaagcgcgcca

SEQ ID NO: 2361211 - RNA, 17 nt, Bordetella pertussis
cgcgaagcgcgccagca

SEQ ID NO: 2361212 - RNA, 18 nt, Bordetella pertussis
cgcgaagcgcgccagcag

SEQ ID NO: 2361213 - RNA, 14 nt, Bordetella pertussis
cgcgaaggccgccc

SEQ ID NO: 2361214 - RNA, 16 nt, Bordetella pertussis
cgcgaaggccgccccc

SEQ ID NO: 2361215 - RNA, 21 nt, Bordetella pertussis
cgcgaaggccgccccccuacg

SEQ ID NO: 2361216 - RNA, 22 nt, Bordetella pertussis
cgcgaaggcuucgucgaccagc

SEQ ID NO: 2361217 - RNA, 16 nt, Bordetella pertussis
cgcgaaguggccacca

SEQ ID NO: 2361218 - RNA, 23 nt, Bordetella pertussis
cgcgaauuuuucuuccaguucgc

SEQ ID NO: 2361219 - RNA, 22 nt, Bordetella pertussis
cgcgacaaauagccgaccgcgc

SEQ ID NO: 2361220 - RNA, 13 nt, Bordetella pertussis
cgcgacagcacca

SEQ ID NO: 2361221 - RNA, 18 nt, Bordetella pertussis
cgcgacagcaccaacugg

SEQ ID NO: 2361222 - RNA, 17 nt, Bordetella pertussis
cgcgacagcaggccggu

SEQ ID NO: 2361223 - RNA, 19 nt, Bordetella pertussis
cgcgacagcaggccgguca

SEQ ID NO: 2361224 - RNA, 16 nt, Bordetella pertussis
cgcgacagccgcgcca

SEQ ID NO: 2361225 - RNA, 20 nt, Bordetella pertussis
cgcgacagccgcgccagcgc

SEQ ID NO: 2361226 - RNA, 22 nt, Bordetella pertussis
cgcgacagccgcgccagcgccu

SEQ ID NO: 2361227 - RNA, 14 nt, Bordetella pertussis
cgcgacagcgcugg

SEQ ID NO: 2361228 - RNA, 16 nt, Bordetella pertussis
cgcgacagcgcuggug

SEQ ID NO: 2361229 - RNA, 20 nt, Bordetella pertussis
cgcgacagcgcugguggcca

SEQ ID NO: 2361230 - RNA, 16 nt, Bordetella pertussis
cgcgacaggcccgcgg

SEQ ID NO: 2361231 - RNA, 20 nt, Bordetella pertussis
acgaauuucucggccagcgc

SEQ ID NO: 2361232 - RNA, 12 nt, Bordetella pertussis
acgacacgccca

SEQ ID NO: 2361233 - RNA, 17 nt, Bordetella pertussis
acgacacgcccagcagg

SEQ ID NO: 2361234 - RNA, 15 nt, Bordetella pertussis
acgacacgucaucgu

SEQ ID NO: 2361235 - RNA, 23 nt, Bordetella pertussis
acgacacgucaucguggccgcgc

SEQ ID NO: 2361236 - RNA, 20 nt, Bordetella pertussis
acgacagaccguagcgcagg

SEQ ID NO: 2361237 - RNA, 13 nt, Bordetella pertussis
acgacagcgacac

SEQ ID NO: 2361238 - RNA, 17 nt, Bordetella pertussis
acgaccaaccugaccgc

SEQ ID NO: 2361239 - RNA, 18 nt, Bordetella pertussis
acgaccagcacgagaugu

SEQ ID NO: 2361240 - RNA, 22 nt, Bordetella pertussis
acgaccaggccguggcccagcc

SEQ ID NO: 2361241 - RNA, 22 nt, Bordetella pertussis
acgaccccgccgugccgggccu

SEQ ID NO: 2361242 - RNA, 20 nt, Bordetella pertussis
acgaccgaaccgauccagcc

SEQ ID NO: 2361243 - RNA, 14 nt, Bordetella pertussis
acgaccugccacug

SEQ ID NO: 2361244 - RNA, 13 nt, Bordetella pertussis
acgaccugcgcau

SEQ ID NO: 2361245 - RNA, 19 nt, Bordetella pertussis
acgaccugcgcaugcgccu

SEQ ID NO: 2361246 - RNA, 23 nt, Bordetella pertussis
acgaccuugcccgucagcggcgc

SEQ ID NO: 2361247 - RNA, 15 nt, Bordetella pertussis
acgaccuugcggccg

SEQ ID NO: 2361248 - RNA, 18 nt, Bordetella pertussis
acgaccuugcggccgcgc

SEQ ID NO: 2361249 - RNA, 22 nt, Bordetella pertussis
acgaccuugcuggaccgcgccu

SEQ ID NO: 2361250 - RNA, 24 nt, Bordetella pertussis
acgaccuugcuggaccgcgccugg

SEQ ID NO: 2361251 - RNA, 16 nt, Bordetella pertussis
acgaccuuggcggccg

SEQ ID NO: 2361252 - RNA, 17 nt, Bordetella pertussis
acgaccuuggcggccga

SEQ ID NO: 2361253 - RNA, 15 nt, Bordetella pertussis
acgacgaacaacacg

SEQ ID NO: 2361254 - RNA, 17 nt, Bordetella pertussis
acgacgacggccggcgc

SEQ ID NO: 2361255 - RNA, 17 nt, Bordetella pertussis
acgacgacuacuggcaa

SEQ ID NO: 2361256 - RNA, 15 nt, Bordetella pertussis
acgacgagaucgcgc

SEQ ID NO: 2361257 - RNA, 17 nt, Bordetella pertussis
acgacgagaucgcgccu

SEQ ID NO: 2361258 - RNA, 16 nt, Bordetella pertussis
acgacgaucggccuga

SEQ ID NO: 2361259 - RNA, 15 nt, Bordetella pertussis
acgacgcagcgugcg

SEQ ID NO: 2361260 - RNA, 20 nt, Bordetella pertussis
acgacgcagcgugcgacgca

SEQ ID NO: 2361261 - RNA, 14 nt, Bordetella pertussis
acgacgcaggcgcc

SEQ ID NO: 2361262 - RNA, 16 nt, Bordetella pertussis
acgacgcaggcgccgc

SEQ ID NO: 2361263 - RNA, 17 nt, Bordetella pertussis
acgacgcaggcgccgca

SEQ ID NO: 2361264 - RNA, 20 nt, Bordetella pertussis
acgacgccuggaccggcucc

SEQ ID NO: 2361265 - RNA, 14 nt, Bordetella pertussis
acgacgcggcaugc

SEQ ID NO: 2361266 - RNA, 23 nt, Bordetella pertussis
acgacgcguuguucgggccggcu

SEQ ID NO: 2361267 - RNA, 18 nt, Bordetella pertussis
acgacggcaagucgacgc

SEQ ID NO: 2361268 - RNA, 14 nt, Bordetella pertussis
acgacggccggcgc

SEQ ID NO: 2361269 - RNA, 15 nt, Bordetella pertussis
acgacggccggggcc

SEQ ID NO: 2361270 - RNA, 19 nt, Bordetella pertussis
acgacggccuccgcgccga

SEQ ID NO: 2361271 - RNA, 16 nt, Bordetella pertussis
acgacguagucggcgc

SEQ ID NO: 2361272 - RNA, 16 nt, Bordetella pertussis
acgacguugggcaugc

SEQ ID NO: 2361273 - RNA, 21 nt, Bordetella pertussis
acgacguugggcaugccgauc

SEQ ID NO: 2361274 - RNA, 20 nt, Bordetella pertussis
cgcgacgguccugcgcgccg

SEQ ID NO: 2361275 - RNA, 19 nt, Bordetella pertussis
cgcgacgugucggccacca

SEQ ID NO: 2361276 - RNA, 15 nt, Bordetella pertussis
cgcgacuggcccagg

SEQ ID NO: 2361277 - RNA, 16 nt, Bordetella pertussis
cgcgacuggcccaggc

SEQ ID NO: 2361278 - RNA, 18 nt, Bordetella pertussis
cgcgacuggcccaggcgg

SEQ ID NO: 2361279 - RNA, 19 nt, Bordetella pertussis
cgcgacuggcccaggcggg

SEQ ID NO: 2361280 - RNA, 22 nt, Bordetella pertussis
cgcgacuggcccaggcgggcca

SEQ ID NO: 2361281 - RNA, 16 nt, Bordetella pertussis
cgcgacuuccucgacc

SEQ ID NO: 2361282 - RNA, 19 nt, Bordetella pertussis
cgcgacuuccucgacccgc

SEQ ID NO: 2361283 - RNA, 21 nt, Bordetella pertussis
cgcgacuuccucgacccgcgc

SEQ ID NO: 2361284 - RNA, 22 nt, Bordetella pertussis
cgcgacuuccucgacccgcgcc

SEQ ID NO: 2361285 - RNA, 19 nt, Bordetella pertussis
cgcgacuucgccgaucgag

SEQ ID NO: 2361286 - RNA, 21 nt, Bordetella pertussis
cgcgacuucgccgaucgagca

SEQ ID NO: 2361287 - RNA, 22 nt, Bordetella pertussis
cgcgacuucgccgaucgagcag

SEQ ID NO: 2361288 - RNA, 14 nt, Bordetella pertussis
cgcgagaaccaggc

SEQ ID NO: 2361289 - RNA, 15 nt, Bordetella pertussis
cgcgagaaccaggcc

SEQ ID NO: 2361290 - RNA, 19 nt, Bordetella pertussis
cgcgagcagucgaccacgc

SEQ ID NO: 2361291 - RNA, 14 nt, Bordetella pertussis
cgcgagcccaucag

SEQ ID NO: 2361292 - RNA, 12 nt, Bordetella pertussis
cgcgagccgccc

SEQ ID NO: 2361293 - RNA, 14 nt, Bordetella pertussis
cgcgagccgcccac

SEQ ID NO: 2361294 - RNA, 17 nt, Bordetella pertussis
cgcgagcgcacaggcgg

SEQ ID NO: 2361295 - RNA, 12 nt, Bordetella pertussis
cgcgagcgccgg

SEQ ID NO: 2361296 - RNA, 18 nt, Bordetella pertussis
cgcgagcgccgggcgccg

SEQ ID NO: 2361297 - RNA, 21 nt, Bordetella pertussis
cgcgagcgccgggcgccgcgc

SEQ ID NO: 2361298 - RNA, 20 nt, Bordetella pertussis
cgcgagcgcguggaaccgcc

SEQ ID NO: 2361299 - RNA, 14 nt, Bordetella pertussis
cgcgagcggccagc

SEQ ID NO: 2361300 - RNA, 18 nt, Bordetella pertussis
cgcgagcggccagccugc

SEQ ID NO: 2361301 - RNA, 14 nt, Bordetella pertussis
cgcgagcggcggcc

SEQ ID NO: 2361302 - RNA, 18 nt, Bordetella pertussis
cgcgagcuggucgaacgc

SEQ ID NO: 2361303 - RNA, 14 nt, Bordetella pertussis
cgcgaggcgcaggc

SEQ ID NO: 2361304 - RNA, 16 nt, Bordetella pertussis
cgcgaggcgcaggccg

SEQ ID NO: 2361305 - RNA, 20 nt, Bordetella pertussis
cgcgaggcgcaggccgacgc

SEQ ID NO: 2361306 - RNA, 22 nt, Bordetella pertussis
cgcgaggcgcaggccgacgcgc

SEQ ID NO: 2361307 - RNA, 17 nt, Bordetella pertussis
cgcgaggcggcgacgca

SEQ ID NO: 2361308 - RNA, 16 nt, Bordetella pertussis
cgcgaggcggcggccg

SEQ ID NO: 2361309 - RNA, 17 nt, Bordetella pertussis
cgcgaggcggcggccgg

SEQ ID NO: 2361310 - RNA, 18 nt, Bordetella pertussis
cgcgaggcggcggccggg

SEQ ID NO: 2361311 - RNA, 18 nt, Bordetella pertussis
cgcgagggcuucgacucc

SEQ ID NO: 2361312 - RNA, 18 nt, Bordetella pertussis
cgcgaggugccggacgcc

SEQ ID NO: 2361313 - RNA, 20 nt, Bordetella pertussis
cgcgaggugccggacgccga

SEQ ID NO: 2361314 - RNA, 16 nt, Bordetella pertussis
cgcgagguggcgcucg

SEQ ID NO: 2361315 - RNA, 21 nt, Bordetella pertussis
cgcgagguggcgcucgcgccc

SEQ ID NO: 2361316 - RNA, 22 nt, Bordetella pertussis
cgcgagguggcgcucgcgccca

SEQ ID NO: 2361317 - RNA, 22 nt, Bordetella pertussis
cgcgaggugggcggcagcaggc

SEQ ID NO: 2361318 - RNA, 21 nt, Bordetella pertussis
cgcgaguaucccuaccgccuu

SEQ ID NO: 2361319 - RNA, 17 nt, Bordetella pertussis
cgcgaguauucacgccg

SEQ ID NO: 2361320 - RNA, 17 nt, Bordetella pertussis
cgcgauagauggccagg

SEQ ID NO: 2361321 - RNA, 21 nt, Bordetella pertussis
cgcgauauugaaggccgaggc

SEQ ID NO: 2361322 - RNA, 23 nt, Bordetella pertussis
cgcgaucaccgagugggcggccu

SEQ ID NO: 2361323 - RNA, 21 nt, Bordetella pertussis
cgcgaucagcgcggccgcuug

SEQ ID NO: 2361324 - RNA, 16 nt, Bordetella pertussis
cgcgauccagcagcgu

SEQ ID NO: 2361325 - RNA, 13 nt, Bordetella pertussis
cgcgauccgcgcc

SEQ ID NO: 2361326 - RNA, 16 nt, Bordetella pertussis
cgcgauccgcgccagg

SEQ ID NO: 2361327 - RNA, 15 nt, Bordetella pertussis
cgcgaucgccagcag

SEQ ID NO: 2361328 - RNA, 15 nt, Bordetella pertussis
cgcgaucgccgcaug

SEQ ID NO: 2361329 - RNA, 15 nt, Bordetella pertussis
cgcgaucgucgaccg

SEQ ID NO: 2361330 - RNA, 16 nt, Bordetella pertussis
cgcgaucgucgaccgc

SEQ ID NO: 2361331 - RNA, 19 nt, Bordetella pertussis
cgcgaucucagccaucauc

SEQ ID NO: 2361332 - RNA, 16 nt, Bordetella pertussis
cgcgaucucgggcagg

SEQ ID NO: 2361333 - RNA, 17 nt, Bordetella pertussis
cgcgaucucguggccca

SEQ ID NO: 2361334 - RNA, 19 nt, Bordetella pertussis
cgcgaucucguggcccagc

SEQ ID NO: 2361335 - RNA, 22 nt, Bordetella pertussis
cgcgaucucguggcccagcacc

SEQ ID NO: 2361336 - RNA, 23 nt, Bordetella pertussis
cgcgaugcaugaaccgcagcgcc

SEQ ID NO: 2361337 - RNA, 19 nt, Bordetella pertussis
cgcgaugcccgcgcaccag

SEQ ID NO: 2361338 - RNA, 12 nt, Bordetella pertussis
cgcgaugcgcag

SEQ ID NO: 2361339 - RNA, 13 nt, Bordetella pertussis
cgcgaugcgcagc

SEQ ID NO: 2361340 - RNA, 15 nt, Bordetella pertussis
cgcgaugcgcagcag

SEQ ID NO: 2361341 - RNA, 16 nt, Bordetella pertussis
cgcgaugcgcagcagc

SEQ ID NO: 2361342 - RNA, 17 nt, Bordetella pertussis
cgcgaugcgcagcagca

SEQ ID NO: 2361343 - RNA, 21 nt, Bordetella pertussis
cgcgaugcgcagcagcagcgc

SEQ ID NO: 2361344 - RNA, 14 nt, Bordetella pertussis
cgcgaugcgccagg

SEQ ID NO: 2361345 - RNA, 13 nt, Bordetella pertussis
cgcgaugcgcgcg

SEQ ID NO: 2361346 - RNA, 14 nt, Bordetella pertussis
cgcgaugcgcgcgc

SEQ ID NO: 2361347 - RNA, 20 nt, Bordetella pertussis
cgcgaugcgcgcgcgggcca

SEQ ID NO: 2361348 - RNA, 17 nt, Bordetella pertussis
cgcgaugcgcgcgugca

SEQ ID NO: 2361349 - RNA, 21 nt, Bordetella pertussis
cgcgaugcgcgcgugcagcgc

SEQ ID NO: 2361350 - RNA, 14 nt, Bordetella pertussis
cgcgaugcgcggcc

SEQ ID NO: 2361351 - RNA, 15 nt, Bordetella pertussis
cgcgaugcgcggccc

SEQ ID NO: 2361352 - RNA, 17 nt, Bordetella pertussis
cgcgaugcgcggcccgg

SEQ ID NO: 2361353 - RNA, 18 nt, Bordetella pertussis
cgcgaugcgcggcccggc

SEQ ID NO: 2361354 - RNA, 18 nt, Bordetella pertussis
cgcgaugcgucaggggca

SEQ ID NO: 2361355 - RNA, 14 nt, Bordetella pertussis
cgcgaugcugcgca

SEQ ID NO: 2361356 - RNA, 15 nt, Bordetella pertussis
cgcgaugcugcgcaa

SEQ ID NO: 2361357 - RNA, 13 nt, Bordetella pertussis
cgcgauggcgccg

SEQ ID NO: 2361358 - RNA, 16 nt, Bordetella pertussis
cgcgauggcgccggcc

SEQ ID NO: 2361359 - RNA, 18 nt, Bordetella pertussis
cgcgauggcgccggccag

SEQ ID NO: 2361360 - RNA, 20 nt, Bordetella pertussis
cgcgauggcgccggccagcg

SEQ ID NO: 2361361 - RNA, 13 nt, Bordetella pertussis
cgcgauggcggca

SEQ ID NO: 2361362 - RNA, 14 nt, Bordetella pertussis
cgcgaugggccugc

SEQ ID NO: 2361363 - RNA, 21 nt, Bordetella pertussis
cgcgaugggccugcccauggc

SEQ ID NO: 2361364 - RNA, 20 nt, Bordetella pertussis
cgcgauguccagcuccagcg

SEQ ID NO: 2361365 - RNA, 14 nt, Bordetella pertussis
cgcgaugucgcgcg

SEQ ID NO: 2361366 - RNA, 17 nt, Bordetella pertussis
cgcgaugucgcgcgcgc

SEQ ID NO: 2361367 - RNA, 13 nt, Bordetella pertussis
cgcgaugugacgg

SEQ ID NO: 2361368 - RNA, 14 nt, Bordetella pertussis
cgcgaugugacggc

SEQ ID NO: 2361369 - RNA, 15 nt, Bordetella pertussis
cgcgaugugacggcu

SEQ ID NO: 2361370 - RNA, 17 nt, Bordetella pertussis
cgcgauucccuggcgcg

SEQ ID NO: 2361371 - RNA, 20 nt, Bordetella pertussis
cgcgauucccuggcgcgcca

SEQ ID NO: 2361372 - RNA, 21 nt, Bordetella pertussis
cgcgauucccuggcgcgccag

SEQ ID NO: 2361373 - RNA, 21 nt, Bordetella pertussis
cgcgauugaguucgcgcgccg

SEQ ID NO: 2361374 - RNA, 22 nt, Bordetella pertussis
cgcgauugaguucgcgcgccgg

SEQ ID NO: 2361375 - RNA, 23 nt, Bordetella pertussis
cgcgauugaguucgcgcgccggc

SEQ ID NO: 2361376 - RNA, 18 nt, Bordetella pertussis
cgcgauugcagguggcca

SEQ ID NO: 2361377 - RNA, 22 nt, Bordetella pertussis
cgcgauugcagguggccagccc

SEQ ID NO: 2361378 - RNA, 18 nt, Bordetella pertussis
cgcgcaaaccgacgcggc

SEQ ID NO: 2361379 - RNA, 19 nt, Bordetella pertussis
cgcgcaaaccgacgcggcc

SEQ ID NO: 2361380 - RNA, 13 nt, Bordetella pertussis
cgcgcaacacgcg

SEQ ID NO: 2361381 - RNA, 15 nt, Bordetella pertussis
cgcgcaacaggucgu

SEQ ID NO: 2361382 - RNA, 20 nt, Bordetella pertussis
cgcgcaaccaggggcggcgc

SEQ ID NO: 2361383 - RNA, 14 nt, Bordetella pertussis
cgcgcaacgccgcc

SEQ ID NO: 2361384 - RNA, 15 nt, Bordetella pertussis
cgcgcaacgccgcca

SEQ ID NO: 2361385 - RNA, 20 nt, Bordetella pertussis
cgcgcaacgccgccaccagg

SEQ ID NO: 2361386 - RNA, 15 nt, Bordetella pertussis
cgcgcaacuccagca

SEQ ID NO: 2361387 - RNA, 16 nt, Bordetella pertussis
cgcgcagcguggcggc

SEQ ID NO: 2361388 - RNA, 22 nt, Bordetella pertussis
cgcgcagcguggcggcgacggc

SEQ ID NO: 2361389 - RNA, 21 nt, Bordetella pertussis
cgcgcagcucccccacgccgc

SEQ ID NO: 2361390 - RNA, 22 nt, Bordetella pertussis
cgcgcagcucccccacgccgcc

SEQ ID NO: 2361391 - RNA, 18 nt, Bordetella pertussis
cgcgcagcugccugagca

SEQ ID NO: 2361392 - RNA, 20 nt, Bordetella pertussis
cgcgcaggacaaggcgcgcg

SEQ ID NO: 2361393 - RNA, 21 nt, Bordetella pertussis
cgcgcaggacaaggcgcgcgc

SEQ ID NO: 2361394 - RNA, 19 nt, Bordetella pertussis
cgcgcaggauuucaucgcc

SEQ ID NO: 2361395 - RNA, 14 nt, Bordetella pertussis
cgcgcaggccauug

SEQ ID NO: 2361396 - RNA, 14 nt, Bordetella pertussis
cgcgcaggcccuug

SEQ ID NO: 2361397 - RNA, 12 nt, Bordetella pertussis
cgcgcaggcggg

SEQ ID NO: 2361398 - RNA, 15 nt, Bordetella pertussis
cgcgcaggcgggccu

SEQ ID NO: 2361399 - RNA, 17 nt, Bordetella pertussis
cgcgcaggcgggccucg

SEQ ID NO: 2361400 - RNA, 14 nt, Bordetella pertussis
cgcgcaggcgugcg

SEQ ID NO: 2361401 - RNA, 22 nt, Bordetella pertussis
cgcgcaggcgugcgcgggcgcc

SEQ ID NO: 2361402 - RNA, 14 nt, Bordetella pertussis
cgcgcagggcaucg

SEQ ID NO: 2361403 - RNA, 13 nt, Bordetella pertussis
cgcgcagggcggc

SEQ ID NO: 2361404 - RNA, 16 nt, Bordetella pertussis
cgcgcagggcggccgg

SEQ ID NO: 2361405 - RNA, 22 nt, Bordetella pertussis
cgcgcagggcggccggcacgcc

SEQ ID NO: 2361406 - RNA, 17 nt, Bordetella pertussis
cgcgcagggcggccucg

SEQ ID NO: 2361407 - RNA, 21 nt, Bordetella pertussis
cgcgcagggcggccucgacgg

SEQ ID NO: 2361408 - RNA, 16 nt, Bordetella pertussis
cgcgcaggugugccag

SEQ ID NO: 2361409 - RNA, 21 nt, Bordetella pertussis
cgcgcaggugugccagccgcu

SEQ ID NO: 2361410 - RNA, 22 nt, Bordetella pertussis
cgcgcaguccaaggaaagcccg

SEQ ID NO: 2361411 - RNA, 15 nt, Bordetella pertussis
cgcgcaguccgcaca

SEQ ID NO: 2361412 - RNA, 19 nt, Bordetella pertussis
cgcgcaguuguucgcgcaa

SEQ ID NO: 2361413 - RNA, 22 nt, Bordetella pertussis
cgcgcaucacgcuggccgcgcc

SEQ ID NO: 2361414 - RNA, 20 nt, Bordetella pertussis
cgcgcauccgguggugcugg

SEQ ID NO: 2361415 - RNA, 13 nt, Bordetella pertussis
cgcgcaucgcgcg

SEQ ID NO: 2361416 - RNA, 14 nt, Bordetella pertussis
cgcgcaucgcgcgg

SEQ ID NO: 2361417 - RNA, 16 nt, Bordetella pertussis
cgcgcaucgcgcggca

SEQ ID NO: 2361418 - RNA, 17 nt, Bordetella pertussis
cgcgcaucgcgcggcau

SEQ ID NO: 2361419 - RNA, 13 nt, Bordetella pertussis
cgcgcaucggccg

SEQ ID NO: 2361420 - RNA, 15 nt, Bordetella pertussis
cgcgcaucggcgccg

SEQ ID NO: 2361421 - RNA, 15 nt, Bordetella pertussis
cgcgcaucgggaucc

SEQ ID NO: 2361422 - RNA, 17 nt, Bordetella pertussis
cgcgcaucgucaggcag

SEQ ID NO: 2361423 - RNA, 19 nt, Bordetella pertussis
cgcgcaugauuccugucgc

SEQ ID NO: 2361424 - RNA, 23 nt, Bordetella pertussis
cgcgcaugauuccugucgcgcug

SEQ ID NO: 2361425 - RNA, 16 nt, Bordetella pertussis
cgcgcaugccagcuug

SEQ ID NO: 2361426 - RNA, 16 nt, Bordetella pertussis
cgcgcaugcccgaccg

SEQ ID NO: 2361427 - RNA, 13 nt, Bordetella pertussis
cgcgcaugcgcac

SEQ ID NO: 2361428 - RNA, 16 nt, Bordetella pertussis
cgcgcaugcgccuuac

SEQ ID NO: 2361429 - RNA, 16 nt, Bordetella pertussis
cgcgcauggacgccgc

SEQ ID NO: 2361430 - RNA, 17 nt, Bordetella pertussis
cgcgcauggcgaugacc

SEQ ID NO: 2361431 - RNA, 17 nt, Bordetella pertussis
cgcgcauucgucgcugc

SEQ ID NO: 2361432 - RNA, 18 nt, Bordetella pertussis
cgcgcauucgucgcugcc

SEQ ID NO: 2361433 - RNA, 22 nt, Bordetella pertussis
cgcgcauucgucgcugccgcgc

SEQ ID NO: 2361434 - RNA, 16 nt, Bordetella pertussis
cgcgcauuucgaccug

SEQ ID NO: 2361435 - RNA, 19 nt, Bordetella pertussis
cgcgcauuucgaccugcgc

SEQ ID NO: 2361436 - RNA, 20 nt, Bordetella pertussis
cgcgcauuucgaccugcgca

SEQ ID NO: 2361437 - RNA, 23 nt, Bordetella pertussis
cgcgcauuucgaccugcgcaccg

SEQ ID NO: 2361438 - RNA, 22 nt, Bordetella pertussis
cgcgccaaucagauggcgcagc

SEQ ID NO: 2361439 - RNA, 15 nt, Bordetella pertussis
cgcgccacacgggcg

SEQ ID NO: 2361440 - RNA, 18 nt, Bordetella pertussis
cgcgccacacgggcgccu

SEQ ID NO: 2361441 - RNA, 21 nt, Bordetella pertussis
cgcgccacauccugcacggcg

SEQ ID NO: 2361442 - RNA, 15 nt, Bordetella pertussis
cgcgccaccaccguc

SEQ ID NO: 2361443 - RNA, 14 nt, Bordetella pertussis
cgcgccaccaugcc

SEQ ID NO: 2361444 - RNA, 15 nt, Bordetella pertussis
cgcgccaccgccaga

SEQ ID NO: 2361445 - RNA, 16 nt, Bordetella pertussis
cgcgccacggcgucgc

SEQ ID NO: 2361446 - RNA, 12 nt, Bordetella pertussis
cgcgccacggcu

SEQ ID NO: 2361447 - RNA, 13 nt, Bordetella pertussis
cgcgccagcacgg

SEQ ID NO: 2361448 - RNA, 18 nt, Bordetella pertussis
cgcgccagcacgguggcg

SEQ ID NO: 2361449 - RNA, 14 nt, Bordetella pertussis
cgcgccagcagcgc

SEQ ID NO: 2361450 - RNA, 15 nt, Bordetella pertussis
cgcgccagcagcgcc

SEQ ID NO: 2361451 - RNA, 13 nt, Bordetella pertussis
cgcgccagcccgc

SEQ ID NO: 2361452 - RNA, 15 nt, Bordetella pertussis
cgcgccagcccgccg

SEQ ID NO: 2361453 - RNA, 17 nt, Bordetella pertussis
cgcgccagcccgccgcu

SEQ ID NO: 2361454 - RNA, 12 nt, Bordetella pertussis
cgcgccagcccu

SEQ ID NO: 2361455 - RNA, 14 nt, Bordetella pertussis
cgcgccagccgcgc

SEQ ID NO: 2361456 - RNA, 15 nt, Bordetella pertussis
cgcgccagccgcgcg

SEQ ID NO: 2361457 - RNA, 18 nt, Bordetella pertussis
cgcgccagccgcgcgacc

SEQ ID NO: 2361458 - RNA, 21 nt, Bordetella pertussis
cgcgccagccgcgcgaccuug

SEQ ID NO: 2361459 - RNA, 14 nt, Bordetella pertussis
cgcgccagccgcug

SEQ ID NO: 2361460 - RNA, 21 nt, Bordetella pertussis
cgcgccagccgcugcagcgac

SEQ ID NO: 2361461 - RNA, 13 nt, Bordetella pertussis
cgcgccagcgcca

SEQ ID NO: 2361462 - RNA, 16 nt, Bordetella pertussis
cgcgccagcgccacgc

SEQ ID NO: 2361463 - RNA, 15 nt, Bordetella pertussis
cgcgccagcgccgcg

SEQ ID NO: 2361464 - RNA, 14 nt, Bordetella pertussis
cgcgccagcgccgg

SEQ ID NO: 2361465 - RNA, 17 nt, Bordetella pertussis
cgcgccagcgccggcgc

SEQ ID NO: 2361466 - RNA, 21 nt, Bordetella pertussis
acgauuuccgcuaccaggcgc

SEQ ID NO: 2361467 - RNA, 22 nt, Bordetella pertussis
acgauuuccgcuaccaggcgcg

SEQ ID NO: 2361468 - RNA, 13 nt, Bordetella pertussis
acgauuucggcca

SEQ ID NO: 2361469 - RNA, 18 nt, Bordetella pertussis
acgcaacagacccgggcc

SEQ ID NO: 2361470 - RNA, 17 nt, Bordetella pertussis
acgcaaccggucggccg

SEQ ID NO: 2361471 - RNA, 19 nt, Bordetella pertussis
acgcaaccggucggccggc

SEQ ID NO: 2361472 - RNA, 20 nt, Bordetella pertussis
acgcaaccggucggccggca

SEQ ID NO: 2361473 - RNA, 13 nt, Bordetella pertussis
acgcaagcccggc

SEQ ID NO: 2361474 - RNA, 14 nt, Bordetella pertussis
acgcaagcccggca

SEQ ID NO: 2361475 - RNA, 12 nt, Bordetella pertussis
acgcaaggccga

SEQ ID NO: 2361476 - RNA, 23 nt, Bordetella pertussis
acgcaagggccccccggcgcggc

SEQ ID NO: 2361477 - RNA, 13 nt, Bordetella pertussis
acgcaaucggcga

SEQ ID NO: 2361478 - RNA, 14 nt, Bordetella pertussis
acgcacaagggccc

SEQ ID NO: 2361479 - RNA, 17 nt, Bordetella pertussis
acgcacaagggccccgc

SEQ ID NO: 2361480 - RNA, 15 nt, Bordetella pertussis
acgcacagcaccugg

SEQ ID NO: 2361481 - RNA, 13 nt, Bordetella pertussis
acgcacagcaugc

SEQ ID NO: 2361482 - RNA, 17 nt, Bordetella pertussis
acgcacaugaugcccag

SEQ ID NO: 2361483 - RNA, 23 nt, Bordetella pertussis
acgcacaugaugcccagcgccag

SEQ ID NO: 2361484 - RNA, 18 nt, Bordetella pertussis
acgcaccgccgccggccc

SEQ ID NO: 2361485 - RNA, 17 nt, Bordetella pertussis
acgcaccgcgccagcgc

SEQ ID NO: 2361486 - RNA, 22 nt, Bordetella pertussis
acgcaccgcgccagcgccggcg

SEQ ID NO: 2361487 - RNA, 19 nt, Bordetella pertussis
acgcaccuuucugcugcuc

SEQ ID NO: 2361488 - RNA, 17 nt, Bordetella pertussis
acgcacgguacgccgaa

SEQ ID NO: 2361489 - RNA, 20 nt, Bordetella pertussis
acgcagaaauggaugcgcgc

SEQ ID NO: 2361490 - RNA, 14 nt, Bordetella pertussis
acgcagaccacgcc

SEQ ID NO: 2361491 - RNA, 15 nt, Bordetella pertussis
acgcagaccacgccg

SEQ ID NO: 2361492 - RNA, 18 nt, Bordetella pertussis
acgcagcacggcuugcgc

SEQ ID NO: 2361493 - RNA, 13 nt, Bordetella pertussis
acgcagccgcccg

SEQ ID NO: 2361494 - RNA, 14 nt, Bordetella pertussis
acgcagccgcccgg

SEQ ID NO: 2361495 - RNA, 15 nt, Bordetella pertussis
acgcagccgcccggc

SEQ ID NO: 2361496 - RNA, 17 nt, Bordetella pertussis
acgcagccuucguccug

SEQ ID NO: 2361497 - RNA, 19 nt, Bordetella pertussis
acgcagccuucguccugcc

SEQ ID NO: 2361498 - RNA, 15 nt, Bordetella pertussis
acgcagcgcaggauu

SEQ ID NO: 2361499 - RNA, 23 nt, Bordetella pertussis
acgcagcgcgugugguuggcgcu

SEQ ID NO: 2361500 - RNA, 16 nt, Bordetella pertussis
acgcaggagucggagg

SEQ ID NO: 2361501 - RNA, 23 nt, Bordetella pertussis
cgcgccaggcgguacaggccggc

SEQ ID NO: 2361502 - RNA, 12 nt, Bordetella pertussis
cgcgccaggcgu

SEQ ID NO: 2361503 - RNA, 22 nt, Bordetella pertussis
cgcgccaggcguagaccaccug

SEQ ID NO: 2361504 - RNA, 14 nt, Bordetella pertussis
cgcgccagggcccc

SEQ ID NO: 2361505 - RNA, 17 nt, Bordetella pertussis
cgcgccagggccccucc

SEQ ID NO: 2361506 - RNA, 21 nt, Bordetella pertussis
cgcgccagggccccuccggcg

SEQ ID NO: 2361507 - RNA, 18 nt, Bordetella pertussis
cgcgccagggcgcggauc

SEQ ID NO: 2361508 - RNA, 17 nt, Bordetella pertussis
cgcgccaggggaugacg

SEQ ID NO: 2361509 - RNA, 21 nt, Bordetella pertussis
cgcgccaggggaugacgggcg

SEQ ID NO: 2361510 - RNA, 18 nt, Bordetella pertussis
cgcgccagguaggccggc

SEQ ID NO: 2361511 - RNA, 19 nt, Bordetella pertussis
cgcgccagguaggccggcg

SEQ ID NO: 2361512 - RNA, 21 nt, Bordetella pertussis
cgcgccagguaggccggcgcg

SEQ ID NO: 2361513 - RNA, 13 nt, Bordetella pertussis
cgcgccaggucgc

SEQ ID NO: 2361514 - RNA, 15 nt, Bordetella pertussis
cgcgccaggucgcgc

SEQ ID NO: 2361515 - RNA, 17 nt, Bordetella pertussis
cgcgccaggucgcgcac

SEQ ID NO: 2361516 - RNA, 19 nt, Bordetella pertussis
cgcgccaggucgcgcacca

SEQ ID NO: 2361517 - RNA, 20 nt, Bordetella pertussis
cgcgccaggucgcgcaccag

SEQ ID NO: 2361518 - RNA, 21 nt, Bordetella pertussis
cgcgccaggucgcgcaccagg

SEQ ID NO: 2361519 - RNA, 18 nt, Bordetella pertussis
cgcgccaggugcacggug

SEQ ID NO: 2361520 - RNA, 18 nt, Bordetella pertussis
cgcgccaguucaaggcgc

SEQ ID NO: 2361521 - RNA, 20 nt, Bordetella pertussis
cgcgccaguugcgcaccgcu

SEQ ID NO: 2361522 - RNA, 18 nt, Bordetella pertussis
cgcgccaucacggugucg

SEQ ID NO: 2361523 - RNA, 16 nt, Bordetella pertussis
cgcgccauccggcgca

SEQ ID NO: 2361524 - RNA, 18 nt, Bordetella pertussis
cgcgccauccggcgcaug

SEQ ID NO: 2361525 - RNA, 21 nt, Bordetella pertussis
cgcgccauccugaacgccgcg

SEQ ID NO: 2361526 - RNA, 22 nt, Bordetella pertussis
cgcgccauccugaacgccgcgc

SEQ ID NO: 2361527 - RNA, 14 nt, Bordetella pertussis
cgcgccaucgacgg

SEQ ID NO: 2361528 - RNA, 19 nt, Bordetella pertussis
cgcgccaucgacgggcggc

SEQ ID NO: 2361529 - RNA, 15 nt, Bordetella pertussis
cgcgccaugaaagcg

SEQ ID NO: 2361530 - RNA, 22 nt, Bordetella pertussis
cgcgccaugaaagcgaacaggg

SEQ ID NO: 2361531 - RNA, 19 nt, Bordetella pertussis
cgcgccaugaacucgcgcu

SEQ ID NO: 2361532 - RNA, 21 nt, Bordetella pertussis
cgcgccaugaacucgcgcucg

SEQ ID NO: 2361533 - RNA, 18 nt, Bordetella pertussis
cgcgccaugagccacaau

SEQ ID NO: 2361534 - RNA, 20 nt, Bordetella pertussis
cgcgccaugcaacacgacca

SEQ ID NO: 2361535 - RNA, 21 nt, Bordetella pertussis
cgcgccaugcaacacgaccag

SEQ ID NO: 2361536 - RNA, 23 nt, Bordetella pertussis
cgcgccaugcaacacgaccagca

SEQ ID NO: 2361537 - RNA, 15 nt, Bordetella pertussis
cgcgccaugcucgcg

SEQ ID NO: 2361538 - RNA, 20 nt, Bordetella pertussis
cgcgccaugcucgcgcacag

SEQ ID NO: 2361539 - RNA, 21 nt, Bordetella pertussis
cgcgccaugcucgcgcacagc

SEQ ID NO: 2361540 - RNA, 17 nt, Bordetella pertussis
cgcgccauggccggccg

SEQ ID NO: 2361541 - RNA, 21 nt, Bordetella pertussis
cgcgccauggccggccgccgg

SEQ ID NO: 2361542 - RNA, 15 nt, Bordetella pertussis
cgcgccaugucgacg

SEQ ID NO: 2361543 - RNA, 19 nt, Bordetella pertussis
cgcgccauugccacggcgg

SEQ ID NO: 2361544 - RNA, 20 nt, Bordetella pertussis
cgcgccauugccacggcggg

SEQ ID NO: 2361545 - RNA, 22 nt, Bordetella pertussis
cgcgccauugccacggcgggcc

SEQ ID NO: 2361546 - RNA, 22 nt, Bordetella pertussis
cgcgcccaauccgaucagcacg

SEQ ID NO: 2361547 - RNA, 20 nt, Bordetella pertussis
cgcgcccaccgagacgcugu

SEQ ID NO: 2361548 - RNA, 18 nt, Bordetella pertussis
cgcgcccagaucgaucca

SEQ ID NO: 2361549 - RNA, 19 nt, Bordetella pertussis
cgcgcccagaucgauccag

SEQ ID NO: 2361550 - RNA, 13 nt, Bordetella pertussis
cgcgcccagcagc

SEQ ID NO: 2361551 - RNA, 14 nt, Bordetella pertussis
cgcgcccagcagcg

SEQ ID NO: 2361552 - RNA, 16 nt, Bordetella pertussis
cgcgcccagcagcgcc

SEQ ID NO: 2361553 - RNA, 17 nt, Bordetella pertussis
cgcgcccagcagcgcca

SEQ ID NO: 2361554 - RNA, 15 nt, Bordetella pertussis
cgcgcccagccccgc

SEQ ID NO: 2361555 - RNA, 12 nt, Bordetella pertussis
cgcgcccagccg

SEQ ID NO: 2361556 - RNA, 13 nt, Bordetella pertussis
cgcgcccagcgcg

SEQ ID NO: 2361557 - RNA, 14 nt, Bordetella pertussis
cgcgcccagcgcgc

SEQ ID NO: 2361558 - RNA, 16 nt, Bordetella pertussis
cgcgcccagcgcggcc

SEQ ID NO: 2361559 - RNA, 16 nt, Bordetella pertussis
cgcgcccagcggcagg

SEQ ID NO: 2361560 - RNA, 12 nt, Bordetella pertussis
cgcgcccagcug

SEQ ID NO: 2361561 - RNA, 16 nt, Bordetella pertussis
cgcgcccagcugucca

SEQ ID NO: 2361562 - RNA, 21 nt, Bordetella pertussis
cgcgcccagcuugaugccgcc

SEQ ID NO: 2361563 - RNA, 22 nt, Bordetella pertussis
cgcgcccagcuugaugccgccg

SEQ ID NO: 2361564 - RNA, 20 nt, Bordetella pertussis
cgcgcccaggccagccaggu

SEQ ID NO: 2361565 - RNA, 19 nt, Bordetella pertussis
cgcgcccaggggccggcgc

SEQ ID NO: 2361566 - RNA, 21 nt, Bordetella pertussis
cgcgcccaggggccggcgcgc

SEQ ID NO: 2361567 - RNA, 22 nt, Bordetella pertussis
cgcgcccaggggccggcgcgcc

SEQ ID NO: 2361568 - RNA, 22 nt, Bordetella pertussis
cgcgcccagguccugcgccagc

SEQ ID NO: 2361569 - RNA, 16 nt, Bordetella pertussis
cgcgcccauuucgaug

SEQ ID NO: 2361570 - RNA, 22 nt, Bordetella pertussis
cgcgccccaucaccauggccga

SEQ ID NO: 2361571 - RNA, 13 nt, Bordetella pertussis
cgcgcccccacgc

SEQ ID NO: 2361572 - RNA, 15 nt, Bordetella pertussis
cgcgcccccacgccg

SEQ ID NO: 2361573 - RNA, 17 nt, Bordetella pertussis
cgcgcccccacgccgcu

SEQ ID NO: 2361574 - RNA, 18 nt, Bordetella pertussis
cgcgcccccacgccgcug

SEQ ID NO: 2361575 - RNA, 16 nt, Bordetella pertussis
cgcgcccccagcgccg

SEQ ID NO: 2361576 - RNA, 19 nt, Bordetella pertussis
cgcgccccgcuucgggccg

SEQ ID NO: 2361577 - RNA, 20 nt, Bordetella pertussis
cgcgccccgcuucgggccgg

SEQ ID NO: 2361578 - RNA, 16 nt, Bordetella pertussis
cgcgccccuagcgccg

SEQ ID NO: 2361579 - RNA, 17 nt, Bordetella pertussis
cgcgccccuagcgccgc

SEQ ID NO: 2361580 - RNA, 20 nt, Bordetella pertussis
cgcgccccuagcgccgcgcc

SEQ ID NO: 2361581 - RNA, 21 nt, Bordetella pertussis
cgcgccccuagcgccgcgcca

SEQ ID NO: 2361582 - RNA, 15 nt, Bordetella pertussis
cgcgcccgagcgcca

SEQ ID NO: 2361583 - RNA, 14 nt, Bordetella pertussis
cgcgcccgaggcgc

SEQ ID NO: 2361584 - RNA, 16 nt, Bordetella pertussis
cgcgcccgaggcgcgc

SEQ ID NO: 2361585 - RNA, 22 nt, Bordetella pertussis
cgcgcccgaggcgcgcagcacg

SEQ ID NO: 2361586 - RNA, 14 nt, Bordetella pertussis
cgcgcccgcaggcg

SEQ ID NO: 2361587 - RNA, 17 nt, Bordetella pertussis
cgcgcccgcaggcggcg

SEQ ID NO: 2361588 - RNA, 14 nt, Bordetella pertussis
cgcgcccgccgcgc

SEQ ID NO: 2361589 - RNA, 15 nt, Bordetella pertussis
cgcgcccgccgcguc

SEQ ID NO: 2361590 - RNA, 22 nt, Bordetella pertussis
cgcgcccgccgcgucggcgccg

SEQ ID NO: 2361591 - RNA, 23 nt, Bordetella pertussis
cgcgcccgccgcgucggcgccga

SEQ ID NO: 2361592 - RNA, 21 nt, Bordetella pertussis
cgcgcccgccuucagcgggcc

SEQ ID NO: 2361593 - RNA, 19 nt, Bordetella pertussis
cgcgcccgccuucggcggc

SEQ ID NO: 2361594 - RNA, 19 nt, Bordetella pertussis
cgcgcccgcguacagcccg

SEQ ID NO: 2361595 - RNA, 21 nt, Bordetella pertussis
cgcgcccgcuugcggccggcg

SEQ ID NO: 2361596 - RNA, 20 nt, Bordetella pertussis
cgcgcccgcuugggccgcgc

SEQ ID NO: 2361597 - RNA, 21 nt, Bordetella pertussis
cgcgcccgcuugggccgcgcc

SEQ ID NO: 2361598 - RNA, 13 nt, Bordetella pertussis
cgcgcccggccgg

SEQ ID NO: 2361599 - RNA, 15 nt, Bordetella pertussis
cgcgcccggccggcc

SEQ ID NO: 2361600 - RNA, 13 nt, Bordetella pertussis
cgcgcccggcgaa

SEQ ID NO: 2361601 - RNA, 21 nt, Bordetella pertussis
cgcgcccggcggccaggccgg

SEQ ID NO: 2361602 - RNA, 15 nt, Bordetella pertussis
cgcgcccgggcugau

SEQ ID NO: 2361603 - RNA, 21 nt, Bordetella pertussis
cgcgcccguccacggccugcg

SEQ ID NO: 2361604 - RNA, 24 nt, Bordetella pertussis
cgcgcccucguugacgccgacgau

SEQ ID NO: 2361605 - RNA, 16 nt, Bordetella pertussis
cgcgcccugcacgcgc

SEQ ID NO: 2361606 - RNA, 14 nt, Bordetella pertussis
cgcgcccugcuuga

SEQ ID NO: 2361607 - RNA, 18 nt, Bordetella pertussis
cgcgcccuggcgcggcgg

SEQ ID NO: 2361608 - RNA, 19 nt, Bordetella pertussis
cgcgcccuggcgcggcggc

SEQ ID NO: 2361609 - RNA, 21 nt, Bordetella pertussis
cgcgcccuggcgcggcggcgu

SEQ ID NO: 2361610 - RNA, 13 nt, Bordetella pertussis
cgcgcccuggggc

SEQ ID NO: 2361611 - RNA, 12 nt, Bordetella pertussis
cgcgccgaaaug

SEQ ID NO: 2361612 - RNA, 15 nt, Bordetella pertussis
cgcgccgaacaccag

SEQ ID NO: 2361613 - RNA, 12 nt, Bordetella pertussis
cgcgccggcggc

SEQ ID NO: 2361614 - RNA, 14 nt, Bordetella pertussis
cgcgccggcggcaa

SEQ ID NO: 2361615 - RNA, 13 nt, Bordetella pertussis
cgcgccggcggcc

SEQ ID NO: 2361616 - RNA, 16 nt, Bordetella pertussis
cgcgccggcggccugc

SEQ ID NO: 2361617 - RNA, 17 nt, Bordetella pertussis
cgcgccggcggccugca

SEQ ID NO: 2361618 - RNA, 22 nt, Bordetella pertussis
cgcgccggcggccugcaggccg

SEQ ID NO: 2361619 - RNA, 18 nt, Bordetella pertussis
cgcgccggcuaccgcgcc

SEQ ID NO: 2361620 - RNA, 18 nt, Bordetella pertussis
cgcgccggcucccgcgcu

SEQ ID NO: 2361621 - RNA, 20 nt, Bordetella pertussis
cgcgccggcucccgcgcugc

SEQ ID NO: 2361622 - RNA, 15 nt, Bordetella pertussis
cgcgccggcucgaac

SEQ ID NO: 2361623 - RNA, 23 nt, Bordetella pertussis
cgcgccggcugaauuggcgccca

SEQ ID NO: 2361624 - RNA, 18 nt, Bordetella pertussis
cgcgccgggccacgagca

SEQ ID NO: 2361625 - RNA, 19 nt, Bordetella pertussis
cgcgccgggccacgagcag

SEQ ID NO: 2361626 - RNA, 21 nt, Bordetella pertussis
cgcgccgggcccggccacggc

SEQ ID NO: 2361627 - RNA, 13 nt, Bordetella pertussis
cgcgccgggccgg

SEQ ID NO: 2361628 - RNA, 15 nt, Bordetella pertussis
cgcgccgggccggcg

SEQ ID NO: 2361629 - RNA, 14 nt, Bordetella pertussis
cgcgccgggccuag

SEQ ID NO: 2361630 - RNA, 20 nt, Bordetella pertussis
cgcgccgggccuagcccggc

SEQ ID NO: 2361631 - RNA, 14 nt, Bordetella pertussis
cgcgccgggcgaac

SEQ ID NO: 2361632 - RNA, 19 nt, Bordetella pertussis
cgcgccgggcgaaccggug

SEQ ID NO: 2361633 - RNA, 13 nt, Bordetella pertussis
cgcgccgggcgcg

SEQ ID NO: 2361634 - RNA, 15 nt, Bordetella pertussis
cgcgccgggcgcgcc

SEQ ID NO: 2361635 - RNA, 21 nt, Bordetella pertussis
cgcgccgggcgcgccggcggg

SEQ ID NO: 2361636 - RNA, 19 nt, Bordetella pertussis
cgcgccggggcggcgcagc

SEQ ID NO: 2361637 - RNA, 23 nt, Bordetella pertussis
cgcgccggguuuuuacaugccgc

SEQ ID NO: 2361638 - RNA, 16 nt, Bordetella pertussis
cgcgccggucacgcug

SEQ ID NO: 2361639 - RNA, 20 nt, Bordetella pertussis
cgcgccggucacgcuggugg

SEQ ID NO: 2361640 - RNA, 19 nt, Bordetella pertussis
cgcgccggucaggcgucgu

SEQ ID NO: 2361641 - RNA, 17 nt, Bordetella pertussis
cgcgccgguggccagca

SEQ ID NO: 2361642 - RNA, 18 nt, Bordetella pertussis
cgcgccgguggccagcag

SEQ ID NO: 2361643 - RNA, 20 nt, Bordetella pertussis
cgcgccgguggccagcagcu

SEQ ID NO: 2361644 - RNA, 20 nt, Bordetella pertussis
cgcgccguacagccgcggca

SEQ ID NO: 2361645 - RNA, 22 nt, Bordetella pertussis
cgcgccguacagccgcggcaga

SEQ ID NO: 2361646 - RNA, 16 nt, Bordetella pertussis
cgcgccguacagggcc

SEQ ID NO: 2361647 - RNA, 16 nt, Bordetella pertussis
cgcgccguaccccagc

SEQ ID NO: 2361648 - RNA, 17 nt, Bordetella pertussis
cgcgccguaccccagca

SEQ ID NO: 2361649 - RNA, 18 nt, Bordetella pertussis
cgcgccguaccugcagca

SEQ ID NO: 2361650 - RNA, 22 nt, Bordetella pertussis
cgcgccguccgagcccgacgcg

SEQ ID NO: 2361651 - RNA, 15 nt, Bordetella pertussis
cgcgccguccgggcc

SEQ ID NO: 2361652 - RNA, 16 nt, Bordetella pertussis
cgcgccguccgggccg

SEQ ID NO: 2361653 - RNA, 17 nt, Bordetella pertussis
cgcgccgucgaacuccu

SEQ ID NO: 2361654 - RNA, 20 nt, Bordetella pertussis
cgcgccgucgaacuccugca

SEQ ID NO: 2361655 - RNA, 16 nt, Bordetella pertussis
cgcgccgucggcgucg

SEQ ID NO: 2361656 - RNA, 19 nt, Bordetella pertussis
cgcgccgucgggggccggc

SEQ ID NO: 2361657 - RNA, 19 nt, Bordetella pertussis
cgcgccgugcagacggcgg

SEQ ID NO: 2361658 - RNA, 22 nt, Bordetella pertussis
cgcgccguggugcugaccggcu

SEQ ID NO: 2361659 - RNA, 17 nt, Bordetella pertussis
cgcgccguucagggacg

SEQ ID NO: 2361660 - RNA, 19 nt, Bordetella pertussis
cgcgccguucagggacggg

SEQ ID NO: 2361661 - RNA, 22 nt, Bordetella pertussis
cgcgccguucagggacgggcca

SEQ ID NO: 2361662 - RNA, 19 nt, Bordetella pertussis
cgcgccguucucaggccga

SEQ ID NO: 2361663 - RNA, 21 nt, Bordetella pertussis
cgcgccuacagcagcggcucg

SEQ ID NO: 2361664 - RNA, 17 nt, Bordetella pertussis
cgcgccuaccggcgccg

SEQ ID NO: 2361665 - RNA, 20 nt, Bordetella pertussis
cgcgccuaccggcgccgacg

SEQ ID NO: 2361666 - RNA, 17 nt, Bordetella pertussis
cgcgccuauaucgacgg

SEQ ID NO: 2361667 - RNA, 18 nt, Bordetella pertussis
cgcgccuauaucgacggc

SEQ ID NO: 2361668 - RNA, 21 nt, Bordetella pertussis
cgcgccuauaucgacggcgcc

SEQ ID NO: 2361669 - RNA, 22 nt, Bordetella pertussis
cgcgccuauaucgacggcgccu

SEQ ID NO: 2361670 - RNA, 22 nt, Bordetella pertussis
cgcgccuaucaggccucgaaga

SEQ ID NO: 2361671 - RNA, 15 nt, Bordetella pertussis
cgcgccuccagcucc

SEQ ID NO: 2361672 - RNA, 22 nt, Bordetella pertussis
cgcgccuccagcuccagcgcgc

SEQ ID NO: 2361673 - RNA, 15 nt, Bordetella pertussis
cgcgccucggacgcc

SEQ ID NO: 2361674 - RNA, 20 nt, Bordetella pertussis
cgcgccucggacgccuggcg

SEQ ID NO: 2361675 - RNA, 14 nt, Bordetella pertussis
cgcgccucggcgcg

SEQ ID NO: 2361676 - RNA, 17 nt, Bordetella pertussis
cgcgccucggcgcgcgc

SEQ ID NO: 2361677 - RNA, 20 nt, Bordetella pertussis
cgcgccucggcgcgcgcggc

SEQ ID NO: 2361678 - RNA, 19 nt, Bordetella pertussis
cgcgccucgugcgaggcca

SEQ ID NO: 2361679 - RNA, 19 nt, Bordetella pertussis
cgcgccugagcugccaggc

SEQ ID NO: 2361680 - RNA, 13 nt, Bordetella pertussis
cgcgccugcagca

SEQ ID NO: 2361681 - RNA, 23 nt, Bordetella pertussis
cgcgccugcagcacggccacggc

SEQ ID NO: 2361682 - RNA, 15 nt, Bordetella pertussis
cgcgccugcagcagc

SEQ ID NO: 2361683 - RNA, 16 nt, Bordetella pertussis
cgcgccugcagcagcg

SEQ ID NO: 2361684 - RNA, 18 nt, Bordetella pertussis
cgcgccugcagcagcggc

SEQ ID NO: 2361685 - RNA, 14 nt, Bordetella pertussis
cgcgccugcaugcc

SEQ ID NO: 2361686 - RNA, 19 nt, Bordetella pertussis
cgcgccugcauguccagcg

SEQ ID NO: 2361687 - RNA, 15 nt, Bordetella pertussis
cgcgccugcccaggc

SEQ ID NO: 2361688 - RNA, 17 nt, Bordetella pertussis
cgcgccugcccaggcca

SEQ ID NO: 2361689 - RNA, 14 nt, Bordetella pertussis
cgcgccugccccgc

SEQ ID NO: 2361690 - RNA, 15 nt, Bordetella pertussis
cgcgccugccccgcc

SEQ ID NO: 2361691 - RNA, 17 nt, Bordetella pertussis
cgcgccugccccgccug

SEQ ID NO: 2361692 - RNA, 16 nt, Bordetella pertussis
cgcgccugcccgcaac

SEQ ID NO: 2361693 - RNA, 11 nt, Bordetella pertussis
cgcgccugcgc

SEQ ID NO: 2361694 - RNA, 14 nt, Bordetella pertussis
cgcgccugcgcgcc

SEQ ID NO: 2361695 - RNA, 15 nt, Bordetella pertussis
cgcgccugcgcgcgg

SEQ ID NO: 2361696 - RNA, 15 nt, Bordetella pertussis
cgcgccugcucguac

SEQ ID NO: 2361697 - RNA, 17 nt, Bordetella pertussis
cgcgccuuacgcggcgc

SEQ ID NO: 2361698 - RNA, 21 nt, Bordetella pertussis
cgcgccuuacgcggcgcgcgc

SEQ ID NO: 2361699 - RNA, 21 nt, Bordetella pertussis
cgcgccuuccugggcgccggc

SEQ ID NO: 2361700 - RNA, 18 nt, Bordetella pertussis
cgcgccuucgaggccggc

SEQ ID NO: 2361701 - RNA, 20 nt, Bordetella pertussis
cgcgccuucgaggccggcgu

SEQ ID NO: 2361702 - RNA, 17 nt, Bordetella pertussis
cgcgccuucggcaggcg

SEQ ID NO: 2361703 - RNA, 15 nt, Bordetella pertussis
cgcgccuucggcgcg

SEQ ID NO: 2361704 - RNA, 18 nt, Bordetella pertussis
cgcgccuucggcgcgcac

SEQ ID NO: 2361705 - RNA, 19 nt, Bordetella pertussis
cgcgccuucggcgcgcacg

SEQ ID NO: 2361706 - RNA, 20 nt, Bordetella pertussis
cgcgccuucggcgcgcacgc

SEQ ID NO: 2361707 - RNA, 16 nt, Bordetella pertussis
cgcgccuucuacccgc

SEQ ID NO: 2361708 - RNA, 23 nt, Bordetella pertussis
cgcgccuugaaccccggcugcgc

SEQ ID NO: 2361709 - RNA, 13 nt, Bordetella pertussis
cgcgcgacagccg

SEQ ID NO: 2361710 - RNA, 19 nt, Bordetella pertussis
cgcgcgacagccgcgccag

SEQ ID NO: 2361711 - RNA, 13 nt, Bordetella pertussis
cgcgcgaccaggc

SEQ ID NO: 2361712 - RNA, 14 nt, Bordetella pertussis
cgcgcgaccaggcu

SEQ ID NO: 2361713 - RNA, 16 nt, Bordetella pertussis
cgcgcgaccucgggac

SEQ ID NO: 2361714 - RNA, 16 nt, Bordetella pertussis
cgcgcgacgacagcgg

SEQ ID NO: 2361715 - RNA, 13 nt, Bordetella pertussis
cgcgcgacggcgc

SEQ ID NO: 2361716 - RNA, 18 nt, Bordetella pertussis
cgcgcgacgugucggcca

SEQ ID NO: 2361717 - RNA, 19 nt, Bordetella pertussis
cgcgcgacgugucggccac

SEQ ID NO: 2361718 - RNA, 22 nt, Bordetella pertussis
cgcgcgacgugucggccaccac

SEQ ID NO: 2361719 - RNA, 19 nt, Bordetella pertussis
cgcgcgacuccaccggcgu

SEQ ID NO: 2361720 - RNA, 14 nt, Bordetella pertussis
cgcgcgacuggccc

SEQ ID NO: 2361721 - RNA, 18 nt, Bordetella pertussis
cgcgcgacuuccucgacc

SEQ ID NO: 2361722 - RNA, 20 nt, Bordetella pertussis
cgcgcgacuuccucgacccg

SEQ ID NO: 2361723 - RNA, 15 nt, Bordetella pertussis
cgcgcgacuucgccg

SEQ ID NO: 2361724 - RNA, 20 nt, Bordetella pertussis
cgcgcgacuucgccgaucga

SEQ ID NO: 2361725 - RNA, 17 nt, Bordetella pertussis
cgcgcgagaccagcgga

SEQ ID NO: 2361726 - RNA, 15 nt, Bordetella pertussis
cgcgcgcuggcgccc

SEQ ID NO: 2361727 - RNA, 23 nt, Bordetella pertussis
cgcgcgcuggcugugcccgcccc

SEQ ID NO: 2361728 - RNA, 15 nt, Bordetella pertussis
cgcgcgcuggggcug

SEQ ID NO: 2361729 - RNA, 20 nt, Bordetella pertussis
cgcgcgcuucaggcgccgca

SEQ ID NO: 2361730 - RNA, 22 nt, Bordetella pertussis
cgcgcgcuuccucgaccagguc

SEQ ID NO: 2361731 - RNA, 16 nt, Bordetella pertussis
cgcgcggacugccaga

SEQ ID NO: 2361732 - RNA, 17 nt, Bordetella pertussis
cgcgcggacugccagau

SEQ ID NO: 2361733 - RNA, 18 nt, Bordetella pertussis
cgcgcggauauucgucgg

SEQ ID NO: 2361734 - RNA, 21 nt, Bordetella pertussis
cgcgcggauauucgucggccg

SEQ ID NO: 2361735 - RNA, 13 nt, Bordetella pertussis
cgcgcggauccag

SEQ ID NO: 2361736 - RNA, 20 nt, Bordetella pertussis
cgcgcggaucgaaaccggcg

SEQ ID NO: 2361737 - RNA, 21 nt, Bordetella pertussis
cgcgcggaucgaaaccggcgc

SEQ ID NO: 2361738 - RNA, 17 nt, Bordetella pertussis
cgcgcggcagggcgucg

SEQ ID NO: 2361739 - RNA, 21 nt, Bordetella pertussis
cgcgcggcagggcgucggccg

SEQ ID NO: 2361740 - RNA, 12 nt, Bordetella pertussis
cgcgcggcaugg

SEQ ID NO: 2361741 - RNA, 14 nt, Bordetella pertussis
cgcgcggccagcgc

SEQ ID NO: 2361742 - RNA, 12 nt, Bordetella pertussis
cgcgcggccagu

SEQ ID NO: 2361743 - RNA, 15 nt, Bordetella pertussis
cgcgcggccaguucg

SEQ ID NO: 2361744 - RNA, 20 nt, Bordetella pertussis
cgcgcggccaguucgacgcc

SEQ ID NO: 2361745 - RNA, 19 nt, Bordetella pertussis
cgcgcggccauguccagca

SEQ ID NO: 2361746 - RNA, 14 nt, Bordetella pertussis
cgcgcggccccggc

SEQ ID NO: 2361747 - RNA, 13 nt, Bordetella pertussis
cgcgcggccggca

SEQ ID NO: 2361748 - RNA, 14 nt, Bordetella pertussis
cgcgcggccggcac

SEQ ID NO: 2361749 - RNA, 14 nt, Bordetella pertussis
cgcgcggccggccg

SEQ ID NO: 2361750 - RNA, 23 nt, Bordetella pertussis
cgcgcggccggccgcgcccaugc

SEQ ID NO: 2361751 - RNA, 13 nt, Bordetella pertussis
cgcgcggccggcg

SEQ ID NO: 2361752 - RNA, 14 nt, Bordetella pertussis
cgcgcggccggcgc

SEQ ID NO: 2361753 - RNA, 15 nt, Bordetella pertussis
cgcgcggccggcgcg

SEQ ID NO: 2361754 - RNA, 14 nt, Bordetella pertussis
cgcgcggccgggcu

SEQ ID NO: 2361755 - RNA, 13 nt, Bordetella pertussis
cgcgcggccgugu

SEQ ID NO: 2361756 - RNA, 15 nt, Bordetella pertussis
cgcgcggccucgacg

SEQ ID NO: 2361757 - RNA, 18 nt, Bordetella pertussis
cgcgcggccucgacgaug

SEQ ID NO: 2361758 - RNA, 16 nt, Bordetella pertussis
cgcgcggccuggcggu

SEQ ID NO: 2361759 - RNA, 16 nt, Bordetella pertussis
cgcgcggccugggcgg

SEQ ID NO: 2361760 - RNA, 14 nt, Bordetella pertussis
cgcgcggcgcagcg

SEQ ID NO: 2361761 - RNA, 14 nt, Bordetella pertussis
cgcgcggcgccugg

SEQ ID NO: 2361762 - RNA, 14 nt, Bordetella pertussis
cgcgcggcgcggcu

SEQ ID NO: 2361763 - RNA, 22 nt, Bordetella pertussis
cgcgcggcgcugcacgcggccg

SEQ ID NO: 2361764 - RNA, 14 nt, Bordetella pertussis
cgcgcggcggaucg

SEQ ID NO: 2361765 - RNA, 16 nt, Bordetella pertussis
cgcgcggcggccuugu

SEQ ID NO: 2361766 - RNA, 12 nt, Bordetella pertussis
cgcgcggcggcg

SEQ ID NO: 2361767 - RNA, 14 nt, Bordetella pertussis
cgcgcggcggcgga

SEQ ID NO: 2361768 - RNA, 16 nt, Bordetella pertussis
cgcgcggcucgccgcg

SEQ ID NO: 2361769 - RNA, 17 nt, Bordetella pertussis
cgcgcggcucgccgcgc

SEQ ID NO: 2361770 - RNA, 18 nt, Bordetella pertussis
cgcgcggcucgccgcgca

SEQ ID NO: 2361771 - RNA, 13 nt, Bordetella pertussis
cgcgcggcuggcu

SEQ ID NO: 2361772 - RNA, 18 nt, Bordetella pertussis
cgcgcggcuggcuguucg

SEQ ID NO: 2361773 - RNA, 17 nt, Bordetella pertussis
cgcgcggcugggucggc

SEQ ID NO: 2361774 - RNA, 14 nt, Bordetella pertussis
cgcgcgggccagca

SEQ ID NO: 2361775 - RNA, 15 nt, Bordetella pertussis
cgcgcgggccagcag

SEQ ID NO: 2361776 - RNA, 14 nt, Bordetella pertussis
cgcgcgggcgcgca

SEQ ID NO: 2361777 - RNA, 15 nt, Bordetella pertussis
cgcgcgggcgcgcag

SEQ ID NO: 2361778 - RNA, 16 nt, Bordetella pertussis
cgcgcgggcgcgcagc

SEQ ID NO: 2361779 - RNA, 12 nt, Bordetella pertussis
cgcgcgggcggc

SEQ ID NO: 2361780 - RNA, 14 nt, Bordetella pertussis
cgcgcgggcggccc

SEQ ID NO: 2361781 - RNA, 15 nt, Bordetella pertussis
cgcgcgggcggcccg

SEQ ID NO: 2361782 - RNA, 14 nt, Bordetella pertussis
cgcgcggggcaggc

SEQ ID NO: 2361783 - RNA, 14 nt, Bordetella pertussis
cgcgcgggggugcg

SEQ ID NO: 2361784 - RNA, 21 nt, Bordetella pertussis
cgcgcgggggugcgcgacagc

SEQ ID NO: 2361785 - RNA, 16 nt, Bordetella pertussis
cgcgcggguccaggcc

SEQ ID NO: 2361786 - RNA, 17 nt, Bordetella pertussis
cgcgcggguccaggccc

SEQ ID NO: 2361787 - RNA, 19 nt, Bordetella pertussis
cgcgcggguccaggcccga

SEQ ID NO: 2361788 - RNA, 20 nt, Bordetella pertussis
cgcgcggguccuugccgggc

SEQ ID NO: 2361789 - RNA, 20 nt, Bordetella pertussis
cgcgcggguuggcucaugca

SEQ ID NO: 2361790 - RNA, 17 nt, Bordetella pertussis
cgcgcgguacgcaccgc

SEQ ID NO: 2361791 - RNA, 18 nt, Bordetella pertussis
cgcgcgguacgcaccgcc

SEQ ID NO: 2361792 - RNA, 19 nt, Bordetella pertussis
cgcgcgguacgcaccgccg

SEQ ID NO: 2361793 - RNA, 23 nt, Bordetella pertussis
cgcgcgguacgcaccgccgccgg

SEQ ID NO: 2361794 - RNA, 17 nt, Bordetella pertussis
cgcgcgguauccagguc

SEQ ID NO: 2361795 - RNA, 20 nt, Bordetella pertussis
cgcgcgguauugcgccaccc

SEQ ID NO: 2361796 - RNA, 21 nt, Bordetella pertussis
cgcgcgguauugcgccacccc

SEQ ID NO: 2361797 - RNA, 13 nt, Bordetella pertussis
cgcgcggugacgu

SEQ ID NO: 2361798 - RNA, 16 nt, Bordetella pertussis
cgcgcggugccgccug

SEQ ID NO: 2361799 - RNA, 19 nt, Bordetella pertussis
cgcgcgguggccgccgcgc

SEQ ID NO: 2361800 - RNA, 22 nt, Bordetella pertussis
cgcgcgguggccgccgcgcgcc

SEQ ID NO: 2361801 - RNA, 18 nt, Bordetella pertussis
cgcgcggugucgccgccg

SEQ ID NO: 2361802 - RNA, 20 nt, Bordetella pertussis
cgcgcgguugagcgccaggg

SEQ ID NO: 2361803 - RNA, 16 nt, Bordetella pertussis
cgcgcguacagccggg

SEQ ID NO: 2361804 - RNA, 16 nt, Bordetella pertussis
cgcgcguagcgauccg

SEQ ID NO: 2361805 - RNA, 17 nt, Bordetella pertussis
cgcgcguagcgauccga

SEQ ID NO: 2361806 - RNA, 12 nt, Bordetella pertussis
cgcgcguaucgg

SEQ ID NO: 2361807 - RNA, 15 nt, Bordetella pertussis
cgcgcguaucggcgc

SEQ ID NO: 2361808 - RNA, 15 nt, Bordetella pertussis
cgcgcgucgugcccg

SEQ ID NO: 2361809 - RNA, 18 nt, Bordetella pertussis
cgcgcgucgugcccgcca

SEQ ID NO: 2361810 - RNA, 19 nt, Bordetella pertussis
cgcgcgugagcgaauccag

SEQ ID NO: 2361811 - RNA, 13 nt, Bordetella pertussis
cgcgcgugcagcg

SEQ ID NO: 2361812 - RNA, 14 nt, Bordetella pertussis
cgcgcgugcagcgc

SEQ ID NO: 2361813 - RNA, 15 nt, Bordetella pertussis
cgcgcgugcagcgcc

SEQ ID NO: 2361814 - RNA, 16 nt, Bordetella pertussis
cgcgcgugcagcgccg

SEQ ID NO: 2361815 - RNA, 19 nt, Bordetella pertussis
cgcgcgugcagcgccgcgc

SEQ ID NO: 2361816 - RNA, 16 nt, Bordetella pertussis
cgcgcgugcaggccgc

SEQ ID NO: 2361817 - RNA, 14 nt, Bordetella pertussis
cgcgcgugcaggua

SEQ ID NO: 2361818 - RNA, 15 nt, Bordetella pertussis
cgcgcgugcagguag

SEQ ID NO: 2361819 - RNA, 17 nt, Bordetella pertussis
cgcgcgugccgcaggcc

SEQ ID NO: 2361820 - RNA, 14 nt, Bordetella pertussis
cgcgcgugccgcgc

SEQ ID NO: 2361821 - RNA, 15 nt, Bordetella pertussis
cgcgcgugcucgcgc

SEQ ID NO: 2361822 - RNA, 12 nt, Bordetella pertussis
cgcgcgugcugg

SEQ ID NO: 2361823 - RNA, 20 nt, Bordetella pertussis
cgcgcguugaccgccucgau

SEQ ID NO: 2361824 - RNA, 20 nt, Bordetella pertussis
cgcgcguugaucaucggccc

SEQ ID NO: 2361825 - RNA, 12 nt, Bordetella pertussis
cgcgcguugccu

SEQ ID NO: 2361826 - RNA, 23 nt, Bordetella pertussis
cgcgcuaagcacaagcgcguggc

SEQ ID NO: 2361827 - RNA, 24 nt, Bordetella pertussis
cgcgcuaagcacaagcgcguggcc

SEQ ID NO: 2361828 - RNA, 14 nt, Bordetella pertussis
cgcgcucaccgagg

SEQ ID NO: 2361829 - RNA, 19 nt, Bordetella pertussis
cgcgcucaccgagggccgg

SEQ ID NO: 2361830 - RNA, 17 nt, Bordetella pertussis
cgcgcucagcaccaggc

SEQ ID NO: 2361831 - RNA, 14 nt, Bordetella pertussis
cgcgcucagcgcca

SEQ ID NO: 2361832 - RNA, 17 nt, Bordetella pertussis
cgcgcucagcgccauca

SEQ ID NO: 2361833 - RNA, 13 nt, Bordetella pertussis
cgcgcucaggccg

SEQ ID NO: 2361834 - RNA, 15 nt, Bordetella pertussis
cgcgcucaggccgcu

SEQ ID NO: 2361835 - RNA, 20 nt, Bordetella pertussis
cgcgcucaggcggugacgcc

SEQ ID NO: 2361836 - RNA, 18 nt, Bordetella pertussis
cgcgcucagggggcgccc

SEQ ID NO: 2361837 - RNA, 15 nt, Bordetella pertussis
cgcgcucauggcgca

SEQ ID NO: 2361838 - RNA, 13 nt, Bordetella pertussis
cgcgcuccagcau

SEQ ID NO: 2361839 - RNA, 17 nt, Bordetella pertussis
cgcgcuccagcauguac

SEQ ID NO: 2361840 - RNA, 12 nt, Bordetella pertussis
acgccgccaugg

SEQ ID NO: 2361841 - RNA, 16 nt, Bordetella pertussis
acgccgcccagcgcgu

SEQ ID NO: 2361842 - RNA, 21 nt, Bordetella pertussis
acgccgcccagcgcgugggcc

SEQ ID NO: 2361843 - RNA, 22 nt, Bordetella pertussis
acgccgcccguccgggcggcgu

SEQ ID NO: 2361844 - RNA, 13 nt, Bordetella pertussis
acgccgccgaacg

SEQ ID NO: 2361845 - RNA, 17 nt, Bordetella pertussis
acgccgccgauggcgcc

SEQ ID NO: 2361846 - RNA, 20 nt, Bordetella pertussis
acgccgccgauggcgccacc

SEQ ID NO: 2361847 - RNA, 17 nt, Bordetella pertussis
acgccgccgcagccgcc

SEQ ID NO: 2361848 - RNA, 19 nt, Bordetella pertussis
acgccgccgcagccgccag

SEQ ID NO: 2361849 - RNA, 22 nt, Bordetella pertussis
acgccgccgcagccgccagcgc

SEQ ID NO: 2361850 - RNA, 12 nt, Bordetella pertussis
acgccgccggcc

SEQ ID NO: 2361851 - RNA, 17 nt, Bordetella pertussis
acgccgccggccagcug

SEQ ID NO: 2361852 - RNA, 14 nt, Bordetella pertussis
acgccgccggccca

SEQ ID NO: 2361853 - RNA, 14 nt, Bordetella pertussis
acgccgccuggccc

SEQ ID NO: 2361854 - RNA, 21 nt, Bordetella pertussis
acgccgcgacacaaggcggcc

SEQ ID NO: 2361855 - RNA, 15 nt, Bordetella pertussis
acgccgcgccaggca

SEQ ID NO: 2361856 - RNA, 13 nt, Bordetella pertussis
acgccgcgccggc

SEQ ID NO: 2361857 - RNA, 16 nt, Bordetella pertussis
acgccgcgccggcgcg

SEQ ID NO: 2361858 - RNA, 17 nt, Bordetella pertussis
acgccgcgcgcgucgcc

SEQ ID NO: 2361859 - RNA, 20 nt, Bordetella pertussis
acgccgcgcgcgucgccgcu

SEQ ID NO: 2361860 - RNA, 20 nt, Bordetella pertussis
acgccgcgcucagcaccagg

SEQ ID NO: 2361861 - RNA, 22 nt, Bordetella pertussis
acgccgcgcucguugcgcguga

SEQ ID NO: 2361862 - RNA, 16 nt, Bordetella pertussis
acgccgcggugcuggg

SEQ ID NO: 2361863 - RNA, 17 nt, Bordetella pertussis
acgccgcggugcugggc

SEQ ID NO: 2361864 - RNA, 17 nt, Bordetella pertussis
acgccgcgucgcuggcc

SEQ ID NO: 2361865 - RNA, 18 nt, Bordetella pertussis
acgccgcgucgcuggccg

SEQ ID NO: 2361866 - RNA, 13 nt, Bordetella pertussis
acgccgcugaugu

SEQ ID NO: 2361867 - RNA, 15 nt, Bordetella pertussis
acgccggaccagucg

SEQ ID NO: 2361868 - RNA, 18 nt, Bordetella pertussis
acgccggccacgaacggc

SEQ ID NO: 2361869 - RNA, 22 nt, Bordetella pertussis
acgccggccauggcggccggcg

SEQ ID NO: 2361870 - RNA, 12 nt, Bordetella pertussis
acgccggccggg

SEQ ID NO: 2361871 - RNA, 14 nt, Bordetella pertussis
acgccggccugacg

SEQ ID NO: 2361872 - RNA, 16 nt, Bordetella pertussis
acgccggccugacgcg

SEQ ID NO: 2361873 - RNA, 17 nt, Bordetella pertussis
acgccggccugacgcgc

SEQ ID NO: 2361874 - RNA, 20 nt, Bordetella pertussis
acgccggccugcgccagcuc

SEQ ID NO: 2361875 - RNA, 18 nt, Bordetella pertussis
acgccggccuugcugaac

SEQ ID NO: 2361876 - RNA, 18 nt, Bordetella pertussis
acgccggcgaaugccggc

SEQ ID NO: 2361877 - RNA, 20 nt, Bordetella pertussis
acgccggcgaaugccggccg

SEQ ID NO: 2361878 - RNA, 13 nt, Bordetella pertussis
acgccggcggcgc

SEQ ID NO: 2361879 - RNA, 23 nt, Bordetella pertussis
acgccggcggcgugcgccugcug

SEQ ID NO: 2361880 - RNA, 16 nt, Bordetella pertussis
acgccggcgggcaggc

SEQ ID NO: 2361881 - RNA, 17 nt, Bordetella pertussis
acgccggcgggcaggcu

SEQ ID NO: 2361882 - RNA, 18 nt, Bordetella pertussis
acgccggcgggcaggcuc

SEQ ID NO: 2361883 - RNA, 20 nt, Bordetella pertussis
acgccggcgggcaggcucca

SEQ ID NO: 2361884 - RNA, 21 nt, Bordetella pertussis
acgccggcgggcaggcuccac

SEQ ID NO: 2361885 - RNA, 19 nt, Bordetella pertussis
acgccggcggucacgccga

SEQ ID NO: 2361886 - RNA, 19 nt, Bordetella pertussis
acgccggcucaggccagcg

SEQ ID NO: 2361887 - RNA, 24 nt, Bordetella pertussis
acgccggcuucagccgcaagcugg

SEQ ID NO: 2361888 - RNA, 20 nt, Bordetella pertussis
acgccggcuuucagcgccga

SEQ ID NO: 2361889 - RNA, 21 nt, Bordetella pertussis
acgccggcuuucagcgccgag

SEQ ID NO: 2361890 - RNA, 14 nt, Bordetella pertussis
acgccgggcgcgcu

SEQ ID NO: 2361891 - RNA, 22 nt, Bordetella pertussis
acgccgggcgcgcugcccagcc

SEQ ID NO: 2361892 - RNA, 18 nt, Bordetella pertussis
acgccguacugggcacca

SEQ ID NO: 2361893 - RNA, 16 nt, Bordetella pertussis
acgccgucgaccccgu

SEQ ID NO: 2361894 - RNA, 16 nt, Bordetella pertussis
acgccguggcgcaagg

SEQ ID NO: 2361895 - RNA, 22 nt, Bordetella pertussis
acgccgugguggucacguucga

SEQ ID NO: 2361896 - RNA, 14 nt, Bordetella pertussis
acgccguugcggcc

SEQ ID NO: 2361897 - RNA, 16 nt, Bordetella pertussis
acgccucgggcgcaac

SEQ ID NO: 2361898 - RNA, 14 nt, Bordetella pertussis
acgccugccgcgcc

SEQ ID NO: 2361899 - RNA, 17 nt, Bordetella pertussis
acgccugccgcgcccgg

SEQ ID NO: 2361900 - RNA, 19 nt, Bordetella pertussis
acgccugccgcgcccggcg

SEQ ID NO: 2361901 - RNA, 20 nt, Bordetella pertussis
acgccugcgccauggcgcgc

SEQ ID NO: 2361902 - RNA, 21 nt, Bordetella pertussis
acgccugcgccggguccggcc

SEQ ID NO: 2361903 - RNA, 22 nt, Bordetella pertussis
acgccuggaccggcuccggccg

SEQ ID NO: 2361904 - RNA, 14 nt, Bordetella pertussis
acgccuggcgcggc

SEQ ID NO: 2361905 - RNA, 14 nt, Bordetella pertussis
acgccuucgagcac

SEQ ID NO: 2361906 - RNA, 14 nt, Bordetella pertussis
acgccuucggcgcg

SEQ ID NO: 2361907 - RNA, 22 nt, Bordetella pertussis
acgccuugcccgggcuggccgc

SEQ ID NO: 2361908 - RNA, 19 nt, Bordetella pertussis
acgccuuguucgcgcgcgg

SEQ ID NO: 2361909 - RNA, 17 nt, Bordetella pertussis
acgcgacacgcagcaac

SEQ ID NO: 2361910 - RNA, 19 nt, Bordetella pertussis
acgcgacaguucgcccccc

SEQ ID NO: 2361911 - RNA, 12 nt, Bordetella pertussis
acgcgacgcgcc

SEQ ID NO: 2361912 - RNA, 14 nt, Bordetella pertussis
acgcgacgcgccgg

SEQ ID NO: 2361913 - RNA, 15 nt, Bordetella pertussis
acgcgacgcgccgga

SEQ ID NO: 2361914 - RNA, 16 nt, Bordetella pertussis
acgcgacgcgccggau

SEQ ID NO: 2361915 - RNA, 21 nt, Bordetella pertussis
acgcgaugcccgcgcaccagg

SEQ ID NO: 2361916 - RNA, 18 nt, Bordetella pertussis
acgcgauguccagcucca

SEQ ID NO: 2361917 - RNA, 14 nt, Bordetella pertussis
acgcgcaacgccgc

SEQ ID NO: 2361918 - RNA, 13 nt, Bordetella pertussis
acgcgcaccaggc

SEQ ID NO: 2361919 - RNA, 22 nt, Bordetella pertussis
acgcgcaccaggccugccugau

SEQ ID NO: 2361920 - RNA, 15 nt, Bordetella pertussis
acgcgcagcacgcug

SEQ ID NO: 2361921 - RNA, 16 nt, Bordetella pertussis
acgcgcagcacgcugc

SEQ ID NO: 2361922 - RNA, 15 nt, Bordetella pertussis
acgcgcagcggcagg

SEQ ID NO: 2361923 - RNA, 20 nt, Bordetella pertussis
acgcgcagcggcaggcccug

SEQ ID NO: 2361924 - RNA, 19 nt, Bordetella pertussis
acgcgcagcuugcccgcgc

SEQ ID NO: 2361925 - RNA, 22 nt, Bordetella pertussis
acgcgcauucgacaaccacccu

SEQ ID NO: 2361926 - RNA, 19 nt, Bordetella pertussis
acgcgcauucgucgcugcc

SEQ ID NO: 2361927 - RNA, 22 nt, Bordetella pertussis
acgcgcauucgucgcugccgcg

SEQ ID NO: 2361928 - RNA, 17 nt, Bordetella pertussis
acgcgcauuucgaccug

SEQ ID NO: 2361929 - RNA, 20 nt, Bordetella pertussis
acgcgcauuucgaccugcgc

SEQ ID NO: 2361930 - RNA, 12 nt, Bordetella pertussis
acgcgccagcug

SEQ ID NO: 2361931 - RNA, 12 nt, Bordetella pertussis
acgcgccgaaca

SEQ ID NO: 2361932 - RNA, 18 nt, Bordetella pertussis
acgcgccgccaggcgcga

SEQ ID NO: 2361933 - RNA, 17 nt, Bordetella pertussis
cgcgcuucagugcucgg

SEQ ID NO: 2361934 - RNA, 15 nt, Bordetella pertussis
cgcgcuucgagccgg

SEQ ID NO: 2361935 - RNA, 19 nt, Bordetella pertussis
cgcgcuucguccugaucga

SEQ ID NO: 2361936 - RNA, 18 nt, Bordetella pertussis
cgcgcuucucggugcgcc

SEQ ID NO: 2361937 - RNA, 21 nt, Bordetella pertussis
cgcgcuucucggugcgccgcc

SEQ ID NO: 2361938 - RNA, 18 nt, Bordetella pertussis
cgcgcuucuuggcgacca

SEQ ID NO: 2361939 - RNA, 19 nt, Bordetella pertussis
cgcgcuucuuggcgaccag

SEQ ID NO: 2361940 - RNA, 20 nt, Bordetella pertussis
cgcgcuucuuggcgaccagg

SEQ ID NO: 2361941 - RNA, 23 nt, Bordetella pertussis
cgcgcuucuuggcgaccaggccc

SEQ ID NO: 2361942 - RNA, 16 nt, Bordetella pertussis
cgcgcuugacguccag

SEQ ID NO: 2361943 - RNA, 18 nt, Bordetella pertussis
cgcgcuugacguccagcg

SEQ ID NO: 2361944 - RNA, 19 nt, Bordetella pertussis
cgcgcuugagcggcucgcc

SEQ ID NO: 2361945 - RNA, 22 nt, Bordetella pertussis
cgcgcuugagcggcucgccucc

SEQ ID NO: 2361946 - RNA, 23 nt, Bordetella pertussis
cgcgcuugagcggcucgccuccc

SEQ ID NO: 2361947 - RNA, 16 nt, Bordetella pertussis
cgcgcuugaggcuggu

SEQ ID NO: 2361948 - RNA, 13 nt, Bordetella pertussis
cgcgcuugcgcgc

SEQ ID NO: 2361949 - RNA, 16 nt, Bordetella pertussis
cgcgcuugcgcgccac

SEQ ID NO: 2361950 - RNA, 17 nt, Bordetella pertussis
cgcgcuugcgcgccacg

SEQ ID NO: 2361951 - RNA, 15 nt, Bordetella pertussis
cgcgcuugcggccgu

SEQ ID NO: 2361952 - RNA, 16 nt, Bordetella pertussis
cgcgcuuucagguggg

SEQ ID NO: 2361953 - RNA, 23 nt, Bordetella pertussis
cgcggcccgccacgcaggcgggc

SEQ ID NO: 2361954 - RNA, 15 nt, Bordetella pertussis
cgcggcccggccgca

SEQ ID NO: 2361955 - RNA, 18 nt, Bordetella pertussis
cgcggcccggccgcauug

SEQ ID NO: 2361956 - RNA, 16 nt, Bordetella pertussis
cgcggcccggcgucgg

SEQ ID NO: 2361957 - RNA, 16 nt, Bordetella pertussis
cgcggcccguagcugg

SEQ ID NO: 2361958 - RNA, 18 nt, Bordetella pertussis
cgcggcccgugccacggc

SEQ ID NO: 2361959 - RNA, 13 nt, Bordetella pertussis
cgcggcccugggc

SEQ ID NO: 2361960 - RNA, 21 nt, Bordetella pertussis
cgcggcccugggccagccagc

SEQ ID NO: 2361961 - RNA, 22 nt, Bordetella pertussis
cgcggcccugggccagccagcg

SEQ ID NO: 2361962 - RNA, 14 nt, Bordetella pertussis
cgcggcccugggcg

SEQ ID NO: 2361963 - RNA, 12 nt, Bordetella pertussis
cgcggccgacgu

SEQ ID NO: 2361964 - RNA, 17 nt, Bordetella pertussis
cgcggccgacguggacc

SEQ ID NO: 2361965 - RNA, 15 nt, Bordetella pertussis
cgcggccgagcgggc

SEQ ID NO: 2361966 - RNA, 19 nt, Bordetella pertussis
cgcggccgagcgggccagc

SEQ ID NO: 2361967 - RNA, 21 nt, Bordetella pertussis
cgcggccgagcgggccagcgc

SEQ ID NO: 2361968 - RNA, 21 nt, Bordetella pertussis
cgcggccgagcuccucgagcg

SEQ ID NO: 2361969 - RNA, 17 nt, Bordetella pertussis
cgcggccgaggccagcg

SEQ ID NO: 2361970 - RNA, 22 nt, Bordetella pertussis
cgcggccgaggccagcgugccc

SEQ ID NO: 2361971 - RNA, 23 nt, Bordetella pertussis
cgcggccgaggccagcgugccca

SEQ ID NO: 2361972 - RNA, 21 nt, Bordetella pertussis
cgcggccgauguuuuccuggg

SEQ ID NO: 2361973 - RNA, 13 nt, Bordetella pertussis
cgcggccgccagc

SEQ ID NO: 2361974 - RNA, 16 nt, Bordetella pertussis
cgcggccgcccccagc

SEQ ID NO: 2361975 - RNA, 20 nt, Bordetella pertussis
cgcggccgcccccagcgcgc

SEQ ID NO: 2361976 - RNA, 23 nt, Bordetella pertussis
cgcggccgcccccagcgcgccug

SEQ ID NO: 2361977 - RNA, 14 nt, Bordetella pertussis
cgcggccgccgccc

SEQ ID NO: 2361978 - RNA, 14 nt, Bordetella pertussis
cgcggccgcgcagg

SEQ ID NO: 2361979 - RNA, 13 nt, Bordetella pertussis
cgcggccgcgcgc

SEQ ID NO: 2361980 - RNA, 14 nt, Bordetella pertussis
cgcggccgcgcgcu

SEQ ID NO: 2361981 - RNA, 23 nt, Bordetella pertussis
cgcggccgcgcgcuucaggcgcc

SEQ ID NO: 2361982 - RNA, 13 nt, Bordetella pertussis
cgcggccgcgcug

SEQ ID NO: 2361983 - RNA, 17 nt, Bordetella pertussis
cgcggccgcgcuggcgc

SEQ ID NO: 2361984 - RNA, 16 nt, Bordetella pertussis
cgcggccgcgggccgc

SEQ ID NO: 2361985 - RNA, 20 nt, Bordetella pertussis
cgcggccgcggucagccaga

SEQ ID NO: 2361986 - RNA, 22 nt, Bordetella pertussis
cgcggccgcuugucgaugacgc

SEQ ID NO: 2361987 - RNA, 14 nt, Bordetella pertussis
cgcggccggacagg

SEQ ID NO: 2361988 - RNA, 16 nt, Bordetella pertussis
cgcggccggaggccgc

SEQ ID NO: 2361989 - RNA, 12 nt, Bordetella pertussis
cgcggccggcaa

SEQ ID NO: 2361990 - RNA, 14 nt, Bordetella pertussis
cgcggccggcaagg

SEQ ID NO: 2361991 - RNA, 16 nt, Bordetella pertussis
cgcggccggcaaggug

SEQ ID NO: 2361992 - RNA, 19 nt, Bordetella pertussis
cgcggccggcaccaggauc

SEQ ID NO: 2361993 - RNA, 15 nt, Bordetella pertussis
cgcggccggcaccau

SEQ ID NO: 2361994 - RNA, 18 nt, Bordetella pertussis
cgcggccggcacgcccag

SEQ ID NO: 2361995 - RNA, 12 nt, Bordetella pertussis
cgcggccggccg

SEQ ID NO: 2361996 - RNA, 18 nt, Bordetella pertussis
cgcggccggccgcgccca

SEQ ID NO: 2361997 - RNA, 20 nt, Bordetella pertussis
cgcggccggccgcgcccaug

SEQ ID NO: 2361998 - RNA, 15 nt, Bordetella pertussis
cgcggccggccugcu

SEQ ID NO: 2361999 - RNA, 12 nt, Bordetella pertussis
cgcggccggcgc

SEQ ID NO: 2362000 - RNA, 14 nt, Bordetella pertussis
cgcggccggcgcgc

SEQ ID NO: 2362001 - RNA, 15 nt, Bordetella pertussis
cgcggccggcgcgcc

SEQ ID NO: 2362002 - RNA, 17 nt, Bordetella pertussis
cgcggccggcgcgccgg

SEQ ID NO: 2362003 - RNA, 13 nt, Bordetella pertussis
cgcggccggcggc

SEQ ID NO: 2362004 - RNA, 14 nt, Bordetella pertussis
cgcggccggcggcg

SEQ ID NO: 2362005 - RNA, 23 nt, Bordetella pertussis
cgcggccggcuugcgcaagccgg

SEQ ID NO: 2362006 - RNA, 22 nt, Bordetella pertussis
cgcggccggggguuccugccca

SEQ ID NO: 2362007 - RNA, 21 nt, Bordetella pertussis
cgcggccgggucggccugcca

SEQ ID NO: 2362008 - RNA, 17 nt, Bordetella pertussis
cgcggccggguggccgc

SEQ ID NO: 2362009 - RNA, 19 nt, Bordetella pertussis
cgcggccgucaccgccgcc

SEQ ID NO: 2362010 - RNA, 15 nt, Bordetella pertussis
cgcggccgucaggcg

SEQ ID NO: 2362011 - RNA, 21 nt, Bordetella pertussis
cgcggccgucggcgcuggcgc

SEQ ID NO: 2362012 - RNA, 23 nt, Bordetella pertussis
cgcggccgucggcgcuggcgcgc

SEQ ID NO: 2362013 - RNA, 12 nt, Bordetella pertussis
cgcggccgucgu

SEQ ID NO: 2362014 - RNA, 19 nt, Bordetella pertussis
cgcggccguggcggccugc

SEQ ID NO: 2362015 - RNA, 18 nt, Bordetella pertussis
cgcggccguguucgagca

SEQ ID NO: 2362016 - RNA, 19 nt, Bordetella pertussis
cgcggccguguucgagcag

SEQ ID NO: 2362017 - RNA, 19 nt, Bordetella pertussis
cgcggccguuggcgauggc

SEQ ID NO: 2362018 - RNA, 23 nt, Bordetella pertussis
cgcggccguuggcgauggcgcgg

SEQ ID NO: 2362019 - RNA, 22 nt, Bordetella pertussis
cgcggccuauuuggcggccugg

SEQ ID NO: 2362020 - RNA, 23 nt, Bordetella pertussis
cgcggccuauuuggcggccuggc

SEQ ID NO: 2362021 - RNA, 19 nt, Bordetella pertussis
cgcggccugcagaccagca

SEQ ID NO: 2362022 - RNA, 23 nt, Bordetella pertussis
cgcggccugcagaccagcaccgg

SEQ ID NO: 2362023 - RNA, 13 nt, Bordetella pertussis
cgcggccugcgcg

SEQ ID NO: 2362024 - RNA, 16 nt, Bordetella pertussis
cgcggccugcuccggc

SEQ ID NO: 2362025 - RNA, 14 nt, Bordetella pertussis
cgcggccugcucga

SEQ ID NO: 2362026 - RNA, 13 nt, Bordetella pertussis
cgcggccuggccg

SEQ ID NO: 2362027 - RNA, 19 nt, Bordetella pertussis
cgcggccugggcggcgcgc

SEQ ID NO: 2362028 - RNA, 14 nt, Bordetella pertussis
cgcggccuucccaa

SEQ ID NO: 2362029 - RNA, 21 nt, Bordetella pertussis
cgcggccuugcaugcgccgca

SEQ ID NO: 2362030 - RNA, 24 nt, Bordetella pertussis
cgcggccuugcaugcgccgcacca

SEQ ID NO: 2362031 - RNA, 23 nt, Bordetella pertussis
cgcggccuuggucgcgaccucgg

SEQ ID NO: 2362032 - RNA, 18 nt, Bordetella pertussis
cgcggcgaaggcgcggcu

SEQ ID NO: 2362033 - RNA, 17 nt, Bordetella pertussis
cgcggcgagcacggccu

SEQ ID NO: 2362034 - RNA, 18 nt, Bordetella pertussis
cgcggcgagccgcgcgca

SEQ ID NO: 2362035 - RNA, 14 nt, Bordetella pertussis
cgcggcgagcgccg

SEQ ID NO: 2362036 - RNA, 15 nt, Bordetella pertussis
cgcggcgagcgccgc

SEQ ID NO: 2362037 - RNA, 17 nt, Bordetella pertussis
cgcggcgagcgccgcca

SEQ ID NO: 2362038 - RNA, 19 nt, Bordetella pertussis
cgcggcgagcgccgccagg

SEQ ID NO: 2362039 - RNA, 20 nt, Bordetella pertussis
cgcggcgauacgcgccgccu

SEQ ID NO: 2362040 - RNA, 18 nt, Bordetella pertussis
cgcggcgaucggcccggg

SEQ ID NO: 2362041 - RNA, 22 nt, Bordetella pertussis
cgcggcgaugccggccagcagc

SEQ ID NO: 2362042 - RNA, 17 nt, Bordetella pertussis
cgcggcgauugcggccc

SEQ ID NO: 2362043 - RNA, 21 nt, Bordetella pertussis
cgcggcgauugcggcccgcgg

SEQ ID NO: 2362044 - RNA, 14 nt, Bordetella pertussis
cgcggcgcagcaug

SEQ ID NO: 2362045 - RNA, 22 nt, Bordetella pertussis
cgcggcgcagcaugagcugaug

SEQ ID NO: 2362046 - RNA, 14 nt, Bordetella pertussis
cgcggcgcagcgca

SEQ ID NO: 2362047 - RNA, 17 nt, Bordetella pertussis
cgcggcgcaggccugcg

SEQ ID NO: 2362048 - RNA, 19 nt, Bordetella pertussis
cgcggcgcaggccugcggc

SEQ ID NO: 2362049 - RNA, 13 nt, Bordetella pertussis
cgcggcgcaggcg

SEQ ID NO: 2362050 - RNA, 20 nt, Bordetella pertussis
cgcggcgcauuggccaacgg

SEQ ID NO: 2362051 - RNA, 14 nt, Bordetella pertussis
cgcggcgccagcgc

SEQ ID NO: 2362052 - RNA, 16 nt, Bordetella pertussis
cgcggcgccagcgccc

SEQ ID NO: 2362053 - RNA, 16 nt, Bordetella pertussis
cgcggcgccaugccgc

SEQ ID NO: 2362054 - RNA, 19 nt, Bordetella pertussis
cgcggcgccaugccgcgcc

SEQ ID NO: 2362055 - RNA, 20 nt, Bordetella pertussis
cgcggcgccaugccgcgccc

SEQ ID NO: 2362056 - RNA, 14 nt, Bordetella pertussis
cgcggcgcccagcu

SEQ ID NO: 2362057 - RNA, 15 nt, Bordetella pertussis
cgcggcgcccagcug

SEQ ID NO: 2362058 - RNA, 15 nt, Bordetella pertussis
cgcggcgcccccgcg

SEQ ID NO: 2362059 - RNA, 14 nt, Bordetella pertussis
cgcggcgccccgug

SEQ ID NO: 2362060 - RNA, 13 nt, Bordetella pertussis
cgcggcgcccgcc

SEQ ID NO: 2362061 - RNA, 14 nt, Bordetella pertussis
cgcggcgcccgcgc

SEQ ID NO: 2362062 - RNA, 15 nt, Bordetella pertussis
cgcggcgcccgcgca

SEQ ID NO: 2362063 - RNA, 17 nt, Bordetella pertussis
cgcggcgcccgcgcaug

SEQ ID NO: 2362064 - RNA, 10 nt, Bordetella pertussis
cgcggcgccg

SEQ ID NO: 2362065 - RNA, 14 nt, Bordetella pertussis
cgcggcgccgcauu

SEQ ID NO: 2362066 - RNA, 14 nt, Bordetella pertussis
acgcgcgccagcug

SEQ ID NO: 2362067 - RNA, 12 nt, Bordetella pertussis
acgcgcgccgca

SEQ ID NO: 2362068 - RNA, 17 nt, Bordetella pertussis
acgcgcgccggccagcg

SEQ ID NO: 2362069 - RNA, 15 nt, Bordetella pertussis
acgcgcgccggcgcu

SEQ ID NO: 2362070 - RNA, 12 nt, Bordetella pertussis
acgcgcgcgccc

SEQ ID NO: 2362071 - RNA, 22 nt, Bordetella pertussis
acgcgcgcgcccugcacgcgcg

SEQ ID NO: 2362072 - RNA, 14 nt, Bordetella pertussis
acgcgcgcgccgcc

SEQ ID NO: 2362073 - RNA, 18 nt, Bordetella pertussis
acgcgcgcgccgccggcc

SEQ ID NO: 2362074 - RNA, 19 nt, Bordetella pertussis
acgcgcgcgcgcacaggcg

SEQ ID NO: 2362075 - RNA, 22 nt, Bordetella pertussis
acgcgcgcgcgcacaggcgcuc

SEQ ID NO: 2362076 - RNA, 14 nt, Bordetella pertussis
acgcgcgcggcgcg

SEQ ID NO: 2362077 - RNA, 16 nt, Bordetella pertussis
acgcgcgcggcgcggc

SEQ ID NO: 2362078 - RNA, 17 nt, Bordetella pertussis
acgcgcgcggcgcggcu

SEQ ID NO: 2362079 - RNA, 15 nt, Bordetella pertussis
acgcgcgcgggcgcg

SEQ ID NO: 2362080 - RNA, 19 nt, Bordetella pertussis
acgcgcgcgggcgcgccgu

SEQ ID NO: 2362081 - RNA, 12 nt, Bordetella pertussis
acgcgcgcuccu

SEQ ID NO: 2362082 - RNA, 14 nt, Bordetella pertussis
acgcgcgcuggcgc

SEQ ID NO: 2362083 - RNA, 23 nt, Bordetella pertussis
acgcgcgcuggcgcccggccugc

SEQ ID NO: 2362084 - RNA, 14 nt, Bordetella pertussis
acgcgcggcggcgg

SEQ ID NO: 2362085 - RNA, 18 nt, Bordetella pertussis
acgcgcguccuuggcggc

SEQ ID NO: 2362086 - RNA, 23 nt, Bordetella pertussis
acgcgcucaggcggugacgcccu

SEQ ID NO: 2362087 - RNA, 23 nt, Bordetella pertussis
acgcgcuccagcgugucgaacac

SEQ ID NO: 2362088 - RNA, 16 nt, Bordetella pertussis
acgcgcuccggcugcg

SEQ ID NO: 2362089 - RNA, 15 nt, Bordetella pertussis
acgcgcucgccgucg

SEQ ID NO: 2362090 - RNA, 13 nt, Bordetella pertussis
acgcgcugccgga

SEQ ID NO: 2362091 - RNA, 13 nt, Bordetella pertussis
acgcgcugcgcgc

SEQ ID NO: 2362092 - RNA, 13 nt, Bordetella pertussis
acgcgcugcugca

SEQ ID NO: 2362093 - RNA, 23 nt, Bordetella pertussis
acgcgcugcugcaguugcgccac

SEQ ID NO: 2362094 - RNA, 12 nt, Bordetella pertussis
acgcgcuggccg

SEQ ID NO: 2362095 - RNA, 18 nt, Bordetella pertussis
acgcgcugguaguagagc

SEQ ID NO: 2362096 - RNA, 22 nt, Bordetella pertussis
acgcgcugguaguagagcgaau

SEQ ID NO: 2362097 - RNA, 21 nt, Bordetella pertussis
acgcgcugguccgccgccgcg

SEQ ID NO: 2362098 - RNA, 18 nt, Bordetella pertussis
acgcgcuguaggcgccgg

SEQ ID NO: 2362099 - RNA, 19 nt, Bordetella pertussis
acgcgcuguaggcgccggc

SEQ ID NO: 2362100 - RNA, 22 nt, Bordetella pertussis
acgcgcuguaggcgccggcgcc

SEQ ID NO: 2362101 - RNA, 22 nt, Bordetella pertussis
acgcgcuguccgaugcgcugcu

SEQ ID NO: 2362102 - RNA, 17 nt, Bordetella pertussis
acgcgcuugaggcuggu

SEQ ID NO: 2362103 - RNA, 15 nt, Bordetella pertussis
acgcgcuugcgcgcc

SEQ ID NO: 2362104 - RNA, 17 nt, Bordetella pertussis
acgcgcuugcgcgccac

SEQ ID NO: 2362105 - RNA, 21 nt, Bordetella pertussis
acgcgcuugcucggugcgggc

SEQ ID NO: 2362106 - RNA, 22 nt, Bordetella pertussis
acgcgcuuuuccccgcccagcg

SEQ ID NO: 2362107 - RNA, 19 nt, Bordetella pertussis
acgcggaggagguggcugg

SEQ ID NO: 2362108 - RNA, 22 nt, Bordetella pertussis
acgcggaggagguggcuggugc

SEQ ID NO: 2362109 - RNA, 11 nt, Bordetella pertussis
acgcggccagc

SEQ ID NO: 2362110 - RNA, 23 nt, Bordetella pertussis
acgcggccaugcggugcgccgcg

SEQ ID NO: 2362111 - RNA, 18 nt, Bordetella pertussis
acgcggccgcgggccgcu

SEQ ID NO: 2362112 - RNA, 19 nt, Bordetella pertussis
acgcggccgcgggccgcug

SEQ ID NO: 2362113 - RNA, 21 nt, Bordetella pertussis
acgcggccgcgggccgcuggu

SEQ ID NO: 2362114 - RNA, 19 nt, Bordetella pertussis
acgcggccguggaggcggc

SEQ ID NO: 2362115 - RNA, 20 nt, Bordetella pertussis
acgcggccguggcggccugc

SEQ ID NO: 2362116 - RNA, 21 nt, Bordetella pertussis
acgcggcgcgcgccugcagca

SEQ ID NO: 2362117 - RNA, 13 nt, Bordetella pertussis
acgcggcgcugcu

SEQ ID NO: 2362118 - RNA, 23 nt, Bordetella pertussis
acgcggcgcugcuggccggccag

SEQ ID NO: 2362119 - RNA, 12 nt, Bordetella pertussis
acgcggcggccg

SEQ ID NO: 2362120 - RNA, 22 nt, Bordetella pertussis
acgcggcggccgguaucggccu

SEQ ID NO: 2362121 - RNA, 18 nt, Bordetella pertussis
acgcggcguacuggcgcg

SEQ ID NO: 2362122 - RNA, 19 nt, Bordetella pertussis
acgcggcguacuggcgcgg

SEQ ID NO: 2362123 - RNA, 20 nt, Bordetella pertussis
acgcggcguacuggcgcggc

SEQ ID NO: 2362124 - RNA, 13 nt, Bordetella pertussis
acgcggcgucagg

SEQ ID NO: 2362125 - RNA, 18 nt, Bordetella pertussis
acgcggcgucgacgcccg

SEQ ID NO: 2362126 - RNA, 19 nt, Bordetella pertussis
acgcgggcauugggcagcg

SEQ ID NO: 2362127 - RNA, 22 nt, Bordetella pertussis
acgcgggccggccguuucaggc

SEQ ID NO: 2362128 - RNA, 16 nt, Bordetella pertussis
acgcgggcgcugacgc

SEQ ID NO: 2362129 - RNA, 12 nt, Bordetella pertussis
acgcgggcgugg

SEQ ID NO: 2362130 - RNA, 18 nt, Bordetella pertussis
acgcgggcuugcugcccc

SEQ ID NO: 2362131 - RNA, 14 nt, Bordetella pertussis
acgcggggacaggc

SEQ ID NO: 2362132 - RNA, 20 nt, Bordetella pertussis
acgcggguucgacgccggca

SEQ ID NO: 2362133 - RNA, 15 nt, Bordetella pertussis
acgcgguccacgccg

SEQ ID NO: 2362134 - RNA, 15 nt, Bordetella pertussis
acgcgguccagcccc

SEQ ID NO: 2362135 - RNA, 17 nt, Bordetella pertussis
acgcggucgaugcgcac

SEQ ID NO: 2362136 - RNA, 19 nt, Bordetella pertussis
acgcggucgcauuggccgc

SEQ ID NO: 2362137 - RNA, 21 nt, Bordetella pertussis
acgcgguggcguuggccugcc

SEQ ID NO: 2362138 - RNA, 16 nt, Bordetella pertussis
acgcguacggcccugg

SEQ ID NO: 2362139 - RNA, 15 nt, Bordetella pertussis
acgcguaggucaggc

SEQ ID NO: 2362140 - RNA, 23 nt, Bordetella pertussis
acgcguaggucaggcccacgccg

SEQ ID NO: 2362141 - RNA, 14 nt, Bordetella pertussis
acgcguccaggccc

SEQ ID NO: 2362142 - RNA, 22 nt, Bordetella pertussis
acgcguccaggcccuggcggcg

SEQ ID NO: 2362143 - RNA, 18 nt, Bordetella pertussis
acgcguccucggccagcc

SEQ ID NO: 2362144 - RNA, 19 nt, Bordetella pertussis
acgcguccucggccagccg

SEQ ID NO: 2362145 - RNA, 23 nt, Bordetella pertussis
acgcgugaacuccugcaacuggu

SEQ ID NO: 2362146 - RNA, 22 nt, Bordetella pertussis
acgcgugaauaccgcgcacagg

SEQ ID NO: 2362147 - RNA, 17 nt, Bordetella pertussis
acgcgugcgcggccgcg

SEQ ID NO: 2362148 - RNA, 20 nt, Bordetella pertussis
acgcguucaagucgcccugc

SEQ ID NO: 2362149 - RNA, 18 nt, Bordetella pertussis
acgcguucgggcggcagg

SEQ ID NO: 2362150 - RNA, 20 nt, Bordetella pertussis
acgcguucgggcggcaggug

SEQ ID NO: 2362151 - RNA, 23 nt, Bordetella pertussis
acgcguucgggcggcaggugcgc

SEQ ID NO: 2362152 - RNA, 22 nt, Bordetella pertussis
acgcguuguucgggccggcugc

SEQ ID NO: 2362153 - RNA, 21 nt, Bordetella pertussis
acgcguuuggcuuaccaggcg

SEQ ID NO: 2362154 - RNA, 17 nt, Bordetella pertussis
acgcucacgcccguguc

SEQ ID NO: 2362155 - RNA, 17 nt, Bordetella pertussis
acgcucagcaugcgcug

SEQ ID NO: 2362156 - RNA, 18 nt, Bordetella pertussis
acgcucauccaggcgcgu

SEQ ID NO: 2362157 - RNA, 14 nt, Bordetella pertussis
acgcucgaugcgcc

SEQ ID NO: 2362158 - RNA, 15 nt, Bordetella pertussis
acgcucuugagcgcg

SEQ ID NO: 2362159 - RNA, 17 nt, Bordetella pertussis
acgcucuugagcgcggc

SEQ ID NO: 2362160 - RNA, 23 nt, Bordetella pertussis
acgcucuugagcgcggccucgcc

SEQ ID NO: 2362161 - RNA, 17 nt, Bordetella pertussis
acgcucuugcgcgcgcc

SEQ ID NO: 2362162 - RNA, 23 nt, Bordetella pertussis
acgcugaacuacgaaacucccac

SEQ ID NO: 2362163 - RNA, 16 nt, Bordetella pertussis
acgcugaagcgccgcc

SEQ ID NO: 2362164 - RNA, 17 nt, Bordetella pertussis
acgcugaagcgccgcca

SEQ ID NO: 2362165 - RNA, 15 nt, Bordetella pertussis
cgcggcgucgacgcc

SEQ ID NO: 2362166 - RNA, 16 nt, Bordetella pertussis
cgcggcgucgacgccc

SEQ ID NO: 2362167 - RNA, 20 nt, Bordetella pertussis
cgcggcgucgacgcccgcgc

SEQ ID NO: 2362168 - RNA, 20 nt, Bordetella pertussis
cgcggcgucguccaucgacg

SEQ ID NO: 2362169 - RNA, 19 nt, Bordetella pertussis
cgcggcgugcugcccgcgu

SEQ ID NO: 2362170 - RNA, 22 nt, Bordetella pertussis
cgcggcguugcggcagcggccc

SEQ ID NO: 2362171 - RNA, 23 nt, Bordetella pertussis
cgcggcguugcggcagcggccca

SEQ ID NO: 2362172 - RNA, 15 nt, Bordetella pertussis
cgcggcguugcggcg

SEQ ID NO: 2362173 - RNA, 16 nt, Bordetella pertussis
cgcggcguugcggcgc

SEQ ID NO: 2362174 - RNA, 18 nt, Bordetella pertussis
cgcggcuccagcucagca

SEQ ID NO: 2362175 - RNA, 23 nt, Bordetella pertussis
cgcggcuccagcucagcagcgcc

SEQ ID NO: 2362176 - RNA, 24 nt, Bordetella pertussis
cgcggcuccagcucagcagcgcca

SEQ ID NO: 2362177 - RNA, 21 nt, Bordetella pertussis
cgcggcucgccgcgcacgggc

SEQ ID NO: 2362178 - RNA, 22 nt, Bordetella pertussis
cgcgguauucggcgaccaggug

SEQ ID NO: 2362179 - RNA, 17 nt, Bordetella pertussis
cgcgguauugccggaug

SEQ ID NO: 2362180 - RNA, 23 nt, Bordetella pertussis
cgcgguauugcgccaccccgccg

SEQ ID NO: 2362181 - RNA, 21 nt, Bordetella pertussis
cgcggucacaucuguccugau

SEQ ID NO: 2362182 - RNA, 19 nt, Bordetella pertussis
cgcggucaccgagcugagc

SEQ ID NO: 2362183 - RNA, 14 nt, Bordetella pertussis
cgcggucagcauga

SEQ ID NO: 2362184 - RNA, 17 nt, Bordetella pertussis
cgcggucaucggcgacg

SEQ ID NO: 2362185 - RNA, 20 nt, Bordetella pertussis
cgcgguccaccucgucgucc

SEQ ID NO: 2362186 - RNA, 13 nt, Bordetella pertussis
cgcgguccacgcc

SEQ ID NO: 2362187 - RNA, 15 nt, Bordetella pertussis
cgcgguccacgcccu

SEQ ID NO: 2362188 - RNA, 16 nt, Bordetella pertussis
cgcgguccacgccggg

SEQ ID NO: 2362189 - RNA, 16 nt, Bordetella pertussis
cgcgguccacgcgggc

SEQ ID NO: 2362190 - RNA, 17 nt, Bordetella pertussis
cgcgguccacgcgggca

SEQ ID NO: 2362191 - RNA, 14 nt, Bordetella pertussis
cgcgguccagcacc

SEQ ID NO: 2362192 - RNA, 17 nt, Bordetella pertussis
cgcgguccagcaccagg

SEQ ID NO: 2362193 - RNA, 18 nt, Bordetella pertussis
cgcgguccagcaccaggg

SEQ ID NO: 2362194 - RNA, 13 nt, Bordetella pertussis
cgcgguccagccc

SEQ ID NO: 2362195 - RNA, 20 nt, Bordetella pertussis
cgcgguccagccccugcccg

SEQ ID NO: 2362196 - RNA, 14 nt, Bordetella pertussis
cgcgguccauggug

SEQ ID NO: 2362197 - RNA, 23 nt, Bordetella pertussis
cgcgguccauggugaugcugucg

SEQ ID NO: 2362198 - RNA, 12 nt, Bordetella pertussis
cgcgguccgcag

SEQ ID NO: 2362199 - RNA, 19 nt, Bordetella pertussis
cgcgguccgcagcgcucgc

SEQ ID NO: 2362200 - RNA, 21 nt, Bordetella pertussis
cgcgguccgcagcgcucgcac

SEQ ID NO: 2362201 - RNA, 16 nt, Bordetella pertussis
cgcgguccugaccggc

SEQ ID NO: 2362202 - RNA, 20 nt, Bordetella pertussis
cgcgguccugaccggcggcg

SEQ ID NO: 2362203 - RNA, 18 nt, Bordetella pertussis
cgcggucgaugaccagcc

SEQ ID NO: 2362204 - RNA, 16 nt, Bordetella pertussis
cgcggucgaugcgcac

SEQ ID NO: 2362205 - RNA, 20 nt, Bordetella pertussis
cgcggucgaugcgcacgccc

SEQ ID NO: 2362206 - RNA, 20 nt, Bordetella pertussis
cgcggucgcauuggccgccg

SEQ ID NO: 2362207 - RNA, 22 nt, Bordetella pertussis
cgcggucgcccaacccggcgag

SEQ ID NO: 2362208 - RNA, 14 nt, Bordetella pertussis
cgcggucggcgggc

SEQ ID NO: 2362209 - RNA, 17 nt, Bordetella pertussis
cgcggucgggaucaucc

SEQ ID NO: 2362210 - RNA, 22 nt, Bordetella pertussis
cgcggucggugcaaugcccagu

SEQ ID NO: 2362211 - RNA, 23 nt, Bordetella pertussis
cgcggucugcgguccgaugucga

SEQ ID NO: 2362212 - RNA, 18 nt, Bordetella pertussis
cgcggugaggcggccggg

SEQ ID NO: 2362213 - RNA, 19 nt, Bordetella pertussis
cgcggugcaagcggccggc

SEQ ID NO: 2362214 - RNA, 20 nt, Bordetella pertussis
cgcggugcaagcggccggcc

SEQ ID NO: 2362215 - RNA, 22 nt, Bordetella pertussis
cgcggugcaagcggccggccug

SEQ ID NO: 2362216 - RNA, 19 nt, Bordetella pertussis
cgcggugccgccuggccag

SEQ ID NO: 2362217 - RNA, 16 nt, Bordetella pertussis
cgcggugccugugccc

SEQ ID NO: 2362218 - RNA, 18 nt, Bordetella pertussis
cgcggugcgcaccaggcc

SEQ ID NO: 2362219 - RNA, 13 nt, Bordetella pertussis
cgcggugcgggug

SEQ ID NO: 2362220 - RNA, 22 nt, Bordetella pertussis
cgcggugcucggcgaacugggc

SEQ ID NO: 2362221 - RNA, 14 nt, Bordetella pertussis
cgcgguggccagcg

SEQ ID NO: 2362222 - RNA, 20 nt, Bordetella pertussis
cgcgguggccagcgaaccga

SEQ ID NO: 2362223 - RNA, 16 nt, Bordetella pertussis
cgcgguggccaugcug

SEQ ID NO: 2362224 - RNA, 19 nt, Bordetella pertussis
cgcgguggccaugcugggc

SEQ ID NO: 2362225 - RNA, 22 nt, Bordetella pertussis
cgcgguggccaugcugggcggg

SEQ ID NO: 2362226 - RNA, 12 nt, Bordetella pertussis
cgcgguggccgc

SEQ ID NO: 2362227 - RNA, 14 nt, Bordetella pertussis
cgcgguggccgccg

SEQ ID NO: 2362228 - RNA, 15 nt, Bordetella pertussis
cgcgguggccgccgc

SEQ ID NO: 2362229 - RNA, 20 nt, Bordetella pertussis
cgcgguggcgggcgugcgga

SEQ ID NO: 2362230 - RNA, 16 nt, Bordetella pertussis
cgcggugggcagcggc

SEQ ID NO: 2362231 - RNA, 14 nt, Bordetella pertussis
cgcgguggggcgca

SEQ ID NO: 2362232 - RNA, 21 nt, Bordetella pertussis
cgcggugucggacaacugcgc

SEQ ID NO: 2362233 - RNA, 19 nt, Bordetella pertussis
cgcgguucgcauagcgccg

SEQ ID NO: 2362234 - RNA, 20 nt, Bordetella pertussis
cgcgguucgcauagcgccgg

SEQ ID NO: 2362235 - RNA, 21 nt, Bordetella pertussis
cgcgguucgcauagcgccggu

SEQ ID NO: 2362236 - RNA, 16 nt, Bordetella pertussis
cgcgguugagcgccag

SEQ ID NO: 2362237 - RNA, 17 nt, Bordetella pertussis
cgcgguugagcgccagg

SEQ ID NO: 2362238 - RNA, 16 nt, Bordetella pertussis
cgcgguugggcgcaca

SEQ ID NO: 2362239 - RNA, 20 nt, Bordetella pertussis
cgcgguugguuugcggcgcg

SEQ ID NO: 2362240 - RNA, 23 nt, Bordetella pertussis
cgcgguugguuugcggcgcgacc

SEQ ID NO: 2362241 - RNA, 15 nt, Bordetella pertussis
cgcguacaacgccgc

SEQ ID NO: 2362242 - RNA, 16 nt, Bordetella pertussis
cgcguacaacgccgcg

SEQ ID NO: 2362243 - RNA, 20 nt, Bordetella pertussis
cgcguacaacgccgcguccg

SEQ ID NO: 2362244 - RNA, 18 nt, Bordetella pertussis
cgcguacagcccgaacag

SEQ ID NO: 2362245 - RNA, 19 nt, Bordetella pertussis
cgcguacgcggcgcggucg

SEQ ID NO: 2362246 - RNA, 15 nt, Bordetella pertussis
cgcguacguggcgcg

SEQ ID NO: 2362247 - RNA, 18 nt, Bordetella pertussis
cgcguacguggcgcggcu

SEQ ID NO: 2362248 - RNA, 19 nt, Bordetella pertussis
cgcguacguggcgcggcug

SEQ ID NO: 2362249 - RNA, 21 nt, Bordetella pertussis
cgcguacuuccucgaccagcc

SEQ ID NO: 2362250 - RNA, 13 nt, Bordetella pertussis
cgcguagcccaug

SEQ ID NO: 2362251 - RNA, 14 nt, Bordetella pertussis
cgcguagcccaugu

SEQ ID NO: 2362252 - RNA, 16 nt, Bordetella pertussis
cgcguagcgcggccgg

SEQ ID NO: 2362253 - RNA, 15 nt, Bordetella pertussis
cgcguaggcgcgcgc

SEQ ID NO: 2362254 - RNA, 16 nt, Bordetella pertussis
cgcguaggcgcgcgca

SEQ ID NO: 2362255 - RNA, 17 nt, Bordetella pertussis
cgcguaguccgagcccg

SEQ ID NO: 2362256 - RNA, 20 nt, Bordetella pertussis
cgcguagugguaugaccggc

SEQ ID NO: 2362257 - RNA, 22 nt, Bordetella pertussis
cgcguagugguaugaccggcgc

SEQ ID NO: 2362258 - RNA, 23 nt, Bordetella pertussis
cgcguagugguaugaccggcgcg

SEQ ID NO: 2362259 - RNA, 18 nt, Bordetella pertussis
cgcguaguugucggcgca

SEQ ID NO: 2362260 - RNA, 21 nt, Bordetella pertussis
cgcguauccagcaucaccagc

SEQ ID NO: 2362261 - RNA, 14 nt, Bordetella pertussis
cgcguaugcccugc

SEQ ID NO: 2362262 - RNA, 18 nt, Bordetella pertussis
cgcguaugcccugcggac

SEQ ID NO: 2362263 - RNA, 14 nt, Bordetella pertussis
cgcguauggcggcg

SEQ ID NO: 2362264 - RNA, 16 nt, Bordetella pertussis
cgcguauggcggcgcc

SEQ ID NO: 2362265 - RNA, 15 nt, Bordetella pertussis
cgcguauuccggguc

SEQ ID NO: 2362266 - RNA, 12 nt, Bordetella pertussis
cgcgucaagggg

SEQ ID NO: 2362267 - RNA, 14 nt, Bordetella pertussis
cgcgucaaggggcu

SEQ ID NO: 2362268 - RNA, 22 nt, Bordetella pertussis
cgcgucaaggggcuguaccugg

SEQ ID NO: 2362269 - RNA, 20 nt, Bordetella pertussis
cgcgucacaaagacggcuug

SEQ ID NO: 2362270 - RNA, 14 nt, Bordetella pertussis
cgcgucaggccggg

SEQ ID NO: 2362271 - RNA, 18 nt, Bordetella pertussis
cgcgucaggccgggcagc

SEQ ID NO: 2362272 - RNA, 19 nt, Bordetella pertussis
cgcgucaggcgagcgcggc

SEQ ID NO: 2362273 - RNA, 20 nt, Bordetella pertussis
cgcgucaggcgagcgcggcg

SEQ ID NO: 2362274 - RNA, 20 nt, Bordetella pertussis
cgcgucaguugggcgcgccc

SEQ ID NO: 2362275 - RNA, 21 nt, Bordetella pertussis
cgcgucaguugggcgcgccca

SEQ ID NO: 2362276 - RNA, 22 nt, Bordetella pertussis
cgcgucaguugggcgcgcccag

SEQ ID NO: 2362277 - RNA, 21 nt, Bordetella pertussis
cgcgucauacacggcgcgggc

SEQ ID NO: 2362278 - RNA, 22 nt, Bordetella pertussis
cgcgucauacacggcgcgggcg

SEQ ID NO: 2362279 - RNA, 17 nt, Bordetella pertussis
cgcguccaagcagaccc

SEQ ID NO: 2362280 - RNA, 13 nt, Bordetella pertussis
cgcguccagcgcg

SEQ ID NO: 2362281 - RNA, 14 nt, Bordetella pertussis
cgcguccagcgcgc

SEQ ID NO: 2362282 - RNA, 16 nt, Bordetella pertussis
cgcguccagcgcgcgg

SEQ ID NO: 2362283 - RNA, 17 nt, Bordetella pertussis
cgcguccagcgcgcggc

SEQ ID NO: 2362284 - RNA, 18 nt, Bordetella pertussis
cgcguccagcgcgcggcc

SEQ ID NO: 2362285 - RNA, 19 nt, Bordetella pertussis
cgcguccagcgcgcggccu

SEQ ID NO: 2362286 - RNA, 12 nt, Bordetella pertussis
cgcguccaggcc

SEQ ID NO: 2362287 - RNA, 23 nt, Bordetella pertussis
cgcguccaggcccagcgcguccu

SEQ ID NO: 2362288 - RNA, 14 nt, Bordetella pertussis
cgcguccaggcccu

SEQ ID NO: 2362289 - RNA, 20 nt, Bordetella pertussis
cgcguccaggcccuggcggc

SEQ ID NO: 2362290 - RNA, 18 nt, Bordetella pertussis
acgcugaucucggccugc

SEQ ID NO: 2362291 - RNA, 17 nt, Bordetella pertussis
acgcugaugcgcgucag

SEQ ID NO: 2362292 - RNA, 15 nt, Bordetella pertussis
acgcugauggccgcc

SEQ ID NO: 2362293 - RNA, 22 nt, Bordetella pertussis
acgcugauggccgccagcggcu

SEQ ID NO: 2362294 - RNA, 23 nt, Bordetella pertussis
acgcugauggccgccagcggcug

SEQ ID NO: 2362295 - RNA, 13 nt, Bordetella pertussis
acgcugcccugcu

SEQ ID NO: 2362296 - RNA, 16 nt, Bordetella pertussis
acgcugcccugcugcu

SEQ ID NO: 2362297 - RNA, 21 nt, Bordetella pertussis
acgcugcccugcugcugcagc

SEQ ID NO: 2362298 - RNA, 19 nt, Bordetella pertussis
acgcugcgcggcggcuugc

SEQ ID NO: 2362299 - RNA, 18 nt, Bordetella pertussis
acgcugcugauccucgcc

SEQ ID NO: 2362300 - RNA, 21 nt, Bordetella pertussis
acgcuggaagagaccgcuuau

SEQ ID NO: 2362301 - RNA, 13 nt, Bordetella pertussis
acgcuggagcgcg

SEQ ID NO: 2362302 - RNA, 14 nt, Bordetella pertussis
acgcuggagcgcgg

SEQ ID NO: 2362303 - RNA, 16 nt, Bordetella pertussis
acgcuggcaucgucgc

SEQ ID NO: 2362304 - RNA, 18 nt, Bordetella pertussis
acgcuggccgcgcccgcc

SEQ ID NO: 2362305 - RNA, 20 nt, Bordetella pertussis
acgcuggcgcccgccugcgc

SEQ ID NO: 2362306 - RNA, 17 nt, Bordetella pertussis
acgcuggcuaucgccuc

SEQ ID NO: 2362307 - RNA, 14 nt, Bordetella pertussis
acgcugggccagac

SEQ ID NO: 2362308 - RNA, 22 nt, Bordetella pertussis
acgcugggccagaccgcgcgca

SEQ ID NO: 2362309 - RNA, 15 nt, Bordetella pertussis
acgcugggcgaggcg

SEQ ID NO: 2362310 - RNA, 21 nt, Bordetella pertussis
acgcugggcuacgacccgcug

SEQ ID NO: 2362311 - RNA, 19 nt, Bordetella pertussis
acgcugguggccaccagcc

SEQ ID NO: 2362312 - RNA, 22 nt, Bordetella pertussis
acgcugguggccaccagcccca

SEQ ID NO: 2362313 - RNA, 22 nt, Bordetella pertussis
acgcuguaacaacacguacgac

SEQ ID NO: 2362314 - RNA, 16 nt, Bordetella pertussis
acgcuguagaggcgcg

SEQ ID NO: 2362315 - RNA, 23 nt, Bordetella pertussis
acgcuguagaggcgcggcucgcc

SEQ ID NO: 2362316 - RNA, 13 nt, Bordetella pertussis
acgcugucgcgcc

SEQ ID NO: 2362317 - RNA, 16 nt, Bordetella pertussis
acgcugucggggugcc

SEQ ID NO: 2362318 - RNA, 22 nt, Bordetella pertussis
acgcugucggggugccguucgg

SEQ ID NO: 2362319 - RNA, 14 nt, Bordetella pertussis
acgcuuaucgcggc

SEQ ID NO: 2362320 - RNA, 16 nt, Bordetella pertussis
acgcuuaucgcggcgc

SEQ ID NO: 2362321 - RNA, 17 nt, Bordetella pertussis
acgcuuaucgcggcgcg

SEQ ID NO: 2362322 - RNA, 20 nt, Bordetella pertussis
acgcuuccugggccugcggc

SEQ ID NO: 2362323 - RNA, 14 nt, Bordetella pertussis
acgcuucguucagc

SEQ ID NO: 2362324 - RNA, 13 nt, Bordetella pertussis
acgcuugccggcg

SEQ ID NO: 2362325 - RNA, 14 nt, Bordetella pertussis
acggaaacguugcg

SEQ ID NO: 2362326 - RNA, 22 nt, Bordetella pertussis
acggaacgugccgucgggcgcc

SEQ ID NO: 2362327 - RNA, 23 nt, Bordetella pertussis
acggaaguccugcaucgccaugc

SEQ ID NO: 2362328 - RNA, 15 nt, Bordetella pertussis
acggacagcccgcgc

SEQ ID NO: 2362329 - RNA, 17 nt, Bordetella pertussis
acggacagcccgcgcug

SEQ ID NO: 2362330 - RNA, 16 nt, Bordetella pertussis
acggacuggcugguca

SEQ ID NO: 2362331 - RNA, 20 nt, Bordetella pertussis
acggauaauugggcggcauc

SEQ ID NO: 2362332 - RNA, 12 nt, Bordetella pertussis
acggaucagccg

SEQ ID NO: 2362333 - RNA, 14 nt, Bordetella pertussis
acggaucagccgcu

SEQ ID NO: 2362334 - RNA, 13 nt, Bordetella pertussis
acggauugcugau

SEQ ID NO: 2362335 - RNA, 23 nt, Bordetella pertussis
acggcaaaacggugccuugcggc

SEQ ID NO: 2362336 - RNA, 19 nt, Bordetella pertussis
acggcaaaagccggggugc

SEQ ID NO: 2362337 - RNA, 15 nt, Bordetella pertussis
acggcaagagccugg

SEQ ID NO: 2362338 - RNA, 16 nt, Bordetella pertussis
acggcaagagccuggc

SEQ ID NO: 2362339 - RNA, 13 nt, Bordetella pertussis
acggcaagaucgc

SEQ ID NO: 2362340 - RNA, 16 nt, Bordetella pertussis
acggcaaugccugcgc

SEQ ID NO: 2362341 - RNA, 21 nt, Bordetella pertussis
acggcaaugucgcaggccgcg

SEQ ID NO: 2362342 - RNA, 12 nt, Bordetella pertussis
acggcaccagcc

SEQ ID NO: 2362343 - RNA, 13 nt, Bordetella pertussis
acggcaccagccg

SEQ ID NO: 2362344 - RNA, 16 nt, Bordetella pertussis
acggcagaugaucuac

SEQ ID NO: 2362345 - RNA, 12 nt, Bordetella pertussis
acggcagcagcg

SEQ ID NO: 2362346 - RNA, 15 nt, Bordetella pertussis
acggcagcagcgcgc

SEQ ID NO: 2362347 - RNA, 17 nt, Bordetella pertussis
acggcagcagcgcgccg

SEQ ID NO: 2362348 - RNA, 18 nt, Bordetella pertussis
acggcagcagcgcgccgg

SEQ ID NO: 2362349 - RNA, 12 nt, Bordetella pertussis
acggcagcgcgc

SEQ ID NO: 2362350 - RNA, 17 nt, Bordetella pertussis
acggcaggcgccugccc

SEQ ID NO: 2362351 - RNA, 15 nt, Bordetella pertussis
acggcaucggccagc

SEQ ID NO: 2362352 - RNA, 18 nt, Bordetella pertussis
acggcaucggcgccgcgc

SEQ ID NO: 2362353 - RNA, 21 nt, Bordetella pertussis
acggcaucggcgccgcgcgcu

SEQ ID NO: 2362354 - RNA, 16 nt, Bordetella pertussis
acggcauggccagcuu

SEQ ID NO: 2362355 - RNA, 22 nt, Bordetella pertussis
acggcauggccagcuucgggcc

SEQ ID NO: 2362356 - RNA, 20 nt, Bordetella pertussis
acggcauggccggcaggucg

SEQ ID NO: 2362357 - RNA, 20 nt, Bordetella pertussis
acggcaugucccgaggcgcc

SEQ ID NO: 2362358 - RNA, 15 nt, Bordetella pertussis
acggccaacccucgc

SEQ ID NO: 2362359 - RNA, 20 nt, Bordetella pertussis
acggccaacccucgcacggc

SEQ ID NO: 2362360 - RNA, 16 nt, Bordetella pertussis
acggccaagcagcgcc

SEQ ID NO: 2362361 - RNA, 18 nt, Bordetella pertussis
acggccaagcagcgccug

SEQ ID NO: 2362362 - RNA, 20 nt, Bordetella pertussis
acggccaagcagcgccugcc

SEQ ID NO: 2362363 - RNA, 20 nt, Bordetella pertussis
acggccaccagggcccggac

SEQ ID NO: 2362364 - RNA, 17 nt, Bordetella pertussis
acggccacgaucaucag

SEQ ID NO: 2362365 - RNA, 19 nt, Bordetella pertussis
acggccacgcagcgcgugu

SEQ ID NO: 2362366 - RNA, 13 nt, Bordetella pertussis
acggccacgucgg

SEQ ID NO: 2362367 - RNA, 14 nt, Bordetella pertussis
acggccagcaccau

SEQ ID NO: 2362368 - RNA, 16 nt, Bordetella pertussis
acggccagcacguaga

SEQ ID NO: 2362369 - RNA, 14 nt, Bordetella pertussis
acggccagcagcac

SEQ ID NO: 2362370 - RNA, 21 nt, Bordetella pertussis
acggccagcaggagcccgcug

SEQ ID NO: 2362371 - RNA, 22 nt, Bordetella pertussis
acggccagcaggagcccgcugc

SEQ ID NO: 2362372 - RNA, 22 nt, Bordetella pertussis
acggccagcaucguaucgggcg

SEQ ID NO: 2362373 - RNA, 21 nt, Bordetella pertussis
acggccagcauuaccagcaac

SEQ ID NO: 2362374 - RNA, 18 nt, Bordetella pertussis
acggccagcgucagcgca

SEQ ID NO: 2362375 - RNA, 16 nt, Bordetella pertussis
acggccaggacggcau

SEQ ID NO: 2362376 - RNA, 10 nt, Bordetella pertussis
acggccaggg

SEQ ID NO: 2362377 - RNA, 11 nt, Bordetella pertussis
acggccagggg

SEQ ID NO: 2362378 - RNA, 16 nt, Bordetella pertussis
acggccaggggcagcu

SEQ ID NO: 2362379 - RNA, 18 nt, Bordetella pertussis
acggccaggggcagcucg

SEQ ID NO: 2362380 - RNA, 14 nt, Bordetella pertussis
acggccauccggcc

SEQ ID NO: 2362381 - RNA, 21 nt, Bordetella pertussis
acggcccacgcugucggggug

SEQ ID NO: 2362382 - RNA, 16 nt, Bordetella pertussis
acggcccgccaggaag

SEQ ID NO: 2362383 - RNA, 21 nt, Bordetella pertussis
acggcccgccaggaagcgggc

SEQ ID NO: 2362384 - RNA, 14 nt, Bordetella pertussis
acggcccuggucua

SEQ ID NO: 2362385 - RNA, 20 nt, Bordetella pertussis
acggccgcaagcuggccgau

SEQ ID NO: 2362386 - RNA, 22 nt, Bordetella pertussis
acggccgcaugcgugaagccca

SEQ ID NO: 2362387 - RNA, 18 nt, Bordetella pertussis
acggccgccaccugggcc

SEQ ID NO: 2362388 - RNA, 22 nt, Bordetella pertussis
acggccgccaccugggccgccu

SEQ ID NO: 2362389 - RNA, 11 nt, Bordetella pertussis
acggccgccgg

SEQ ID NO: 2362390 - RNA, 15 nt, Bordetella pertussis
acggccgcggccggc

SEQ ID NO: 2362391 - RNA, 21 nt, Bordetella pertussis
acggccggcagcgccuugccu

SEQ ID NO: 2362392 - RNA, 13 nt, Bordetella pertussis
acggccggccagg

SEQ ID NO: 2362393 - RNA, 14 nt, Bordetella pertussis
acggccggccaggc

SEQ ID NO: 2362394 - RNA, 15 nt, Bordetella pertussis
acggccggccaggcg

SEQ ID NO: 2362395 - RNA, 16 nt, Bordetella pertussis
acggccggccaggcgc

SEQ ID NO: 2362396 - RNA, 19 nt, Bordetella pertussis
acggccggcgcacgccgga

SEQ ID NO: 2362397 - RNA, 12 nt, Bordetella pertussis
acggccggcucc

SEQ ID NO: 2362398 - RNA, 16 nt, Bordetella pertussis
cgcguggcccgcgccg

SEQ ID NO: 2362399 - RNA, 17 nt, Bordetella pertussis
cgcguggcccgcgccgc

SEQ ID NO: 2362400 - RNA, 17 nt, Bordetella pertussis
cgcguggccgccacgcc

SEQ ID NO: 2362401 - RNA, 19 nt, Bordetella pertussis
cgcguggccgcgcugcugc

SEQ ID NO: 2362402 - RNA, 13 nt, Bordetella pertussis
cgcguggccggcg

SEQ ID NO: 2362403 - RNA, 13 nt, Bordetella pertussis
cgcuccggcauga

SEQ ID NO: 2362404 - RNA, 21 nt, Bordetella pertussis
cgcuccggcugcgcgcgcagc

SEQ ID NO: 2362405 - RNA, 21 nt, Bordetella pertussis
cgcuccuccccaacggggacg

SEQ ID NO: 2362406 - RNA, 17 nt, Bordetella pertussis
cgcuccucgcgcgcgga

SEQ ID NO: 2362407 - RNA, 20 nt, Bordetella pertussis
cgcuccugcucggcgaugcg

SEQ ID NO: 2362408 - RNA, 18 nt, Bordetella pertussis
cgcuccuucgugguggcg

SEQ ID NO: 2362409 - RNA, 17 nt, Bordetella pertussis
cgcucgaaaaagcccug

SEQ ID NO: 2362410 - RNA, 19 nt, Bordetella pertussis
cgcucgaaaaagcccugcg

SEQ ID NO: 2362411 - RNA, 23 nt, Bordetella pertussis
cgcucgaaaaagcccugcguggc

SEQ ID NO: 2362412 - RNA, 14 nt, Bordetella pertussis
cgcucgaagcgcau

SEQ ID NO: 2362413 - RNA, 15 nt, Bordetella pertussis
cgcucgaaggcgccg

SEQ ID NO: 2362414 - RNA, 16 nt, Bordetella pertussis
cgcucgaauggcugcg

SEQ ID NO: 2362415 - RNA, 21 nt, Bordetella pertussis
cgcucgaauggcugcgcgccg

SEQ ID NO: 2362416 - RNA, 19 nt, Bordetella pertussis
cgcucgaccuugucgcccg

SEQ ID NO: 2362417 - RNA, 20 nt, Bordetella pertussis
cgcucgaccuugucgcccga

SEQ ID NO: 2362418 - RNA, 21 nt, Bordetella pertussis
cgcucgaccuugucgcccgau

SEQ ID NO: 2362419 - RNA, 18 nt, Bordetella pertussis
cgcucgacgaagcccgug

SEQ ID NO: 2362420 - RNA, 23 nt, Bordetella pertussis
cgcucgacgaagcccgugucggc

SEQ ID NO: 2362421 - RNA, 18 nt, Bordetella pertussis
cgcucgagcgccugcagc

SEQ ID NO: 2362422 - RNA, 18 nt, Bordetella pertussis
cgcucgagcgcggcgcgc

SEQ ID NO: 2362423 - RNA, 16 nt, Bordetella pertussis
cgcucgaggccaggcu

SEQ ID NO: 2362424 - RNA, 20 nt, Bordetella pertussis
cgcucgaggccaggcugacc

SEQ ID NO: 2362425 - RNA, 15 nt, Bordetella pertussis
cgcucgaugcgccag

SEQ ID NO: 2362426 - RNA, 17 nt, Bordetella pertussis
cgcucgaugcgccaguc

SEQ ID NO: 2362427 - RNA, 22 nt, Bordetella pertussis
cgcucgaugcgccaguccagcg

SEQ ID NO: 2362428 - RNA, 13 nt, Bordetella pertussis
cgcucgcccagcc

SEQ ID NO: 2362429 - RNA, 16 nt, Bordetella pertussis
cgcucgcccagccgcc

SEQ ID NO: 2362430 - RNA, 17 nt, Bordetella pertussis
cgcucgcccagccgccu

SEQ ID NO: 2362431 - RNA, 13 nt, Bordetella pertussis
cgcucgcccggcc

SEQ ID NO: 2362432 - RNA, 14 nt, Bordetella pertussis
cgcucgcccggcca

SEQ ID NO: 2362433 - RNA, 17 nt, Bordetella pertussis
cgcucgcccucgcgcca

SEQ ID NO: 2362434 - RNA, 22 nt, Bordetella pertussis
cgcucgcccucgcgccaccaug

SEQ ID NO: 2362435 - RNA, 16 nt, Bordetella pertussis
cgcucgccggcgcgca

SEQ ID NO: 2362436 - RNA, 20 nt, Bordetella pertussis
cgcucgcgcaccgcaugggc

SEQ ID NO: 2362437 - RNA, 14 nt, Bordetella pertussis
cgcucgcgcaggcg

SEQ ID NO: 2362438 - RNA, 14 nt, Bordetella pertussis
cgcucgcgccaggc

SEQ ID NO: 2362439 - RNA, 16 nt, Bordetella pertussis
cgcucgcgccaggccc

SEQ ID NO: 2362440 - RNA, 17 nt, Bordetella pertussis
cgcucgcgccaggcccc

SEQ ID NO: 2362441 - RNA, 21 nt, Bordetella pertussis
cgcucgcgcccaucucggccg

SEQ ID NO: 2362442 - RNA, 16 nt, Bordetella pertussis
cgcucgcgcgaccacu

SEQ ID NO: 2362443 - RNA, 19 nt, Bordetella pertussis
cgcucgcgcgaccacuggc

SEQ ID NO: 2362444 - RNA, 17 nt, Bordetella pertussis
cgcucgcgcucggccag

SEQ ID NO: 2362445 - RNA, 18 nt, Bordetella pertussis
cgcucgcgcucggccagc

SEQ ID NO: 2362446 - RNA, 14 nt, Bordetella pertussis
cgcucgcgggugcg

SEQ ID NO: 2362447 - RNA, 15 nt, Bordetella pertussis
cgcucgcgggugcgc

SEQ ID NO: 2362448 - RNA, 17 nt, Bordetella pertussis
cgcucgcucacggggcu

SEQ ID NO: 2362449 - RNA, 12 nt, Bordetella pertussis
cgcucgcugccg

SEQ ID NO: 2362450 - RNA, 14 nt, Bordetella pertussis
cgcucgcugccggc

SEQ ID NO: 2362451 - RNA, 19 nt, Bordetella pertussis
cgcucggagggcuccaggc

SEQ ID NO: 2362452 - RNA, 21 nt, Bordetella pertussis
cgcucggagggcuccaggcug

SEQ ID NO: 2362453 - RNA, 19 nt, Bordetella pertussis
cgcucggccacgcgcugcu

SEQ ID NO: 2362454 - RNA, 13 nt, Bordetella pertussis
cgcucggccagca

SEQ ID NO: 2362455 - RNA, 16 nt, Bordetella pertussis
cgcucggccagcaugc

SEQ ID NO: 2362456 - RNA, 17 nt, Bordetella pertussis
cgcucggccagcaugcg

SEQ ID NO: 2362457 - RNA, 13 nt, Bordetella pertussis
cgcucggccagcg

SEQ ID NO: 2362458 - RNA, 18 nt, Bordetella pertussis
cgcucggccagcgaggcc

SEQ ID NO: 2362459 - RNA, 14 nt, Bordetella pertussis
cgcucggccagcgc

SEQ ID NO: 2362460 - RNA, 21 nt, Bordetella pertussis
cgcucggccagcgcgcggccg

SEQ ID NO: 2362461 - RNA, 18 nt, Bordetella pertussis
cgcucggccucggucagg

SEQ ID NO: 2362462 - RNA, 15 nt, Bordetella pertussis
cgcucggccuugccg

SEQ ID NO: 2362463 - RNA, 18 nt, Bordetella pertussis
cgcucggcgacggucagg

SEQ ID NO: 2362464 - RNA, 22 nt, Bordetella pertussis
cgcucggcguugcuggcaaagc

SEQ ID NO: 2362465 - RNA, 17 nt, Bordetella pertussis
cgcucggcuuccugccg

SEQ ID NO: 2362466 - RNA, 20 nt, Bordetella pertussis
cgcucggcuuccugccgcac

SEQ ID NO: 2362467 - RNA, 14 nt, Bordetella pertussis
cgcucgggcgcggc

SEQ ID NO: 2362468 - RNA, 16 nt, Bordetella pertussis
cgcucgggcucgcgcg

SEQ ID NO: 2362469 - RNA, 22 nt, Bordetella pertussis
cgcucggucauguccagcgcca

SEQ ID NO: 2362470 - RNA, 19 nt, Bordetella pertussis
cgcucgguguggauggcgg

SEQ ID NO: 2362471 - RNA, 20 nt, Bordetella pertussis
cgcucgucaugaucccgcgc

SEQ ID NO: 2362472 - RNA, 16 nt, Bordetella pertussis
cgcucguugcgcguga

SEQ ID NO: 2362473 - RNA, 17 nt, Bordetella pertussis
cgcucuacacggccgcc

SEQ ID NO: 2362474 - RNA, 18 nt, Bordetella pertussis
cgcucuacacggccgcca

SEQ ID NO: 2362475 - RNA, 21 nt, Bordetella pertussis
cgcucuacacggccgccaccu

SEQ ID NO: 2362476 - RNA, 19 nt, Bordetella pertussis
cgcucuccgaacaggcggu

SEQ ID NO: 2362477 - RNA, 15 nt, Bordetella pertussis
cgcucuugagcgcgg

SEQ ID NO: 2362478 - RNA, 17 nt, Bordetella pertussis
cgcucuugagcgcggcc

SEQ ID NO: 2362479 - RNA, 20 nt, Bordetella pertussis
cgcucuugagcgcggccucg

SEQ ID NO: 2362480 - RNA, 15 nt, Bordetella pertussis
cgcucuuggcgugcu

SEQ ID NO: 2362481 - RNA, 14 nt, Bordetella pertussis
cgcugaacgaaucg

SEQ ID NO: 2362482 - RNA, 14 nt, Bordetella pertussis
cgcugaagcgccgc

SEQ ID NO: 2362483 - RNA, 16 nt, Bordetella pertussis
cgcugaagcgccgcca

SEQ ID NO: 2362484 - RNA, 18 nt, Bordetella pertussis
cgcugaagcgccgccaca

SEQ ID NO: 2362485 - RNA, 22 nt, Bordetella pertussis
cgcugaauccggggugccuguc

SEQ ID NO: 2362486 - RNA, 13 nt, Bordetella pertussis
cgcugacagcgcu

SEQ ID NO: 2362487 - RNA, 15 nt, Bordetella pertussis
cgcugaccagcacga

SEQ ID NO: 2362488 - RNA, 15 nt, Bordetella pertussis
cgcugacccuggccg

SEQ ID NO: 2362489 - RNA, 16 nt, Bordetella pertussis
cgcugacccuggccga

SEQ ID NO: 2362490 - RNA, 14 nt, Bordetella pertussis
cgcugaccggccug

SEQ ID NO: 2362491 - RNA, 15 nt, Bordetella pertussis
cgcugaccggccugg

SEQ ID NO: 2362492 - RNA, 13 nt, Bordetella pertussis
cgcugaccggcgg

SEQ ID NO: 2362493 - RNA, 14 nt, Bordetella pertussis
cgcugaccggcggc

SEQ ID NO: 2362494 - RNA, 19 nt, Bordetella pertussis
cgcugaccggcggcacggc

SEQ ID NO: 2362495 - RNA, 21 nt, Bordetella pertussis
cgcugaccggcggcacggccg

SEQ ID NO: 2362496 - RNA, 13 nt, Bordetella pertussis
cgcugaccggcgu

SEQ ID NO: 2362497 - RNA, 20 nt, Bordetella pertussis
cgcugaccugcacgauggcg

SEQ ID NO: 2362498 - RNA, 19 nt, Bordetella pertussis
cgcugaccuggugugccug

SEQ ID NO: 2362499 - RNA, 20 nt, Bordetella pertussis
cgcugaccuggugugccugu

SEQ ID NO: 2362500 - RNA, 21 nt, Bordetella pertussis
cgcugaccuggugugccuguc

SEQ ID NO: 2362501 - RNA, 19 nt, Bordetella pertussis
cgcugacugcggugccugu

SEQ ID NO: 2362502 - RNA, 14 nt, Bordetella pertussis
cgcugacugggcgg

SEQ ID NO: 2362503 - RNA, 23 nt, Bordetella pertussis
cgcugacuuccggggagccugcc

SEQ ID NO: 2362504 - RNA, 14 nt, Bordetella pertussis
cgcugauccuggcu

SEQ ID NO: 2362505 - RNA, 18 nt, Bordetella pertussis
cgcugauccuggcucuga

SEQ ID NO: 2362506 - RNA, 14 nt, Bordetella pertussis
cgcugaucgccggc

SEQ ID NO: 2362507 - RNA, 16 nt, Bordetella pertussis
cgcugaucgccggcgc

SEQ ID NO: 2362508 - RNA, 13 nt, Bordetella pertussis
cgcugaucggccg

SEQ ID NO: 2362509 - RNA, 16 nt, Bordetella pertussis
cgcugaucuuccuggg

SEQ ID NO: 2362510 - RNA, 18 nt, Bordetella pertussis
cgcugaugcccagcccgg

SEQ ID NO: 2362511 - RNA, 16 nt, Bordetella pertussis
cgcugaugcgcggcgg

SEQ ID NO: 2362512 - RNA, 16 nt, Bordetella pertussis
cgcugaugcgcgucag

SEQ ID NO: 2362513 - RNA, 13 nt, Bordetella pertussis
cgcugaugcuggc

SEQ ID NO: 2362514 - RNA, 17 nt, Bordetella pertussis
cgcugauggccgccagc

SEQ ID NO: 2362515 - RNA, 18 nt, Bordetella pertussis
cgcugauggccgccagcg

SEQ ID NO: 2362516 - RNA, 14 nt, Bordetella pertussis
cgcugcugucgcgc

SEQ ID NO: 2362517 - RNA, 21 nt, Bordetella pertussis
cgcuggaaacuaaaucgcggc

SEQ ID NO: 2362518 - RNA, 24 nt, Bordetella pertussis
cgcuggaaacuaaaucgcggcucg

SEQ ID NO: 2362519 - RNA, 16 nt, Bordetella pertussis
cgcuggaagacguggc

SEQ ID NO: 2362520 - RNA, 18 nt, Bordetella pertussis
cgcuggaagacguggccc

SEQ ID NO: 2362521 - RNA, 21 nt, Bordetella pertussis
cgcuggaagacguggcccgcg

SEQ ID NO: 2362522 - RNA, 19 nt, Bordetella pertussis
cgcuggaauauggcguccg

SEQ ID NO: 2362523 - RNA, 21 nt, Bordetella pertussis
cgcuggacagauccagcgcgg

SEQ ID NO: 2362524 - RNA, 22 nt, Bordetella pertussis
cgcuggacagauccagcgcggc

SEQ ID NO: 2362525 - RNA, 22 nt, Bordetella pertussis
cgcuggacaugggcaagccgau

SEQ ID NO: 2362526 - RNA, 18 nt, Bordetella pertussis
cgcuggaccgggaauggc

SEQ ID NO: 2362527 - RNA, 16 nt, Bordetella pertussis
cgcuggacgcccuggc

SEQ ID NO: 2362528 - RNA, 13 nt, Bordetella pertussis
cgcuggacgcgcc

SEQ ID NO: 2362529 - RNA, 14 nt, Bordetella pertussis
cgcuggacgcgccg

SEQ ID NO: 2362530 - RNA, 17 nt, Bordetella pertussis
cgcuggagaacaggcgg

SEQ ID NO: 2362531 - RNA, 18 nt, Bordetella pertussis
cgcuggagaacaggcggc

SEQ ID NO: 2362532 - RNA, 16 nt, Bordetella pertussis
cgcuggagaccggcau

SEQ ID NO: 2362533 - RNA, 17 nt, Bordetella pertussis
cgcuggagaccggcaug

SEQ ID NO: 2362534 - RNA, 18 nt, Bordetella pertussis
cgcuggagaccggcaugg

SEQ ID NO: 2362535 - RNA, 19 nt, Bordetella pertussis
cgcuggagauggcgccgau

SEQ ID NO: 2362536 - RNA, 15 nt, Bordetella pertussis
cgcuggagcgcggcg

SEQ ID NO: 2362537 - RNA, 18 nt, Bordetella pertussis
cgcuggagcgcggcggcg

SEQ ID NO: 2362538 - RNA, 13 nt, Bordetella pertussis
cgcuggaggccuu

SEQ ID NO: 2362539 - RNA, 21 nt, Bordetella pertussis
cgcuggauggucacgcccagg

SEQ ID NO: 2362540 - RNA, 21 nt, Bordetella pertussis
cgcuggccagccgcucgcgcg

SEQ ID NO: 2362541 - RNA, 23 nt, Bordetella pertussis
cgcuggccaucaccgccuccggg

SEQ ID NO: 2362542 - RNA, 12 nt, Bordetella pertussis
cgcuggccaucg

SEQ ID NO: 2362543 - RNA, 13 nt, Bordetella pertussis
cgcuggccaugcc

SEQ ID NO: 2362544 - RNA, 21 nt, Bordetella pertussis
cgcuggcccacucggugcgcg

SEQ ID NO: 2362545 - RNA, 20 nt, Bordetella pertussis
cgcuggcccaguucgcgcag

SEQ ID NO: 2362546 - RNA, 12 nt, Bordetella pertussis
cgcuggcccggg

SEQ ID NO: 2362547 - RNA, 19 nt, Bordetella pertussis
cgcuggccgccauggcgcu

SEQ ID NO: 2362548 - RNA, 20 nt, Bordetella pertussis
cgcuggccgccauggcgcug

SEQ ID NO: 2362549 - RNA, 13 nt, Bordetella pertussis
cgcuggccgcccg

SEQ ID NO: 2362550 - RNA, 14 nt, Bordetella pertussis
cgcuggccgcccgc

SEQ ID NO: 2362551 - RNA, 20 nt, Bordetella pertussis
cgcuggccgcgcuggcggcg

SEQ ID NO: 2362552 - RNA, 19 nt, Bordetella pertussis
cgcuggccggacgcaaccg

SEQ ID NO: 2362553 - RNA, 12 nt, Bordetella pertussis
cgcuggccggcc

SEQ ID NO: 2362554 - RNA, 14 nt, Bordetella pertussis
cgcuggccggccgc

SEQ ID NO: 2362555 - RNA, 17 nt, Bordetella pertussis
cgcuggccggccgcgug

SEQ ID NO: 2362556 - RNA, 13 nt, Bordetella pertussis
cgcuggccggcgu

SEQ ID NO: 2362557 - RNA, 13 nt, Bordetella pertussis
cgcuggccgucgc

SEQ ID NO: 2362558 - RNA, 16 nt, Bordetella pertussis
cgcuggccugccgcgc

SEQ ID NO: 2362559 - RNA, 15 nt, Bordetella pertussis
cgcuggccuggccgc

SEQ ID NO: 2362560 - RNA, 17 nt, Bordetella pertussis
cgcuggccuggccgccg

SEQ ID NO: 2362561 - RNA, 20 nt, Bordetella pertussis
cgcuggcgaagaacaccgcc

SEQ ID NO: 2362562 - RNA, 14 nt, Bordetella pertussis
cgcuggcgaucagg

SEQ ID NO: 2362563 - RNA, 20 nt, Bordetella pertussis
cgcuggcgaugcccaccagc

SEQ ID NO: 2362564 - RNA, 19 nt, Bordetella pertussis
cgcuggcgaugcgggccac

SEQ ID NO: 2362565 - RNA, 18 nt, Bordetella pertussis
cgcuggcgauggccugau

SEQ ID NO: 2362566 - RNA, 16 nt, Bordetella pertussis
cgcuggcgcaaggacg

SEQ ID NO: 2362567 - RNA, 13 nt, Bordetella pertussis
cgcuggcgcagca

SEQ ID NO: 2362568 - RNA, 14 nt, Bordetella pertussis
cgcuggcgcagcag

SEQ ID NO: 2362569 - RNA, 16 nt, Bordetella pertussis
cgcuggcgcagcaggc

SEQ ID NO: 2362570 - RNA, 18 nt, Bordetella pertussis
cgcuggcgcccgccugcg

SEQ ID NO: 2362571 - RNA, 15 nt, Bordetella pertussis
cgcuggcgcccggcc

SEQ ID NO: 2362572 - RNA, 22 nt, Bordetella pertussis
cgcuggcgcccggccugcgggc

SEQ ID NO: 2362573 - RNA, 17 nt, Bordetella pertussis
cgcuggcgccgcgcgcc

SEQ ID NO: 2362574 - RNA, 17 nt, Bordetella pertussis
cgcuggcgcgagaacca

SEQ ID NO: 2362575 - RNA, 23 nt, Bordetella pertussis
cgcuggcgcgagaaccaggccac

SEQ ID NO: 2362576 - RNA, 12 nt, Bordetella pertussis
cgcuggcgcgcc

SEQ ID NO: 2362577 - RNA, 19 nt, Bordetella pertussis
cgcuggcgcgcgacggcgc

SEQ ID NO: 2362578 - RNA, 20 nt, Bordetella pertussis
cgcuggcgcgcgacggcgcc

SEQ ID NO: 2362579 - RNA, 17 nt, Bordetella pertussis
cgcuggcgcgcggccgc

SEQ ID NO: 2362580 - RNA, 18 nt, Bordetella pertussis
cgcuggcgcgcggccgcg

SEQ ID NO: 2362581 - RNA, 15 nt, Bordetella pertussis
cgcuggcgcgcggcu

SEQ ID NO: 2362582 - RNA, 12 nt, Bordetella pertussis
cgcuggcgcgcu

SEQ ID NO: 2362583 - RNA, 15 nt, Bordetella pertussis
cgcuggcgcgucugg

SEQ ID NO: 2362584 - RNA, 17 nt, Bordetella pertussis
cgcuggcgcucgggcgc

SEQ ID NO: 2362585 - RNA, 20 nt, Bordetella pertussis
cgcuggcgcucgggcgcggc

SEQ ID NO: 2362586 - RNA, 13 nt, Bordetella pertussis
cgcuggcgcuggc

SEQ ID NO: 2362587 - RNA, 18 nt, Bordetella pertussis
cgcuggcgcuggccgccc

SEQ ID NO: 2362588 - RNA, 22 nt, Bordetella pertussis
cgcuggcggaccgaacggccgg

SEQ ID NO: 2362589 - RNA, 22 nt, Bordetella pertussis
cgcuggcggccgcgggcgugcu

SEQ ID NO: 2362590 - RNA, 19 nt, Bordetella pertussis
cgcuggcggcgcaggccgc

SEQ ID NO: 2362591 - RNA, 20 nt, Bordetella pertussis
cgcuggcggcgcaggccgcg

SEQ ID NO: 2362592 - RNA, 18 nt, Bordetella pertussis
cgcuggcgguggccgcgc

SEQ ID NO: 2362593 - RNA, 19 nt, Bordetella pertussis
cgcuggcgguggccgcgca

SEQ ID NO: 2362594 - RNA, 11 nt, Bordetella pertussis
cgcuggcgucc

SEQ ID NO: 2362595 - RNA, 20 nt, Bordetella pertussis
cgcuggcguccagccugccc

SEQ ID NO: 2362596 - RNA, 21 nt, Bordetella pertussis
cgcuggcguugacguggcuga

SEQ ID NO: 2362597 - RNA, 14 nt, Bordetella pertussis
cgcuggcuggacgc

SEQ ID NO: 2362598 - RNA, 22 nt, Bordetella pertussis
cgcuggcuggacgcgcgcggcg

SEQ ID NO: 2362599 - RNA, 23 nt, Bordetella pertussis
cgcuggcuggacgcgcgcggcga

SEQ ID NO: 2362600 - RNA, 13 nt, Bordetella pertussis
cgcuggcugggcc

SEQ ID NO: 2362601 - RNA, 14 nt, Bordetella pertussis
cgcuggcugggccu

SEQ ID NO: 2362602 - RNA, 17 nt, Bordetella pertussis
cgcuggcugggccugcu

SEQ ID NO: 2362603 - RNA, 18 nt, Bordetella pertussis
cgcuggcugggccugcug

SEQ ID NO: 2362604 - RNA, 14 nt, Bordetella pertussis
cgcuggcuucggcg

SEQ ID NO: 2362605 - RNA, 18 nt, Bordetella pertussis
cgcuggcuucggcguacu

SEQ ID NO: 2362606 - RNA, 18 nt, Bordetella pertussis
cgcuggcuucgucgccgg

SEQ ID NO: 2362607 - RNA, 13 nt, Bordetella pertussis
cgcugggacaggc

SEQ ID NO: 2362608 - RNA, 15 nt, Bordetella pertussis
cgcugggacaggcac

SEQ ID NO: 2362609 - RNA, 20 nt, Bordetella pertussis
cgcugggacaggcacaccgu

SEQ ID NO: 2362610 - RNA, 21 nt, Bordetella pertussis
cgcugggauggguacgccggc

SEQ ID NO: 2362611 - RNA, 18 nt, Bordetella pertussis
cgcugggcacauccagcg

SEQ ID NO: 2362612 - RNA, 18 nt, Bordetella pertussis
cgcugggcaggcuggcgc

SEQ ID NO: 2362613 - RNA, 14 nt, Bordetella pertussis
cgcugggcaugggc

SEQ ID NO: 2362614 - RNA, 23 nt, Bordetella pertussis
cgcugggcaugggcggcccggcc

SEQ ID NO: 2362615 - RNA, 19 nt, Bordetella pertussis
cgcugggccagaccgcgcg

SEQ ID NO: 2362616 - RNA, 16 nt, Bordetella pertussis
cgcugggccagcaucg

SEQ ID NO: 2362617 - RNA, 18 nt, Bordetella pertussis
cgcugggccagcaucggc

SEQ ID NO: 2362618 - RNA, 17 nt, Bordetella pertussis
cgcugggccaggccggc

SEQ ID NO: 2362619 - RNA, 18 nt, Bordetella pertussis
cgcugggccaggccggcc

SEQ ID NO: 2362620 - RNA, 22 nt, Bordetella pertussis
cgcugggcgcauuggcccugcu

SEQ ID NO: 2362621 - RNA, 17 nt, Bordetella pertussis
cgcugggcgccagcagc

SEQ ID NO: 2362622 - RNA, 21 nt, Bordetella pertussis
cgcugggcgccagcagcacgu

SEQ ID NO: 2362623 - RNA, 15 nt, Bordetella pertussis
cgcugggcgcgcaca

SEQ ID NO: 2362624 - RNA, 20 nt, Bordetella pertussis
cgcugggcgguugcgcugcu

SEQ ID NO: 2362625 - RNA, 16 nt, Bordetella pertussis
cgcugggcguggcgcg

SEQ ID NO: 2362626 - RNA, 17 nt, Bordetella pertussis
cgcugggcguggcgcgc

SEQ ID NO: 2362627 - RNA, 14 nt, Bordetella pertussis
cgcugggcuacgac

SEQ ID NO: 2362628 - RNA, 18 nt, Bordetella pertussis
cgcugggcuacgacccgc

SEQ ID NO: 2362629 - RNA, 19 nt, Bordetella pertussis
cgcuuggcccugcagcggc

SEQ ID NO: 2362630 - RNA, 20 nt, Bordetella pertussis
cgcuuggccugcgccaccgc

SEQ ID NO: 2362631 - RNA, 18 nt, Bordetella pertussis
cgcuuggcguagccggaa

SEQ ID NO: 2362632 - RNA, 12 nt, Bordetella pertussis
cgcuugggccgc

SEQ ID NO: 2362633 - RNA, 20 nt, Bordetella pertussis
cgcuugggccgcgccugcag

SEQ ID NO: 2362634 - RNA, 22 nt, Bordetella pertussis
cgcuuggucagcaucagcagac

SEQ ID NO: 2362635 - RNA, 15 nt, Bordetella pertussis
cgcuugucgaugacg

SEQ ID NO: 2362636 - RNA, 16 nt, Bordetella pertussis
cgcuugucgaugacgc

SEQ ID NO: 2362637 - RNA, 21 nt, Bordetella pertussis
cgcuugucgaugacgcgccgc

SEQ ID NO: 2362638 - RNA, 15 nt, Bordetella pertussis
cgcuugugcgucggc

SEQ ID NO: 2362639 - RNA, 16 nt, Bordetella pertussis
cgcuuucgaccagcga

SEQ ID NO: 2362640 - RNA, 19 nt, Bordetella pertussis
cgcuuucggggcgcaagau

SEQ ID NO: 2362641 - RNA, 15 nt, Bordetella pertussis
cgcuuucucccgccg

SEQ ID NO: 2362642 - RNA, 15 nt, Bordetella pertussis
cgcuuugaacgauuc

SEQ ID NO: 2362643 - RNA, 19 nt, Bordetella pertussis
cgcuuuuccccgcccagcg

SEQ ID NO: 2362644 - RNA, 17 nt, Bordetella pertussis
cggaaacacguccagcg

SEQ ID NO: 2362645 - RNA, 22 nt, Bordetella pertussis
cggaaacacguccagcgccgcg

SEQ ID NO: 2362646 - RNA, 19 nt, Bordetella pertussis
cggaaacccuucgcgcagc

SEQ ID NO: 2362647 - RNA, 23 nt, Bordetella pertussis
cggaaagcuggcguucgucgccu

SEQ ID NO: 2362648 - RNA, 15 nt, Bordetella pertussis
cggaaauccgggcgc

SEQ ID NO: 2362649 - RNA, 20 nt, Bordetella pertussis
cggaaauccgggcgcugcgc

SEQ ID NO: 2362650 - RNA, 19 nt, Bordetella pertussis
cggaaauccuagucaugcg

SEQ ID NO: 2362651 - RNA, 12 nt, Bordetella pertussis
cggaacaccagc

SEQ ID NO: 2362652 - RNA, 16 nt, Bordetella pertussis
cggaacaccagcaagc

SEQ ID NO: 2362653 - RNA, 22 nt, Bordetella pertussis
cggaacaccagcaagccggcgg

SEQ ID NO: 2362654 - RNA, 19 nt, Bordetella pertussis
cggaacagcguccagccgc

SEQ ID NO: 2362655 - RNA, 16 nt, Bordetella pertussis
cggaacgugccgucgg

SEQ ID NO: 2362656 - RNA, 21 nt, Bordetella pertussis
cggaacgugccgucgggcgcc

SEQ ID NO: 2362657 - RNA, 19 nt, Bordetella pertussis
cggaagacauggcgcgcgc

SEQ ID NO: 2362658 - RNA, 21 nt, Bordetella pertussis
cggaagacauggcgcgcgcca

SEQ ID NO: 2362659 - RNA, 23 nt, Bordetella pertussis
cggaagacauggcgcgcgccagc

SEQ ID NO: 2362660 - RNA, 16 nt, Bordetella pertussis
cggaagucgggcacca

SEQ ID NO: 2362661 - RNA, 18 nt, Bordetella pertussis
cggaagucgggcaccagc

SEQ ID NO: 2362662 - RNA, 21 nt, Bordetella pertussis
cggaauccacagcuggugccg

SEQ ID NO: 2362663 - RNA, 13 nt, Bordetella pertussis
cggaauccuggcg

SEQ ID NO: 2362664 - RNA, 17 nt, Bordetella pertussis
cggaauccuggcgacgg

SEQ ID NO: 2362665 - RNA, 18 nt, Bordetella pertussis
cggaauccuggcgacggc

SEQ ID NO: 2362666 - RNA, 21 nt, Bordetella pertussis
cggaauccuggcgacggccug

SEQ ID NO: 2362667 - RNA, 23 nt, Bordetella pertussis
cggaaugcggcgacagggcgucg

SEQ ID NO: 2362668 - RNA, 14 nt, Bordetella pertussis
cggaauggucaagc

SEQ ID NO: 2362669 - RNA, 17 nt, Bordetella pertussis
cggaauggucaagcggc

SEQ ID NO: 2362670 - RNA, 18 nt, Bordetella pertussis
cggaauggucaagcggcu

SEQ ID NO: 2362671 - RNA, 23 nt, Bordetella pertussis
cggaaugucguugcacagcacgu

SEQ ID NO: 2362672 - RNA, 15 nt, Bordetella pertussis
cggacaacgccagga

SEQ ID NO: 2362673 - RNA, 16 nt, Bordetella pertussis
cggacaacgcgcgcca

SEQ ID NO: 2362674 - RNA, 18 nt, Bordetella pertussis
cggacacgcaugcaggua

SEQ ID NO: 2362675 - RNA, 17 nt, Bordetella pertussis
cggacacguacaaccgc

SEQ ID NO: 2362676 - RNA, 18 nt, Bordetella pertussis
cggacagaugccguccug

SEQ ID NO: 2362677 - RNA, 15 nt, Bordetella pertussis
cggacagcccgcgcu

SEQ ID NO: 2362678 - RNA, 16 nt, Bordetella pertussis
cggacagggccccggc

SEQ ID NO: 2362679 - RNA, 18 nt, Bordetella pertussis
cggacagggccgcgagca

SEQ ID NO: 2362680 - RNA, 20 nt, Bordetella pertussis
cggacagggccgcgagcaug

SEQ ID NO: 2362681 - RNA, 23 nt, Bordetella pertussis
cggacagggccgcgagcaugcgc

SEQ ID NO: 2362682 - RNA, 15 nt, Bordetella pertussis
cggacaggucggcgc

SEQ ID NO: 2362683 - RNA, 16 nt, Bordetella pertussis
cggacaggucggcgcc

SEQ ID NO: 2362684 - RNA, 23 nt, Bordetella pertussis
cggaccagcgguugcgccagcuu

SEQ ID NO: 2362685 - RNA, 16 nt, Bordetella pertussis
cggaccagggcucgua

SEQ ID NO: 2362686 - RNA, 22 nt, Bordetella pertussis
cggacccaggccucggcuugca

SEQ ID NO: 2362687 - RNA, 13 nt, Bordetella pertussis
cggacccaguucg

SEQ ID NO: 2362688 - RNA, 13 nt, Bordetella pertussis
cggacccgcgccg

SEQ ID NO: 2362689 - RNA, 14 nt, Bordetella pertussis
cggacccgcgccgc

SEQ ID NO: 2362690 - RNA, 17 nt, Bordetella pertussis
cggacccgcgccgcagg

SEQ ID NO: 2362691 - RNA, 18 nt, Bordetella pertussis
cggacccgcgccgcaggc

SEQ ID NO: 2362692 - RNA, 15 nt, Bordetella pertussis
cggaccggugcccuc

SEQ ID NO: 2362693 - RNA, 15 nt, Bordetella pertussis
cggaccguuccagac

SEQ ID NO: 2362694 - RNA, 16 nt, Bordetella pertussis
cggaccuccugguccg

SEQ ID NO: 2362695 - RNA, 16 nt, Bordetella pertussis
cggaccugcucgagcg

SEQ ID NO: 2362696 - RNA, 18 nt, Bordetella pertussis
cggaccuggccagcgugg

SEQ ID NO: 2362697 - RNA, 20 nt, Bordetella pertussis
cggaccuugcgaggcccggc

SEQ ID NO: 2362698 - RNA, 23 nt, Bordetella pertussis
cggaccuugcgaggcccggccug

SEQ ID NO: 2362699 - RNA, 15 nt, Bordetella pertussis
cggacgaagccuagg

SEQ ID NO: 2362700 - RNA, 15 nt, Bordetella pertussis
cggacgagcgcagca

SEQ ID NO: 2362701 - RNA, 21 nt, Bordetella pertussis
cggacgagcgcagcaagcugc

SEQ ID NO: 2362702 - RNA, 12 nt, Bordetella pertussis
cggacgauggcc

SEQ ID NO: 2362703 - RNA, 16 nt, Bordetella pertussis
cggacgauggccugug

SEQ ID NO: 2362704 - RNA, 21 nt, Bordetella pertussis
cggacgauggccugugcggcc

SEQ ID NO: 2362705 - RNA, 19 nt, Bordetella pertussis
cggacgauguagaucuggc

SEQ ID NO: 2362706 - RNA, 21 nt, Bordetella pertussis
cggacgcaaaaacgcccggcg

SEQ ID NO: 2362707 - RNA, 23 nt, Bordetella pertussis
cggacgcaaaaacgcccggcgcg

SEQ ID NO: 2362708 - RNA, 12 nt, Bordetella pertussis
cggacgccagcc

SEQ ID NO: 2362709 - RNA, 16 nt, Bordetella pertussis
cggacgccagcccugg

SEQ ID NO: 2362710 - RNA, 19 nt, Bordetella pertussis
cggacgccauggcggcggc

SEQ ID NO: 2362711 - RNA, 13 nt, Bordetella pertussis
cggacgcccugaa

SEQ ID NO: 2362712 - RNA, 15 nt, Bordetella pertussis
cggacgcccugaacu

SEQ ID NO: 2362713 - RNA, 21 nt, Bordetella pertussis
cggacgcccugaacuauggcg

SEQ ID NO: 2362714 - RNA, 15 nt, Bordetella pertussis
cggacgccgacuggg

SEQ ID NO: 2362715 - RNA, 11 nt, Bordetella pertussis
cggacgcgcgc

SEQ ID NO: 2362716 - RNA, 12 nt, Bordetella pertussis
cggacgcgcgcc

SEQ ID NO: 2362717 - RNA, 20 nt, Bordetella pertussis
cggacgcgcgccgcaucaug

SEQ ID NO: 2362718 - RNA, 14 nt, Bordetella pertussis
cggacgcggccggc

SEQ ID NO: 2362719 - RNA, 16 nt, Bordetella pertussis
cggacgcggggauggc

SEQ ID NO: 2362720 - RNA, 12 nt, Bordetella pertussis
cggacggcgccu

SEQ ID NO: 2362721 - RNA, 15 nt, Bordetella pertussis
cggacggcgggcgcc

SEQ ID NO: 2362722 - RNA, 16 nt, Bordetella pertussis
cggacggcgggcgccc

SEQ ID NO: 2362723 - RNA, 17 nt, Bordetella pertussis
cggacgggccaggccga

SEQ ID NO: 2362724 - RNA, 23 nt, Bordetella pertussis
cggacggguaucgucgaccugga

SEQ ID NO: 2362725 - RNA, 18 nt, Bordetella pertussis
cggacguagucgcacgcg

SEQ ID NO: 2362726 - RNA, 15 nt, Bordetella pertussis
cggacgugggcgccu

SEQ ID NO: 2362727 - RNA, 23 nt, Bordetella pertussis
cggacugaacgcguccaggcccu

SEQ ID NO: 2362728 - RNA, 19 nt, Bordetella pertussis
cggacuggauauggcgccg

SEQ ID NO: 2362729 - RNA, 21 nt, Bordetella pertussis
cggacuggauauggcgccgca

SEQ ID NO: 2362730 - RNA, 22 nt, Bordetella pertussis
cggacuggauauggcgccgcac

SEQ ID NO: 2362731 - RNA, 24 nt, Bordetella pertussis
cggacuggauauggcgccgcacau

SEQ ID NO: 2362732 - RNA, 14 nt, Bordetella pertussis
cggacuggccgcgc

SEQ ID NO: 2362733 - RNA, 17 nt, Bordetella pertussis
cggacuggccgcgccgc

SEQ ID NO: 2362734 - RNA, 20 nt, Bordetella pertussis
cggacuggccgcgccgcugg

SEQ ID NO: 2362735 - RNA, 14 nt, Bordetella pertussis
cggacuggcgcgca

SEQ ID NO: 2362736 - RNA, 17 nt, Bordetella pertussis
cggacuggcgcgcacca

SEQ ID NO: 2362737 - RNA, 17 nt, Bordetella pertussis
cggacuggcuggucagg

SEQ ID NO: 2362738 - RNA, 21 nt, Bordetella pertussis
cggacuggcuggucaggcggu

SEQ ID NO: 2362739 - RNA, 21 nt, Bordetella pertussis
cggacuucgcuuucgguggcg

SEQ ID NO: 2362740 - RNA, 20 nt, Bordetella pertussis
cggagaaagaagcccccgcg

SEQ ID NO: 2362741 - RNA, 13 nt, Bordetella pertussis
cggauuggcgcug

SEQ ID NO: 2362742 - RNA, 19 nt, Bordetella pertussis
cggauuguuuaucaggcag

SEQ ID NO: 2362743 - RNA, 19 nt, Bordetella pertussis
cggcaaaaaaaaccgcgcg

SEQ ID NO: 2362744 - RNA, 22 nt, Bordetella pertussis
cggcaaaaaaaaccgcgcgccg

SEQ ID NO: 2362745 - RNA, 17 nt, Bordetella pertussis
cggcaaacccggcaauc

SEQ ID NO: 2362746 - RNA, 18 nt, Bordetella pertussis
cggcaaacggcuggacgu

SEQ ID NO: 2362747 - RNA, 17 nt, Bordetella pertussis
cggcaaacuuccccgcg

SEQ ID NO: 2362748 - RNA, 15 nt, Bordetella pertussis
cggcaaagaucaccu

SEQ ID NO: 2362749 - RNA, 15 nt, Bordetella pertussis
cggcaaagucggggc

SEQ ID NO: 2362750 - RNA, 17 nt, Bordetella pertussis
cggcaacaucuccacca

SEQ ID NO: 2362751 - RNA, 18 nt, Bordetella pertussis
cggcaacccgcccacgcg

SEQ ID NO: 2362752 - RNA, 21 nt, Bordetella pertussis
cggcaacccgcccacgcggcg

SEQ ID NO: 2362753 - RNA, 22 nt, Bordetella pertussis
cggcaacccgcccacgcggcgc

SEQ ID NO: 2362754 - RNA, 15 nt, Bordetella pertussis
cggcaaccgcgccuc

SEQ ID NO: 2362755 - RNA, 15 nt, Bordetella pertussis
cggcaaccgucgcca

SEQ ID NO: 2362756 - RNA, 19 nt, Bordetella pertussis
cggcaaccgucgccagcgc

SEQ ID NO: 2362757 - RNA, 16 nt, Bordetella pertussis
cggcaaccugcacgcg

SEQ ID NO: 2362758 - RNA, 18 nt, Bordetella pertussis
cggcaaccugcacgcggg

SEQ ID NO: 2362759 - RNA, 22 nt, Bordetella pertussis
cggcaaccugcacgcgggcgcu

SEQ ID NO: 2362760 - RNA, 20 nt, Bordetella pertussis
cggcaacgccggccauggcg

SEQ ID NO: 2362761 - RNA, 15 nt, Bordetella pertussis
cggcaacgugcaggc

SEQ ID NO: 2362762 - RNA, 13 nt, Bordetella pertussis
cggcaagaagauc

SEQ ID NO: 2362763 - RNA, 15 nt, Bordetella pertussis
cggcaagacggcgcu

SEQ ID NO: 2362764 - RNA, 18 nt, Bordetella pertussis
cggcaagacggcgcucgg

SEQ ID NO: 2362765 - RNA, 17 nt, Bordetella pertussis
cggcaagaucgccggcu

SEQ ID NO: 2362766 - RNA, 15 nt, Bordetella pertussis
cggcaagcacgaaca

SEQ ID NO: 2362767 - RNA, 14 nt, Bordetella pertussis
cggcaagcagccgg

SEQ ID NO: 2362768 - RNA, 15 nt, Bordetella pertussis
cggcaagccgcggcg

SEQ ID NO: 2362769 - RNA, 18 nt, Bordetella pertussis
cggcaagccgcggcgguu

SEQ ID NO: 2362770 - RNA, 18 nt, Bordetella pertussis
cggcaagccuugcggccc

SEQ ID NO: 2362771 - RNA, 23 nt, Bordetella pertussis
cggcaagccuugcggcccuugcg

SEQ ID NO: 2362772 - RNA, 20 nt, Bordetella pertussis
cggcaagcgcucgccggcgc

SEQ ID NO: 2362773 - RNA, 21 nt, Bordetella pertussis
cggcaagcgcucgccggcgcg

SEQ ID NO: 2362774 - RNA, 23 nt, Bordetella pertussis
cggcaagcgcucgccggcgcgca

SEQ ID NO: 2362775 - RNA, 15 nt, Bordetella pertussis
cggcaagcggcgugg

SEQ ID NO: 2362776 - RNA, 12 nt, Bordetella pertussis
cggcaaggccgc

SEQ ID NO: 2362777 - RNA, 16 nt, Bordetella pertussis
cggcaaggggccagcc

SEQ ID NO: 2362778 - RNA, 21 nt, Bordetella pertussis
cggcaaggggccagccuggcg

SEQ ID NO: 2362779 - RNA, 15 nt, Bordetella pertussis
cggcaagggugccug

SEQ ID NO: 2362780 - RNA, 18 nt, Bordetella pertussis
cggcaagggugccugucc

SEQ ID NO: 2362781 - RNA, 19 nt, Bordetella pertussis
cggcaagggugccuguccc

SEQ ID NO: 2362782 - RNA, 20 nt, Bordetella pertussis
cggcaagguagccgaugacc

SEQ ID NO: 2362783 - RNA, 17 nt, Bordetella pertussis
cggcaaggucagcagca

SEQ ID NO: 2362784 - RNA, 22 nt, Bordetella pertussis
cggcaaggucagcagcaugccu

SEQ ID NO: 2362785 - RNA, 20 nt, Bordetella pertussis
cggcaagguccaggcgcgca

SEQ ID NO: 2362786 - RNA, 18 nt, Bordetella pertussis
cggcaagucgacgcugau

SEQ ID NO: 2362787 - RNA, 23 nt, Bordetella pertussis
cggcaauaccuucugcaaggccu

SEQ ID NO: 2362788 - RNA, 21 nt, Bordetella pertussis
cggcaaucgaaaagcccgccg

SEQ ID NO: 2362789 - RNA, 16 nt, Bordetella pertussis
cggcaaucuugccgcc

SEQ ID NO: 2362790 - RNA, 17 nt, Bordetella pertussis
cggcaaucuugccgccg

SEQ ID NO: 2362791 - RNA, 19 nt, Bordetella pertussis
cggcaaucuugccgccggg

SEQ ID NO: 2362792 - RNA, 21 nt, Bordetella pertussis
cggcaaugacauccucgggcg

SEQ ID NO: 2362793 - RNA, 24 nt, Bordetella pertussis
cggcaaugacauccucgggcgacu

SEQ ID NO: 2362794 - RNA, 22 nt, Bordetella pertussis
cggcaaugccugcgcgaugcgc

SEQ ID NO: 2362795 - RNA, 15 nt, Bordetella pertussis
cggcaaugcgcgcgc

SEQ ID NO: 2362796 - RNA, 19 nt, Bordetella pertussis
cggcaaugucgcaggccgc

SEQ ID NO: 2362797 - RNA, 15 nt, Bordetella pertussis
cggcacaaccuggcg

SEQ ID NO: 2362798 - RNA, 17 nt, Bordetella pertussis
cggcacaaccuggcgcg

SEQ ID NO: 2362799 - RNA, 18 nt, Bordetella pertussis
cggcacaaccuggcgcgc

SEQ ID NO: 2362800 - RNA, 17 nt, Bordetella pertussis
cggcacaccccgggcgg

SEQ ID NO: 2362801 - RNA, 14 nt, Bordetella pertussis
cggcaccacgaccg

SEQ ID NO: 2362802 - RNA, 15 nt, Bordetella pertussis
cggcaccacgaccgg

SEQ ID NO: 2362803 - RNA, 19 nt, Bordetella pertussis
cggcaccacgaccggcucg

SEQ ID NO: 2362804 - RNA, 11 nt, Bordetella pertussis
cggcaccagcc

SEQ ID NO: 2362805 - RNA, 14 nt, Bordetella pertussis
cggcaccagccggg

SEQ ID NO: 2362806 - RNA, 15 nt, Bordetella pertussis
cggcaccagccgggc

SEQ ID NO: 2362807 - RNA, 16 nt, Bordetella pertussis
cggcaccagccgggcu

SEQ ID NO: 2362808 - RNA, 13 nt, Bordetella pertussis
cggcaccagcgcc

SEQ ID NO: 2362809 - RNA, 14 nt, Bordetella pertussis
cggcaccagcgcca

SEQ ID NO: 2362810 - RNA, 23 nt, Bordetella pertussis
cggcaccagcgccacgcccaggc

SEQ ID NO: 2362811 - RNA, 15 nt, Bordetella pertussis
cggcaccaggauccc

SEQ ID NO: 2362812 - RNA, 14 nt, Bordetella pertussis
cggcaccaucgccg

SEQ ID NO: 2362813 - RNA, 19 nt, Bordetella pertussis
cggcaccaucgccgccugc

SEQ ID NO: 2362814 - RNA, 20 nt, Bordetella pertussis
cggcaccaucguugccuggg

SEQ ID NO: 2362815 - RNA, 22 nt, Bordetella pertussis
cggcaccaucguugccugggug

SEQ ID NO: 2362816 - RNA, 14 nt, Bordetella pertussis
cggcaccaugcgca

SEQ ID NO: 2362817 - RNA, 15 nt, Bordetella pertussis
cggcaccaugcgcac

SEQ ID NO: 2362818 - RNA, 13 nt, Bordetella pertussis
cggcaccauugcc

SEQ ID NO: 2362819 - RNA, 16 nt, Bordetella pertussis
cggcaccauugccggc

SEQ ID NO: 2362820 - RNA, 17 nt, Bordetella pertussis
cggcaccauugccggcg

SEQ ID NO: 2362821 - RNA, 20 nt, Bordetella pertussis
cggcaccauugccggcgcgc

SEQ ID NO: 2362822 - RNA, 12 nt, Bordetella pertussis
cggcacccagcc

SEQ ID NO: 2362823 - RNA, 14 nt, Bordetella pertussis
cggcacccagccgg

SEQ ID NO: 2362824 - RNA, 17 nt, Bordetella pertussis
cggcacccagccggacc

SEQ ID NO: 2362825 - RNA, 19 nt, Bordetella pertussis
cggcacccgcuaccccggc

SEQ ID NO: 2362826 - RNA, 20 nt, Bordetella pertussis
cggcacccgcuaccccggca

SEQ ID NO: 2362827 - RNA, 19 nt, Bordetella pertussis
cggcaccgaggccgagugg

SEQ ID NO: 2362828 - RNA, 20 nt, Bordetella pertussis
cggcaccgaggccgaguggc

SEQ ID NO: 2362829 - RNA, 15 nt, Bordetella pertussis
cggcaccgcgcagcc

SEQ ID NO: 2362830 - RNA, 17 nt, Bordetella pertussis
cggcaccgcgcagcccg

SEQ ID NO: 2362831 - RNA, 18 nt, Bordetella pertussis
cggcaccgcgcagcccgg

SEQ ID NO: 2362832 - RNA, 21 nt, Bordetella pertussis
cggcaccgcgcagcccggcgu

SEQ ID NO: 2362833 - RNA, 15 nt, Bordetella pertussis
cggcaccucggccgg

SEQ ID NO: 2362834 - RNA, 18 nt, Bordetella pertussis
cggcaccucggccggggc

SEQ ID NO: 2362835 - RNA, 15 nt, Bordetella pertussis
cggcaccucggcgcc

SEQ ID NO: 2362836 - RNA, 16 nt, Bordetella pertussis
cggcaccucggcgccg

SEQ ID NO: 2362837 - RNA, 20 nt, Bordetella pertussis
cggcaccucggcgccgcggc

SEQ ID NO: 2362838 - RNA, 14 nt, Bordetella pertussis
cggcaccugcugcu

SEQ ID NO: 2362839 - RNA, 17 nt, Bordetella pertussis
cggcaccugcugcuuga

SEQ ID NO: 2362840 - RNA, 24 nt, Bordetella pertussis
cggcaccugcugcuugaccuuggc

SEQ ID NO: 2362841 - RNA, 13 nt, Bordetella pertussis
cggcaccugggcc

SEQ ID NO: 2362842 - RNA, 17 nt, Bordetella pertussis
cggcaccugggccuuca

SEQ ID NO: 2362843 - RNA, 17 nt, Bordetella pertussis
cggcaccuucgcgcagc

SEQ ID NO: 2362844 - RNA, 20 nt, Bordetella pertussis
cggcaccuucgcgcagcggc

SEQ ID NO: 2362845 - RNA, 21 nt, Bordetella pertussis
cggcaccuucgcgcagcggcg

SEQ ID NO: 2362846 - RNA, 21 nt, Bordetella pertussis
cggcaccuucuuccaggcgcc

SEQ ID NO: 2362847 - RNA, 22 nt, Bordetella pertussis
cggcaccuucuuccaggcgccc

SEQ ID NO: 2362848 - RNA, 19 nt, Bordetella pertussis
cggcacgaaaagccgcggc

SEQ ID NO: 2362849 - RNA, 20 nt, Bordetella pertussis
cggcacgaaaagccgcggcc

SEQ ID NO: 2362850 - RNA, 21 nt, Bordetella pertussis
cggcacgacgcugaugcccag

SEQ ID NO: 2362851 - RNA, 13 nt, Bordetella pertussis
cggcacgacggcc

SEQ ID NO: 2362852 - RNA, 16 nt, Bordetella pertussis
cggcacgacggccucc

SEQ ID NO: 2362853 - RNA, 18 nt, Bordetella pertussis
cggcacgacggccuccgc

SEQ ID NO: 2362854 - RNA, 16 nt, Bordetella pertussis
cggcagcucgcgcugc

SEQ ID NO: 2362855 - RNA, 18 nt, Bordetella pertussis
cggcagcucgcgcugcgc

SEQ ID NO: 2362856 - RNA, 22 nt, Bordetella pertussis
cggcagcugacgggucuccacg

SEQ ID NO: 2362857 - RNA, 20 nt, Bordetella pertussis
cggcagcuugaccgccucca

SEQ ID NO: 2362858 - RNA, 19 nt, Bordetella pertussis
cggcagcuugucgaucgcc

SEQ ID NO: 2362859 - RNA, 20 nt, Bordetella pertussis
cggcagcuugucgaucgcca

SEQ ID NO: 2362860 - RNA, 21 nt, Bordetella pertussis
cggcaggagccuguccccgcg

SEQ ID NO: 2362861 - RNA, 20 nt, Bordetella pertussis
cggcaggcacacgaccggcu

SEQ ID NO: 2362862 - RNA, 12 nt, Bordetella pertussis
cggcaggcccag

SEQ ID NO: 2362863 - RNA, 17 nt, Bordetella pertussis
cggcaggccccggcccg

SEQ ID NO: 2362864 - RNA, 17 nt, Bordetella pertussis
cggcaggccgcagcggg

SEQ ID NO: 2362865 - RNA, 19 nt, Bordetella pertussis
cggcaggccgcagcgggcc

SEQ ID NO: 2362866 - RNA, 20 nt, Bordetella pertussis
cggcaggccgcagcgggccc

SEQ ID NO: 2362867 - RNA, 21 nt, Bordetella pertussis
cggcaggccgcagcgggcccg

SEQ ID NO: 2362868 - RNA, 12 nt, Bordetella pertussis
cggcaggccgcg

SEQ ID NO: 2362869 - RNA, 13 nt, Bordetella pertussis
cggcaggccgcgc

SEQ ID NO: 2362870 - RNA, 14 nt, Bordetella pertussis
cggcaggccgcgcc

SEQ ID NO: 2362871 - RNA, 21 nt, Bordetella pertussis
cggcaggccgcgccacaggcg

SEQ ID NO: 2362872 - RNA, 16 nt, Bordetella pertussis
cggcaggccgcgcugc

SEQ ID NO: 2362873 - RNA, 17 nt, Bordetella pertussis
cggcaggccgcgcugcc

SEQ ID NO: 2362874 - RNA, 18 nt, Bordetella pertussis
cggcaggccgcgcugcca

SEQ ID NO: 2362875 - RNA, 19 nt, Bordetella pertussis
cggcaggccgcgcugccag

SEQ ID NO: 2362876 - RNA, 12 nt, Bordetella pertussis
cggcaggccggc

SEQ ID NO: 2362877 - RNA, 17 nt, Bordetella pertussis
cggcaggccggccagca

SEQ ID NO: 2362878 - RNA, 20 nt, Bordetella pertussis
cggcaggccggccagcaagg

SEQ ID NO: 2362879 - RNA, 21 nt, Bordetella pertussis
cggcaggccggccagcaaggg

SEQ ID NO: 2362880 - RNA, 15 nt, Bordetella pertussis
cggcaggcgccgccg

SEQ ID NO: 2362881 - RNA, 16 nt, Bordetella pertussis
cggcaggcgccgccgc

SEQ ID NO: 2362882 - RNA, 18 nt, Bordetella pertussis
cggcaggcgccgccgccc

SEQ ID NO: 2362883 - RNA, 20 nt, Bordetella pertussis
cggcaggcgccgccgcccgg

SEQ ID NO: 2362884 - RNA, 17 nt, Bordetella pertussis
cggcaggcgccggcugg

SEQ ID NO: 2362885 - RNA, 19 nt, Bordetella pertussis
cggcaggcgccggcuggca

SEQ ID NO: 2362886 - RNA, 20 nt, Bordetella pertussis
cggcaggcgccggcuggcau

SEQ ID NO: 2362887 - RNA, 14 nt, Bordetella pertussis
cggcaggcgcgagg

SEQ ID NO: 2362888 - RNA, 19 nt, Bordetella pertussis
cggcaggcgcgccagcccg

SEQ ID NO: 2362889 - RNA, 14 nt, Bordetella pertussis
cggcaggcggugcg

SEQ ID NO: 2362890 - RNA, 12 nt, Bordetella pertussis
cggcaggcuggc

SEQ ID NO: 2362891 - RNA, 15 nt, Bordetella pertussis
cggcaggcuggccgg

SEQ ID NO: 2362892 - RNA, 16 nt, Bordetella pertussis
cggcaggcuggccggc

SEQ ID NO: 2362893 - RNA, 19 nt, Bordetella pertussis
cggcaggcuggccggcgug

SEQ ID NO: 2362894 - RNA, 12 nt, Bordetella pertussis
cggcagggccag

SEQ ID NO: 2362895 - RNA, 18 nt, Bordetella pertussis
cggcagggccagcgccag

SEQ ID NO: 2362896 - RNA, 12 nt, Bordetella pertussis
cggcagggcggc

SEQ ID NO: 2362897 - RNA, 14 nt, Bordetella pertussis
cggcagggcgucgg

SEQ ID NO: 2362898 - RNA, 15 nt, Bordetella pertussis
cggcagggcgucggc

SEQ ID NO: 2362899 - RNA, 16 nt, Bordetella pertussis
cggcagggcgucggcc

SEQ ID NO: 2362900 - RNA, 22 nt, Bordetella pertussis
cggcagggcgucggccgcgccc

SEQ ID NO: 2362901 - RNA, 21 nt, Bordetella pertussis
cggcaggggcucgcgcccgag

SEQ ID NO: 2362902 - RNA, 20 nt, Bordetella pertussis
cggcagggucucggccacgg

SEQ ID NO: 2362903 - RNA, 16 nt, Bordetella pertussis
cggcaggucgaugccc

SEQ ID NO: 2362904 - RNA, 22 nt, Bordetella pertussis
cggcaggucgauggggucgggc

SEQ ID NO: 2362905 - RNA, 13 nt, Bordetella pertussis
cggcaggucgcgc

SEQ ID NO: 2362906 - RNA, 18 nt, Bordetella pertussis
cggcaggucgcgcgacgu

SEQ ID NO: 2362907 - RNA, 22 nt, Bordetella pertussis
cggcaggucggguagcugcuga

SEQ ID NO: 2362908 - RNA, 14 nt, Bordetella pertussis
cggcaggucggugc

SEQ ID NO: 2362909 - RNA, 20 nt, Bordetella pertussis
cggcaggugcacgcacggua

SEQ ID NO: 2362910 - RNA, 21 nt, Bordetella pertussis
cggcaggugcagaaaccccag

SEQ ID NO: 2362911 - RNA, 14 nt, Bordetella pertussis
cggcaggugcgcca

SEQ ID NO: 2362912 - RNA, 20 nt, Bordetella pertussis
cggcaggugcgccagcacgg

SEQ ID NO: 2362913 - RNA, 22 nt, Bordetella pertussis
cggcaggugcgucacgcacagc

SEQ ID NO: 2362914 - RNA, 19 nt, Bordetella pertussis
cggcagguucugcgcgucc

SEQ ID NO: 2362915 - RNA, 21 nt, Bordetella pertussis
cggcagguucugcgcguccug

SEQ ID NO: 2362916 - RNA, 22 nt, Bordetella pertussis
cggcagguucugcgcguccugg

SEQ ID NO: 2362917 - RNA, 23 nt, Bordetella pertussis
cggcagguucugcgcguccuggc

SEQ ID NO: 2362918 - RNA, 22 nt, Bordetella pertussis
cggcagguugaaguugcucggc

SEQ ID NO: 2362919 - RNA, 22 nt, Bordetella pertussis
cggcagugggcggugaccaugc

SEQ ID NO: 2362920 - RNA, 16 nt, Bordetella pertussis
cggcagugucaggaug

SEQ ID NO: 2362921 - RNA, 19 nt, Bordetella pertussis
cggcagugucaggaugccc

SEQ ID NO: 2362922 - RNA, 22 nt, Bordetella pertussis
cggcagugucaggaugcccugg

SEQ ID NO: 2362923 - RNA, 20 nt, Bordetella pertussis
cggcauacauccucgaugcc

SEQ ID NO: 2362924 - RNA, 20 nt, Bordetella pertussis
cggcauacgccgauggcgcg

SEQ ID NO: 2362925 - RNA, 23 nt, Bordetella pertussis
cggcauacgccgauggcgcggcc

SEQ ID NO: 2362926 - RNA, 15 nt, Bordetella pertussis
cggcauagcccaggc

SEQ ID NO: 2362927 - RNA, 18 nt, Bordetella pertussis
cggcauagcccaggccgc

SEQ ID NO: 2362928 - RNA, 19 nt, Bordetella pertussis
cggcauagcccaggccgcc

SEQ ID NO: 2362929 - RNA, 22 nt, Bordetella pertussis
cggcauaggcggcgcaggccag

SEQ ID NO: 2362930 - RNA, 21 nt, Bordetella pertussis
cggcaucaguucaggcuggcg

SEQ ID NO: 2362931 - RNA, 15 nt, Bordetella pertussis
cggcaucccugcuug

SEQ ID NO: 2362932 - RNA, 21 nt, Bordetella pertussis
cggcaucgacaugcccgccgg

SEQ ID NO: 2362933 - RNA, 19 nt, Bordetella pertussis
cggcaucgccgcgggcgaa

SEQ ID NO: 2362934 - RNA, 20 nt, Bordetella pertussis
cggcaucgcgcugacagcgc

SEQ ID NO: 2362935 - RNA, 22 nt, Bordetella pertussis
cggcaucgcgcugacagcgcuc

SEQ ID NO: 2362936 - RNA, 12 nt, Bordetella pertussis
cggcaucggcca

SEQ ID NO: 2362937 - RNA, 22 nt, Bordetella pertussis
cggcaucggccacgcugcccug

SEQ ID NO: 2362938 - RNA, 15 nt, Bordetella pertussis
cggcaucggccagca

SEQ ID NO: 2362939 - RNA, 19 nt, Bordetella pertussis
cggcaucggccauggcggu

SEQ ID NO: 2362940 - RNA, 17 nt, Bordetella pertussis
cggcaucggcgccgcgc

SEQ ID NO: 2362941 - RNA, 18 nt, Bordetella pertussis
cggcaucggcgccgcgcg

SEQ ID NO: 2362942 - RNA, 19 nt, Bordetella pertussis
cggcaucguuacacuggcc

SEQ ID NO: 2362943 - RNA, 16 nt, Bordetella pertussis
cggcaucguucaggcg

SEQ ID NO: 2362944 - RNA, 18 nt, Bordetella pertussis
cggcaucguucaggcgca

SEQ ID NO: 2362945 - RNA, 13 nt, Bordetella pertussis
cggcaucuguccg

SEQ ID NO: 2362946 - RNA, 18 nt, Bordetella pertussis
cggcaucuguccgcgccg

SEQ ID NO: 2362947 - RNA, 19 nt, Bordetella pertussis
cggcaucuguccgcgccgg

SEQ ID NO: 2362948 - RNA, 22 nt, Bordetella pertussis
cggcaucuguccgcgccgggaa

SEQ ID NO: 2362949 - RNA, 13 nt, Bordetella pertussis
cggcaucuugccu

SEQ ID NO: 2362950 - RNA, 18 nt, Bordetella pertussis
cggcaucuugccuuggcg

SEQ ID NO: 2362951 - RNA, 17 nt, Bordetella pertussis
cggcaugaagcgcagca

SEQ ID NO: 2362952 - RNA, 20 nt, Bordetella pertussis
cggcaugaccgcggacgcca

SEQ ID NO: 2362953 - RNA, 23 nt, Bordetella pertussis
cggcaugaccgcggacgccaugg

SEQ ID NO: 2362954 - RNA, 13 nt, Bordetella pertussis
cggcaugauggcc

SEQ ID NO: 2362955 - RNA, 16 nt, Bordetella pertussis
cggcaugauggcccgg

SEQ ID NO: 2362956 - RNA, 24 nt, Bordetella pertussis
cggcaugccguccacgcccagcgc

SEQ ID NO: 2362957 - RNA, 13 nt, Bordetella pertussis
cggcaugcgcaug

SEQ ID NO: 2362958 - RNA, 17 nt, Bordetella pertussis
cggcaugcgcaugcugg

SEQ ID NO: 2362959 - RNA, 21 nt, Bordetella pertussis
cggcaugcgccagccagcgca

SEQ ID NO: 2362960 - RNA, 12 nt, Bordetella pertussis
cggcauggccag

SEQ ID NO: 2362961 - RNA, 13 nt, Bordetella pertussis
cggcauggccagc

SEQ ID NO: 2362962 - RNA, 16 nt, Bordetella pertussis
cggcauggccaggaag

SEQ ID NO: 2362963 - RNA, 13 nt, Bordetella pertussis
cggcauggccggc

SEQ ID NO: 2362964 - RNA, 16 nt, Bordetella pertussis
cggcauggccggcagg

SEQ ID NO: 2362965 - RNA, 13 nt, Bordetella pertussis
cggcauggcgccg

SEQ ID NO: 2362966 - RNA, 22 nt, Bordetella pertussis
cggccagaccuugcgcgacggc

SEQ ID NO: 2362967 - RNA, 14 nt, Bordetella pertussis
cggccagagccugg

SEQ ID NO: 2362968 - RNA, 15 nt, Bordetella pertussis
cggccagagccugga

SEQ ID NO: 2362969 - RNA, 19 nt, Bordetella pertussis
cggccagaucggacgggcc

SEQ ID NO: 2362970 - RNA, 21 nt, Bordetella pertussis
cggccagaucggacgggccga

SEQ ID NO: 2362971 - RNA, 16 nt, Bordetella pertussis
cggccagcaagcgcgc

SEQ ID NO: 2362972 - RNA, 17 nt, Bordetella pertussis
cggccagcaagcgcgcc

SEQ ID NO: 2362973 - RNA, 18 nt, Bordetella pertussis
cggccagcaagcgcgcca

SEQ ID NO: 2362974 - RNA, 15 nt, Bordetella pertussis
cggccagcaccaugg

SEQ ID NO: 2362975 - RNA, 12 nt, Bordetella pertussis
cggccagcaccg

SEQ ID NO: 2362976 - RNA, 14 nt, Bordetella pertussis
cggccagcaccggc

SEQ ID NO: 2362977 - RNA, 16 nt, Bordetella pertussis
cggccagcaccggccc

SEQ ID NO: 2362978 - RNA, 19 nt, Bordetella pertussis
cggccagcaccggccgccg

SEQ ID NO: 2362979 - RNA, 15 nt, Bordetella pertussis
cggccagcacgccgg

SEQ ID NO: 2362980 - RNA, 16 nt, Bordetella pertussis
cggccagcacgccggc

SEQ ID NO: 2362981 - RNA, 19 nt, Bordetella pertussis
cggccagcacgccggcggg

SEQ ID NO: 2362982 - RNA, 20 nt, Bordetella pertussis
cggccagcacgccggcgggc

SEQ ID NO: 2362983 - RNA, 15 nt, Bordetella pertussis
cggccagcacgucau

SEQ ID NO: 2362984 - RNA, 22 nt, Bordetella pertussis
cggccagcacgucauccugggc

SEQ ID NO: 2362985 - RNA, 11 nt, Bordetella pertussis
cggccagcagc

SEQ ID NO: 2362986 - RNA, 22 nt, Bordetella pertussis
cggccagcagcacgaucgcggc

SEQ ID NO: 2362987 - RNA, 23 nt, Bordetella pertussis
cggccagcagcacgaucgcggcg

SEQ ID NO: 2362988 - RNA, 24 nt, Bordetella pertussis
cggccagcagcacgaucgcggcgc

SEQ ID NO: 2362989 - RNA, 14 nt, Bordetella pertussis
cggccagcagcgac

SEQ ID NO: 2362990 - RNA, 17 nt, Bordetella pertussis
cggccagcagcgacggc

SEQ ID NO: 2362991 - RNA, 19 nt, Bordetella pertussis
cggccagcagcgacggccc

SEQ ID NO: 2362992 - RNA, 21 nt, Bordetella pertussis
cggccagcagcgacggcccca

SEQ ID NO: 2362993 - RNA, 23 nt, Bordetella pertussis
cggccagcagcgacggccccagc

SEQ ID NO: 2362994 - RNA, 14 nt, Bordetella pertussis
cggccagcagcgcc

SEQ ID NO: 2362995 - RNA, 17 nt, Bordetella pertussis
cggccagcagcgccugg

SEQ ID NO: 2362996 - RNA, 21 nt, Bordetella pertussis
cggccagcagcgcgugcagcc

SEQ ID NO: 2362997 - RNA, 21 nt, Bordetella pertussis
cggccagcagcggcaggucgg

SEQ ID NO: 2362998 - RNA, 12 nt, Bordetella pertussis
cggccagcagcu

SEQ ID NO: 2362999 - RNA, 13 nt, Bordetella pertussis
cggccagcagcuu

SEQ ID NO: 2363000 - RNA, 15 nt, Bordetella pertussis
cggccagcagcuugg

SEQ ID NO: 2363001 - RNA, 17 nt, Bordetella pertussis
cggccagcaggagcccg

SEQ ID NO: 2363002 - RNA, 19 nt, Bordetella pertussis
cggccagcaguguuucggc

SEQ ID NO: 2363003 - RNA, 14 nt, Bordetella pertussis
cggccagcauaccc

SEQ ID NO: 2363004 - RNA, 22 nt, Bordetella pertussis
cggccagcaucguaucgggcgu

SEQ ID NO: 2363005 - RNA, 15 nt, Bordetella pertussis
cggccagcaugcugg

SEQ ID NO: 2363006 - RNA, 16 nt, Bordetella pertussis
cggccagcaugcuggg

SEQ ID NO: 2363007 - RNA, 13 nt, Bordetella pertussis
cggccagccacgc

SEQ ID NO: 2363008 - RNA, 15 nt, Bordetella pertussis
cggccagccacgccg

SEQ ID NO: 2363009 - RNA, 17 nt, Bordetella pertussis
cggccagccacgccggc

SEQ ID NO: 2363010 - RNA, 20 nt, Bordetella pertussis
cggccagccacgccggcgcg

SEQ ID NO: 2363011 - RNA, 23 nt, Bordetella pertussis
cggccagccacgccggcgcgccg

SEQ ID NO: 2363012 - RNA, 19 nt, Bordetella pertussis
cggccagccauugccgcac

SEQ ID NO: 2363013 - RNA, 15 nt, Bordetella pertussis
cggccagccccaccu

SEQ ID NO: 2363014 - RNA, 16 nt, Bordetella pertussis
cggccagccccaccuu

SEQ ID NO: 2363015 - RNA, 11 nt, Bordetella pertussis
cggccagccgg

SEQ ID NO: 2363016 - RNA, 12 nt, Bordetella pertussis
cggccagccggc

SEQ ID NO: 2363017 - RNA, 14 nt, Bordetella pertussis
cggccagccggccg

SEQ ID NO: 2363018 - RNA, 15 nt, Bordetella pertussis
cggccagccggccga

SEQ ID NO: 2363019 - RNA, 17 nt, Bordetella pertussis
cggccagccggcgcgcc

SEQ ID NO: 2363020 - RNA, 13 nt, Bordetella pertussis
cggccagccgggc

SEQ ID NO: 2363021 - RNA, 14 nt, Bordetella pertussis
cggccagccgggcg

SEQ ID NO: 2363022 - RNA, 15 nt, Bordetella pertussis
cggccagccgggcga

SEQ ID NO: 2363023 - RNA, 15 nt, Bordetella pertussis
cggccagccugcccg

SEQ ID NO: 2363024 - RNA, 14 nt, Bordetella pertussis
cggccagccugccg

SEQ ID NO: 2363025 - RNA, 16 nt, Bordetella pertussis
cggccagccugccgcg

SEQ ID NO: 2363026 - RNA, 19 nt, Bordetella pertussis
cggccagccugccgcggcc

SEQ ID NO: 2363027 - RNA, 20 nt, Bordetella pertussis
cggccagccugccgcggccg

SEQ ID NO: 2363028 - RNA, 23 nt, Bordetella pertussis
cggccagccugccgcggccgccc

SEQ ID NO: 2363029 - RNA, 15 nt, Bordetella pertussis
cggccagccugugcg

SEQ ID NO: 2363030 - RNA, 17 nt, Bordetella pertussis
cggccagccugugcgcc

SEQ ID NO: 2363031 - RNA, 18 nt, Bordetella pertussis
cggccagccugugcgcca

SEQ ID NO: 2363032 - RNA, 16 nt, Bordetella pertussis
cggccagcgaggccgc

SEQ ID NO: 2363033 - RNA, 17 nt, Bordetella pertussis
cggccagcgaggccgcu

SEQ ID NO: 2363034 - RNA, 19 nt, Bordetella pertussis
cggccagcgccaccaccgg

SEQ ID NO: 2363035 - RNA, 17 nt, Bordetella pertussis
cggccagcgccagccgc

SEQ ID NO: 2363036 - RNA, 21 nt, Bordetella pertussis
cggccagcgccaguccgcgcu

SEQ ID NO: 2363037 - RNA, 12 nt, Bordetella pertussis
cggccagcgccg

SEQ ID NO: 2363038 - RNA, 17 nt, Bordetella pertussis
cggccagcgccgcgccg

SEQ ID NO: 2363039 - RNA, 17 nt, Bordetella pertussis
cggccagcgccggcgcg

SEQ ID NO: 2363040 - RNA, 19 nt, Bordetella pertussis
cggccagcgccggcgcgcg

SEQ ID NO: 2363041 - RNA, 14 nt, Bordetella pertussis
cggccagcgccugg

SEQ ID NO: 2363042 - RNA, 15 nt, Bordetella pertussis
cggccagcgccuggg

SEQ ID NO: 2363043 - RNA, 12 nt, Bordetella pertussis
cggccagcgcga

SEQ ID NO: 2363044 - RNA, 14 nt, Bordetella pertussis
cggccagcgcgacg

SEQ ID NO: 2363045 - RNA, 12 nt, Bordetella pertussis
cggccagcgcgc

SEQ ID NO: 2363046 - RNA, 23 nt, Bordetella pertussis
cggccagcgcgcaacccacggcg

SEQ ID NO: 2363047 - RNA, 14 nt, Bordetella pertussis
cggccagcgcgccc

SEQ ID NO: 2363048 - RNA, 21 nt, Bordetella pertussis
cggccagcgcgccggccaggg

SEQ ID NO: 2363049 - RNA, 13 nt, Bordetella pertussis
cggccagcgcgcg

SEQ ID NO: 2363050 - RNA, 15 nt, Bordetella pertussis
cggccagcgcgcgcc

SEQ ID NO: 2363051 - RNA, 16 nt, Bordetella pertussis
cggccagcgcgcgcca

SEQ ID NO: 2363052 - RNA, 17 nt, Bordetella pertussis
cggccagcgcgcgccag

SEQ ID NO: 2363053 - RNA, 14 nt, Bordetella pertussis
cggccagcgcgcgg

SEQ ID NO: 2363054 - RNA, 19 nt, Bordetella pertussis
cggccagcgcgcggccggc

SEQ ID NO: 2363055 - RNA, 20 nt, Bordetella pertussis
cggccagcgcgcggccggcc

SEQ ID NO: 2363056 - RNA, 16 nt, Bordetella pertussis
cggccagcgcgcggcg

SEQ ID NO: 2363057 - RNA, 15 nt, Bordetella pertussis
cggccagcgcggcau

SEQ ID NO: 2363058 - RNA, 19 nt, Bordetella pertussis
cggccagcgcggcaucggc

SEQ ID NO: 2363059 - RNA, 14 nt, Bordetella pertussis
cggccagcgcggcg

SEQ ID NO: 2363060 - RNA, 17 nt, Bordetella pertussis
cggccagcgcggcggca

SEQ ID NO: 2363061 - RNA, 21 nt, Bordetella pertussis
cggccagcgcggcggcagcgc

SEQ ID NO: 2363062 - RNA, 14 nt, Bordetella pertussis
cggccagcgcggug

SEQ ID NO: 2363063 - RNA, 23 nt, Bordetella pertussis
cggccagcgcgucgagcagcgca

SEQ ID NO: 2363064 - RNA, 23 nt, Bordetella pertussis
cggccagcggaugaugcggcgcc

SEQ ID NO: 2363065 - RNA, 12 nt, Bordetella pertussis
cggccagcggca

SEQ ID NO: 2363066 - RNA, 14 nt, Bordetella pertussis
cggccagcggcagg

SEQ ID NO: 2363067 - RNA, 18 nt, Bordetella pertussis
cggccagcggcaggccca

SEQ ID NO: 2363068 - RNA, 15 nt, Bordetella pertussis
cggccagcggcaggg

SEQ ID NO: 2363069 - RNA, 13 nt, Bordetella pertussis
cggccagcggcga

SEQ ID NO: 2363070 - RNA, 23 nt, Bordetella pertussis
cggccagcggcgcuuaccgcgcc

SEQ ID NO: 2363071 - RNA, 16 nt, Bordetella pertussis
cggccagcgucagcgc

SEQ ID NO: 2363072 - RNA, 14 nt, Bordetella pertussis
cggccagcgugccg

SEQ ID NO: 2363073 - RNA, 20 nt, Bordetella pertussis
cggccagcgugccggugacg

SEQ ID NO: 2363074 - RNA, 21 nt, Bordetella pertussis
cggccagcgugccggugacga

SEQ ID NO: 2363075 - RNA, 21 nt, Bordetella pertussis
cggccagcucggcggccgccu

SEQ ID NO: 2363076 - RNA, 16 nt, Bordetella pertussis
cggccagcugcaugcg

SEQ ID NO: 2363077 - RNA, 17 nt, Bordetella pertussis
cggccagcugcaugcgc

SEQ ID NO: 2363078 - RNA, 21 nt, Bordetella pertussis
cggccagcugcaugcgcacgg

SEQ ID NO: 2363079 - RNA, 14 nt, Bordetella pertussis
cggccagcugggcc

SEQ ID NO: 2363080 - RNA, 16 nt, Bordetella pertussis
cggcccacggccagca

SEQ ID NO: 2363081 - RNA, 21 nt, Bordetella pertussis
cggcccagcacgccgcgcucg

SEQ ID NO: 2363082 - RNA, 16 nt, Bordetella pertussis
cggcccagccgcucgg

SEQ ID NO: 2363083 - RNA, 19 nt, Bordetella pertussis
cggcccagccgcucggcca

SEQ ID NO: 2363084 - RNA, 13 nt, Bordetella pertussis
cggcccagcgcca

SEQ ID NO: 2363085 - RNA, 16 nt, Bordetella pertussis
cggcccagcgccaucg

SEQ ID NO: 2363086 - RNA, 17 nt, Bordetella pertussis
cggcccagcgccaucgg

SEQ ID NO: 2363087 - RNA, 12 nt, Bordetella pertussis
cggcccagcgcg

SEQ ID NO: 2363088 - RNA, 16 nt, Bordetella pertussis
cggcccagcgcggcgg

SEQ ID NO: 2363089 - RNA, 16 nt, Bordetella pertussis
cggcccagcguggcgg

SEQ ID NO: 2363090 - RNA, 18 nt, Bordetella pertussis
cggcccagcguggcggug

SEQ ID NO: 2363091 - RNA, 21 nt, Bordetella pertussis
cggcccagcucugguccaggc

SEQ ID NO: 2363092 - RNA, 12 nt, Bordetella pertussis
cggcccaggccg

SEQ ID NO: 2363093 - RNA, 15 nt, Bordetella pertussis
cggcccaggccgggc

SEQ ID NO: 2363094 - RNA, 16 nt, Bordetella pertussis
cggcccaggccgggcg

SEQ ID NO: 2363095 - RNA, 15 nt, Bordetella pertussis
cggcccaggcgcgcu

SEQ ID NO: 2363096 - RNA, 16 nt, Bordetella pertussis
cggcccaggcgcgcug

SEQ ID NO: 2363097 - RNA, 16 nt, Bordetella pertussis
cggcccaggcguccag

SEQ ID NO: 2363098 - RNA, 23 nt, Bordetella pertussis
cggcccaggcguccaggcugccg

SEQ ID NO: 2363099 - RNA, 12 nt, Bordetella pertussis
cggcccagguca

SEQ ID NO: 2363100 - RNA, 18 nt, Bordetella pertussis
cggcccaggucaucgcca

SEQ ID NO: 2363101 - RNA, 20 nt, Bordetella pertussis
cggcccaggucaucgccagg

SEQ ID NO: 2363102 - RNA, 15 nt, Bordetella pertussis
cggcccaguccaggg

SEQ ID NO: 2363103 - RNA, 16 nt, Bordetella pertussis
cggcccaguccagggu

SEQ ID NO: 2363104 - RNA, 12 nt, Bordetella pertussis
cggcccauccau

SEQ ID NO: 2363105 - RNA, 20 nt, Bordetella pertussis
cggcccauccaucugguggu

SEQ ID NO: 2363106 - RNA, 15 nt, Bordetella pertussis
cggcccaucgugcgc

SEQ ID NO: 2363107 - RNA, 16 nt, Bordetella pertussis
cggcccaugaccggcg

SEQ ID NO: 2363108 - RNA, 20 nt, Bordetella pertussis
cggcccaugaccggcguguc

SEQ ID NO: 2363109 - RNA, 16 nt, Bordetella pertussis
cggcccauucgcgcac

SEQ ID NO: 2363110 - RNA, 18 nt, Bordetella pertussis
cggcccauucgcgcaccg

SEQ ID NO: 2363111 - RNA, 19 nt, Bordetella pertussis
cggcccauucgcgcaccga

SEQ ID NO: 2363112 - RNA, 18 nt, Bordetella pertussis
cggcccauugcggcaccu

SEQ ID NO: 2363113 - RNA, 13 nt, Bordetella pertussis
cggccccagcgcc

SEQ ID NO: 2363114 - RNA, 14 nt, Bordetella pertussis
cggccccagcgccg

SEQ ID NO: 2363115 - RNA, 17 nt, Bordetella pertussis
cggccccagcgccgcga

SEQ ID NO: 2363116 - RNA, 19 nt, Bordetella pertussis
cggccccagcgccgcgagc

SEQ ID NO: 2363117 - RNA, 13 nt, Bordetella pertussis
cggccccaggaug

SEQ ID NO: 2363118 - RNA, 22 nt, Bordetella pertussis
cggccccaggaugcgcaccggc

SEQ ID NO: 2363119 - RNA, 23 nt, Bordetella pertussis
cggccccaggaugcgcaccggcc

SEQ ID NO: 2363120 - RNA, 24 nt, Bordetella pertussis
cggccccaggaugcgcaccggcca

SEQ ID NO: 2363121 - RNA, 13 nt, Bordetella pertussis
cggccccaggccg

SEQ ID NO: 2363122 - RNA, 14 nt, Bordetella pertussis
cggccccaggccgg

SEQ ID NO: 2363123 - RNA, 18 nt, Bordetella pertussis
cggccccauccucaucgu

SEQ ID NO: 2363124 - RNA, 19 nt, Bordetella pertussis
cggccccaugcgcggcacg

SEQ ID NO: 2363125 - RNA, 16 nt, Bordetella pertussis
cggccccaugucgauc

SEQ ID NO: 2363126 - RNA, 14 nt, Bordetella pertussis
cggcccccagccca

SEQ ID NO: 2363127 - RNA, 20 nt, Bordetella pertussis
cggccccgcaaggggccggc

SEQ ID NO: 2363128 - RNA, 23 nt, Bordetella pertussis
cggccccgcaaggggccggcgcc

SEQ ID NO: 2363129 - RNA, 13 nt, Bordetella pertussis
cggccccgccagg

SEQ ID NO: 2363130 - RNA, 19 nt, Bordetella pertussis
cggccccgcgucggcgaag

SEQ ID NO: 2363131 - RNA, 21 nt, Bordetella pertussis
cggccccggcaccaucgccgc

SEQ ID NO: 2363132 - RNA, 14 nt, Bordetella pertussis
cggccccggccgcc

SEQ ID NO: 2363133 - RNA, 17 nt, Bordetella pertussis
cggccccggccgccccc

SEQ ID NO: 2363134 - RNA, 13 nt, Bordetella pertussis
cggccccggcucc

SEQ ID NO: 2363135 - RNA, 14 nt, Bordetella pertussis
cggccccggcuccc

SEQ ID NO: 2363136 - RNA, 21 nt, Bordetella pertussis
cggccccguugucgccgcggc

SEQ ID NO: 2363137 - RNA, 23 nt, Bordetella pertussis
cggccccguugucgccgcggccg

SEQ ID NO: 2363138 - RNA, 19 nt, Bordetella pertussis
cggccccugcccugcggcu

SEQ ID NO: 2363139 - RNA, 20 nt, Bordetella pertussis
cggcccgccacgcaggcggg

SEQ ID NO: 2363140 - RNA, 21 nt, Bordetella pertussis
cggcccgccacgcaggcgggc

SEQ ID NO: 2363141 - RNA, 17 nt, Bordetella pertussis
cggcccgccacgcgggc

SEQ ID NO: 2363142 - RNA, 21 nt, Bordetella pertussis
cggcccgccacgcgggccggc

SEQ ID NO: 2363143 - RNA, 22 nt, Bordetella pertussis
cggcccgccacgcgggccggcc

SEQ ID NO: 2363144 - RNA, 13 nt, Bordetella pertussis
cggcccgccagga

SEQ ID NO: 2363145 - RNA, 18 nt, Bordetella pertussis
cggcccgccaggaagcgg

SEQ ID NO: 2363146 - RNA, 18 nt, Bordetella pertussis
cggcccgccccacggcga

SEQ ID NO: 2363147 - RNA, 20 nt, Bordetella pertussis
cggcccgcccgcccugggca

SEQ ID NO: 2363148 - RNA, 15 nt, Bordetella pertussis
cggcccgccgacugg

SEQ ID NO: 2363149 - RNA, 13 nt, Bordetella pertussis
cggcccgcgccag

SEQ ID NO: 2363150 - RNA, 14 nt, Bordetella pertussis
cggcccgcgccagc

SEQ ID NO: 2363151 - RNA, 18 nt, Bordetella pertussis
cggcccgcgccagcgcca

SEQ ID NO: 2363152 - RNA, 12 nt, Bordetella pertussis
cggcccgcgccg

SEQ ID NO: 2363153 - RNA, 13 nt, Bordetella pertussis
cggcccgcgccgg

SEQ ID NO: 2363154 - RNA, 14 nt, Bordetella pertussis
cggcccgcgccggg

SEQ ID NO: 2363155 - RNA, 22 nt, Bordetella pertussis
cggcccgcgcgucuucaguuga

SEQ ID NO: 2363156 - RNA, 12 nt, Bordetella pertussis
cggcccgcgcug

SEQ ID NO: 2363157 - RNA, 18 nt, Bordetella pertussis
cggcccgcuccaggcggc

SEQ ID NO: 2363158 - RNA, 20 nt, Bordetella pertussis
cggcccggaauaccgccagc

SEQ ID NO: 2363159 - RNA, 21 nt, Bordetella pertussis
cggcccggaauaccgccagcu

SEQ ID NO: 2363160 - RNA, 22 nt, Bordetella pertussis
cggcccggaauaccgccagcuc

SEQ ID NO: 2363161 - RNA, 14 nt, Bordetella pertussis
cggcccggccgcau

SEQ ID NO: 2363162 - RNA, 14 nt, Bordetella pertussis
cggcccggccgccg

SEQ ID NO: 2363163 - RNA, 15 nt, Bordetella pertussis
cggcccggccgccgc

SEQ ID NO: 2363164 - RNA, 17 nt, Bordetella pertussis
cggcccggccgccgccg

SEQ ID NO: 2363165 - RNA, 21 nt, Bordetella pertussis
cggcccggccgccgccggcaa

SEQ ID NO: 2363166 - RNA, 13 nt, Bordetella pertussis
cggcccggcgccg

SEQ ID NO: 2363167 - RNA, 16 nt, Bordetella pertussis
cggcccggcgccggug

SEQ ID NO: 2363168 - RNA, 12 nt, Bordetella pertussis
cggcccggcggc

SEQ ID NO: 2363169 - RNA, 14 nt, Bordetella pertussis
cggcccggcgggcc

SEQ ID NO: 2363170 - RNA, 20 nt, Bordetella pertussis
cggcccggcgggccggcuca

SEQ ID NO: 2363171 - RNA, 13 nt, Bordetella pertussis
cggcccggcgucg

SEQ ID NO: 2363172 - RNA, 21 nt, Bordetella pertussis
cggcccggcgucgggucagcc

SEQ ID NO: 2363173 - RNA, 18 nt, Bordetella pertussis
cggcccggugcagccgcc

SEQ ID NO: 2363174 - RNA, 20 nt, Bordetella pertussis
cggcccggugcagccgccgc

SEQ ID NO: 2363175 - RNA, 20 nt, Bordetella pertussis
cggcccgugccacggcuucg

SEQ ID NO: 2363176 - RNA, 19 nt, Bordetella pertussis
cggcccgugcgcaacgcgc

SEQ ID NO: 2363177 - RNA, 21 nt, Bordetella pertussis
cggcccgugcgcaacgcgcgc

SEQ ID NO: 2363178 - RNA, 23 nt, Bordetella pertussis
cggcccgugcgcaacgcgcgcgc

SEQ ID NO: 2363179 - RNA, 19 nt, Bordetella pertussis
cggcccguuccacaggcga

SEQ ID NO: 2363180 - RNA, 21 nt, Bordetella pertussis
cggcccguuccacaggcgaug

SEQ ID NO: 2363181 - RNA, 15 nt, Bordetella pertussis
cggcccguuggcagg

SEQ ID NO: 2363182 - RNA, 18 nt, Bordetella pertussis
cggcccguuggcaggcca

SEQ ID NO: 2363183 - RNA, 19 nt, Bordetella pertussis
cggcccguuggcaggccag

SEQ ID NO: 2363184 - RNA, 20 nt, Bordetella pertussis
cggcccguuggcaggccagc

SEQ ID NO: 2363185 - RNA, 21 nt, Bordetella pertussis
cggcccugcaggaacucgcac

SEQ ID NO: 2363186 - RNA, 14 nt, Bordetella pertussis
cggcccugccgccc

SEQ ID NO: 2363187 - RNA, 21 nt, Bordetella pertussis
cggcccugccgcccuggcgca

SEQ ID NO: 2363188 - RNA, 20 nt, Bordetella pertussis
cggcccugcgucaguugaag

SEQ ID NO: 2363189 - RNA, 16 nt, Bordetella pertussis
cggcccugggccagcc

SEQ ID NO: 2363190 - RNA, 19 nt, Bordetella pertussis
cggcccugggccagccagc

SEQ ID NO: 2363191 - RNA, 23 nt, Bordetella pertussis
cggcccugggccagccagcgccg

SEQ ID NO: 2363192 - RNA, 20 nt, Bordetella pertussis
cggcccugggcgcggcggug

SEQ ID NO: 2363193 - RNA, 23 nt, Bordetella pertussis
acgggauugccgucacgcgugaa

SEQ ID NO: 2363194 - RNA, 17 nt, Bordetella pertussis
acgggcaggcccagcca

SEQ ID NO: 2363195 - RNA, 18 nt, Bordetella pertussis
acgggcaggcccagccag

SEQ ID NO: 2363196 - RNA, 20 nt, Bordetella pertussis
acgggccagccccggcgcgc

SEQ ID NO: 2363197 - RNA, 21 nt, Bordetella pertussis
acgggccagccccggcgcgcc

SEQ ID NO: 2363198 - RNA, 19 nt, Bordetella pertussis
acgggccauggaugcgcgc

SEQ ID NO: 2363199 - RNA, 14 nt, Bordetella pertussis
acgggccgagugga

SEQ ID NO: 2363200 - RNA, 23 nt, Bordetella pertussis
acgggccgcuggucaccgccccg

SEQ ID NO: 2363201 - RNA, 23 nt, Bordetella pertussis
acgggcgccagcagcgggcuggg

SEQ ID NO: 2363202 - RNA, 14 nt, Bordetella pertussis
acgggcgccugccg

SEQ ID NO: 2363203 - RNA, 15 nt, Bordetella pertussis
acgggcgccugccgc

SEQ ID NO: 2363204 - RNA, 20 nt, Bordetella pertussis
acgggcgccuguccccgcug

SEQ ID NO: 2363205 - RNA, 18 nt, Bordetella pertussis
acgggcgcugcacgcagc

SEQ ID NO: 2363206 - RNA, 12 nt, Bordetella pertussis
acgggcgcugcc

SEQ ID NO: 2363207 - RNA, 16 nt, Bordetella pertussis
acgggcggcggcgcgc

SEQ ID NO: 2363208 - RNA, 18 nt, Bordetella pertussis
acgggcggcgucgccgcg

SEQ ID NO: 2363209 - RNA, 20 nt, Bordetella pertussis
acgggcggcgucgccgcgca

SEQ ID NO: 2363210 - RNA, 15 nt, Bordetella pertussis
acgggcggcugccag

SEQ ID NO: 2363211 - RNA, 15 nt, Bordetella pertussis
acgggcggggugauc

SEQ ID NO: 2363212 - RNA, 20 nt, Bordetella pertussis
acgggcucgcugaccggcgu

SEQ ID NO: 2363213 - RNA, 22 nt, Bordetella pertussis
acgggcuguucgcgcagcaggc

SEQ ID NO: 2363214 - RNA, 17 nt, Bordetella pertussis
acggggaacaggcgcgc

SEQ ID NO: 2363215 - RNA, 16 nt, Bordetella pertussis
acggggacaggcacgc

SEQ ID NO: 2363216 - RNA, 13 nt, Bordetella pertussis
cggccgacggcgc

SEQ ID NO: 2363217 - RNA, 14 nt, Bordetella pertussis
cggccgacggcgcu

SEQ ID NO: 2363218 - RNA, 15 nt, Bordetella pertussis
cggccgacggcgcug

SEQ ID NO: 2363219 - RNA, 16 nt, Bordetella pertussis
cggccgacgggcggcu

SEQ ID NO: 2363220 - RNA, 19 nt, Bordetella pertussis
cggccgacgggcggcugcu

SEQ ID NO: 2363221 - RNA, 21 nt, Bordetella pertussis
cggccgacgggcggcugcugg

SEQ ID NO: 2363222 - RNA, 19 nt, Bordetella pertussis
cggccgacguggaccgcgc

SEQ ID NO: 2363223 - RNA, 20 nt, Bordetella pertussis
cggccgacguggaccgcgcg

SEQ ID NO: 2363224 - RNA, 22 nt, Bordetella pertussis
cggccgacucgaaacgggcggc

SEQ ID NO: 2363225 - RNA, 15 nt, Bordetella pertussis
cggccgagcgggcca

SEQ ID NO: 2363226 - RNA, 20 nt, Bordetella pertussis
cggccgagcgggccagcgcg

SEQ ID NO: 2363227 - RNA, 22 nt, Bordetella pertussis
cggccgagcgggccagcgcggc

SEQ ID NO: 2363228 - RNA, 13 nt, Bordetella pertussis
cggccgagcuccu

SEQ ID NO: 2363229 - RNA, 14 nt, Bordetella pertussis
cggccgagcuccuc

SEQ ID NO: 2363230 - RNA, 19 nt, Bordetella pertussis
cggccgagcuccucgagcg

SEQ ID NO: 2363231 - RNA, 21 nt, Bordetella pertussis
cggccgagcuccucgagcgug

SEQ ID NO: 2363232 - RNA, 14 nt, Bordetella pertussis
cggccgaggccagc

SEQ ID NO: 2363233 - RNA, 15 nt, Bordetella pertussis
cggccgaggccagcg

SEQ ID NO: 2363234 - RNA, 20 nt, Bordetella pertussis
cggccgaggccagcgugccc

SEQ ID NO: 2363235 - RNA, 13 nt, Bordetella pertussis
cggccgaggucgg

SEQ ID NO: 2363236 - RNA, 16 nt, Bordetella pertussis
cggccgaggucggcgg

SEQ ID NO: 2363237 - RNA, 16 nt, Bordetella pertussis
cggccgauagccgcgg

SEQ ID NO: 2363238 - RNA, 19 nt, Bordetella pertussis
cggccgauagccgcggcgc

SEQ ID NO: 2363239 - RNA, 20 nt, Bordetella pertussis
cggccgauagccgcggcgcc

SEQ ID NO: 2363240 - RNA, 21 nt, Bordetella pertussis
cggccgauagccgcggcgccg

SEQ ID NO: 2363241 - RNA, 22 nt, Bordetella pertussis
cggccgauagccgcggcgccgc

SEQ ID NO: 2363242 - RNA, 21 nt, Bordetella pertussis
cggccgauagccgugaccugc

SEQ ID NO: 2363243 - RNA, 23 nt, Bordetella pertussis
cggccgauagccgugaccugcuc

SEQ ID NO: 2363244 - RNA, 16 nt, Bordetella pertussis
cggccgaucgcgccgu

SEQ ID NO: 2363245 - RNA, 20 nt, Bordetella pertussis
cggccgaucgcgccguccga

SEQ ID NO: 2363246 - RNA, 22 nt, Bordetella pertussis
cggccgaucgcgccguccgagc

SEQ ID NO: 2363247 - RNA, 23 nt, Bordetella pertussis
cggccgaugacaucgccgcugcg

SEQ ID NO: 2363248 - RNA, 15 nt, Bordetella pertussis
cggccgauggcaucg

SEQ ID NO: 2363249 - RNA, 18 nt, Bordetella pertussis
cggccgauggcaucgccc

SEQ ID NO: 2363250 - RNA, 20 nt, Bordetella pertussis
cggccgauggcaucgccccg

SEQ ID NO: 2363251 - RNA, 18 nt, Bordetella pertussis
cggccgcaagcuggccga

SEQ ID NO: 2363252 - RNA, 13 nt, Bordetella pertussis
cggccgcacgcgg

SEQ ID NO: 2363253 - RNA, 14 nt, Bordetella pertussis
cggccgcacgcggc

SEQ ID NO: 2363254 - RNA, 15 nt, Bordetella pertussis
cggccgcacgcggcc

SEQ ID NO: 2363255 - RNA, 20 nt, Bordetella pertussis
cggccgcacgcggccgcggg

SEQ ID NO: 2363256 - RNA, 14 nt, Bordetella pertussis
cggccgcagcaguu

SEQ ID NO: 2363257 - RNA, 13 nt, Bordetella pertussis
cggccgcagcgga

SEQ ID NO: 2363258 - RNA, 17 nt, Bordetella pertussis
cggccgcagggcgugcg

SEQ ID NO: 2363259 - RNA, 22 nt, Bordetella pertussis
cggccgcaugcgugaagcccau

SEQ ID NO: 2363260 - RNA, 17 nt, Bordetella pertussis
cggccgcauugggacgc

SEQ ID NO: 2363261 - RNA, 20 nt, Bordetella pertussis
cggccgcauugggacgcggc

SEQ ID NO: 2363262 - RNA, 19 nt, Bordetella pertussis
cggccgccacccaggcggc

SEQ ID NO: 2363263 - RNA, 14 nt, Bordetella pertussis
cggccgccaccugg

SEQ ID NO: 2363264 - RNA, 17 nt, Bordetella pertussis
cggccgccaccugggcc

SEQ ID NO: 2363265 - RNA, 21 nt, Bordetella pertussis
cggccgccaccugggccgccu

SEQ ID NO: 2363266 - RNA, 15 nt, Bordetella pertussis
cggccgccacgcccu

SEQ ID NO: 2363267 - RNA, 17 nt, Bordetella pertussis
cggccgccacgcccugg

SEQ ID NO: 2363268 - RNA, 18 nt, Bordetella pertussis
cggccgccacgcccuggc

SEQ ID NO: 2363269 - RNA, 15 nt, Bordetella pertussis
cggccgccagcaagg

SEQ ID NO: 2363270 - RNA, 16 nt, Bordetella pertussis
cggccgccagcaaggc

SEQ ID NO: 2363271 - RNA, 20 nt, Bordetella pertussis
cggccgccagcauggcgucg

SEQ ID NO: 2363272 - RNA, 12 nt, Bordetella pertussis
cggccgccagcc

SEQ ID NO: 2363273 - RNA, 13 nt, Bordetella pertussis
cggccgccagcca

SEQ ID NO: 2363274 - RNA, 22 nt, Bordetella pertussis
cggccgccagccaccccgucau

SEQ ID NO: 2363275 - RNA, 14 nt, Bordetella pertussis
cggccgccagccgg

SEQ ID NO: 2363276 - RNA, 21 nt, Bordetella pertussis
cggccgccagccggcccagca

SEQ ID NO: 2363277 - RNA, 19 nt, Bordetella pertussis
cggccgccagcgccaugau

SEQ ID NO: 2363278 - RNA, 16 nt, Bordetella pertussis
cggccgccagguagcg

SEQ ID NO: 2363279 - RNA, 22 nt, Bordetella pertussis
cggccgccagguagcggguggc

SEQ ID NO: 2363280 - RNA, 21 nt, Bordetella pertussis
cggccgccauggccggcguug

SEQ ID NO: 2363281 - RNA, 15 nt, Bordetella pertussis
cggccgcccacggca

SEQ ID NO: 2363282 - RNA, 13 nt, Bordetella pertussis
cggccgcccagca

SEQ ID NO: 2363283 - RNA, 12 nt, Bordetella pertussis
cggccgcccagg

SEQ ID NO: 2363284 - RNA, 13 nt, Bordetella pertussis
cggccgcccaggc

SEQ ID NO: 2363285 - RNA, 15 nt, Bordetella pertussis
cggccgcccaggcgc

SEQ ID NO: 2363286 - RNA, 16 nt, Bordetella pertussis
cggccgcccaggcgca

SEQ ID NO: 2363287 - RNA, 19 nt, Bordetella pertussis
cggccgcccaggcgcagcc

SEQ ID NO: 2363288 - RNA, 14 nt, Bordetella pertussis
cggccgcccgccug

SEQ ID NO: 2363289 - RNA, 16 nt, Bordetella pertussis
cggccgcccggcaugg

SEQ ID NO: 2363290 - RNA, 13 nt, Bordetella pertussis
cggccgccgaacg

SEQ ID NO: 2363291 - RNA, 15 nt, Bordetella pertussis
cggccgccgaacggc

SEQ ID NO: 2363292 - RNA, 18 nt, Bordetella pertussis
cggccgccgaacggcacg

SEQ ID NO: 2363293 - RNA, 20 nt, Bordetella pertussis
cggccgccgaacggcacgug

SEQ ID NO: 2363294 - RNA, 15 nt, Bordetella pertussis
cggccgccgacgccg

SEQ ID NO: 2363295 - RNA, 16 nt, Bordetella pertussis
cggccgccgacgccgc

SEQ ID NO: 2363296 - RNA, 19 nt, Bordetella pertussis
cggccgccgacgccgccac

SEQ ID NO: 2363297 - RNA, 14 nt, Bordetella pertussis
cggccgccgccagc

SEQ ID NO: 2363298 - RNA, 16 nt, Bordetella pertussis
cggccgccgccagcgc

SEQ ID NO: 2363299 - RNA, 17 nt, Bordetella pertussis
cggccgccgccagcgcg

SEQ ID NO: 2363300 - RNA, 19 nt, Bordetella pertussis
cggccgccgccagcgcgcc

SEQ ID NO: 2363301 - RNA, 13 nt, Bordetella pertussis
cggccgccgcccg

SEQ ID NO: 2363302 - RNA, 21 nt, Bordetella pertussis
cggccgccgcccgccucaggc

SEQ ID NO: 2363303 - RNA, 14 nt, Bordetella pertussis
cggccgccgccggc

SEQ ID NO: 2363304 - RNA, 20 nt, Bordetella pertussis
cggccgccggauugacgucc

SEQ ID NO: 2363305 - RNA, 23 nt, Bordetella pertussis
cggccgccggauugacguccaug

SEQ ID NO: 2363306 - RNA, 15 nt, Bordetella pertussis
cggccggcgcgccgg

SEQ ID NO: 2363307 - RNA, 16 nt, Bordetella pertussis
cggccggcgcgccggc

SEQ ID NO: 2363308 - RNA, 18 nt, Bordetella pertussis
cggccggcgcgccggccu

SEQ ID NO: 2363309 - RNA, 13 nt, Bordetella pertussis
cggccggcgcgcg

SEQ ID NO: 2363310 - RNA, 16 nt, Bordetella pertussis
cggccggcgcgcgcga

SEQ ID NO: 2363311 - RNA, 21 nt, Bordetella pertussis
cggccggcgcgucgccggcga

SEQ ID NO: 2363312 - RNA, 15 nt, Bordetella pertussis
cggccggcgcgugcu

SEQ ID NO: 2363313 - RNA, 20 nt, Bordetella pertussis
cggccggcgcgugcuggcgc

SEQ ID NO: 2363314 - RNA, 13 nt, Bordetella pertussis
cggccggcggccc

SEQ ID NO: 2363315 - RNA, 15 nt, Bordetella pertussis
cggccggcggcgccg

SEQ ID NO: 2363316 - RNA, 17 nt, Bordetella pertussis
cggccggcggucgcgcu

SEQ ID NO: 2363317 - RNA, 19 nt, Bordetella pertussis
cggccggcggucgcgcugg

SEQ ID NO: 2363318 - RNA, 22 nt, Bordetella pertussis
cggccggcggucgcgcuggccc

SEQ ID NO: 2363319 - RNA, 20 nt, Bordetella pertussis
cggccggcugcaccagcgcg

SEQ ID NO: 2363320 - RNA, 21 nt, Bordetella pertussis
cggccggcugcaccagcgcgc

SEQ ID NO: 2363321 - RNA, 13 nt, Bordetella pertussis
cggccggcugcgc

SEQ ID NO: 2363322 - RNA, 16 nt, Bordetella pertussis
cggccggcugcgcgcc

SEQ ID NO: 2363323 - RNA, 20 nt, Bordetella pertussis
cggccggcugcgcgccgacc

SEQ ID NO: 2363324 - RNA, 21 nt, Bordetella pertussis
cggccggcuugcgcaagccgg

SEQ ID NO: 2363325 - RNA, 22 nt, Bordetella pertussis
cggccggcuugcgcaagccggc

SEQ ID NO: 2363326 - RNA, 16 nt, Bordetella pertussis
cggccgggaaggcggg

SEQ ID NO: 2363327 - RNA, 23 nt, Bordetella pertussis
cggccgggaccuuggcggcuggc

SEQ ID NO: 2363328 - RNA, 16 nt, Bordetella pertussis
cggccgggagccuguc

SEQ ID NO: 2363329 - RNA, 15 nt, Bordetella pertussis
cggccgggcacaccg

SEQ ID NO: 2363330 - RNA, 22 nt, Bordetella pertussis
cggccgggcacaccgucacgcg

SEQ ID NO: 2363331 - RNA, 14 nt, Bordetella pertussis
cggccgggccagcg

SEQ ID NO: 2363332 - RNA, 16 nt, Bordetella pertussis
cggccgggccagcgcg

SEQ ID NO: 2363333 - RNA, 14 nt, Bordetella pertussis
cggccgggccagua

SEQ ID NO: 2363334 - RNA, 16 nt, Bordetella pertussis
cggccgggccaguacc

SEQ ID NO: 2363335 - RNA, 14 nt, Bordetella pertussis
cggccgggcgccca

SEQ ID NO: 2363336 - RNA, 16 nt, Bordetella pertussis
cggccgggcgcccagc

SEQ ID NO: 2363337 - RNA, 17 nt, Bordetella pertussis
cggccgggcgcccagcg

SEQ ID NO: 2363338 - RNA, 13 nt, Bordetella pertussis
cggccgggcgcgg

SEQ ID NO: 2363339 - RNA, 16 nt, Bordetella pertussis
cggccgggcgcggcgc

SEQ ID NO: 2363340 - RNA, 18 nt, Bordetella pertussis
cggccgggcgcggcgccc

SEQ ID NO: 2363341 - RNA, 15 nt, Bordetella pertussis
cggccgggcucaggc

SEQ ID NO: 2363342 - RNA, 18 nt, Bordetella pertussis
cggccgggcucaggcugc

SEQ ID NO: 2363343 - RNA, 16 nt, Bordetella pertussis
cggccggggcccgcgg

SEQ ID NO: 2363344 - RNA, 17 nt, Bordetella pertussis
cggccggggcccgcggg

SEQ ID NO: 2363345 - RNA, 14 nt, Bordetella pertussis
cggccggggccgcc

SEQ ID NO: 2363346 - RNA, 15 nt, Bordetella pertussis
cggccggggccgccc

SEQ ID NO: 2363347 - RNA, 17 nt, Bordetella pertussis
cggccggggccgcccug

SEQ ID NO: 2363348 - RNA, 18 nt, Bordetella pertussis
cggccggggccgcccugg

SEQ ID NO: 2363349 - RNA, 22 nt, Bordetella pertussis
cggccggggcggucaaugcggc

SEQ ID NO: 2363350 - RNA, 20 nt, Bordetella pertussis
cggccggggucuugccgcgc

SEQ ID NO: 2363351 - RNA, 21 nt, Bordetella pertussis
cggccggggucuugccgcgca

SEQ ID NO: 2363352 - RNA, 15 nt, Bordetella pertussis
cggccgggucggccu

SEQ ID NO: 2363353 - RNA, 17 nt, Bordetella pertussis
cggccgggucggccugc

SEQ ID NO: 2363354 - RNA, 19 nt, Bordetella pertussis
cggccggguugucgcccac

SEQ ID NO: 2363355 - RNA, 19 nt, Bordetella pertussis
cggccgguaaggcgcuugc

SEQ ID NO: 2363356 - RNA, 16 nt, Bordetella pertussis
cggccgguaucgacgc

SEQ ID NO: 2363357 - RNA, 19 nt, Bordetella pertussis
cggccgguaucgacgcgcg

SEQ ID NO: 2363358 - RNA, 20 nt, Bordetella pertussis
cggccgguaucgacgcgcgu

SEQ ID NO: 2363359 - RNA, 14 nt, Bordetella pertussis
cggccgguaucggc

SEQ ID NO: 2363360 - RNA, 13 nt, Bordetella pertussis
cggccggucaggg

SEQ ID NO: 2363361 - RNA, 14 nt, Bordetella pertussis
cggccggucaggga

SEQ ID NO: 2363362 - RNA, 15 nt, Bordetella pertussis
cggccggucagggag

SEQ ID NO: 2363363 - RNA, 23 nt, Bordetella pertussis
cggccggugaucuugccgaugcg

SEQ ID NO: 2363364 - RNA, 20 nt, Bordetella pertussis
cggccggugcaucggccggc

SEQ ID NO: 2363365 - RNA, 23 nt, Bordetella pertussis
cggccgguggaaauacagaucgc

SEQ ID NO: 2363366 - RNA, 23 nt, Bordetella pertussis
cggccgguggguguggccaugca

SEQ ID NO: 2363367 - RNA, 23 nt, Bordetella pertussis
cggccgguuccugcaaggccggc

SEQ ID NO: 2363368 - RNA, 21 nt, Bordetella pertussis
cggccguaacccgaguccuug

SEQ ID NO: 2363369 - RNA, 18 nt, Bordetella pertussis
cggccguaaugcaucuuu

SEQ ID NO: 2363370 - RNA, 18 nt, Bordetella pertussis
cggccguaguucggcggg

SEQ ID NO: 2363371 - RNA, 17 nt, Bordetella pertussis
cggccgucaacagcaug

SEQ ID NO: 2363372 - RNA, 14 nt, Bordetella pertussis
cggccgucagcagc

SEQ ID NO: 2363373 - RNA, 15 nt, Bordetella pertussis
cggccgucagcagca

SEQ ID NO: 2363374 - RNA, 18 nt, Bordetella pertussis
cggccgucagcagcaggc

SEQ ID NO: 2363375 - RNA, 21 nt, Bordetella pertussis
cggccgucagcagcaggcugg

SEQ ID NO: 2363376 - RNA, 22 nt, Bordetella pertussis
cggccgucagcagcaggcuggc

SEQ ID NO: 2363377 - RNA, 19 nt, Bordetella pertussis
cggccgucgaccgacagca

SEQ ID NO: 2363378 - RNA, 22 nt, Bordetella pertussis
cggccgucgccgcccaugcgca

SEQ ID NO: 2363379 - RNA, 19 nt, Bordetella pertussis
cggccgucgccuucggcgg

SEQ ID NO: 2363380 - RNA, 13 nt, Bordetella pertussis
cggccgucggcgc

SEQ ID NO: 2363381 - RNA, 14 nt, Bordetella pertussis
cggccgucggcgcu

SEQ ID NO: 2363382 - RNA, 16 nt, Bordetella pertussis
cggccgucggcgcugg

SEQ ID NO: 2363383 - RNA, 21 nt, Bordetella pertussis
cggccgucggcgcuggcgcgc

SEQ ID NO: 2363384 - RNA, 23 nt, Bordetella pertussis
cggccgucggcgcuggcgcgcug

SEQ ID NO: 2363385 - RNA, 24 nt, Bordetella pertussis
cggccgucggcgcuggcgcgcugu

SEQ ID NO: 2363386 - RNA, 23 nt, Bordetella pertussis
cggccgucggggccgauggucag

SEQ ID NO: 2363387 - RNA, 14 nt, Bordetella pertussis
cggccgucgguggu

SEQ ID NO: 2363388 - RNA, 15 nt, Bordetella pertussis
cggccgucgugcagc

SEQ ID NO: 2363389 - RNA, 17 nt, Bordetella pertussis
cggccgucgugcagcgu

SEQ ID NO: 2363390 - RNA, 13 nt, Bordetella pertussis
cggccgucugggc

SEQ ID NO: 2363391 - RNA, 13 nt, Bordetella pertussis
cggccgugccgcc

SEQ ID NO: 2363392 - RNA, 16 nt, Bordetella pertussis
cggccgugccgcccgg

SEQ ID NO: 2363393 - RNA, 19 nt, Bordetella pertussis
cggccgugcgccagcgcca

SEQ ID NO: 2363394 - RNA, 19 nt, Bordetella pertussis
cggccguggaggcggcggc

SEQ ID NO: 2363395 - RNA, 18 nt, Bordetella pertussis
cggccguggccgggcccg

SEQ ID NO: 2363396 - RNA, 20 nt, Bordetella pertussis
cggccguggccgggcccggc

SEQ ID NO: 2363397 - RNA, 21 nt, Bordetella pertussis
cggccguggccgggcccggcg

SEQ ID NO: 2363398 - RNA, 17 nt, Bordetella pertussis
cggccguggcggccugc

SEQ ID NO: 2363399 - RNA, 19 nt, Bordetella pertussis
cggccguggcggccugcgc

SEQ ID NO: 2363400 - RNA, 20 nt, Bordetella pertussis
cggccguggcggccugcgcc

SEQ ID NO: 2363401 - RNA, 23 nt, Bordetella pertussis
cggccguguucgagcaggcgcgc

SEQ ID NO: 2363402 - RNA, 23 nt, Bordetella pertussis
cggccguuaugguucggccucgc

SEQ ID NO: 2363403 - RNA, 16 nt, Bordetella pertussis
cggccguugcuccagc

SEQ ID NO: 2363404 - RNA, 23 nt, Bordetella pertussis
cggccguugcuccagccaggcgc

SEQ ID NO: 2363405 - RNA, 14 nt, Bordetella pertussis
cggccguuggcgau

SEQ ID NO: 2363406 - RNA, 17 nt, Bordetella pertussis
cggccguuggcgauggc

SEQ ID NO: 2363407 - RNA, 14 nt, Bordetella pertussis
cggccguuggcgug

SEQ ID NO: 2363408 - RNA, 18 nt, Bordetella pertussis
cggccguuggcgugcagc

SEQ ID NO: 2363409 - RNA, 15 nt, Bordetella pertussis
cggccguuucaggcc

SEQ ID NO: 2363410 - RNA, 23 nt, Bordetella pertussis
cggccguuucaggccugcggcgc

SEQ ID NO: 2363411 - RNA, 16 nt, Bordetella pertussis
cggccguuugccccuc

SEQ ID NO: 2363412 - RNA, 20 nt, Bordetella pertussis
cggccguuugccccucggcg

SEQ ID NO: 2363413 - RNA, 21 nt, Bordetella pertussis
cggccguuugccccucggcgg

SEQ ID NO: 2363414 - RNA, 22 nt, Bordetella pertussis
cggccguuugccccucggcggg

SEQ ID NO: 2363415 - RNA, 15 nt, Bordetella pertussis
cggccuaucaccugg

SEQ ID NO: 2363416 - RNA, 18 nt, Bordetella pertussis
cggccuaucaccugggca

SEQ ID NO: 2363417 - RNA, 20 nt, Bordetella pertussis
cggccuaucaccugggcaac

SEQ ID NO: 2363418 - RNA, 15 nt, Bordetella pertussis
cggcgacugccccag

SEQ ID NO: 2363419 - RNA, 20 nt, Bordetella pertussis
cggcgacugccccagcggcu

SEQ ID NO: 2363420 - RNA, 17 nt, Bordetella pertussis
cggcgacuuccgcuucc

SEQ ID NO: 2363421 - RNA, 23 nt, Bordetella pertussis
cggcgacuuccgcuuccggccgg

SEQ ID NO: 2363422 - RNA, 16 nt, Bordetella pertussis
cggcgacuucggcggc

SEQ ID NO: 2363423 - RNA, 18 nt, Bordetella pertussis
cggcgacuucggcggcca

SEQ ID NO: 2363424 - RNA, 21 nt, Bordetella pertussis
cggcgacuucggcggccaugc

SEQ ID NO: 2363425 - RNA, 23 nt, Bordetella pertussis
cggcgagcaauccgucaggcagc

SEQ ID NO: 2363426 - RNA, 20 nt, Bordetella pertussis
cggcgagcauggcgguggcc

SEQ ID NO: 2363427 - RNA, 15 nt, Bordetella pertussis
cggcgagccgauggc

SEQ ID NO: 2363428 - RNA, 15 nt, Bordetella pertussis
cggcgagccgcgcgc

SEQ ID NO: 2363429 - RNA, 21 nt, Bordetella pertussis
cggcgagccgcgcgcaugcgc

SEQ ID NO: 2363430 - RNA, 14 nt, Bordetella pertussis
cggcgagccgggca

SEQ ID NO: 2363431 - RNA, 17 nt, Bordetella pertussis
cggcgagccgggcaccg

SEQ ID NO: 2363432 - RNA, 18 nt, Bordetella pertussis
cggcgagccgggcaccga

SEQ ID NO: 2363433 - RNA, 23 nt, Bordetella pertussis
cggcgagccgggcaccgagccgc

SEQ ID NO: 2363434 - RNA, 15 nt, Bordetella pertussis
cggcgagcgccgcca

SEQ ID NO: 2363435 - RNA, 20 nt, Bordetella pertussis
cggcgagcgccgccaggccg

SEQ ID NO: 2363436 - RNA, 23 nt, Bordetella pertussis
cggcgagcgccgccaggccgucg

SEQ ID NO: 2363437 - RNA, 12 nt, Bordetella pertussis
cggcgagcgcgg

SEQ ID NO: 2363438 - RNA, 16 nt, Bordetella pertussis
cggcgagcgcggcgcg

SEQ ID NO: 2363439 - RNA, 19 nt, Bordetella pertussis
cggcgagcgcggcgcgcgc

SEQ ID NO: 2363440 - RNA, 13 nt, Bordetella pertussis
cggcgagcucggc

SEQ ID NO: 2363441 - RNA, 16 nt, Bordetella pertussis
cggcgagcucggcaug

SEQ ID NO: 2363442 - RNA, 18 nt, Bordetella pertussis
cggcgagcucggcauggc

SEQ ID NO: 2363443 - RNA, 17 nt, Bordetella pertussis
cggcgagcuggcccugg

SEQ ID NO: 2363444 - RNA, 20 nt, Bordetella pertussis
cggcgaggaggugcgccgcu

SEQ ID NO: 2363445 - RNA, 14 nt, Bordetella pertussis
cggcgaggccgccc

SEQ ID NO: 2363446 - RNA, 19 nt, Bordetella pertussis
cggcgaggccgcccgcccc

SEQ ID NO: 2363447 - RNA, 20 nt, Bordetella pertussis
cggcgaggcguccagccccu

SEQ ID NO: 2363448 - RNA, 20 nt, Bordetella pertussis
cggcgauacgcgccgccugg

SEQ ID NO: 2363449 - RNA, 22 nt, Bordetella pertussis
cggcgauauccagguaggcggc

SEQ ID NO: 2363450 - RNA, 14 nt, Bordetella pertussis
cggcgauauggcca

SEQ ID NO: 2363451 - RNA, 19 nt, Bordetella pertussis
cggcgaucaccugcguggc

SEQ ID NO: 2363452 - RNA, 14 nt, Bordetella pertussis
cggcgaucacgccg

SEQ ID NO: 2363453 - RNA, 15 nt, Bordetella pertussis
cggcgaucacgccga

SEQ ID NO: 2363454 - RNA, 16 nt, Bordetella pertussis
cggcgaucaugccgcc

SEQ ID NO: 2363455 - RNA, 16 nt, Bordetella pertussis
cggcgaucauggcgug

SEQ ID NO: 2363456 - RNA, 18 nt, Bordetella pertussis
cggcgaucauggcguguc

SEQ ID NO: 2363457 - RNA, 14 nt, Bordetella pertussis
cggcgauccgccgc

SEQ ID NO: 2363458 - RNA, 16 nt, Bordetella pertussis
cggcgauccgccgcgg

SEQ ID NO: 2363459 - RNA, 21 nt, Bordetella pertussis
cggcgauccgccgcggccagc

SEQ ID NO: 2363460 - RNA, 22 nt, Bordetella pertussis
cggcgauccgccgcggccagcg

SEQ ID NO: 2363461 - RNA, 24 nt, Bordetella pertussis
cggcgaucgccgcaaaucaaugaa

SEQ ID NO: 2363462 - RNA, 14 nt, Bordetella pertussis
cggcgaucggcccg

SEQ ID NO: 2363463 - RNA, 20 nt, Bordetella pertussis
cggcgaucucgucgaccgcc

SEQ ID NO: 2363464 - RNA, 16 nt, Bordetella pertussis
cggcgaucugcgcggc

SEQ ID NO: 2363465 - RNA, 18 nt, Bordetella pertussis
cggcgaucugggccucgg

SEQ ID NO: 2363466 - RNA, 14 nt, Bordetella pertussis
cggcgaucuuguag

SEQ ID NO: 2363467 - RNA, 23 nt, Bordetella pertussis
cggcgaucuuguaggcgauccag

SEQ ID NO: 2363468 - RNA, 16 nt, Bordetella pertussis
cggcgaugaacagcgg

SEQ ID NO: 2363469 - RNA, 18 nt, Bordetella pertussis
cggcgaugaacagcggca

SEQ ID NO: 2363470 - RNA, 23 nt, Bordetella pertussis
cggcgaugaacagcggcacgccg

SEQ ID NO: 2363471 - RNA, 20 nt, Bordetella pertussis
cggcgaugaagucgcggccc

SEQ ID NO: 2363472 - RNA, 14 nt, Bordetella pertussis
cggcgaugacggcu

SEQ ID NO: 2363473 - RNA, 21 nt, Bordetella pertussis
cggcgaugaucgccucggggc

SEQ ID NO: 2363474 - RNA, 16 nt, Bordetella pertussis
cggcgaugcacccagg

SEQ ID NO: 2363475 - RNA, 20 nt, Bordetella pertussis
cggcgaugccccaguccagg

SEQ ID NO: 2363476 - RNA, 13 nt, Bordetella pertussis
cggcgaugccgcu

SEQ ID NO: 2363477 - RNA, 20 nt, Bordetella pertussis
cggcgaugccgcuggcgaug

SEQ ID NO: 2363478 - RNA, 18 nt, Bordetella pertussis
cggcgaugccgcugucgg

SEQ ID NO: 2363479 - RNA, 18 nt, Bordetella pertussis
cggcgaugccggccagca

SEQ ID NO: 2363480 - RNA, 19 nt, Bordetella pertussis
cggcgaugccggccagcag

SEQ ID NO: 2363481 - RNA, 14 nt, Bordetella pertussis
cggcgaugccggcg

SEQ ID NO: 2363482 - RNA, 14 nt, Bordetella pertussis
cggcgaugccguac

SEQ ID NO: 2363483 - RNA, 23 nt, Bordetella pertussis
cggcgaugccguacuuggcgaug

SEQ ID NO: 2363484 - RNA, 17 nt, Bordetella pertussis
cggcgaugcgcgagcgc

SEQ ID NO: 2363485 - RNA, 13 nt, Bordetella pertussis
cggcgaugcgggc

SEQ ID NO: 2363486 - RNA, 15 nt, Bordetella pertussis
cggcgaugcgggcca

SEQ ID NO: 2363487 - RNA, 14 nt, Bordetella pertussis
cggcgaugcgggcg

SEQ ID NO: 2363488 - RNA, 14 nt, Bordetella pertussis
cggcgaugcugccg

SEQ ID NO: 2363489 - RNA, 14 nt, Bordetella pertussis
cggcgauggcccgg

SEQ ID NO: 2363490 - RNA, 16 nt, Bordetella pertussis
cggcgauggcccggua

SEQ ID NO: 2363491 - RNA, 17 nt, Bordetella pertussis
cggcgauggcgcgcgcc

SEQ ID NO: 2363492 - RNA, 18 nt, Bordetella pertussis
cggcgauggcgcgcgcca

SEQ ID NO: 2363493 - RNA, 14 nt, Bordetella pertussis
cggcgauggcguug

SEQ ID NO: 2363494 - RNA, 21 nt, Bordetella pertussis
cggcgauggcguugcgcacca

SEQ ID NO: 2363495 - RNA, 20 nt, Bordetella pertussis
cggcgauggucugggugacg

SEQ ID NO: 2363496 - RNA, 14 nt, Bordetella pertussis
cggcgauguggcgc

SEQ ID NO: 2363497 - RNA, 17 nt, Bordetella pertussis
cggcgauguggcgcgcc

SEQ ID NO: 2363498 - RNA, 18 nt, Bordetella pertussis
cggcgauguggcgcgcca

SEQ ID NO: 2363499 - RNA, 17 nt, Bordetella pertussis
cggcgauugcgccagcg

SEQ ID NO: 2363500 - RNA, 19 nt, Bordetella pertussis
cggcgauugcgccagcgcu

SEQ ID NO: 2363501 - RNA, 17 nt, Bordetella pertussis
cggcgauugcggcccgc

SEQ ID NO: 2363502 - RNA, 18 nt, Bordetella pertussis
cggcgcaacccggccucg

SEQ ID NO: 2363503 - RNA, 14 nt, Bordetella pertussis
cggcgcaaccggcc

SEQ ID NO: 2363504 - RNA, 15 nt, Bordetella pertussis
cggcgcaaccggccc

SEQ ID NO: 2363505 - RNA, 17 nt, Bordetella pertussis
cggcgcaaccggcccga

SEQ ID NO: 2363506 - RNA, 16 nt, Bordetella pertussis
cggcgcaacgggccga

SEQ ID NO: 2363507 - RNA, 18 nt, Bordetella pertussis
cggcgcaauccaaccugg

SEQ ID NO: 2363508 - RNA, 24 nt, Bordetella pertussis
cggcgcacaaucugcgucgccugg

SEQ ID NO: 2363509 - RNA, 17 nt, Bordetella pertussis
cggcgcacaccaucagc

SEQ ID NO: 2363510 - RNA, 21 nt, Bordetella pertussis
cggcgcaccaaucuugccagg

SEQ ID NO: 2363511 - RNA, 13 nt, Bordetella pertussis
cggcgcaccagcg

SEQ ID NO: 2363512 - RNA, 20 nt, Bordetella pertussis
cggcgcaccagcgaggcggc

SEQ ID NO: 2363513 - RNA, 19 nt, Bordetella pertussis
cggcgcaccgacagcaagg

SEQ ID NO: 2363514 - RNA, 16 nt, Bordetella pertussis
cggcgcacgccccgac

SEQ ID NO: 2363515 - RNA, 12 nt, Bordetella pertussis
cggcgcacgccg

SEQ ID NO: 2363516 - RNA, 14 nt, Bordetella pertussis
cggcgcacgccgga

SEQ ID NO: 2363517 - RNA, 16 nt, Bordetella pertussis
cggcgcacgccggacc

SEQ ID NO: 2363518 - RNA, 19 nt, Bordetella pertussis
cggcgcagauccucgaaca

SEQ ID NO: 2363519 - RNA, 13 nt, Bordetella pertussis
cggcgcagauggc

SEQ ID NO: 2363520 - RNA, 13 nt, Bordetella pertussis
cggcgcagcacca

SEQ ID NO: 2363521 - RNA, 16 nt, Bordetella pertussis
cggcgcagcaccaggc

SEQ ID NO: 2363522 - RNA, 17 nt, Bordetella pertussis
cggcgcagcaccaggcu

SEQ ID NO: 2363523 - RNA, 19 nt, Bordetella pertussis
cggcgcagcaucuugcgcc

SEQ ID NO: 2363524 - RNA, 12 nt, Bordetella pertussis
cggcgcagcaug

SEQ ID NO: 2363525 - RNA, 20 nt, Bordetella pertussis
cggcgcagcauuucggcgcc

SEQ ID NO: 2363526 - RNA, 13 nt, Bordetella pertussis
cggcgcagcccag

SEQ ID NO: 2363527 - RNA, 14 nt, Bordetella pertussis
cggcgcagccgcca

SEQ ID NO: 2363528 - RNA, 13 nt, Bordetella pertussis
cggcgcagccggc

SEQ ID NO: 2363529 - RNA, 14 nt, Bordetella pertussis
cggcgcagccggcc

SEQ ID NO: 2363530 - RNA, 15 nt, Bordetella pertussis
cggcgcagccggccg

SEQ ID NO: 2363531 - RNA, 15 nt, Bordetella pertussis
cggcgcccggugcgc

SEQ ID NO: 2363532 - RNA, 18 nt, Bordetella pertussis
cggcgcccggugcgcgca

SEQ ID NO: 2363533 - RNA, 20 nt, Bordetella pertussis
cggcgcccggugcgcgcagg

SEQ ID NO: 2363534 - RNA, 22 nt, Bordetella pertussis
cggcgcccggugcgcgcagggc

SEQ ID NO: 2363535 - RNA, 21 nt, Bordetella pertussis
cggcgcccucuuucgccgcgc

SEQ ID NO: 2363536 - RNA, 22 nt, Bordetella pertussis
cggcgcccucuuucgccgcgcg

SEQ ID NO: 2363537 - RNA, 13 nt, Bordetella pertussis
cggcgcccugcag

SEQ ID NO: 2363538 - RNA, 23 nt, Bordetella pertussis
cggcgcccugcgcguacguggcg

SEQ ID NO: 2363539 - RNA, 13 nt, Bordetella pertussis
cggcgccgacaac

SEQ ID NO: 2363540 - RNA, 17 nt, Bordetella pertussis
cggcgccgacaacggcg

SEQ ID NO: 2363541 - RNA, 13 nt, Bordetella pertussis
cggcgccgaccag

SEQ ID NO: 2363542 - RNA, 14 nt, Bordetella pertussis
cggcgccgaccagg

SEQ ID NO: 2363543 - RNA, 12 nt, Bordetella pertussis
cggcgccgacgc

SEQ ID NO: 2363544 - RNA, 14 nt, Bordetella pertussis
cggcgccgaggcgg

SEQ ID NO: 2363545 - RNA, 16 nt, Bordetella pertussis
cggcgccgaucagcag

SEQ ID NO: 2363546 - RNA, 22 nt, Bordetella pertussis
cggcgccgauggugcgggcgau

SEQ ID NO: 2363547 - RNA, 14 nt, Bordetella pertussis
cggcgccgccccuu

SEQ ID NO: 2363548 - RNA, 16 nt, Bordetella pertussis
cggcgccgccggcggc

SEQ ID NO: 2363549 - RNA, 17 nt, Bordetella pertussis
cggcgccgccggcggcc

SEQ ID NO: 2363550 - RNA, 20 nt, Bordetella pertussis
cggcgccgccggcggccugg

SEQ ID NO: 2363551 - RNA, 20 nt, Bordetella pertussis
cggcgccgccucaggccggc

SEQ ID NO: 2363552 - RNA, 21 nt, Bordetella pertussis
cggcgccgccucaggccggcg

SEQ ID NO: 2363553 - RNA, 13 nt, Bordetella pertussis
cggcgccgccucg

SEQ ID NO: 2363554 - RNA, 22 nt, Bordetella pertussis
cggcgccgccucgggcacggcc

SEQ ID NO: 2363555 - RNA, 11 nt, Bordetella pertussis
cggcgccgcgc

SEQ ID NO: 2363556 - RNA, 14 nt, Bordetella pertussis
cggcgccgcgcagc

SEQ ID NO: 2363557 - RNA, 13 nt, Bordetella pertussis
cggcgccgcgcgc

SEQ ID NO: 2363558 - RNA, 17 nt, Bordetella pertussis
cggcgccgcgcgcggcc

SEQ ID NO: 2363559 - RNA, 14 nt, Bordetella pertussis
cggcgccgcgcgcu

SEQ ID NO: 2363560 - RNA, 15 nt, Bordetella pertussis
cggcgccgcgcgcug

SEQ ID NO: 2363561 - RNA, 13 nt, Bordetella pertussis
cggcgccgcgcgu

SEQ ID NO: 2363562 - RNA, 23 nt, Bordetella pertussis
cggcgccgcgcguaugcaccggg

SEQ ID NO: 2363563 - RNA, 14 nt, Bordetella pertussis
cggcgccgcgcuga

SEQ ID NO: 2363564 - RNA, 14 nt, Bordetella pertussis
cggcgccgcggcgc

SEQ ID NO: 2363565 - RNA, 15 nt, Bordetella pertussis
cggcgccgcggcgcu

SEQ ID NO: 2363566 - RNA, 20 nt, Bordetella pertussis
cggcgccgcguucacgccgg

SEQ ID NO: 2363567 - RNA, 14 nt, Bordetella pertussis
cggcgccgcuggcc

SEQ ID NO: 2363568 - RNA, 13 nt, Bordetella pertussis
cggcgccgcuucc

SEQ ID NO: 2363569 - RNA, 18 nt, Bordetella pertussis
cggcgccgcuuccggcau

SEQ ID NO: 2363570 - RNA, 13 nt, Bordetella pertussis
cggcgccggaucg

SEQ ID NO: 2363571 - RNA, 15 nt, Bordetella pertussis
cggcgccggaucggc

SEQ ID NO: 2363572 - RNA, 17 nt, Bordetella pertussis
cggcgccggaucggccg

SEQ ID NO: 2363573 - RNA, 20 nt, Bordetella pertussis
cggcgccggaucggccggca

SEQ ID NO: 2363574 - RNA, 12 nt, Bordetella pertussis
cggcgccggcaa

SEQ ID NO: 2363575 - RNA, 13 nt, Bordetella pertussis
cggcgccggcaaa

SEQ ID NO: 2363576 - RNA, 13 nt, Bordetella pertussis
cggcgccggcacg

SEQ ID NO: 2363577 - RNA, 16 nt, Bordetella pertussis
cggcgccggcacgguu

SEQ ID NO: 2363578 - RNA, 12 nt, Bordetella pertussis
cggcgccggccg

SEQ ID NO: 2363579 - RNA, 14 nt, Bordetella pertussis
cggcgccggccgcc

SEQ ID NO: 2363580 - RNA, 16 nt, Bordetella pertussis
cggcgccggccgcccg

SEQ ID NO: 2363581 - RNA, 14 nt, Bordetella pertussis
cggcgccggccuca

SEQ ID NO: 2363582 - RNA, 14 nt, Bordetella pertussis
cggcgccggccucc

SEQ ID NO: 2363583 - RNA, 15 nt, Bordetella pertussis
cggcgccggccucca

SEQ ID NO: 2363584 - RNA, 19 nt, Bordetella pertussis
cggcgccggccuccagcau

SEQ ID NO: 2363585 - RNA, 11 nt, Bordetella pertussis
cggcgccggcg

SEQ ID NO: 2363586 - RNA, 13 nt, Bordetella pertussis
cggcgccggcgac

SEQ ID NO: 2363587 - RNA, 18 nt, Bordetella pertussis
cggcgccggcgacgccgc

SEQ ID NO: 2363588 - RNA, 16 nt, Bordetella pertussis
cggcgccggcgcgccg

SEQ ID NO: 2363589 - RNA, 15 nt, Bordetella pertussis
cggcgccggcggcgc

SEQ ID NO: 2363590 - RNA, 13 nt, Bordetella pertussis
cggcgccggcguc

SEQ ID NO: 2363591 - RNA, 15 nt, Bordetella pertussis
cggcgccggcgucca

SEQ ID NO: 2363592 - RNA, 23 nt, Bordetella pertussis
cggcgccggcguccacggcaucg

SEQ ID NO: 2363593 - RNA, 21 nt, Bordetella pertussis
cggcgccgggcagcccgcgca

SEQ ID NO: 2363594 - RNA, 23 nt, Bordetella pertussis
cggcgccgggcagcccgcgcacg

SEQ ID NO: 2363595 - RNA, 19 nt, Bordetella pertussis
cggcgccgggcgacggcgu

SEQ ID NO: 2363596 - RNA, 22 nt, Bordetella pertussis
cggcgccgggcgacggcgugcu

SEQ ID NO: 2363597 - RNA, 20 nt, Bordetella pertussis
cggcgccgggcuggugcgcc

SEQ ID NO: 2363598 - RNA, 18 nt, Bordetella pertussis
cggcgccggugaccgcca

SEQ ID NO: 2363599 - RNA, 20 nt, Bordetella pertussis
cggcgccggugaccgccagc

SEQ ID NO: 2363600 - RNA, 21 nt, Bordetella pertussis
cggcgccggugaccgccagca

SEQ ID NO: 2363601 - RNA, 22 nt, Bordetella pertussis
cggcgccggugaccgccagcag

SEQ ID NO: 2363602 - RNA, 19 nt, Bordetella pertussis
cggcgccggugcgcggcgc

SEQ ID NO: 2363603 - RNA, 21 nt, Bordetella pertussis
cggcgccggugcgcggcgccc

SEQ ID NO: 2363604 - RNA, 18 nt, Bordetella pertussis
cggcgccggugggcaggg

SEQ ID NO: 2363605 - RNA, 15 nt, Bordetella pertussis
cggcgccguccagcg

SEQ ID NO: 2363606 - RNA, 18 nt, Bordetella pertussis
cggcgccguccagcgcgg

SEQ ID NO: 2363607 - RNA, 19 nt, Bordetella pertussis
cggcgccguccagcgcggc

SEQ ID NO: 2363608 - RNA, 20 nt, Bordetella pertussis
cggcgccguccagcgcggca

SEQ ID NO: 2363609 - RNA, 22 nt, Bordetella pertussis
cggcgccguccagcgcggcaug

SEQ ID NO: 2363610 - RNA, 23 nt, Bordetella pertussis
cggcgccguccagcgcggcaugc

SEQ ID NO: 2363611 - RNA, 23 nt, Bordetella pertussis
cggcgccguucaugcgucgaacg

SEQ ID NO: 2363612 - RNA, 19 nt, Bordetella pertussis
cggcgccguuuucagcgca

SEQ ID NO: 2363613 - RNA, 20 nt, Bordetella pertussis
cggcgccugccugccgagcg

SEQ ID NO: 2363614 - RNA, 22 nt, Bordetella pertussis
cggcgccugccugccgagcgcu

SEQ ID NO: 2363615 - RNA, 12 nt, Bordetella pertussis
cggcgccugcgc

SEQ ID NO: 2363616 - RNA, 19 nt, Bordetella pertussis
cggcgccugcgcgcgcugg

SEQ ID NO: 2363617 - RNA, 12 nt, Bordetella pertussis
cggcgccugcgu

SEQ ID NO: 2363618 - RNA, 17 nt, Bordetella pertussis
cggcgccugcgucguug

SEQ ID NO: 2363619 - RNA, 13 nt, Bordetella pertussis
cggcgccuggccg

SEQ ID NO: 2363620 - RNA, 16 nt, Bordetella pertussis
cggcgccuggccgccc

SEQ ID NO: 2363621 - RNA, 20 nt, Bordetella pertussis
cggcgccuggccgcccagcg

SEQ ID NO: 2363622 - RNA, 23 nt, Bordetella pertussis
cggcgccuggccgcccagcgccu

SEQ ID NO: 2363623 - RNA, 14 nt, Bordetella pertussis
cggcgccuggccgu

SEQ ID NO: 2363624 - RNA, 14 nt, Bordetella pertussis
cggcgccuggcgca

SEQ ID NO: 2363625 - RNA, 17 nt, Bordetella pertussis
cggcgccuggcgcauga

SEQ ID NO: 2363626 - RNA, 13 nt, Bordetella pertussis
cggcgccugggcc

SEQ ID NO: 2363627 - RNA, 14 nt, Bordetella pertussis
cggcgccuggucgc

SEQ ID NO: 2363628 - RNA, 17 nt, Bordetella pertussis
cggcgccuggucgcgcg

SEQ ID NO: 2363629 - RNA, 19 nt, Bordetella pertussis
cggcgccuggucgcgcgcc

SEQ ID NO: 2363630 - RNA, 21 nt, Bordetella pertussis
cggcgccuggucgcgcgccug

SEQ ID NO: 2363631 - RNA, 19 nt, Bordetella pertussis
cggcgccuuggccugggcg

SEQ ID NO: 2363632 - RNA, 15 nt, Bordetella pertussis
cggcgcgaacaccgg

SEQ ID NO: 2363633 - RNA, 19 nt, Bordetella pertussis
cggcgcgaacaccggcagg

SEQ ID NO: 2363634 - RNA, 22 nt, Bordetella pertussis
cggcgcgaacaccggcaggccg

SEQ ID NO: 2363635 - RNA, 16 nt, Bordetella pertussis
cggcgcgaacggcagc

SEQ ID NO: 2363636 - RNA, 17 nt, Bordetella pertussis
cggcgcgaacggcagcu

SEQ ID NO: 2363637 - RNA, 23 nt, Bordetella pertussis
cggcgcgaacggcuugauggcga

SEQ ID NO: 2363638 - RNA, 15 nt, Bordetella pertussis
cggcgcgacaggcgg

SEQ ID NO: 2363639 - RNA, 16 nt, Bordetella pertussis
cggcgcgacaggcggu

SEQ ID NO: 2363640 - RNA, 19 nt, Bordetella pertussis
cggcgcgaccgccuccagc

SEQ ID NO: 2363641 - RNA, 23 nt, Bordetella pertussis
cggcgcgaccgccuccagcgcgg

SEQ ID NO: 2363642 - RNA, 16 nt, Bordetella pertussis
cggcgcgaccugcgcg

SEQ ID NO: 2363643 - RNA, 18 nt, Bordetella pertussis
cggcgcgaccugcgcgac

SEQ ID NO: 2363644 - RNA, 12 nt, Bordetella pertussis
cggcgcggcugg

SEQ ID NO: 2363645 - RNA, 18 nt, Bordetella pertussis
cggcgcggcuuucgccgg

SEQ ID NO: 2363646 - RNA, 13 nt, Bordetella pertussis
cggcgcgggcacu

SEQ ID NO: 2363647 - RNA, 16 nt, Bordetella pertussis
cggcgcgggcacucgg

SEQ ID NO: 2363648 - RNA, 17 nt, Bordetella pertussis
cggcgcgggcacucggc

SEQ ID NO: 2363649 - RNA, 23 nt, Bordetella pertussis
cggcgcgggcacucggccauggu

SEQ ID NO: 2363650 - RNA, 17 nt, Bordetella pertussis
cggcgcgggcgcaggcg

SEQ ID NO: 2363651 - RNA, 14 nt, Bordetella pertussis
cggcgcgggcggcu

SEQ ID NO: 2363652 - RNA, 23 nt, Bordetella pertussis
cggcgcgggcggcuaggcgcagc

SEQ ID NO: 2363653 - RNA, 24 nt, Bordetella pertussis
cggcgcgggcggcuaggcgcagca

SEQ ID NO: 2363654 - RNA, 15 nt, Bordetella pertussis
cggcgcggggcaccg

SEQ ID NO: 2363655 - RNA, 20 nt, Bordetella pertussis
cggcgcgggucuugagcggc

SEQ ID NO: 2363656 - RNA, 22 nt, Bordetella pertussis
cggcgcgggucuugagcggccc

SEQ ID NO: 2363657 - RNA, 18 nt, Bordetella pertussis
cggcgcgguauggccgcc

SEQ ID NO: 2363658 - RNA, 19 nt, Bordetella pertussis
cggcgcgguauggccgccc

SEQ ID NO: 2363659 - RNA, 20 nt, Bordetella pertussis
cggcgcgguauggccgccca

SEQ ID NO: 2363660 - RNA, 19 nt, Bordetella pertussis
cggcgcgguauucgcgcug

SEQ ID NO: 2363661 - RNA, 16 nt, Bordetella pertussis
cggcgcggucagcaug

SEQ ID NO: 2363662 - RNA, 17 nt, Bordetella pertussis
cggcgcggugaggcggc

SEQ ID NO: 2363663 - RNA, 15 nt, Bordetella pertussis
cggcgcggugccugu

SEQ ID NO: 2363664 - RNA, 15 nt, Bordetella pertussis
cggcgcgguggccau

SEQ ID NO: 2363665 - RNA, 16 nt, Bordetella pertussis
cggcgcgguggccaug

SEQ ID NO: 2363666 - RNA, 18 nt, Bordetella pertussis
cggcgcgguggccaugcu

SEQ ID NO: 2363667 - RNA, 18 nt, Bordetella pertussis
cggcgcgguugguuugcg

SEQ ID NO: 2363668 - RNA, 18 nt, Bordetella pertussis
cggcgcgucgccggcgau

SEQ ID NO: 2363669 - RNA, 14 nt, Bordetella pertussis
cggcgcgucgcgcg

SEQ ID NO: 2363670 - RNA, 15 nt, Bordetella pertussis
cggcgcgucgcgcgc

SEQ ID NO: 2363671 - RNA, 17 nt, Bordetella pertussis
cggcgcgucgcgcgcca

SEQ ID NO: 2363672 - RNA, 18 nt, Bordetella pertussis
cggcgcgucgcgcgccag

SEQ ID NO: 2363673 - RNA, 16 nt, Bordetella pertussis
cggcgcgugccagcag

SEQ ID NO: 2363674 - RNA, 13 nt, Bordetella pertussis
cggcgcgugcgga

SEQ ID NO: 2363675 - RNA, 18 nt, Bordetella pertussis
cggcgcgugcuggcgcag

SEQ ID NO: 2363676 - RNA, 20 nt, Bordetella pertussis
cggcgcgugcuggcgcagca

SEQ ID NO: 2363677 - RNA, 17 nt, Bordetella pertussis
cggcgcguucagcagca

SEQ ID NO: 2363678 - RNA, 18 nt, Bordetella pertussis
cggcgcguucagcagcag

SEQ ID NO: 2363679 - RNA, 20 nt, Bordetella pertussis
cggcgcguucagcagcaggc

SEQ ID NO: 2363680 - RNA, 21 nt, Bordetella pertussis
cggcgcguucagggcgccgcg

SEQ ID NO: 2363681 - RNA, 23 nt, Bordetella pertussis
cggcgcguucagggcgccgcggc

SEQ ID NO: 2363682 - RNA, 17 nt, Bordetella pertussis
cggcgcguucgccgcag

SEQ ID NO: 2363683 - RNA, 18 nt, Bordetella pertussis
cggcgcguucgccgcagc

SEQ ID NO: 2363684 - RNA, 19 nt, Bordetella pertussis
cggcgcguucucagccgcc

SEQ ID NO: 2363685 - RNA, 20 nt, Bordetella pertussis
cggcgcguucucagccgccc

SEQ ID NO: 2363686 - RNA, 21 nt, Bordetella pertussis
cggcgcguucucagccgcccg

SEQ ID NO: 2363687 - RNA, 21 nt, Bordetella pertussis
cggcgcuacagggugccgcgc

SEQ ID NO: 2363688 - RNA, 19 nt, Bordetella pertussis
cggcgcucagagccccagg

SEQ ID NO: 2363689 - RNA, 15 nt, Bordetella pertussis
cggcgcucagcgacg

SEQ ID NO: 2363690 - RNA, 20 nt, Bordetella pertussis
cggcgcucagcgacgcgcgc

SEQ ID NO: 2363691 - RNA, 22 nt, Bordetella pertussis
cggcgcucagcgacgcgcgccg

SEQ ID NO: 2363692 - RNA, 23 nt, Bordetella pertussis
cggcgcucagcgacgcgcgccgg

SEQ ID NO: 2363693 - RNA, 17 nt, Bordetella pertussis
cggcgcucagcgcgccg

SEQ ID NO: 2363694 - RNA, 19 nt, Bordetella pertussis
cggcgcucagcgcgccgag

SEQ ID NO: 2363695 - RNA, 15 nt, Bordetella pertussis
cggcgcucaggaacc

SEQ ID NO: 2363696 - RNA, 21 nt, Bordetella pertussis
cggcgcucaggaaccagcggc

SEQ ID NO: 2363697 - RNA, 17 nt, Bordetella pertussis
cggcgcucgaaggcgcc

SEQ ID NO: 2363698 - RNA, 19 nt, Bordetella pertussis
cggcgcucgaaggcgccga

SEQ ID NO: 2363699 - RNA, 23 nt, Bordetella pertussis
cggcgcucgaaggcgccgacggc

SEQ ID NO: 2363700 - RNA, 14 nt, Bordetella pertussis
cggcgcucgccccg

SEQ ID NO: 2363701 - RNA, 16 nt, Bordetella pertussis
cggcgcucgccccggc

SEQ ID NO: 2363702 - RNA, 15 nt, Bordetella pertussis
cggcgcucggccucg

SEQ ID NO: 2363703 - RNA, 21 nt, Bordetella pertussis
cggcgcucuugguggugccug

SEQ ID NO: 2363704 - RNA, 12 nt, Bordetella pertussis
cggcgcugcagc

SEQ ID NO: 2363705 - RNA, 13 nt, Bordetella pertussis
cggcgcugcagcg

SEQ ID NO: 2363706 - RNA, 14 nt, Bordetella pertussis
cggcgcugcagcgc

SEQ ID NO: 2363707 - RNA, 15 nt, Bordetella pertussis
cggcgcugcagcgca

SEQ ID NO: 2363708 - RNA, 18 nt, Bordetella pertussis
cggcgcugcagcgcagga

SEQ ID NO: 2363709 - RNA, 16 nt, Bordetella pertussis
cggcgcugccgggguc

SEQ ID NO: 2363710 - RNA, 17 nt, Bordetella pertussis
cggcgcugccggggucc

SEQ ID NO: 2363711 - RNA, 21 nt, Bordetella pertussis
cggcgcugccgggguccuugg

SEQ ID NO: 2363712 - RNA, 14 nt, Bordetella pertussis
cggcgcugcgcagc

SEQ ID NO: 2363713 - RNA, 16 nt, Bordetella pertussis
cggcgcugcgcagcag

SEQ ID NO: 2363714 - RNA, 22 nt, Bordetella pertussis
cggcgcugcgcagcagggcggc

SEQ ID NO: 2363715 - RNA, 18 nt, Bordetella pertussis
cggcgcugcggucgcgau

SEQ ID NO: 2363716 - RNA, 14 nt, Bordetella pertussis
cggcgcugcuggcc

SEQ ID NO: 2363717 - RNA, 23 nt, Bordetella pertussis
cggcgcugcugucgcgcgacugg

SEQ ID NO: 2363718 - RNA, 15 nt, Bordetella pertussis
cggcgcuggccauca

SEQ ID NO: 2363719 - RNA, 16 nt, Bordetella pertussis
cggcgcuggccaucac

SEQ ID NO: 2363720 - RNA, 13 nt, Bordetella pertussis
cggcgcuggccug

SEQ ID NO: 2363721 - RNA, 15 nt, Bordetella pertussis
cggcgcuggccugcc

SEQ ID NO: 2363722 - RNA, 19 nt, Bordetella pertussis
cggcgcuggccuggccgcc

SEQ ID NO: 2363723 - RNA, 20 nt, Bordetella pertussis
cggcgcuggccuggccgccg

SEQ ID NO: 2363724 - RNA, 21 nt, Bordetella pertussis
cggcgcuggccuggccgccgg

SEQ ID NO: 2363725 - RNA, 23 nt, Bordetella pertussis
cggcgcuggcgagcauggcaucg

SEQ ID NO: 2363726 - RNA, 14 nt, Bordetella pertussis
cggcgcuggcgcgc

SEQ ID NO: 2363727 - RNA, 14 nt, Bordetella pertussis
cggcgcuggcguug

SEQ ID NO: 2363728 - RNA, 11 nt, Bordetella pertussis
cggcgcuggcu

SEQ ID NO: 2363729 - RNA, 18 nt, Bordetella pertussis
cggcgcuggcuggacgcg

SEQ ID NO: 2363730 - RNA, 21 nt, Bordetella pertussis
cggcgcuggcuggacgcgcgc

SEQ ID NO: 2363731 - RNA, 22 nt, Bordetella pertussis
cggcgcuggcuggacgcgcgcg

SEQ ID NO: 2363732 - RNA, 14 nt, Bordetella pertussis
cggcgcuggcuucg

SEQ ID NO: 2363733 - RNA, 17 nt, Bordetella pertussis
cggcgcugggcaggcug

SEQ ID NO: 2363734 - RNA, 13 nt, Bordetella pertussis
cggcgcugggcgc

SEQ ID NO: 2363735 - RNA, 14 nt, Bordetella pertussis
cggcgcugggcgca

SEQ ID NO: 2363736 - RNA, 15 nt, Bordetella pertussis
cggcgcugggcgcau

SEQ ID NO: 2363737 - RNA, 19 nt, Bordetella pertussis
cggcgcugggcgcauuggc

SEQ ID NO: 2363738 - RNA, 17 nt, Bordetella pertussis
cggcgcuggucaaccug

SEQ ID NO: 2363739 - RNA, 18 nt, Bordetella pertussis
cggcgcuggucaaccugg

SEQ ID NO: 2363740 - RNA, 16 nt, Bordetella pertussis
cggcgcuuaccgcgcc

SEQ ID NO: 2363741 - RNA, 17 nt, Bordetella pertussis
cggcgcuuaccgcgccg

SEQ ID NO: 2363742 - RNA, 18 nt, Bordetella pertussis
cggcgcuuaccgcgccgg

SEQ ID NO: 2363743 - RNA, 19 nt, Bordetella pertussis
cggcgcuuaccgcgccggc

SEQ ID NO: 2363744 - RNA, 20 nt, Bordetella pertussis
cggcgcuuaccgcgccggcu

SEQ ID NO: 2363745 - RNA, 22 nt, Bordetella pertussis
cggcgcuuaccgcgccggcucg

SEQ ID NO: 2363746 - RNA, 15 nt, Bordetella pertussis
cggcggaaauugggg

SEQ ID NO: 2363747 - RNA, 20 nt, Bordetella pertussis
cggcggaaauuggggccgcc

SEQ ID NO: 2363748 - RNA, 16 nt, Bordetella pertussis
cggcggaaugcggcga

SEQ ID NO: 2363749 - RNA, 17 nt, Bordetella pertussis
cggcggaaugcggcgac

SEQ ID NO: 2363750 - RNA, 14 nt, Bordetella pertussis
cggcggacugcgcc

SEQ ID NO: 2363751 - RNA, 15 nt, Bordetella pertussis
cggcggacugcgccg

SEQ ID NO: 2363752 - RNA, 16 nt, Bordetella pertussis
cggcggacugcgccgc

SEQ ID NO: 2363753 - RNA, 17 nt, Bordetella pertussis
cggcggacugcgccgca

SEQ ID NO: 2363754 - RNA, 12 nt, Bordetella pertussis
cggcggacuggc

SEQ ID NO: 2363755 - RNA, 19 nt, Bordetella pertussis
cggcggacuggccgcgccg

SEQ ID NO: 2363756 - RNA, 20 nt, Bordetella pertussis
cggcggacuggccgcgccgc

SEQ ID NO: 2363757 - RNA, 13 nt, Bordetella pertussis
cggcggcgcgccg

SEQ ID NO: 2363758 - RNA, 14 nt, Bordetella pertussis
cggcggcgcgccgc

SEQ ID NO: 2363759 - RNA, 12 nt, Bordetella pertussis
cggcggcgcgcg

SEQ ID NO: 2363760 - RNA, 13 nt, Bordetella pertussis
cggcggcgcgcug

SEQ ID NO: 2363761 - RNA, 16 nt, Bordetella pertussis
cggcggcgcggcgcca

SEQ ID NO: 2363762 - RNA, 18 nt, Bordetella pertussis
cggcggcgcggcgccaug

SEQ ID NO: 2363763 - RNA, 20 nt, Bordetella pertussis
cggcggcgcguucgccgcag

SEQ ID NO: 2363764 - RNA, 23 nt, Bordetella pertussis
cggcggcgcguucgccgcagccg

SEQ ID NO: 2363765 - RNA, 18 nt, Bordetella pertussis
cggcggcgcuggccugcc

SEQ ID NO: 2363766 - RNA, 13 nt, Bordetella pertussis
cggcggcggaucg

SEQ ID NO: 2363767 - RNA, 21 nt, Bordetella pertussis
cggcggcgggcggccggcgcg

SEQ ID NO: 2363768 - RNA, 14 nt, Bordetella pertussis
cggcggcgggcugc

SEQ ID NO: 2363769 - RNA, 15 nt, Bordetella pertussis
cggcggcgggcugca

SEQ ID NO: 2363770 - RNA, 12 nt, Bordetella pertussis
cggcggcgucgg

SEQ ID NO: 2363771 - RNA, 17 nt, Bordetella pertussis
cggcggcgucggcgccc

SEQ ID NO: 2363772 - RNA, 16 nt, Bordetella pertussis
cggcggcgugcccugc

SEQ ID NO: 2363773 - RNA, 18 nt, Bordetella pertussis
cggcggcguggcggcggg

SEQ ID NO: 2363774 - RNA, 12 nt, Bordetella pertussis
cggcggcguuca

SEQ ID NO: 2363775 - RNA, 23 nt, Bordetella pertussis
cggcggcguuccugggcacgccg

SEQ ID NO: 2363776 - RNA, 14 nt, Bordetella pertussis
cggcggcuggacgc

SEQ ID NO: 2363777 - RNA, 18 nt, Bordetella pertussis
cggcggcugugggccucg

SEQ ID NO: 2363778 - RNA, 18 nt, Bordetella pertussis
cggcggcuucgcgcagca

SEQ ID NO: 2363779 - RNA, 15 nt, Bordetella pertussis
cggcggcuucggccg

SEQ ID NO: 2363780 - RNA, 18 nt, Bordetella pertussis
cggcggcuugccgucgac

SEQ ID NO: 2363781 - RNA, 20 nt, Bordetella pertussis
cggcggcuugccgucgaccg

SEQ ID NO: 2363782 - RNA, 14 nt, Bordetella pertussis
cggcgggaacaggc

SEQ ID NO: 2363783 - RNA, 16 nt, Bordetella pertussis
cggcgggaacaggcac

SEQ ID NO: 2363784 - RNA, 18 nt, Bordetella pertussis
cggcgggaacaggcaccg

SEQ ID NO: 2363785 - RNA, 13 nt, Bordetella pertussis
cggcgggacgcag

SEQ ID NO: 2363786 - RNA, 22 nt, Bordetella pertussis
cggcgggacgcaggcccagcca

SEQ ID NO: 2363787 - RNA, 16 nt, Bordetella pertussis
cggcgggacggccauu

SEQ ID NO: 2363788 - RNA, 17 nt, Bordetella pertussis
cggcgggacggccauuc

SEQ ID NO: 2363789 - RNA, 17 nt, Bordetella pertussis
cggcgggaucgggcagc

SEQ ID NO: 2363790 - RNA, 22 nt, Bordetella pertussis
cggcgggaucugcaugccgacc

SEQ ID NO: 2363791 - RNA, 15 nt, Bordetella pertussis
cggcgggcaggcggg

SEQ ID NO: 2363792 - RNA, 20 nt, Bordetella pertussis
cggcgggcaggcgggccagg

SEQ ID NO: 2363793 - RNA, 13 nt, Bordetella pertussis
cggcgggccccgc

SEQ ID NO: 2363794 - RNA, 16 nt, Bordetella pertussis
cggcgggccccgcagg

SEQ ID NO: 2363795 - RNA, 19 nt, Bordetella pertussis
cggcgggccccgcagggcc

SEQ ID NO: 2363796 - RNA, 14 nt, Bordetella pertussis
cggcgggccgcaug

SEQ ID NO: 2363797 - RNA, 12 nt, Bordetella pertussis
cggcgggccggc

SEQ ID NO: 2363798 - RNA, 13 nt, Bordetella pertussis
cggcgggccggcu

SEQ ID NO: 2363799 - RNA, 14 nt, Bordetella pertussis
cggcgggcgccccg

SEQ ID NO: 2363800 - RNA, 21 nt, Bordetella pertussis
cggcgggcgccccgaucggcg

SEQ ID NO: 2363801 - RNA, 13 nt, Bordetella pertussis
cggcgggcgcgca

SEQ ID NO: 2363802 - RNA, 16 nt, Bordetella pertussis
cggcgggcgcuggcgc

SEQ ID NO: 2363803 - RNA, 16 nt, Bordetella pertussis
cggcgggcggccggcg

SEQ ID NO: 2363804 - RNA, 17 nt, Bordetella pertussis
cggcgggcggccggcgc

SEQ ID NO: 2363805 - RNA, 13 nt, Bordetella pertussis
cggcgggcggcgc

SEQ ID NO: 2363806 - RNA, 14 nt, Bordetella pertussis
cggcgggcggcgcc

SEQ ID NO: 2363807 - RNA, 15 nt, Bordetella pertussis
cggcgggcggcgcca

SEQ ID NO: 2363808 - RNA, 17 nt, Bordetella pertussis
cggcgggcggcgccagc

SEQ ID NO: 2363809 - RNA, 18 nt, Bordetella pertussis
cggcgggcggcgccagcg

SEQ ID NO: 2363810 - RNA, 17 nt, Bordetella pertussis
cggcgggcggcgcggcc

SEQ ID NO: 2363811 - RNA, 18 nt, Bordetella pertussis
cggcgggcggcgcggcca

SEQ ID NO: 2363812 - RNA, 20 nt, Bordetella pertussis
cggcgggcgugaugccgacc

SEQ ID NO: 2363813 - RNA, 12 nt, Bordetella pertussis
cggcgggcucag

SEQ ID NO: 2363814 - RNA, 15 nt, Bordetella pertussis
cggcgggcucagccc

SEQ ID NO: 2363815 - RNA, 20 nt, Bordetella pertussis
cggcgggcucgagcuggcug

SEQ ID NO: 2363816 - RNA, 14 nt, Bordetella pertussis
cggcgggcucggcg

SEQ ID NO: 2363817 - RNA, 22 nt, Bordetella pertussis
cggcgggcucggcgccggcggc

SEQ ID NO: 2363818 - RNA, 14 nt, Bordetella pertussis
cggcggggacaggc

SEQ ID NO: 2363819 - RNA, 18 nt, Bordetella pertussis
cggcgggucaaguccggc

SEQ ID NO: 2363820 - RNA, 20 nt, Bordetella pertussis
cggcgggucaaguccggcgc

SEQ ID NO: 2363821 - RNA, 21 nt, Bordetella pertussis
cggcgggucaaguccggcgcc

SEQ ID NO: 2363822 - RNA, 16 nt, Bordetella pertussis
cggcggguggccucgc

SEQ ID NO: 2363823 - RNA, 17 nt, Bordetella pertussis
cggcggguggcggcggg

SEQ ID NO: 2363824 - RNA, 19 nt, Bordetella pertussis
cggcggguucgcagggcgc

SEQ ID NO: 2363825 - RNA, 20 nt, Bordetella pertussis
cggcggguucgcagggcgca

SEQ ID NO: 2363826 - RNA, 17 nt, Bordetella pertussis
cggcgguaagcguccgc

SEQ ID NO: 2363827 - RNA, 21 nt, Bordetella pertussis
cggcgguaagcguccgcgcgc

SEQ ID NO: 2363828 - RNA, 16 nt, Bordetella pertussis
cggcgguaccaggccg

SEQ ID NO: 2363829 - RNA, 17 nt, Bordetella pertussis
cggcgguaccaggccga

SEQ ID NO: 2363830 - RNA, 14 nt, Bordetella pertussis
cggcggucagcgcg

SEQ ID NO: 2363831 - RNA, 17 nt, Bordetella pertussis
cggcggucagcgcggcg

SEQ ID NO: 2363832 - RNA, 18 nt, Bordetella pertussis
cggcggucagcgcggcgc

SEQ ID NO: 2363833 - RNA, 21 nt, Bordetella pertussis
cggcggucagcgcggcgccgg

SEQ ID NO: 2363834 - RNA, 12 nt, Bordetella pertussis
cggcgguccaca

SEQ ID NO: 2363835 - RNA, 17 nt, Bordetella pertussis
cggcgguccacagcccg

SEQ ID NO: 2363836 - RNA, 15 nt, Bordetella pertussis
cggcggucccgagcg

SEQ ID NO: 2363837 - RNA, 21 nt, Bordetella pertussis
cggcggucccgagcgcucccg

SEQ ID NO: 2363838 - RNA, 18 nt, Bordetella pertussis
cggcgguccugcugaucc

SEQ ID NO: 2363839 - RNA, 15 nt, Bordetella pertussis
cggcggucgcgcugg

SEQ ID NO: 2363840 - RNA, 18 nt, Bordetella pertussis
cggcggucgcgcuggccc

SEQ ID NO: 2363841 - RNA, 18 nt, Bordetella pertussis
cggcggugaccaccaggc

SEQ ID NO: 2363842 - RNA, 18 nt, Bordetella pertussis
cggcggugaugucgccgg

SEQ ID NO: 2363843 - RNA, 19 nt, Bordetella pertussis
cggcggugccagcgcaagg

SEQ ID NO: 2363844 - RNA, 15 nt, Bordetella pertussis
cggcggugccgccca

SEQ ID NO: 2363845 - RNA, 21 nt, Bordetella pertussis
cggcggugccgcccaccguga

SEQ ID NO: 2363846 - RNA, 13 nt, Bordetella pertussis
cggcggugccgcg

SEQ ID NO: 2363847 - RNA, 17 nt, Bordetella pertussis
cggcggugccgcgcacc

SEQ ID NO: 2363848 - RNA, 18 nt, Bordetella pertussis
cggcggugccgcgcaccc

SEQ ID NO: 2363849 - RNA, 20 nt, Bordetella pertussis
cggcggugccgcgcacccag

SEQ ID NO: 2363850 - RNA, 15 nt, Bordetella pertussis
cggcggugccugucc

SEQ ID NO: 2363851 - RNA, 22 nt, Bordetella pertussis
cggcgguucguccucgucggcc

SEQ ID NO: 2363852 - RNA, 23 nt, Bordetella pertussis
cggcgguucguccucgucggcca

SEQ ID NO: 2363853 - RNA, 14 nt, Bordetella pertussis
cggcgguugcccgc

SEQ ID NO: 2363854 - RNA, 16 nt, Bordetella pertussis
cggcgguugcccgccc

SEQ ID NO: 2363855 - RNA, 17 nt, Bordetella pertussis
cggcgguugcccgcccc

SEQ ID NO: 2363856 - RNA, 17 nt, Bordetella pertussis
cggcgguuucggccggg

SEQ ID NO: 2363857 - RNA, 22 nt, Bordetella pertussis
cggcgguuucuuccagcagggc

SEQ ID NO: 2363858 - RNA, 13 nt, Bordetella pertussis
cggcguaaggccg

SEQ ID NO: 2363859 - RNA, 17 nt, Bordetella pertussis
cggcguaaggccgccgg

SEQ ID NO: 2363860 - RNA, 19 nt, Bordetella pertussis
cggcguaaggccgccggcc

SEQ ID NO: 2363861 - RNA, 20 nt, Bordetella pertussis
cggcguaaggccgccggcca

SEQ ID NO: 2363862 - RNA, 21 nt, Bordetella pertussis
cggcguaaggccgccggccac

SEQ ID NO: 2363863 - RNA, 23 nt, Bordetella pertussis
cggcguaaggccgccggccacca

SEQ ID NO: 2363864 - RNA, 14 nt, Bordetella pertussis
cggcguaccaggca

SEQ ID NO: 2363865 - RNA, 15 nt, Bordetella pertussis
cggcguaccaggcag

SEQ ID NO: 2363866 - RNA, 19 nt, Bordetella pertussis
cggcguaccaggcagccgg

SEQ ID NO: 2363867 - RNA, 20 nt, Bordetella pertussis
cggcguaccaggcagccggc

SEQ ID NO: 2363868 - RNA, 21 nt, Bordetella pertussis
cggcguaccaggcagccggcc

SEQ ID NO: 2363869 - RNA, 23 nt, Bordetella pertussis
cggcguaccaggcagccggcccc

SEQ ID NO: 2363870 - RNA, 20 nt, Bordetella pertussis
cggcguggggccggccgcgc

SEQ ID NO: 2363871 - RNA, 23 nt, Bordetella pertussis
cggcguggggccggccgcgcgcg

SEQ ID NO: 2363872 - RNA, 18 nt, Bordetella pertussis
cggcgugguaucgcgcca

SEQ ID NO: 2363873 - RNA, 19 nt, Bordetella pertussis
cggcgugguaucgcgccag

SEQ ID NO: 2363874 - RNA, 23 nt, Bordetella pertussis
cggcgugguaucgcgccagcgcc

SEQ ID NO: 2363875 - RNA, 17 nt, Bordetella pertussis
cggcguguagagcugcg

SEQ ID NO: 2363876 - RNA, 16 nt, Bordetella pertussis
cggcguguccagcggc

SEQ ID NO: 2363877 - RNA, 17 nt, Bordetella pertussis
cggcguguccagcggcg

SEQ ID NO: 2363878 - RNA, 18 nt, Bordetella pertussis
cggcguguccagcggcgc

SEQ ID NO: 2363879 - RNA, 22 nt, Bordetella pertussis
cggcguguccagcggcgccagc

SEQ ID NO: 2363880 - RNA, 21 nt, Bordetella pertussis
cggcgugugcccagcaccagg

SEQ ID NO: 2363881 - RNA, 16 nt, Bordetella pertussis
cggcguguucagcgcg

SEQ ID NO: 2363882 - RNA, 17 nt, Bordetella pertussis
cggcguguucagcgcgc

SEQ ID NO: 2363883 - RNA, 22 nt, Bordetella pertussis
cggcguucaccaggaagcgcgc

SEQ ID NO: 2363884 - RNA, 14 nt, Bordetella pertussis
cggcguuccuggcg

SEQ ID NO: 2363885 - RNA, 15 nt, Bordetella pertussis
cggcguuccuggcgc

SEQ ID NO: 2363886 - RNA, 16 nt, Bordetella pertussis
cggcguuccuggcgcu

SEQ ID NO: 2363887 - RNA, 16 nt, Bordetella pertussis
cggcguuccugggcac

SEQ ID NO: 2363888 - RNA, 17 nt, Bordetella pertussis
cggcguucugcagcgcg

SEQ ID NO: 2363889 - RNA, 21 nt, Bordetella pertussis
cggcguucuggucagccgugu

SEQ ID NO: 2363890 - RNA, 17 nt, Bordetella pertussis
cggcguucuucagcgcg

SEQ ID NO: 2363891 - RNA, 18 nt, Bordetella pertussis
cggcguucuucagcgcgc

SEQ ID NO: 2363892 - RNA, 15 nt, Bordetella pertussis
cggcguugaccuggu

SEQ ID NO: 2363893 - RNA, 15 nt, Bordetella pertussis
cggcguugcggcagc

SEQ ID NO: 2363894 - RNA, 15 nt, Bordetella pertussis
cggcguugcggcgcc

SEQ ID NO: 2363895 - RNA, 16 nt, Bordetella pertussis
cggcguugcggcgcca

SEQ ID NO: 2363896 - RNA, 17 nt, Bordetella pertussis
cggcguuggccgggucg

SEQ ID NO: 2363897 - RNA, 23 nt, Bordetella pertussis
cggcguuggccgggucgcgcagc

SEQ ID NO: 2363898 - RNA, 21 nt, Bordetella pertussis
cggcguugucauuuccagaac

SEQ ID NO: 2363899 - RNA, 15 nt, Bordetella pertussis
cggcguugugccggc

SEQ ID NO: 2363900 - RNA, 17 nt, Bordetella pertussis
cggcguugugccggcgc

SEQ ID NO: 2363901 - RNA, 19 nt, Bordetella pertussis
cggcguugugccggcgcag

SEQ ID NO: 2363902 - RNA, 15 nt, Bordetella pertussis
cggcuacacccugcu

SEQ ID NO: 2363903 - RNA, 21 nt, Bordetella pertussis
cggcuacagcucgccggcgau

SEQ ID NO: 2363904 - RNA, 19 nt, Bordetella pertussis
cggcuaccacguggucugg

SEQ ID NO: 2363905 - RNA, 14 nt, Bordetella pertussis
cggcuacgaccuga

SEQ ID NO: 2363906 - RNA, 16 nt, Bordetella pertussis
cggcuaggcgcagcag

SEQ ID NO: 2363907 - RNA, 21 nt, Bordetella pertussis
cggcuaggcgcagcaggccag

SEQ ID NO: 2363908 - RNA, 22 nt, Bordetella pertussis
cggcuaggcgcagcaggccagg

SEQ ID NO: 2363909 - RNA, 18 nt, Bordetella pertussis
cggcuauaccgggcuggu

SEQ ID NO: 2363910 - RNA, 21 nt, Bordetella pertussis
cggcuauaccgggcuggucag

SEQ ID NO: 2363911 - RNA, 13 nt, Bordetella pertussis
cggcuauccgcgg

SEQ ID NO: 2363912 - RNA, 15 nt, Bordetella pertussis
cggcuauccgcgggu

SEQ ID NO: 2363913 - RNA, 18 nt, Bordetella pertussis
cggcuauccgcggguucg

SEQ ID NO: 2363914 - RNA, 22 nt, Bordetella pertussis
cggcuauccgcggguucggcgg

SEQ ID NO: 2363915 - RNA, 14 nt, Bordetella pertussis
cggcucagcccccc

SEQ ID NO: 2363916 - RNA, 23 nt, Bordetella pertussis
cggcucagccccccguaggcggc

SEQ ID NO: 2363917 - RNA, 20 nt, Bordetella pertussis
cggcucagccucgagguggc

SEQ ID NO: 2363918 - RNA, 18 nt, Bordetella pertussis
cggcucauucggcgcgcu

SEQ ID NO: 2363919 - RNA, 20 nt, Bordetella pertussis
cggcucauucggcgcgcucg

SEQ ID NO: 2363920 - RNA, 22 nt, Bordetella pertussis
cggcuccagcucagcagcgcca

SEQ ID NO: 2363921 - RNA, 13 nt, Bordetella pertussis
cggcuccaggccg

SEQ ID NO: 2363922 - RNA, 18 nt, Bordetella pertussis
cggcuccaggccgcccag

SEQ ID NO: 2363923 - RNA, 17 nt, Bordetella pertussis
cggcucccgcgccauug

SEQ ID NO: 2363924 - RNA, 15 nt, Bordetella pertussis
cggcucccgcgcugc

SEQ ID NO: 2363925 - RNA, 16 nt, Bordetella pertussis
cggcucccgcgcugcc

SEQ ID NO: 2363926 - RNA, 19 nt, Bordetella pertussis
cggcucccgcgcugccgcu

SEQ ID NO: 2363927 - RNA, 18 nt, Bordetella pertussis
cggcuccgauagcggcgc

SEQ ID NO: 2363928 - RNA, 21 nt, Bordetella pertussis
cggcuccgauagcggcgccgc

SEQ ID NO: 2363929 - RNA, 22 nt, Bordetella pertussis
cggcuccgauagcggcgccgcu

SEQ ID NO: 2363930 - RNA, 20 nt, Bordetella pertussis
cggcuccgcuaucauccgcg

SEQ ID NO: 2363931 - RNA, 14 nt, Bordetella pertussis
cggcuccggccgcu

SEQ ID NO: 2363932 - RNA, 16 nt, Bordetella pertussis
cggcuccggccgcuuc

SEQ ID NO: 2363933 - RNA, 21 nt, Bordetella pertussis
cggcuccugcuggcgcgucgg

SEQ ID NO: 2363934 - RNA, 18 nt, Bordetella pertussis
cggcucgaacaggcuggc

SEQ ID NO: 2363935 - RNA, 12 nt, Bordetella pertussis
cggcucgacgcc

SEQ ID NO: 2363936 - RNA, 17 nt, Bordetella pertussis
cggcucgacgccguacu

SEQ ID NO: 2363937 - RNA, 19 nt, Bordetella pertussis
cggcucgagcaagggccag

SEQ ID NO: 2363938 - RNA, 20 nt, Bordetella pertussis
cggcucgagcaagggccaga

SEQ ID NO: 2363939 - RNA, 21 nt, Bordetella pertussis
cggcucgagcaagggccagac

SEQ ID NO: 2363940 - RNA, 14 nt, Bordetella pertussis
cggcucgagcggca

SEQ ID NO: 2363941 - RNA, 18 nt, Bordetella pertussis
cggcucgagcggcagcag

SEQ ID NO: 2363942 - RNA, 23 nt, Bordetella pertussis
cggcucgagcggcagcagcgaga

SEQ ID NO: 2363943 - RNA, 14 nt, Bordetella pertussis
cggcucgagcuccu

SEQ ID NO: 2363944 - RNA, 18 nt, Bordetella pertussis
cggcucgagcuccugcuc

SEQ ID NO: 2363945 - RNA, 15 nt, Bordetella pertussis
cggcucgaggaacca

SEQ ID NO: 2363946 - RNA, 22 nt, Bordetella pertussis
cggcucgaggaaccagccgucg

SEQ ID NO: 2363947 - RNA, 23 nt, Bordetella pertussis
cggcucgaggaaccagccgucgg

SEQ ID NO: 2363948 - RNA, 19 nt, Bordetella pertussis
cggcucgaucgccgccggc

SEQ ID NO: 2363949 - RNA, 22 nt, Bordetella pertussis
cggcucgaugcaauagcgcccg

SEQ ID NO: 2363950 - RNA, 23 nt, Bordetella pertussis
cggcucgaugcaauagcgcccgc

SEQ ID NO: 2363951 - RNA, 14 nt, Bordetella pertussis
cggcucgccgcaua

SEQ ID NO: 2363952 - RNA, 16 nt, Bordetella pertussis
cggcucgccgcauacc

SEQ ID NO: 2363953 - RNA, 13 nt, Bordetella pertussis
cggcucgccgcgc

SEQ ID NO: 2363954 - RNA, 15 nt, Bordetella pertussis
cggcucgccgcuccg

SEQ ID NO: 2363955 - RNA, 16 nt, Bordetella pertussis
cggcucgccggccgcg

SEQ ID NO: 2363956 - RNA, 17 nt, Bordetella pertussis
cggcucgccggccgcgc

SEQ ID NO: 2363957 - RNA, 18 nt, Bordetella pertussis
cggcucgccggccgcgcc

SEQ ID NO: 2363958 - RNA, 23 nt, Bordetella pertussis
cggcucgccggccgcgcccagcg

SEQ ID NO: 2363959 - RNA, 13 nt, Bordetella pertussis
cggcucgccuccc

SEQ ID NO: 2363960 - RNA, 14 nt, Bordetella pertussis
cggcucgccucccc

SEQ ID NO: 2363961 - RNA, 22 nt, Bordetella pertussis
cggcucgccuccccaggccagc

SEQ ID NO: 2363962 - RNA, 19 nt, Bordetella pertussis
cggcucgcgcucgcccggc

SEQ ID NO: 2363963 - RNA, 20 nt, Bordetella pertussis
cggcucggaccuggccagcg

SEQ ID NO: 2363964 - RNA, 16 nt, Bordetella pertussis
cggcucggcggcaucg

SEQ ID NO: 2363965 - RNA, 21 nt, Bordetella pertussis
cggcucggugaugauggccag

SEQ ID NO: 2363966 - RNA, 22 nt, Bordetella pertussis
cggcucguaggcgagguccagg

SEQ ID NO: 2363967 - RNA, 16 nt, Bordetella pertussis
cggcucgucgaacagc

SEQ ID NO: 2363968 - RNA, 19 nt, Bordetella pertussis
cggcucgucgaacagcauc

SEQ ID NO: 2363969 - RNA, 22 nt, Bordetella pertussis
cggcucuaccaacccugccucc

SEQ ID NO: 2363970 - RNA, 21 nt, Bordetella pertussis
cggcucuggaucgugcccagc

SEQ ID NO: 2363971 - RNA, 18 nt, Bordetella pertussis
cggcugaagaagcccggc

SEQ ID NO: 2363972 - RNA, 19 nt, Bordetella pertussis
cggcugaagaagcccggcu

SEQ ID NO: 2363973 - RNA, 21 nt, Bordetella pertussis
cggcugaagaagcccggcugc

SEQ ID NO: 2363974 - RNA, 22 nt, Bordetella pertussis
cggcugaagaagcccggcugcu

SEQ ID NO: 2363975 - RNA, 16 nt, Bordetella pertussis
cggcugaauuggcgcc

SEQ ID NO: 2363976 - RNA, 17 nt, Bordetella pertussis
cggcugaauuggcgccc

SEQ ID NO: 2363977 - RNA, 17 nt, Bordetella pertussis
cggcugaucaccgccgg

SEQ ID NO: 2363978 - RNA, 19 nt, Bordetella pertussis
cggcugaugcccuucggca

SEQ ID NO: 2363979 - RNA, 18 nt, Bordetella pertussis
cggcugauucucggguuu

SEQ ID NO: 2363980 - RNA, 18 nt, Bordetella pertussis
cggcugcaagacgcccag

SEQ ID NO: 2363981 - RNA, 22 nt, Bordetella pertussis
cggcugcaagacgcccaggccc

SEQ ID NO: 2363982 - RNA, 18 nt, Bordetella pertussis
cggcuuguucgagcgcgc

SEQ ID NO: 2363983 - RNA, 21 nt, Bordetella pertussis
cggcuuguucgagcgcgcgca

SEQ ID NO: 2363984 - RNA, 15 nt, Bordetella pertussis
cggcuuuggacaggc

SEQ ID NO: 2363985 - RNA, 19 nt, Bordetella pertussis
cggcuuuggacaggcgugc

SEQ ID NO: 2363986 - RNA, 19 nt, Bordetella pertussis
cggcuuuuucucggccucg

SEQ ID NO: 2363987 - RNA, 23 nt, Bordetella pertussis
cggcuuuuuugcguucgcgccgc

SEQ ID NO: 2363988 - RNA, 13 nt, Bordetella pertussis
cgggaaacaggcc

SEQ ID NO: 2363989 - RNA, 19 nt, Bordetella pertussis
cgggaagcgcucgcgcagg

SEQ ID NO: 2363990 - RNA, 22 nt, Bordetella pertussis
cgggaagcgcucgcgcaggcgu

SEQ ID NO: 2363991 - RNA, 16 nt, Bordetella pertussis
cgggaaugaagcgcga

SEQ ID NO: 2363992 - RNA, 20 nt, Bordetella pertussis
cgggaaugauuccgcuggcg

SEQ ID NO: 2363993 - RNA, 18 nt, Bordetella pertussis
cgggaauugggcgagccc

SEQ ID NO: 2363994 - RNA, 20 nt, Bordetella pertussis
cgggaauugggcgagcccag

SEQ ID NO: 2363995 - RNA, 14 nt, Bordetella pertussis
cgggacaggcaccc

SEQ ID NO: 2363996 - RNA, 22 nt, Bordetella pertussis
cgggacaggcaccccgucgucc

SEQ ID NO: 2363997 - RNA, 15 nt, Bordetella pertussis
cgggacaggcaccuu

SEQ ID NO: 2363998 - RNA, 14 nt, Bordetella pertussis
cgggacaggcgcca

SEQ ID NO: 2363999 - RNA, 16 nt, Bordetella pertussis
cgggacaggcgccaca

SEQ ID NO: 2364000 - RNA, 19 nt, Bordetella pertussis
cgggaccgaacaccaccga

SEQ ID NO: 2364001 - RNA, 14 nt, Bordetella pertussis
cgggaccggcgcgu

SEQ ID NO: 2364002 - RNA, 18 nt, Bordetella pertussis
cgggaccuuggcggcugg

SEQ ID NO: 2364003 - RNA, 21 nt, Bordetella pertussis
cgggacgcaggcccagccagc

SEQ ID NO: 2364004 - RNA, 18 nt, Bordetella pertussis
cgggacggaaguccugca

SEQ ID NO: 2364005 - RNA, 14 nt, Bordetella pertussis
cgggacggccaggg

SEQ ID NO: 2364006 - RNA, 16 nt, Bordetella pertussis
cgggacggccaggggc

SEQ ID NO: 2364007 - RNA, 15 nt, Bordetella pertussis
cgggacugagucguc

SEQ ID NO: 2364008 - RNA, 16 nt, Bordetella pertussis
cgggacugagucguca

SEQ ID NO: 2364009 - RNA, 12 nt, Bordetella pertussis
cgggacuggcga

SEQ ID NO: 2364010 - RNA, 15 nt, Bordetella pertussis
cgggacuggcgagca

SEQ ID NO: 2364011 - RNA, 19 nt, Bordetella pertussis
cgggacuguaccgcgcgau

SEQ ID NO: 2364012 - RNA, 20 nt, Bordetella pertussis
cgggagaucuguaccgccgg

SEQ ID NO: 2364013 - RNA, 20 nt, Bordetella pertussis
cgggagccggcaagccaggg

SEQ ID NO: 2364014 - RNA, 19 nt, Bordetella pertussis
cgggagccuguccccgccg

SEQ ID NO: 2364015 - RNA, 20 nt, Bordetella pertussis
cgggagccuguccccgccgg

SEQ ID NO: 2364016 - RNA, 18 nt, Bordetella pertussis
cgggagccuguccccgcg

SEQ ID NO: 2364017 - RNA, 15 nt, Bordetella pertussis
cgggagcggccagca

SEQ ID NO: 2364018 - RNA, 16 nt, Bordetella pertussis
cgggagcggccagcaa

SEQ ID NO: 2364019 - RNA, 20 nt, Bordetella pertussis
cgggaggaagggugcggcgc

SEQ ID NO: 2364020 - RNA, 21 nt, Bordetella pertussis
cgggauaggccucggccaccu

SEQ ID NO: 2364021 - RNA, 15 nt, Bordetella pertussis
cgggauaguccagca

SEQ ID NO: 2364022 - RNA, 17 nt, Bordetella pertussis
cgggauaguccagcacc

SEQ ID NO: 2364023 - RNA, 13 nt, Bordetella pertussis
cgggauccacgcc

SEQ ID NO: 2364024 - RNA, 15 nt, Bordetella pertussis
cgggauccacgccgc

SEQ ID NO: 2364025 - RNA, 17 nt, Bordetella pertussis
cgggauccacgccgccg

SEQ ID NO: 2364026 - RNA, 18 nt, Bordetella pertussis
cgggauccacgccgccgg

SEQ ID NO: 2364027 - RNA, 21 nt, Bordetella pertussis
cgggauccacgccgccggcca

SEQ ID NO: 2364028 - RNA, 15 nt, Bordetella pertussis
cgggauccggcagca

SEQ ID NO: 2364029 - RNA, 13 nt, Bordetella pertussis
cgggaucggcguc

SEQ ID NO: 2364030 - RNA, 15 nt, Bordetella pertussis
cgggaucgggcagcu

SEQ ID NO: 2364031 - RNA, 22 nt, Bordetella pertussis
cgggaucgggcagcuuggcgcg

SEQ ID NO: 2364032 - RNA, 22 nt, Bordetella pertussis
cgggaucguggcgccgcgggcc

SEQ ID NO: 2364033 - RNA, 15 nt, Bordetella pertussis
cgggaucugcgagcc

SEQ ID NO: 2364034 - RNA, 17 nt, Bordetella pertussis
cgggaugccccgcccgc

SEQ ID NO: 2364035 - RNA, 22 nt, Bordetella pertussis
cgggaugccguaggugcgcgcc

SEQ ID NO: 2364036 - RNA, 17 nt, Bordetella pertussis
cgggaugggccacccag

SEQ ID NO: 2364037 - RNA, 22 nt, Bordetella pertussis
cgggaugggccacccagcucag

SEQ ID NO: 2364038 - RNA, 18 nt, Bordetella pertussis
cgggauguccgcgucggc

SEQ ID NO: 2364039 - RNA, 16 nt, Bordetella pertussis
cgggauuucgcuggcc

SEQ ID NO: 2364040 - RNA, 15 nt, Bordetella pertussis
cgggcaaacggcggc

SEQ ID NO: 2364041 - RNA, 22 nt, Bordetella pertussis
cgggcaaacggcggcaggccgc

SEQ ID NO: 2364042 - RNA, 15 nt, Bordetella pertussis
cgggcaaagcccagc

SEQ ID NO: 2364043 - RNA, 15 nt, Bordetella pertussis
cgggcaacaaggcca

SEQ ID NO: 2364044 - RNA, 16 nt, Bordetella pertussis
cgggcaacaaggccac

SEQ ID NO: 2364045 - RNA, 19 nt, Bordetella pertussis
cgggcaacaaggccacgaa

SEQ ID NO: 2364046 - RNA, 14 nt, Bordetella pertussis
cgggcaacuucacc

SEQ ID NO: 2364047 - RNA, 18 nt, Bordetella pertussis
cgggcaagcggcguaucg

SEQ ID NO: 2364048 - RNA, 17 nt, Bordetella pertussis
cgggcaaucggcgugca

SEQ ID NO: 2364049 - RNA, 23 nt, Bordetella pertussis
cgggcaaucggcgugcagcaagc

SEQ ID NO: 2364050 - RNA, 16 nt, Bordetella pertussis
cgggcacaacccgccc

SEQ ID NO: 2364051 - RNA, 17 nt, Bordetella pertussis
cgggcacaacccgcccg

SEQ ID NO: 2364052 - RNA, 20 nt, Bordetella pertussis
cgggcacaacccgcccgggg

SEQ ID NO: 2364053 - RNA, 21 nt, Bordetella pertussis
cgggcacaacccgcccggggc

SEQ ID NO: 2364054 - RNA, 20 nt, Bordetella pertussis
cgggcacaccgucacgcgca

SEQ ID NO: 2364055 - RNA, 15 nt, Bordetella pertussis
cgggcaccagcacuu

SEQ ID NO: 2364056 - RNA, 19 nt, Bordetella pertussis
cgggcaccaucucccgcag

SEQ ID NO: 2364057 - RNA, 18 nt, Bordetella pertussis
cgggcaccaugcgcgagg

SEQ ID NO: 2364058 - RNA, 20 nt, Bordetella pertussis
cgggcaccaugcgcgagggc

SEQ ID NO: 2364059 - RNA, 18 nt, Bordetella pertussis
cgggcaccgacacgcugg

SEQ ID NO: 2364060 - RNA, 20 nt, Bordetella pertussis
cgggcaccgacacgcuggcg

SEQ ID NO: 2364061 - RNA, 13 nt, Bordetella pertussis
cgggcaccgagcc

SEQ ID NO: 2364062 - RNA, 19 nt, Bordetella pertussis
cgggcacgagaucgccugg

SEQ ID NO: 2364063 - RNA, 17 nt, Bordetella pertussis
cgggcacgaucaccgcc

SEQ ID NO: 2364064 - RNA, 18 nt, Bordetella pertussis
cgggcacgaucaccgccg

SEQ ID NO: 2364065 - RNA, 20 nt, Bordetella pertussis
cgggcacgaucaccgccgcg

SEQ ID NO: 2364066 - RNA, 22 nt, Bordetella pertussis
cgggcacgaucaccgccgcggc

SEQ ID NO: 2364067 - RNA, 22 nt, Bordetella pertussis
cgggcacgaugcguugcgccuc

SEQ ID NO: 2364068 - RNA, 14 nt, Bordetella pertussis
cgggcacgauggcc

SEQ ID NO: 2364069 - RNA, 18 nt, Bordetella pertussis
cgggcacgauggccgcgc

SEQ ID NO: 2364070 - RNA, 21 nt, Bordetella pertussis
cgggcacgauggccgcgccca

SEQ ID NO: 2364071 - RNA, 12 nt, Bordetella pertussis
cgggcacggcca

SEQ ID NO: 2364072 - RNA, 18 nt, Bordetella pertussis
cgggcacggccagcacca

SEQ ID NO: 2364073 - RNA, 21 nt, Bordetella pertussis
cgggcacggccagcaccaugg

SEQ ID NO: 2364074 - RNA, 19 nt, Bordetella pertussis
cgggcacguaguacagcag

SEQ ID NO: 2364075 - RNA, 19 nt, Bordetella pertussis
cgggcacguccggaucuuc

SEQ ID NO: 2364076 - RNA, 16 nt, Bordetella pertussis
cgggcacucggccaug

SEQ ID NO: 2364077 - RNA, 20 nt, Bordetella pertussis
cgggcagcaauucgaccggc

SEQ ID NO: 2364078 - RNA, 13 nt, Bordetella pertussis
cgggcagcaccgc

SEQ ID NO: 2364079 - RNA, 22 nt, Bordetella pertussis
cgggcagcaccggggcagggcg

SEQ ID NO: 2364080 - RNA, 12 nt, Bordetella pertussis
cgggcagcacgc

SEQ ID NO: 2364081 - RNA, 17 nt, Bordetella pertussis
cgggcagcacgcgcacc

SEQ ID NO: 2364082 - RNA, 20 nt, Bordetella pertussis
cgggcagcacgcgcaccagg

SEQ ID NO: 2364083 - RNA, 16 nt, Bordetella pertussis
cgggcagcagcagggc

SEQ ID NO: 2364084 - RNA, 20 nt, Bordetella pertussis
cgggcagcagcagggccagg

SEQ ID NO: 2364085 - RNA, 21 nt, Bordetella pertussis
cgggcagcagcagggccaggc

SEQ ID NO: 2364086 - RNA, 23 nt, Bordetella pertussis
cgggcagcagcagggccaggccg

SEQ ID NO: 2364087 - RNA, 12 nt, Bordetella pertussis
cgggcagcaugg

SEQ ID NO: 2364088 - RNA, 14 nt, Bordetella pertussis
cgggcagcauggcg

SEQ ID NO: 2364089 - RNA, 16 nt, Bordetella pertussis
cgggcagcauggcgcc

SEQ ID NO: 2364090 - RNA, 17 nt, Bordetella pertussis
cgggcagcauggcgcca

SEQ ID NO: 2364091 - RNA, 16 nt, Bordetella pertussis
cgggcagcccgcgcac

SEQ ID NO: 2364092 - RNA, 12 nt, Bordetella pertussis
cgggcagcgccc

SEQ ID NO: 2364093 - RNA, 13 nt, Bordetella pertussis
cgggcagcgcccg

SEQ ID NO: 2364094 - RNA, 16 nt, Bordetella pertussis
cgggcagcggcgacgg

SEQ ID NO: 2364095 - RNA, 19 nt, Bordetella pertussis
cgggccgggcaggccgcgc

SEQ ID NO: 2364096 - RNA, 18 nt, Bordetella pertussis
cgggccgguuucggccug

SEQ ID NO: 2364097 - RNA, 21 nt, Bordetella pertussis
cgggccgguuucggccugcag

SEQ ID NO: 2364098 - RNA, 15 nt, Bordetella pertussis
cgggccgucgccgcg

SEQ ID NO: 2364099 - RNA, 16 nt, Bordetella pertussis
cgggccgucgccgcgc

SEQ ID NO: 2364100 - RNA, 18 nt, Bordetella pertussis
cgggccgucgccgcgcgg

SEQ ID NO: 2364101 - RNA, 19 nt, Bordetella pertussis
cgggccgucgccgcgcggc

SEQ ID NO: 2364102 - RNA, 15 nt, Bordetella pertussis
cgggccgucgugcgc

SEQ ID NO: 2364103 - RNA, 19 nt, Bordetella pertussis
cgggccgucgugcgccugg

SEQ ID NO: 2364104 - RNA, 22 nt, Bordetella pertussis
cgggccgucgugcgccuggcgg

SEQ ID NO: 2364105 - RNA, 19 nt, Bordetella pertussis
cgggccgucuacaggccca

SEQ ID NO: 2364106 - RNA, 23 nt, Bordetella pertussis
cgggccguggcgauccagggccg

SEQ ID NO: 2364107 - RNA, 17 nt, Bordetella pertussis
cgggccuacuucggcag

SEQ ID NO: 2364108 - RNA, 14 nt, Bordetella pertussis
cgggccuagcccgg

SEQ ID NO: 2364109 - RNA, 15 nt, Bordetella pertussis
cgggccuagcccggc

SEQ ID NO: 2364110 - RNA, 18 nt, Bordetella pertussis
cgggccuagcccggcgcc

SEQ ID NO: 2364111 - RNA, 19 nt, Bordetella pertussis
cgggccuagcccggcgcca

SEQ ID NO: 2364112 - RNA, 21 nt, Bordetella pertussis
cgggccucgaagcccggcagg

SEQ ID NO: 2364113 - RNA, 16 nt, Bordetella pertussis
cgggccucgacgggga

SEQ ID NO: 2364114 - RNA, 18 nt, Bordetella pertussis
cgggccucgaugaccggg

SEQ ID NO: 2364115 - RNA, 14 nt, Bordetella pertussis
cgggccugcagcau

SEQ ID NO: 2364116 - RNA, 15 nt, Bordetella pertussis
cgggccugcagcaug

SEQ ID NO: 2364117 - RNA, 12 nt, Bordetella pertussis
cgggccugcagu

SEQ ID NO: 2364118 - RNA, 13 nt, Bordetella pertussis
cgggccugccgcg

SEQ ID NO: 2364119 - RNA, 14 nt, Bordetella pertussis
cgggccugccgcgc

SEQ ID NO: 2364120 - RNA, 14 nt, Bordetella pertussis
cgggccuggaucgg

SEQ ID NO: 2364121 - RNA, 18 nt, Bordetella pertussis
cgggccuggccugcgccg

SEQ ID NO: 2364122 - RNA, 20 nt, Bordetella pertussis
cgggccuggccugcgccgcc

SEQ ID NO: 2364123 - RNA, 12 nt, Bordetella pertussis
cgggccuggcgu

SEQ ID NO: 2364124 - RNA, 15 nt, Bordetella pertussis
cgggccuggcguucg

SEQ ID NO: 2364125 - RNA, 22 nt, Bordetella pertussis
cgggccuggcguucggcaccgg

SEQ ID NO: 2364126 - RNA, 17 nt, Bordetella pertussis
cgggccuggugcccgac

SEQ ID NO: 2364127 - RNA, 19 nt, Bordetella pertussis
cgggccuggugcccgacgc

SEQ ID NO: 2364128 - RNA, 20 nt, Bordetella pertussis
cgggccuuggccagcagcgc

SEQ ID NO: 2364129 - RNA, 23 nt, Bordetella pertussis
cgggccuuggccagcagcgcauc

SEQ ID NO: 2364130 - RNA, 16 nt, Bordetella pertussis
cgggcgaaccgguggc

SEQ ID NO: 2364131 - RNA, 17 nt, Bordetella pertussis
cgggcgaaccgguggcc

SEQ ID NO: 2364132 - RNA, 14 nt, Bordetella pertussis
cgggcgacaggcgc

SEQ ID NO: 2364133 - RNA, 18 nt, Bordetella pertussis
cgggcgacaggcgcgccc

SEQ ID NO: 2364134 - RNA, 17 nt, Bordetella pertussis
cgggcgaccccggaggg

SEQ ID NO: 2364135 - RNA, 18 nt, Bordetella pertussis
cgggcgagaucagccacc

SEQ ID NO: 2364136 - RNA, 12 nt, Bordetella pertussis
cgggcgagaugg

SEQ ID NO: 2364137 - RNA, 18 nt, Bordetella pertussis
cgggcgagauggcgugca

SEQ ID NO: 2364138 - RNA, 19 nt, Bordetella pertussis
cgggcgaggacuacgcggu

SEQ ID NO: 2364139 - RNA, 15 nt, Bordetella pertussis
cgggcgaggcggggc

SEQ ID NO: 2364140 - RNA, 16 nt, Bordetella pertussis
cgggcgaggcggggcu

SEQ ID NO: 2364141 - RNA, 16 nt, Bordetella pertussis
cgggcgaggucagccc

SEQ ID NO: 2364142 - RNA, 22 nt, Bordetella pertussis
cgggcgaggucagcccggcggc

SEQ ID NO: 2364143 - RNA, 18 nt, Bordetella pertussis
cgggcgauauccaucggc

SEQ ID NO: 2364144 - RNA, 20 nt, Bordetella pertussis
cgggcgauauccaucggcgc

SEQ ID NO: 2364145 - RNA, 22 nt, Bordetella pertussis
cgggcgauauccaucggcgcgc

SEQ ID NO: 2364146 - RNA, 16 nt, Bordetella pertussis
cgggcgaucgcgucgg

SEQ ID NO: 2364147 - RNA, 18 nt, Bordetella pertussis
cgggcgaucgcgucggcc

SEQ ID NO: 2364148 - RNA, 16 nt, Bordetella pertussis
cgggcgauugcucgac

SEQ ID NO: 2364149 - RNA, 19 nt, Bordetella pertussis
cgggcgauuugccgcagcc

SEQ ID NO: 2364150 - RNA, 22 nt, Bordetella pertussis
cgggcgauuugccgcagcccgc

SEQ ID NO: 2364151 - RNA, 17 nt, Bordetella pertussis
cgggcgcaagccagcac

SEQ ID NO: 2364152 - RNA, 14 nt, Bordetella pertussis
cgggcgcaagcgcg

SEQ ID NO: 2364153 - RNA, 21 nt, Bordetella pertussis
cgggcgcaaguguggcgcacc

SEQ ID NO: 2364154 - RNA, 21 nt, Bordetella pertussis
cgggcgcacaguugcaggcca

SEQ ID NO: 2364155 - RNA, 14 nt, Bordetella pertussis
cgggcgcagcgccg

SEQ ID NO: 2364156 - RNA, 18 nt, Bordetella pertussis
cgggcgcagcgccgcuuc

SEQ ID NO: 2364157 - RNA, 17 nt, Bordetella pertussis
cgggcgcaggcguuucg

SEQ ID NO: 2364158 - RNA, 18 nt, Bordetella pertussis
cgggcgcauugccgccaa

SEQ ID NO: 2364159 - RNA, 10 nt, Bordetella pertussis
cgggcgccag

SEQ ID NO: 2364160 - RNA, 20 nt, Bordetella pertussis
cgggcgccagcagcgggcug

SEQ ID NO: 2364161 - RNA, 21 nt, Bordetella pertussis
cgggcgccagcagcgggcugg

SEQ ID NO: 2364162 - RNA, 17 nt, Bordetella pertussis
cgggcgccaucgcggua

SEQ ID NO: 2364163 - RNA, 12 nt, Bordetella pertussis
cgggcgcccagc

SEQ ID NO: 2364164 - RNA, 21 nt, Bordetella pertussis
cgggcgccccgaucggcgccg

SEQ ID NO: 2364165 - RNA, 14 nt, Bordetella pertussis
cgggcgcccgcgcg

SEQ ID NO: 2364166 - RNA, 22 nt, Bordetella pertussis
cgggcgcccgcuucucacugcc

SEQ ID NO: 2364167 - RNA, 16 nt, Bordetella pertussis
cgggcgcccggccggc

SEQ ID NO: 2364168 - RNA, 19 nt, Bordetella pertussis
cgggcgcccggccggccuu

SEQ ID NO: 2364169 - RNA, 17 nt, Bordetella pertussis
cgggcgccgcaacgccg

SEQ ID NO: 2364170 - RNA, 14 nt, Bordetella pertussis
cgggcgccgcgccc

SEQ ID NO: 2364171 - RNA, 14 nt, Bordetella pertussis
cgggcgccggcggc

SEQ ID NO: 2364172 - RNA, 20 nt, Bordetella pertussis
cgggcgccggcgucacgcgg

SEQ ID NO: 2364173 - RNA, 20 nt, Bordetella pertussis
cgggcgccucguccugcagg

SEQ ID NO: 2364174 - RNA, 13 nt, Bordetella pertussis
cgggcgccugccg

SEQ ID NO: 2364175 - RNA, 12 nt, Bordetella pertussis
cgggcgccugcg

SEQ ID NO: 2364176 - RNA, 14 nt, Bordetella pertussis
cgggcgccugcggc

SEQ ID NO: 2364177 - RNA, 15 nt, Bordetella pertussis
cgggcgccugcggca

SEQ ID NO: 2364178 - RNA, 22 nt, Bordetella pertussis
cgggcgccugcggcaggccgca

SEQ ID NO: 2364179 - RNA, 24 nt, Bordetella pertussis
cgggcgccugcggcaggccgcagc

SEQ ID NO: 2364180 - RNA, 21 nt, Bordetella pertussis
cgggcgccuguccccgcagga

SEQ ID NO: 2364181 - RNA, 14 nt, Bordetella pertussis
cgggcgcgcagcgc

SEQ ID NO: 2364182 - RNA, 15 nt, Bordetella pertussis
cgggcgcgcagcgcg

SEQ ID NO: 2364183 - RNA, 16 nt, Bordetella pertussis
cgggcgcgcagcgcga

SEQ ID NO: 2364184 - RNA, 18 nt, Bordetella pertussis
cgggcgcgcccggcgcgc

SEQ ID NO: 2364185 - RNA, 14 nt, Bordetella pertussis
cgggcgcgccggcg

SEQ ID NO: 2364186 - RNA, 20 nt, Bordetella pertussis
cgggcgcgccggcgggcgcu

SEQ ID NO: 2364187 - RNA, 21 nt, Bordetella pertussis
cgggcgcgccgucgcuggggc

SEQ ID NO: 2364188 - RNA, 16 nt, Bordetella pertussis
cgggcgcgcgccggcg

SEQ ID NO: 2364189 - RNA, 18 nt, Bordetella pertussis
cgggcgcgcgccggcggc

SEQ ID NO: 2364190 - RNA, 13 nt, Bordetella pertussis
cgggcgcgcugcc

SEQ ID NO: 2364191 - RNA, 14 nt, Bordetella pertussis
cgggcgcgcugccc

SEQ ID NO: 2364192 - RNA, 17 nt, Bordetella pertussis
cgggcgcgcugcccagc

SEQ ID NO: 2364193 - RNA, 15 nt, Bordetella pertussis
cgggcgcgcuucagu

SEQ ID NO: 2364194 - RNA, 22 nt, Bordetella pertussis
cgggcgcgcuucagugcucggg

SEQ ID NO: 2364195 - RNA, 15 nt, Bordetella pertussis
cgggcgcggcaggcg

SEQ ID NO: 2364196 - RNA, 18 nt, Bordetella pertussis
cgggcgcggcauggcgcc

SEQ ID NO: 2364197 - RNA, 22 nt, Bordetella pertussis
cgggcgcggcauggcgccgcgc

SEQ ID NO: 2364198 - RNA, 15 nt, Bordetella pertussis
cgggcgcggccaggc

SEQ ID NO: 2364199 - RNA, 18 nt, Bordetella pertussis
cgggcgcggccaggcgcu

SEQ ID NO: 2364200 - RNA, 16 nt, Bordetella pertussis
cgggcgcggcccggcg

SEQ ID NO: 2364201 - RNA, 19 nt, Bordetella pertussis
cgggcgcggcccggcgucg

SEQ ID NO: 2364202 - RNA, 14 nt, Bordetella pertussis
cgggcgcggccgcc

SEQ ID NO: 2364203 - RNA, 15 nt, Bordetella pertussis
cgggcgcggccgccg

SEQ ID NO: 2364204 - RNA, 22 nt, Bordetella pertussis
cgggcgcggccgccgcccgccu

SEQ ID NO: 2364205 - RNA, 16 nt, Bordetella pertussis
cgggcgcgggcugucg

SEQ ID NO: 2364206 - RNA, 22 nt, Bordetella pertussis
cgggcgcgguauucgcugcugg

SEQ ID NO: 2364207 - RNA, 20 nt, Bordetella pertussis
cgggcgcggugcgcaccagg

SEQ ID NO: 2364208 - RNA, 20 nt, Bordetella pertussis
cggggaacaggcgcgccagc

SEQ ID NO: 2364209 - RNA, 21 nt, Bordetella pertussis
cggggaacaggcgcgccagcc

SEQ ID NO: 2364210 - RNA, 22 nt, Bordetella pertussis
cggggaagauguggucggcgcc

SEQ ID NO: 2364211 - RNA, 15 nt, Bordetella pertussis
cggggacaggcacac

SEQ ID NO: 2364212 - RNA, 16 nt, Bordetella pertussis
cggggacaggcacacc

SEQ ID NO: 2364213 - RNA, 20 nt, Bordetella pertussis
cggggacaggcaccccagca

SEQ ID NO: 2364214 - RNA, 19 nt, Bordetella pertussis
cggggacaggcacccgcac

SEQ ID NO: 2364215 - RNA, 17 nt, Bordetella pertussis
cggggacaggcaccgcc

SEQ ID NO: 2364216 - RNA, 18 nt, Bordetella pertussis
cggggacaggcaccgccg

SEQ ID NO: 2364217 - RNA, 16 nt, Bordetella pertussis
cggggacaggcaccuc

SEQ ID NO: 2364218 - RNA, 14 nt, Bordetella pertussis
cggggacaggcacg

SEQ ID NO: 2364219 - RNA, 16 nt, Bordetella pertussis
cggggacaggcgccuc

SEQ ID NO: 2364220 - RNA, 17 nt, Bordetella pertussis
cggggaccggcacccgc

SEQ ID NO: 2364221 - RNA, 15 nt, Bordetella pertussis
cggggacgccggcgg

SEQ ID NO: 2364222 - RNA, 18 nt, Bordetella pertussis
cggggacgccggcgggca

SEQ ID NO: 2364223 - RNA, 15 nt, Bordetella pertussis
cggggacgggcgccc

SEQ ID NO: 2364224 - RNA, 15 nt, Bordetella pertussis
cggggacuggcacca

SEQ ID NO: 2364225 - RNA, 17 nt, Bordetella pertussis
cggggacuggcaccaau

SEQ ID NO: 2364226 - RNA, 15 nt, Bordetella pertussis
cggggacuggcaccg

SEQ ID NO: 2364227 - RNA, 18 nt, Bordetella pertussis
cggggacuggcaccggcc

SEQ ID NO: 2364228 - RNA, 20 nt, Bordetella pertussis
cggggacuggcacgcgcuga

SEQ ID NO: 2364229 - RNA, 18 nt, Bordetella pertussis
cggggaucaccagcccgg

SEQ ID NO: 2364230 - RNA, 18 nt, Bordetella pertussis
cggggauggaguucagca

SEQ ID NO: 2364231 - RNA, 14 nt, Bordetella pertussis
cggggauggcuucc

SEQ ID NO: 2364232 - RNA, 21 nt, Bordetella pertussis
cggggauggcuuccugcggca

SEQ ID NO: 2364233 - RNA, 19 nt, Bordetella pertussis
cggggcaacgacgcaggcg

SEQ ID NO: 2364234 - RNA, 22 nt, Bordetella pertussis
cggggcaacgacgcaggcgccg

SEQ ID NO: 2364235 - RNA, 15 nt, Bordetella pertussis
cggggcacccaggcg

SEQ ID NO: 2364236 - RNA, 16 nt, Bordetella pertussis
cggggcacccaggcgg

SEQ ID NO: 2364237 - RNA, 17 nt, Bordetella pertussis
cggggcacccaggcggg

SEQ ID NO: 2364238 - RNA, 23 nt, Bordetella pertussis
cggggcacccaggcgggcuggcg

SEQ ID NO: 2364239 - RNA, 23 nt, Bordetella pertussis
cggggcagcgaauacggcaagca

SEQ ID NO: 2364240 - RNA, 20 nt, Bordetella pertussis
cggggcaggaagccggcccg

SEQ ID NO: 2364241 - RNA, 14 nt, Bordetella pertussis
cggggcaggccgau

SEQ ID NO: 2364242 - RNA, 13 nt, Bordetella pertussis
cggggcaggccug

SEQ ID NO: 2364243 - RNA, 14 nt, Bordetella pertussis
cggggcaggccugg

SEQ ID NO: 2364244 - RNA, 19 nt, Bordetella pertussis
cggggcagggcgccugcag

SEQ ID NO: 2364245 - RNA, 13 nt, Bordetella pertussis
cggggcagggcgg

SEQ ID NO: 2364246 - RNA, 22 nt, Bordetella pertussis
cggggcaucaauagcccgugcg

SEQ ID NO: 2364247 - RNA, 24 nt, Bordetella pertussis
cggggcaucaauagcccgugcggg

SEQ ID NO: 2364248 - RNA, 17 nt, Bordetella pertussis
cggggccaagauccagc

SEQ ID NO: 2364249 - RNA, 21 nt, Bordetella pertussis
cggggccacauggucgcccag

SEQ ID NO: 2364250 - RNA, 22 nt, Bordetella pertussis
cggggccacauggucgcccagc

SEQ ID NO: 2364251 - RNA, 14 nt, Bordetella pertussis
cggggccaggcgca

SEQ ID NO: 2364252 - RNA, 17 nt, Bordetella pertussis
cggggcccgcgggcgcc

SEQ ID NO: 2364253 - RNA, 18 nt, Bordetella pertussis
cggggcccgcgggcgccc

SEQ ID NO: 2364254 - RNA, 22 nt, Bordetella pertussis
cggggccgauggucagcguguc

SEQ ID NO: 2364255 - RNA, 12 nt, Bordetella pertussis
cggggccgcagc

SEQ ID NO: 2364256 - RNA, 22 nt, Bordetella pertussis
cggggccgcccagcaccuuggc

SEQ ID NO: 2364257 - RNA, 17 nt, Bordetella pertussis
cggggccgcccugguca

SEQ ID NO: 2364258 - RNA, 12 nt, Bordetella pertussis
cggggccgccuc

SEQ ID NO: 2364259 - RNA, 17 nt, Bordetella pertussis
cggggccgccucggcgg

SEQ ID NO: 2364260 - RNA, 20 nt, Bordetella pertussis
cggggccgccucggcggcca

SEQ ID NO: 2364261 - RNA, 16 nt, Bordetella pertussis
cggggccgcgccggcu

SEQ ID NO: 2364262 - RNA, 21 nt, Bordetella pertussis
cggggccgcuucggccugcgc

SEQ ID NO: 2364263 - RNA, 15 nt, Bordetella pertussis
cggggccgguccgcu

SEQ ID NO: 2364264 - RNA, 17 nt, Bordetella pertussis
cggggcgagcgcagccg

SEQ ID NO: 2364265 - RNA, 13 nt, Bordetella pertussis
cggggcgcccagc

SEQ ID NO: 2364266 - RNA, 14 nt, Bordetella pertussis
cggggcgcgagagg

SEQ ID NO: 2364267 - RNA, 15 nt, Bordetella pertussis
cggggcgcucgagcg

SEQ ID NO: 2364268 - RNA, 21 nt, Bordetella pertussis
cggggcgcucgagcgccugca

SEQ ID NO: 2364269 - RNA, 14 nt, Bordetella pertussis
cggggcgcuugcca

SEQ ID NO: 2364270 - RNA, 18 nt, Bordetella pertussis
cggggcgcuugccacuau

SEQ ID NO: 2364271 - RNA, 14 nt, Bordetella pertussis
cggggcggcagguc

SEQ ID NO: 2364272 - RNA, 16 nt, Bordetella pertussis
cggggcggcaggucgc

SEQ ID NO: 2364273 - RNA, 18 nt, Bordetella pertussis
cggggcggcaggucgcgc

SEQ ID NO: 2364274 - RNA, 14 nt, Bordetella pertussis
cggggcggcgcagc

SEQ ID NO: 2364275 - RNA, 15 nt, Bordetella pertussis
cggggcggcgcagca

SEQ ID NO: 2364276 - RNA, 13 nt, Bordetella pertussis
cggggcgggcgcg

SEQ ID NO: 2364277 - RNA, 22 nt, Bordetella pertussis
cggggcggucaaugcggcggcg

SEQ ID NO: 2364278 - RNA, 19 nt, Bordetella pertussis
cggggcguagcucagccug

SEQ ID NO: 2364279 - RNA, 15 nt, Bordetella pertussis
cggggcguccaccgc

SEQ ID NO: 2364280 - RNA, 16 nt, Bordetella pertussis
cggggcguccaccgcc

SEQ ID NO: 2364281 - RNA, 21 nt, Bordetella pertussis
cggggcgucgcugcuggcggc

SEQ ID NO: 2364282 - RNA, 20 nt, Bordetella pertussis
cggggcgucgucgcggucca

SEQ ID NO: 2364283 - RNA, 23 nt, Bordetella pertussis
cggggcgucgucgcgguccagca

SEQ ID NO: 2364284 - RNA, 18 nt, Bordetella pertussis
cggggcgugagcaggcgc

SEQ ID NO: 2364285 - RNA, 21 nt, Bordetella pertussis
cggggcucgugguggguuggc

SEQ ID NO: 2364286 - RNA, 11 nt, Bordetella pertussis
cggggcuggcc

SEQ ID NO: 2364287 - RNA, 18 nt, Bordetella pertussis
cggggcuggccagcuggc

SEQ ID NO: 2364288 - RNA, 12 nt, Bordetella pertussis
cggggcuggcgc

SEQ ID NO: 2364289 - RNA, 16 nt, Bordetella pertussis
cggggcugucgcgcgc

SEQ ID NO: 2364290 - RNA, 16 nt, Bordetella pertussis
cgggggacgcccgccc

SEQ ID NO: 2364291 - RNA, 15 nt, Bordetella pertussis
cgggggcaggcacgc

SEQ ID NO: 2364292 - RNA, 14 nt, Bordetella pertussis
cgggggccggcucg

SEQ ID NO: 2364293 - RNA, 20 nt, Bordetella pertussis
cgggggcggccggggccgcc

SEQ ID NO: 2364294 - RNA, 16 nt, Bordetella pertussis
cggggguuccugccca

SEQ ID NO: 2364295 - RNA, 24 nt, Bordetella pertussis
cggggucaauccgcccguugcggc

SEQ ID NO: 2364296 - RNA, 15 nt, Bordetella pertussis
cggggucagcgccgg

SEQ ID NO: 2364297 - RNA, 20 nt, Bordetella pertussis
cggggucagcgccggcacgc

SEQ ID NO: 2364298 - RNA, 22 nt, Bordetella pertussis
cggggucgaucgcaucgcggca

SEQ ID NO: 2364299 - RNA, 15 nt, Bordetella pertussis
cggggucgucggcgc

SEQ ID NO: 2364300 - RNA, 22 nt, Bordetella pertussis
cggggucuugccgcgcagcguc

SEQ ID NO: 2364301 - RNA, 17 nt, Bordetella pertussis
cggggugaucugcgcca

SEQ ID NO: 2364302 - RNA, 20 nt, Bordetella pertussis
cggggugccguucggccagc

SEQ ID NO: 2364303 - RNA, 14 nt, Bordetella pertussis
cggggugccugucc

SEQ ID NO: 2364304 - RNA, 17 nt, Bordetella pertussis
cggggugccuguccccg

SEQ ID NO: 2364305 - RNA, 21 nt, Bordetella pertussis
cggggugccuguccccgcgga

SEQ ID NO: 2364306 - RNA, 21 nt, Bordetella pertussis
cggggugccuguccccgcggg

SEQ ID NO: 2364307 - RNA, 23 nt, Bordetella pertussis
cggggugccuguccccgcgggga

SEQ ID NO: 2364308 - RNA, 14 nt, Bordetella pertussis
cgggguggcacagc

SEQ ID NO: 2364309 - RNA, 14 nt, Bordetella pertussis
cgggguggccggcg

SEQ ID NO: 2364310 - RNA, 16 nt, Bordetella pertussis
cgggguggccggcgcg

SEQ ID NO: 2364311 - RNA, 20 nt, Bordetella pertussis
cgggguggccggcgcgcggc

SEQ ID NO: 2364312 - RNA, 21 nt, Bordetella pertussis
cgggguggccggcgcgcggcc

SEQ ID NO: 2364313 - RNA, 21 nt, Bordetella pertussis
cgggguggucuuccaggcgca

SEQ ID NO: 2364314 - RNA, 15 nt, Bordetella pertussis
cggggugugccgaug

SEQ ID NO: 2364315 - RNA, 17 nt, Bordetella pertussis
cgggguuccacagcgcc

SEQ ID NO: 2364316 - RNA, 18 nt, Bordetella pertussis
cgggguuccacagcgccg

SEQ ID NO: 2364317 - RNA, 13 nt, Bordetella pertussis
cgggguucuggca

SEQ ID NO: 2364318 - RNA, 15 nt, Bordetella pertussis
cgggguucuggcagg

SEQ ID NO: 2364319 - RNA, 13 nt, Bordetella pertussis
cgggguucugucc

SEQ ID NO: 2364320 - RNA, 19 nt, Bordetella pertussis
cgggguucuguccggcgcu

SEQ ID NO: 2364321 - RNA, 20 nt, Bordetella pertussis
cgguaggcgcccgacggcgc

SEQ ID NO: 2364322 - RNA, 16 nt, Bordetella pertussis
cgguagggcgauggcg

SEQ ID NO: 2364323 - RNA, 21 nt, Bordetella pertussis
cgguagguaugguuggccacg

SEQ ID NO: 2364324 - RNA, 18 nt, Bordetella pertussis
cgguaguucagcagcgcc

SEQ ID NO: 2364325 - RNA, 14 nt, Bordetella pertussis
cgguauccaggucg

SEQ ID NO: 2364326 - RNA, 20 nt, Bordetella pertussis
cgguaucccaccugcagcca

SEQ ID NO: 2364327 - RNA, 15 nt, Bordetella pertussis
cgguaucgacgcgcg

SEQ ID NO: 2364328 - RNA, 16 nt, Bordetella pertussis
cgguaucgacgcgcgu

SEQ ID NO: 2364329 - RNA, 18 nt, Bordetella pertussis
cgguaucgcggcgcaggc

SEQ ID NO: 2364330 - RNA, 21 nt, Bordetella pertussis
cgguaucgcggcgcaggcggg

SEQ ID NO: 2364331 - RNA, 14 nt, Bordetella pertussis
cgguaucgcgucgg

SEQ ID NO: 2364332 - RNA, 23 nt, Bordetella pertussis
cgguaucgggcaacaaggccacg

SEQ ID NO: 2364333 - RNA, 22 nt, Bordetella pertussis
cgguaucucagcgcgccgcgcc

SEQ ID NO: 2364334 - RNA, 24 nt, Bordetella pertussis
cgguaucucagcgcgccgcgccgg

SEQ ID NO: 2364335 - RNA, 21 nt, Bordetella pertussis
cgguaucuguccccgcgggga

SEQ ID NO: 2364336 - RNA, 13 nt, Bordetella pertussis
cgguaugccugcc

SEQ ID NO: 2364337 - RNA, 14 nt, Bordetella pertussis
cgguaugcggcgcc

SEQ ID NO: 2364338 - RNA, 22 nt, Bordetella pertussis
cgguaugcggcgcccaggccca

SEQ ID NO: 2364339 - RNA, 19 nt, Bordetella pertussis
cgguauggccgcccagcau

SEQ ID NO: 2364340 - RNA, 23 nt, Bordetella pertussis
cgguauggcggcaacgugcaggc

SEQ ID NO: 2364341 - RNA, 21 nt, Bordetella pertussis
cgguauuccucgacgauggcg

SEQ ID NO: 2364342 - RNA, 19 nt, Bordetella pertussis
cgguauucgcgcuggcgcg

SEQ ID NO: 2364343 - RNA, 22 nt, Bordetella pertussis
cgguauucgcgcuggcgcgaga

SEQ ID NO: 2364344 - RNA, 17 nt, Bordetella pertussis
cgguauugcgccacccc

SEQ ID NO: 2364345 - RNA, 22 nt, Bordetella pertussis
cgguauugcgccaccccgccgc

SEQ ID NO: 2364346 - RNA, 23 nt, Bordetella pertussis
cggucaaucuauacaacgcggug

SEQ ID NO: 2364347 - RNA, 14 nt, Bordetella pertussis
cggucaaugcggcg

SEQ ID NO: 2364348 - RNA, 16 nt, Bordetella pertussis
cggucacacugggcgg

SEQ ID NO: 2364349 - RNA, 15 nt, Bordetella pertussis
cggucaccgagcuga

SEQ ID NO: 2364350 - RNA, 15 nt, Bordetella pertussis
cggucaccgcgccca

SEQ ID NO: 2364351 - RNA, 22 nt, Bordetella pertussis
cggucaccgcgcccaggguggu

SEQ ID NO: 2364352 - RNA, 19 nt, Bordetella pertussis
cggucaccgucccguagcg

SEQ ID NO: 2364353 - RNA, 22 nt, Bordetella pertussis
cggucacgaucuggccgauggc

SEQ ID NO: 2364354 - RNA, 17 nt, Bordetella pertussis
cggucacgccgaugacc

SEQ ID NO: 2364355 - RNA, 20 nt, Bordetella pertussis
cggucacgccgaugaccagg

SEQ ID NO: 2364356 - RNA, 20 nt, Bordetella pertussis
cggucacgcugguggccacc

SEQ ID NO: 2364357 - RNA, 21 nt, Bordetella pertussis
cggucacguacucgccgucga

SEQ ID NO: 2364358 - RNA, 18 nt, Bordetella pertussis
cggucacguucagcgccg

SEQ ID NO: 2364359 - RNA, 21 nt, Bordetella pertussis
cggucacguucagcgccggca

SEQ ID NO: 2364360 - RNA, 23 nt, Bordetella pertussis
cggucacugccgaaacgcuggcg

SEQ ID NO: 2364361 - RNA, 18 nt, Bordetella pertussis
cggucagcaaccccagca

SEQ ID NO: 2364362 - RNA, 19 nt, Bordetella pertussis
cggucagcaaccccagcag

SEQ ID NO: 2364363 - RNA, 19 nt, Bordetella pertussis
cggucagcacuugccggcc

SEQ ID NO: 2364364 - RNA, 20 nt, Bordetella pertussis
cggucagcacuugccggccg

SEQ ID NO: 2364365 - RNA, 12 nt, Bordetella pertussis
cggucagcaggg

SEQ ID NO: 2364366 - RNA, 13 nt, Bordetella pertussis
cggucagcagggc

SEQ ID NO: 2364367 - RNA, 16 nt, Bordetella pertussis
cggucagcagggcgcc

SEQ ID NO: 2364368 - RNA, 17 nt, Bordetella pertussis
cggucagcagggcgccg

SEQ ID NO: 2364369 - RNA, 18 nt, Bordetella pertussis
cggucagcagggcgccga

SEQ ID NO: 2364370 - RNA, 14 nt, Bordetella pertussis
cggucagcccaggc

SEQ ID NO: 2364371 - RNA, 15 nt, Bordetella pertussis
cggucagcccaggcg

SEQ ID NO: 2364372 - RNA, 16 nt, Bordetella pertussis
cggucagcccaggcgg

SEQ ID NO: 2364373 - RNA, 17 nt, Bordetella pertussis
cggucagcccaggcggg

SEQ ID NO: 2364374 - RNA, 14 nt, Bordetella pertussis
cggucagcgcggcg

SEQ ID NO: 2364375 - RNA, 17 nt, Bordetella pertussis
cggucagcucgucgccg

SEQ ID NO: 2364376 - RNA, 23 nt, Bordetella pertussis
cggucagcugcuguuggccuucg

SEQ ID NO: 2364377 - RNA, 19 nt, Bordetella pertussis
cggucagcuggaacgcgcc

SEQ ID NO: 2364378 - RNA, 15 nt, Bordetella pertussis
cggucagcuugccgc

SEQ ID NO: 2364379 - RNA, 16 nt, Bordetella pertussis
cggucagcuugccgcc

SEQ ID NO: 2364380 - RNA, 17 nt, Bordetella pertussis
cggucagcuugccgccc

SEQ ID NO: 2364381 - RNA, 20 nt, Bordetella pertussis
cggucagcuugccgcccagg

SEQ ID NO: 2364382 - RNA, 19 nt, Bordetella pertussis
cggucagggcgaagcgcgc

SEQ ID NO: 2364383 - RNA, 13 nt, Bordetella pertussis
cggucaggggcag

SEQ ID NO: 2364384 - RNA, 15 nt, Bordetella pertussis
cggucagucgggacg

SEQ ID NO: 2364385 - RNA, 17 nt, Bordetella pertussis
cggucaucacgcggucg

SEQ ID NO: 2364386 - RNA, 13 nt, Bordetella pertussis
cggucaucggcga

SEQ ID NO: 2364387 - RNA, 15 nt, Bordetella pertussis
cggucaugcccaugc

SEQ ID NO: 2364388 - RNA, 20 nt, Bordetella pertussis
cggucaugccgaacagcaug

SEQ ID NO: 2364389 - RNA, 18 nt, Bordetella pertussis
cggucauguccagcgcca

SEQ ID NO: 2364390 - RNA, 14 nt, Bordetella pertussis
cgguccacagcccg

SEQ ID NO: 2364391 - RNA, 15 nt, Bordetella pertussis
cgguccacagcccgg

SEQ ID NO: 2364392 - RNA, 16 nt, Bordetella pertussis
cgguccacagcccggc

SEQ ID NO: 2364393 - RNA, 18 nt, Bordetella pertussis
cgguccacagcccggccc

SEQ ID NO: 2364394 - RNA, 15 nt, Bordetella pertussis
cgguccacgcgggca

SEQ ID NO: 2364395 - RNA, 19 nt, Bordetella pertussis
cgguccacgcgggcaucgg

SEQ ID NO: 2364396 - RNA, 13 nt, Bordetella pertussis
cgguccagacggg

SEQ ID NO: 2364397 - RNA, 15 nt, Bordetella pertussis
cgguccagcaaggcg

SEQ ID NO: 2364398 - RNA, 16 nt, Bordetella pertussis
cgguccagcaccaggg

SEQ ID NO: 2364399 - RNA, 22 nt, Bordetella pertussis
cgguccagcaccagggcgcgca

SEQ ID NO: 2364400 - RNA, 14 nt, Bordetella pertussis
cgguccagcacggc

SEQ ID NO: 2364401 - RNA, 17 nt, Bordetella pertussis
cgguccagcugcgcgcg

SEQ ID NO: 2364402 - RNA, 23 nt, Bordetella pertussis
cgguccagcugcgcgcgagcggc

SEQ ID NO: 2364403 - RNA, 14 nt, Bordetella pertussis
cgguccaggcggcc

SEQ ID NO: 2364404 - RNA, 17 nt, Bordetella pertussis
cgguccaggcggccgcg

SEQ ID NO: 2364405 - RNA, 21 nt, Bordetella pertussis
cgguccaugcgaaagcggcca

SEQ ID NO: 2364406 - RNA, 17 nt, Bordetella pertussis
cgguccgacgguagccg

SEQ ID NO: 2364407 - RNA, 14 nt, Bordetella pertussis
cgguccgcagcgcu

SEQ ID NO: 2364408 - RNA, 16 nt, Bordetella pertussis
cgguccgcagcgcucg

SEQ ID NO: 2364409 - RNA, 23 nt, Bordetella pertussis
cgguccgcagcgcucgcacggca

SEQ ID NO: 2364410 - RNA, 16 nt, Bordetella pertussis
cgguccgcucgaggcc

SEQ ID NO: 2364411 - RNA, 19 nt, Bordetella pertussis
cgguccgcucgaggccagg

SEQ ID NO: 2364412 - RNA, 16 nt, Bordetella pertussis
cgguccguacgccacu

SEQ ID NO: 2364413 - RNA, 17 nt, Bordetella pertussis
cgguccugaccggcggc

SEQ ID NO: 2364414 - RNA, 15 nt, Bordetella pertussis
cgguccugcgcgccg

SEQ ID NO: 2364415 - RNA, 16 nt, Bordetella pertussis
cgguccugcgcgccga

SEQ ID NO: 2364416 - RNA, 13 nt, Bordetella pertussis
cgguccugcugau

SEQ ID NO: 2364417 - RNA, 15 nt, Bordetella pertussis
cgguccugcugaucc

SEQ ID NO: 2364418 - RNA, 16 nt, Bordetella pertussis
cggucgacaccgugaa

SEQ ID NO: 2364419 - RNA, 18 nt, Bordetella pertussis
cggucgacccucagcccg

SEQ ID NO: 2364420 - RNA, 22 nt, Bordetella pertussis
cggucgacccucagcccgcacc

SEQ ID NO: 2364421 - RNA, 21 nt, Bordetella pertussis
cggucgacgaaauagccgacc

SEQ ID NO: 2364422 - RNA, 22 nt, Bordetella pertussis
cggucgaugaagcccgagcggc

SEQ ID NO: 2364423 - RNA, 18 nt, Bordetella pertussis
cggucgaugaccagccag

SEQ ID NO: 2364424 - RNA, 14 nt, Bordetella pertussis
cggucgaugcgcac

SEQ ID NO: 2364425 - RNA, 18 nt, Bordetella pertussis
cggucgcauuggccgccg

SEQ ID NO: 2364426 - RNA, 19 nt, Bordetella pertussis
cggucgcauuggccgccgc

SEQ ID NO: 2364427 - RNA, 22 nt, Bordetella pertussis
cggucgcccaacccggcgaggc

SEQ ID NO: 2364428 - RNA, 20 nt, Bordetella pertussis
cggucgccgcggucgcagac

SEQ ID NO: 2364429 - RNA, 22 nt, Bordetella pertussis
cggucgccgcggucgcagacga

SEQ ID NO: 2364430 - RNA, 12 nt, Bordetella pertussis
cggucgccggca

SEQ ID NO: 2364431 - RNA, 18 nt, Bordetella pertussis
cggucgccguccaggcgc

SEQ ID NO: 2364432 - RNA, 17 nt, Bordetella pertussis
cggucgccucgaagacc

SEQ ID NO: 2364433 - RNA, 16 nt, Bordetella pertussis
cggugccuguccccgc

SEQ ID NO: 2364434 - RNA, 21 nt, Bordetella pertussis
cggugccuguccccgcgggga

SEQ ID NO: 2364435 - RNA, 16 nt, Bordetella pertussis
cggugccugugcccgc

SEQ ID NO: 2364436 - RNA, 18 nt, Bordetella pertussis
cggugccuguucccgccg

SEQ ID NO: 2364437 - RNA, 21 nt, Bordetella pertussis
cggugccuguucccgccgggc

SEQ ID NO: 2364438 - RNA, 17 nt, Bordetella pertussis
cggugccuugcggcgcc

SEQ ID NO: 2364439 - RNA, 18 nt, Bordetella pertussis
cggugccuugcggcgccg

SEQ ID NO: 2364440 - RNA, 15 nt, Bordetella pertussis
cggugcgagaucucg

SEQ ID NO: 2364441 - RNA, 20 nt, Bordetella pertussis
cggugcgagaucucgaugcg

SEQ ID NO: 2364442 - RNA, 16 nt, Bordetella pertussis
cggugcgauagcgccg

SEQ ID NO: 2364443 - RNA, 17 nt, Bordetella pertussis
cggugcgauagcgccgc

SEQ ID NO: 2364444 - RNA, 18 nt, Bordetella pertussis
cggugcgauagcgccgcg

SEQ ID NO: 2364445 - RNA, 23 nt, Bordetella pertussis
cggugcgauagcgccgcgcaucg

SEQ ID NO: 2364446 - RNA, 15 nt, Bordetella pertussis
cggugcgcacauggc

SEQ ID NO: 2364447 - RNA, 16 nt, Bordetella pertussis
cggugcgcacauggcg

SEQ ID NO: 2364448 - RNA, 21 nt, Bordetella pertussis
cggugcgcacauggcggaugg

SEQ ID NO: 2364449 - RNA, 15 nt, Bordetella pertussis
cggugcgcaccaggc

SEQ ID NO: 2364450 - RNA, 24 nt, Bordetella pertussis
cggugcgcacgauggggccgucgc

SEQ ID NO: 2364451 - RNA, 14 nt, Bordetella pertussis
cggugcgcagcacc

SEQ ID NO: 2364452 - RNA, 21 nt, Bordetella pertussis
cggugcgcagcaccagcaugu

SEQ ID NO: 2364453 - RNA, 20 nt, Bordetella pertussis
cggugcgcagcggcaggcgg

SEQ ID NO: 2364454 - RNA, 22 nt, Bordetella pertussis
cggugcgcagcggcaggcggcu

SEQ ID NO: 2364455 - RNA, 14 nt, Bordetella pertussis
cggugcgccgccgc

SEQ ID NO: 2364456 - RNA, 15 nt, Bordetella pertussis
cggugcgccgccgcc

SEQ ID NO: 2364457 - RNA, 17 nt, Bordetella pertussis
cggugcgcgcagggcgg

SEQ ID NO: 2364458 - RNA, 18 nt, Bordetella pertussis
cggugcgcgcagggcggc

SEQ ID NO: 2364459 - RNA, 23 nt, Bordetella pertussis
cggugcgcgcagggcggccggca

SEQ ID NO: 2364460 - RNA, 14 nt, Bordetella pertussis
cggugcgcgcggcc

SEQ ID NO: 2364461 - RNA, 15 nt, Bordetella pertussis
cggugcgcgcggccg

SEQ ID NO: 2364462 - RNA, 12 nt, Bordetella pertussis
cggugcgcggcg

SEQ ID NO: 2364463 - RNA, 18 nt, Bordetella pertussis
cggugcgcggcgcagccc

SEQ ID NO: 2364464 - RNA, 14 nt, Bordetella pertussis
cggugcgcgugggc

SEQ ID NO: 2364465 - RNA, 20 nt, Bordetella pertussis
cggugcggaggcggccgcgg

SEQ ID NO: 2364466 - RNA, 22 nt, Bordetella pertussis
cggugcggaucaagcggcccgc

SEQ ID NO: 2364467 - RNA, 16 nt, Bordetella pertussis
cggugcggccucggcg

SEQ ID NO: 2364468 - RNA, 14 nt, Bordetella pertussis
cggugcgggugggc

SEQ ID NO: 2364469 - RNA, 15 nt, Bordetella pertussis
cggugcgggugggcg

SEQ ID NO: 2364470 - RNA, 18 nt, Bordetella pertussis
cggugcgggugggcgcgc

SEQ ID NO: 2364471 - RNA, 15 nt, Bordetella pertussis
cggugcguaccagcc

SEQ ID NO: 2364472 - RNA, 14 nt, Bordetella pertussis
cggugcguccagga

SEQ ID NO: 2364473 - RNA, 18 nt, Bordetella pertussis
cggugcgugcgcccaugg

SEQ ID NO: 2364474 - RNA, 19 nt, Bordetella pertussis
cggugcgugcgcccauggc

SEQ ID NO: 2364475 - RNA, 18 nt, Bordetella pertussis
cggugcguuccaugacgu

SEQ ID NO: 2364476 - RNA, 21 nt, Bordetella pertussis
cggugcucgaggugcacgugg

SEQ ID NO: 2364477 - RNA, 18 nt, Bordetella pertussis
cggugcucggccagcgcg

SEQ ID NO: 2364478 - RNA, 17 nt, Bordetella pertussis
cggugcugaacgccucg

SEQ ID NO: 2364479 - RNA, 17 nt, Bordetella pertussis
cggugcuugaugcccag

SEQ ID NO: 2364480 - RNA, 22 nt, Bordetella pertussis
cgguggaaauacagaucgccgc

SEQ ID NO: 2364481 - RNA, 23 nt, Bordetella pertussis
cgguggauucggacgccucgccg

SEQ ID NO: 2364482 - RNA, 16 nt, Bordetella pertussis
cgguggccagccaggc

SEQ ID NO: 2364483 - RNA, 18 nt, Bordetella pertussis
cgguggccagccaggcgg

SEQ ID NO: 2364484 - RNA, 19 nt, Bordetella pertussis
cgguggccagccaggcggu

SEQ ID NO: 2364485 - RNA, 14 nt, Bordetella pertussis
cgguggccagcgcc

SEQ ID NO: 2364486 - RNA, 14 nt, Bordetella pertussis
cgguggccagcgug

SEQ ID NO: 2364487 - RNA, 19 nt, Bordetella pertussis
cgguggccaugcugggcgg

SEQ ID NO: 2364488 - RNA, 22 nt, Bordetella pertussis
cgguggccaugcugggcgggcu

SEQ ID NO: 2364489 - RNA, 19 nt, Bordetella pertussis
cgguggccauggacagcac

SEQ ID NO: 2364490 - RNA, 21 nt, Bordetella pertussis
cgguggccauggacagcaccg

SEQ ID NO: 2364491 - RNA, 12 nt, Bordetella pertussis
cgguggccgccg

SEQ ID NO: 2364492 - RNA, 14 nt, Bordetella pertussis
cgguggccgccgcg

SEQ ID NO: 2364493 - RNA, 16 nt, Bordetella pertussis
cgguggccgccgcgcg

SEQ ID NO: 2364494 - RNA, 17 nt, Bordetella pertussis
cgguggccgccgcgcgc

SEQ ID NO: 2364495 - RNA, 18 nt, Bordetella pertussis
cgguggccgccgcgcgcc

SEQ ID NO: 2364496 - RNA, 20 nt, Bordetella pertussis
cgguggccgccgcgcgccgc

SEQ ID NO: 2364497 - RNA, 13 nt, Bordetella pertussis
cgguggccgcgca

SEQ ID NO: 2364498 - RNA, 18 nt, Bordetella pertussis
cgguggccgcgcaugcca

SEQ ID NO: 2364499 - RNA, 19 nt, Bordetella pertussis
cgguggccgcuucggcggc

SEQ ID NO: 2364500 - RNA, 20 nt, Bordetella pertussis
cgguggccuuguacaggcac

SEQ ID NO: 2364501 - RNA, 22 nt, Bordetella pertussis
cgguggccuuguacaggcacuc

SEQ ID NO: 2364502 - RNA, 16 nt, Bordetella pertussis
cgguggcgaaggccgc

SEQ ID NO: 2364503 - RNA, 19 nt, Bordetella pertussis
cgguggcgaaggccgccgc

SEQ ID NO: 2364504 - RNA, 22 nt, Bordetella pertussis
cgguggcgaaggccgccgcgcc

SEQ ID NO: 2364505 - RNA, 16 nt, Bordetella pertussis
cgguggcgcccggcgg

SEQ ID NO: 2364506 - RNA, 12 nt, Bordetella pertussis
cgguggcgcgca

SEQ ID NO: 2364507 - RNA, 14 nt, Bordetella pertussis
cgguggcgcgcagu

SEQ ID NO: 2364508 - RNA, 21 nt, Bordetella pertussis
cgguggcggccguuggcgugc

SEQ ID NO: 2364509 - RNA, 21 nt, Bordetella pertussis
cgguggcgggccagcuccccg

SEQ ID NO: 2364510 - RNA, 18 nt, Bordetella pertussis
cgguggcgggcgugcgga

SEQ ID NO: 2364511 - RNA, 23 nt, Bordetella pertussis
cgguggcgguuggugucgcgcag

SEQ ID NO: 2364512 - RNA, 20 nt, Bordetella pertussis
cgguggcguaguagcccagg

SEQ ID NO: 2364513 - RNA, 19 nt, Bordetella pertussis
cgguggcguuggccugcca

SEQ ID NO: 2364514 - RNA, 22 nt, Bordetella pertussis
cgguggcuggggcuggcauggc

SEQ ID NO: 2364515 - RNA, 14 nt, Bordetella pertussis
cgguggcuuggcgc

SEQ ID NO: 2364516 - RNA, 21 nt, Bordetella pertussis
cggugggauaaggcgugccgc

SEQ ID NO: 2364517 - RNA, 14 nt, Bordetella pertussis
cggugggcagcagc

SEQ ID NO: 2364518 - RNA, 17 nt, Bordetella pertussis
cggugggcagcgcgucg

SEQ ID NO: 2364519 - RNA, 17 nt, Bordetella pertussis
cggugggcgacgcggcg

SEQ ID NO: 2364520 - RNA, 18 nt, Bordetella pertussis
cgguggggcaggucgcca

SEQ ID NO: 2364521 - RNA, 19 nt, Bordetella pertussis
cgguggggcaguugaccau

SEQ ID NO: 2364522 - RNA, 15 nt, Bordetella pertussis
cgguggguguggcca

SEQ ID NO: 2364523 - RNA, 16 nt, Bordetella pertussis
cgguggucaucgaugc

SEQ ID NO: 2364524 - RNA, 14 nt, Bordetella pertussis
cgguggucgggcag

SEQ ID NO: 2364525 - RNA, 23 nt, Bordetella pertussis
cgguggucugccaguccauccag

SEQ ID NO: 2364526 - RNA, 19 nt, Bordetella pertussis
cgguggugaccacggcgcg

SEQ ID NO: 2364527 - RNA, 13 nt, Bordetella pertussis
cgguggugcccau

SEQ ID NO: 2364528 - RNA, 17 nt, Bordetella pertussis
cgguggugcugcugggc

SEQ ID NO: 2364529 - RNA, 18 nt, Bordetella pertussis
cgguggugcugcugggcg

SEQ ID NO: 2364530 - RNA, 13 nt, Bordetella pertussis
cggugguggccaa

SEQ ID NO: 2364531 - RNA, 17 nt, Bordetella pertussis
cggugguggccaacgac

SEQ ID NO: 2364532 - RNA, 15 nt, Bordetella pertussis
cgguggugucggcgg

SEQ ID NO: 2364533 - RNA, 16 nt, Bordetella pertussis
cgguggugucggcggc

SEQ ID NO: 2364534 - RNA, 21 nt, Bordetella pertussis
cgguggugucggcggccagca

SEQ ID NO: 2364535 - RNA, 17 nt, Bordetella pertussis
cgguguagaccaccagc

SEQ ID NO: 2364536 - RNA, 13 nt, Bordetella pertussis
cgguguagcugcc

SEQ ID NO: 2364537 - RNA, 20 nt, Bordetella pertussis
cgguguaggcgggcagcggc

SEQ ID NO: 2364538 - RNA, 20 nt, Bordetella pertussis
cggugucgaugggcccgggc

SEQ ID NO: 2364539 - RNA, 20 nt, Bordetella pertussis
cggugucgcaccgcaaggaa

SEQ ID NO: 2364540 - RNA, 13 nt, Bordetella pertussis
cggugucggcguc

SEQ ID NO: 2364541 - RNA, 20 nt, Bordetella pertussis
cggugucggggccgggccgg

SEQ ID NO: 2364542 - RNA, 22 nt, Bordetella pertussis
cggugucggggccgggccggcg

SEQ ID NO: 2364543 - RNA, 19 nt, Bordetella pertussis
cgguguggugcugcgccgc

SEQ ID NO: 2364544 - RNA, 21 nt, Bordetella pertussis
cgguguucgagccggacgugg

SEQ ID NO: 2364545 - RNA, 16 nt, Bordetella pertussis
cguagcgcggccgggu

SEQ ID NO: 2364546 - RNA, 19 nt, Bordetella pertussis
cguagcgcggccgggucgg

SEQ ID NO: 2364547 - RNA, 11 nt, Bordetella pertussis
cguagcgcugc

SEQ ID NO: 2364548 - RNA, 13 nt, Bordetella pertussis
cguagcgcugcag

SEQ ID NO: 2364549 - RNA, 15 nt, Bordetella pertussis
cguagcgcugcagcc

SEQ ID NO: 2364550 - RNA, 16 nt, Bordetella pertussis
cguagcgcugcagcca

SEQ ID NO: 2364551 - RNA, 17 nt, Bordetella pertussis
cguagcguucgccgucg

SEQ ID NO: 2364552 - RNA, 18 nt, Bordetella pertussis
cguagcguucgccgucga

SEQ ID NO: 2364553 - RNA, 16 nt, Bordetella pertussis
cguaggacagccccag

SEQ ID NO: 2364554 - RNA, 19 nt, Bordetella pertussis
cguaggacagccccagcag

SEQ ID NO: 2364555 - RNA, 18 nt, Bordetella pertussis
cguaggcaaagcgcggcu

SEQ ID NO: 2364556 - RNA, 19 nt, Bordetella pertussis
cguaggcaaagcgcggcug

SEQ ID NO: 2364557 - RNA, 19 nt, Bordetella pertussis
cguaggcaggggcuccagg

SEQ ID NO: 2364558 - RNA, 20 nt, Bordetella pertussis
cguaggcgagguccaggcgg

SEQ ID NO: 2364559 - RNA, 20 nt, Bordetella pertussis
cguaggcgccggccuugccg

SEQ ID NO: 2364560 - RNA, 12 nt, Bordetella pertussis
cguaggcgcgcg

SEQ ID NO: 2364561 - RNA, 14 nt, Bordetella pertussis
cguaggcgcgcgca

SEQ ID NO: 2364562 - RNA, 15 nt, Bordetella pertussis
cguaggcgcuguugg

SEQ ID NO: 2364563 - RNA, 21 nt, Bordetella pertussis
cguagggcacaucggccaccc

SEQ ID NO: 2364564 - RNA, 15 nt, Bordetella pertussis
cguaggucaggccca

SEQ ID NO: 2364565 - RNA, 14 nt, Bordetella pertussis
cguaguacagcagc

SEQ ID NO: 2364566 - RNA, 17 nt, Bordetella pertussis
cguaguacagcagcagc

SEQ ID NO: 2364567 - RNA, 15 nt, Bordetella pertussis
cguaguagcccaggc

SEQ ID NO: 2364568 - RNA, 16 nt, Bordetella pertussis
cguaguagcccaggcc

SEQ ID NO: 2364569 - RNA, 17 nt, Bordetella pertussis
cguaguccagcagcagc

SEQ ID NO: 2364570 - RNA, 18 nt, Bordetella pertussis
cguaguccagcagcagcg

SEQ ID NO: 2364571 - RNA, 22 nt, Bordetella pertussis
cguaguccagcagcagcgccgc

SEQ ID NO: 2364572 - RNA, 17 nt, Bordetella pertussis
cguaguccgagcccggg

SEQ ID NO: 2364573 - RNA, 15 nt, Bordetella pertussis
cguagucgagccagg

SEQ ID NO: 2364574 - RNA, 18 nt, Bordetella pertussis
cguagucgagccaggugg

SEQ ID NO: 2364575 - RNA, 18 nt, Bordetella pertussis
cguagucgcgccagcggc

SEQ ID NO: 2364576 - RNA, 14 nt, Bordetella pertussis
cguagugcgcgccg

SEQ ID NO: 2364577 - RNA, 15 nt, Bordetella pertussis
cguagugcgcgccgc

SEQ ID NO: 2364578 - RNA, 21 nt, Bordetella pertussis
cguaguguucgauggcggcca

SEQ ID NO: 2364579 - RNA, 17 nt, Bordetella pertussis
cguaguucagccacacg

SEQ ID NO: 2364580 - RNA, 17 nt, Bordetella pertussis
cguaguugucggcgcag

SEQ ID NO: 2364581 - RNA, 19 nt, Bordetella pertussis
cguaucaacuuccagcgcc

SEQ ID NO: 2364582 - RNA, 20 nt, Bordetella pertussis
cguaucaacuuccagcgccc

SEQ ID NO: 2364583 - RNA, 16 nt, Bordetella pertussis
cguauccagcaucacc

SEQ ID NO: 2364584 - RNA, 15 nt, Bordetella pertussis
cguaucgauagccga

SEQ ID NO: 2364585 - RNA, 17 nt, Bordetella pertussis
cguaucgccgccgccgg

SEQ ID NO: 2364586 - RNA, 22 nt, Bordetella pertussis
cguaucgccgcugaugcuggca

SEQ ID NO: 2364587 - RNA, 18 nt, Bordetella pertussis
cguaucgccugacguucg

SEQ ID NO: 2364588 - RNA, 19 nt, Bordetella pertussis
cguaucgcguggcgcgcca

SEQ ID NO: 2364589 - RNA, 14 nt, Bordetella pertussis
cguaugcggcagca

SEQ ID NO: 2364590 - RNA, 20 nt, Bordetella pertussis
cguauggcccgccaccacgg

SEQ ID NO: 2364591 - RNA, 21 nt, Bordetella pertussis
cguauggcccgccaccacggc

SEQ ID NO: 2364592 - RNA, 22 nt, Bordetella pertussis
cguauggccguuggccagcgcc

SEQ ID NO: 2364593 - RNA, 19 nt, Bordetella pertussis
cguauggcggggugccugu

SEQ ID NO: 2364594 - RNA, 18 nt, Bordetella pertussis
cguauuccggguccagcc

SEQ ID NO: 2364595 - RNA, 18 nt, Bordetella pertussis
cguauugcugcugcuggc

SEQ ID NO: 2364596 - RNA, 19 nt, Bordetella pertussis
cguauugcugcugcuggcu

SEQ ID NO: 2364597 - RNA, 15 nt, Bordetella pertussis
cgucaacgcccaggu

SEQ ID NO: 2364598 - RNA, 15 nt, Bordetella pertussis
cgucaagccagcggc

SEQ ID NO: 2364599 - RNA, 16 nt, Bordetella pertussis
cgucaagccagcggcg

SEQ ID NO: 2364600 - RNA, 22 nt, Bordetella pertussis
cgucaagccagcggcgcggcgc

SEQ ID NO: 2364601 - RNA, 18 nt, Bordetella pertussis
cgucaagcgucgauggcg

SEQ ID NO: 2364602 - RNA, 18 nt, Bordetella pertussis
cgucaauccgccgccagc

SEQ ID NO: 2364603 - RNA, 13 nt, Bordetella pertussis
cgucaccagcagg

SEQ ID NO: 2364604 - RNA, 17 nt, Bordetella pertussis
cgucaccagcaggcggc

SEQ ID NO: 2364605 - RNA, 17 nt, Bordetella pertussis
cgucaccaucgccgcgu

SEQ ID NO: 2364606 - RNA, 13 nt, Bordetella pertussis
cgucaccccgccc

SEQ ID NO: 2364607 - RNA, 16 nt, Bordetella pertussis
cgucaccccgcccugc

SEQ ID NO: 2364608 - RNA, 21 nt, Bordetella pertussis
cgucaccccgcccugcccggc

SEQ ID NO: 2364609 - RNA, 16 nt, Bordetella pertussis
cgucaccgacgccagc

SEQ ID NO: 2364610 - RNA, 14 nt, Bordetella pertussis
cgucaccgccgccg

SEQ ID NO: 2364611 - RNA, 19 nt, Bordetella pertussis
cgucaccgccgccgcgccg

SEQ ID NO: 2364612 - RNA, 16 nt, Bordetella pertussis
cgucacgaaagcgccc

SEQ ID NO: 2364613 - RNA, 19 nt, Bordetella pertussis
cgucacgaaagcgcccagg

SEQ ID NO: 2364614 - RNA, 20 nt, Bordetella pertussis
cgucacgaaagcgcccaggc

SEQ ID NO: 2364615 - RNA, 22 nt, Bordetella pertussis
cgucacgaaagcgcccaggccg

SEQ ID NO: 2364616 - RNA, 16 nt, Bordetella pertussis
cgucacgauuucggcc

SEQ ID NO: 2364617 - RNA, 17 nt, Bordetella pertussis
cgucacgauuucggcca

SEQ ID NO: 2364618 - RNA, 14 nt, Bordetella pertussis
cgucacgcacagca

SEQ ID NO: 2364619 - RNA, 18 nt, Bordetella pertussis
cgucacgcacagcaccug

SEQ ID NO: 2364620 - RNA, 23 nt, Bordetella pertussis
cgucacgcacagcaccugguggc

SEQ ID NO: 2364621 - RNA, 15 nt, Bordetella pertussis
cgucacgcgcaaggc

SEQ ID NO: 2364622 - RNA, 13 nt, Bordetella pertussis
cgucacgcgcugg

SEQ ID NO: 2364623 - RNA, 15 nt, Bordetella pertussis
cgucacgcgcuggua

SEQ ID NO: 2364624 - RNA, 13 nt, Bordetella pertussis
cgucacgcggccg

SEQ ID NO: 2364625 - RNA, 14 nt, Bordetella pertussis
cgucacgcggccgg

SEQ ID NO: 2364626 - RNA, 14 nt, Bordetella pertussis
cgucacgcugaacu

SEQ ID NO: 2364627 - RNA, 18 nt, Bordetella pertussis
cgucacggcaagacggcg

SEQ ID NO: 2364628 - RNA, 19 nt, Bordetella pertussis
cgucacggcaagacggcgc

SEQ ID NO: 2364629 - RNA, 12 nt, Bordetella pertussis
cgucagacgcgc

SEQ ID NO: 2364630 - RNA, 13 nt, Bordetella pertussis
cgucagacgcgcu

SEQ ID NO: 2364631 - RNA, 23 nt, Bordetella pertussis
cgucagagcccuucgacgcggcg

SEQ ID NO: 2364632 - RNA, 16 nt, Bordetella pertussis
cgucagcacaucgccc

SEQ ID NO: 2364633 - RNA, 22 nt, Bordetella pertussis
cgucagcacggucggcgcguaa

SEQ ID NO: 2364634 - RNA, 17 nt, Bordetella pertussis
cgucagcagcacgccuu

SEQ ID NO: 2364635 - RNA, 14 nt, Bordetella pertussis
cgucagcagcgcgg

SEQ ID NO: 2364636 - RNA, 23 nt, Bordetella pertussis
cgucagcaugcacgacuacggcg

SEQ ID NO: 2364637 - RNA, 16 nt, Bordetella pertussis
cgucagcgacaucgug

SEQ ID NO: 2364638 - RNA, 23 nt, Bordetella pertussis
cgucagcgcccaaucgggcagca

SEQ ID NO: 2364639 - RNA, 12 nt, Bordetella pertussis
cgucagcgccgc

SEQ ID NO: 2364640 - RNA, 16 nt, Bordetella pertussis
cgucagcggcgcgccc

SEQ ID NO: 2364641 - RNA, 17 nt, Bordetella pertussis
cgucagcgugcgccccg

SEQ ID NO: 2364642 - RNA, 18 nt, Bordetella pertussis
cgucagcgugcgccccgc

SEQ ID NO: 2364643 - RNA, 16 nt, Bordetella pertussis
cgucagcucgaucagg

SEQ ID NO: 2364644 - RNA, 17 nt, Bordetella pertussis
cgucagcucgaucaggc

SEQ ID NO: 2364645 - RNA, 20 nt, Bordetella pertussis
cgucagcucgaucaggcgcu

SEQ ID NO: 2364646 - RNA, 22 nt, Bordetella pertussis
cgucaggaucaggccggcgaug

SEQ ID NO: 2364647 - RNA, 17 nt, Bordetella pertussis
cgucaggcaggcgcgcc

SEQ ID NO: 2364648 - RNA, 21 nt, Bordetella pertussis
cgucaggcaggcgcgccgggc

SEQ ID NO: 2364649 - RNA, 13 nt, Bordetella pertussis
cgucaggccgggc

SEQ ID NO: 2364650 - RNA, 20 nt, Bordetella pertussis
cgucaggcgagcgcggcggg

SEQ ID NO: 2364651 - RNA, 19 nt, Bordetella pertussis
cgucaggcguugcgccgca

SEQ ID NO: 2364652 - RNA, 13 nt, Bordetella pertussis
cgucagggccgca

SEQ ID NO: 2364653 - RNA, 14 nt, Bordetella pertussis
cgucagggccgcag

SEQ ID NO: 2364654 - RNA, 15 nt, Bordetella pertussis
cgucagggccgcagc

SEQ ID NO: 2364655 - RNA, 16 nt, Bordetella pertussis
cgucagggccgcagca

SEQ ID NO: 2364656 - RNA, 15 nt, Bordetella pertussis
cgucaggggcaugcc

SEQ ID NO: 2364657 - RNA, 18 nt, Bordetella pertussis
cgucaggugcagcgagac

SEQ ID NO: 2364658 - RNA, 22 nt, Bordetella pertussis
cgucccagggggucagggccgc

SEQ ID NO: 2364659 - RNA, 20 nt, Bordetella pertussis
cgucccagucgccgcgcccg

SEQ ID NO: 2364660 - RNA, 22 nt, Bordetella pertussis
cguccccaauacccgccacaga

SEQ ID NO: 2364661 - RNA, 19 nt, Bordetella pertussis
cguccccacggggacuggc

SEQ ID NO: 2364662 - RNA, 19 nt, Bordetella pertussis
cgucccgacccccggcccg

SEQ ID NO: 2364663 - RNA, 17 nt, Bordetella pertussis
cgucccggugaucgucc

SEQ ID NO: 2364664 - RNA, 16 nt, Bordetella pertussis
cgucccgugccggccg

SEQ ID NO: 2364665 - RNA, 17 nt, Bordetella pertussis
cgucccgugccggccgg

SEQ ID NO: 2364666 - RNA, 13 nt, Bordetella pertussis
cgucccuggucca

SEQ ID NO: 2364667 - RNA, 18 nt, Bordetella pertussis
cguccgaauacgccacgu

SEQ ID NO: 2364668 - RNA, 20 nt, Bordetella pertussis
cguccgagcccgacgcgagg

SEQ ID NO: 2364669 - RNA, 17 nt, Bordetella pertussis
cguccgcaucgcgcaag

SEQ ID NO: 2364670 - RNA, 22 nt, Bordetella pertussis
cguccgccccauccacggcgcc

SEQ ID NO: 2364671 - RNA, 15 nt, Bordetella pertussis
cguccgcgacgcugu

SEQ ID NO: 2364672 - RNA, 23 nt, Bordetella pertussis
cguccgcgacgguccugcgcgcc

SEQ ID NO: 2364673 - RNA, 14 nt, Bordetella pertussis
cguccgcgccgaac

SEQ ID NO: 2364674 - RNA, 13 nt, Bordetella pertussis
cguccgcgcgccg

SEQ ID NO: 2364675 - RNA, 15 nt, Bordetella pertussis
cguccgcgcgccgcu

SEQ ID NO: 2364676 - RNA, 16 nt, Bordetella pertussis
cguccgcgcgccgcug

SEQ ID NO: 2364677 - RNA, 18 nt, Bordetella pertussis
cguccgcgucgccgccgu

SEQ ID NO: 2364678 - RNA, 18 nt, Bordetella pertussis
cguccgcucaugccggca

SEQ ID NO: 2364679 - RNA, 19 nt, Bordetella pertussis
cguccgcuucgucgggcag

SEQ ID NO: 2364680 - RNA, 15 nt, Bordetella pertussis
cguccggaucuuccu

SEQ ID NO: 2364681 - RNA, 14 nt, Bordetella pertussis
cguccggccccagg

SEQ ID NO: 2364682 - RNA, 16 nt, Bordetella pertussis
cguccggccgugccgc

SEQ ID NO: 2364683 - RNA, 21 nt, Bordetella pertussis
cguccggcgcccgccgccggg

SEQ ID NO: 2364684 - RNA, 12 nt, Bordetella pertussis
cguccggcgcgc

SEQ ID NO: 2364685 - RNA, 14 nt, Bordetella pertussis
cguccggcgcgucg

SEQ ID NO: 2364686 - RNA, 13 nt, Bordetella pertussis
cguccgggccggu

SEQ ID NO: 2364687 - RNA, 16 nt, Bordetella pertussis
cguccggggucagguu

SEQ ID NO: 2364688 - RNA, 16 nt, Bordetella pertussis
cguccggguuggcgau

SEQ ID NO: 2364689 - RNA, 19 nt, Bordetella pertussis
cguccggguuggcgaugcu

SEQ ID NO: 2364690 - RNA, 21 nt, Bordetella pertussis
cguccggugcgauagcgccgc

SEQ ID NO: 2364691 - RNA, 21 nt, Bordetella pertussis
cguccgucggguugccgcugc

SEQ ID NO: 2364692 - RNA, 23 nt, Bordetella pertussis
cguccgucggguugccgcugcau

SEQ ID NO: 2364693 - RNA, 16 nt, Bordetella pertussis
cguccgucucgcccag

SEQ ID NO: 2364694 - RNA, 17 nt, Bordetella pertussis
cguccgucucgcccagg

SEQ ID NO: 2364695 - RNA, 22 nt, Bordetella pertussis
cguccgucucgcccaggcccag

SEQ ID NO: 2364696 - RNA, 21 nt, Bordetella pertussis
cguccgugagugcagcgcuca

SEQ ID NO: 2364697 - RNA, 16 nt, Bordetella pertussis
cguccguggccggcgc

SEQ ID NO: 2364698 - RNA, 17 nt, Bordetella pertussis
cguccguggccggcgcg

SEQ ID NO: 2364699 - RNA, 21 nt, Bordetella pertussis
cguccguuucgucggcgcgcg

SEQ ID NO: 2364700 - RNA, 17 nt, Bordetella pertussis
cguccucaggcccgcgg

SEQ ID NO: 2364701 - RNA, 22 nt, Bordetella pertussis
cguccucaggcccgcggcgcca

SEQ ID NO: 2364702 - RNA, 13 nt, Bordetella pertussis
cguccucgaccag

SEQ ID NO: 2364703 - RNA, 14 nt, Bordetella pertussis
cguccucgaccagg

SEQ ID NO: 2364704 - RNA, 16 nt, Bordetella pertussis
cguccucgaccaggau

SEQ ID NO: 2364705 - RNA, 18 nt, Bordetella pertussis
cguccucgcgggccuggc

SEQ ID NO: 2364706 - RNA, 19 nt, Bordetella pertussis
cguccucggcacggccagc

SEQ ID NO: 2364707 - RNA, 20 nt, Bordetella pertussis
cguccucggcacggccagca

SEQ ID NO: 2364708 - RNA, 15 nt, Bordetella pertussis
cguccucggccagcc

SEQ ID NO: 2364709 - RNA, 21 nt, Bordetella pertussis
cguccucggccagccgggcga

SEQ ID NO: 2364710 - RNA, 14 nt, Bordetella pertussis
cguccucggccugg

SEQ ID NO: 2364711 - RNA, 15 nt, Bordetella pertussis
cguccucggccuggc

SEQ ID NO: 2364712 - RNA, 15 nt, Bordetella pertussis
cguccucgucggcga

SEQ ID NO: 2364713 - RNA, 23 nt, Bordetella pertussis
cguccugaucgaggagcugcugu

SEQ ID NO: 2364714 - RNA, 16 nt, Bordetella pertussis
cguccugcacguccuc

SEQ ID NO: 2364715 - RNA, 14 nt, Bordetella pertussis
cguccugcagcagg

SEQ ID NO: 2364716 - RNA, 15 nt, Bordetella pertussis
cguccugcagcaggg

SEQ ID NO: 2364717 - RNA, 14 nt, Bordetella pertussis
cguccugcaggaag

SEQ ID NO: 2364718 - RNA, 19 nt, Bordetella pertussis
cguccugcaggaaggccgc

SEQ ID NO: 2364719 - RNA, 21 nt, Bordetella pertussis
cguccugcaggaaggccgccg

SEQ ID NO: 2364720 - RNA, 15 nt, Bordetella pertussis
cguccugcaggcggc

SEQ ID NO: 2364721 - RNA, 19 nt, Bordetella pertussis
cguccugcaggcggcgcau

SEQ ID NO: 2364722 - RNA, 20 nt, Bordetella pertussis
cguccugccaguugccgccg

SEQ ID NO: 2364723 - RNA, 18 nt, Bordetella pertussis
cguccugccauugcgcgg

SEQ ID NO: 2364724 - RNA, 20 nt, Bordetella pertussis
cguccugccauugcgcggcc

SEQ ID NO: 2364725 - RNA, 15 nt, Bordetella pertussis
cguccugccgcgacc

SEQ ID NO: 2364726 - RNA, 16 nt, Bordetella pertussis
cguccugcgccaguug

SEQ ID NO: 2364727 - RNA, 18 nt, Bordetella pertussis
cguccugcggcggcagcu

SEQ ID NO: 2364728 - RNA, 21 nt, Bordetella pertussis
cguccugcggcggcagcuuga

SEQ ID NO: 2364729 - RNA, 17 nt, Bordetella pertussis
cguccugcugcggcacg

SEQ ID NO: 2364730 - RNA, 17 nt, Bordetella pertussis
cguccuggccacugccu

SEQ ID NO: 2364731 - RNA, 13 nt, Bordetella pertussis
cguccuggccguc

SEQ ID NO: 2364732 - RNA, 14 nt, Bordetella pertussis
cguccuggccguca

SEQ ID NO: 2364733 - RNA, 14 nt, Bordetella pertussis
cguccuggcgaccg

SEQ ID NO: 2364734 - RNA, 19 nt, Bordetella pertussis
cguccugggccgagcgcgc

SEQ ID NO: 2364735 - RNA, 20 nt, Bordetella pertussis
cguccugggccgagcgcgcc

SEQ ID NO: 2364736 - RNA, 22 nt, Bordetella pertussis
cguccugggccgagcgcgccag

SEQ ID NO: 2364737 - RNA, 16 nt, Bordetella pertussis
cguccuggggcgcggu

SEQ ID NO: 2364738 - RNA, 16 nt, Bordetella pertussis
cguccuucgucggcgg

SEQ ID NO: 2364739 - RNA, 15 nt, Bordetella pertussis
cguccuugagcgcca

SEQ ID NO: 2364740 - RNA, 17 nt, Bordetella pertussis
cguccuugagcgccagc

SEQ ID NO: 2364741 - RNA, 22 nt, Bordetella pertussis
cguccuugaggaacuggacggc

SEQ ID NO: 2364742 - RNA, 14 nt, Bordetella pertussis
cguccuugagggcg

SEQ ID NO: 2364743 - RNA, 15 nt, Bordetella pertussis
cguccuugagggcgc

SEQ ID NO: 2364744 - RNA, 17 nt, Bordetella pertussis
cguccuuggcggccuug

SEQ ID NO: 2364745 - RNA, 14 nt, Bordetella pertussis
cguccuugugccag

SEQ ID NO: 2364746 - RNA, 19 nt, Bordetella pertussis
cgucgaaacgcugcgcgau

SEQ ID NO: 2364747 - RNA, 20 nt, Bordetella pertussis
cgucgaacagcuucuccaug

SEQ ID NO: 2364748 - RNA, 15 nt, Bordetella pertussis
cgucgaacggccggg

SEQ ID NO: 2364749 - RNA, 16 nt, Bordetella pertussis
cgucgaacggccgggc

SEQ ID NO: 2364750 - RNA, 20 nt, Bordetella pertussis
cgucgaacuccugcagcacg

SEQ ID NO: 2364751 - RNA, 21 nt, Bordetella pertussis
cgucgaacuccugcagcacgc

SEQ ID NO: 2364752 - RNA, 16 nt, Bordetella pertussis
cgucgaagccggcgcc

SEQ ID NO: 2364753 - RNA, 18 nt, Bordetella pertussis
cgucgaagccggugaugc

SEQ ID NO: 2364754 - RNA, 18 nt, Bordetella pertussis
cgucgaaggccgcaacca

SEQ ID NO: 2364755 - RNA, 19 nt, Bordetella pertussis
cgucgaaggccgccggacg

SEQ ID NO: 2364756 - RNA, 22 nt, Bordetella pertussis
cgucgaaggccgccggacgcag

SEQ ID NO: 2364757 - RNA, 14 nt, Bordetella pertussis
cgucgaaggcgcgc

SEQ ID NO: 2364758 - RNA, 21 nt, Bordetella pertussis
cgucgaaggcgcgcuccagca

SEQ ID NO: 2364759 - RNA, 15 nt, Bordetella pertussis
cgucgaaggcggccg

SEQ ID NO: 2364760 - RNA, 17 nt, Bordetella pertussis
cgucgaaggcggccggc

SEQ ID NO: 2364761 - RNA, 22 nt, Bordetella pertussis
cgucgacagcaugaacggcagc

SEQ ID NO: 2364762 - RNA, 14 nt, Bordetella pertussis
cgucgaccaccagc

SEQ ID NO: 2364763 - RNA, 20 nt, Bordetella pertussis
cgucgaccaccagcaucgcg

SEQ ID NO: 2364764 - RNA, 23 nt, Bordetella pertussis
cgucgaccaccagcaucgcgccu

SEQ ID NO: 2364765 - RNA, 17 nt, Bordetella pertussis
cgucgaccacgccggcg

SEQ ID NO: 2364766 - RNA, 20 nt, Bordetella pertussis
cgucgaccacgccggcggcc

SEQ ID NO: 2364767 - RNA, 23 nt, Bordetella pertussis
cgucgaccacgccggcggccaug

SEQ ID NO: 2364768 - RNA, 17 nt, Bordetella pertussis
cgucgaccagcagcacg

SEQ ID NO: 2364769 - RNA, 15 nt, Bordetella pertussis
cgucgaccagcaucc

SEQ ID NO: 2364770 - RNA, 15 nt, Bordetella pertussis
cgucgaccgacagca

SEQ ID NO: 2364771 - RNA, 21 nt, Bordetella pertussis
cgucgcgguccagcaccaggg

SEQ ID NO: 2364772 - RNA, 14 nt, Bordetella pertussis
cgucgcguagcgcg

SEQ ID NO: 2364773 - RNA, 18 nt, Bordetella pertussis
cgucgcucugcgcggcau

SEQ ID NO: 2364774 - RNA, 18 nt, Bordetella pertussis
cgucgcugccgcgcgauc

SEQ ID NO: 2364775 - RNA, 23 nt, Bordetella pertussis
cgucgcugcgcggcgggaccgug

SEQ ID NO: 2364776 - RNA, 13 nt, Bordetella pertussis
cgucgcugcggcc

SEQ ID NO: 2364777 - RNA, 16 nt, Bordetella pertussis
cgucgcugcuggcggc

SEQ ID NO: 2364778 - RNA, 20 nt, Bordetella pertussis
cgucgcugcuggcggcgcug

SEQ ID NO: 2364779 - RNA, 14 nt, Bordetella pertussis
cgucgcuggcagcc

SEQ ID NO: 2364780 - RNA, 13 nt, Bordetella pertussis
cgucgcuggcgcg

SEQ ID NO: 2364781 - RNA, 15 nt, Bordetella pertussis
cgucggacaacgcca

SEQ ID NO: 2364782 - RNA, 16 nt, Bordetella pertussis
cgucggacgcgcgccg

SEQ ID NO: 2364783 - RNA, 19 nt, Bordetella pertussis
cgucggcaaccgucgccag

SEQ ID NO: 2364784 - RNA, 21 nt, Bordetella pertussis
cgucggcaaccgucgccagcg

SEQ ID NO: 2364785 - RNA, 21 nt, Bordetella pertussis
cgucggcaccuucgcgcagcg

SEQ ID NO: 2364786 - RNA, 14 nt, Bordetella pertussis
cgucggccaaggcc

SEQ ID NO: 2364787 - RNA, 16 nt, Bordetella pertussis
cgucggccaaggccgg

SEQ ID NO: 2364788 - RNA, 13 nt, Bordetella pertussis
cgucggccacgcc

SEQ ID NO: 2364789 - RNA, 12 nt, Bordetella pertussis
cgucggccacgu

SEQ ID NO: 2364790 - RNA, 14 nt, Bordetella pertussis
cgucggccagcgcc

SEQ ID NO: 2364791 - RNA, 16 nt, Bordetella pertussis
cgucggccagcgccgc

SEQ ID NO: 2364792 - RNA, 15 nt, Bordetella pertussis
cgucggccagcgcga

SEQ ID NO: 2364793 - RNA, 15 nt, Bordetella pertussis
cgucggccagcuugc

SEQ ID NO: 2364794 - RNA, 11 nt, Bordetella pertussis
cgucggccagg

SEQ ID NO: 2364795 - RNA, 14 nt, Bordetella pertussis
cgucggccaggccg

SEQ ID NO: 2364796 - RNA, 15 nt, Bordetella pertussis
cgucggccaggccga

SEQ ID NO: 2364797 - RNA, 14 nt, Bordetella pertussis
cgucggccaggcgc

SEQ ID NO: 2364798 - RNA, 15 nt, Bordetella pertussis
cgucggccaggcgcc

SEQ ID NO: 2364799 - RNA, 20 nt, Bordetella pertussis
cgucggccaggcgccagaug

SEQ ID NO: 2364800 - RNA, 20 nt, Bordetella pertussis
cgucggccaugcgcgccagc

SEQ ID NO: 2364801 - RNA, 15 nt, Bordetella pertussis
cgucggccgccagcc

SEQ ID NO: 2364802 - RNA, 15 nt, Bordetella pertussis
cgucggccgccgccg

SEQ ID NO: 2364803 - RNA, 16 nt, Bordetella pertussis
cgucggccgccgccgu

SEQ ID NO: 2364804 - RNA, 13 nt, Bordetella pertussis
cgucggccgcgcc

SEQ ID NO: 2364805 - RNA, 15 nt, Bordetella pertussis
cgucggccgcgccca

SEQ ID NO: 2364806 - RNA, 17 nt, Bordetella pertussis
cgucggccgcgcccagg

SEQ ID NO: 2364807 - RNA, 18 nt, Bordetella pertussis
cgucggccgcgcccaggu

SEQ ID NO: 2364808 - RNA, 12 nt, Bordetella pertussis
cgucggccgcgu

SEQ ID NO: 2364809 - RNA, 15 nt, Bordetella pertussis
cgucggccgcgucga

SEQ ID NO: 2364810 - RNA, 12 nt, Bordetella pertussis
cgucggccgucu

SEQ ID NO: 2364811 - RNA, 23 nt, Bordetella pertussis
cgucggccucaucgagcgccugg

SEQ ID NO: 2364812 - RNA, 17 nt, Bordetella pertussis
cgucggccugcacgcuc

SEQ ID NO: 2364813 - RNA, 18 nt, Bordetella pertussis
cgucggccugccagccug

SEQ ID NO: 2364814 - RNA, 11 nt, Bordetella pertussis
cgucggccugg

SEQ ID NO: 2364815 - RNA, 12 nt, Bordetella pertussis
cgucggccugga

SEQ ID NO: 2364816 - RNA, 22 nt, Bordetella pertussis
cgucggcgaagccuugcgcggc

SEQ ID NO: 2364817 - RNA, 22 nt, Bordetella pertussis
cgucggcgaucaccugcguggc

SEQ ID NO: 2364818 - RNA, 18 nt, Bordetella pertussis
cgucggcgauggcccggu

SEQ ID NO: 2364819 - RNA, 14 nt, Bordetella pertussis
cgucggcgccaugc

SEQ ID NO: 2364820 - RNA, 16 nt, Bordetella pertussis
cgucggcgccaugcug

SEQ ID NO: 2364821 - RNA, 23 nt, Bordetella pertussis
cgucggcgccaugcuggccgccg

SEQ ID NO: 2364822 - RNA, 15 nt, Bordetella pertussis
cgucggcgcccggcg

SEQ ID NO: 2364823 - RNA, 19 nt, Bordetella pertussis
cgucggcgcccggcgccgc

SEQ ID NO: 2364824 - RNA, 20 nt, Bordetella pertussis
cgucggcgcccggcgccgcg

SEQ ID NO: 2364825 - RNA, 13 nt, Bordetella pertussis
cgucggcgccgau

SEQ ID NO: 2364826 - RNA, 20 nt, Bordetella pertussis
cgucggcgccgaucagcagg

SEQ ID NO: 2364827 - RNA, 14 nt, Bordetella pertussis
cgucggcgcgcgcc

SEQ ID NO: 2364828 - RNA, 16 nt, Bordetella pertussis
cgucggcgcgcgccag

SEQ ID NO: 2364829 - RNA, 21 nt, Bordetella pertussis
cgucggcgcgcgccaggccca

SEQ ID NO: 2364830 - RNA, 14 nt, Bordetella pertussis
cgucggcgcgguau

SEQ ID NO: 2364831 - RNA, 22 nt, Bordetella pertussis
cgucggcgcgguauucgcgcug

SEQ ID NO: 2364832 - RNA, 12 nt, Bordetella pertussis
cgucggcgcucu

SEQ ID NO: 2364833 - RNA, 16 nt, Bordetella pertussis
cgucggcgcucuuggg

SEQ ID NO: 2364834 - RNA, 14 nt, Bordetella pertussis
cgucggcgcugcag

SEQ ID NO: 2364835 - RNA, 20 nt, Bordetella pertussis
cgucggcgcugcagcgcagg

SEQ ID NO: 2364836 - RNA, 13 nt, Bordetella pertussis
cgucggcgcuggc

SEQ ID NO: 2364837 - RNA, 17 nt, Bordetella pertussis
cgucggcggcccacagc

SEQ ID NO: 2364838 - RNA, 18 nt, Bordetella pertussis
cgucggcggcccacagcg

SEQ ID NO: 2364839 - RNA, 15 nt, Bordetella pertussis
cgucggcggccgccu

SEQ ID NO: 2364840 - RNA, 16 nt, Bordetella pertussis
cgucggcggccgccuu

SEQ ID NO: 2364841 - RNA, 17 nt, Bordetella pertussis
cgucggcgggacgcagg

SEQ ID NO: 2364842 - RNA, 23 nt, Bordetella pertussis
cgucggcgggacgcaggcccagc

SEQ ID NO: 2364843 - RNA, 15 nt, Bordetella pertussis
cgucggcguaaggcc

SEQ ID NO: 2364844 - RNA, 19 nt, Bordetella pertussis
cgucggcguaaggccgccg

SEQ ID NO: 2364845 - RNA, 20 nt, Bordetella pertussis
cgucggcguaaggccgccgg

SEQ ID NO: 2364846 - RNA, 23 nt, Bordetella pertussis
cgucggcguaaggccgccggcca

SEQ ID NO: 2364847 - RNA, 14 nt, Bordetella pertussis
cgucggcguugugc

SEQ ID NO: 2364848 - RNA, 20 nt, Bordetella pertussis
cgucggcguugugccggcgc

SEQ ID NO: 2364849 - RNA, 23 nt, Bordetella pertussis
cgucggcguugugccggcgcagg

SEQ ID NO: 2364850 - RNA, 16 nt, Bordetella pertussis
cgucggcucaguccaa

SEQ ID NO: 2364851 - RNA, 21 nt, Bordetella pertussis
cgucggcucaguccaagguca

SEQ ID NO: 2364852 - RNA, 15 nt, Bordetella pertussis
cgucgggcaagcggc

SEQ ID NO: 2364853 - RNA, 17 nt, Bordetella pertussis
cgucgggcagcaggcgc

SEQ ID NO: 2364854 - RNA, 20 nt, Bordetella pertussis
cgucgggcagcgcggcggcg

SEQ ID NO: 2364855 - RNA, 22 nt, Bordetella pertussis
cgucgggcagcgcggcggcgac

SEQ ID NO: 2364856 - RNA, 21 nt, Bordetella pertussis
cgucgggcaggauggccaugc

SEQ ID NO: 2364857 - RNA, 18 nt, Bordetella pertussis
cgucgggcagggcgacgu

SEQ ID NO: 2364858 - RNA, 21 nt, Bordetella pertussis
cgucgggcaguugcuggcggc

SEQ ID NO: 2364859 - RNA, 23 nt, Bordetella pertussis
cgucgggcaguugcuggcggccg

SEQ ID NO: 2364860 - RNA, 14 nt, Bordetella pertussis
cgucgggcgccgca

SEQ ID NO: 2364861 - RNA, 19 nt, Bordetella pertussis
cgucgggcgccgcaacgcc

SEQ ID NO: 2364862 - RNA, 14 nt, Bordetella pertussis
cgucgggggcggcc

SEQ ID NO: 2364863 - RNA, 14 nt, Bordetella pertussis
cgucggggucgucg

SEQ ID NO: 2364864 - RNA, 18 nt, Bordetella pertussis
cgucggugccguccagcg

SEQ ID NO: 2364865 - RNA, 12 nt, Bordetella pertussis
cgucgguggcca

SEQ ID NO: 2364866 - RNA, 20 nt, Bordetella pertussis
cgucgguggugaccacggcg

SEQ ID NO: 2364867 - RNA, 22 nt, Bordetella pertussis
cgucguacuggugggccgacgg

SEQ ID NO: 2364868 - RNA, 15 nt, Bordetella pertussis
cgucguagccgccga

SEQ ID NO: 2364869 - RNA, 16 nt, Bordetella pertussis
cgucguagcgccagcg

SEQ ID NO: 2364870 - RNA, 14 nt, Bordetella pertussis
cgucguagcgcugc

SEQ ID NO: 2364871 - RNA, 15 nt, Bordetella pertussis
cgucguagcgcugca

SEQ ID NO: 2364872 - RNA, 20 nt, Bordetella pertussis
cgucguagcgggcggcggcg

SEQ ID NO: 2364873 - RNA, 18 nt, Bordetella pertussis
cgucguagugcgcgccgc

SEQ ID NO: 2364874 - RNA, 19 nt, Bordetella pertussis
cgucguagugcgcgccgcu

SEQ ID NO: 2364875 - RNA, 13 nt, Bordetella pertussis
cgucguccacgcc

SEQ ID NO: 2364876 - RNA, 14 nt, Bordetella pertussis
cgucguccagcuug

SEQ ID NO: 2364877 - RNA, 15 nt, Bordetella pertussis
cgucguccaggcgca

SEQ ID NO: 2364878 - RNA, 22 nt, Bordetella pertussis
cgucguccaucgacgcggcgac

SEQ ID NO: 2364879 - RNA, 18 nt, Bordetella pertussis
cgucguccguccuggcca

SEQ ID NO: 2364880 - RNA, 20 nt, Bordetella pertussis
cgucguccguccuggccacu

SEQ ID NO: 2364881 - RNA, 23 nt, Bordetella pertussis
cgucguccguccuggccacugcc

SEQ ID NO: 2364882 - RNA, 20 nt, Bordetella pertussis
cgucguccucggcacggcca

SEQ ID NO: 2364883 - RNA, 15 nt, Bordetella pertussis
cgucgucgaugccga

SEQ ID NO: 2364884 - RNA, 14 nt, Bordetella pertussis
cgucgucgccaccg

SEQ ID NO: 2364885 - RNA, 18 nt, Bordetella pertussis
cgugaugccccagguccg

SEQ ID NO: 2364886 - RNA, 20 nt, Bordetella pertussis
cgugaugccgaccaggcccg

SEQ ID NO: 2364887 - RNA, 17 nt, Bordetella pertussis
cgugaugccgucgagcg

SEQ ID NO: 2364888 - RNA, 20 nt, Bordetella pertussis
cgugaugccgucgagcgcgg

SEQ ID NO: 2364889 - RNA, 16 nt, Bordetella pertussis
cgugaugcgcgccgcu

SEQ ID NO: 2364890 - RNA, 19 nt, Bordetella pertussis
cgugaugcggucggccaca

SEQ ID NO: 2364891 - RNA, 14 nt, Bordetella pertussis
cgugauggacgccg

SEQ ID NO: 2364892 - RNA, 15 nt, Bordetella pertussis
cgugauggacgccgg

SEQ ID NO: 2364893 - RNA, 13 nt, Bordetella pertussis
cgugauggggccg

SEQ ID NO: 2364894 - RNA, 13 nt, Bordetella pertussis
cgugaugucgccg

SEQ ID NO: 2364895 - RNA, 18 nt, Bordetella pertussis
cgugaugucgccgucggc

SEQ ID NO: 2364896 - RNA, 14 nt, Bordetella pertussis
cgugcaccagcccg

SEQ ID NO: 2364897 - RNA, 24 nt, Bordetella pertussis
cgugcaccagcccgaugcgccagg

SEQ ID NO: 2364898 - RNA, 16 nt, Bordetella pertussis
cgugcaccaugccgac

SEQ ID NO: 2364899 - RNA, 14 nt, Bordetella pertussis
cgugcacgaccugc

SEQ ID NO: 2364900 - RNA, 15 nt, Bordetella pertussis
cgugcacgcccgcgg

SEQ ID NO: 2364901 - RNA, 18 nt, Bordetella pertussis
cgugcacgcccgcggcgc

SEQ ID NO: 2364902 - RNA, 20 nt, Bordetella pertussis
cgugcacgcccgcggcgccc

SEQ ID NO: 2364903 - RNA, 23 nt, Bordetella pertussis
cgugcacgcccgcggcgcccagc

SEQ ID NO: 2364904 - RNA, 16 nt, Bordetella pertussis
cgugcagaagcugacc

SEQ ID NO: 2364905 - RNA, 20 nt, Bordetella pertussis
cgugcagacggcggcuggac

SEQ ID NO: 2364906 - RNA, 21 nt, Bordetella pertussis
cgugcagacggcggcuggacg

SEQ ID NO: 2364907 - RNA, 21 nt, Bordetella pertussis
cgugcagagcaccacggcgcg

SEQ ID NO: 2364908 - RNA, 12 nt, Bordetella pertussis
cgugcagaucug

SEQ ID NO: 2364909 - RNA, 12 nt, Bordetella pertussis
cgugcagauggc

SEQ ID NO: 2364910 - RNA, 21 nt, Bordetella pertussis
cgugcagcaagcccaccgggc

SEQ ID NO: 2364911 - RNA, 16 nt, Bordetella pertussis
cgugcagcaggggcug

SEQ ID NO: 2364912 - RNA, 19 nt, Bordetella pertussis
cgugcagcaggggcugcca

SEQ ID NO: 2364913 - RNA, 14 nt, Bordetella pertussis
cgugcagccagcgg

SEQ ID NO: 2364914 - RNA, 16 nt, Bordetella pertussis
cgugcagccagcggcc

SEQ ID NO: 2364915 - RNA, 17 nt, Bordetella pertussis
cgugcagccagcggccg

SEQ ID NO: 2364916 - RNA, 19 nt, Bordetella pertussis
cgugcagccagcggccgau

SEQ ID NO: 2364917 - RNA, 20 nt, Bordetella pertussis
cgugcagcgacuugucgcgc

SEQ ID NO: 2364918 - RNA, 18 nt, Bordetella pertussis
cgugcagcgccgcgcgcu

SEQ ID NO: 2364919 - RNA, 16 nt, Bordetella pertussis
cgugcagcgcgugggc

SEQ ID NO: 2364920 - RNA, 17 nt, Bordetella pertussis
cgugcagcgcgugggcc

SEQ ID NO: 2364921 - RNA, 20 nt, Bordetella pertussis
cgugcagcgcgugggccagu

SEQ ID NO: 2364922 - RNA, 14 nt, Bordetella pertussis
cgugcagcgugggc

SEQ ID NO: 2364923 - RNA, 15 nt, Bordetella pertussis
cgugcaggcccgggc

SEQ ID NO: 2364924 - RNA, 16 nt, Bordetella pertussis
cgugcaggcccgggcg

SEQ ID NO: 2364925 - RNA, 18 nt, Bordetella pertussis
cgugcaggcccgggcgcc

SEQ ID NO: 2364926 - RNA, 13 nt, Bordetella pertussis
cgugcaggccggc

SEQ ID NO: 2364927 - RNA, 15 nt, Bordetella pertussis
cgugcaggccggcgg

SEQ ID NO: 2364928 - RNA, 17 nt, Bordetella pertussis
cgugcaggccggcggcg

SEQ ID NO: 2364929 - RNA, 20 nt, Bordetella pertussis
cgugcagggucagggugucg

SEQ ID NO: 2364930 - RNA, 12 nt, Bordetella pertussis
cgugcagguacu

SEQ ID NO: 2364931 - RNA, 15 nt, Bordetella pertussis
cgugccacggcuucg

SEQ ID NO: 2364932 - RNA, 12 nt, Bordetella pertussis
cgugccagcagg

SEQ ID NO: 2364933 - RNA, 17 nt, Bordetella pertussis
cgugccagcaggucgcg

SEQ ID NO: 2364934 - RNA, 20 nt, Bordetella pertussis
cgugccagcaggucgcgcac

SEQ ID NO: 2364935 - RNA, 21 nt, Bordetella pertussis
cgugccagcaggucgcgcacg

SEQ ID NO: 2364936 - RNA, 12 nt, Bordetella pertussis
cgugccagccga

SEQ ID NO: 2364937 - RNA, 17 nt, Bordetella pertussis
cgugccagccgaacugg

SEQ ID NO: 2364938 - RNA, 20 nt, Bordetella pertussis
cgugccauacagcaaggaca

SEQ ID NO: 2364939 - RNA, 16 nt, Bordetella pertussis
cgugccauggaccggc

SEQ ID NO: 2364940 - RNA, 17 nt, Bordetella pertussis
cgugccauggacgccgg

SEQ ID NO: 2364941 - RNA, 23 nt, Bordetella pertussis
cgugcccaaugucaccgacgcca

SEQ ID NO: 2364942 - RNA, 14 nt, Bordetella pertussis
cgugcccagcgaga

SEQ ID NO: 2364943 - RNA, 14 nt, Bordetella pertussis
cgugcccagcuggc

SEQ ID NO: 2364944 - RNA, 18 nt, Bordetella pertussis
cgugcccagcuggcaccg

SEQ ID NO: 2364945 - RNA, 11 nt, Bordetella pertussis
cgugcccaggg

SEQ ID NO: 2364946 - RNA, 14 nt, Bordetella pertussis
cgugcccagggcca

SEQ ID NO: 2364947 - RNA, 17 nt, Bordetella pertussis
cgugcccagggccacga

SEQ ID NO: 2364948 - RNA, 14 nt, Bordetella pertussis
cgugcccaguuucg

SEQ ID NO: 2364949 - RNA, 17 nt, Bordetella pertussis
cgugcccgcguccacca

SEQ ID NO: 2364950 - RNA, 20 nt, Bordetella pertussis
cgugcccgcguccaccaagg

SEQ ID NO: 2364951 - RNA, 15 nt, Bordetella pertussis
cgugcccggcgggcc

SEQ ID NO: 2364952 - RNA, 18 nt, Bordetella pertussis
cgugcccguugccgcgcg

SEQ ID NO: 2364953 - RNA, 19 nt, Bordetella pertussis
cgugcccguugccgcgcgc

SEQ ID NO: 2364954 - RNA, 15 nt, Bordetella pertussis
cgugcccugcggcgc

SEQ ID NO: 2364955 - RNA, 18 nt, Bordetella pertussis
cgugcccugcggcgcggc

SEQ ID NO: 2364956 - RNA, 15 nt, Bordetella pertussis
cgugccgacgaugcc

SEQ ID NO: 2364957 - RNA, 17 nt, Bordetella pertussis
cgugccgacgaugccgc

SEQ ID NO: 2364958 - RNA, 18 nt, Bordetella pertussis
cgugccgcacgguggcgc

SEQ ID NO: 2364959 - RNA, 13 nt, Bordetella pertussis
cgugccgcagaag

SEQ ID NO: 2364960 - RNA, 15 nt, Bordetella pertussis
cgugccgcagauguc

SEQ ID NO: 2364961 - RNA, 19 nt, Bordetella pertussis
cgugccgcagaugucaguc

SEQ ID NO: 2364962 - RNA, 14 nt, Bordetella pertussis
cgugccgcaggcca

SEQ ID NO: 2364963 - RNA, 16 nt, Bordetella pertussis
cgugccgcaggccagc

SEQ ID NO: 2364964 - RNA, 18 nt, Bordetella pertussis
cgugccgcaggccagccc

SEQ ID NO: 2364965 - RNA, 14 nt, Bordetella pertussis
cgugccgcccagga

SEQ ID NO: 2364966 - RNA, 15 nt, Bordetella pertussis
cgugccgccggcgcg

SEQ ID NO: 2364967 - RNA, 16 nt, Bordetella pertussis
cgugccgccggcgcgu

SEQ ID NO: 2364968 - RNA, 18 nt, Bordetella pertussis
cgugccgcgcaggucggc

SEQ ID NO: 2364969 - RNA, 19 nt, Bordetella pertussis
cgugccgcgcaggucggcg

SEQ ID NO: 2364970 - RNA, 18 nt, Bordetella pertussis
cgugccgcgcgcaccggc

SEQ ID NO: 2364971 - RNA, 15 nt, Bordetella pertussis
cgugccgcgcugggc

SEQ ID NO: 2364972 - RNA, 19 nt, Bordetella pertussis
cgugccgcggcgcggcccg

SEQ ID NO: 2364973 - RNA, 12 nt, Bordetella pertussis
cgugccggaugg

SEQ ID NO: 2364974 - RNA, 15 nt, Bordetella pertussis
cgugccggccggacc

SEQ ID NO: 2364975 - RNA, 22 nt, Bordetella pertussis
cgugccgggaugcugcucggcc

SEQ ID NO: 2364976 - RNA, 13 nt, Bordetella pertussis
cgugccgggcagc

SEQ ID NO: 2364977 - RNA, 18 nt, Bordetella pertussis
cgugccggugacgacgcg

SEQ ID NO: 2364978 - RNA, 15 nt, Bordetella pertussis
cgugccgucgaugau

SEQ ID NO: 2364979 - RNA, 17 nt, Bordetella pertussis
cgugccgucgggcgccg

SEQ ID NO: 2364980 - RNA, 19 nt, Bordetella pertussis
cgugccucaacuggccggc

SEQ ID NO: 2364981 - RNA, 22 nt, Bordetella pertussis
cgugccucaacuggccggccug

SEQ ID NO: 2364982 - RNA, 19 nt, Bordetella pertussis
cgugccuguccccgcacgg

SEQ ID NO: 2364983 - RNA, 15 nt, Bordetella pertussis
cgugccuugccggcc

SEQ ID NO: 2364984 - RNA, 22 nt, Bordetella pertussis
cgugcgacgcaugucagcgccu

SEQ ID NO: 2364985 - RNA, 15 nt, Bordetella pertussis
cgugcgacgugaccc

SEQ ID NO: 2364986 - RNA, 11 nt, Bordetella pertussis
cgugcgaggcc

SEQ ID NO: 2364987 - RNA, 16 nt, Bordetella pertussis
cgugcgaggccacggc

SEQ ID NO: 2364988 - RNA, 17 nt, Bordetella pertussis
cgugcgaggccacggca

SEQ ID NO: 2364989 - RNA, 16 nt, Bordetella pertussis
cgugcgaggcgaacag

SEQ ID NO: 2364990 - RNA, 22 nt, Bordetella pertussis
cgugcgcacgcguucgggcggc

SEQ ID NO: 2364991 - RNA, 20 nt, Bordetella pertussis
cgugcgcagguauuccgccg

SEQ ID NO: 2364992 - RNA, 16 nt, Bordetella pertussis
cgugcgcaucagcgca

SEQ ID NO: 2364993 - RNA, 17 nt, Bordetella pertussis
cgugcgccacagcauga

SEQ ID NO: 2364994 - RNA, 15 nt, Bordetella pertussis
cgugcgccagcgcca

SEQ ID NO: 2364995 - RNA, 16 nt, Bordetella pertussis
cgugcgccagcgccag

SEQ ID NO: 2364996 - RNA, 23 nt, Bordetella pertussis
cgugcgccaggcaaaggcccagg

SEQ ID NO: 2364997 - RNA, 13 nt, Bordetella pertussis
cgugcgcccaugg

SEQ ID NO: 2364998 - RNA, 17 nt, Bordetella pertussis
cgugcgcccauggcgcg

SEQ ID NO: 2364999 - RNA, 20 nt, Bordetella pertussis
cguggccguucggugcgcag

SEQ ID NO: 2365000 - RNA, 22 nt, Bordetella pertussis
cguggccugcuugaagacgccc

SEQ ID NO: 2365001 - RNA, 18 nt, Bordetella pertussis
cguggcgacgcgcugccg

SEQ ID NO: 2365002 - RNA, 13 nt, Bordetella pertussis
cguggcgacgucg

SEQ ID NO: 2365003 - RNA, 17 nt, Bordetella pertussis
cguggcgauagcgcucc

SEQ ID NO: 2365004 - RNA, 18 nt, Bordetella pertussis
cguggcgauccagggccg

SEQ ID NO: 2365005 - RNA, 22 nt, Bordetella pertussis
cguggcgauccagggccgccag

SEQ ID NO: 2365006 - RNA, 23 nt, Bordetella pertussis
cguggcgauccagggccgccagc

SEQ ID NO: 2365007 - RNA, 13 nt, Bordetella pertussis
cguggcgcaccag

SEQ ID NO: 2365008 - RNA, 12 nt, Bordetella pertussis
cguggcgcagcu

SEQ ID NO: 2365009 - RNA, 18 nt, Bordetella pertussis
cguggcgcagucgagcac

SEQ ID NO: 2365010 - RNA, 22 nt, Bordetella pertussis
cguggcgcagucgagcaccgcg

SEQ ID NO: 2365011 - RNA, 19 nt, Bordetella pertussis
cguggcgccgacccugccc

SEQ ID NO: 2365012 - RNA, 23 nt, Bordetella pertussis
cguggcgcgcaaccaggggcggc

SEQ ID NO: 2365013 - RNA, 23 nt, Bordetella pertussis
cguggcgcgcacacuggccagca

SEQ ID NO: 2365014 - RNA, 14 nt, Bordetella pertussis
cguggcgcgcaccu

SEQ ID NO: 2365015 - RNA, 15 nt, Bordetella pertussis
cguggcgcgcaccug

SEQ ID NO: 2365016 - RNA, 14 nt, Bordetella pertussis
cguggcgcgccagc

SEQ ID NO: 2365017 - RNA, 15 nt, Bordetella pertussis
cguggcgcgccagcg

SEQ ID NO: 2365018 - RNA, 21 nt, Bordetella pertussis
cguggcgcgccuccagcucca

SEQ ID NO: 2365019 - RNA, 12 nt, Bordetella pertussis
cguggcggccac

SEQ ID NO: 2365020 - RNA, 13 nt, Bordetella pertussis
cguggcggccaca

SEQ ID NO: 2365021 - RNA, 16 nt, Bordetella pertussis
cguggcggccacaacc

SEQ ID NO: 2365022 - RNA, 16 nt, Bordetella pertussis
cguggcggccaggccg

SEQ ID NO: 2365023 - RNA, 12 nt, Bordetella pertussis
cguggcggccgc

SEQ ID NO: 2365024 - RNA, 14 nt, Bordetella pertussis
cguggcggccgcgg

SEQ ID NO: 2365025 - RNA, 14 nt, Bordetella pertussis
cguggcggccugcg

SEQ ID NO: 2365026 - RNA, 17 nt, Bordetella pertussis
cguggcggccugcgccg

SEQ ID NO: 2365027 - RNA, 20 nt, Bordetella pertussis
cguggcggccugcgccggca

SEQ ID NO: 2365028 - RNA, 18 nt, Bordetella pertussis
cguggcggcgauguggcg

SEQ ID NO: 2365029 - RNA, 21 nt, Bordetella pertussis
cguggcggcgauguggcgcgc

SEQ ID NO: 2365030 - RNA, 16 nt, Bordetella pertussis
cguggcggcgcagcgc

SEQ ID NO: 2365031 - RNA, 12 nt, Bordetella pertussis
cguggcgggccg

SEQ ID NO: 2365032 - RNA, 14 nt, Bordetella pertussis
cguggcgggccgcg

SEQ ID NO: 2365033 - RNA, 16 nt, Bordetella pertussis
cguggcgggccgcgcc

SEQ ID NO: 2365034 - RNA, 17 nt, Bordetella pertussis
cguggcgggccgcgccg

SEQ ID NO: 2365035 - RNA, 20 nt, Bordetella pertussis
cguggcgggccgcgccgcgg

SEQ ID NO: 2365036 - RNA, 16 nt, Bordetella pertussis
cguggcggggcguucg

SEQ ID NO: 2365037 - RNA, 17 nt, Bordetella pertussis
cguggcggguccacgug

SEQ ID NO: 2365038 - RNA, 13 nt, Bordetella pertussis
cguggcguccaug

SEQ ID NO: 2365039 - RNA, 15 nt, Bordetella pertussis
cguggcguccaugca

SEQ ID NO: 2365040 - RNA, 16 nt, Bordetella pertussis
cguggcgucguggggc

SEQ ID NO: 2365041 - RNA, 18 nt, Bordetella pertussis
cguggcgugcaggccggc

SEQ ID NO: 2365042 - RNA, 21 nt, Bordetella pertussis
cguggcgugcaggccggcggc

SEQ ID NO: 2365043 - RNA, 14 nt, Bordetella pertussis
cguggcugaccagc

SEQ ID NO: 2365044 - RNA, 15 nt, Bordetella pertussis
cguggcugaccagca

SEQ ID NO: 2365045 - RNA, 21 nt, Bordetella pertussis
cguggcugaccagcagcaccg

SEQ ID NO: 2365046 - RNA, 21 nt, Bordetella pertussis
cguggcuggugauguccugca

SEQ ID NO: 2365047 - RNA, 14 nt, Bordetella pertussis
cgugggacaggcac

SEQ ID NO: 2365048 - RNA, 12 nt, Bordetella pertussis
cgugggccagca

SEQ ID NO: 2365049 - RNA, 17 nt, Bordetella pertussis
cgugggccaguccgcag

SEQ ID NO: 2365050 - RNA, 20 nt, Bordetella pertussis
cgugggccaguccgcagcgc

SEQ ID NO: 2365051 - RNA, 23 nt, Bordetella pertussis
cgugggcgagcguuuuggcgagc

SEQ ID NO: 2365052 - RNA, 14 nt, Bordetella pertussis
cgugggcggcggca

SEQ ID NO: 2365053 - RNA, 21 nt, Bordetella pertussis
cgugggcucgaugcguccguc

SEQ ID NO: 2365054 - RNA, 17 nt, Bordetella pertussis
cguggggacaggcaccu

SEQ ID NO: 2365055 - RNA, 18 nt, Bordetella pertussis
cguggggacaggcaccug

SEQ ID NO: 2365056 - RNA, 14 nt, Bordetella pertussis
cguggggagcgcgg

SEQ ID NO: 2365057 - RNA, 16 nt, Bordetella pertussis
cguggggagcgcggcc

SEQ ID NO: 2365058 - RNA, 22 nt, Bordetella pertussis
cgugguacgacgagcgcaccau

SEQ ID NO: 2365059 - RNA, 13 nt, Bordetella pertussis
cgugguacgugga

SEQ ID NO: 2365060 - RNA, 21 nt, Bordetella pertussis
cgugguacguggacucgaugg

SEQ ID NO: 2365061 - RNA, 15 nt, Bordetella pertussis
cgugguaucgcgcca

SEQ ID NO: 2365062 - RNA, 17 nt, Bordetella pertussis
cgugguaucgcgccagc

SEQ ID NO: 2365063 - RNA, 19 nt, Bordetella pertussis
cgugguaucgcgccagcgc

SEQ ID NO: 2365064 - RNA, 15 nt, Bordetella pertussis
cguggucaucgaugg

SEQ ID NO: 2365065 - RNA, 18 nt, Bordetella pertussis
cgugguccacgaagcagg

SEQ ID NO: 2365066 - RNA, 22 nt, Bordetella pertussis
cguggucgacauagacgcgcag

SEQ ID NO: 2365067 - RNA, 15 nt, Bordetella pertussis
cguggucgcaguccc

SEQ ID NO: 2365068 - RNA, 22 nt, Bordetella pertussis
cguggucgcagucccaguccgg

SEQ ID NO: 2365069 - RNA, 17 nt, Bordetella pertussis
cguggucgccagcacgc

SEQ ID NO: 2365070 - RNA, 15 nt, Bordetella pertussis
cguggucgucccgca

SEQ ID NO: 2365071 - RNA, 18 nt, Bordetella pertussis
cguggugcccugcuccca

SEQ ID NO: 2365072 - RNA, 22 nt, Bordetella pertussis
cgugguggccuugcugcccgac

SEQ ID NO: 2365073 - RNA, 16 nt, Bordetella pertussis
cguggugggcaccgug

SEQ ID NO: 2365074 - RNA, 22 nt, Bordetella pertussis
cguggugggccacucgaugggc

SEQ ID NO: 2365075 - RNA, 18 nt, Bordetella pertussis
cguguagagcaggccgcc

SEQ ID NO: 2365076 - RNA, 14 nt, Bordetella pertussis
cguguagagcugcg

SEQ ID NO: 2365077 - RNA, 17 nt, Bordetella pertussis
cguguagagcugcggcg

SEQ ID NO: 2365078 - RNA, 14 nt, Bordetella pertussis
cguguagggccugg

SEQ ID NO: 2365079 - RNA, 13 nt, Bordetella pertussis
cgugucaggcgga

SEQ ID NO: 2365080 - RNA, 22 nt, Bordetella pertussis
cgugucaggcggagucgccccg

SEQ ID NO: 2365081 - RNA, 14 nt, Bordetella pertussis
cgugucccagccgg

SEQ ID NO: 2365082 - RNA, 19 nt, Bordetella pertussis
cguguccgccguagcgcgc

SEQ ID NO: 2365083 - RNA, 21 nt, Bordetella pertussis
cguguccgccguagcgcgcca

SEQ ID NO: 2365084 - RNA, 16 nt, Bordetella pertussis
cgugucgaacaccagg

SEQ ID NO: 2365085 - RNA, 20 nt, Bordetella pertussis
cgugucgcccuucaggccag

SEQ ID NO: 2365086 - RNA, 13 nt, Bordetella pertussis
cgugucgccgucg

SEQ ID NO: 2365087 - RNA, 15 nt, Bordetella pertussis
cgugucggcaaccug

SEQ ID NO: 2365088 - RNA, 16 nt, Bordetella pertussis
cgugugauagcacugc

SEQ ID NO: 2365089 - RNA, 18 nt, Bordetella pertussis
cgugugauagcacugcac

SEQ ID NO: 2365090 - RNA, 17 nt, Bordetella pertussis
cgugugaucgccgacga

SEQ ID NO: 2365091 - RNA, 22 nt, Bordetella pertussis
cgugugaucgccgacgaugucg

SEQ ID NO: 2365092 - RNA, 22 nt, Bordetella pertussis
cgugugcaggacgaacaggccg

SEQ ID NO: 2365093 - RNA, 15 nt, Bordetella pertussis
cgugugcccagcacc

SEQ ID NO: 2365094 - RNA, 19 nt, Bordetella pertussis
cgugugcccagcaccaggc

SEQ ID NO: 2365095 - RNA, 21 nt, Bordetella pertussis
cgugugcccagcaccaggccg

SEQ ID NO: 2365096 - RNA, 23 nt, Bordetella pertussis
cgugugcccagcaccaggccgaa

SEQ ID NO: 2365097 - RNA, 15 nt, Bordetella pertussis
cgugugccgccagcg

SEQ ID NO: 2365098 - RNA, 17 nt, Bordetella pertussis
cguguggcaggccagcg

SEQ ID NO: 2365099 - RNA, 23 nt, Bordetella pertussis
cguguggugaaagccgccggcgc

SEQ ID NO: 2365100 - RNA, 12 nt, Bordetella pertussis
cgugugguuggc

SEQ ID NO: 2365101 - RNA, 16 nt, Bordetella pertussis
cgugugucccggcggg

SEQ ID NO: 2365102 - RNA, 19 nt, Bordetella pertussis
cgugugucccggcggggca

SEQ ID NO: 2365103 - RNA, 21 nt, Bordetella pertussis
cguguucagcgcgcgcgccga

SEQ ID NO: 2365104 - RNA, 14 nt, Bordetella pertussis
cguguuccagcgcc

SEQ ID NO: 2365105 - RNA, 15 nt, Bordetella pertussis
cguguuccagcgccu

SEQ ID NO: 2365106 - RNA, 15 nt, Bordetella pertussis
cguguucgacgcggc

SEQ ID NO: 2365107 - RNA, 17 nt, Bordetella pertussis
cguguucgacgcggccg

SEQ ID NO: 2365108 - RNA, 14 nt, Bordetella pertussis
cguguucgagcagg

SEQ ID NO: 2365109 - RNA, 17 nt, Bordetella pertussis
cguguucgagcaggcgc

SEQ ID NO: 2365110 - RNA, 22 nt, Bordetella pertussis
cguguucgagcaggcgcgcggu

SEQ ID NO: 2365111 - RNA, 18 nt, Bordetella pertussis
cguguugcgugcgagcag

SEQ ID NO: 2365112 - RNA, 22 nt, Bordetella pertussis
cguugcggcgccucgguccagc

SEQ ID NO: 2365113 - RNA, 21 nt, Bordetella pertussis
cguugcuccagccaggcgcgc

SEQ ID NO: 2365114 - RNA, 14 nt, Bordetella pertussis
cguugcugcagcgu

SEQ ID NO: 2365115 - RNA, 15 nt, Bordetella pertussis
cguuggagcaagcgu

SEQ ID NO: 2365116 - RNA, 13 nt, Bordetella pertussis
cguuggcaggcca

SEQ ID NO: 2365117 - RNA, 16 nt, Bordetella pertussis
cguuggcaggccagca

SEQ ID NO: 2365118 - RNA, 19 nt, Bordetella pertussis
cguuggcaggccagcaugg

SEQ ID NO: 2365119 - RNA, 18 nt, Bordetella pertussis
cguuggccaaugcgccgc

SEQ ID NO: 2365120 - RNA, 15 nt, Bordetella pertussis
cguuggccagcgccg

SEQ ID NO: 2365121 - RNA, 16 nt, Bordetella pertussis
cguuggccagcgccgc

SEQ ID NO: 2365122 - RNA, 17 nt, Bordetella pertussis
cguuggccagcgccgcc

SEQ ID NO: 2365123 - RNA, 23 nt, Bordetella pertussis
cguuggccgcgaaggcuucgucg

SEQ ID NO: 2365124 - RNA, 19 nt, Bordetella pertussis
cguuggccgggucgcgcag

SEQ ID NO: 2365125 - RNA, 21 nt, Bordetella pertussis
cguuggccgggucgcgcagca

SEQ ID NO: 2365126 - RNA, 23 nt, Bordetella pertussis
cguuggccgggucgcgcagcagg

SEQ ID NO: 2365127 - RNA, 17 nt, Bordetella pertussis
cguuggccugaccggaa

SEQ ID NO: 2365128 - RNA, 23 nt, Bordetella pertussis
cguuggccugccauccggccgca

SEQ ID NO: 2365129 - RNA, 14 nt, Bordetella pertussis
cguuggcgcccagc

SEQ ID NO: 2365130 - RNA, 18 nt, Bordetella pertussis
cguuggcgcccagcgcca

SEQ ID NO: 2365131 - RNA, 18 nt, Bordetella pertussis
cguuggcggccggccagc

SEQ ID NO: 2365132 - RNA, 20 nt, Bordetella pertussis
cguugggcaugccgaucagc

SEQ ID NO: 2365133 - RNA, 16 nt, Bordetella pertussis
cguuggucaccacgcc

SEQ ID NO: 2365134 - RNA, 13 nt, Bordetella pertussis
cguuggucuuggg

SEQ ID NO: 2365135 - RNA, 22 nt, Bordetella pertussis
cguuggugucggcggcgagcug

SEQ ID NO: 2365136 - RNA, 22 nt, Bordetella pertussis
cguugguguguaccguacccgc

SEQ ID NO: 2365137 - RNA, 14 nt, Bordetella pertussis
cguuguccaggccg

SEQ ID NO: 2365138 - RNA, 15 nt, Bordetella pertussis
cguuguccaggccga

SEQ ID NO: 2365139 - RNA, 18 nt, Bordetella pertussis
cguuguccaggccgauca

SEQ ID NO: 2365140 - RNA, 22 nt, Bordetella pertussis
cguuguccaggccgaucagcga

SEQ ID NO: 2365141 - RNA, 15 nt, Bordetella pertussis
cguuguccuggcgcg

SEQ ID NO: 2365142 - RNA, 20 nt, Bordetella pertussis
cguugucgagcaggccgccg

SEQ ID NO: 2365143 - RNA, 19 nt, Bordetella pertussis
cguugucgcgccgcgaugc

SEQ ID NO: 2365144 - RNA, 13 nt, Bordetella pertussis
cguugucgcgcgu

SEQ ID NO: 2365145 - RNA, 15 nt, Bordetella pertussis
cguuguucgggccgg

SEQ ID NO: 2365146 - RNA, 17 nt, Bordetella pertussis
cguuguucgggccggcu

SEQ ID NO: 2365147 - RNA, 18 nt, Bordetella pertussis
cguuuacuccccagacgc

SEQ ID NO: 2365148 - RNA, 18 nt, Bordetella pertussis
cguuucaccgcuggacga

SEQ ID NO: 2365149 - RNA, 16 nt, Bordetella pertussis
cguuuccagggcgcgc

SEQ ID NO: 2365150 - RNA, 20 nt, Bordetella pertussis
cguuucuacugggugcuggc

SEQ ID NO: 2365151 - RNA, 19 nt, Bordetella pertussis
cguuucucaacccgccggc

SEQ ID NO: 2365152 - RNA, 17 nt, Bordetella pertussis
cguuugccccucggcgg

SEQ ID NO: 2365153 - RNA, 19 nt, Bordetella pertussis
cguuugcggacgggccagu

SEQ ID NO: 2365154 - RNA, 14 nt, Bordetella pertussis
cguuuggccugccc

SEQ ID NO: 2365155 - RNA, 17 nt, Bordetella pertussis
cguuuggccugcccugg

SEQ ID NO: 2365156 - RNA, 14 nt, Bordetella pertussis
cguuuuccagcauc

SEQ ID NO: 2365157 - RNA, 18 nt, Bordetella pertussis
cuaaaaggaaauauaugg

SEQ ID NO: 2365158 - RNA, 17 nt, Bordetella pertussis
cuaagaugaaucgcaug

SEQ ID NO: 2365159 - RNA, 20 nt, Bordetella pertussis
cuacaccaucaacgggccgc

SEQ ID NO: 2365160 - RNA, 14 nt, Bordetella pertussis
cuacacggccgcca

SEQ ID NO: 2365161 - RNA, 23 nt, Bordetella pertussis
cuacacggccgccaccugggccg

SEQ ID NO: 2365162 - RNA, 15 nt, Bordetella pertussis
cuacacggugggcga

SEQ ID NO: 2365163 - RNA, 19 nt, Bordetella pertussis
cuacacggugggcgacgcg

SEQ ID NO: 2365164 - RNA, 23 nt, Bordetella pertussis
cuacagcgucacggcaagacggc

SEQ ID NO: 2365165 - RNA, 15 nt, Bordetella pertussis
cuacagcgugguggg

SEQ ID NO: 2365166 - RNA, 14 nt, Bordetella pertussis
cuacaggcccagcg

SEQ ID NO: 2365167 - RNA, 20 nt, Bordetella pertussis
cuacaggcccagcgccagca

SEQ ID NO: 2365168 - RNA, 15 nt, Bordetella pertussis
cuacagggugccgcg

SEQ ID NO: 2365169 - RNA, 18 nt, Bordetella pertussis
cuacagggugccgcgccg

SEQ ID NO: 2365170 - RNA, 19 nt, Bordetella pertussis
cuacagggugccgcgccgg

SEQ ID NO: 2365171 - RNA, 16 nt, Bordetella pertussis
cuaccaggcgcgcgcg

SEQ ID NO: 2365172 - RNA, 18 nt, Bordetella pertussis
cuaccaggugggcgcgcu

SEQ ID NO: 2365173 - RNA, 15 nt, Bordetella pertussis
cuacccgccgggcgg

SEQ ID NO: 2365174 - RNA, 19 nt, Bordetella pertussis
cuaccgcuucccuggcaag

SEQ ID NO: 2365175 - RNA, 15 nt, Bordetella pertussis
cuaccggcgccgacg

SEQ ID NO: 2365176 - RNA, 22 nt, Bordetella pertussis
cuaccggcgccgacgcgcuggc

SEQ ID NO: 2365177 - RNA, 14 nt, Bordetella pertussis
cuaccucagcaugg

SEQ ID NO: 2365178 - RNA, 23 nt, Bordetella pertussis
cuaccugucgggcggcggcgugg

SEQ ID NO: 2365179 - RNA, 16 nt, Bordetella pertussis
cuacgaguaccgccgc

SEQ ID NO: 2365180 - RNA, 14 nt, Bordetella pertussis
cuacgcgcgcgccg

SEQ ID NO: 2365181 - RNA, 13 nt, Bordetella pertussis
cuacgcgcuggcg

SEQ ID NO: 2365182 - RNA, 15 nt, Bordetella pertussis
cuacggcggcggcca

SEQ ID NO: 2365183 - RNA, 16 nt, Bordetella pertussis
cuacggcggcggccau

SEQ ID NO: 2365184 - RNA, 23 nt, Bordetella pertussis
cuacgggcgcugcacgcagcgca

SEQ ID NO: 2365185 - RNA, 12 nt, Bordetella pertussis
cuacgugcugga

SEQ ID NO: 2365186 - RNA, 18 nt, Bordetella pertussis
cuacgugcuggacccgcu

SEQ ID NO: 2365187 - RNA, 18 nt, Bordetella pertussis
cuacuggcaacgggucgc

SEQ ID NO: 2365188 - RNA, 14 nt, Bordetella pertussis
cuacuggcgcgcgc

SEQ ID NO: 2365189 - RNA, 15 nt, Bordetella pertussis
cuacuggcugaucac

SEQ ID NO: 2365190 - RNA, 16 nt, Bordetella pertussis
cuacuugccggcgcuc

SEQ ID NO: 2365191 - RNA, 23 nt, Bordetella pertussis
cuagccaccgauaucgauaccaa

SEQ ID NO: 2365192 - RNA, 16 nt, Bordetella pertussis
cuagcccggcgccacc

SEQ ID NO: 2365193 - RNA, 17 nt, Bordetella pertussis
cuagcccggcgccaccc

SEQ ID NO: 2365194 - RNA, 16 nt, Bordetella pertussis
cuagcgccgcgccagg

SEQ ID NO: 2365195 - RNA, 17 nt, Bordetella pertussis
cuagcgccgcgccaggu

SEQ ID NO: 2365196 - RNA, 14 nt, Bordetella pertussis
cuaggcgcagcagg

SEQ ID NO: 2365197 - RNA, 20 nt, Bordetella pertussis
cuaguagaacucgccagguc

SEQ ID NO: 2365198 - RNA, 22 nt, Bordetella pertussis
cuagucaugcgugaacuggucc

SEQ ID NO: 2365199 - RNA, 20 nt, Bordetella pertussis
cuaguucuauauaggacuau

SEQ ID NO: 2365200 - RNA, 18 nt, Bordetella pertussis
cuauacaacgcgguggcg

SEQ ID NO: 2365201 - RNA, 15 nt, Bordetella pertussis
cuaucaucaggccca

SEQ ID NO: 2365202 - RNA, 14 nt, Bordetella pertussis
cuaucauccgcgca

SEQ ID NO: 2365203 - RNA, 22 nt, Bordetella pertussis
cuaucccaacccguuccccauc

SEQ ID NO: 2365204 - RNA, 18 nt, Bordetella pertussis
cuaucuuucgggcgcggg

SEQ ID NO: 2365205 - RNA, 13 nt, Bordetella pertussis
cuaugaagacgcg

SEQ ID NO: 2365206 - RNA, 21 nt, Bordetella pertussis
cuaugaagacgcgcucgccgu

SEQ ID NO: 2365207 - RNA, 18 nt, Bordetella pertussis
cuaugcagcugcgccagc

SEQ ID NO: 2365208 - RNA, 22 nt, Bordetella pertussis
cuaugcgguguugcucgugcug

SEQ ID NO: 2365209 - RNA, 23 nt, Bordetella pertussis
cuaugcgguguugcucgugcugg

SEQ ID NO: 2365210 - RNA, 16 nt, Bordetella pertussis
cuaugcuuuacccuga

SEQ ID NO: 2365211 - RNA, 14 nt, Bordetella pertussis
cuauggccuggaug

SEQ ID NO: 2365212 - RNA, 14 nt, Bordetella pertussis
cuauguaggcgccg

SEQ ID NO: 2365213 - RNA, 23 nt, Bordetella pertussis
cuaugugcaggccaccgacggcg

SEQ ID NO: 2365214 - RNA, 22 nt, Bordetella pertussis
cuauguggcguucgcggugggc

SEQ ID NO: 2365215 - RNA, 20 nt, Bordetella pertussis
cuauucggccaacggcuggc

SEQ ID NO: 2365216 - RNA, 14 nt, Bordetella pertussis
cuauugcgacgccg

SEQ ID NO: 2365217 - RNA, 11 nt, Bordetella pertussis
cuauuuccagg

SEQ ID NO: 2365218 - RNA, 23 nt, Bordetella pertussis
cuauuuccagggcgucgcggcgu

SEQ ID NO: 2365219 - RNA, 15 nt, Bordetella pertussis
cucaacccgccggcc

SEQ ID NO: 2365220 - RNA, 21 nt, Bordetella pertussis
cucaaccgcgcguaucggcgc

SEQ ID NO: 2365221 - RNA, 16 nt, Bordetella pertussis
cucaaccucgacgcgc

SEQ ID NO: 2365222 - RNA, 23 nt, Bordetella pertussis
cucaacgaagaacagccgcugca

SEQ ID NO: 2365223 - RNA, 15 nt, Bordetella pertussis
cucaauucggccuga

SEQ ID NO: 2365224 - RNA, 21 nt, Bordetella pertussis
cucacagggucaaggcgcggc

SEQ ID NO: 2365225 - RNA, 20 nt, Bordetella pertussis
cuccaggcgcaagccuggag

SEQ ID NO: 2365226 - RNA, 18 nt, Bordetella pertussis
cuccaggcggcggugcca

SEQ ID NO: 2365227 - RNA, 17 nt, Bordetella pertussis
cuccaggcucaggcggc

SEQ ID NO: 2365228 - RNA, 19 nt, Bordetella pertussis
cuccaggcucaggcggcca

SEQ ID NO: 2365229 - RNA, 16 nt, Bordetella pertussis
cuccagucccgcaccg

SEQ ID NO: 2365230 - RNA, 21 nt, Bordetella pertussis
cuccagucccgcaccgggcaa

SEQ ID NO: 2365231 - RNA, 17 nt, Bordetella pertussis
cuccauagcgccgcucg

SEQ ID NO: 2365232 - RNA, 23 nt, Bordetella pertussis
cuccaucuguucggcgccgggcg

SEQ ID NO: 2365233 - RNA, 19 nt, Bordetella pertussis
cuccaugcgauagcgggcc

SEQ ID NO: 2365234 - RNA, 15 nt, Bordetella pertussis
cuccaugcggcggcg

SEQ ID NO: 2365235 - RNA, 13 nt, Bordetella pertussis
cuccauggcgccg

SEQ ID NO: 2365236 - RNA, 19 nt, Bordetella pertussis
cuccauggcgccggcggcc

SEQ ID NO: 2365237 - RNA, 15 nt, Bordetella pertussis
cucccacgaacgcca

SEQ ID NO: 2365238 - RNA, 18 nt, Bordetella pertussis
cucccacgaccugcaacc

SEQ ID NO: 2365239 - RNA, 17 nt, Bordetella pertussis
cucccagaaacuggcgc

SEQ ID NO: 2365240 - RNA, 18 nt, Bordetella pertussis
cucccagaaacuggcgcu

SEQ ID NO: 2365241 - RNA, 18 nt, Bordetella pertussis
cucccagaccugcgcgcc

SEQ ID NO: 2365242 - RNA, 19 nt, Bordetella pertussis
cucccauugcgcggccagg

SEQ ID NO: 2365243 - RNA, 12 nt, Bordetella pertussis
cuccccaggcca

SEQ ID NO: 2365244 - RNA, 20 nt, Bordetella pertussis
cuccccgugcggggaccggc

SEQ ID NO: 2365245 - RNA, 14 nt, Bordetella pertussis
cucccgaaaaccgc

SEQ ID NO: 2365246 - RNA, 14 nt, Bordetella pertussis
cucccgauauauga

SEQ ID NO: 2365247 - RNA, 17 nt, Bordetella pertussis
cucccgcaggcccacaa

SEQ ID NO: 2365248 - RNA, 21 nt, Bordetella pertussis
cucccgcaggcccacaaugcc

SEQ ID NO: 2365249 - RNA, 14 nt, Bordetella pertussis
cucccgccgcccgg

SEQ ID NO: 2365250 - RNA, 14 nt, Bordetella pertussis
cucccgcuggcggc

SEQ ID NO: 2365251 - RNA, 23 nt, Bordetella pertussis
cucccggaccagcaguugcgcca

SEQ ID NO: 2365252 - RNA, 21 nt, Bordetella pertussis
cucccugugggggacaggcac

SEQ ID NO: 2365253 - RNA, 15 nt, Bordetella pertussis
cuccgaacaggcggu

SEQ ID NO: 2365254 - RNA, 14 nt, Bordetella pertussis
cuccgaagggcugc

SEQ ID NO: 2365255 - RNA, 14 nt, Bordetella pertussis
cuccgacaggcgcc

SEQ ID NO: 2365256 - RNA, 21 nt, Bordetella pertussis
cuccgagacguagggcacauc

SEQ ID NO: 2365257 - RNA, 17 nt, Bordetella pertussis
cuccgauagcggcgccg

SEQ ID NO: 2365258 - RNA, 21 nt, Bordetella pertussis
cuccgauagcggcgccgcuuc

SEQ ID NO: 2365259 - RNA, 18 nt, Bordetella pertussis
cuccgccauggaggcgca

SEQ ID NO: 2365260 - RNA, 19 nt, Bordetella pertussis
cuccgcgcacagcgcggcg

SEQ ID NO: 2365261 - RNA, 16 nt, Bordetella pertussis
cuccgcguugcgcugc

SEQ ID NO: 2365262 - RNA, 17 nt, Bordetella pertussis
cuccgcguugcgcugcc

SEQ ID NO: 2365263 - RNA, 20 nt, Bordetella pertussis
cuccgcuaucauccgcgcau

SEQ ID NO: 2365264 - RNA, 14 nt, Bordetella pertussis
cuccggcaacagca

SEQ ID NO: 2365265 - RNA, 16 nt, Bordetella pertussis
cuccggccgggccagc

SEQ ID NO: 2365266 - RNA, 18 nt, Bordetella pertussis
cuccggccgggccagcgc

SEQ ID NO: 2365267 - RNA, 20 nt, Bordetella pertussis
cuccggccgggccagcgcga

SEQ ID NO: 2365268 - RNA, 14 nt, Bordetella pertussis
cuccggcgccagca

SEQ ID NO: 2365269 - RNA, 13 nt, Bordetella pertussis
cuccggcgccgcc

SEQ ID NO: 2365270 - RNA, 15 nt, Bordetella pertussis
cuccggcgccgccuc

SEQ ID NO: 2365271 - RNA, 17 nt, Bordetella pertussis
cuccggcggcagcgcga

SEQ ID NO: 2365272 - RNA, 19 nt, Bordetella pertussis
cuccggcgugacguggccc

SEQ ID NO: 2365273 - RNA, 17 nt, Bordetella pertussis
cuccggcgugauggacg

SEQ ID NO: 2365274 - RNA, 14 nt, Bordetella pertussis
cuccggcugcgcgc

SEQ ID NO: 2365275 - RNA, 16 nt, Bordetella pertussis
cuccggcugcgcgcgc

SEQ ID NO: 2365276 - RNA, 14 nt, Bordetella pertussis
cuccggcuugccga

SEQ ID NO: 2365277 - RNA, 15 nt, Bordetella pertussis
cuccgggagccuguc

SEQ ID NO: 2365278 - RNA, 19 nt, Bordetella pertussis
cuccgggagccuguccccg

SEQ ID NO: 2365279 - RNA, 14 nt, Bordetella pertussis
cuccgggucgagcg

SEQ ID NO: 2365280 - RNA, 12 nt, Bordetella pertussis
cuccgggucgcg

SEQ ID NO: 2365281 - RNA, 17 nt, Bordetella pertussis
cuccgggucgcggcacg

SEQ ID NO: 2365282 - RNA, 16 nt, Bordetella pertussis
cuccggugccuggcuc

SEQ ID NO: 2365283 - RNA, 12 nt, Bordetella pertussis
cuccgguucggc

SEQ ID NO: 2365284 - RNA, 18 nt, Bordetella pertussis
cuccgguucggcgcggcg

SEQ ID NO: 2365285 - RNA, 19 nt, Bordetella pertussis
cuccgguucggcgcggcgc

SEQ ID NO: 2365286 - RNA, 20 nt, Bordetella pertussis
cuccguaaagaugcgcgccg

SEQ ID NO: 2365287 - RNA, 14 nt, Bordetella pertussis
cuccgucauggcgc

SEQ ID NO: 2365288 - RNA, 19 nt, Bordetella pertussis
cuccgucauggcgccguga

SEQ ID NO: 2365289 - RNA, 14 nt, Bordetella pertussis
cuccgugcaucggc

SEQ ID NO: 2365290 - RNA, 15 nt, Bordetella pertussis
cuccgugcaucggca

SEQ ID NO: 2365291 - RNA, 19 nt, Bordetella pertussis
cuccuccccaacggggacg

SEQ ID NO: 2365292 - RNA, 14 nt, Bordetella pertussis
cuccuccgcggggg

SEQ ID NO: 2365293 - RNA, 20 nt, Bordetella pertussis
cuccucgaccugggucggaa

SEQ ID NO: 2365294 - RNA, 17 nt, Bordetella pertussis
cuccucgacgucgccca

SEQ ID NO: 2365295 - RNA, 14 nt, Bordetella pertussis
cuccucgcccgacc

SEQ ID NO: 2365296 - RNA, 23 nt, Bordetella pertussis
cuccucgcccgaccugcuggcgc

SEQ ID NO: 2365297 - RNA, 13 nt, Bordetella pertussis
cuccucgcgcgcg

SEQ ID NO: 2365298 - RNA, 23 nt, Bordetella pertussis
cuccucggccaggucgcgcauca

SEQ ID NO: 2365299 - RNA, 16 nt, Bordetella pertussis
cuccugcaacuggugc

SEQ ID NO: 2365300 - RNA, 13 nt, Bordetella pertussis
cuccugcagcacg

SEQ ID NO: 2365301 - RNA, 20 nt, Bordetella pertussis
cuccugcagcacgcuggccu

SEQ ID NO: 2365302 - RNA, 11 nt, Bordetella pertussis
cuccugccagg

SEQ ID NO: 2365303 - RNA, 19 nt, Bordetella pertussis
cuccugcguccagccgagc

SEQ ID NO: 2365304 - RNA, 14 nt, Bordetella pertussis
cuccugcucggcga

SEQ ID NO: 2365305 - RNA, 15 nt, Bordetella pertussis
cuccugcuggcgcgu

SEQ ID NO: 2365306 - RNA, 17 nt, Bordetella pertussis
cuccugcuggcgcgucg

SEQ ID NO: 2365307 - RNA, 23 nt, Bordetella pertussis
cuccugcuggcgcgucggcgcgc

SEQ ID NO: 2365308 - RNA, 20 nt, Bordetella pertussis
cuccuggacgaugcgcgaag

SEQ ID NO: 2365309 - RNA, 18 nt, Bordetella pertussis
cuccugguugaccgagcc

SEQ ID NO: 2365310 - RNA, 18 nt, Bordetella pertussis
cuccugugggggcgcggc

SEQ ID NO: 2365311 - RNA, 12 nt, Bordetella pertussis
cuccuugaccag

SEQ ID NO: 2365312 - RNA, 20 nt, Bordetella pertussis
cuccuugagcacguccagcg

SEQ ID NO: 2365313 - RNA, 15 nt, Bordetella pertussis
cucgaaacgcuggac

SEQ ID NO: 2365314 - RNA, 22 nt, Bordetella pertussis
cucgaacaccggcuuggccucg

SEQ ID NO: 2365315 - RNA, 15 nt, Bordetella pertussis
cucgaacacgccgac

SEQ ID NO: 2365316 - RNA, 16 nt, Bordetella pertussis
cucgaacaggccaucg

SEQ ID NO: 2365317 - RNA, 23 nt, Bordetella pertussis
cucgaacaggccaucgccgccgc

SEQ ID NO: 2365318 - RNA, 16 nt, Bordetella pertussis
cucgaacgccgcgucg

SEQ ID NO: 2365319 - RNA, 20 nt, Bordetella pertussis
cucgaagaccucggcgcuca

SEQ ID NO: 2365320 - RNA, 17 nt, Bordetella pertussis
cucgaaguacagcuuga

SEQ ID NO: 2365321 - RNA, 19 nt, Bordetella pertussis
cucgaauggcugcgcgccg

SEQ ID NO: 2365322 - RNA, 14 nt, Bordetella pertussis
cucgacagcagccc

SEQ ID NO: 2365323 - RNA, 23 nt, Bordetella pertussis
cucgacagcagcccgcuggccga

SEQ ID NO: 2365324 - RNA, 12 nt, Bordetella pertussis
cucgaccagccc

SEQ ID NO: 2365325 - RNA, 20 nt, Bordetella pertussis
cucgaccagcccggccgcca

SEQ ID NO: 2365326 - RNA, 12 nt, Bordetella pertussis
cucgaccagcgc

SEQ ID NO: 2365327 - RNA, 14 nt, Bordetella pertussis
cucgaccagcgcgc

SEQ ID NO: 2365328 - RNA, 16 nt, Bordetella pertussis
cucgaccagcgcgcgg

SEQ ID NO: 2365329 - RNA, 14 nt, Bordetella pertussis
cucgaccaggaugu

SEQ ID NO: 2365330 - RNA, 16 nt, Bordetella pertussis
cucgaccaggcgggca

SEQ ID NO: 2365331 - RNA, 22 nt, Bordetella pertussis
cucgaccaggcgggcaucgccc

SEQ ID NO: 2365332 - RNA, 13 nt, Bordetella pertussis
cucgaccaggucc

SEQ ID NO: 2365333 - RNA, 20 nt, Bordetella pertussis
cucgaccaucauggccaggg

SEQ ID NO: 2365334 - RNA, 23 nt, Bordetella pertussis
cucgaccaucauggccagggccg

SEQ ID NO: 2365335 - RNA, 20 nt, Bordetella pertussis
cucgacccgcucggccacgc

SEQ ID NO: 2365336 - RNA, 12 nt, Bordetella pertussis
cucgaccgccgc

SEQ ID NO: 2365337 - RNA, 20 nt, Bordetella pertussis
cucgaccgcuucggucagcu

SEQ ID NO: 2365338 - RNA, 19 nt, Bordetella pertussis
cucgacgaacacgcgcgcc

SEQ ID NO: 2365339 - RNA, 13 nt, Bordetella pertussis
cucgcgccaggcc

SEQ ID NO: 2365340 - RNA, 15 nt, Bordetella pertussis
cucgcgccagggccc

SEQ ID NO: 2365341 - RNA, 18 nt, Bordetella pertussis
cucgcgccagggccccuc

SEQ ID NO: 2365342 - RNA, 20 nt, Bordetella pertussis
cucgcgcccaucucggccgc

SEQ ID NO: 2365343 - RNA, 14 nt, Bordetella pertussis
cucgcgcgaccacu

SEQ ID NO: 2365344 - RNA, 20 nt, Bordetella pertussis
cucgcgcgauguucaggccg

SEQ ID NO: 2365345 - RNA, 17 nt, Bordetella pertussis
cucgcgcgcaguccugc

SEQ ID NO: 2365346 - RNA, 15 nt, Bordetella pertussis
cucgcgcgccagcag

SEQ ID NO: 2365347 - RNA, 16 nt, Bordetella pertussis
cucgcgcgccagcagu

SEQ ID NO: 2365348 - RNA, 21 nt, Bordetella pertussis
cucgcgcgcgaugcgcaggcu

SEQ ID NO: 2365349 - RNA, 22 nt, Bordetella pertussis
cucgcgcgcggacugccagauc

SEQ ID NO: 2365350 - RNA, 13 nt, Bordetella pertussis
cucgcgcgggucc

SEQ ID NO: 2365351 - RNA, 17 nt, Bordetella pertussis
cucgcgcggguccuugc

SEQ ID NO: 2365352 - RNA, 18 nt, Bordetella pertussis
cucgcgcggguccuugcc

SEQ ID NO: 2365353 - RNA, 13 nt, Bordetella pertussis
cucgcgcuccagc

SEQ ID NO: 2365354 - RNA, 14 nt, Bordetella pertussis
cucgcgcuccagca

SEQ ID NO: 2365355 - RNA, 16 nt, Bordetella pertussis
cucgcgcuccagcaug

SEQ ID NO: 2365356 - RNA, 15 nt, Bordetella pertussis
cucgcgcucgcccgg

SEQ ID NO: 2365357 - RNA, 12 nt, Bordetella pertussis
cucgcgcucgcg

SEQ ID NO: 2365358 - RNA, 13 nt, Bordetella pertussis
cucgcgcucgcgc

SEQ ID NO: 2365359 - RNA, 14 nt, Bordetella pertussis
cucgcgcucggcca

SEQ ID NO: 2365360 - RNA, 17 nt, Bordetella pertussis
cucgcgcucggccagca

SEQ ID NO: 2365361 - RNA, 17 nt, Bordetella pertussis
cucgcgcucggccagcg

SEQ ID NO: 2365362 - RNA, 13 nt, Bordetella pertussis
cucgcgcucggcg

SEQ ID NO: 2365363 - RNA, 14 nt, Bordetella pertussis
cucgcgcucggcga

SEQ ID NO: 2365364 - RNA, 14 nt, Bordetella pertussis
cucgcgcugcagca

SEQ ID NO: 2365365 - RNA, 16 nt, Bordetella pertussis
cucgcgcugcagcaug

SEQ ID NO: 2365366 - RNA, 17 nt, Bordetella pertussis
cucgcgcugcagcauga

SEQ ID NO: 2365367 - RNA, 16 nt, Bordetella pertussis
cucgcgcuugcugauu

SEQ ID NO: 2365368 - RNA, 20 nt, Bordetella pertussis
cucgcgcuugcugauuucga

SEQ ID NO: 2365369 - RNA, 20 nt, Bordetella pertussis
cucgcggaaauccgggcgcu

SEQ ID NO: 2365370 - RNA, 23 nt, Bordetella pertussis
cucgcggcccuggucgucgcggc

SEQ ID NO: 2365371 - RNA, 13 nt, Bordetella pertussis
cucgcggccgucg

SEQ ID NO: 2365372 - RNA, 15 nt, Bordetella pertussis
cucgcggcgcagcau

SEQ ID NO: 2365373 - RNA, 20 nt, Bordetella pertussis
cucgcgggccuggcggaucu

SEQ ID NO: 2365374 - RNA, 14 nt, Bordetella pertussis
cucgcgggccuugg

SEQ ID NO: 2365375 - RNA, 17 nt, Bordetella pertussis
cucgcgggccuuggcca

SEQ ID NO: 2365376 - RNA, 16 nt, Bordetella pertussis
cucgcgggugcgcagc

SEQ ID NO: 2365377 - RNA, 21 nt, Bordetella pertussis
cucgcgguugcgucucggccu

SEQ ID NO: 2365378 - RNA, 19 nt, Bordetella pertussis
cucgcucaacagcuugccc

SEQ ID NO: 2365379 - RNA, 14 nt, Bordetella pertussis
cucgcuccagcgga

SEQ ID NO: 2365380 - RNA, 15 nt, Bordetella pertussis
cucgcugccggcgcc

SEQ ID NO: 2365381 - RNA, 14 nt, Bordetella pertussis
cucgcugccggcgu

SEQ ID NO: 2365382 - RNA, 22 nt, Bordetella pertussis
cucgcugccggcguccugcggc

SEQ ID NO: 2365383 - RNA, 15 nt, Bordetella pertussis
cucgcuugcccgugc

SEQ ID NO: 2365384 - RNA, 17 nt, Bordetella pertussis
cucgcuuuaccagcugu

SEQ ID NO: 2365385 - RNA, 20 nt, Bordetella pertussis
cucggaagacauggcgcgcg

SEQ ID NO: 2365386 - RNA, 20 nt, Bordetella pertussis
cucggacaggucggcgccca

SEQ ID NO: 2365387 - RNA, 23 nt, Bordetella pertussis
cucggacaggucggcgcccacgc

SEQ ID NO: 2365388 - RNA, 14 nt, Bordetella pertussis
cucggaccuggcca

SEQ ID NO: 2365389 - RNA, 19 nt, Bordetella pertussis
cucggacgagacaggcgcg

SEQ ID NO: 2365390 - RNA, 13 nt, Bordetella pertussis
cucggacgccugg

SEQ ID NO: 2365391 - RNA, 21 nt, Bordetella pertussis
cucggacgccuggcgcggccc

SEQ ID NO: 2365392 - RNA, 14 nt, Bordetella pertussis
cucggagcccagug

SEQ ID NO: 2365393 - RNA, 17 nt, Bordetella pertussis
cucggaggauacggcca

SEQ ID NO: 2365394 - RNA, 19 nt, Bordetella pertussis
cucggagggcuccaggcug

SEQ ID NO: 2365395 - RNA, 11 nt, Bordetella pertussis
cucggcaaacg

SEQ ID NO: 2365396 - RNA, 19 nt, Bordetella pertussis
cucggcaaacggcuggacg

SEQ ID NO: 2365397 - RNA, 14 nt, Bordetella pertussis
cucggcacggccag

SEQ ID NO: 2365398 - RNA, 15 nt, Bordetella pertussis
cucggcacggccagc

SEQ ID NO: 2365399 - RNA, 19 nt, Bordetella pertussis
cucggcauccagcucggcg

SEQ ID NO: 2365400 - RNA, 14 nt, Bordetella pertussis
cucggcaucggcca

SEQ ID NO: 2365401 - RNA, 16 nt, Bordetella pertussis
cucggcaucggccacg

SEQ ID NO: 2365402 - RNA, 22 nt, Bordetella pertussis
cucggcaucggccacgcugccc

SEQ ID NO: 2365403 - RNA, 16 nt, Bordetella pertussis
cucggcauggcgcgcg

SEQ ID NO: 2365404 - RNA, 17 nt, Bordetella pertussis
cucggccaccuggcgca

SEQ ID NO: 2365405 - RNA, 19 nt, Bordetella pertussis
cucggccaccuggucgucg

SEQ ID NO: 2365406 - RNA, 21 nt, Bordetella pertussis
cucggccacgcgcaacgccgc

SEQ ID NO: 2365407 - RNA, 16 nt, Bordetella pertussis
cucggccacgcgcugc

SEQ ID NO: 2365408 - RNA, 19 nt, Bordetella pertussis
cucggccacggucggcacg

SEQ ID NO: 2365409 - RNA, 17 nt, Bordetella pertussis
cucggccacgucggcgg

SEQ ID NO: 2365410 - RNA, 21 nt, Bordetella pertussis
cucggccacgucggcggccgc

SEQ ID NO: 2365411 - RNA, 14 nt, Bordetella pertussis
cucggccagcaugc

SEQ ID NO: 2365412 - RNA, 16 nt, Bordetella pertussis
cucggccagcgaggcc

SEQ ID NO: 2365413 - RNA, 12 nt, Bordetella pertussis
cucggccagcgc

SEQ ID NO: 2365414 - RNA, 14 nt, Bordetella pertussis
cucggccagcgccg

SEQ ID NO: 2365415 - RNA, 15 nt, Bordetella pertussis
cucggccagcgccga

SEQ ID NO: 2365416 - RNA, 16 nt, Bordetella pertussis
cucggccagcgccgaa

SEQ ID NO: 2365417 - RNA, 20 nt, Bordetella pertussis
cucggccagcgcgcggggca

SEQ ID NO: 2365418 - RNA, 13 nt, Bordetella pertussis
cucggccagcugg

SEQ ID NO: 2365419 - RNA, 23 nt, Bordetella pertussis
cucggccaggaaagccggcguca

SEQ ID NO: 2365420 - RNA, 18 nt, Bordetella pertussis
cucggccaggccauggcg

SEQ ID NO: 2365421 - RNA, 15 nt, Bordetella pertussis
cucggccaggucgcg

SEQ ID NO: 2365422 - RNA, 20 nt, Bordetella pertussis
cucggccaggugcgccaugc

SEQ ID NO: 2365423 - RNA, 23 nt, Bordetella pertussis
cucggccauguucuucaggcucc

SEQ ID NO: 2365424 - RNA, 17 nt, Bordetella pertussis
cucggcccauugcggca

SEQ ID NO: 2365425 - RNA, 20 nt, Bordetella pertussis
cucggcccuagagcaugcgg

SEQ ID NO: 2365426 - RNA, 17 nt, Bordetella pertussis
cucggccgcauggcggc

SEQ ID NO: 2365427 - RNA, 16 nt, Bordetella pertussis
cucggccucggucagg

SEQ ID NO: 2365428 - RNA, 19 nt, Bordetella pertussis
cucggccucggucagggug

SEQ ID NO: 2365429 - RNA, 20 nt, Bordetella pertussis
cucggccucggucagggugg

SEQ ID NO: 2365430 - RNA, 19 nt, Bordetella pertussis
cucggccucgguggucagg

SEQ ID NO: 2365431 - RNA, 13 nt, Bordetella pertussis
cucggccuggccc

SEQ ID NO: 2365432 - RNA, 14 nt, Bordetella pertussis
cucggccugggcgc

SEQ ID NO: 2365433 - RNA, 16 nt, Bordetella pertussis
cucggccugggcgcga

SEQ ID NO: 2365434 - RNA, 17 nt, Bordetella pertussis
cucggccuugggcgcgg

SEQ ID NO: 2365435 - RNA, 14 nt, Bordetella pertussis
cucggcgaagccgc

SEQ ID NO: 2365436 - RNA, 21 nt, Bordetella pertussis
cucggcgaagccgcagcggca

SEQ ID NO: 2365437 - RNA, 17 nt, Bordetella pertussis
cucggcgaccaggccca

SEQ ID NO: 2365438 - RNA, 16 nt, Bordetella pertussis
cucggcgaugcgccau

SEQ ID NO: 2365439 - RNA, 14 nt, Bordetella pertussis
cucggcgcccagcu

SEQ ID NO: 2365440 - RNA, 17 nt, Bordetella pertussis
cucggcgcccagcugcu

SEQ ID NO: 2365441 - RNA, 18 nt, Bordetella pertussis
cucggcgcccagcugcuu

SEQ ID NO: 2365442 - RNA, 17 nt, Bordetella pertussis
cucggcgcccgcggccu

SEQ ID NO: 2365443 - RNA, 13 nt, Bordetella pertussis
cucggcgccgcgg

SEQ ID NO: 2365444 - RNA, 14 nt, Bordetella pertussis
cucggcgccggcgg

SEQ ID NO: 2365445 - RNA, 15 nt, Bordetella pertussis
cucggcgccggcggc

SEQ ID NO: 2365446 - RNA, 16 nt, Bordetella pertussis
cucggcgcgcgcggcg

SEQ ID NO: 2365447 - RNA, 14 nt, Bordetella pertussis
cucggcggccagcg

SEQ ID NO: 2365448 - RNA, 15 nt, Bordetella pertussis
cucggcggccagcgc

SEQ ID NO: 2365449 - RNA, 16 nt, Bordetella pertussis
cucggcggccagcgcg

SEQ ID NO: 2365450 - RNA, 18 nt, Bordetella pertussis
cucggcggccagcgcgcc

SEQ ID NO: 2365451 - RNA, 20 nt, Bordetella pertussis
cucggcggccagcgcgcccu

SEQ ID NO: 2365452 - RNA, 14 nt, Bordetella pertussis
cucggcggccgccu

SEQ ID NO: 2365453 - RNA, 17 nt, Bordetella pertussis
cucuucgacagcgcgca

SEQ ID NO: 2365454 - RNA, 19 nt, Bordetella pertussis
cucuucgagcgcggcgcgc

SEQ ID NO: 2365455 - RNA, 15 nt, Bordetella pertussis
cucuucgccggacag

SEQ ID NO: 2365456 - RNA, 13 nt, Bordetella pertussis
cucuucggcggcc

SEQ ID NO: 2365457 - RNA, 15 nt, Bordetella pertussis
cucuucgucgccggc

SEQ ID NO: 2365458 - RNA, 17 nt, Bordetella pertussis
cucuucgucgccggcgc

SEQ ID NO: 2365459 - RNA, 18 nt, Bordetella pertussis
cucuucgucgccggcgcu

SEQ ID NO: 2365460 - RNA, 22 nt, Bordetella pertussis
cucuugaacgccuugcccgggc

SEQ ID NO: 2365461 - RNA, 17 nt, Bordetella pertussis
cucuugaccagcuuguc

SEQ ID NO: 2365462 - RNA, 21 nt, Bordetella pertussis
cucuugguggugccugcuugc

SEQ ID NO: 2365463 - RNA, 13 nt, Bordetella pertussis
cucuuuccccucc

SEQ ID NO: 2365464 - RNA, 15 nt, Bordetella pertussis
cugaaaccgcaggca

SEQ ID NO: 2365465 - RNA, 18 nt, Bordetella pertussis
cugaaaccucgaugaacg

SEQ ID NO: 2365466 - RNA, 17 nt, Bordetella pertussis
cugaacaagggccgacu

SEQ ID NO: 2365467 - RNA, 20 nt, Bordetella pertussis
cugaacaccggcgcgccugg

SEQ ID NO: 2365468 - RNA, 22 nt, Bordetella pertussis
cugaacaccggcgcgccuggcg

SEQ ID NO: 2365469 - RNA, 16 nt, Bordetella pertussis
cugaacgaauaaucgc

SEQ ID NO: 2365470 - RNA, 15 nt, Bordetella pertussis
cugaacgacgguaca

SEQ ID NO: 2365471 - RNA, 19 nt, Bordetella pertussis
cugaacgccgcgcugccug

SEQ ID NO: 2365472 - RNA, 21 nt, Bordetella pertussis
cugaacgccgcgcugccugaa

SEQ ID NO: 2365473 - RNA, 16 nt, Bordetella pertussis
cugaacgccgggccgu

SEQ ID NO: 2365474 - RNA, 15 nt, Bordetella pertussis
cugaacgcguccagg

SEQ ID NO: 2365475 - RNA, 14 nt, Bordetella pertussis
cugaacguggcguc

SEQ ID NO: 2365476 - RNA, 22 nt, Bordetella pertussis
cugaacguguaggucagcgccu

SEQ ID NO: 2365477 - RNA, 19 nt, Bordetella pertussis
cugaaggaccucgcgccgg

SEQ ID NO: 2365478 - RNA, 13 nt, Bordetella pertussis
cugaagguggcgu

SEQ ID NO: 2365479 - RNA, 18 nt, Bordetella pertussis
cugaaguaguacucgccg

SEQ ID NO: 2365480 - RNA, 19 nt, Bordetella pertussis
cugaaguaguacucgccgu

SEQ ID NO: 2365481 - RNA, 23 nt, Bordetella pertussis
cugaauccggggugccuguccuc

SEQ ID NO: 2365482 - RNA, 14 nt, Bordetella pertussis
cugaaugccgccgu

SEQ ID NO: 2365483 - RNA, 22 nt, Bordetella pertussis
cugaaugccgccgugaugccgc

SEQ ID NO: 2365484 - RNA, 20 nt, Bordetella pertussis
cugacaccguuuuggcaggc

SEQ ID NO: 2365485 - RNA, 21 nt, Bordetella pertussis
cugaccagcagcaccgugccg

SEQ ID NO: 2365486 - RNA, 19 nt, Bordetella pertussis
cugaccagcgcgucgcacu

SEQ ID NO: 2365487 - RNA, 15 nt, Bordetella pertussis
cugacccgcuggcug

SEQ ID NO: 2365488 - RNA, 19 nt, Bordetella pertussis
cugacccgcuggcuggcag

SEQ ID NO: 2365489 - RNA, 12 nt, Bordetella pertussis
cugacccuggcc

SEQ ID NO: 2365490 - RNA, 14 nt, Bordetella pertussis
cugaccgacggccu

SEQ ID NO: 2365491 - RNA, 18 nt, Bordetella pertussis
cugaccgacggccuggag

SEQ ID NO: 2365492 - RNA, 20 nt, Bordetella pertussis
cugaccgacggccuggaggc

SEQ ID NO: 2365493 - RNA, 15 nt, Bordetella pertussis
cugaccgacgugcgc

SEQ ID NO: 2365494 - RNA, 17 nt, Bordetella pertussis
cugaccgacgugcgccg

SEQ ID NO: 2365495 - RNA, 15 nt, Bordetella pertussis
cugaccggccugguc

SEQ ID NO: 2365496 - RNA, 15 nt, Bordetella pertussis
cugaccggcggcgcu

SEQ ID NO: 2365497 - RNA, 15 nt, Bordetella pertussis
cugaccggcggcguc

SEQ ID NO: 2365498 - RNA, 16 nt, Bordetella pertussis
cugaccggcggcgucu

SEQ ID NO: 2365499 - RNA, 21 nt, Bordetella pertussis
cugaccggcggcgucugguac

SEQ ID NO: 2365500 - RNA, 13 nt, Bordetella pertussis
cugaccggcuucc

SEQ ID NO: 2365501 - RNA, 20 nt, Bordetella pertussis
cugaccggcuucccguggcu

SEQ ID NO: 2365502 - RNA, 17 nt, Bordetella pertussis
cugaccguccauggcgu

SEQ ID NO: 2365503 - RNA, 15 nt, Bordetella pertussis
cugaccgugcauccc

SEQ ID NO: 2365504 - RNA, 15 nt, Bordetella pertussis
cugaccuauucgucg

SEQ ID NO: 2365505 - RNA, 21 nt, Bordetella pertussis
cugaccucgcccaggccgggc

SEQ ID NO: 2365506 - RNA, 19 nt, Bordetella pertussis
cugaccugcacgauggcgc

SEQ ID NO: 2365507 - RNA, 21 nt, Bordetella pertussis
cugaccuggugugccuguccc

SEQ ID NO: 2365508 - RNA, 16 nt, Bordetella pertussis
cugacgaaacgcgcgu

SEQ ID NO: 2365509 - RNA, 20 nt, Bordetella pertussis
cugacgaaacgcgcguccuu

SEQ ID NO: 2365510 - RNA, 23 nt, Bordetella pertussis
cugacgaaacgcgcguccuuggc

SEQ ID NO: 2365511 - RNA, 18 nt, Bordetella pertussis
cugacgauguucaggcca

SEQ ID NO: 2365512 - RNA, 13 nt, Bordetella pertussis
cugacgccugcgc

SEQ ID NO: 2365513 - RNA, 16 nt, Bordetella pertussis
cugacgcgcaagcggc

SEQ ID NO: 2365514 - RNA, 21 nt, Bordetella pertussis
cugacggccccguugucgccg

SEQ ID NO: 2365515 - RNA, 13 nt, Bordetella pertussis
cugacggcuacac

SEQ ID NO: 2365516 - RNA, 19 nt, Bordetella pertussis
cugacggcuacacccugcu

SEQ ID NO: 2365517 - RNA, 13 nt, Bordetella pertussis
cugacgggccucg

SEQ ID NO: 2365518 - RNA, 14 nt, Bordetella pertussis
cugacgggccucga

SEQ ID NO: 2365519 - RNA, 19 nt, Bordetella pertussis
cugacgggucacccgccgc

SEQ ID NO: 2365520 - RNA, 23 nt, Bordetella pertussis
cugacgggucacccgccgcacca

SEQ ID NO: 2365521 - RNA, 17 nt, Bordetella pertussis
cugacgguaagcaccag

SEQ ID NO: 2365522 - RNA, 17 nt, Bordetella pertussis
cugacgugcgccacagc

SEQ ID NO: 2365523 - RNA, 20 nt, Bordetella pertussis
cugacgugcgccacagcaug

SEQ ID NO: 2365524 - RNA, 21 nt, Bordetella pertussis
cugacguucggggcgucgcug

SEQ ID NO: 2365525 - RNA, 22 nt, Bordetella pertussis
cugacguucggggcgucgcugc

SEQ ID NO: 2365526 - RNA, 15 nt, Bordetella pertussis
cugacugcggugccu

SEQ ID NO: 2365527 - RNA, 14 nt, Bordetella pertussis
cugacugugcagcc

SEQ ID NO: 2365528 - RNA, 22 nt, Bordetella pertussis
cugacugugcagccacgccugg

SEQ ID NO: 2365529 - RNA, 14 nt, Bordetella pertussis
cugacuucgccguc

SEQ ID NO: 2365530 - RNA, 20 nt, Bordetella pertussis
cugagaucguccagcgacuc

SEQ ID NO: 2365531 - RNA, 18 nt, Bordetella pertussis
cugagcacaugcccggcc

SEQ ID NO: 2365532 - RNA, 22 nt, Bordetella pertussis
cugagcacaugcccggccacca

SEQ ID NO: 2365533 - RNA, 13 nt, Bordetella pertussis
cugagcaccagca

SEQ ID NO: 2365534 - RNA, 20 nt, Bordetella pertussis
cugagccaggcgcccggcgu

SEQ ID NO: 2365535 - RNA, 18 nt, Bordetella pertussis
cugagccauuccggcugg

SEQ ID NO: 2365536 - RNA, 18 nt, Bordetella pertussis
cugagccgauacaggcgc

SEQ ID NO: 2365537 - RNA, 19 nt, Bordetella pertussis
cugagccgauacaggcgcu

SEQ ID NO: 2365538 - RNA, 16 nt, Bordetella pertussis
cugagcgacaugucgc

SEQ ID NO: 2365539 - RNA, 20 nt, Bordetella pertussis
cugagcgacaugucgccgcg

SEQ ID NO: 2365540 - RNA, 21 nt, Bordetella pertussis
cugagcgacaugucgccgcgg

SEQ ID NO: 2365541 - RNA, 14 nt, Bordetella pertussis
cugagcgccggggu

SEQ ID NO: 2365542 - RNA, 16 nt, Bordetella pertussis
cugagcgugacguagc

SEQ ID NO: 2365543 - RNA, 18 nt, Bordetella pertussis
cugaggcuuucgaagcgc

SEQ ID NO: 2365544 - RNA, 20 nt, Bordetella pertussis
cugaggcuuucgaagcgcuc

SEQ ID NO: 2365545 - RNA, 21 nt, Bordetella pertussis
cugaucaaucugaucaucuuc

SEQ ID NO: 2365546 - RNA, 22 nt, Bordetella pertussis
cugauccgcaccggcgugcgcu

SEQ ID NO: 2365547 - RNA, 17 nt, Bordetella pertussis
cugauccucgccagcgg

SEQ ID NO: 2365548 - RNA, 18 nt, Bordetella pertussis
cugauccucgccagcggc

SEQ ID NO: 2365549 - RNA, 19 nt, Bordetella pertussis
cugaucgacaugcuggccc

SEQ ID NO: 2365550 - RNA, 21 nt, Bordetella pertussis
cugaucgacaugcuggcccag

SEQ ID NO: 2365551 - RNA, 24 nt, Bordetella pertussis
cugaucgaggagcugcugugcgcc

SEQ ID NO: 2365552 - RNA, 14 nt, Bordetella pertussis
cugaucgcgcagcg

SEQ ID NO: 2365553 - RNA, 16 nt, Bordetella pertussis
cugaucgcgcagcgcc

SEQ ID NO: 2365554 - RNA, 14 nt, Bordetella pertussis
cugaucggccgacu

SEQ ID NO: 2365555 - RNA, 13 nt, Bordetella pertussis
cugaucggggcca

SEQ ID NO: 2365556 - RNA, 22 nt, Bordetella pertussis
cugaucucgcgcaccgacacca

SEQ ID NO: 2365557 - RNA, 15 nt, Bordetella pertussis
cugaucuuccugggc

SEQ ID NO: 2365558 - RNA, 17 nt, Bordetella pertussis
cugaucuugugcaucuc

SEQ ID NO: 2365559 - RNA, 17 nt, Bordetella pertussis
cugaucuuucagcgcga

SEQ ID NO: 2365560 - RNA, 17 nt, Bordetella pertussis
cugaugagaucgcccgc

SEQ ID NO: 2365561 - RNA, 14 nt, Bordetella pertussis
cugaugcaggccug

SEQ ID NO: 2365562 - RNA, 15 nt, Bordetella pertussis
cugaugcaggccugc

SEQ ID NO: 2365563 - RNA, 18 nt, Bordetella pertussis
cugaugcccagcccggcu

SEQ ID NO: 2365564 - RNA, 18 nt, Bordetella pertussis
cugaugcccuucggcaug

SEQ ID NO: 2365565 - RNA, 19 nt, Bordetella pertussis
cugaugccgaccgaagagg

SEQ ID NO: 2365566 - RNA, 19 nt, Bordetella pertussis
cugcaggaucgcggccagc

SEQ ID NO: 2365567 - RNA, 20 nt, Bordetella pertussis
cugcaggaucgcggccagcg

SEQ ID NO: 2365568 - RNA, 17 nt, Bordetella pertussis
cugcaggaugaggcgcc

SEQ ID NO: 2365569 - RNA, 17 nt, Bordetella pertussis
cugcaggaugggccguc

SEQ ID NO: 2365570 - RNA, 13 nt, Bordetella pertussis
cugcaggccaucg

SEQ ID NO: 2365571 - RNA, 19 nt, Bordetella pertussis
cugcaggcccagcacgcgc

SEQ ID NO: 2365572 - RNA, 22 nt, Bordetella pertussis
cugcaggcccagcacgcgcgcc

SEQ ID NO: 2365573 - RNA, 23 nt, Bordetella pertussis
cugcaggcccagcacgcgcgcca

SEQ ID NO: 2365574 - RNA, 14 nt, Bordetella pertussis
cugcaggcccggcg

SEQ ID NO: 2365575 - RNA, 16 nt, Bordetella pertussis
cugcaggcccggcgcg

SEQ ID NO: 2365576 - RNA, 17 nt, Bordetella pertussis
cugcaggcccggcgcga

SEQ ID NO: 2365577 - RNA, 12 nt, Bordetella pertussis
cugcaggccgaa

SEQ ID NO: 2365578 - RNA, 12 nt, Bordetella pertussis
cugcaggccggc

SEQ ID NO: 2365579 - RNA, 16 nt, Bordetella pertussis
cugcaggccgggcagu

SEQ ID NO: 2365580 - RNA, 16 nt, Bordetella pertussis
cugcaggcgcugcgca

SEQ ID NO: 2365581 - RNA, 17 nt, Bordetella pertussis
cugcaggcgcugcgcau

SEQ ID NO: 2365582 - RNA, 18 nt, Bordetella pertussis
cugcaggcgucccggaug

SEQ ID NO: 2365583 - RNA, 20 nt, Bordetella pertussis
cugcaggcucuggcugacga

SEQ ID NO: 2365584 - RNA, 16 nt, Bordetella pertussis
cugcaggcucuugacc

SEQ ID NO: 2365585 - RNA, 22 nt, Bordetella pertussis
cugcagggcaugggcccgggcg

SEQ ID NO: 2365586 - RNA, 23 nt, Bordetella pertussis
cugcagggcaugggcccgggcgc

SEQ ID NO: 2365587 - RNA, 16 nt, Bordetella pertussis
cugcagggccuggaag

SEQ ID NO: 2365588 - RNA, 17 nt, Bordetella pertussis
cugcagggccuggaagc

SEQ ID NO: 2365589 - RNA, 22 nt, Bordetella pertussis
cugcagggccuggaagcuggcc

SEQ ID NO: 2365590 - RNA, 13 nt, Bordetella pertussis
cugcagggcgucu

SEQ ID NO: 2365591 - RNA, 21 nt, Bordetella pertussis
cugcagggcgucugcucgccg

SEQ ID NO: 2365592 - RNA, 18 nt, Bordetella pertussis
cugcagggucagcccgcc

SEQ ID NO: 2365593 - RNA, 21 nt, Bordetella pertussis
cugcaggucuucgggcgugcg

SEQ ID NO: 2365594 - RNA, 20 nt, Bordetella pertussis
cugcaggugccgccggcgcg

SEQ ID NO: 2365595 - RNA, 22 nt, Bordetella pertussis
cugcaggugccgccggcgcggc

SEQ ID NO: 2365596 - RNA, 14 nt, Bordetella pertussis
cugcaggugccugu

SEQ ID NO: 2365597 - RNA, 21 nt, Bordetella pertussis
cugcaggugccugucccagcg

SEQ ID NO: 2365598 - RNA, 15 nt, Bordetella pertussis
cugcaguucggccgc

SEQ ID NO: 2365599 - RNA, 19 nt, Bordetella pertussis
cugcaguucggccgccagg

SEQ ID NO: 2365600 - RNA, 21 nt, Bordetella pertussis
cugcaguucggccgccagguc

SEQ ID NO: 2365601 - RNA, 22 nt, Bordetella pertussis
cugcaguuugaguacgacgccg

SEQ ID NO: 2365602 - RNA, 18 nt, Bordetella pertussis
cugcauacccauggccaa

SEQ ID NO: 2365603 - RNA, 14 nt, Bordetella pertussis
cugcauccggccca

SEQ ID NO: 2365604 - RNA, 18 nt, Bordetella pertussis
cugcauccggcccagcgc

SEQ ID NO: 2365605 - RNA, 19 nt, Bordetella pertussis
cugcauccggcccagcgcc

SEQ ID NO: 2365606 - RNA, 18 nt, Bordetella pertussis
cugcaucggcaugagcga

SEQ ID NO: 2365607 - RNA, 16 nt, Bordetella pertussis
cugcaugaccgccgcc

SEQ ID NO: 2365608 - RNA, 17 nt, Bordetella pertussis
cugcaugaccgccgcca

SEQ ID NO: 2365609 - RNA, 21 nt, Bordetella pertussis
cugcaugccauggacgagggc

SEQ ID NO: 2365610 - RNA, 19 nt, Bordetella pertussis
cugcaugccccaacggcgc

SEQ ID NO: 2365611 - RNA, 15 nt, Bordetella pertussis
cugcaugcgcgaacg

SEQ ID NO: 2365612 - RNA, 12 nt, Bordetella pertussis
cugcaugucgua

SEQ ID NO: 2365613 - RNA, 22 nt, Bordetella pertussis
cugccaaagacaaugccccgca

SEQ ID NO: 2365614 - RNA, 12 nt, Bordetella pertussis
cugccaagcgcc

SEQ ID NO: 2365615 - RNA, 18 nt, Bordetella pertussis
cugccaauagcgguggcg

SEQ ID NO: 2365616 - RNA, 21 nt, Bordetella pertussis
cugccacagcgugacggcggc

SEQ ID NO: 2365617 - RNA, 15 nt, Bordetella pertussis
cugccacaucacgcc

SEQ ID NO: 2365618 - RNA, 16 nt, Bordetella pertussis
cugccacaucgaaggc

SEQ ID NO: 2365619 - RNA, 15 nt, Bordetella pertussis
cugccaccagcgcgc

SEQ ID NO: 2365620 - RNA, 21 nt, Bordetella pertussis
cugccaccagcgcgccagcag

SEQ ID NO: 2365621 - RNA, 14 nt, Bordetella pertussis
cugccacuccuggu

SEQ ID NO: 2365622 - RNA, 14 nt, Bordetella pertussis
cugccagaacagcc

SEQ ID NO: 2365623 - RNA, 18 nt, Bordetella pertussis
cugccagaacagccgcga

SEQ ID NO: 2365624 - RNA, 20 nt, Bordetella pertussis
cugccagaacagccgcgagg

SEQ ID NO: 2365625 - RNA, 14 nt, Bordetella pertussis
cugccagacggcca

SEQ ID NO: 2365626 - RNA, 19 nt, Bordetella pertussis
cugccagacggccagcgcg

SEQ ID NO: 2365627 - RNA, 20 nt, Bordetella pertussis
cugccagacggccagcgcgc

SEQ ID NO: 2365628 - RNA, 22 nt, Bordetella pertussis
cugccagacggccagcgcgcgu

SEQ ID NO: 2365629 - RNA, 22 nt, Bordetella pertussis
cugccagccauguucgaccagg

SEQ ID NO: 2365630 - RNA, 23 nt, Bordetella pertussis
cugccagccauguucgaccagga

SEQ ID NO: 2365631 - RNA, 17 nt, Bordetella pertussis
cugccagcccaccagcg

SEQ ID NO: 2365632 - RNA, 20 nt, Bordetella pertussis
cugccagcccaccagcgcca

SEQ ID NO: 2365633 - RNA, 13 nt, Bordetella pertussis
cugccagccugcc

SEQ ID NO: 2365634 - RNA, 17 nt, Bordetella pertussis
cugccagccugccacau

SEQ ID NO: 2365635 - RNA, 13 nt, Bordetella pertussis
cugccaggcgagc

SEQ ID NO: 2365636 - RNA, 20 nt, Bordetella pertussis
cugccaggcgagcgccgcgc

SEQ ID NO: 2365637 - RNA, 15 nt, Bordetella pertussis
cugccaggcgcccca

SEQ ID NO: 2365638 - RNA, 15 nt, Bordetella pertussis
cugccaggcgccgcg

SEQ ID NO: 2365639 - RNA, 18 nt, Bordetella pertussis
cugccaggcgccgcgucc

SEQ ID NO: 2365640 - RNA, 20 nt, Bordetella pertussis
cugccaggcuaucguggcug

SEQ ID NO: 2365641 - RNA, 19 nt, Bordetella pertussis
cugccagggaaucacccga

SEQ ID NO: 2365642 - RNA, 19 nt, Bordetella pertussis
cugccagggugcaccaggu

SEQ ID NO: 2365643 - RNA, 15 nt, Bordetella pertussis
cugccaguaggcgcc

SEQ ID NO: 2365644 - RNA, 18 nt, Bordetella pertussis
cugccaguaggcgcccca

SEQ ID NO: 2365645 - RNA, 21 nt, Bordetella pertussis
cugccaguaggcgccccaggc

SEQ ID NO: 2365646 - RNA, 17 nt, Bordetella pertussis
cugccaguccauccagc

SEQ ID NO: 2365647 - RNA, 20 nt, Bordetella pertussis
cugccagugguccaucaggu

SEQ ID NO: 2365648 - RNA, 16 nt, Bordetella pertussis
cugccaguugaaccgc

SEQ ID NO: 2365649 - RNA, 19 nt, Bordetella pertussis
cugccaguuguaguggugu

SEQ ID NO: 2365650 - RNA, 16 nt, Bordetella pertussis
cugccauccggccgca

SEQ ID NO: 2365651 - RNA, 17 nt, Bordetella pertussis
cugccaugccgcgcgcc

SEQ ID NO: 2365652 - RNA, 14 nt, Bordetella pertussis
cugccauggccccg

SEQ ID NO: 2365653 - RNA, 15 nt, Bordetella pertussis
cugccauugcgcggc

SEQ ID NO: 2365654 - RNA, 23 nt, Bordetella pertussis
cugcccaccgccgcccgccaggc

SEQ ID NO: 2365655 - RNA, 16 nt, Bordetella pertussis
cugcccaccgccgugg

SEQ ID NO: 2365656 - RNA, 19 nt, Bordetella pertussis
cugcccaccuuccugcugg

SEQ ID NO: 2365657 - RNA, 24 nt, Bordetella pertussis
cugcccaccuugcgcgcgaacucc

SEQ ID NO: 2365658 - RNA, 13 nt, Bordetella pertussis
cugcccagccaca

SEQ ID NO: 2365659 - RNA, 14 nt, Bordetella pertussis
cugcccagccacac

SEQ ID NO: 2365660 - RNA, 19 nt, Bordetella pertussis
cugcccagccacaccaggu

SEQ ID NO: 2365661 - RNA, 17 nt, Bordetella pertussis
cugcccaggauggagag

SEQ ID NO: 2365662 - RNA, 18 nt, Bordetella pertussis
cugcccaggauggagagg

SEQ ID NO: 2365663 - RNA, 15 nt, Bordetella pertussis
cugcccaggccagcg

SEQ ID NO: 2365664 - RNA, 13 nt, Bordetella pertussis
cugcccauggccu

SEQ ID NO: 2365665 - RNA, 16 nt, Bordetella pertussis
cugcccauggccugca

SEQ ID NO: 2365666 - RNA, 20 nt, Bordetella pertussis
cugccccagcggcuggcgca

SEQ ID NO: 2365667 - RNA, 21 nt, Bordetella pertussis
cugccccagcggcuggcgcac

SEQ ID NO: 2365668 - RNA, 23 nt, Bordetella pertussis
cugccccagcggcuggcgcacga

SEQ ID NO: 2365669 - RNA, 19 nt, Bordetella pertussis
cugccccagcuugucggcc

SEQ ID NO: 2365670 - RNA, 13 nt, Bordetella pertussis
cugccccauccca

SEQ ID NO: 2365671 - RNA, 22 nt, Bordetella pertussis
cugccccaucccauccgcgcca

SEQ ID NO: 2365672 - RNA, 12 nt, Bordetella pertussis
cugccccauggc

SEQ ID NO: 2365673 - RNA, 15 nt, Bordetella pertussis
cugccccauggcaug

SEQ ID NO: 2365674 - RNA, 15 nt, Bordetella pertussis
cugccccauggccug

SEQ ID NO: 2365675 - RNA, 15 nt, Bordetella pertussis
cugccccgccugcgc

SEQ ID NO: 2365676 - RNA, 16 nt, Bordetella pertussis
cugccccgccugcgcc

SEQ ID NO: 2365677 - RNA, 17 nt, Bordetella pertussis
cugccccgccugcgcca

SEQ ID NO: 2365678 - RNA, 17 nt, Bordetella pertussis
cugccccggcagagaca

SEQ ID NO: 2365679 - RNA, 15 nt, Bordetella pertussis
cugccgucggcguug

SEQ ID NO: 2365680 - RNA, 18 nt, Bordetella pertussis
cugccgucgucguccagg

SEQ ID NO: 2365681 - RNA, 19 nt, Bordetella pertussis
cugccgucgucguccaggc

SEQ ID NO: 2365682 - RNA, 20 nt, Bordetella pertussis
cugccgugcagauggcggau

SEQ ID NO: 2365683 - RNA, 15 nt, Bordetella pertussis
cugccgugggacagg

SEQ ID NO: 2365684 - RNA, 23 nt, Bordetella pertussis
cugccgugggacaggcacccugc

SEQ ID NO: 2365685 - RNA, 19 nt, Bordetella pertussis
cugccgugggacaggcacu

SEQ ID NO: 2365686 - RNA, 17 nt, Bordetella pertussis
cugccguucgcgcugcc

SEQ ID NO: 2365687 - RNA, 19 nt, Bordetella pertussis
cugccguuuucgaucaggg

SEQ ID NO: 2365688 - RNA, 22 nt, Bordetella pertussis
cugccguuuucgaucagggcga

SEQ ID NO: 2365689 - RNA, 21 nt, Bordetella pertussis
cugccuacuugcgggacugga

SEQ ID NO: 2365690 - RNA, 13 nt, Bordetella pertussis
cugccugcagcgc

SEQ ID NO: 2365691 - RNA, 15 nt, Bordetella pertussis
cugccugcagcgcgc

SEQ ID NO: 2365692 - RNA, 15 nt, Bordetella pertussis
cugccugccgccugc

SEQ ID NO: 2365693 - RNA, 13 nt, Bordetella pertussis
cugccugccggcc

SEQ ID NO: 2365694 - RNA, 15 nt, Bordetella pertussis
cugccugccggccgg

SEQ ID NO: 2365695 - RNA, 16 nt, Bordetella pertussis
cugccugccggccggc

SEQ ID NO: 2365696 - RNA, 15 nt, Bordetella pertussis
cugccuggcgaacag

SEQ ID NO: 2365697 - RNA, 19 nt, Bordetella pertussis
cugcgaaaaagcccgcgcc

SEQ ID NO: 2365698 - RNA, 20 nt, Bordetella pertussis
cugcgaaaaagcccgcgcca

SEQ ID NO: 2365699 - RNA, 22 nt, Bordetella pertussis
cugcgaaaaagcccgcgccacc

SEQ ID NO: 2365700 - RNA, 16 nt, Bordetella pertussis
cugcgaaagcgcgucg

SEQ ID NO: 2365701 - RNA, 21 nt, Bordetella pertussis
cugcgaaagcgcgucgagcag

SEQ ID NO: 2365702 - RNA, 15 nt, Bordetella pertussis
cugcgaacgcccggc

SEQ ID NO: 2365703 - RNA, 20 nt, Bordetella pertussis
cugcgaacgcccggcccagg

SEQ ID NO: 2365704 - RNA, 21 nt, Bordetella pertussis
cugcgaacgcccggcccaggc

SEQ ID NO: 2365705 - RNA, 22 nt, Bordetella pertussis
cugcgaacgcccggcccaggcc

SEQ ID NO: 2365706 - RNA, 14 nt, Bordetella pertussis
cugcgacagcaccg

SEQ ID NO: 2365707 - RNA, 16 nt, Bordetella pertussis
cugcgacagcaccggg

SEQ ID NO: 2365708 - RNA, 14 nt, Bordetella pertussis
cugcgacagcaggg

SEQ ID NO: 2365709 - RNA, 16 nt, Bordetella pertussis
cugcgacagcagggcc

SEQ ID NO: 2365710 - RNA, 17 nt, Bordetella pertussis
cugcgacagcagggcca

SEQ ID NO: 2365711 - RNA, 19 nt, Bordetella pertussis
cugcgacagcagggccagg

SEQ ID NO: 2365712 - RNA, 16 nt, Bordetella pertussis
cugcgacaggcgcagc

SEQ ID NO: 2365713 - RNA, 19 nt, Bordetella pertussis
cugcgacaggcgcagcucg

SEQ ID NO: 2365714 - RNA, 22 nt, Bordetella pertussis
cugcgagacgcgcucgcgcgcg

SEQ ID NO: 2365715 - RNA, 18 nt, Bordetella pertussis
cugcgagagauagcccag
